United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 41

SEQ ID NO: 1465876 - RNA, 16 nt, Pseudomonas aeruginosa PA01
guucgaauccuacacg

SEQ ID NO: 1465877 - RNA, 20 nt, Pseudomonas aeruginosa PA01
guucgaaucucucuaccccg

SEQ ID NO: 1465878 - RNA, 23 nt, Pseudomonas aeruginosa PA01
guucgaaugcugcccggagcggc

SEQ ID NO: 1465879 - RNA, 17 nt, Pseudomonas aeruginosa PA01
guucuucgccgcccgcg

SEQ ID NO: 1465880 - RNA, 19 nt, Pseudomonas aeruginosa PA01
guucuucgccgcccgcgcc

SEQ ID NO: 1465881 - RNA, 16 nt, Pseudomonas aeruginosa PA01
guucuggucgccgaca

SEQ ID NO: 1465882 - RNA, 23 nt, Pseudomonas aeruginosa PA01
guucuuccccugcaugccggccg

SEQ ID NO: 1465883 - RNA, 16 nt, Pseudomonas aeruginosa PA01
guugacgcaguuccgc

SEQ ID NO: 1465884 - RNA, 23 nt, Pseudomonas aeruginosa PA01
guugacgcggaugcccuggucgg

SEQ ID NO: 1465885 - RNA, 16 nt, Pseudomonas aeruginosa PA01
guugaggccguccagu

SEQ ID NO: 1465886 - RNA, 21 nt, Pseudomonas aeruginosa PA01
guugagguagagcacgccguc

SEQ ID NO: 1465887 - RNA, 17 nt, Pseudomonas aeruginosa PA01
guugaccugcagcgccu

SEQ ID NO: 1465888 - RNA, 20 nt, Pseudomonas aeruginosa PA01
guugaccgccagacaggcca

SEQ ID NO: 1465889 - RNA, 20 nt, Pseudomonas aeruginosa PA01
guugaacugcgguccggcga

SEQ ID NO: 1465890 - RNA, 15 nt, Pseudomonas aeruginosa PA01
guugacgaugcggcc

SEQ ID NO: 1465891 - RNA, 20 nt, Pseudomonas aeruginosa PA01
guugacgaugcggcccgccg

SEQ ID NO: 1465892 - RNA, 23 nt, Pseudomonas aeruginosa PA01
guugaccgugaugcccagcggcg

SEQ ID NO: 1465893 - RNA, 17 nt, Pseudomonas aeruginosa PA01
guugaccuuggccauga

SEQ ID NO: 1465894 - RNA, 20 nt, Pseudomonas aeruginosa PA01
guugcggucgcgcccgcugu

SEQ ID NO: 1465895 - RNA, 15 nt, Pseudomonas aeruginosa PA01
guugcgggcgcaggu

SEQ ID NO: 1465896 - RNA, 18 nt, Pseudomonas aeruginosa PA01
guugcgguuauucgcccu

SEQ ID NO: 1465897 - RNA, 19 nt, Pseudomonas aeruginosa PA01
guugcgguuauucgcccua

SEQ ID NO: 1465898 - RNA, 17 nt, Pseudomonas aeruginosa PA01
guugcucgagccguucc

SEQ ID NO: 1465899 - RNA, 23 nt, Pseudomonas aeruginosa PA01
guugcugaucacguagaugccgg

SEQ ID NO: 1465900 - RNA, 20 nt, Pseudomonas aeruginosa PA01
guuggccgucuccaggcgcg

SEQ ID NO: 1465901 - RNA, 21 nt, Pseudomonas aeruginosa PA01
guuggccgucuccaggcgcgc

SEQ ID NO: 1465902 - RNA, 23 nt, Pseudomonas aeruginosa PA01
guuggccgucuccaggcgcgccg

SEQ ID NO: 1465903 - RNA, 12 nt, Pseudomonas aeruginosa PA01
guugcuggccgg

SEQ ID NO: 1465904 - RNA, 14 nt, Pseudomonas aeruginosa PA01
guugcugcccuggc

SEQ ID NO: 1465905 - RNA, 16 nt, Pseudomonas aeruginosa PA01
guugcugcccuggcgc

SEQ ID NO: 1465906 - RNA, 18 nt, Pseudomonas aeruginosa PA01
guugcugcuugcgcgcgg

SEQ ID NO: 1465907 - RNA, 19 nt, Pseudomonas aeruginosa PA01
guuggccuugagcaggcgg

SEQ ID NO: 1465908 - RNA, 17 nt, Pseudomonas aeruginosa PA01
guuggccuugaugccgg

SEQ ID NO: 1465909 - RNA, 20 nt, Pseudomonas aeruginosa PA01
guuggccuugaugccggcga

SEQ ID NO: 1465910 - RNA, 21 nt, Pseudomonas aeruginosa PA01
guuggcgaacaaucggucgcc

SEQ ID NO: 1465911 - RNA, 17 nt, Pseudomonas aeruginosa PA01
guuggcgaacaggcagc

SEQ ID NO: 1465912 - RNA, 21 nt, Pseudomonas aeruginosa PA01
guuggcgaacuucaggccggc

SEQ ID NO: 1465913 - RNA, 21 nt, Pseudomonas aeruginosa PA01
guuggcgaaguucccgccgcu

SEQ ID NO: 1465914 - RNA, 23 nt, Pseudomonas aeruginosa PA01
guuggcgaggacuuucuugacca

SEQ ID NO: 1465915 - RNA, 14 nt, Pseudomonas aeruginosa PA01
guuggcgaggucgc

SEQ ID NO: 1465916 - RNA, 22 nt, Pseudomonas aeruginosa PA01
guuggcgccccagaucgccagc

SEQ ID NO: 1465917 - RNA, 15 nt, Pseudomonas aeruginosa PA01
guuggcgccguccug

SEQ ID NO: 1465918 - RNA, 15 nt, Pseudomonas aeruginosa PA01
guuggcgccgggcgc

SEQ ID NO: 1465919 - RNA, 19 nt, Pseudomonas aeruginosa PA01
guuggcgaugaucuggcca

SEQ ID NO: 1465920 - RNA, 15 nt, Pseudomonas aeruginosa PA01
guuggcgcaggccgg

SEQ ID NO: 1465921 - RNA, 17 nt, Pseudomonas aeruginosa PA01
guuggcgccuucggcga

SEQ ID NO: 1465922 - RNA, 18 nt, Pseudomonas aeruginosa PA01
guugggauagcuuuccag

SEQ ID NO: 1465923 - RNA, 14 nt, Pseudomonas aeruginosa PA01
guugggcaggcgca

SEQ ID NO: 1465924 - RNA, 18 nt, Pseudomonas aeruginosa PA01
guugcccgagugccggcg

SEQ ID NO: 1465925 - RNA, 13 nt, Pseudomonas aeruginosa PA01
guugcccaccagc

SEQ ID NO: 1465926 - RNA, 20 nt, Pseudomonas aeruginosa PA01
guugcccaccagcgucgcca

SEQ ID NO: 1465927 - RNA, 14 nt, Pseudomonas aeruginosa PA01
guugcccacggcca

SEQ ID NO: 1465928 - RNA, 20 nt, Pseudomonas aeruginosa PA01
guugcccacggccaggccca

SEQ ID NO: 1465929 - RNA, 17 nt, Pseudomonas aeruginosa PA01
guugccauccagcgccu

SEQ ID NO: 1465930 - RNA, 22 nt, Pseudomonas aeruginosa PA01
guugcccagccccaccgccagg

SEQ ID NO: 1465931 - RNA, 15 nt, Pseudomonas aeruginosa PA01
guugccagccggccu

SEQ ID NO: 1465932 - RNA, 16 nt, Pseudomonas aeruginosa PA01
guugccagccggccuu

SEQ ID NO: 1465933 - RNA, 17 nt, Pseudomonas aeruginosa PA01
guugccaggccggcgca

SEQ ID NO: 1465934 - RNA, 23 nt, Pseudomonas aeruginosa PA01
guugcaggcacggaagcgcugcu

SEQ ID NO: 1465935 - RNA, 18 nt, Pseudomonas aeruginosa PA01
guugccagacgaucagcg

SEQ ID NO: 1465936 - RNA, 13 nt, Pseudomonas aeruginosa PA01
guugcggcccuuc

SEQ ID NO: 1465937 - RNA, 15 nt, Pseudomonas aeruginosa PA01
guugcggcccagcgg

SEQ ID NO: 1465938 - RNA, 22 nt, Pseudomonas aeruginosa PA01
guugccgaagcgcucggucagc

SEQ ID NO: 1465939 - RNA, 15 nt, Pseudomonas aeruginosa PA01
guugccgaccgagca

SEQ ID NO: 1465940 - RNA, 24 nt, Pseudomonas aeruginosa PA01
guugccgaccgagcagcggacgca

SEQ ID NO: 1465941 - RNA, 16 nt, Pseudomonas aeruginosa PA01
guugcccugggccggc

SEQ ID NO: 1465942 - RNA, 17 nt, Pseudomonas aeruginosa PA01
guugccgaucaggcuga

SEQ ID NO: 1465943 - RNA, 11 nt, Pseudomonas aeruginosa PA01
guugcgcugcu

SEQ ID NO: 1465944 - RNA, 21 nt, Pseudomonas aeruginosa PA01
guugccgcagcagcggcgaca

SEQ ID NO: 1465945 - RNA, 22 nt, Pseudomonas aeruginosa PA01
guugcggaaagcgacgccgcga

SEQ ID NO: 1465946 - RNA, 17 nt, Pseudomonas aeruginosa PA01
guuuuacucgucgccaa

SEQ ID NO: 1465947 - RNA, 15 nt, Pseudomonas aeruginosa PA01
guuuuccuggcccug

SEQ ID NO: 1465948 - RNA, 18 nt, Pseudomonas aeruginosa PA01
guuuucguugccgcgcuc

SEQ ID NO: 1465949 - RNA, 16 nt, Pseudomonas aeruginosa PA01
guuuuuccuuguggcg

SEQ ID NO: 1465950 - RNA, 13 nt, Pseudomonas aeruginosa PA01
guuugcgccgccg

SEQ ID NO: 1465951 - RNA, 12 nt, Pseudomonas aeruginosa PA01
guuuggcgcccg

SEQ ID NO: 1465952 - RNA, 23 nt, Pseudomonas aeruginosa PA01
guuucuucgccuugcccuggccg

SEQ ID NO: 1465953 - RNA, 18 nt, Pseudomonas aeruginosa PA01
guuucucggucgccgcca

SEQ ID NO: 1465954 - RNA, 19 nt, Pseudomonas aeruginosa PA01
guuucucggucgccgccag

SEQ ID NO: 1465955 - RNA, 17 nt, Pseudomonas aeruginosa PA01
guuucucggcgauggcg

SEQ ID NO: 1465956 - RNA, 16 nt, Pseudomonas aeruginosa PA01
guuugcccagcgccgc

SEQ ID NO: 1465957 - RNA, 18 nt, Pseudomonas aeruginosa PA01
guuugcccagcgccgccu

SEQ ID NO: 1465958 - RNA, 18 nt, Pseudomonas aeruginosa PA01
guuucggguccaggcgcc

SEQ ID NO: 1465959 - RNA, 14 nt, Pseudomonas aeruginosa PA01
guuucggccgcugc

SEQ ID NO: 1465960 - RNA, 12 nt, Pseudomonas aeruginosa PA01
guuucgucgcgg

SEQ ID NO: 1465961 - RNA, 20 nt, Pseudomonas aeruginosa PA01
guuucguugcggaacgcggc

SEQ ID NO: 1465962 - RNA, 16 nt, Pseudomonas aeruginosa PA01
guuucgcggaaggcgu

SEQ ID NO: 1465963 - RNA, 17 nt, Pseudomonas aeruginosa PA01
guuucgacgaugcucgg

SEQ ID NO: 1465964 - RNA, 19 nt, Pseudomonas aeruginosa PA01
guuucgaagccgccgccga

SEQ ID NO: 1465965 - RNA, 17 nt, Pseudomonas aeruginosa PA01
guuuccgcuguccgccg

SEQ ID NO: 1465966 - RNA, 13 nt, Pseudomonas aeruginosa PA01
guuuccggcagca

SEQ ID NO: 1465967 - RNA, 17 nt, Pseudomonas aeruginosa PA01
guuuccggccaggcgcg

SEQ ID NO: 1465968 - RNA, 16 nt, Pseudomonas aeruginosa PA01
guuuccgugcgcugcg

SEQ ID NO: 1465969 - RNA, 17 nt, Pseudomonas aeruginosa PA01
guuuccgugcgcugcgc

SEQ ID NO: 1465970 - RNA, 23 nt, Pseudomonas aeruginosa PA01
guuuccgugcggaaaccgcggcc

SEQ ID NO: 1465971 - RNA, 17 nt, Pseudomonas aeruginosa PA01
guuuccgugugcagcag

SEQ ID NO: 1465972 - RNA, 17 nt, Pseudomonas aeruginosa PA01
guuggugcacgcgccgg

SEQ ID NO: 1465973 - RNA, 19 nt, Pseudomonas aeruginosa PA01
guuggugcacgcgccgggu

SEQ ID NO: 1465974 - RNA, 16 nt, Pseudomonas aeruginosa PA01
guugguggccgcgccg

SEQ ID NO: 1465975 - RNA, 16 nt, Pseudomonas aeruginosa PA01
guugguggggcgccgg

SEQ ID NO: 1465976 - RNA, 14 nt, Pseudomonas aeruginosa PA01
guuguacagcgagg

SEQ ID NO: 1465977 - RNA, 17 nt, Pseudomonas aeruginosa PA01
guuguagaucggcagca

SEQ ID NO: 1465978 - RNA, 16 nt, Pseudomonas aeruginosa PA01
guuguaggcgccgccg

SEQ ID NO: 1465979 - RNA, 19 nt, Pseudomonas aeruginosa PA01
guuccgacugcgagccgac

SEQ ID NO: 1465980 - RNA, 20 nt, Pseudomonas aeruginosa PA01
guucccugcgccucgaccug

SEQ ID NO: 1465981 - RNA, 22 nt, Pseudomonas aeruginosa PA01
guucccucaggauagccggcgc

SEQ ID NO: 1465982 - RNA, 23 nt, Pseudomonas aeruginosa PA01
guucccagcagcaacagcgccgc

SEQ ID NO: 1465983 - RNA, 16 nt, Pseudomonas aeruginosa PA01
guucccggccuggcgc

SEQ ID NO: 1465984 - RNA, 20 nt, Pseudomonas aeruginosa PA01
guucccggccuggcgcgcgc

SEQ ID NO: 1465985 - RNA, 21 nt, Pseudomonas aeruginosa PA01
guucccggucgagguugcgcg

SEQ ID NO: 1465986 - RNA, 16 nt, Pseudomonas aeruginosa PA01
guucccguccgggcac

SEQ ID NO: 1465987 - RNA, 19 nt, Pseudomonas aeruginosa PA01
guuccaggucgcugcugaa

SEQ ID NO: 1465988 - RNA, 16 nt, Pseudomonas aeruginosa PA01
guuccaguacacccag

SEQ ID NO: 1465989 - RNA, 19 nt, Pseudomonas aeruginosa PA01
guuccaguucggccgcggc

SEQ ID NO: 1465990 - RNA, 18 nt, Pseudomonas aeruginosa PA01
guucccagaccuggccgc

SEQ ID NO: 1465991 - RNA, 13 nt, Pseudomonas aeruginosa PA01
guucccccagcac

SEQ ID NO: 1465992 - RNA, 15 nt, Pseudomonas aeruginosa PA01
guucccccagcaccu

SEQ ID NO: 1465993 - RNA, 16 nt, Pseudomonas aeruginosa PA01
guuccuguucgcugcc

SEQ ID NO: 1465994 - RNA, 13 nt, Pseudomonas aeruginosa PA01
guuccuucgccga

SEQ ID NO: 1465995 - RNA, 17 nt, Pseudomonas aeruginosa PA01
guuccuucuugacccgc

SEQ ID NO: 1465996 - RNA, 16 nt, Pseudomonas aeruginosa PA01
guucgaaccguggcgg

SEQ ID NO: 1465997 - RNA, 20 nt, Pseudomonas aeruginosa PA01
guucgaaccguggcggccgc

SEQ ID NO: 1465998 - RNA, 21 nt, Pseudomonas aeruginosa PA01
guucgaaccguggcggccgcc

SEQ ID NO: 1465999 - RNA, 22 nt, Pseudomonas aeruginosa PA01
guuccuuuuccucgaucaggcc

SEQ ID NO: 1466000 - RNA, 19 nt, Pseudomonas aeruginosa PA01
guuccuccagagugcgcag

SEQ ID NO: 1466001 - RNA, 20 nt, Pseudomonas aeruginosa PA01
guuccuccauuagcgucgcg

SEQ ID NO: 1466002 - RNA, 13 nt, Pseudomonas aeruginosa PA01
guuccucgcgagg

SEQ ID NO: 1466003 - RNA, 23 nt, Pseudomonas aeruginosa PA01
guuccucgcggaagcguugcucg

SEQ ID NO: 1466004 - RNA, 13 nt, Pseudomonas aeruginosa PA01
guuccucggcggc

SEQ ID NO: 1466005 - RNA, 14 nt, Pseudomonas aeruginosa PA01
guuccucggcggcg

SEQ ID NO: 1466006 - RNA, 15 nt, Pseudomonas aeruginosa PA01
guuccugcuccuccg

SEQ ID NO: 1466007 - RNA, 13 nt, Pseudomonas aeruginosa PA01
guuccggcucagc

SEQ ID NO: 1466008 - RNA, 18 nt, Pseudomonas aeruginosa PA01
guuccggcucagccgcug

SEQ ID NO: 1466009 - RNA, 18 nt, Pseudomonas aeruginosa PA01
guuccgggcccaguucgc

SEQ ID NO: 1466010 - RNA, 19 nt, Pseudomonas aeruginosa PA01
guuccgggucgcugcccau

SEQ ID NO: 1466011 - RNA, 16 nt, Pseudomonas aeruginosa PA01
guuccaccuggcgcag

SEQ ID NO: 1466012 - RNA, 15 nt, Pseudomonas aeruginosa PA01
guuccagcucgucga

SEQ ID NO: 1466013 - RNA, 21 nt, Pseudomonas aeruginosa PA01
guuccagcucgucgagcugcu

SEQ ID NO: 1466014 - RNA, 23 nt, Pseudomonas aeruginosa PA01
guuccagcucgucgagcugcucg

SEQ ID NO: 1466015 - RNA, 17 nt, Pseudomonas aeruginosa PA01
guuccaggagggcugcu

SEQ ID NO: 1466016 - RNA, 14 nt, Pseudomonas aeruginosa PA01
guuccaggcggggc

SEQ ID NO: 1466017 - RNA, 19 nt, Pseudomonas aeruginosa PA01
guuccagggccugcuccag

SEQ ID NO: 1466018 - RNA, 18 nt, Pseudomonas aeruginosa PA01
guuccagggccugguaga

SEQ ID NO: 1466019 - RNA, 22 nt, Pseudomonas aeruginosa PA01
guuccagcggcacuucccgccc

SEQ ID NO: 1466020 - RNA, 14 nt, Pseudomonas aeruginosa PA01
guuccagcggccgc

SEQ ID NO: 1466021 - RNA, 18 nt, Pseudomonas aeruginosa PA01
guuccagcggccgcgagc

SEQ ID NO: 1466022 - RNA, 17 nt, Pseudomonas aeruginosa PA01
guucaucgucggcagcc

SEQ ID NO: 1466023 - RNA, 16 nt, Pseudomonas aeruginosa PA01
guucaguucugggcgg

SEQ ID NO: 1466024 - RNA, 20 nt, Pseudomonas aeruginosa PA01
guucaggugaaaagcgcuga

SEQ ID NO: 1466025 - RNA, 22 nt, Pseudomonas aeruginosa PA01
guucaggugcuggacucgcgcc

SEQ ID NO: 1466026 - RNA, 19 nt, Pseudomonas aeruginosa PA01
guucaggucgaggccgcgg

SEQ ID NO: 1466027 - RNA, 15 nt, Pseudomonas aeruginosa PA01
guucaggucgaugcc

SEQ ID NO: 1466028 - RNA, 17 nt, Pseudomonas aeruginosa PA01
guucaggguggcgaccg

SEQ ID NO: 1466029 - RNA, 14 nt, Pseudomonas aeruginosa PA01
guucaggccggcgc

SEQ ID NO: 1466030 - RNA, 17 nt, Pseudomonas aeruginosa PA01
guucaggacgcuccugc

SEQ ID NO: 1466031 - RNA, 17 nt, Pseudomonas aeruginosa PA01
guucaggcaaccgggua

SEQ ID NO: 1466032 - RNA, 18 nt, Pseudomonas aeruginosa PA01
guucagucccgcggcgcg

SEQ ID NO: 1466033 - RNA, 17 nt, Pseudomonas aeruginosa PA01
guucagucggccaggcg

SEQ ID NO: 1466034 - RNA, 16 nt, Pseudomonas aeruginosa PA01
guucaucgccgccagg

SEQ ID NO: 1466035 - RNA, 20 nt, Pseudomonas aeruginosa PA01
guucaucgccgccaggcaga

SEQ ID NO: 1466036 - RNA, 16 nt, Pseudomonas aeruginosa PA01
guguugccguggucgc

SEQ ID NO: 1466037 - RNA, 17 nt, Pseudomonas aeruginosa PA01
guguugcggagaggugg

SEQ ID NO: 1466038 - RNA, 15 nt, Pseudomonas aeruginosa PA01
guuagaauaccggcc

SEQ ID NO: 1466039 - RNA, 11 nt, Pseudomonas aeruginosa PA01
guguuguucgc

SEQ ID NO: 1466040 - RNA, 13 nt, Pseudomonas aeruginosa PA01
guuauccgccgau

SEQ ID NO: 1466041 - RNA, 14 nt, Pseudomonas aeruginosa PA01
guuauccgccgccg

SEQ ID NO: 1466042 - RNA, 15 nt, Pseudomonas aeruginosa PA01
guuauccgccgccga

SEQ ID NO: 1466043 - RNA, 14 nt, Pseudomonas aeruginosa PA01
guuauccgccggug

SEQ ID NO: 1466044 - RNA, 22 nt, Pseudomonas aeruginosa PA01
guuauccgccggugcgcgaucg

SEQ ID NO: 1466045 - RNA, 20 nt, Pseudomonas aeruginosa PA01
guuauccgccguggaacgca

SEQ ID NO: 1466046 - RNA, 22 nt, Pseudomonas aeruginosa PA01
guucacguaggagccggccagg

SEQ ID NO: 1466047 - RNA, 18 nt, Pseudomonas aeruginosa PA01
guucagcccgccgugcgc

SEQ ID NO: 1466048 - RNA, 23 nt, Pseudomonas aeruginosa PA01
guucagcaggucgcggccccagc

SEQ ID NO: 1466049 - RNA, 23 nt, Pseudomonas aeruginosa PA01
guucagcggcacggucauggcca

SEQ ID NO: 1466050 - RNA, 22 nt, Pseudomonas aeruginosa PA01
guucagcggcgcgucgaccacg

SEQ ID NO: 1466051 - RNA, 20 nt, Pseudomonas aeruginosa PA01
guucagcgccucgcgggucu

SEQ ID NO: 1466052 - RNA, 19 nt, Pseudomonas aeruginosa PA01
guucagcgcgaaggccacg

SEQ ID NO: 1466053 - RNA, 18 nt, Pseudomonas aeruginosa PA01
guucagcgggcgcuugaa

SEQ ID NO: 1466054 - RNA, 21 nt, Pseudomonas aeruginosa PA01
guucagcgggcgcuugaagcc

SEQ ID NO: 1466055 - RNA, 22 nt, Pseudomonas aeruginosa PA01
guucagcggguucuugccgcug

SEQ ID NO: 1466056 - RNA, 14 nt, Pseudomonas aeruginosa PA01
guucaccccgcccu

SEQ ID NO: 1466057 - RNA, 23 nt, Pseudomonas aeruginosa PA01
guucaccccgcccuuggcggcgc

SEQ ID NO: 1466058 - RNA, 15 nt, Pseudomonas aeruginosa PA01
guucacgccuggcgg

SEQ ID NO: 1466059 - RNA, 15 nt, Pseudomonas aeruginosa PA01
guucacgcgaccacc

SEQ ID NO: 1466060 - RNA, 20 nt, Pseudomonas aeruginosa PA01
guucaccguggcgcuggccg

SEQ ID NO: 1466061 - RNA, 19 nt, Pseudomonas aeruginosa PA01
guucacgcaguacagcugc

SEQ ID NO: 1466062 - RNA, 14 nt, Pseudomonas aeruginosa PA01
guucaccgcggccu

SEQ ID NO: 1466063 - RNA, 18 nt, Pseudomonas aeruginosa PA01
guuaugcgcccuaccugu

SEQ ID NO: 1466064 - RNA, 17 nt, Pseudomonas aeruginosa PA01
gugggcgagggcgcgca

SEQ ID NO: 1466065 - RNA, 21 nt, Pseudomonas aeruginosa PA01
gugggcgaaguugaaacggcg

SEQ ID NO: 1466066 - RNA, 13 nt, Pseudomonas aeruginosa PA01
gugggcgccgccg

SEQ ID NO: 1466067 - RNA, 17 nt, Pseudomonas aeruginosa PA01
gugggcgccgccgguga

SEQ ID NO: 1466068 - RNA, 15 nt, Pseudomonas aeruginosa PA01
gugggcggccggcca

SEQ ID NO: 1466069 - RNA, 17 nt, Pseudomonas aeruginosa PA01
gugggcggccggccagg

SEQ ID NO: 1466070 - RNA, 14 nt, Pseudomonas aeruginosa PA01
guggguccacgccg

SEQ ID NO: 1466071 - RNA, 15 nt, Pseudomonas aeruginosa PA01
guggguccacgccgg

SEQ ID NO: 1466072 - RNA, 14 nt, Pseudomonas aeruginosa PA01
gugggucgggucgg

SEQ ID NO: 1466073 - RNA, 13 nt, Pseudomonas aeruginosa PA01
guggucaggcgcc

SEQ ID NO: 1466074 - RNA, 15 nt, Pseudomonas aeruginosa PA01
guggucaggcgccag

SEQ ID NO: 1466075 - RNA, 13 nt, Pseudomonas aeruginosa PA01
guggucauggcgc

SEQ ID NO: 1466076 - RNA, 17 nt, Pseudomonas aeruginosa PA01
guggucaccgccagcgg

SEQ ID NO: 1466077 - RNA, 19 nt, Pseudomonas aeruginosa PA01
gugguaucggcgcucaccg

SEQ ID NO: 1466078 - RNA, 13 nt, Pseudomonas aeruginosa PA01
guggucagccagc

SEQ ID NO: 1466079 - RNA, 18 nt, Pseudomonas aeruginosa PA01
guggucagccagccgagc

SEQ ID NO: 1466080 - RNA, 19 nt, Pseudomonas aeruginosa PA01
guggucagccagccgagca

SEQ ID NO: 1466081 - RNA, 20 nt, Pseudomonas aeruginosa PA01
guggucgccguccaccaagc

SEQ ID NO: 1466082 - RNA, 14 nt, Pseudomonas aeruginosa PA01
guggucgcgcaggc

SEQ ID NO: 1466083 - RNA, 12 nt, Pseudomonas aeruginosa PA01
guggucgcgcuc

SEQ ID NO: 1466084 - RNA, 19 nt, Pseudomonas aeruginosa PA01
guggucgcagcuccagcgg

SEQ ID NO: 1466085 - RNA, 23 nt, Pseudomonas aeruginosa PA01
guggucgaucuccuccucggcgg

SEQ ID NO: 1466086 - RNA, 21 nt, Pseudomonas aeruginosa PA01
gugguccgccagcaggcguug

SEQ ID NO: 1466087 - RNA, 15 nt, Pseudomonas aeruginosa PA01
guggucgaccaggcg

SEQ ID NO: 1466088 - RNA, 15 nt, Pseudomonas aeruginosa PA01
guggcuucguccagc

SEQ ID NO: 1466089 - RNA, 15 nt, Pseudomonas aeruginosa PA01
guggcuuuccagcau

SEQ ID NO: 1466090 - RNA, 22 nt, Pseudomonas aeruginosa PA01
guggcuuuucucgccucccggc

SEQ ID NO: 1466091 - RNA, 14 nt, Pseudomonas aeruginosa PA01
guggcuggcgccgc

SEQ ID NO: 1466092 - RNA, 17 nt, Pseudomonas aeruginosa PA01
guggcuggcgccgcggg

SEQ ID NO: 1466093 - RNA, 23 nt, Pseudomonas aeruginosa PA01
guggcuggucaguucggcccagc

SEQ ID NO: 1466094 - RNA, 13 nt, Pseudomonas aeruginosa PA01
guggcuggugaug

SEQ ID NO: 1466095 - RNA, 14 nt, Pseudomonas aeruginosa PA01
guggcuggugaugc

SEQ ID NO: 1466096 - RNA, 20 nt, Pseudomonas aeruginosa PA01
gugggacugagccgcuggua

SEQ ID NO: 1466097 - RNA, 17 nt, Pseudomonas aeruginosa PA01
guggcauucgucgccgc

SEQ ID NO: 1466098 - RNA, 21 nt, Pseudomonas aeruginosa PA01
guggcaugggccaguuccggc

SEQ ID NO: 1466099 - RNA, 12 nt, Pseudomonas aeruginosa PA01
guggcaggccug

SEQ ID NO: 1466100 - RNA, 14 nt, Pseudomonas aeruginosa PA01
guggcaggcgcugc

SEQ ID NO: 1466101 - RNA, 13 nt, Pseudomonas aeruginosa PA01
guggucguggcgg

SEQ ID NO: 1466102 - RNA, 16 nt, Pseudomonas aeruginosa PA01
gugguguagcgcaggu

SEQ ID NO: 1466103 - RNA, 17 nt, Pseudomonas aeruginosa PA01
gugguguagcgcagguu

SEQ ID NO: 1466104 - RNA, 15 nt, Pseudomonas aeruginosa PA01
guguccaccaccagc

SEQ ID NO: 1466105 - RNA, 21 nt, Pseudomonas aeruginosa PA01
guguccaccaccagcaggccc

SEQ ID NO: 1466106 - RNA, 22 nt, Pseudomonas aeruginosa PA01
guguccaccaccagcaggccca

SEQ ID NO: 1466107 - RNA, 23 nt, Pseudomonas aeruginosa PA01
guguccaccaccagcaggcccag

SEQ ID NO: 1466108 - RNA, 20 nt, Pseudomonas aeruginosa PA01
guguccgauucuuggcucgg

SEQ ID NO: 1466109 - RNA, 23 nt, Pseudomonas aeruginosa PA01
guguccgcccuuuuucgucgcca

SEQ ID NO: 1466110 - RNA, 13 nt, Pseudomonas aeruginosa PA01
gugucggcggcgc

SEQ ID NO: 1466111 - RNA, 17 nt, Pseudomonas aeruginosa PA01
gugucggcgaucaggcc

SEQ ID NO: 1466112 - RNA, 19 nt, Pseudomonas aeruginosa PA01
gugucggcgaucaggccga

SEQ ID NO: 1466113 - RNA, 17 nt, Pseudomonas aeruginosa PA01
gugucgccuuccggcag

SEQ ID NO: 1466114 - RNA, 14 nt, Pseudomonas aeruginosa PA01
gugucgagggcgaa

SEQ ID NO: 1466115 - RNA, 15 nt, Pseudomonas aeruginosa PA01
gugucgacaccuggc

SEQ ID NO: 1466116 - RNA, 16 nt, Pseudomonas aeruginosa PA01
gugucgacaccuggca

SEQ ID NO: 1466117 - RNA, 19 nt, Pseudomonas aeruginosa PA01
gugucgacaccuggcaaca

SEQ ID NO: 1466118 - RNA, 22 nt, Pseudomonas aeruginosa PA01
gugucguuguugccgcgcacca

SEQ ID NO: 1466119 - RNA, 14 nt, Pseudomonas aeruginosa PA01
gugucgugccgaca

SEQ ID NO: 1466120 - RNA, 16 nt, Pseudomonas aeruginosa PA01
gugucggugcccucgc

SEQ ID NO: 1466121 - RNA, 18 nt, Pseudomonas aeruginosa PA01
gugucggugcccucgcgg

SEQ ID NO: 1466122 - RNA, 23 nt, Pseudomonas aeruginosa PA01
gugugcgcugcaucggcgcgccg

SEQ ID NO: 1466123 - RNA, 15 nt, Pseudomonas aeruginosa PA01
guguggccugggcgc

SEQ ID NO: 1466124 - RNA, 16 nt, Pseudomonas aeruginosa PA01
guggaugaacagcgga

SEQ ID NO: 1466125 - RNA, 20 nt, Pseudomonas aeruginosa PA01
guggaugccgguggcgccca

SEQ ID NO: 1466126 - RNA, 13 nt, Pseudomonas aeruginosa PA01
guggaucgcccga

SEQ ID NO: 1466127 - RNA, 15 nt, Pseudomonas aeruginosa PA01
guggaucgcccggcu

SEQ ID NO: 1466128 - RNA, 11 nt, Pseudomonas aeruginosa PA01
guggaucggcc

SEQ ID NO: 1466129 - RNA, 15 nt, Pseudomonas aeruginosa PA01
guggcaagccucgcg

SEQ ID NO: 1466130 - RNA, 19 nt, Pseudomonas aeruginosa PA01
guggaccaacagccggcgg

SEQ ID NO: 1466131 - RNA, 20 nt, Pseudomonas aeruginosa PA01
guggaccaacagccggcggg

SEQ ID NO: 1466132 - RNA, 21 nt, Pseudomonas aeruginosa PA01
guggaccaacgggcugccagc

SEQ ID NO: 1466133 - RNA, 15 nt, Pseudomonas aeruginosa PA01
guggaccagcgccgc

SEQ ID NO: 1466134 - RNA, 16 nt, Pseudomonas aeruginosa PA01
guggacauacaggcgc

SEQ ID NO: 1466135 - RNA, 17 nt, Pseudomonas aeruginosa PA01
guggacauacaggcgcg

SEQ ID NO: 1466136 - RNA, 22 nt, Pseudomonas aeruginosa PA01
guggacauacaggcgcgccugg

SEQ ID NO: 1466137 - RNA, 14 nt, Pseudomonas aeruginosa PA01
guggacgccgguga

SEQ ID NO: 1466138 - RNA, 19 nt, Pseudomonas aeruginosa PA01
guggagccggugccggcgg

SEQ ID NO: 1466139 - RNA, 23 nt, Pseudomonas aeruginosa PA01
guggagccggugccggcggcgga

SEQ ID NO: 1466140 - RNA, 17 nt, Pseudomonas aeruginosa PA01
guggacgucgucggcga

SEQ ID NO: 1466141 - RNA, 17 nt, Pseudomonas aeruginosa PA01
guggacggucucgccgc

SEQ ID NO: 1466142 - RNA, 19 nt, Pseudomonas aeruginosa PA01
guggaggaucuccaacugg

SEQ ID NO: 1466143 - RNA, 16 nt, Pseudomonas aeruginosa PA01
guggaguaccaggcca

SEQ ID NO: 1466144 - RNA, 12 nt, Pseudomonas aeruginosa PA01
guggaggcgggc

SEQ ID NO: 1466145 - RNA, 16 nt, Pseudomonas aeruginosa PA01
guggauaacguccgcg

SEQ ID NO: 1466146 - RNA, 15 nt, Pseudomonas aeruginosa PA01
guggauaggcggcgg

SEQ ID NO: 1466147 - RNA, 17 nt, Pseudomonas aeruginosa PA01
guggauaggcggcggau

SEQ ID NO: 1466148 - RNA, 16 nt, Pseudomonas aeruginosa PA01
guggacacccugcugc

SEQ ID NO: 1466149 - RNA, 23 nt, Pseudomonas aeruginosa PA01
guggacacccugcugcugcucag

SEQ ID NO: 1466150 - RNA, 15 nt, Pseudomonas aeruginosa PA01
guggaauccagggcc

SEQ ID NO: 1466151 - RNA, 17 nt, Pseudomonas aeruginosa PA01
guggaagccguggcggg

SEQ ID NO: 1466152 - RNA, 18 nt, Pseudomonas aeruginosa PA01
guggaagccguggcgggc

SEQ ID NO: 1466153 - RNA, 14 nt, Pseudomonas aeruginosa PA01
guggaagcgcgcgu

SEQ ID NO: 1466154 - RNA, 21 nt, Pseudomonas aeruginosa PA01
gugcuuggugucggccgccag

SEQ ID NO: 1466155 - RNA, 20 nt, Pseudomonas aeruginosa PA01
gugcuugucacgcucggcau

SEQ ID NO: 1466156 - RNA, 17 nt, Pseudomonas aeruginosa PA01
gugcuuggcaccgcgca

SEQ ID NO: 1466157 - RNA, 21 nt, Pseudomonas aeruginosa PA01
gugcuuuccugcuccagcagg

SEQ ID NO: 1466158 - RNA, 14 nt, Pseudomonas aeruginosa PA01
guggaaccgcggcg

SEQ ID NO: 1466159 - RNA, 18 nt, Pseudomonas aeruginosa PA01
guggaaccgcggcgcccu

SEQ ID NO: 1466160 - RNA, 20 nt, Pseudomonas aeruginosa PA01
guggaacagccgcagcggca

SEQ ID NO: 1466161 - RNA, 14 nt, Pseudomonas aeruginosa PA01
guggaacagcgcgu

SEQ ID NO: 1466162 - RNA, 12 nt, Pseudomonas aeruginosa PA01
gugcucggccag

SEQ ID NO: 1466163 - RNA, 13 nt, Pseudomonas aeruginosa PA01
gugcucggccagu

SEQ ID NO: 1466164 - RNA, 20 nt, Pseudomonas aeruginosa PA01
gugcucggcgaucucgccca

SEQ ID NO: 1466165 - RNA, 21 nt, Pseudomonas aeruginosa PA01
gugcucggcgaucucgcccag

SEQ ID NO: 1466166 - RNA, 18 nt, Pseudomonas aeruginosa PA01
gugcucgaugaucgacug

SEQ ID NO: 1466167 - RNA, 15 nt, Pseudomonas aeruginosa PA01
gugcucgacgggcgc

SEQ ID NO: 1466168 - RNA, 22 nt, Pseudomonas aeruginosa PA01
gugcucgaucagguaggcgccg

SEQ ID NO: 1466169 - RNA, 16 nt, Pseudomonas aeruginosa PA01
gugcucgaacgggcac

SEQ ID NO: 1466170 - RNA, 16 nt, Pseudomonas aeruginosa PA01
gugcuucucaccgagg

SEQ ID NO: 1466171 - RNA, 15 nt, Pseudomonas aeruginosa PA01
gugcuugaccgccgc

SEQ ID NO: 1466172 - RNA, 18 nt, Pseudomonas aeruginosa PA01
gugcuugaccgccgccug

SEQ ID NO: 1466173 - RNA, 20 nt, Pseudomonas aeruginosa PA01
gugcuugaccgccgccuggg

SEQ ID NO: 1466174 - RNA, 22 nt, Pseudomonas aeruginosa PA01
gugcuuggcuucgagcugcgag

SEQ ID NO: 1466175 - RNA, 18 nt, Pseudomonas aeruginosa PA01
gugcuucaucggcccggc

SEQ ID NO: 1466176 - RNA, 17 nt, Pseudomonas aeruginosa PA01
gugcuuaauacggcgca

SEQ ID NO: 1466177 - RNA, 20 nt, Pseudomonas aeruginosa PA01
gugcuuacggagaagggcgc

SEQ ID NO: 1466178 - RNA, 12 nt, Pseudomonas aeruginosa PA01
gugcgcccagca

SEQ ID NO: 1466179 - RNA, 13 nt, Pseudomonas aeruginosa PA01
gugcgcccagcag

SEQ ID NO: 1466180 - RNA, 17 nt, Pseudomonas aeruginosa PA01
gugcgcccagcagcagg

SEQ ID NO: 1466181 - RNA, 12 nt, Pseudomonas aeruginosa PA01
gugcgccagcuc

SEQ ID NO: 1466182 - RNA, 18 nt, Pseudomonas aeruginosa PA01
gugcgccagcucggccug

SEQ ID NO: 1466183 - RNA, 19 nt, Pseudomonas aeruginosa PA01
gugcgccccagcucagcag

SEQ ID NO: 1466184 - RNA, 13 nt, Pseudomonas aeruginosa PA01
gugcgccccaggu

SEQ ID NO: 1466185 - RNA, 17 nt, Pseudomonas aeruginosa PA01
gugcgccccaggugcag

SEQ ID NO: 1466186 - RNA, 22 nt, Pseudomonas aeruginosa PA01
gugcgccccaggugcagcgagg

SEQ ID NO: 1466187 - RNA, 16 nt, Pseudomonas aeruginosa PA01
gugcgccgagcgcucg

SEQ ID NO: 1466188 - RNA, 21 nt, Pseudomonas aeruginosa PA01
gugcgccgcagcgcaagucgg

SEQ ID NO: 1466189 - RNA, 19 nt, Pseudomonas aeruginosa PA01
gugcggagggucaggccga

SEQ ID NO: 1466190 - RNA, 13 nt, Pseudomonas aeruginosa PA01
gugcgagggcggc

SEQ ID NO: 1466191 - RNA, 23 nt, Pseudomonas aeruginosa PA01
gugcgagucaccccgaccagcgc

SEQ ID NO: 1466192 - RNA, 18 nt, Pseudomonas aeruginosa PA01
gugcgauggaugcgcggc

SEQ ID NO: 1466193 - RNA, 23 nt, Pseudomonas aeruginosa PA01
gugcgacuggggcaucucggcca

SEQ ID NO: 1466194 - RNA, 12 nt, Pseudomonas aeruginosa PA01
gugcgacgcagc

SEQ ID NO: 1466195 - RNA, 17 nt, Pseudomonas aeruginosa PA01
gugcgacgcagcagagg

SEQ ID NO: 1466196 - RNA, 22 nt, Pseudomonas aeruginosa PA01
gugcgggcagacaccaccaggu

SEQ ID NO: 1466197 - RNA, 18 nt, Pseudomonas aeruginosa PA01
gugcgggcaguccuggcg

SEQ ID NO: 1466198 - RNA, 17 nt, Pseudomonas aeruginosa PA01
gugcggcguucgccgcg

SEQ ID NO: 1466199 - RNA, 12 nt, Pseudomonas aeruginosa PA01
gugcggccaggc

SEQ ID NO: 1466200 - RNA, 21 nt, Pseudomonas aeruginosa PA01
gugcggccauugcccgguggc

SEQ ID NO: 1466201 - RNA, 18 nt, Pseudomonas aeruginosa PA01
gugcggcauuccgggcga

SEQ ID NO: 1466202 - RNA, 12 nt, Pseudomonas aeruginosa PA01
gugcggccgagg

SEQ ID NO: 1466203 - RNA, 13 nt, Pseudomonas aeruginosa PA01
gugcggcagcagg

SEQ ID NO: 1466204 - RNA, 14 nt, Pseudomonas aeruginosa PA01
gugcggcagcaggc

SEQ ID NO: 1466205 - RNA, 17 nt, Pseudomonas aeruginosa PA01
gugcggcaccagccagg

SEQ ID NO: 1466206 - RNA, 19 nt, Pseudomonas aeruginosa PA01
gugcggcaccagccaggug

SEQ ID NO: 1466207 - RNA, 23 nt, Pseudomonas aeruginosa PA01
gugcuccucgucguacuggcgga

SEQ ID NO: 1466208 - RNA, 12 nt, Pseudomonas aeruginosa PA01
gugcgucgaggg

SEQ ID NO: 1466209 - RNA, 15 nt, Pseudomonas aeruginosa PA01
gugcgucgagggccu

SEQ ID NO: 1466210 - RNA, 13 nt, Pseudomonas aeruginosa PA01
gugcgggcgcggg

SEQ ID NO: 1466211 - RNA, 14 nt, Pseudomonas aeruginosa PA01
gugcgguggcuggc

SEQ ID NO: 1466212 - RNA, 17 nt, Pseudomonas aeruginosa PA01
gugcgguggcuggcgua

SEQ ID NO: 1466213 - RNA, 15 nt, Pseudomonas aeruginosa PA01
gugcguacuuggccc

SEQ ID NO: 1466214 - RNA, 13 nt, Pseudomonas aeruginosa PA01
gugccgggccggc

SEQ ID NO: 1466215 - RNA, 17 nt, Pseudomonas aeruginosa PA01
gugccgggccggccagg

SEQ ID NO: 1466216 - RNA, 15 nt, Pseudomonas aeruginosa PA01
gugccgggcgucugc

SEQ ID NO: 1466217 - RNA, 20 nt, Pseudomonas aeruginosa PA01
gugccgcggaauggcgcgca

SEQ ID NO: 1466218 - RNA, 18 nt, Pseudomonas aeruginosa PA01
gugccgccggcgccgccg

SEQ ID NO: 1466219 - RNA, 19 nt, Pseudomonas aeruginosa PA01
gugccgccugggcggucgg

SEQ ID NO: 1466220 - RNA, 22 nt, Pseudomonas aeruginosa PA01
gugccgccugggcggucggcuc

SEQ ID NO: 1466221 - RNA, 13 nt, Pseudomonas aeruginosa PA01
gugccgccggcgc

SEQ ID NO: 1466222 - RNA, 14 nt, Pseudomonas aeruginosa PA01
gugccgccggccac

SEQ ID NO: 1466223 - RNA, 22 nt, Pseudomonas aeruginosa PA01
gugccgccggccaccagcagca

SEQ ID NO: 1466224 - RNA, 14 nt, Pseudomonas aeruginosa PA01
gugccgcccugggg

SEQ ID NO: 1466225 - RNA, 20 nt, Pseudomonas aeruginosa PA01
gugccgggcuuuuucauggc

SEQ ID NO: 1466226 - RNA, 16 nt, Pseudomonas aeruginosa PA01
gugccggucgcgcagc

SEQ ID NO: 1466227 - RNA, 19 nt, Pseudomonas aeruginosa PA01
gugccggugcggguggucg

SEQ ID NO: 1466228 - RNA, 23 nt, Pseudomonas aeruginosa PA01
gugccggugcggguggucgccgc

SEQ ID NO: 1466229 - RNA, 19 nt, Pseudomonas aeruginosa PA01
gugccuguuccuccgccag

SEQ ID NO: 1466230 - RNA, 21 nt, Pseudomonas aeruginosa PA01
gugccuguuccuccgccaggu

SEQ ID NO: 1466231 - RNA, 16 nt, Pseudomonas aeruginosa PA01
gugccuuccgcgccca

SEQ ID NO: 1466232 - RNA, 15 nt, Pseudomonas aeruginosa PA01
gugccuucggcggcg

SEQ ID NO: 1466233 - RNA, 18 nt, Pseudomonas aeruginosa PA01
gugccuucggcggcgccu

SEQ ID NO: 1466234 - RNA, 23 nt, Pseudomonas aeruginosa PA01
gugcgaacacaccgaccgcgagu

SEQ ID NO: 1466235 - RNA, 14 nt, Pseudomonas aeruginosa PA01
gugccgucaggcac

SEQ ID NO: 1466236 - RNA, 16 nt, Pseudomonas aeruginosa PA01
gugccgcccggcgcca

SEQ ID NO: 1466237 - RNA, 14 nt, Pseudomonas aeruginosa PA01
gugccgccaggccu

SEQ ID NO: 1466238 - RNA, 21 nt, Pseudomonas aeruginosa PA01
gugccgccagucggccuggcu

SEQ ID NO: 1466239 - RNA, 23 nt, Pseudomonas aeruginosa PA01
gugccgccauagagugcccaggc

SEQ ID NO: 1466240 - RNA, 14 nt, Pseudomonas aeruginosa PA01
gugccgcaggccgc

SEQ ID NO: 1466241 - RNA, 13 nt, Pseudomonas aeruginosa PA01
gugcccgccggcg

SEQ ID NO: 1466242 - RNA, 14 nt, Pseudomonas aeruginosa PA01
gugccgaggccgcc

SEQ ID NO: 1466243 - RNA, 19 nt, Pseudomonas aeruginosa PA01
gugccgaggccgccgcggg

SEQ ID NO: 1466244 - RNA, 21 nt, Pseudomonas aeruginosa PA01
gugccgaggccgccgcgggca

SEQ ID NO: 1466245 - RNA, 16 nt, Pseudomonas aeruginosa PA01
gugccgaucagcccgu

SEQ ID NO: 1466246 - RNA, 20 nt, Pseudomonas aeruginosa PA01
gugaggcgcagcagcgccag

SEQ ID NO: 1466247 - RNA, 19 nt, Pseudomonas aeruginosa PA01
gugagguagaagcggccgc

SEQ ID NO: 1466248 - RNA, 15 nt, Pseudomonas aeruginosa PA01
gugagguugccgccg

SEQ ID NO: 1466249 - RNA, 16 nt, Pseudomonas aeruginosa PA01
gugagguugccgccga

SEQ ID NO: 1466250 - RNA, 19 nt, Pseudomonas aeruginosa PA01
gugagggucgcgccgacga

SEQ ID NO: 1466251 - RNA, 17 nt, Pseudomonas aeruginosa PA01
gugaggugggcgcgccg

SEQ ID NO: 1466252 - RNA, 13 nt, Pseudomonas aeruginosa PA01
gugauaccgccgg

SEQ ID NO: 1466253 - RNA, 19 nt, Pseudomonas aeruginosa PA01
gugauaccgccggcggcga

SEQ ID NO: 1466254 - RNA, 18 nt, Pseudomonas aeruginosa PA01
gugcagcggaagcccugc

SEQ ID NO: 1466255 - RNA, 15 nt, Pseudomonas aeruginosa PA01
gugcaccgaggcgcg

SEQ ID NO: 1466256 - RNA, 22 nt, Pseudomonas aeruginosa PA01
gugcagcccggucacgccggga

SEQ ID NO: 1466257 - RNA, 18 nt, Pseudomonas aeruginosa PA01
gugcagcccuggcguggc

SEQ ID NO: 1466258 - RNA, 13 nt, Pseudomonas aeruginosa PA01
gugcaccgcgcug

SEQ ID NO: 1466259 - RNA, 20 nt, Pseudomonas aeruginosa PA01
gugcacccagaccuuccagc

SEQ ID NO: 1466260 - RNA, 21 nt, Pseudomonas aeruginosa PA01
gugcaccaucgcauagguggg

SEQ ID NO: 1466261 - RNA, 15 nt, Pseudomonas aeruginosa PA01
gugccaggcgcucgc

SEQ ID NO: 1466262 - RNA, 21 nt, Pseudomonas aeruginosa PA01
gugccaggcggcagccgcggc

SEQ ID NO: 1466263 - RNA, 18 nt, Pseudomonas aeruginosa PA01
gugccaggcucgccgcca

SEQ ID NO: 1466264 - RNA, 21 nt, Pseudomonas aeruginosa PA01
gugccaggcucgccgccagca

SEQ ID NO: 1466265 - RNA, 16 nt, Pseudomonas aeruginosa PA01
gugccagggcggucgg

SEQ ID NO: 1466266 - RNA, 20 nt, Pseudomonas aeruginosa PA01
gugccagggcggucggccag

SEQ ID NO: 1466267 - RNA, 19 nt, Pseudomonas aeruginosa PA01
gugccagggcuucccaggc

SEQ ID NO: 1466268 - RNA, 23 nt, Pseudomonas aeruginosa PA01
gugccagggcuucccaggccagc

SEQ ID NO: 1466269 - RNA, 13 nt, Pseudomonas aeruginosa PA01
gugccacaggugg

SEQ ID NO: 1466270 - RNA, 13 nt, Pseudomonas aeruginosa PA01
gugccacaggccc

SEQ ID NO: 1466271 - RNA, 16 nt, Pseudomonas aeruginosa PA01
gugccacaggcccugg

SEQ ID NO: 1466272 - RNA, 19 nt, Pseudomonas aeruginosa PA01
gugccacaggcccuggauc

SEQ ID NO: 1466273 - RNA, 18 nt, Pseudomonas aeruginosa PA01
gugccauugcuugagcag

SEQ ID NO: 1466274 - RNA, 18 nt, Pseudomonas aeruginosa PA01
gugccauacagcgcccau

SEQ ID NO: 1466275 - RNA, 14 nt, Pseudomonas aeruginosa PA01
gugcagcuccaccg

SEQ ID NO: 1466276 - RNA, 15 nt, Pseudomonas aeruginosa PA01
gugcagcuccaccga

SEQ ID NO: 1466277 - RNA, 14 nt, Pseudomonas aeruginosa PA01
gugcagcucggcac

SEQ ID NO: 1466278 - RNA, 18 nt, Pseudomonas aeruginosa PA01
gugcagcuucuccaggga

SEQ ID NO: 1466279 - RNA, 13 nt, Pseudomonas aeruginosa PA01
gugcaggaacagc

SEQ ID NO: 1466280 - RNA, 16 nt, Pseudomonas aeruginosa PA01
gugcaggaagcgccgg

SEQ ID NO: 1466281 - RNA, 16 nt, Pseudomonas aeruginosa PA01
gugcaggaaguggcgg

SEQ ID NO: 1466282 - RNA, 14 nt, Pseudomonas aeruginosa PA01
gugcauccgccgca

SEQ ID NO: 1466283 - RNA, 14 nt, Pseudomonas aeruginosa PA01
gugcaggccgacgu

SEQ ID NO: 1466284 - RNA, 13 nt, Pseudomonas aeruginosa PA01
gugcaggccgccg

SEQ ID NO: 1466285 - RNA, 15 nt, Pseudomonas aeruginosa PA01
gugcaggaucaccug

SEQ ID NO: 1466286 - RNA, 15 nt, Pseudomonas aeruginosa PA01
gugcauggccgggcc

SEQ ID NO: 1466287 - RNA, 22 nt, Pseudomonas aeruginosa PA01
gugcauguagcgcuccucgcgc

SEQ ID NO: 1466288 - RNA, 12 nt, Pseudomonas aeruginosa PA01
gugcaugccggg

SEQ ID NO: 1466289 - RNA, 16 nt, Pseudomonas aeruginosa PA01
gugcaugaaggcgcug

SEQ ID NO: 1466290 - RNA, 14 nt, Pseudomonas aeruginosa PA01
uggcgagcgcgauc

SEQ ID NO: 1466291 - RNA, 20 nt, Pseudomonas aeruginosa PA01
uggcgaggaacacccagaag

SEQ ID NO: 1466292 - RNA, 17 nt, Pseudomonas aeruginosa PA01
uggcgagaauggcgaug

SEQ ID NO: 1466293 - RNA, 22 nt, Pseudomonas aeruginosa PA01
uggcgcagacgaucuccugcug

SEQ ID NO: 1466294 - RNA, 16 nt, Pseudomonas aeruginosa PA01
uggcgcaggccgggcg

SEQ ID NO: 1466295 - RNA, 18 nt, Pseudomonas aeruginosa PA01
uggcgcaggccgggcgga

SEQ ID NO: 1466296 - RNA, 13 nt, Pseudomonas aeruginosa PA01
uggcgcagcauca

SEQ ID NO: 1466297 - RNA, 13 nt, Pseudomonas aeruginosa PA01
uggcgcagccagg

SEQ ID NO: 1466298 - RNA, 17 nt, Pseudomonas aeruginosa PA01
uggcgcagccgcugcug

SEQ ID NO: 1466299 - RNA, 22 nt, Pseudomonas aeruginosa PA01
uggcgcagccgcugggccacgu

SEQ ID NO: 1466300 - RNA, 15 nt, Pseudomonas aeruginosa PA01
uggcgcagcggcagc

SEQ ID NO: 1466301 - RNA, 21 nt, Pseudomonas aeruginosa PA01
uggcgcagcggcagcgccagg

SEQ ID NO: 1466302 - RNA, 13 nt, Pseudomonas aeruginosa PA01
uggcgaccuggua

SEQ ID NO: 1466303 - RNA, 19 nt, Pseudomonas aeruginosa PA01
uggcgacgacgggagcgcg

SEQ ID NO: 1466304 - RNA, 18 nt, Pseudomonas aeruginosa PA01
uggcgacgaugcgcccca

SEQ ID NO: 1466305 - RNA, 15 nt, Pseudomonas aeruginosa PA01
uggcgacgcagcacg

SEQ ID NO: 1466306 - RNA, 17 nt, Pseudomonas aeruginosa PA01
uggcgacgcagcacggc

SEQ ID NO: 1466307 - RNA, 19 nt, Pseudomonas aeruginosa PA01
uggcgacgcagcacggcgg

SEQ ID NO: 1466308 - RNA, 12 nt, Pseudomonas aeruginosa PA01
uggcgacgccgg

SEQ ID NO: 1466309 - RNA, 14 nt, Pseudomonas aeruginosa PA01
uggcgacgcgcagg

SEQ ID NO: 1466310 - RNA, 15 nt, Pseudomonas aeruginosa PA01
uggcgacgcgcaggc

SEQ ID NO: 1466311 - RNA, 18 nt, Pseudomonas aeruginosa PA01
uggcgacgcgcaggccgg

SEQ ID NO: 1466312 - RNA, 23 nt, Pseudomonas aeruginosa PA01
uggcgccgaaaaaaaggggcccg

SEQ ID NO: 1466313 - RNA, 15 nt, Pseudomonas aeruginosa PA01
uggcgccgaccucca

SEQ ID NO: 1466314 - RNA, 22 nt, Pseudomonas aeruginosa PA01
uggcgcccaacgucuucaggcg

SEQ ID NO: 1466315 - RNA, 14 nt, Pseudomonas aeruginosa PA01
uggcgcccagccag

SEQ ID NO: 1466316 - RNA, 14 nt, Pseudomonas aeruginosa PA01
uggcgccgcagggc

SEQ ID NO: 1466317 - RNA, 14 nt, Pseudomonas aeruginosa PA01
uggcgccgcuggcg

SEQ ID NO: 1466318 - RNA, 14 nt, Pseudomonas aeruginosa PA01
uggcgccaggccgc

SEQ ID NO: 1466319 - RNA, 17 nt, Pseudomonas aeruginosa PA01
uggcgccccagaucgcc

SEQ ID NO: 1466320 - RNA, 14 nt, Pseudomonas aeruginosa PA01
uggcgccagccagc

SEQ ID NO: 1466321 - RNA, 20 nt, Pseudomonas aeruginosa PA01
uggcgcauccgcccgaucgc

SEQ ID NO: 1466322 - RNA, 16 nt, Pseudomonas aeruginosa PA01
uggcgcauggcgcucu

SEQ ID NO: 1466323 - RNA, 13 nt, Pseudomonas aeruginosa PA01
uggcgcaggcggc

SEQ ID NO: 1466324 - RNA, 18 nt, Pseudomonas aeruginosa PA01
uggcgcaggcggcgcugu

SEQ ID NO: 1466325 - RNA, 14 nt, Pseudomonas aeruginosa PA01
uggcgccgccgagg

SEQ ID NO: 1466326 - RNA, 14 nt, Pseudomonas aeruginosa PA01
uggcgccggccaga

SEQ ID NO: 1466327 - RNA, 14 nt, Pseudomonas aeruginosa PA01
uggcgccgccggcg

SEQ ID NO: 1466328 - RNA, 15 nt, Pseudomonas aeruginosa PA01
uggcgccgccggcga

SEQ ID NO: 1466329 - RNA, 14 nt, Pseudomonas aeruginosa PA01
uggcgcgcaccacc

SEQ ID NO: 1466330 - RNA, 18 nt, Pseudomonas aeruginosa PA01
uggcgcgcaccaccuggc

SEQ ID NO: 1466331 - RNA, 19 nt, Pseudomonas aeruginosa PA01
uggcgcgcagggcaucgau

SEQ ID NO: 1466332 - RNA, 23 nt, Pseudomonas aeruginosa PA01
uggcgcgcagggcaucgaugacc

SEQ ID NO: 1466333 - RNA, 11 nt, Pseudomonas aeruginosa PA01
uggcgcgccuc

SEQ ID NO: 1466334 - RNA, 13 nt, Pseudomonas aeruginosa PA01
uggcgcgcgacag

SEQ ID NO: 1466335 - RNA, 22 nt, Pseudomonas aeruginosa PA01
uggcgcggaugucgggcucgac

SEQ ID NO: 1466336 - RNA, 16 nt, Pseudomonas aeruginosa PA01
uggcgcgcgcgccagg

SEQ ID NO: 1466337 - RNA, 17 nt, Pseudomonas aeruginosa PA01
uggcgcgcgcgcugcca

SEQ ID NO: 1466338 - RNA, 18 nt, Pseudomonas aeruginosa PA01
uggcgcgcggccgcgucc

SEQ ID NO: 1466339 - RNA, 22 nt, Pseudomonas aeruginosa PA01
uggcggcaugccguugggccag

SEQ ID NO: 1466340 - RNA, 23 nt, Pseudomonas aeruginosa PA01
uggcggcaugccguugggccagg

SEQ ID NO: 1466341 - RNA, 19 nt, Pseudomonas aeruginosa PA01
uggcggcauugagcgccag

SEQ ID NO: 1466342 - RNA, 21 nt, Pseudomonas aeruginosa PA01
uggcggcauugagcgccagca

SEQ ID NO: 1466343 - RNA, 16 nt, Pseudomonas aeruginosa PA01
uggcggaaaagcccgc

SEQ ID NO: 1466344 - RNA, 19 nt, Pseudomonas aeruginosa PA01
uggcggaaggucagguagg

SEQ ID NO: 1466345 - RNA, 13 nt, Pseudomonas aeruginosa PA01
uggcggaccgccu

SEQ ID NO: 1466346 - RNA, 16 nt, Pseudomonas aeruginosa PA01
uggcggaccgccucga

SEQ ID NO: 1466347 - RNA, 21 nt, Pseudomonas aeruginosa PA01
uggcggacaacccggcgcugg

SEQ ID NO: 1466348 - RNA, 22 nt, Pseudomonas aeruginosa PA01
uggcggagaaacuuucuucgcc

SEQ ID NO: 1466349 - RNA, 20 nt, Pseudomonas aeruginosa PA01
uggcggauagccgcaagcgg

SEQ ID NO: 1466350 - RNA, 16 nt, Pseudomonas aeruginosa PA01
uggcggaucaccggcu

SEQ ID NO: 1466351 - RNA, 21 nt, Pseudomonas aeruginosa PA01
uggcggaucaccggcuggccc

SEQ ID NO: 1466352 - RNA, 23 nt, Pseudomonas aeruginosa PA01
uggcggaucuggaauucgccgcg

SEQ ID NO: 1466353 - RNA, 18 nt, Pseudomonas aeruginosa PA01
uggcggcaaggcacacgc

SEQ ID NO: 1466354 - RNA, 22 nt, Pseudomonas aeruginosa PA01
uggcggcaaggcacacgcccgg

SEQ ID NO: 1466355 - RNA, 21 nt, Pseudomonas aeruginosa PA01
uggcaugcaagaggucgacgg

SEQ ID NO: 1466356 - RNA, 19 nt, Pseudomonas aeruginosa PA01
uggcauggcuuuccaggcg

SEQ ID NO: 1466357 - RNA, 14 nt, Pseudomonas aeruginosa PA01
uggcagugcgccgg

SEQ ID NO: 1466358 - RNA, 17 nt, Pseudomonas aeruginosa PA01
uggcaggcgcugcagcc

SEQ ID NO: 1466359 - RNA, 22 nt, Pseudomonas aeruginosa PA01
uggcagguaucgcugggcgccu

SEQ ID NO: 1466360 - RNA, 17 nt, Pseudomonas aeruginosa PA01
uggcauaaccggaagcg

SEQ ID NO: 1466361 - RNA, 23 nt, Pseudomonas aeruginosa PA01
uggcauaaccggaagcgaucucc

SEQ ID NO: 1466362 - RNA, 17 nt, Pseudomonas aeruginosa PA01
uggccgcuucaagcggc

SEQ ID NO: 1466363 - RNA, 16 nt, Pseudomonas aeruginosa PA01
uggccgcugagcagca

SEQ ID NO: 1466364 - RNA, 24 nt, Pseudomonas aeruginosa PA01
uggccggaaaaagcaccgacacgc

SEQ ID NO: 1466365 - RNA, 15 nt, Pseudomonas aeruginosa PA01
uggccggcagcagcg

SEQ ID NO: 1466366 - RNA, 16 nt, Pseudomonas aeruginosa PA01
uggccggcagcagcgc

SEQ ID NO: 1466367 - RNA, 19 nt, Pseudomonas aeruginosa PA01
uggccggcagcagcgccag

SEQ ID NO: 1466368 - RNA, 12 nt, Pseudomonas aeruginosa PA01
uggccggccagc

SEQ ID NO: 1466369 - RNA, 15 nt, Pseudomonas aeruginosa PA01
uggccggcgaccagc

SEQ ID NO: 1466370 - RNA, 15 nt, Pseudomonas aeruginosa PA01
uggccggcgaucaga

SEQ ID NO: 1466371 - RNA, 20 nt, Pseudomonas aeruginosa PA01
uggccggcgauggccgccug

SEQ ID NO: 1466372 - RNA, 14 nt, Pseudomonas aeruginosa PA01
uggccggcgcggcg

SEQ ID NO: 1466373 - RNA, 18 nt, Pseudomonas aeruginosa PA01
uggccggcgcggcguuca

SEQ ID NO: 1466374 - RNA, 22 nt, Pseudomonas aeruginosa PA01
uggccggcgcggacgauggucg

SEQ ID NO: 1466375 - RNA, 16 nt, Pseudomonas aeruginosa PA01
uggccgucuccaggcg

SEQ ID NO: 1466376 - RNA, 18 nt, Pseudomonas aeruginosa PA01
uggccgucuuccagggcg

SEQ ID NO: 1466377 - RNA, 20 nt, Pseudomonas aeruginosa PA01
uggccgucuuccagggcggc

SEQ ID NO: 1466378 - RNA, 14 nt, Pseudomonas aeruginosa PA01
uggccggcggagau

SEQ ID NO: 1466379 - RNA, 15 nt, Pseudomonas aeruginosa PA01
uggccggcggagaua

SEQ ID NO: 1466380 - RNA, 18 nt, Pseudomonas aeruginosa PA01
uggccggcgggcgcgagg

SEQ ID NO: 1466381 - RNA, 19 nt, Pseudomonas aeruginosa PA01
uggccggcgggcgcgaggc

SEQ ID NO: 1466382 - RNA, 16 nt, Pseudomonas aeruginosa PA01
uggccgugggccgccg

SEQ ID NO: 1466383 - RNA, 14 nt, Pseudomonas aeruginosa PA01
uggccgugcucgau

SEQ ID NO: 1466384 - RNA, 18 nt, Pseudomonas aeruginosa PA01
uggccguggcgccccagg

SEQ ID NO: 1466385 - RNA, 21 nt, Pseudomonas aeruginosa PA01
uggccguggcgccccaggcgg

SEQ ID NO: 1466386 - RNA, 16 nt, Pseudomonas aeruginosa PA01
uggccucagggcgcga

SEQ ID NO: 1466387 - RNA, 14 nt, Pseudomonas aeruginosa PA01
uggccuccacccgc

SEQ ID NO: 1466388 - RNA, 18 nt, Pseudomonas aeruginosa PA01
uggccuccacccgcgaag

SEQ ID NO: 1466389 - RNA, 18 nt, Pseudomonas aeruginosa PA01
uggccguucuccaggucg

SEQ ID NO: 1466390 - RNA, 19 nt, Pseudomonas aeruginosa PA01
uggccguucuccaggucga

SEQ ID NO: 1466391 - RNA, 18 nt, Pseudomonas aeruginosa PA01
uggccguugaccagcgcg

SEQ ID NO: 1466392 - RNA, 19 nt, Pseudomonas aeruginosa PA01
uggccguugagcaccucga

SEQ ID NO: 1466393 - RNA, 15 nt, Pseudomonas aeruginosa PA01
uggccguugcgcagg

SEQ ID NO: 1466394 - RNA, 14 nt, Pseudomonas aeruginosa PA01
uggccguuggcgaa

SEQ ID NO: 1466395 - RNA, 16 nt, Pseudomonas aeruginosa PA01
uggccguuggcgaacu

SEQ ID NO: 1466396 - RNA, 21 nt, Pseudomonas aeruginosa PA01
uggccugcagcaggucgagca

SEQ ID NO: 1466397 - RNA, 15 nt, Pseudomonas aeruginosa PA01
uggccugccgauggg

SEQ ID NO: 1466398 - RNA, 23 nt, Pseudomonas aeruginosa PA01
uggccugccgaugggccuucagg

SEQ ID NO: 1466399 - RNA, 13 nt, Pseudomonas aeruginosa PA01
uggccucggcguc

SEQ ID NO: 1466400 - RNA, 13 nt, Pseudomonas aeruginosa PA01
uggccucggcgau

SEQ ID NO: 1466401 - RNA, 19 nt, Pseudomonas aeruginosa PA01
uggcgaacaaucggucgcc

SEQ ID NO: 1466402 - RNA, 17 nt, Pseudomonas aeruginosa PA01
uggcgaaacuccagcag

SEQ ID NO: 1466403 - RNA, 12 nt, Pseudomonas aeruginosa PA01
uggcgaccgccg

SEQ ID NO: 1466404 - RNA, 14 nt, Pseudomonas aeruginosa PA01
uggcgaacagcacc

SEQ ID NO: 1466405 - RNA, 16 nt, Pseudomonas aeruginosa PA01
uggcgaacagcaccuu

SEQ ID NO: 1466406 - RNA, 17 nt, Pseudomonas aeruginosa PA01
uggcgaacaggcagcgg

SEQ ID NO: 1466407 - RNA, 14 nt, Pseudomonas aeruginosa PA01
uggccuugccgucc

SEQ ID NO: 1466408 - RNA, 15 nt, Pseudomonas aeruginosa PA01
uggccuuggccacga

SEQ ID NO: 1466409 - RNA, 17 nt, Pseudomonas aeruginosa PA01
uggccuuggccacgacc

SEQ ID NO: 1466410 - RNA, 16 nt, Pseudomonas aeruginosa PA01
uggccuugaugccggc

SEQ ID NO: 1466411 - RNA, 20 nt, Pseudomonas aeruginosa PA01
uggccuugaugccggcgaug

SEQ ID NO: 1466412 - RNA, 20 nt, Pseudomonas aeruginosa PA01
uggccuugauggugaccggc

SEQ ID NO: 1466413 - RNA, 14 nt, Pseudomonas aeruginosa PA01
uggccuugagcagg

SEQ ID NO: 1466414 - RNA, 15 nt, Pseudomonas aeruginosa PA01
uggccuugagcaggc

SEQ ID NO: 1466415 - RNA, 14 nt, Pseudomonas aeruginosa PA01
uggccuggcgcuca

SEQ ID NO: 1466416 - RNA, 17 nt, Pseudomonas aeruginosa PA01
uggccuggucggcgcgg

SEQ ID NO: 1466417 - RNA, 18 nt, Pseudomonas aeruginosa PA01
uggccuggucggcgcggc

SEQ ID NO: 1466418 - RNA, 14 nt, Pseudomonas aeruginosa PA01
uggccuggcccggc

SEQ ID NO: 1466419 - RNA, 17 nt, Pseudomonas aeruginosa PA01
uggccuggcccggcgca

SEQ ID NO: 1466420 - RNA, 16 nt, Pseudomonas aeruginosa PA01
uggcguugcugaucac

SEQ ID NO: 1466421 - RNA, 13 nt, Pseudomonas aeruginosa PA01
uggcuacccgcag

SEQ ID NO: 1466422 - RNA, 19 nt, Pseudomonas aeruginosa PA01
uggcguuguugccgccgaa

SEQ ID NO: 1466423 - RNA, 15 nt, Pseudomonas aeruginosa PA01
uggcuaaacaagcca

SEQ ID NO: 1466424 - RNA, 16 nt, Pseudomonas aeruginosa PA01
uggcguuugcgucauc

SEQ ID NO: 1466425 - RNA, 14 nt, Pseudomonas aeruginosa PA01
uggcguuccaggcg

SEQ ID NO: 1466426 - RNA, 20 nt, Pseudomonas aeruginosa PA01
uggcguuccaggcggcggac

SEQ ID NO: 1466427 - RNA, 16 nt, Pseudomonas aeruginosa PA01
uggcguucucggccag

SEQ ID NO: 1466428 - RNA, 18 nt, Pseudomonas aeruginosa PA01
uggcguucucggccaggu

SEQ ID NO: 1466429 - RNA, 16 nt, Pseudomonas aeruginosa PA01
uggcguugacugccug

SEQ ID NO: 1466430 - RNA, 14 nt, Pseudomonas aeruginosa PA01
uggcucaguugcug

SEQ ID NO: 1466431 - RNA, 22 nt, Pseudomonas aeruginosa PA01
uggcuccacugcuuggccaggc

SEQ ID NO: 1466432 - RNA, 15 nt, Pseudomonas aeruginosa PA01
uggcuauucgcccag

SEQ ID NO: 1466433 - RNA, 21 nt, Pseudomonas aeruginosa PA01
uggcuauccuccaggccgccg

SEQ ID NO: 1466434 - RNA, 21 nt, Pseudomonas aeruginosa PA01
uggcuccgcgcguucagccac

SEQ ID NO: 1466435 - RNA, 14 nt, Pseudomonas aeruginosa PA01
uggcucgaucagcc

SEQ ID NO: 1466436 - RNA, 15 nt, Pseudomonas aeruginosa PA01
uggcugaagccgggc

SEQ ID NO: 1466437 - RNA, 16 nt, Pseudomonas aeruginosa PA01
uggcugaagccgggca

SEQ ID NO: 1466438 - RNA, 14 nt, Pseudomonas aeruginosa PA01
uggcggccgccgcg

SEQ ID NO: 1466439 - RNA, 20 nt, Pseudomonas aeruginosa PA01
uggcggccgccgcgcagcac

SEQ ID NO: 1466440 - RNA, 19 nt, Pseudomonas aeruginosa PA01
uggcggccaucaggcgcug

SEQ ID NO: 1466441 - RNA, 15 nt, Pseudomonas aeruginosa PA01
uggcgguggccgugg

SEQ ID NO: 1466442 - RNA, 16 nt, Pseudomonas aeruginosa PA01
uggcggcaucggcgcc

SEQ ID NO: 1466443 - RNA, 18 nt, Pseudomonas aeruginosa PA01
uggcguaccucgccaggc

SEQ ID NO: 1466444 - RNA, 20 nt, Pseudomonas aeruginosa PA01
uggcguacuugggcaucagc

SEQ ID NO: 1466445 - RNA, 17 nt, Pseudomonas aeruginosa PA01
uggcgugcucggcgauc

SEQ ID NO: 1466446 - RNA, 18 nt, Pseudomonas aeruginosa PA01
uggcgugcucggcgaucu

SEQ ID NO: 1466447 - RNA, 15 nt, Pseudomonas aeruginosa PA01
uggcgugccgccagg

SEQ ID NO: 1466448 - RNA, 16 nt, Pseudomonas aeruginosa PA01
uggcgugccgccaggc

SEQ ID NO: 1466449 - RNA, 16 nt, Pseudomonas aeruginosa PA01
uggcugaggcguucca

SEQ ID NO: 1466450 - RNA, 15 nt, Pseudomonas aeruginosa PA01
uggcuggccagcagg

SEQ ID NO: 1466451 - RNA, 13 nt, Pseudomonas aeruginosa PA01
uggcuggccagcc

SEQ ID NO: 1466452 - RNA, 14 nt, Pseudomonas aeruginosa PA01
uggcuggccagccc

SEQ ID NO: 1466453 - RNA, 17 nt, Pseudomonas aeruginosa PA01
uggcucuugccgcgagc

SEQ ID NO: 1466454 - RNA, 13 nt, Pseudomonas aeruginosa PA01
uggcugcgcgcca

SEQ ID NO: 1466455 - RNA, 22 nt, Pseudomonas aeruginosa PA01
uggcugcccaguugcgcggcga

SEQ ID NO: 1466456 - RNA, 12 nt, Pseudomonas aeruginosa PA01
uggcuggcguag

SEQ ID NO: 1466457 - RNA, 20 nt, Pseudomonas aeruginosa PA01
uggcugguaacgggcgaacc

SEQ ID NO: 1466458 - RNA, 18 nt, Pseudomonas aeruginosa PA01
uggcuggccucagggcgc

SEQ ID NO: 1466459 - RNA, 16 nt, Pseudomonas aeruginosa PA01
uggcuggccucggcga

SEQ ID NO: 1466460 - RNA, 13 nt, Pseudomonas aeruginosa PA01
uggcuggcgccgc

SEQ ID NO: 1466461 - RNA, 15 nt, Pseudomonas aeruginosa PA01
uggcuggcgccgcgg

SEQ ID NO: 1466462 - RNA, 13 nt, Pseudomonas aeruginosa PA01
uggcugucggcgc

SEQ ID NO: 1466463 - RNA, 18 nt, Pseudomonas aeruginosa PA01
uggcuggugaugccgcgg

SEQ ID NO: 1466464 - RNA, 15 nt, Pseudomonas aeruginosa PA01
uggcuuccagccagc

SEQ ID NO: 1466465 - RNA, 13 nt, Pseudomonas aeruginosa PA01
uggcuucgaggcg

SEQ ID NO: 1466466 - RNA, 16 nt, Pseudomonas aeruginosa PA01
uggcuuccgagcaguu

SEQ ID NO: 1466467 - RNA, 22 nt, Pseudomonas aeruginosa PA01
ugggaagagcaucucgccggca

SEQ ID NO: 1466468 - RNA, 21 nt, Pseudomonas aeruginosa PA01
ugggaaagaaacgguggaggc

SEQ ID NO: 1466469 - RNA, 18 nt, Pseudomonas aeruginosa PA01
uggcuuuccaggcgccgc

SEQ ID NO: 1466470 - RNA, 23 nt, Pseudomonas aeruginosa PA01
ugggcaagcugcacggcgacccg

SEQ ID NO: 1466471 - RNA, 17 nt, Pseudomonas aeruginosa PA01
ugggcaccgcgccggcg

SEQ ID NO: 1466472 - RNA, 18 nt, Pseudomonas aeruginosa PA01
ugggcaccgcgccggcgg

SEQ ID NO: 1466473 - RNA, 21 nt, Pseudomonas aeruginosa PA01
ugggcacgccgguggccaggc

SEQ ID NO: 1466474 - RNA, 16 nt, Pseudomonas aeruginosa PA01
ugggcacgagucgagg

SEQ ID NO: 1466475 - RNA, 19 nt, Pseudomonas aeruginosa PA01
ugggcacgaucugcgccgc

SEQ ID NO: 1466476 - RNA, 21 nt, Pseudomonas aeruginosa PA01
ugggcacgaucugcgccgcaa

SEQ ID NO: 1466477 - RNA, 23 nt, Pseudomonas aeruginosa PA01
ugggcacgaucugcgccgcaagc

SEQ ID NO: 1466478 - RNA, 18 nt, Pseudomonas aeruginosa PA01
ugggcagcagcgaacgcc

SEQ ID NO: 1466479 - RNA, 19 nt, Pseudomonas aeruginosa PA01
ugggcagcagcgaacgccg

SEQ ID NO: 1466480 - RNA, 21 nt, Pseudomonas aeruginosa PA01
ugggcagcagcgaacgccgca

SEQ ID NO: 1466481 - RNA, 16 nt, Pseudomonas aeruginosa PA01
ugggcaucuuucagcu

SEQ ID NO: 1466482 - RNA, 19 nt, Pseudomonas aeruginosa PA01
ugggcaggauaucgcccag

SEQ ID NO: 1466483 - RNA, 20 nt, Pseudomonas aeruginosa PA01
ugggcaggauaucgcccagg

SEQ ID NO: 1466484 - RNA, 21 nt, Pseudomonas aeruginosa PA01
ugggcaggauaucgcccaggg

SEQ ID NO: 1466485 - RNA, 22 nt, Pseudomonas aeruginosa PA01
ugggcauaggaauacggcgcga

SEQ ID NO: 1466486 - RNA, 18 nt, Pseudomonas aeruginosa PA01
ugggcagcgucgccgggc

SEQ ID NO: 1466487 - RNA, 15 nt, Pseudomonas aeruginosa PA01
ugggacugagccgcu

SEQ ID NO: 1466488 - RNA, 23 nt, Pseudomonas aeruginosa PA01
ugggaacgaguugggcgaccugc

SEQ ID NO: 1466489 - RNA, 16 nt, Pseudomonas aeruginosa PA01
ugggaauugcgcacgc

SEQ ID NO: 1466490 - RNA, 19 nt, Pseudomonas aeruginosa PA01
ugggaucgccacgccggcg

SEQ ID NO: 1466491 - RNA, 15 nt, Pseudomonas aeruginosa PA01
ugggaucggcgauca

SEQ ID NO: 1466492 - RNA, 21 nt, Pseudomonas aeruginosa PA01
ugggaucgucgaagcucggcg

SEQ ID NO: 1466493 - RNA, 13 nt, Pseudomonas aeruginosa PA01
ugggauggccagc

SEQ ID NO: 1466494 - RNA, 15 nt, Pseudomonas aeruginosa PA01
ugggauggccagcca

SEQ ID NO: 1466495 - RNA, 13 nt, Pseudomonas aeruginosa PA01
ugggauggcgcgg

SEQ ID NO: 1466496 - RNA, 22 nt, Pseudomonas aeruginosa PA01
ugggaguccagguacaccaggg

SEQ ID NO: 1466497 - RNA, 16 nt, Pseudomonas aeruginosa PA01
ugggauagcuuuccag

SEQ ID NO: 1466498 - RNA, 15 nt, Pseudomonas aeruginosa PA01
ugggucagcgccagc

SEQ ID NO: 1466499 - RNA, 18 nt, Pseudomonas aeruginosa PA01
ugggucagcgccagcaac

SEQ ID NO: 1466500 - RNA, 12 nt, Pseudomonas aeruginosa PA01
ugggucaccagc

SEQ ID NO: 1466501 - RNA, 18 nt, Pseudomonas aeruginosa PA01
uggguauagaccagcacc

SEQ ID NO: 1466502 - RNA, 20 nt, Pseudomonas aeruginosa PA01
uggguauccagcggccgcga

SEQ ID NO: 1466503 - RNA, 14 nt, Pseudomonas aeruginosa PA01
uggguaccgaacuu

SEQ ID NO: 1466504 - RNA, 22 nt, Pseudomonas aeruginosa PA01
ugggucaucgaacaucucgaag

SEQ ID NO: 1466505 - RNA, 15 nt, Pseudomonas aeruginosa PA01
ugggcaucgagaagg

SEQ ID NO: 1466506 - RNA, 16 nt, Pseudomonas aeruginosa PA01
ugggccagcaggccga

SEQ ID NO: 1466507 - RNA, 14 nt, Pseudomonas aeruginosa PA01
ugggcauggcuggc

SEQ ID NO: 1466508 - RNA, 15 nt, Pseudomonas aeruginosa PA01
ugggccaccaucagg

SEQ ID NO: 1466509 - RNA, 22 nt, Pseudomonas aeruginosa PA01
ugggccggcaugcucagccgcg

SEQ ID NO: 1466510 - RNA, 24 nt, Pseudomonas aeruginosa PA01
ugggccgcgcagaucgcguccagg

SEQ ID NO: 1466511 - RNA, 15 nt, Pseudomonas aeruginosa PA01
ugggccggcgcgccg

SEQ ID NO: 1466512 - RNA, 12 nt, Pseudomonas aeruginosa PA01
ugggccucgcug

SEQ ID NO: 1466513 - RNA, 14 nt, Pseudomonas aeruginosa PA01
ugggccucgcugcg

SEQ ID NO: 1466514 - RNA, 18 nt, Pseudomonas aeruginosa PA01
ugggccugcuccucggca

SEQ ID NO: 1466515 - RNA, 20 nt, Pseudomonas aeruginosa PA01
ugggccuuguucaggguggc

SEQ ID NO: 1466516 - RNA, 16 nt, Pseudomonas aeruginosa PA01
ugggccuugagcaggc

SEQ ID NO: 1466517 - RNA, 18 nt, Pseudomonas aeruginosa PA01
ugggcgaacagcgagacc

SEQ ID NO: 1466518 - RNA, 14 nt, Pseudomonas aeruginosa PA01
ugggcgaagccggc

SEQ ID NO: 1466519 - RNA, 20 nt, Pseudomonas aeruginosa PA01
ugggcgaagccggcggcgcg

SEQ ID NO: 1466520 - RNA, 16 nt, Pseudomonas aeruginosa PA01
ugggcgaagucgacga

SEQ ID NO: 1466521 - RNA, 14 nt, Pseudomonas aeruginosa PA01
ugggcgaagucggc

SEQ ID NO: 1466522 - RNA, 20 nt, Pseudomonas aeruginosa PA01
ugggcgaaguugaaacggcg

SEQ ID NO: 1466523 - RNA, 22 nt, Pseudomonas aeruginosa PA01
ugggcgaaguugaaacggcgga

SEQ ID NO: 1466524 - RNA, 20 nt, Pseudomonas aeruginosa PA01
ugguaacugggaauggcgau

SEQ ID NO: 1466525 - RNA, 17 nt, Pseudomonas aeruginosa PA01
uggucaccuugaccuug

SEQ ID NO: 1466526 - RNA, 16 nt, Pseudomonas aeruginosa PA01
uggucacgccguucag

SEQ ID NO: 1466527 - RNA, 14 nt, Pseudomonas aeruginosa PA01
uggucaccgccagc

SEQ ID NO: 1466528 - RNA, 15 nt, Pseudomonas aeruginosa PA01
uggucaccgccagcg

SEQ ID NO: 1466529 - RNA, 16 nt, Pseudomonas aeruginosa PA01
uggucaccgccagcgg

SEQ ID NO: 1466530 - RNA, 20 nt, Pseudomonas aeruginosa PA01
ugguagcagagggucgccag

SEQ ID NO: 1466531 - RNA, 15 nt, Pseudomonas aeruginosa PA01
uggucagcaccaggg

SEQ ID NO: 1466532 - RNA, 17 nt, Pseudomonas aeruginosa PA01
uggucagccagccgagc

SEQ ID NO: 1466533 - RNA, 21 nt, Pseudomonas aeruginosa PA01
uggucacggcgaagcggcccu

SEQ ID NO: 1466534 - RNA, 22 nt, Pseudomonas aeruginosa PA01
uggucgauauagcccugggcgc

SEQ ID NO: 1466535 - RNA, 22 nt, Pseudomonas aeruginosa PA01
uggucgaugaucuugucgugcc

SEQ ID NO: 1466536 - RNA, 14 nt, Pseudomonas aeruginosa PA01
uggucgaugggcga

SEQ ID NO: 1466537 - RNA, 23 nt, Pseudomonas aeruginosa PA01
uggucgaugggcgagcgacggug

SEQ ID NO: 1466538 - RNA, 19 nt, Pseudomonas aeruginosa PA01
uggucgaucucgucgaagc

SEQ ID NO: 1466539 - RNA, 16 nt, Pseudomonas aeruginosa PA01
uggucgcagccgcgca

SEQ ID NO: 1466540 - RNA, 21 nt, Pseudomonas aeruginosa PA01
uggucgaacacuugaccgucg

SEQ ID NO: 1466541 - RNA, 15 nt, Pseudomonas aeruginosa PA01
ugguccuuauucggc

SEQ ID NO: 1466542 - RNA, 21 nt, Pseudomonas aeruginosa PA01
uggucgacauagcgcagcacc

SEQ ID NO: 1466543 - RNA, 24 nt, Pseudomonas aeruginosa PA01
uggucgacauagcgcagcaccggc

SEQ ID NO: 1466544 - RNA, 20 nt, Pseudomonas aeruginosa PA01
uggucaguucggcccagcag

SEQ ID NO: 1466545 - RNA, 19 nt, Pseudomonas aeruginosa PA01
ugguccggguuggcgcagg

SEQ ID NO: 1466546 - RNA, 22 nt, Pseudomonas aeruginosa PA01
uggucaggaucacaucgcccgg

SEQ ID NO: 1466547 - RNA, 17 nt, Pseudomonas aeruginosa PA01
uggucaggccgaccagc

SEQ ID NO: 1466548 - RNA, 18 nt, Pseudomonas aeruginosa PA01
uggucaggccggcgcgau

SEQ ID NO: 1466549 - RNA, 15 nt, Pseudomonas aeruginosa PA01
uggucaggcgccagg

SEQ ID NO: 1466550 - RNA, 16 nt, Pseudomonas aeruginosa PA01
uggucaggcgccagga

SEQ ID NO: 1466551 - RNA, 23 nt, Pseudomonas aeruginosa PA01
uggucaggucgacgccgccgagc

SEQ ID NO: 1466552 - RNA, 17 nt, Pseudomonas aeruginosa PA01
uggucaggcugacgucg

SEQ ID NO: 1466553 - RNA, 15 nt, Pseudomonas aeruginosa PA01
uggucaggcuggccc

SEQ ID NO: 1466554 - RNA, 14 nt, Pseudomonas aeruginosa PA01
uggucagggugccg

SEQ ID NO: 1466555 - RNA, 15 nt, Pseudomonas aeruginosa PA01
ugguggucggcagcu

SEQ ID NO: 1466556 - RNA, 12 nt, Pseudomonas aeruginosa PA01
ugguggucggca

SEQ ID NO: 1466557 - RNA, 18 nt, Pseudomonas aeruginosa PA01
uggugcgauagaccgcuu

SEQ ID NO: 1466558 - RNA, 17 nt, Pseudomonas aeruginosa PA01
uggugucggccgccagg

SEQ ID NO: 1466559 - RNA, 14 nt, Pseudomonas aeruginosa PA01
uggugugcagcagc

SEQ ID NO: 1466560 - RNA, 16 nt, Pseudomonas aeruginosa PA01
aaucaaaaccagccuu

SEQ ID NO: 1466561 - RNA, 19 nt, Pseudomonas aeruginosa PA01
uggugauccgcacccgcga

SEQ ID NO: 1466562 - RNA, 14 nt, Pseudomonas aeruginosa PA01
uggugaucaccgcc

SEQ ID NO: 1466563 - RNA, 19 nt, Pseudomonas aeruginosa PA01
uggucgccgggauuguugc

SEQ ID NO: 1466564 - RNA, 17 nt, Pseudomonas aeruginosa PA01
uggucgccguccaccaa

SEQ ID NO: 1466565 - RNA, 18 nt, Pseudomonas aeruginosa PA01
uggucgccgcagguccgg

SEQ ID NO: 1466566 - RNA, 17 nt, Pseudomonas aeruginosa PA01
uggucgcgcgcggccag

SEQ ID NO: 1466567 - RNA, 14 nt, Pseudomonas aeruginosa PA01
uggucgcuccagcc

SEQ ID NO: 1466568 - RNA, 15 nt, Pseudomonas aeruginosa PA01
uggucgcuccagccc

SEQ ID NO: 1466569 - RNA, 16 nt, Pseudomonas aeruginosa PA01
uggucggccaggucgc

SEQ ID NO: 1466570 - RNA, 17 nt, Pseudomonas aeruginosa PA01
uggucggcacgaugucg

SEQ ID NO: 1466571 - RNA, 18 nt, Pseudomonas aeruginosa PA01
uggucggcacgaugucga

SEQ ID NO: 1466572 - RNA, 14 nt, Pseudomonas aeruginosa PA01
uggucggcggccuc

SEQ ID NO: 1466573 - RNA, 15 nt, Pseudomonas aeruginosa PA01
uggucggcggccucg

SEQ ID NO: 1466574 - RNA, 22 nt, Pseudomonas aeruginosa PA01
uggucguaggcgcgggcggcgg

SEQ ID NO: 1466575 - RNA, 15 nt, Pseudomonas aeruginosa PA01
uggucggugacccgc

SEQ ID NO: 1466576 - RNA, 16 nt, Pseudomonas aeruginosa PA01
uggucguggcggaagg

SEQ ID NO: 1466577 - RNA, 18 nt, Pseudomonas aeruginosa PA01
uggucguucucgcgcauc

SEQ ID NO: 1466578 - RNA, 17 nt, Pseudomonas aeruginosa PA01
uggucgguucgucgagg

SEQ ID NO: 1466579 - RNA, 18 nt, Pseudomonas aeruginosa PA01
uggucggcuuccgccgcc

SEQ ID NO: 1466580 - RNA, 15 nt, Pseudomonas aeruginosa PA01
uggucgggauggcga

SEQ ID NO: 1466581 - RNA, 15 nt, Pseudomonas aeruginosa PA01
uggucggggccggcg

SEQ ID NO: 1466582 - RNA, 16 nt, Pseudomonas aeruginosa PA01
uggucggcgcggcgcu

SEQ ID NO: 1466583 - RNA, 20 nt, Pseudomonas aeruginosa PA01
uggucguugcgcgccagcgc

SEQ ID NO: 1466584 - RNA, 17 nt, Pseudomonas aeruginosa PA01
uggugacgguccgcgcc

SEQ ID NO: 1466585 - RNA, 18 nt, Pseudomonas aeruginosa PA01
uggugacgguccgcgcca

SEQ ID NO: 1466586 - RNA, 20 nt, Pseudomonas aeruginosa PA01
uggugacgguccgcgccacg

SEQ ID NO: 1466587 - RNA, 14 nt, Pseudomonas aeruginosa PA01
uguccaucagccgc

SEQ ID NO: 1466588 - RNA, 16 nt, Pseudomonas aeruginosa PA01
uguccaucagccgcgc

SEQ ID NO: 1466589 - RNA, 19 nt, Pseudomonas aeruginosa PA01
ugucccgaguaggcgcugc

SEQ ID NO: 1466590 - RNA, 14 nt, Pseudomonas aeruginosa PA01
uguccaggcgcugc

SEQ ID NO: 1466591 - RNA, 16 nt, Pseudomonas aeruginosa PA01
uguccaggcuguggcg

SEQ ID NO: 1466592 - RNA, 18 nt, Pseudomonas aeruginosa PA01
uguccaggcuguggcgcg

SEQ ID NO: 1466593 - RNA, 19 nt, Pseudomonas aeruginosa PA01
uguccaggcuguggcgcgg

SEQ ID NO: 1466594 - RNA, 20 nt, Pseudomonas aeruginosa PA01
uguccaggcuguggcgcggc

SEQ ID NO: 1466595 - RNA, 19 nt, Pseudomonas aeruginosa PA01
uguccagggcgaaccacuc

SEQ ID NO: 1466596 - RNA, 21 nt, Pseudomonas aeruginosa PA01
uguccagggcgaaccacucgg

SEQ ID NO: 1466597 - RNA, 22 nt, Pseudomonas aeruginosa PA01
uguccagcaccaucggguugau

SEQ ID NO: 1466598 - RNA, 19 nt, Pseudomonas aeruginosa PA01
ugucccggacgggugcgcg

SEQ ID NO: 1466599 - RNA, 17 nt, Pseudomonas aeruginosa PA01
uguccgaccacuucggc

SEQ ID NO: 1466600 - RNA, 13 nt, Pseudomonas aeruginosa PA01
uguccgaacgcga

SEQ ID NO: 1466601 - RNA, 21 nt, Pseudomonas aeruginosa PA01
uguccgagcaggucgcggaac

SEQ ID NO: 1466602 - RNA, 22 nt, Pseudomonas aeruginosa PA01
uguccgauucuuggcucggcag

SEQ ID NO: 1466603 - RNA, 14 nt, Pseudomonas aeruginosa PA01
uguccgcaggcagg

SEQ ID NO: 1466604 - RNA, 15 nt, Pseudomonas aeruginosa PA01
uguccgccgccgcgg

SEQ ID NO: 1466605 - RNA, 14 nt, Pseudomonas aeruginosa PA01
uguccgcgccacgg

SEQ ID NO: 1466606 - RNA, 17 nt, Pseudomonas aeruginosa PA01
uguccggcaccaccagc

SEQ ID NO: 1466607 - RNA, 16 nt, Pseudomonas aeruginosa PA01
uguccgggaugccggu

SEQ ID NO: 1466608 - RNA, 16 nt, Pseudomonas aeruginosa PA01
uguccggcgaccacca

SEQ ID NO: 1466609 - RNA, 16 nt, Pseudomonas aeruginosa PA01
uguccggcggcgauga

SEQ ID NO: 1466610 - RNA, 18 nt, Pseudomonas aeruginosa PA01
uguccggcggcugcugcg

SEQ ID NO: 1466611 - RNA, 16 nt, Pseudomonas aeruginosa PA01
uguccguugcgcagca

SEQ ID NO: 1466612 - RNA, 19 nt, Pseudomonas aeruginosa PA01
uguccuggauaagccgcgc

SEQ ID NO: 1466613 - RNA, 21 nt, Pseudomonas aeruginosa PA01
uguccuggcgcaugucgcgau

SEQ ID NO: 1466614 - RNA, 23 nt, Pseudomonas aeruginosa PA01
uguccugccgcaggcgggcgcca

SEQ ID NO: 1466615 - RNA, 18 nt, Pseudomonas aeruginosa PA01
ugucgcggacccgcgccg

SEQ ID NO: 1466616 - RNA, 16 nt, Pseudomonas aeruginosa PA01
ugucgcggcaggcggc

SEQ ID NO: 1466617 - RNA, 17 nt, Pseudomonas aeruginosa PA01
ugucgcggcaggcggcg

SEQ ID NO: 1466618 - RNA, 19 nt, Pseudomonas aeruginosa PA01
ugucgcggcaggcggcggc

SEQ ID NO: 1466619 - RNA, 23 nt, Pseudomonas aeruginosa PA01
ugucgcggcgcuuguagcccagg

SEQ ID NO: 1466620 - RNA, 14 nt, Pseudomonas aeruginosa PA01
ugucgcggcugacg

SEQ ID NO: 1466621 - RNA, 16 nt, Pseudomonas aeruginosa PA01
ugucgcggcugacgaa

SEQ ID NO: 1466622 - RNA, 14 nt, Pseudomonas aeruginosa PA01
ugucgcgguugccg

SEQ ID NO: 1466623 - RNA, 17 nt, Pseudomonas aeruginosa PA01
ugucgcgguugcgcugc

SEQ ID NO: 1466624 - RNA, 22 nt, Pseudomonas aeruginosa PA01
ugucgccggucaggcugcggcg

SEQ ID NO: 1466625 - RNA, 14 nt, Pseudomonas aeruginosa PA01
ugucgcagcggccg

SEQ ID NO: 1466626 - RNA, 16 nt, Pseudomonas aeruginosa PA01
ugucgauuucccccgg

SEQ ID NO: 1466627 - RNA, 17 nt, Pseudomonas aeruginosa PA01
ugucgauuucccccggu

SEQ ID NO: 1466628 - RNA, 23 nt, Pseudomonas aeruginosa PA01
ugucgauuucccccgguccggug

SEQ ID NO: 1466629 - RNA, 15 nt, Pseudomonas aeruginosa PA01
ugucgaagcgcaggu

SEQ ID NO: 1466630 - RNA, 19 nt, Pseudomonas aeruginosa PA01
ugucgaagcgcaggugcac

SEQ ID NO: 1466631 - RNA, 17 nt, Pseudomonas aeruginosa PA01
ugucgaccagcggcggu

SEQ ID NO: 1466632 - RNA, 20 nt, Pseudomonas aeruginosa PA01
ugucgaccauucccacgacc

SEQ ID NO: 1466633 - RNA, 23 nt, Pseudomonas aeruginosa PA01
ugucgaccauucccacgacccgc

SEQ ID NO: 1466634 - RNA, 16 nt, Pseudomonas aeruginosa PA01
ugucgaccuccgccgc

SEQ ID NO: 1466635 - RNA, 20 nt, Pseudomonas aeruginosa PA01
ugucgacgacgaaaggccgc

SEQ ID NO: 1466636 - RNA, 24 nt, Pseudomonas aeruginosa PA01
ugucgacgacgaaaggccgcgccg

SEQ ID NO: 1466637 - RNA, 14 nt, Pseudomonas aeruginosa PA01
uguccuucggccag

SEQ ID NO: 1466638 - RNA, 15 nt, Pseudomonas aeruginosa PA01
uguccggcccggagc

SEQ ID NO: 1466639 - RNA, 12 nt, Pseudomonas aeruginosa PA01
uguccuguggcg

SEQ ID NO: 1466640 - RNA, 13 nt, Pseudomonas aeruginosa PA01
uguccuuguucgg

SEQ ID NO: 1466641 - RNA, 17 nt, Pseudomonas aeruginosa PA01
uguccuuguucggcugg

SEQ ID NO: 1466642 - RNA, 19 nt, Pseudomonas aeruginosa PA01
uguccuuguucggcuggac

SEQ ID NO: 1466643 - RNA, 16 nt, Pseudomonas aeruginosa PA01
ugucgauaccagcgcc

SEQ ID NO: 1466644 - RNA, 23 nt, Pseudomonas aeruginosa PA01
ugucgagggucugcucgacgauc

SEQ ID NO: 1466645 - RNA, 22 nt, Pseudomonas aeruginosa PA01
ugucgaucaggaacgcgccacg

SEQ ID NO: 1466646 - RNA, 15 nt, Pseudomonas aeruginosa PA01
ugucgaugcgcccgc

SEQ ID NO: 1466647 - RNA, 14 nt, Pseudomonas aeruginosa PA01
ugucgaugggcagg

SEQ ID NO: 1466648 - RNA, 13 nt, Pseudomonas aeruginosa PA01
ugucgaugggcga

SEQ ID NO: 1466649 - RNA, 17 nt, Pseudomonas aeruginosa PA01
ugucgaugggcgacagc

SEQ ID NO: 1466650 - RNA, 14 nt, Pseudomonas aeruginosa PA01
ugguucucggucgg

SEQ ID NO: 1466651 - RNA, 13 nt, Pseudomonas aeruginosa PA01
ugguugaacucgc

SEQ ID NO: 1466652 - RNA, 13 nt, Pseudomonas aeruginosa PA01
ugguugaggcgcu

SEQ ID NO: 1466653 - RNA, 22 nt, Pseudomonas aeruginosa PA01
ugucagggcuugcgcgccacca

SEQ ID NO: 1466654 - RNA, 14 nt, Pseudomonas aeruginosa PA01
ugucagggguugca

SEQ ID NO: 1466655 - RNA, 14 nt, Pseudomonas aeruginosa PA01
uguccaccaccagc

SEQ ID NO: 1466656 - RNA, 15 nt, Pseudomonas aeruginosa PA01
uguccaccggcccgg

SEQ ID NO: 1466657 - RNA, 16 nt, Pseudomonas aeruginosa PA01
uguccaccgccgccag

SEQ ID NO: 1466658 - RNA, 15 nt, Pseudomonas aeruginosa PA01
ugcgcgaagccagga

SEQ ID NO: 1466659 - RNA, 17 nt, Pseudomonas aeruginosa PA01
ugcgcgagcaccgcgca

SEQ ID NO: 1466660 - RNA, 20 nt, Pseudomonas aeruginosa PA01
ugcgcgagcaccgcgcagac

SEQ ID NO: 1466661 - RNA, 21 nt, Pseudomonas aeruginosa PA01
ugcgcgagcaccgcgcagacc

SEQ ID NO: 1466662 - RNA, 21 nt, Pseudomonas aeruginosa PA01
ugcgccugcuucagcccggca

SEQ ID NO: 1466663 - RNA, 15 nt, Pseudomonas aeruginosa PA01
ugcgccuggccgcgc

SEQ ID NO: 1466664 - RNA, 16 nt, Pseudomonas aeruginosa PA01
ugcgccuggccgcgca

SEQ ID NO: 1466665 - RNA, 13 nt, Pseudomonas aeruginosa PA01
ugcgccgcucgcg

SEQ ID NO: 1466666 - RNA, 15 nt, Pseudomonas aeruginosa PA01
ugcgccgcucgcgca

SEQ ID NO: 1466667 - RNA, 22 nt, Pseudomonas aeruginosa PA01
ugcgccgcucgcgcacggcgaa

SEQ ID NO: 1466668 - RNA, 18 nt, Pseudomonas aeruginosa PA01
ugcgccggcaucgccaug

SEQ ID NO: 1466669 - RNA, 14 nt, Pseudomonas aeruginosa PA01
ugcgccggcccagc

SEQ ID NO: 1466670 - RNA, 22 nt, Pseudomonas aeruginosa PA01
ugcgccggcccagcaggccggc

SEQ ID NO: 1466671 - RNA, 22 nt, Pseudomonas aeruginosa PA01
ugcgccucgcuggcguucucca

SEQ ID NO: 1466672 - RNA, 20 nt, Pseudomonas aeruginosa PA01
ugcgccucggcccuggcggc

SEQ ID NO: 1466673 - RNA, 21 nt, Pseudomonas aeruginosa PA01
ugcgccgcggcguugcgcgga

SEQ ID NO: 1466674 - RNA, 19 nt, Pseudomonas aeruginosa PA01
ugcgccgcgggucaccagc

SEQ ID NO: 1466675 - RNA, 14 nt, Pseudomonas aeruginosa PA01
ugcgccgcagcggc

SEQ ID NO: 1466676 - RNA, 16 nt, Pseudomonas aeruginosa PA01
ugcgccgcagcggcca

SEQ ID NO: 1466677 - RNA, 22 nt, Pseudomonas aeruginosa PA01
ugcgccgccacgugcacgccgu

SEQ ID NO: 1466678 - RNA, 13 nt, Pseudomonas aeruginosa PA01
ugcgccgccggcu

SEQ ID NO: 1466679 - RNA, 14 nt, Pseudomonas aeruginosa PA01
ugcgcaugcgcagc

SEQ ID NO: 1466680 - RNA, 19 nt, Pseudomonas aeruginosa PA01
ugcgcaugucguccaggcu

SEQ ID NO: 1466681 - RNA, 14 nt, Pseudomonas aeruginosa PA01
ugcgcaucugcgcg

SEQ ID NO: 1466682 - RNA, 15 nt, Pseudomonas aeruginosa PA01
ugcgcaucaggucgg

SEQ ID NO: 1466683 - RNA, 16 nt, Pseudomonas aeruginosa PA01
ugcgcaucaggucggu

SEQ ID NO: 1466684 - RNA, 16 nt, Pseudomonas aeruginosa PA01
ugcgcaucgccugggc

SEQ ID NO: 1466685 - RNA, 14 nt, Pseudomonas aeruginosa PA01
ugcgcgcggccugu

SEQ ID NO: 1466686 - RNA, 19 nt, Pseudomonas aeruginosa PA01
ugcgcgcggccuguucggc

SEQ ID NO: 1466687 - RNA, 21 nt, Pseudomonas aeruginosa PA01
ugcgcgcgcagauaaggcgug

SEQ ID NO: 1466688 - RNA, 20 nt, Pseudomonas aeruginosa PA01
ugcgcgccauuccgcggcac

SEQ ID NO: 1466689 - RNA, 20 nt, Pseudomonas aeruginosa PA01
ugcgcgcggcgagggcgccg

SEQ ID NO: 1466690 - RNA, 18 nt, Pseudomonas aeruginosa PA01
ugcgcgcggcccaccaga

SEQ ID NO: 1466691 - RNA, 18 nt, Pseudomonas aeruginosa PA01
ugcgcggccugcgccgga

SEQ ID NO: 1466692 - RNA, 13 nt, Pseudomonas aeruginosa PA01
ugcgcggcagcag

SEQ ID NO: 1466693 - RNA, 22 nt, Pseudomonas aeruginosa PA01
ugcgcggcagcaggcgggcgaa

SEQ ID NO: 1466694 - RNA, 17 nt, Pseudomonas aeruginosa PA01
ugcgcggcaggaucagg

SEQ ID NO: 1466695 - RNA, 21 nt, Pseudomonas aeruginosa PA01
ugcgcggcagguggcuggcca

SEQ ID NO: 1466696 - RNA, 16 nt, Pseudomonas aeruginosa PA01
ugcgcgaguggaugaa

SEQ ID NO: 1466697 - RNA, 18 nt, Pseudomonas aeruginosa PA01
ugcgcgcaguaggcgcug

SEQ ID NO: 1466698 - RNA, 12 nt, Pseudomonas aeruginosa PA01
ugcgcgccacca

SEQ ID NO: 1466699 - RNA, 13 nt, Pseudomonas aeruginosa PA01
ugcgcgccaccac

SEQ ID NO: 1466700 - RNA, 23 nt, Pseudomonas aeruginosa PA01
ugcgcgccaccaccgucacggcg

SEQ ID NO: 1466701 - RNA, 14 nt, Pseudomonas aeruginosa PA01
ugcgcgccaccagc

SEQ ID NO: 1466702 - RNA, 15 nt, Pseudomonas aeruginosa PA01
ugcgcgccaccagcg

SEQ ID NO: 1466703 - RNA, 18 nt, Pseudomonas aeruginosa PA01
ugcgcgccaucuccucgc

SEQ ID NO: 1466704 - RNA, 13 nt, Pseudomonas aeruginosa PA01
ugcgcgccagggc

SEQ ID NO: 1466705 - RNA, 18 nt, Pseudomonas aeruginosa PA01
ugcgcgccagcgccacgg

SEQ ID NO: 1466706 - RNA, 20 nt, Pseudomonas aeruginosa PA01
ugcgcgccagcgccacggcg

SEQ ID NO: 1466707 - RNA, 22 nt, Pseudomonas aeruginosa PA01
ugcgcgccagcgccacggcgau

SEQ ID NO: 1466708 - RNA, 14 nt, Pseudomonas aeruginosa PA01
ugcgcgccucuucc

SEQ ID NO: 1466709 - RNA, 13 nt, Pseudomonas aeruginosa PA01
ugcgcgccggguc

SEQ ID NO: 1466710 - RNA, 16 nt, Pseudomonas aeruginosa PA01
ugcgcgccgccgggcg

SEQ ID NO: 1466711 - RNA, 22 nt, Pseudomonas aeruginosa PA01
ugcgcgccgccgggcgcccggc

SEQ ID NO: 1466712 - RNA, 13 nt, Pseudomonas aeruginosa PA01
ugcgcgcccuagg

SEQ ID NO: 1466713 - RNA, 19 nt, Pseudomonas aeruginosa PA01
ugcgcgcccuaggguuccg

SEQ ID NO: 1466714 - RNA, 14 nt, Pseudomonas aeruginosa PA01
ugcgcgcccugacg

SEQ ID NO: 1466715 - RNA, 18 nt, Pseudomonas aeruginosa PA01
ugcgcggcguucgcccug

SEQ ID NO: 1466716 - RNA, 19 nt, Pseudomonas aeruginosa PA01
ugcgcggcguucgcccugc

SEQ ID NO: 1466717 - RNA, 20 nt, Pseudomonas aeruginosa PA01
ugcgcggcguucgcccugcg

SEQ ID NO: 1466718 - RNA, 22 nt, Pseudomonas aeruginosa PA01
ugcgcggcguucgcccugcgga

SEQ ID NO: 1466719 - RNA, 13 nt, Pseudomonas aeruginosa PA01
ugcgcgggcaugc

SEQ ID NO: 1466720 - RNA, 14 nt, Pseudomonas aeruginosa PA01
ugcgcggcgccggu

SEQ ID NO: 1466721 - RNA, 21 nt, Pseudomonas aeruginosa PA01
ugcgcgggugucgcgacggug

SEQ ID NO: 1466722 - RNA, 17 nt, Pseudomonas aeruginosa PA01
ugcgcgggguaggggug

SEQ ID NO: 1466723 - RNA, 17 nt, Pseudomonas aeruginosa PA01
ugcgcguggcgucggcg

SEQ ID NO: 1466724 - RNA, 22 nt, Pseudomonas aeruginosa PA01
ugcgcuccacccaggcgccgau

SEQ ID NO: 1466725 - RNA, 19 nt, Pseudomonas aeruginosa PA01
ugcgcuccuuggcuggcca

SEQ ID NO: 1466726 - RNA, 15 nt, Pseudomonas aeruginosa PA01
ugcgcuccgccaggc

SEQ ID NO: 1466727 - RNA, 18 nt, Pseudomonas aeruginosa PA01
ugcgcuccgccaggccgc

SEQ ID NO: 1466728 - RNA, 20 nt, Pseudomonas aeruginosa PA01
ugcgcuccgccaggccgcgc

SEQ ID NO: 1466729 - RNA, 14 nt, Pseudomonas aeruginosa PA01
ugcgcugcaucggc

SEQ ID NO: 1466730 - RNA, 14 nt, Pseudomonas aeruginosa PA01
ugcgcugccagcgc

SEQ ID NO: 1466731 - RNA, 18 nt, Pseudomonas aeruginosa PA01
ugcgcugccagcgccgcc

SEQ ID NO: 1466732 - RNA, 13 nt, Pseudomonas aeruginosa PA01
ugcgcucggcgcu

SEQ ID NO: 1466733 - RNA, 12 nt, Pseudomonas aeruginosa PA01
ugcgcucgcgga

SEQ ID NO: 1466734 - RNA, 15 nt, Pseudomonas aeruginosa PA01
ugcgcugagcaggac

SEQ ID NO: 1466735 - RNA, 16 nt, Pseudomonas aeruginosa PA01
ugcgcugagcaggacc

SEQ ID NO: 1466736 - RNA, 22 nt, Pseudomonas aeruginosa PA01
ugcggacuaccuucgaucaccc

SEQ ID NO: 1466737 - RNA, 16 nt, Pseudomonas aeruginosa PA01
ugcggaccacagggca

SEQ ID NO: 1466738 - RNA, 15 nt, Pseudomonas aeruginosa PA01
ugcgcuguuccgccg

SEQ ID NO: 1466739 - RNA, 17 nt, Pseudomonas aeruginosa PA01
ugcgcuguuccgccgug

SEQ ID NO: 1466740 - RNA, 12 nt, Pseudomonas aeruginosa PA01
ugcgcuggcgcc

SEQ ID NO: 1466741 - RNA, 14 nt, Pseudomonas aeruginosa PA01
ugcgcuggcgccag

SEQ ID NO: 1466742 - RNA, 12 nt, Pseudomonas aeruginosa PA01
ugcgcuggaagu

SEQ ID NO: 1466743 - RNA, 13 nt, Pseudomonas aeruginosa PA01
ugcgcuggccggc

SEQ ID NO: 1466744 - RNA, 14 nt, Pseudomonas aeruginosa PA01
ugcgcuggccggca

SEQ ID NO: 1466745 - RNA, 16 nt, Pseudomonas aeruginosa PA01
ugcgcugggcgccgau

SEQ ID NO: 1466746 - RNA, 13 nt, Pseudomonas aeruginosa PA01
ugcggcagacgug

SEQ ID NO: 1466747 - RNA, 20 nt, Pseudomonas aeruginosa PA01
ugcggcagacgugcugguag

SEQ ID NO: 1466748 - RNA, 12 nt, Pseudomonas aeruginosa PA01
ugcggcagcagg

SEQ ID NO: 1466749 - RNA, 22 nt, Pseudomonas aeruginosa PA01
ugcggaucaacuccgccaggcg

SEQ ID NO: 1466750 - RNA, 18 nt, Pseudomonas aeruginosa PA01
ugcggagggucaggccga

SEQ ID NO: 1466751 - RNA, 19 nt, Pseudomonas aeruginosa PA01
ugcggagggucaggccgag

SEQ ID NO: 1466752 - RNA, 22 nt, Pseudomonas aeruginosa PA01
ugcggagggucaggccgagggc

SEQ ID NO: 1466753 - RNA, 15 nt, Pseudomonas aeruginosa PA01
ugcggcaguccucgc

SEQ ID NO: 1466754 - RNA, 15 nt, Pseudomonas aeruginosa PA01
ugcggcaugaugcgc

SEQ ID NO: 1466755 - RNA, 13 nt, Pseudomonas aeruginosa PA01
ugcggcccaccac

SEQ ID NO: 1466756 - RNA, 21 nt, Pseudomonas aeruginosa PA01
ugcggccccaaggggccgcgc

SEQ ID NO: 1466757 - RNA, 20 nt, Pseudomonas aeruginosa PA01
ugcggccagcgccaggagca

SEQ ID NO: 1466758 - RNA, 22 nt, Pseudomonas aeruginosa PA01
ugcggccagcgccaggagcagg

SEQ ID NO: 1466759 - RNA, 14 nt, Pseudomonas aeruginosa PA01
ugccgcgcucggau

SEQ ID NO: 1466760 - RNA, 13 nt, Pseudomonas aeruginosa PA01
ugccgcgcgggcc

SEQ ID NO: 1466761 - RNA, 18 nt, Pseudomonas aeruginosa PA01
ugccgcgcgggccggcga

SEQ ID NO: 1466762 - RNA, 21 nt, Pseudomonas aeruginosa PA01
ugccgcgccaggcgcaguagg

SEQ ID NO: 1466763 - RNA, 16 nt, Pseudomonas aeruginosa PA01
ugccgcgcccggccag

SEQ ID NO: 1466764 - RNA, 17 nt, Pseudomonas aeruginosa PA01
ugccgcgcccggccagg

SEQ ID NO: 1466765 - RNA, 12 nt, Pseudomonas aeruginosa PA01
ugccgcgccgga

SEQ ID NO: 1466766 - RNA, 14 nt, Pseudomonas aeruginosa PA01
ugccgcgccggaag

SEQ ID NO: 1466767 - RNA, 14 nt, Pseudomonas aeruginosa PA01
ugccgcgcgccugg

SEQ ID NO: 1466768 - RNA, 21 nt, Pseudomonas aeruginosa PA01
ugccgcgcgccuggcuggcca

SEQ ID NO: 1466769 - RNA, 20 nt, Pseudomonas aeruginosa PA01
ugccgcggacggcacggggc

SEQ ID NO: 1466770 - RNA, 21 nt, Pseudomonas aeruginosa PA01
ugccgcggauacggcaggggc

SEQ ID NO: 1466771 - RNA, 15 nt, Pseudomonas aeruginosa PA01
ugccgcggaugacgg

SEQ ID NO: 1466772 - RNA, 21 nt, Pseudomonas aeruginosa PA01
ugccgcgggcuauucccgccg

SEQ ID NO: 1466773 - RNA, 15 nt, Pseudomonas aeruginosa PA01
ugccgcggguagcgu

SEQ ID NO: 1466774 - RNA, 16 nt, Pseudomonas aeruginosa PA01
ugccguacagcccccg

SEQ ID NO: 1466775 - RNA, 21 nt, Pseudomonas aeruginosa PA01
ugccguacaggucggcgccgg

SEQ ID NO: 1466776 - RNA, 23 nt, Pseudomonas aeruginosa PA01
ugccguacaggucggcgccggug

SEQ ID NO: 1466777 - RNA, 18 nt, Pseudomonas aeruginosa PA01
ugccguacucauggccgc

SEQ ID NO: 1466778 - RNA, 24 nt, Pseudomonas aeruginosa PA01
ugccguacucauggccgcagcggc

SEQ ID NO: 1466779 - RNA, 22 nt, Pseudomonas aeruginosa PA01
ugccguacuugaaggugcccag

SEQ ID NO: 1466780 - RNA, 16 nt, Pseudomonas aeruginosa PA01
ugccguauccgcggca

SEQ ID NO: 1466781 - RNA, 21 nt, Pseudomonas aeruginosa PA01
ugccguauccgcggcaggggc

SEQ ID NO: 1466782 - RNA, 14 nt, Pseudomonas aeruginosa PA01
ugccguggcucggc

SEQ ID NO: 1466783 - RNA, 19 nt, Pseudomonas aeruginosa PA01
ugccguggcucggcggcag

SEQ ID NO: 1466784 - RNA, 14 nt, Pseudomonas aeruginosa PA01
ugccgugggcgccg

SEQ ID NO: 1466785 - RNA, 15 nt, Pseudomonas aeruginosa PA01
ugccgugggcgccgc

SEQ ID NO: 1466786 - RNA, 20 nt, Pseudomonas aeruginosa PA01
ugccguggucgcgcaggcgg

SEQ ID NO: 1466787 - RNA, 16 nt, Pseudomonas aeruginosa PA01
ugccguggcggcgcgc

SEQ ID NO: 1466788 - RNA, 18 nt, Pseudomonas aeruginosa PA01
ugccguggcggcgcgcgu

SEQ ID NO: 1466789 - RNA, 17 nt, Pseudomonas aeruginosa PA01
ugccguccagccggcgc

SEQ ID NO: 1466790 - RNA, 13 nt, Pseudomonas aeruginosa PA01
ugccguccaggcg

SEQ ID NO: 1466791 - RNA, 15 nt, Pseudomonas aeruginosa PA01
ugccguccaggcgcg

SEQ ID NO: 1466792 - RNA, 16 nt, Pseudomonas aeruginosa PA01
ugccguuggccgagcg

SEQ ID NO: 1466793 - RNA, 14 nt, Pseudomonas aeruginosa PA01
ugccguugaugucg

SEQ ID NO: 1466794 - RNA, 13 nt, Pseudomonas aeruginosa PA01
ugccguugcacga

SEQ ID NO: 1466795 - RNA, 17 nt, Pseudomonas aeruginosa PA01
ugccguucucccgcgcg

SEQ ID NO: 1466796 - RNA, 15 nt, Pseudomonas aeruginosa PA01
ugccguugggccagg

SEQ ID NO: 1466797 - RNA, 20 nt, Pseudomonas aeruginosa PA01
ugccguuguggcaggcgcug

SEQ ID NO: 1466798 - RNA, 21 nt, Pseudomonas aeruginosa PA01
ugccguuguggcaggcgcugc

SEQ ID NO: 1466799 - RNA, 17 nt, Pseudomonas aeruginosa PA01
ugccguucugugcggcg

SEQ ID NO: 1466800 - RNA, 20 nt, Pseudomonas aeruginosa PA01
ugccguucugugcggcgaug

SEQ ID NO: 1466801 - RNA, 23 nt, Pseudomonas aeruginosa PA01
ugccguucugugcggcgaugucg

SEQ ID NO: 1466802 - RNA, 19 nt, Pseudomonas aeruginosa PA01
ugccucagagucgcaccgg

SEQ ID NO: 1466803 - RNA, 15 nt, Pseudomonas aeruginosa PA01
ugccucccggccauu

SEQ ID NO: 1466804 - RNA, 13 nt, Pseudomonas aeruginosa PA01
ugccucgccgagg

SEQ ID NO: 1466805 - RNA, 15 nt, Pseudomonas aeruginosa PA01
ugccucgccgaggcg

SEQ ID NO: 1466806 - RNA, 15 nt, Pseudomonas aeruginosa PA01
ugccucggcggcggc

SEQ ID NO: 1466807 - RNA, 16 nt, Pseudomonas aeruginosa PA01
ugccugcaccacgcag

SEQ ID NO: 1466808 - RNA, 18 nt, Pseudomonas aeruginosa PA01
ugccugcaccacgcaggc

SEQ ID NO: 1466809 - RNA, 22 nt, Pseudomonas aeruginosa PA01
ugccugcaccacgcaggcgcgu

SEQ ID NO: 1466810 - RNA, 17 nt, Pseudomonas aeruginosa PA01
ugccugcaccgggccga

SEQ ID NO: 1466811 - RNA, 15 nt, Pseudomonas aeruginosa PA01
ugcgcagccacccgc

SEQ ID NO: 1466812 - RNA, 16 nt, Pseudomonas aeruginosa PA01
ugcgcagcuaggcgag

SEQ ID NO: 1466813 - RNA, 19 nt, Pseudomonas aeruginosa PA01
ugcgcagcuucugcagggc

SEQ ID NO: 1466814 - RNA, 12 nt, Pseudomonas aeruginosa PA01
ugcgcagcagcg

SEQ ID NO: 1466815 - RNA, 14 nt, Pseudomonas aeruginosa PA01
ugcgcagcagcguc

SEQ ID NO: 1466816 - RNA, 12 nt, Pseudomonas aeruginosa PA01
ugcgcaggucgc

SEQ ID NO: 1466817 - RNA, 18 nt, Pseudomonas aeruginosa PA01
ugcgcaggucgcgacagg

SEQ ID NO: 1466818 - RNA, 22 nt, Pseudomonas aeruginosa PA01
ugcgcaggugcuugucacgcuc

SEQ ID NO: 1466819 - RNA, 17 nt, Pseudomonas aeruginosa PA01
ugcgcaggccgagaagg

SEQ ID NO: 1466820 - RNA, 22 nt, Pseudomonas aeruginosa PA01
ugcgcagggcgucgaaggcggc

SEQ ID NO: 1466821 - RNA, 23 nt, Pseudomonas aeruginosa PA01
ugcgcagggcgucgaaggcggcg

SEQ ID NO: 1466822 - RNA, 20 nt, Pseudomonas aeruginosa PA01
ugcgcagggcuuccuuggcg

SEQ ID NO: 1466823 - RNA, 19 nt, Pseudomonas aeruginosa PA01
ugcgcaggggcgcggcgcg

SEQ ID NO: 1466824 - RNA, 20 nt, Pseudomonas aeruginosa PA01
ugcgcaggggcgcggcgcgg

SEQ ID NO: 1466825 - RNA, 21 nt, Pseudomonas aeruginosa PA01
ugcgcaggggcgcggcgcgga

SEQ ID NO: 1466826 - RNA, 20 nt, Pseudomonas aeruginosa PA01
ugcgcaggcgcucgcgggcc

SEQ ID NO: 1466827 - RNA, 15 nt, Pseudomonas aeruginosa PA01
ugcgcaggcgguagg

SEQ ID NO: 1466828 - RNA, 22 nt, Pseudomonas aeruginosa PA01
ugcgcaggcguuccucgacgaa

SEQ ID NO: 1466829 - RNA, 18 nt, Pseudomonas aeruginosa PA01
ugcgcaggcuggccgagc

SEQ ID NO: 1466830 - RNA, 19 nt, Pseudomonas aeruginosa PA01
ugcgcaggcuggccgagcg

SEQ ID NO: 1466831 - RNA, 13 nt, Pseudomonas aeruginosa PA01
ugcgcagggcggc

SEQ ID NO: 1466832 - RNA, 12 nt, Pseudomonas aeruginosa PA01
ugcgaucgagga

SEQ ID NO: 1466833 - RNA, 21 nt, Pseudomonas aeruginosa PA01
ugcgaggcccguauggcgggc

SEQ ID NO: 1466834 - RNA, 22 nt, Pseudomonas aeruginosa PA01
aauagggcggcgccaccgcgac

SEQ ID NO: 1466835 - RNA, 15 nt, Pseudomonas aeruginosa PA01
ugcgcagcaacgcga

SEQ ID NO: 1466836 - RNA, 21 nt, Pseudomonas aeruginosa PA01
ugcgcagcaacuggucgccgc

SEQ ID NO: 1466837 - RNA, 18 nt, Pseudomonas aeruginosa PA01
ugcgacaucuccaggccg

SEQ ID NO: 1466838 - RNA, 20 nt, Pseudomonas aeruginosa PA01
ugcgacaucuccaggccgcu

SEQ ID NO: 1466839 - RNA, 20 nt, Pseudomonas aeruginosa PA01
ugccuggcagguccgacgga

SEQ ID NO: 1466840 - RNA, 12 nt, Pseudomonas aeruginosa PA01
ugccuggaaaaa

SEQ ID NO: 1466841 - RNA, 23 nt, Pseudomonas aeruginosa PA01
ugccuggaaguauucggcgggaa

SEQ ID NO: 1466842 - RNA, 20 nt, Pseudomonas aeruginosa PA01
ugccugcuguguccggcgga

SEQ ID NO: 1466843 - RNA, 15 nt, Pseudomonas aeruginosa PA01
ugccugcuucagguc

SEQ ID NO: 1466844 - RNA, 18 nt, Pseudomonas aeruginosa PA01
ugcgacgcacaccgucga

SEQ ID NO: 1466845 - RNA, 19 nt, Pseudomonas aeruginosa PA01
ugcgaggcggugcagcgga

SEQ ID NO: 1466846 - RNA, 15 nt, Pseudomonas aeruginosa PA01
ugcgaggcgucgauc

SEQ ID NO: 1466847 - RNA, 14 nt, Pseudomonas aeruginosa PA01
ugcgaggcuggccu

SEQ ID NO: 1466848 - RNA, 22 nt, Pseudomonas aeruginosa PA01
ugcgagggauguuccaggcccg

SEQ ID NO: 1466849 - RNA, 18 nt, Pseudomonas aeruginosa PA01
ugcgagggcucgggcgcg

SEQ ID NO: 1466850 - RNA, 20 nt, Pseudomonas aeruginosa PA01
ugcgagggcucgggcgcgga

SEQ ID NO: 1466851 - RNA, 24 nt, Pseudomonas aeruginosa PA01
ugcgagggcucgggcgcggacaag

SEQ ID NO: 1466852 - RNA, 23 nt, Pseudomonas aeruginosa PA01
ugcgaguaguagcguuccuggcg

SEQ ID NO: 1466853 - RNA, 20 nt, Pseudomonas aeruginosa PA01
ugcgagucaccccgaccagc

SEQ ID NO: 1466854 - RNA, 21 nt, Pseudomonas aeruginosa PA01
ugcgagucaccccgaccagcg

SEQ ID NO: 1466855 - RNA, 16 nt, Pseudomonas aeruginosa PA01
ugcgauagaccaggaa

SEQ ID NO: 1466856 - RNA, 16 nt, Pseudomonas aeruginosa PA01
ugcgauauggccgauc

SEQ ID NO: 1466857 - RNA, 17 nt, Pseudomonas aeruginosa PA01
ugcgaucagggccucgc

SEQ ID NO: 1466858 - RNA, 13 nt, Pseudomonas aeruginosa PA01
uggcaggcgcccg

SEQ ID NO: 1466859 - RNA, 14 nt, Pseudomonas aeruginosa PA01
uggcaggcgcccgg

SEQ ID NO: 1466860 - RNA, 15 nt, Pseudomonas aeruginosa PA01
uggcaggcgcccggu

SEQ ID NO: 1466861 - RNA, 21 nt, Pseudomonas aeruginosa PA01
uggcagguugauccugggcgc

SEQ ID NO: 1466862 - RNA, 19 nt, Pseudomonas aeruginosa PA01
uggcagguugcacggccgg

SEQ ID NO: 1466863 - RNA, 20 nt, Pseudomonas aeruginosa PA01
uggcagguugcacggccggu

SEQ ID NO: 1466864 - RNA, 15 nt, Pseudomonas aeruginosa PA01
uggcagaacaucgcc

SEQ ID NO: 1466865 - RNA, 23 nt, Pseudomonas aeruginosa PA01
uggcagcgccguugccgaugccg

SEQ ID NO: 1466866 - RNA, 15 nt, Pseudomonas aeruginosa PA01
uggcagagcuggaag

SEQ ID NO: 1466867 - RNA, 13 nt, Pseudomonas aeruginosa PA01
uggcacgcagggc

SEQ ID NO: 1466868 - RNA, 14 nt, Pseudomonas aeruginosa PA01
uggcacggccggcg

SEQ ID NO: 1466869 - RNA, 13 nt, Pseudomonas aeruginosa PA01
uggcaacggcggg

SEQ ID NO: 1466870 - RNA, 19 nt, Pseudomonas aeruginosa PA01
uggcaaucaucgcgucgcc

SEQ ID NO: 1466871 - RNA, 21 nt, Pseudomonas aeruginosa PA01
uggcaacugcguccgaugucg

SEQ ID NO: 1466872 - RNA, 15 nt, Pseudomonas aeruginosa PA01
uggcacccaggccac

SEQ ID NO: 1466873 - RNA, 17 nt, Pseudomonas aeruginosa PA01
uggcacccaggccacgc

SEQ ID NO: 1466874 - RNA, 19 nt, Pseudomonas aeruginosa PA01
uggcacccuggacccgggc

SEQ ID NO: 1466875 - RNA, 20 nt, Pseudomonas aeruginosa PA01
uggcaccgucaagggccagg

SEQ ID NO: 1466876 - RNA, 17 nt, Pseudomonas aeruginosa PA01
uggcacgaacccaggcg

SEQ ID NO: 1466877 - RNA, 19 nt, Pseudomonas aeruginosa PA01
uggcacgacgcucggacag

SEQ ID NO: 1466878 - RNA, 13 nt, Pseudomonas aeruginosa PA01
uggcaccgcgcag

SEQ ID NO: 1466879 - RNA, 13 nt, Pseudomonas aeruginosa PA01
uggcaccggccag

SEQ ID NO: 1466880 - RNA, 16 nt, Pseudomonas aeruginosa PA01
uggcaccggccaggcg

SEQ ID NO: 1466881 - RNA, 18 nt, Pseudomonas aeruginosa PA01
uggcaccggccaggcgcu

SEQ ID NO: 1466882 - RNA, 20 nt, Pseudomonas aeruginosa PA01
uggauucguugaggcccauc

SEQ ID NO: 1466883 - RNA, 18 nt, Pseudomonas aeruginosa PA01
uggauugcagcgucgacg

SEQ ID NO: 1466884 - RNA, 18 nt, Pseudomonas aeruginosa PA01
uggcaaccgucgaacagg

SEQ ID NO: 1466885 - RNA, 15 nt, Pseudomonas aeruginosa PA01
uggauguucgccgcc

SEQ ID NO: 1466886 - RNA, 16 nt, Pseudomonas aeruginosa PA01
uggauguucgccgcca

SEQ ID NO: 1466887 - RNA, 15 nt, Pseudomonas aeruginosa PA01
uggauguugccgccg

SEQ ID NO: 1466888 - RNA, 17 nt, Pseudomonas aeruginosa PA01
uggaugaccacgucgcg

SEQ ID NO: 1466889 - RNA, 18 nt, Pseudomonas aeruginosa PA01
uggaugcagccgauggcg

SEQ ID NO: 1466890 - RNA, 19 nt, Pseudomonas aeruginosa PA01
uggaugcagccggggcuca

SEQ ID NO: 1466891 - RNA, 13 nt, Pseudomonas aeruginosa PA01
uggaugccgacca

SEQ ID NO: 1466892 - RNA, 15 nt, Pseudomonas aeruginosa PA01
uggaugccgguggcg

SEQ ID NO: 1466893 - RNA, 15 nt, Pseudomonas aeruginosa PA01
uggaugcgcggcagg

SEQ ID NO: 1466894 - RNA, 16 nt, Pseudomonas aeruginosa PA01
uggaugcgcggcaggu

SEQ ID NO: 1466895 - RNA, 17 nt, Pseudomonas aeruginosa PA01
uggaugcuccgcgccuc

SEQ ID NO: 1466896 - RNA, 14 nt, Pseudomonas aeruginosa PA01
uggauaggcggcgg

SEQ ID NO: 1466897 - RNA, 22 nt, Pseudomonas aeruginosa PA01
uggaucaccgccaaggccucgg

SEQ ID NO: 1466898 - RNA, 16 nt, Pseudomonas aeruginosa PA01
uggaucaccgcggcgc

SEQ ID NO: 1466899 - RNA, 19 nt, Pseudomonas aeruginosa PA01
uggaucaccgcggcgcuga

SEQ ID NO: 1466900 - RNA, 21 nt, Pseudomonas aeruginosa PA01
uggaucaugggugaagaccag

SEQ ID NO: 1466901 - RNA, 13 nt, Pseudomonas aeruginosa PA01
uggaucgccaggc

SEQ ID NO: 1466902 - RNA, 20 nt, Pseudomonas aeruginosa PA01
uggaucgcccgaacgccgac

SEQ ID NO: 1466903 - RNA, 18 nt, Pseudomonas aeruginosa PA01
uggaucggccucgcggcg

SEQ ID NO: 1466904 - RNA, 12 nt, Pseudomonas aeruginosa PA01
uggaucgcggcg

SEQ ID NO: 1466905 - RNA, 20 nt, Pseudomonas aeruginosa PA01
uggaucgcggcguaggcgcg

SEQ ID NO: 1466906 - RNA, 12 nt, Pseudomonas aeruginosa PA01
uggaucucggcg

SEQ ID NO: 1466907 - RNA, 16 nt, Pseudomonas aeruginosa PA01
uggaugaaacgggcga

SEQ ID NO: 1466908 - RNA, 19 nt, Pseudomonas aeruginosa PA01
uggaugaacgugucgacga

SEQ ID NO: 1466909 - RNA, 15 nt, Pseudomonas aeruginosa PA01
uggacgucgucggcg

SEQ ID NO: 1466910 - RNA, 17 nt, Pseudomonas aeruginosa PA01
uggacggucucgccgcc

SEQ ID NO: 1466911 - RNA, 14 nt, Pseudomonas aeruginosa PA01
uggacucgcgccag

SEQ ID NO: 1466912 - RNA, 14 nt, Pseudomonas aeruginosa PA01
uggacuugucgaag

SEQ ID NO: 1466913 - RNA, 14 nt, Pseudomonas aeruginosa PA01
uggagaagaucgcc

SEQ ID NO: 1466914 - RNA, 12 nt, Pseudomonas aeruginosa PA01
uggagaugccga

SEQ ID NO: 1466915 - RNA, 18 nt, Pseudomonas aeruginosa PA01
uggagaugcucaggcgcu

SEQ ID NO: 1466916 - RNA, 19 nt, Pseudomonas aeruginosa PA01
uggagaugcucaggcgcug

SEQ ID NO: 1466917 - RNA, 20 nt, Pseudomonas aeruginosa PA01
uggagaugcucaggcgcugc

SEQ ID NO: 1466918 - RNA, 13 nt, Pseudomonas aeruginosa PA01
uggagaggucgcc

SEQ ID NO: 1466919 - RNA, 16 nt, Pseudomonas aeruginosa PA01
uggagaggucgccgac

SEQ ID NO: 1466920 - RNA, 17 nt, Pseudomonas aeruginosa PA01
uggagaggucgccgaca

SEQ ID NO: 1466921 - RNA, 18 nt, Pseudomonas aeruginosa PA01
uggagucaggcgccggcc

SEQ ID NO: 1466922 - RNA, 20 nt, Pseudomonas aeruginosa PA01
uggagucaggcgccggccuc

SEQ ID NO: 1466923 - RNA, 21 nt, Pseudomonas aeruginosa PA01
uggagguagcugcgccgccuu

SEQ ID NO: 1466924 - RNA, 22 nt, Pseudomonas aeruginosa PA01
uggaggaucuccaacuggcggc

SEQ ID NO: 1466925 - RNA, 16 nt, Pseudomonas aeruginosa PA01
uggaggucugccacca

SEQ ID NO: 1466926 - RNA, 14 nt, Pseudomonas aeruginosa PA01
uggauaagccgcgc

SEQ ID NO: 1466927 - RNA, 24 nt, Pseudomonas aeruginosa PA01
uggagcgccucgaaggccucgguc

SEQ ID NO: 1466928 - RNA, 14 nt, Pseudomonas aeruginosa PA01
uggagcggaucacg

SEQ ID NO: 1466929 - RNA, 15 nt, Pseudomonas aeruginosa PA01
uggagcgggcgccgg

SEQ ID NO: 1466930 - RNA, 21 nt, Pseudomonas aeruginosa PA01
uggagcagggcgaugaacacc

SEQ ID NO: 1466931 - RNA, 22 nt, Pseudomonas aeruginosa PA01
uggagcagggcgaugaacaccg

SEQ ID NO: 1466932 - RNA, 22 nt, Pseudomonas aeruginosa PA01
uggagcaguuucggaucgacgc

SEQ ID NO: 1466933 - RNA, 19 nt, Pseudomonas aeruginosa PA01
uggagccggugccggcggc

SEQ ID NO: 1466934 - RNA, 14 nt, Pseudomonas aeruginosa PA01
uggaagccguggcg

SEQ ID NO: 1466935 - RNA, 23 nt, Pseudomonas aeruginosa PA01
uggaagccguggcgggccaugcg

SEQ ID NO: 1466936 - RNA, 22 nt, Pseudomonas aeruginosa PA01
uggaaguauugcuccacccgca

SEQ ID NO: 1466937 - RNA, 20 nt, Pseudomonas aeruginosa PA01
uggaaguucacauuggcuuc

SEQ ID NO: 1466938 - RNA, 15 nt, Pseudomonas aeruginosa PA01
uggaagaaggcgauc

SEQ ID NO: 1466939 - RNA, 22 nt, Pseudomonas aeruginosa PA01
uggaagaaggcgaucaucgcca

SEQ ID NO: 1466940 - RNA, 14 nt, Pseudomonas aeruginosa PA01
uggaagagcgccgc

SEQ ID NO: 1466941 - RNA, 16 nt, Pseudomonas aeruginosa PA01
uggaagagcgccgcgg

SEQ ID NO: 1466942 - RNA, 18 nt, Pseudomonas aeruginosa PA01
uggaagagcgccgcggcg

SEQ ID NO: 1466943 - RNA, 19 nt, Pseudomonas aeruginosa PA01
uggaagagcgccgcggcgg

SEQ ID NO: 1466944 - RNA, 18 nt, Pseudomonas aeruginosa PA01
uggaagaggaucgcgaag

SEQ ID NO: 1466945 - RNA, 22 nt, Pseudomonas aeruginosa PA01
uggaagaggaucuccuggcgcg

SEQ ID NO: 1466946 - RNA, 20 nt, Pseudomonas aeruginosa PA01
uggaagccgaucggcauguu

SEQ ID NO: 1466947 - RNA, 17 nt, Pseudomonas aeruginosa PA01
uggaaccgauggccagg

SEQ ID NO: 1466948 - RNA, 17 nt, Pseudomonas aeruginosa PA01
ugcugguugaagccgau

SEQ ID NO: 1466949 - RNA, 18 nt, Pseudomonas aeruginosa PA01
ugcugguugaggccgucc

SEQ ID NO: 1466950 - RNA, 21 nt, Pseudomonas aeruginosa PA01
ugcugggucuccgcucggggu

SEQ ID NO: 1466951 - RNA, 13 nt, Pseudomonas aeruginosa PA01
ugcugguccuggc

SEQ ID NO: 1466952 - RNA, 14 nt, Pseudomonas aeruginosa PA01
ugcuggugcggccg

SEQ ID NO: 1466953 - RNA, 22 nt, Pseudomonas aeruginosa PA01
ugcugguggcccugggcggcga

SEQ ID NO: 1466954 - RNA, 23 nt, Pseudomonas aeruginosa PA01
ugcuguaguaggcgguggccacg

SEQ ID NO: 1466955 - RNA, 22 nt, Pseudomonas aeruginosa PA01
ugcuguaguugacgucgccgau

SEQ ID NO: 1466956 - RNA, 15 nt, Pseudomonas aeruginosa PA01
uggaccuccgccagg

SEQ ID NO: 1466957 - RNA, 14 nt, Pseudomonas aeruginosa PA01
uggaccuggccggc

SEQ ID NO: 1466958 - RNA, 15 nt, Pseudomonas aeruginosa PA01
uggaccgagaccgac

SEQ ID NO: 1466959 - RNA, 22 nt, Pseudomonas aeruginosa PA01
uggaccgagaccgacgcucgcg

SEQ ID NO: 1466960 - RNA, 19 nt, Pseudomonas aeruginosa PA01
uggacccgugcgccccagc

SEQ ID NO: 1466961 - RNA, 18 nt, Pseudomonas aeruginosa PA01
uggaccaggcggccggug

SEQ ID NO: 1466962 - RNA, 21 nt, Pseudomonas aeruginosa PA01
uggaccaguucagcgcgcucg

SEQ ID NO: 1466963 - RNA, 19 nt, Pseudomonas aeruginosa PA01
uggaaguugccgccagcgc

SEQ ID NO: 1466964 - RNA, 21 nt, Pseudomonas aeruginosa PA01
uggaaggcgcugggcggcugg

SEQ ID NO: 1466965 - RNA, 16 nt, Pseudomonas aeruginosa PA01
uggaccaacagccggc

SEQ ID NO: 1466966 - RNA, 15 nt, Pseudomonas aeruginosa PA01
uggaccaccguggcg

SEQ ID NO: 1466967 - RNA, 17 nt, Pseudomonas aeruginosa PA01
uggaccaccguggcgcc

SEQ ID NO: 1466968 - RNA, 19 nt, Pseudomonas aeruginosa PA01
uggaccaccguggcgccgg

SEQ ID NO: 1466969 - RNA, 23 nt, Pseudomonas aeruginosa PA01
ugcguacgcccagcagcggcagg

SEQ ID NO: 1466970 - RNA, 15 nt, Pseudomonas aeruginosa PA01
ugcguagcgacaggc

SEQ ID NO: 1466971 - RNA, 22 nt, Pseudomonas aeruginosa PA01
ugcggcgauggcguccaccgcu

SEQ ID NO: 1466972 - RNA, 14 nt, Pseudomonas aeruginosa PA01
ugcggcgcccgcca

SEQ ID NO: 1466973 - RNA, 15 nt, Pseudomonas aeruginosa PA01
ugcggcgcccgccaa

SEQ ID NO: 1466974 - RNA, 12 nt, Pseudomonas aeruginosa PA01
ugcggcgccgag

SEQ ID NO: 1466975 - RNA, 15 nt, Pseudomonas aeruginosa PA01
ugcggcgccgaggcc

SEQ ID NO: 1466976 - RNA, 17 nt, Pseudomonas aeruginosa PA01
ugcggcgaaacggcgga

SEQ ID NO: 1466977 - RNA, 18 nt, Pseudomonas aeruginosa PA01
ugcggccguucgcccuuc

SEQ ID NO: 1466978 - RNA, 20 nt, Pseudomonas aeruginosa PA01
ugcggccuacuugaucagcc

SEQ ID NO: 1466979 - RNA, 14 nt, Pseudomonas aeruginosa PA01
ugcggccugcaaca

SEQ ID NO: 1466980 - RNA, 19 nt, Pseudomonas aeruginosa PA01
ugcggccugcaacgccgcc

SEQ ID NO: 1466981 - RNA, 17 nt, Pseudomonas aeruginosa PA01
ugcguggaaccgcggcg

SEQ ID NO: 1466982 - RNA, 20 nt, Pseudomonas aeruginosa PA01
ugcguggaaccgcggcgccc

SEQ ID NO: 1466983 - RNA, 12 nt, Pseudomonas aeruginosa PA01
ugcgugcgccgc

SEQ ID NO: 1466984 - RNA, 16 nt, Pseudomonas aeruginosa PA01
ugcgugcgccguagca

SEQ ID NO: 1466985 - RNA, 21 nt, Pseudomonas aeruginosa PA01
ugcgugcgagggcggcggcuc

SEQ ID NO: 1466986 - RNA, 23 nt, Pseudomonas aeruginosa PA01
ugcgucagcgaggcgggcgcgga

SEQ ID NO: 1466987 - RNA, 14 nt, Pseudomonas aeruginosa PA01
ugcguccgcgcagg

SEQ ID NO: 1466988 - RNA, 18 nt, Pseudomonas aeruginosa PA01
ugcguccgcgcaggcggu

SEQ ID NO: 1466989 - RNA, 16 nt, Pseudomonas aeruginosa PA01
ugcgucauccgccuuu

SEQ ID NO: 1466990 - RNA, 18 nt, Pseudomonas aeruginosa PA01
ugcguccauccaggcuuu

SEQ ID NO: 1466991 - RNA, 19 nt, Pseudomonas aeruginosa PA01
ugcguagggcggauaacgc

SEQ ID NO: 1466992 - RNA, 22 nt, Pseudomonas aeruginosa PA01
ugcguuuccggucacgcaggcg

SEQ ID NO: 1466993 - RNA, 12 nt, Pseudomonas aeruginosa PA01
ugcuaugcgccg

SEQ ID NO: 1466994 - RNA, 13 nt, Pseudomonas aeruginosa PA01
ugcuaugcgccgg

SEQ ID NO: 1466995 - RNA, 15 nt, Pseudomonas aeruginosa PA01
ugcuaggcuggaagc

SEQ ID NO: 1466996 - RNA, 12 nt, Pseudomonas aeruginosa PA01
ugcguucgccga

SEQ ID NO: 1466997 - RNA, 13 nt, Pseudomonas aeruginosa PA01
ugcguugcgcggc

SEQ ID NO: 1466998 - RNA, 16 nt, Pseudomonas aeruginosa PA01
ugcguuccuccucguc

SEQ ID NO: 1466999 - RNA, 14 nt, Pseudomonas aeruginosa PA01
ugcguucgcgggcg

SEQ ID NO: 1467000 - RNA, 19 nt, Pseudomonas aeruginosa PA01
ugcguggcgaacgcccggc

SEQ ID NO: 1467001 - RNA, 20 nt, Pseudomonas aeruginosa PA01
ugcguggugcauccgccgca

SEQ ID NO: 1467002 - RNA, 21 nt, Pseudomonas aeruginosa PA01
ugcguggugcauccgccgcag

SEQ ID NO: 1467003 - RNA, 18 nt, Pseudomonas aeruginosa PA01
ugcucuccacuaccgccg

SEQ ID NO: 1467004 - RNA, 16 nt, Pseudomonas aeruginosa PA01
ugcucuucggcggcca

SEQ ID NO: 1467005 - RNA, 13 nt, Pseudomonas aeruginosa PA01
ugcucuuccagcg

SEQ ID NO: 1467006 - RNA, 20 nt, Pseudomonas aeruginosa PA01
ugcucuugaggucggcgcgc

SEQ ID NO: 1467007 - RNA, 19 nt, Pseudomonas aeruginosa PA01
ugcucuuggucaucaccuu

SEQ ID NO: 1467008 - RNA, 17 nt, Pseudomonas aeruginosa PA01
ugcucggcgcccugggu

SEQ ID NO: 1467009 - RNA, 21 nt, Pseudomonas aeruginosa PA01
ugcucggcgaucucgcccagg

SEQ ID NO: 1467010 - RNA, 16 nt, Pseudomonas aeruginosa PA01
ugcucggggucgucgc

SEQ ID NO: 1467011 - RNA, 12 nt, Pseudomonas aeruginosa PA01
ugcucggggccg

SEQ ID NO: 1467012 - RNA, 20 nt, Pseudomonas aeruginosa PA01
ugcucgggcgucuccugccg

SEQ ID NO: 1467013 - RNA, 18 nt, Pseudomonas aeruginosa PA01
ugcucgggcugccgcaga

SEQ ID NO: 1467014 - RNA, 23 nt, Pseudomonas aeruginosa PA01
ugcucagcgcgcucggccuggug

SEQ ID NO: 1467015 - RNA, 23 nt, Pseudomonas aeruginosa PA01
ugcucagcggcccagcgccccgc

SEQ ID NO: 1467016 - RNA, 15 nt, Pseudomonas aeruginosa PA01
ugcucggccagcgcc

SEQ ID NO: 1467017 - RNA, 18 nt, Pseudomonas aeruginosa PA01
ugcucggccagcucgccg

SEQ ID NO: 1467018 - RNA, 19 nt, Pseudomonas aeruginosa PA01
ugcucggccagcucgccga

SEQ ID NO: 1467019 - RNA, 22 nt, Pseudomonas aeruginosa PA01
ugcucggccagguauucgcgcu

SEQ ID NO: 1467020 - RNA, 20 nt, Pseudomonas aeruginosa PA01
ugcucggccugcugcgccgg

SEQ ID NO: 1467021 - RNA, 16 nt, Pseudomonas aeruginosa PA01
ugcucagcgccggcca

SEQ ID NO: 1467022 - RNA, 19 nt, Pseudomonas aeruginosa PA01
ugcuggcacagguccagca

SEQ ID NO: 1467023 - RNA, 23 nt, Pseudomonas aeruginosa PA01
ugcuggccacccuugcgcccggc

SEQ ID NO: 1467024 - RNA, 16 nt, Pseudomonas aeruginosa PA01
ugcuggccaccgcggc

SEQ ID NO: 1467025 - RNA, 15 nt, Pseudomonas aeruginosa PA01
ugcugccggcguccu

SEQ ID NO: 1467026 - RNA, 13 nt, Pseudomonas aeruginosa PA01
ugcugccguagcg

SEQ ID NO: 1467027 - RNA, 18 nt, Pseudomonas aeruginosa PA01
ugcugccauggcggcgga

SEQ ID NO: 1467028 - RNA, 21 nt, Pseudomonas aeruginosa PA01
ugcugcccggagcggcugccg

SEQ ID NO: 1467029 - RNA, 19 nt, Pseudomonas aeruginosa PA01
ugcugcccuggcgcgcgcc

SEQ ID NO: 1467030 - RNA, 18 nt, Pseudomonas aeruginosa PA01
ugcugccauccgcgccga

SEQ ID NO: 1467031 - RNA, 15 nt, Pseudomonas aeruginosa PA01
ugcuggguggaggcc

SEQ ID NO: 1467032 - RNA, 14 nt, Pseudomonas aeruginosa PA01
ugcugggcgggauc

SEQ ID NO: 1467033 - RNA, 14 nt, Pseudomonas aeruginosa PA01
ugcugggccagcgc

SEQ ID NO: 1467034 - RNA, 17 nt, Pseudomonas aeruginosa PA01
ugcugguagagccgggu

SEQ ID NO: 1467035 - RNA, 19 nt, Pseudomonas aeruginosa PA01
ugcugguagugcuggcgca

SEQ ID NO: 1467036 - RNA, 18 nt, Pseudomonas aeruginosa PA01
ugcuggugccgaucagcc

SEQ ID NO: 1467037 - RNA, 11 nt, Pseudomonas aeruginosa PA01
ugcuggccggu

SEQ ID NO: 1467038 - RNA, 15 nt, Pseudomonas aeruginosa PA01
ugcuggccggugccg

SEQ ID NO: 1467039 - RNA, 17 nt, Pseudomonas aeruginosa PA01
ugcuggccuucgucggc

SEQ ID NO: 1467040 - RNA, 21 nt, Pseudomonas aeruginosa PA01
ugcuggcgcgauccgcgcggc

SEQ ID NO: 1467041 - RNA, 22 nt, Pseudomonas aeruginosa PA01
uuucguuggccaggaagcgggc

SEQ ID NO: 1467042 - RNA, 23 nt, Pseudomonas aeruginosa PA01
uuucguagggcgaauaucgcggc

SEQ ID NO: 1467043 - RNA, 16 nt, Pseudomonas aeruginosa PA01
uuucguuuccggcagg

SEQ ID NO: 1467044 - RNA, 21 nt, Pseudomonas aeruginosa PA01
uuucucgccucccggcucgcc

SEQ ID NO: 1467045 - RNA, 13 nt, Pseudomonas aeruginosa PA01
uuucucggcgaug

SEQ ID NO: 1467046 - RNA, 16 nt, Pseudomonas aeruginosa PA01
uuucucggucgccgcc

SEQ ID NO: 1467047 - RNA, 14 nt, Pseudomonas aeruginosa PA01
uuuucgcuccucag

SEQ ID NO: 1467048 - RNA, 17 nt, Pseudomonas aeruginosa PA01
uuuucaggcgacgccgc

SEQ ID NO: 1467049 - RNA, 23 nt, Pseudomonas aeruginosa PA01
uuuugccggagaugugcgcggug

SEQ ID NO: 1467050 - RNA, 22 nt, Pseudomonas aeruginosa PA01
aaucugcccggccaugccgccg

SEQ ID NO: 1467051 - RNA, 18 nt, Pseudomonas aeruginosa PA01
aaugcaacccgccgcuga

SEQ ID NO: 1467052 - RNA, 15 nt, Pseudomonas aeruginosa PA01
aaugcaccugcgccc

SEQ ID NO: 1467053 - RNA, 16 nt, Pseudomonas aeruginosa PA01
aaugcaccugcgcccc

SEQ ID NO: 1467054 - RNA, 17 nt, Pseudomonas aeruginosa PA01
aaugcaccugcgccccg

SEQ ID NO: 1467055 - RNA, 18 nt, Pseudomonas aeruginosa PA01
aaugcccggcagcgccgg

SEQ ID NO: 1467056 - RNA, 22 nt, Pseudomonas aeruginosa PA01
aaugcccggcagcgccgggcau

SEQ ID NO: 1467057 - RNA, 13 nt, Pseudomonas aeruginosa PA01
aaugcccuuggcu

SEQ ID NO: 1467058 - RNA, 18 nt, Pseudomonas aeruginosa PA01
aaucgcccaccaggucgc

SEQ ID NO: 1467059 - RNA, 19 nt, Pseudomonas aeruginosa PA01
aaugcugcccggagcggcu

SEQ ID NO: 1467060 - RNA, 16 nt, Pseudomonas aeruginosa PA01
aaugcugccacccggc

SEQ ID NO: 1467061 - RNA, 17 nt, Pseudomonas aeruginosa PA01
aaugcuugccggcgccu

SEQ ID NO: 1467062 - RNA, 22 nt, Pseudomonas aeruginosa PA01
aauuaacggccauaauggccgc

SEQ ID NO: 1467063 - RNA, 18 nt, Pseudomonas aeruginosa PA01
aauuccgcagccuuggca

SEQ ID NO: 1467064 - RNA, 22 nt, Pseudomonas aeruginosa PA01
aauucgcagagaucggcggcgc

SEQ ID NO: 1467065 - RNA, 15 nt, Pseudomonas aeruginosa PA01
aauucgcggacgccg

SEQ ID NO: 1467066 - RNA, 13 nt, Pseudomonas aeruginosa PA01
aauucgucgccgc

SEQ ID NO: 1467067 - RNA, 15 nt, Pseudomonas aeruginosa PA01
aauugcaggcccggc

SEQ ID NO: 1467068 - RNA, 16 nt, Pseudomonas aeruginosa PA01
aauuggacagcaggcu

SEQ ID NO: 1467069 - RNA, 20 nt, Pseudomonas aeruginosa PA01
aauugccgguagccggcgau

SEQ ID NO: 1467070 - RNA, 21 nt, Pseudomonas aeruginosa PA01
uugcugaagcccaggcgucgc

SEQ ID NO: 1467071 - RNA, 14 nt, Pseudomonas aeruginosa PA01
uugcugcccuggcg

SEQ ID NO: 1467072 - RNA, 13 nt, Pseudomonas aeruginosa PA01
uugcugccggcgu

SEQ ID NO: 1467073 - RNA, 13 nt, Pseudomonas aeruginosa PA01
uugcucucgcgca

SEQ ID NO: 1467074 - RNA, 17 nt, Pseudomonas aeruginosa PA01
uugcugaucgcuccgcu

SEQ ID NO: 1467075 - RNA, 16 nt, Pseudomonas aeruginosa PA01
uugcguaccagcgcgc

SEQ ID NO: 1467076 - RNA, 15 nt, Pseudomonas aeruginosa PA01
uugcggcgccgaggc

SEQ ID NO: 1467077 - RNA, 13 nt, Pseudomonas aeruginosa PA01
uugcggcgccggu

SEQ ID NO: 1467078 - RNA, 14 nt, Pseudomonas aeruginosa PA01
uugcgggcgcgccu

SEQ ID NO: 1467079 - RNA, 20 nt, Pseudomonas aeruginosa PA01
uugcggucgauguccugggc

SEQ ID NO: 1467080 - RNA, 22 nt, Pseudomonas aeruginosa PA01
uugcggucgcgcccgcugugcg

SEQ ID NO: 1467081 - RNA, 14 nt, Pseudomonas aeruginosa PA01
uugcgggugcgcag

SEQ ID NO: 1467082 - RNA, 18 nt, Pseudomonas aeruginosa PA01
uugcgcaccgccugcagc

SEQ ID NO: 1467083 - RNA, 14 nt, Pseudomonas aeruginosa PA01
uugcgcgcauagca

SEQ ID NO: 1467084 - RNA, 13 nt, Pseudomonas aeruginosa PA01
uugcgcgccacca

SEQ ID NO: 1467085 - RNA, 22 nt, Pseudomonas aeruginosa PA01
uugcgcagggcgucgaaggcgg

SEQ ID NO: 1467086 - RNA, 14 nt, Pseudomonas aeruginosa PA01
uugcgcaggggcgc

SEQ ID NO: 1467087 - RNA, 14 nt, Pseudomonas aeruginosa PA01
uugcgcgccgccgc

SEQ ID NO: 1467088 - RNA, 17 nt, Pseudomonas aeruginosa PA01
uugcgcgccgccgccgc

SEQ ID NO: 1467089 - RNA, 17 nt, Pseudomonas aeruginosa PA01
uugcgcguggcgucggc

SEQ ID NO: 1467090 - RNA, 18 nt, Pseudomonas aeruginosa PA01
uugcgcguggcgucggcg

SEQ ID NO: 1467091 - RNA, 18 nt, Pseudomonas aeruginosa PA01
uugcgcggcaggccgucc

SEQ ID NO: 1467092 - RNA, 20 nt, Pseudomonas aeruginosa PA01
uugcgcuccacccaggcgcc

SEQ ID NO: 1467093 - RNA, 21 nt, Pseudomonas aeruginosa PA01
uugcgcucgagccggcugaug

SEQ ID NO: 1467094 - RNA, 21 nt, Pseudomonas aeruginosa PA01
uugcgcuugccggccgccagc

SEQ ID NO: 1467095 - RNA, 19 nt, Pseudomonas aeruginosa PA01
uugcgcuugcgaucgaaga

SEQ ID NO: 1467096 - RNA, 16 nt, Pseudomonas aeruginosa PA01
uugcggaacccgcgca

SEQ ID NO: 1467097 - RNA, 15 nt, Pseudomonas aeruginosa PA01
uugcgaugggugccg

SEQ ID NO: 1467098 - RNA, 15 nt, Pseudomonas aeruginosa PA01
uugcgaaaagcccgc

SEQ ID NO: 1467099 - RNA, 15 nt, Pseudomonas aeruginosa PA01
uugaucgacgccagc

SEQ ID NO: 1467100 - RNA, 19 nt, Pseudomonas aeruginosa PA01
uugaucgagucgccggcga

SEQ ID NO: 1467101 - RNA, 15 nt, Pseudomonas aeruginosa PA01
uugaucaccgcggug

SEQ ID NO: 1467102 - RNA, 11 nt, Pseudomonas aeruginosa PA01
uuggcggcgcc

SEQ ID NO: 1467103 - RNA, 13 nt, Pseudomonas aeruginosa PA01
uuggcggcgccau

SEQ ID NO: 1467104 - RNA, 23 nt, Pseudomonas aeruginosa PA01
uuggcgaaauugccuccgcucug

SEQ ID NO: 1467105 - RNA, 18 nt, Pseudomonas aeruginosa PA01
uuggccuccacccgcgaa

SEQ ID NO: 1467106 - RNA, 14 nt, Pseudomonas aeruginosa PA01
uuggcccgcgccgu

SEQ ID NO: 1467107 - RNA, 18 nt, Pseudomonas aeruginosa PA01
aauccggcuggcgccggu

SEQ ID NO: 1467108 - RNA, 20 nt, Pseudomonas aeruginosa PA01
aauccggcuggcgccggugc

SEQ ID NO: 1467109 - RNA, 22 nt, Pseudomonas aeruginosa PA01
uuggccgaaucgaacagggcga

SEQ ID NO: 1467110 - RNA, 20 nt, Pseudomonas aeruginosa PA01
uuggagcgggcgccggacca

SEQ ID NO: 1467111 - RNA, 20 nt, Pseudomonas aeruginosa PA01
uugcuugcgcucgagccggc

SEQ ID NO: 1467112 - RNA, 19 nt, Pseudomonas aeruginosa PA01
uugggaucggcgaucagcg

SEQ ID NO: 1467113 - RNA, 15 nt, Pseudomonas aeruginosa PA01
uugggaucgucgaaa

SEQ ID NO: 1467114 - RNA, 16 nt, Pseudomonas aeruginosa PA01
uugggauggccagcca

SEQ ID NO: 1467115 - RNA, 13 nt, Pseudomonas aeruginosa PA01
uuggcuucgaaga

SEQ ID NO: 1467116 - RNA, 17 nt, Pseudomonas aeruginosa PA01
uuggcgugcucgcgcau

SEQ ID NO: 1467117 - RNA, 13 nt, Pseudomonas aeruginosa PA01
uugggcgccucgc

SEQ ID NO: 1467118 - RNA, 23 nt, Pseudomonas aeruginosa PA01
uuguacagcgaggcccgcgccgc

SEQ ID NO: 1467119 - RNA, 13 nt, Pseudomonas aeruginosa PA01
uuguacuggccga

SEQ ID NO: 1467120 - RNA, 15 nt, Pseudomonas aeruginosa PA01
uuuagcucggcgaug

SEQ ID NO: 1467121 - RNA, 16 nt, Pseudomonas aeruginosa PA01
aauccuccagccggcg

SEQ ID NO: 1467122 - RNA, 15 nt, Pseudomonas aeruginosa PA01
aauccucgcgcaccg

SEQ ID NO: 1467123 - RNA, 20 nt, Pseudomonas aeruginosa PA01
uuguucgggguggcgaaggc

SEQ ID NO: 1467124 - RNA, 23 nt, Pseudomonas aeruginosa PA01
uuguugacguucugcccgccggc

SEQ ID NO: 1467125 - RNA, 17 nt, Pseudomonas aeruginosa PA01
uuuccugcuccagcagg

SEQ ID NO: 1467126 - RNA, 14 nt, Pseudomonas aeruginosa PA01
uuuccugcugagca

SEQ ID NO: 1467127 - RNA, 13 nt, Pseudomonas aeruginosa PA01
uuuccugcuggcg

SEQ ID NO: 1467128 - RNA, 13 nt, Pseudomonas aeruginosa PA01
uuuccuuguggcg

SEQ ID NO: 1467129 - RNA, 22 nt, Pseudomonas aeruginosa PA01
uuucgaacaaucccagcucgcc

SEQ ID NO: 1467130 - RNA, 15 nt, Pseudomonas aeruginosa PA01
uuucgaucuggcugc

SEQ ID NO: 1467131 - RNA, 13 nt, Pseudomonas aeruginosa PA01
uuuccuucggcac

SEQ ID NO: 1467132 - RNA, 16 nt, Pseudomonas aeruginosa PA01
uuucauggccuggcgc

SEQ ID NO: 1467133 - RNA, 14 nt, Pseudomonas aeruginosa PA01
uuucaugggcgggg

SEQ ID NO: 1467134 - RNA, 23 nt, Pseudomonas aeruginosa PA01
uuucagcuucaggguggcgcugc

SEQ ID NO: 1467135 - RNA, 17 nt, Pseudomonas aeruginosa PA01
uucgaccuccaggccga

SEQ ID NO: 1467136 - RNA, 14 nt, Pseudomonas aeruginosa PA01
uucgacccgccgac

SEQ ID NO: 1467137 - RNA, 16 nt, Pseudomonas aeruginosa PA01
uucgacccgccgacca

SEQ ID NO: 1467138 - RNA, 14 nt, Pseudomonas aeruginosa PA01
uuccugucuccgca

SEQ ID NO: 1467139 - RNA, 14 nt, Pseudomonas aeruginosa PA01
uucgaggcgccgac

SEQ ID NO: 1467140 - RNA, 19 nt, Pseudomonas aeruginosa PA01
uucgaggcgccgaccacga

SEQ ID NO: 1467141 - RNA, 19 nt, Pseudomonas aeruginosa PA01
uucgagcagcucguucgcc

SEQ ID NO: 1467142 - RNA, 21 nt, Pseudomonas aeruginosa PA01
uucgagcaccccgagcccggc

SEQ ID NO: 1467143 - RNA, 17 nt, Pseudomonas aeruginosa PA01
uucgagccuggccaggc

SEQ ID NO: 1467144 - RNA, 15 nt, Pseudomonas aeruginosa PA01
uucgcagagaucggc

SEQ ID NO: 1467145 - RNA, 16 nt, Pseudomonas aeruginosa PA01
uucgcagagaucggcg

SEQ ID NO: 1467146 - RNA, 17 nt, Pseudomonas aeruginosa PA01
uucgcaaagcucgcgca

SEQ ID NO: 1467147 - RNA, 20 nt, Pseudomonas aeruginosa PA01
uucgcaaagcucgcgcaagc

SEQ ID NO: 1467148 - RNA, 14 nt, Pseudomonas aeruginosa PA01
uucgaugccgcgcg

SEQ ID NO: 1467149 - RNA, 22 nt, Pseudomonas aeruginosa PA01
uucgaugccgcgcgccuggcug

SEQ ID NO: 1467150 - RNA, 19 nt, Pseudomonas aeruginosa PA01
uucgaucuccucgcgcagc

SEQ ID NO: 1467151 - RNA, 13 nt, Pseudomonas aeruginosa PA01
uucgcaggccagg

SEQ ID NO: 1467152 - RNA, 16 nt, Pseudomonas aeruginosa PA01
uucgcaggccaggcgc

SEQ ID NO: 1467153 - RNA, 18 nt, Pseudomonas aeruginosa PA01
uucgccgccgagcgccug

SEQ ID NO: 1467154 - RNA, 13 nt, Pseudomonas aeruginosa PA01
uucgccgcgagca

SEQ ID NO: 1467155 - RNA, 20 nt, Pseudomonas aeruginosa PA01
uucgccgcgcaagcucguca

SEQ ID NO: 1467156 - RNA, 17 nt, Pseudomonas aeruginosa PA01
uucgccgcgggcguugc

SEQ ID NO: 1467157 - RNA, 23 nt, Pseudomonas aeruginosa PA01
uucgccgcgggcguugcgcgccu

SEQ ID NO: 1467158 - RNA, 13 nt, Pseudomonas aeruginosa PA01
uucgcucugcgcc

SEQ ID NO: 1467159 - RNA, 17 nt, Pseudomonas aeruginosa PA01
uucgcugccccguagcc

SEQ ID NO: 1467160 - RNA, 14 nt, Pseudomonas aeruginosa PA01
uucgcugcgcgcca

SEQ ID NO: 1467161 - RNA, 13 nt, Pseudomonas aeruginosa PA01
uucgcugcgcagu

SEQ ID NO: 1467162 - RNA, 23 nt, Pseudomonas aeruginosa PA01
uucggccagggagucgcuggcca

SEQ ID NO: 1467163 - RNA, 17 nt, Pseudomonas aeruginosa PA01
uucggccaguucgagca

SEQ ID NO: 1467164 - RNA, 20 nt, Pseudomonas aeruginosa PA01
uucggcgaccagcccgcgcg

SEQ ID NO: 1467165 - RNA, 19 nt, Pseudomonas aeruginosa PA01
uucggcgaggaucgccagc

SEQ ID NO: 1467166 - RNA, 20 nt, Pseudomonas aeruginosa PA01
uucggcgaggaucgccagca

SEQ ID NO: 1467167 - RNA, 17 nt, Pseudomonas aeruginosa PA01
uucggcgaugaccagcu

SEQ ID NO: 1467168 - RNA, 13 nt, Pseudomonas aeruginosa PA01
uucggcgcccagg

SEQ ID NO: 1467169 - RNA, 17 nt, Pseudomonas aeruginosa PA01
uucggcgcccagguagg

SEQ ID NO: 1467170 - RNA, 12 nt, Pseudomonas aeruginosa PA01
uucggcgccgga

SEQ ID NO: 1467171 - RNA, 20 nt, Pseudomonas aeruginosa PA01
uucggcgccggagcugguca

SEQ ID NO: 1467172 - RNA, 16 nt, Pseudomonas aeruginosa PA01
uucgccuggcgcgacg

SEQ ID NO: 1467173 - RNA, 14 nt, Pseudomonas aeruginosa PA01
uucgcgacacaccg

SEQ ID NO: 1467174 - RNA, 20 nt, Pseudomonas aeruginosa PA01
uucgccuugcccuggccggc

SEQ ID NO: 1467175 - RNA, 17 nt, Pseudomonas aeruginosa PA01
uucgccgucgagccagc

SEQ ID NO: 1467176 - RNA, 13 nt, Pseudomonas aeruginosa PA01
uucgccggccagc

SEQ ID NO: 1467177 - RNA, 18 nt, Pseudomonas aeruginosa PA01
uucgccgggcuccagcau

SEQ ID NO: 1467178 - RNA, 20 nt, Pseudomonas aeruginosa PA01
uucgccggguggaacgaggc

SEQ ID NO: 1467179 - RNA, 18 nt, Pseudomonas aeruginosa PA01
uucgcgguggaugccggu

SEQ ID NO: 1467180 - RNA, 21 nt, Pseudomonas aeruginosa PA01
uucgcgugccagacgcucggc

SEQ ID NO: 1467181 - RNA, 15 nt, Pseudomonas aeruginosa PA01
uucgcguggcccggc

SEQ ID NO: 1467182 - RNA, 20 nt, Pseudomonas aeruginosa PA01
uucgcguggcccggcgcggc

SEQ ID NO: 1467183 - RNA, 22 nt, Pseudomonas aeruginosa PA01
uucgcugacccagcgcacgccg

SEQ ID NO: 1467184 - RNA, 23 nt, Pseudomonas aeruginosa PA01
uucccagcagcaacagcgccgcg

SEQ ID NO: 1467185 - RNA, 14 nt, Pseudomonas aeruginosa PA01
uucagucccucguc

SEQ ID NO: 1467186 - RNA, 20 nt, Pseudomonas aeruginosa PA01
uucagcggcgcgucgaccac

SEQ ID NO: 1467187 - RNA, 15 nt, Pseudomonas aeruginosa PA01
uucagcggcguaugc

SEQ ID NO: 1467188 - RNA, 22 nt, Pseudomonas aeruginosa PA01
uucagcggcguaugcgccucca

SEQ ID NO: 1467189 - RNA, 16 nt, Pseudomonas aeruginosa PA01
uucagguauccgcuua

SEQ ID NO: 1467190 - RNA, 20 nt, Pseudomonas aeruginosa PA01
uucccgcgagcagccgacga

SEQ ID NO: 1467191 - RNA, 15 nt, Pseudomonas aeruginosa PA01
uucccgcaccggcgc

SEQ ID NO: 1467192 - RNA, 22 nt, Pseudomonas aeruginosa PA01
uucccgcggcuccagccgcugc

SEQ ID NO: 1467193 - RNA, 13 nt, Pseudomonas aeruginosa PA01
uucccgcuccagg

SEQ ID NO: 1467194 - RNA, 14 nt, Pseudomonas aeruginosa PA01
uuccggcagccagc

SEQ ID NO: 1467195 - RNA, 17 nt, Pseudomonas aeruginosa PA01
uuccggcccggccaggc

SEQ ID NO: 1467196 - RNA, 19 nt, Pseudomonas aeruginosa PA01
uuccccguggcgccgcagg

SEQ ID NO: 1467197 - RNA, 19 nt, Pseudomonas aeruginosa PA01
uucccgaggguggcgcugg

SEQ ID NO: 1467198 - RNA, 20 nt, Pseudomonas aeruginosa PA01
uucccccagcaccuggacga

SEQ ID NO: 1467199 - RNA, 21 nt, Pseudomonas aeruginosa PA01
uucccauuguuggcgcucggc

SEQ ID NO: 1467200 - RNA, 15 nt, Pseudomonas aeruginosa PA01
uuccugcgccucguc

SEQ ID NO: 1467201 - RNA, 13 nt, Pseudomonas aeruginosa PA01
uuccuggaagccg

SEQ ID NO: 1467202 - RNA, 15 nt, Pseudomonas aeruginosa PA01
uuccuggaccuccgc

SEQ ID NO: 1467203 - RNA, 16 nt, Pseudomonas aeruginosa PA01
uuccugggugccgcga

SEQ ID NO: 1467204 - RNA, 15 nt, Pseudomonas aeruginosa PA01
uuccugggaugccgg

SEQ ID NO: 1467205 - RNA, 15 nt, Pseudomonas aeruginosa PA01
uuccugaaggcgcgg

SEQ ID NO: 1467206 - RNA, 12 nt, Pseudomonas aeruginosa PA01
uuccugacgaau

SEQ ID NO: 1467207 - RNA, 11 nt, Pseudomonas aeruginosa PA01
uuccucgcgcc

SEQ ID NO: 1467208 - RNA, 19 nt, Pseudomonas aeruginosa PA01
uuccucggcggcggucgcg

SEQ ID NO: 1467209 - RNA, 21 nt, Pseudomonas aeruginosa PA01
uuccggucacgcaggcgcugg

SEQ ID NO: 1467210 - RNA, 18 nt, Pseudomonas aeruginosa PA01
uuccgggcugcgcucggc

SEQ ID NO: 1467211 - RNA, 13 nt, Pseudomonas aeruginosa PA01
uuccgggcccagu

SEQ ID NO: 1467212 - RNA, 14 nt, Pseudomonas aeruginosa PA01
uuccgggucgcugc

SEQ ID NO: 1467213 - RNA, 15 nt, Pseudomonas aeruginosa PA01
uuccgggucgcugcc

SEQ ID NO: 1467214 - RNA, 13 nt, Pseudomonas aeruginosa PA01
uuccggcgcagcg

SEQ ID NO: 1467215 - RNA, 15 nt, Pseudomonas aeruginosa PA01
uuccuccucgccgcc

SEQ ID NO: 1467216 - RNA, 23 nt, Pseudomonas aeruginosa PA01
uuccgucgucaccucggcgccau

SEQ ID NO: 1467217 - RNA, 19 nt, Pseudomonas aeruginosa PA01
uuccguuguggcggcgcuc

SEQ ID NO: 1467218 - RNA, 19 nt, Pseudomonas aeruginosa PA01
uucuugaucaccgcggugc

SEQ ID NO: 1467219 - RNA, 20 nt, Pseudomonas aeruginosa PA01
uucuucgcuaaccggucgca

SEQ ID NO: 1467220 - RNA, 16 nt, Pseudomonas aeruginosa PA01
uucgguggcgaccagg

SEQ ID NO: 1467221 - RNA, 20 nt, Pseudomonas aeruginosa PA01
uucggucgaucguugccagc

SEQ ID NO: 1467222 - RNA, 17 nt, Pseudomonas aeruginosa PA01
uucggucaggcugaucg

SEQ ID NO: 1467223 - RNA, 18 nt, Pseudomonas aeruginosa PA01
uucggggugcaggggcgc

SEQ ID NO: 1467224 - RNA, 20 nt, Pseudomonas aeruginosa PA01
uucucaccgaggaucggcac

SEQ ID NO: 1467225 - RNA, 16 nt, Pseudomonas aeruginosa PA01
uucucggucgccgcca

SEQ ID NO: 1467226 - RNA, 17 nt, Pseudomonas aeruginosa PA01
uucucgucgccgcccgg

SEQ ID NO: 1467227 - RNA, 22 nt, Pseudomonas aeruginosa PA01
uugagcgcgcccaggcaggcga

SEQ ID NO: 1467228 - RNA, 12 nt, Pseudomonas aeruginosa PA01
uugagccuugcc

SEQ ID NO: 1467229 - RNA, 16 nt, Pseudomonas aeruginosa PA01
uugagcagccaggcga

SEQ ID NO: 1467230 - RNA, 24 nt, Pseudomonas aeruginosa PA01
uugagcagggcgucgcccucggcg

SEQ ID NO: 1467231 - RNA, 22 nt, Pseudomonas aeruginosa PA01
uugagcaggguguugaucaccg

SEQ ID NO: 1467232 - RNA, 13 nt, Pseudomonas aeruginosa PA01
uugagcaccggca

SEQ ID NO: 1467233 - RNA, 14 nt, Pseudomonas aeruginosa PA01
uugagcacgguccg

SEQ ID NO: 1467234 - RNA, 23 nt, Pseudomonas aeruginosa PA01
uugacuugacccgacugcagcgg

SEQ ID NO: 1467235 - RNA, 15 nt, Pseudomonas aeruginosa PA01
uugacgucgccgaug

SEQ ID NO: 1467236 - RNA, 14 nt, Pseudomonas aeruginosa PA01
uugaggccgucgaa

SEQ ID NO: 1467237 - RNA, 23 nt, Pseudomonas aeruginosa PA01
uugaggucguuggccaggcgcga

SEQ ID NO: 1467238 - RNA, 18 nt, Pseudomonas aeruginosa PA01
uugagucgcgcgcgcuuc

SEQ ID NO: 1467239 - RNA, 20 nt, Pseudomonas aeruginosa PA01
uugacaugcccgcgcgcauc

SEQ ID NO: 1467240 - RNA, 20 nt, Pseudomonas aeruginosa PA01
uugacagccucaagccucgc

SEQ ID NO: 1467241 - RNA, 20 nt, Pseudomonas aeruginosa PA01
uugacccgguacagcgccug

SEQ ID NO: 1467242 - RNA, 17 nt, Pseudomonas aeruginosa PA01
uugacccguugcgccuc

SEQ ID NO: 1467243 - RNA, 18 nt, Pseudomonas aeruginosa PA01
uugacccguugcgccucg

SEQ ID NO: 1467244 - RNA, 23 nt, Pseudomonas aeruginosa PA01
uugacccguugcgccucgccgcc

SEQ ID NO: 1467245 - RNA, 16 nt, Pseudomonas aeruginosa PA01
uugacgauggccagcc

SEQ ID NO: 1467246 - RNA, 16 nt, Pseudomonas aeruginosa PA01
uugacgauggcgccau

SEQ ID NO: 1467247 - RNA, 12 nt, Pseudomonas aeruginosa PA01
uugacggcgccg

SEQ ID NO: 1467248 - RNA, 18 nt, Pseudomonas aeruginosa PA01
uugaccugcagcgccucg

SEQ ID NO: 1467249 - RNA, 16 nt, Pseudomonas aeruginosa PA01
uugacgaagccggcga

SEQ ID NO: 1467250 - RNA, 17 nt, Pseudomonas aeruginosa PA01
uugaccuugucggccga

SEQ ID NO: 1467251 - RNA, 23 nt, Pseudomonas aeruginosa PA01
uugacgaaauacucgucgacggc

SEQ ID NO: 1467252 - RNA, 13 nt, Pseudomonas aeruginosa PA01
uugaagcgggaga

SEQ ID NO: 1467253 - RNA, 12 nt, Pseudomonas aeruginosa PA01
uugaagccggcg

SEQ ID NO: 1467254 - RNA, 13 nt, Pseudomonas aeruginosa PA01
uugaagccggcgu

SEQ ID NO: 1467255 - RNA, 14 nt, Pseudomonas aeruginosa PA01
uucaagcuggcgca

SEQ ID NO: 1467256 - RNA, 22 nt, Pseudomonas aeruginosa PA01
uucaaccaggcgauaucccgcc

SEQ ID NO: 1467257 - RNA, 22 nt, Pseudomonas aeruginosa PA01
uucaaaggaaucuucggcgccc

SEQ ID NO: 1467258 - RNA, 16 nt, Pseudomonas aeruginosa PA01
uucaagugucgaugaa

SEQ ID NO: 1467259 - RNA, 18 nt, Pseudomonas aeruginosa PA01
uucaccccgcccuuggcg

SEQ ID NO: 1467260 - RNA, 23 nt, Pseudomonas aeruginosa PA01
uucaccaccccgaacucgccguc

SEQ ID NO: 1467261 - RNA, 12 nt, Pseudomonas aeruginosa PA01
uucaccgcgccg

SEQ ID NO: 1467262 - RNA, 19 nt, Pseudomonas aeruginosa PA01
uucaccgugaucccgcgcg

SEQ ID NO: 1467263 - RNA, 22 nt, Pseudomonas aeruginosa PA01
uucagcccacgcgccuggccgu

SEQ ID NO: 1467264 - RNA, 13 nt, Pseudomonas aeruginosa PA01
uucagccccagca

SEQ ID NO: 1467265 - RNA, 21 nt, Pseudomonas aeruginosa PA01
uucagccccagcacgccgagc

SEQ ID NO: 1467266 - RNA, 16 nt, Pseudomonas aeruginosa PA01
uucagcgccgccaggc

SEQ ID NO: 1467267 - RNA, 22 nt, Pseudomonas aeruginosa PA01
uucagcgccgccaggcccuggg

SEQ ID NO: 1467268 - RNA, 18 nt, Pseudomonas aeruginosa PA01
uucagcgccgcucggcga

SEQ ID NO: 1467269 - RNA, 12 nt, Pseudomonas aeruginosa PA01
uucagcgccggg

SEQ ID NO: 1467270 - RNA, 12 nt, Pseudomonas aeruginosa PA01
uucagcgccucg

SEQ ID NO: 1467271 - RNA, 11 nt, Pseudomonas aeruginosa PA01
uucagcgcgcc

SEQ ID NO: 1467272 - RNA, 18 nt, Pseudomonas aeruginosa PA01
uucagcgcgccccggcga

SEQ ID NO: 1467273 - RNA, 15 nt, Pseudomonas aeruginosa PA01
uucagcgcgccgagc

SEQ ID NO: 1467274 - RNA, 22 nt, Pseudomonas aeruginosa PA01
uucagcgcuuccuugcccuggg

SEQ ID NO: 1467275 - RNA, 18 nt, Pseudomonas aeruginosa PA01
uucagcggaagcccagca

SEQ ID NO: 1467276 - RNA, 12 nt, Pseudomonas aeruginosa PA01
uuauccgccgug

SEQ ID NO: 1467277 - RNA, 21 nt, Pseudomonas aeruginosa PA01
uuauggccgacccgugcgccg

SEQ ID NO: 1467278 - RNA, 18 nt, Pseudomonas aeruginosa PA01
uuaugcgcccuaccuguc

SEQ ID NO: 1467279 - RNA, 14 nt, Pseudomonas aeruginosa PA01
uuaccggcgaccac

SEQ ID NO: 1467280 - RNA, 16 nt, Pseudomonas aeruginosa PA01
uguucaccagcgcugc

SEQ ID NO: 1467281 - RNA, 19 nt, Pseudomonas aeruginosa PA01
ugucggcgcugucgccguu

SEQ ID NO: 1467282 - RNA, 20 nt, Pseudomonas aeruginosa PA01
ugugguuggaaaagccccgc

SEQ ID NO: 1467283 - RNA, 15 nt, Pseudomonas aeruginosa PA01
ugucggcaaccgggc

SEQ ID NO: 1467284 - RNA, 16 nt, Pseudomonas aeruginosa PA01
ugucggcacgacacca

SEQ ID NO: 1467285 - RNA, 14 nt, Pseudomonas aeruginosa PA01
ugucgcuggccagc

SEQ ID NO: 1467286 - RNA, 17 nt, Pseudomonas aeruginosa PA01
ugucgcuggccagcuug

SEQ ID NO: 1467287 - RNA, 14 nt, Pseudomonas aeruginosa PA01
ugucgcuggccugc

SEQ ID NO: 1467288 - RNA, 14 nt, Pseudomonas aeruginosa PA01
ugucgcugaccggc

SEQ ID NO: 1467289 - RNA, 14 nt, Pseudomonas aeruginosa PA01
ugucgcugagcggc

SEQ ID NO: 1467290 - RNA, 15 nt, Pseudomonas aeruginosa PA01
ugucgcucagcgggc

SEQ ID NO: 1467291 - RNA, 17 nt, Pseudomonas aeruginosa PA01
ugucgcucagcgggccg

SEQ ID NO: 1467292 - RNA, 17 nt, Pseudomonas aeruginosa PA01
ugucggcgaacuggcca

SEQ ID NO: 1467293 - RNA, 19 nt, Pseudomonas aeruginosa PA01
ugucggcgaacuggccacc

SEQ ID NO: 1467294 - RNA, 14 nt, Pseudomonas aeruginosa PA01
ugucggccgccagg

SEQ ID NO: 1467295 - RNA, 14 nt, Pseudomonas aeruginosa PA01
ugucggccagcagc

SEQ ID NO: 1467296 - RNA, 20 nt, Pseudomonas aeruginosa PA01
uguugcggcgguggccgcgu

SEQ ID NO: 1467297 - RNA, 15 nt, Pseudomonas aeruginosa PA01
uguuggccagcagcc

SEQ ID NO: 1467298 - RNA, 15 nt, Pseudomonas aeruginosa PA01
uguuggccaaccagg

SEQ ID NO: 1467299 - RNA, 15 nt, Pseudomonas aeruginosa PA01
uguucaggcgcgcgg

SEQ ID NO: 1467300 - RNA, 15 nt, Pseudomonas aeruginosa PA01
uguucaggugcugga

SEQ ID NO: 1467301 - RNA, 22 nt, Pseudomonas aeruginosa PA01
uguucaggugcuggacucgcgc

SEQ ID NO: 1467302 - RNA, 18 nt, Pseudomonas aeruginosa PA01
uguucaguucggcggaaa

SEQ ID NO: 1467303 - RNA, 21 nt, Pseudomonas aeruginosa PA01
uguucccucaggauagccggc

SEQ ID NO: 1467304 - RNA, 21 nt, Pseudomonas aeruginosa PA01
uguuccaggcccgccgcggcg

SEQ ID NO: 1467305 - RNA, 15 nt, Pseudomonas aeruginosa PA01
uguuguugcccacca

SEQ ID NO: 1467306 - RNA, 21 nt, Pseudomonas aeruginosa PA01
uguugggcagggugucgacga

SEQ ID NO: 1467307 - RNA, 17 nt, Pseudomonas aeruginosa PA01
uguuucggguccaggcg

SEQ ID NO: 1467308 - RNA, 23 nt, Pseudomonas aeruginosa PA01
acgcgcuggaccauggccggcgu

SEQ ID NO: 1467309 - RNA, 19 nt, Pseudomonas aeruginosa PA01
acgcgcuuguccuccagcu

SEQ ID NO: 1467310 - RNA, 14 nt, Pseudomonas aeruginosa PA01
acgcggacagccug

SEQ ID NO: 1467311 - RNA, 23 nt, Pseudomonas aeruginosa PA01
acgcggcggcuccggcgccaggc

SEQ ID NO: 1467312 - RNA, 20 nt, Pseudomonas aeruginosa PA01
acgcggcguggucuccgugc

SEQ ID NO: 1467313 - RNA, 17 nt, Pseudomonas aeruginosa PA01
acgcggcuggcgcagga

SEQ ID NO: 1467314 - RNA, 19 nt, Pseudomonas aeruginosa PA01
acgcggcuucggucaggug

SEQ ID NO: 1467315 - RNA, 18 nt, Pseudomonas aeruginosa PA01
acgcgggccucugccucg

SEQ ID NO: 1467316 - RNA, 15 nt, Pseudomonas aeruginosa PA01
acgcgagaagccgcc

SEQ ID NO: 1467317 - RNA, 14 nt, Pseudomonas aeruginosa PA01
acgcgaccagcgcc

SEQ ID NO: 1467318 - RNA, 16 nt, Pseudomonas aeruginosa PA01
acgcgaccagcgccag

SEQ ID NO: 1467319 - RNA, 21 nt, Pseudomonas aeruginosa PA01
acgcgaccagcgccaggcgcg

SEQ ID NO: 1467320 - RNA, 15 nt, Pseudomonas aeruginosa PA01
acgcgccgucgcgac

SEQ ID NO: 1467321 - RNA, 12 nt, Pseudomonas aeruginosa PA01
acgcgccggguc

SEQ ID NO: 1467322 - RNA, 18 nt, Pseudomonas aeruginosa PA01
acgcgaaugcccggcagc

SEQ ID NO: 1467323 - RNA, 14 nt, Pseudomonas aeruginosa PA01
acgccgguggccag

SEQ ID NO: 1467324 - RNA, 16 nt, Pseudomonas aeruginosa PA01
acgccgguggccaggc

SEQ ID NO: 1467325 - RNA, 21 nt, Pseudomonas aeruginosa PA01
acgccggugccaggaccagcc

SEQ ID NO: 1467326 - RNA, 21 nt, Pseudomonas aeruginosa PA01
acgccguccaccagccagcuc

SEQ ID NO: 1467327 - RNA, 17 nt, Pseudomonas aeruginosa PA01
acgccgugcaucaccgg

SEQ ID NO: 1467328 - RNA, 22 nt, Pseudomonas aeruginosa PA01
acgccgugcaucaccggcagca

SEQ ID NO: 1467329 - RNA, 21 nt, Pseudomonas aeruginosa PA01
acgccgucgccgcugaugcgc

SEQ ID NO: 1467330 - RNA, 14 nt, Pseudomonas aeruginosa PA01
acgccucggcgcga

SEQ ID NO: 1467331 - RNA, 23 nt, Pseudomonas aeruginosa PA01
acgccucgcggcuaucgaucacu

SEQ ID NO: 1467332 - RNA, 21 nt, Pseudomonas aeruginosa PA01
acgccucgucggaggcgagga

SEQ ID NO: 1467333 - RNA, 15 nt, Pseudomonas aeruginosa PA01
acgccgccugcgccu

SEQ ID NO: 1467334 - RNA, 16 nt, Pseudomonas aeruginosa PA01
acgccgccugcgccuc

SEQ ID NO: 1467335 - RNA, 17 nt, Pseudomonas aeruginosa PA01
acgccgccugcgccucg

SEQ ID NO: 1467336 - RNA, 19 nt, Pseudomonas aeruginosa PA01
acgccgccugcgccucggc

SEQ ID NO: 1467337 - RNA, 18 nt, Pseudomonas aeruginosa PA01
acgccgcgaagcccagcg

SEQ ID NO: 1467338 - RNA, 20 nt, Pseudomonas aeruginosa PA01
acgccgcgaagcccagcgcc

SEQ ID NO: 1467339 - RNA, 21 nt, Pseudomonas aeruginosa PA01
acgccgcgaagcccagcgccg

SEQ ID NO: 1467340 - RNA, 20 nt, Pseudomonas aeruginosa PA01
acgcccuugcggcgcggccc

SEQ ID NO: 1467341 - RNA, 20 nt, Pseudomonas aeruginosa PA01
acgccgcgauggcucgcggc

SEQ ID NO: 1467342 - RNA, 12 nt, Pseudomonas aeruginosa PA01
acgcccuggagc

SEQ ID NO: 1467343 - RNA, 17 nt, Pseudomonas aeruginosa PA01
acgcccugcaccuuggg

SEQ ID NO: 1467344 - RNA, 22 nt, Pseudomonas aeruginosa PA01
acgcccugcgccagcaucgcau

SEQ ID NO: 1467345 - RNA, 14 nt, Pseudomonas aeruginosa PA01
acgcccuccagcac

SEQ ID NO: 1467346 - RNA, 17 nt, Pseudomonas aeruginosa PA01
acgcccuccagcaccgc

SEQ ID NO: 1467347 - RNA, 14 nt, Pseudomonas aeruginosa PA01
acgcccugggacag

SEQ ID NO: 1467348 - RNA, 18 nt, Pseudomonas aeruginosa PA01
acgccggucucgauggca

SEQ ID NO: 1467349 - RNA, 14 nt, Pseudomonas aeruginosa PA01
acgccggucucggc

SEQ ID NO: 1467350 - RNA, 16 nt, Pseudomonas aeruginosa PA01
acgccggucucggcga

SEQ ID NO: 1467351 - RNA, 17 nt, Pseudomonas aeruginosa PA01
acgccggucucggcgau

SEQ ID NO: 1467352 - RNA, 14 nt, Pseudomonas aeruginosa PA01
acgccgggggucgc

SEQ ID NO: 1467353 - RNA, 13 nt, Pseudomonas aeruginosa PA01
acgccgcgcugca

SEQ ID NO: 1467354 - RNA, 20 nt, Pseudomonas aeruginosa PA01
acgccgcgcugcgccaggcc

SEQ ID NO: 1467355 - RNA, 20 nt, Pseudomonas aeruginosa PA01
acgccgggcugguucagcgg

SEQ ID NO: 1467356 - RNA, 19 nt, Pseudomonas aeruginosa PA01
acgccgggcaacgccaggc

SEQ ID NO: 1467357 - RNA, 22 nt, Pseudomonas aeruginosa PA01
acgccggcuuccaccagacgca

SEQ ID NO: 1467358 - RNA, 16 nt, Pseudomonas aeruginosa PA01
acgcguacgacuucgg

SEQ ID NO: 1467359 - RNA, 18 nt, Pseudomonas aeruginosa PA01
acgcguacgacuucggcg

SEQ ID NO: 1467360 - RNA, 22 nt, Pseudomonas aeruginosa PA01
acgcggugccauucggugcgcu

SEQ ID NO: 1467361 - RNA, 19 nt, Pseudomonas aeruginosa PA01
acgcguucccccguggcga

SEQ ID NO: 1467362 - RNA, 20 nt, Pseudomonas aeruginosa PA01
acgcguucccccguggcgac

SEQ ID NO: 1467363 - RNA, 22 nt, Pseudomonas aeruginosa PA01
acgcguugcuuguguccgccga

SEQ ID NO: 1467364 - RNA, 13 nt, Pseudomonas aeruginosa PA01
acgcguucggcga

SEQ ID NO: 1467365 - RNA, 17 nt, Pseudomonas aeruginosa PA01
acgcguucggcgaugcc

SEQ ID NO: 1467366 - RNA, 13 nt, Pseudomonas aeruginosa PA01
acgcgugaagcug

SEQ ID NO: 1467367 - RNA, 15 nt, Pseudomonas aeruginosa PA01
acgcgugauacagcu

SEQ ID NO: 1467368 - RNA, 20 nt, Pseudomonas aeruginosa PA01
acgcgugauacagcucgcug

SEQ ID NO: 1467369 - RNA, 23 nt, Pseudomonas aeruginosa PA01
acgcuccagcggcagcucggcga

SEQ ID NO: 1467370 - RNA, 14 nt, Pseudomonas aeruginosa PA01
acgcuccugcgccg

SEQ ID NO: 1467371 - RNA, 16 nt, Pseudomonas aeruginosa PA01
acgcuccugcgccggc

SEQ ID NO: 1467372 - RNA, 17 nt, Pseudomonas aeruginosa PA01
acgcuccugcgccggcu

SEQ ID NO: 1467373 - RNA, 22 nt, Pseudomonas aeruginosa PA01
acgcuccuuguagaacggcggc

SEQ ID NO: 1467374 - RNA, 16 nt, Pseudomonas aeruginosa PA01
acgcucgcggcauccc

SEQ ID NO: 1467375 - RNA, 20 nt, Pseudomonas aeruginosa PA01
acgcuacguuccagggccug

SEQ ID NO: 1467376 - RNA, 22 nt, Pseudomonas aeruginosa PA01
acgcucaggaagaagccucgcg

SEQ ID NO: 1467377 - RNA, 12 nt, Pseudomonas aeruginosa PA01
acgcucaggcca

SEQ ID NO: 1467378 - RNA, 14 nt, Pseudomonas aeruginosa PA01
acgcucaggucggu

SEQ ID NO: 1467379 - RNA, 14 nt, Pseudomonas aeruginosa PA01
acgcucagugcgcc

SEQ ID NO: 1467380 - RNA, 17 nt, Pseudomonas aeruginosa PA01
acgcucagugcgccggg

SEQ ID NO: 1467381 - RNA, 14 nt, Pseudomonas aeruginosa PA01
acgcucaccaccac

SEQ ID NO: 1467382 - RNA, 19 nt, Pseudomonas aeruginosa PA01
acgcucaccaccaccgcgc

SEQ ID NO: 1467383 - RNA, 21 nt, Pseudomonas aeruginosa PA01
acgcucaccaccaccgcgccg

SEQ ID NO: 1467384 - RNA, 15 nt, Pseudomonas aeruginosa PA01
acgcuguagaccagc

SEQ ID NO: 1467385 - RNA, 21 nt, Pseudomonas aeruginosa PA01
acgcuggucaggcugacgucg

SEQ ID NO: 1467386 - RNA, 18 nt, Pseudomonas aeruginosa PA01
acgcugggacggcugccc

SEQ ID NO: 1467387 - RNA, 15 nt, Pseudomonas aeruginosa PA01
acgcuggugccgacg

SEQ ID NO: 1467388 - RNA, 22 nt, Pseudomonas aeruginosa PA01
acggagaagcguccgagguggc

SEQ ID NO: 1467389 - RNA, 19 nt, Pseudomonas aeruginosa PA01
acggacguuccaccuggcg

SEQ ID NO: 1467390 - RNA, 14 nt, Pseudomonas aeruginosa PA01
acggacgcgacgcc

SEQ ID NO: 1467391 - RNA, 18 nt, Pseudomonas aeruginosa PA01
acggaaggccacgccgcc

SEQ ID NO: 1467392 - RNA, 12 nt, Pseudomonas aeruginosa PA01
acggaaggucgc

SEQ ID NO: 1467393 - RNA, 15 nt, Pseudomonas aeruginosa PA01
acggaacgucggccu

SEQ ID NO: 1467394 - RNA, 18 nt, Pseudomonas aeruginosa PA01
acggaagcauggccggcu

SEQ ID NO: 1467395 - RNA, 15 nt, Pseudomonas aeruginosa PA01
acggaagcggccgag

SEQ ID NO: 1467396 - RNA, 21 nt, Pseudomonas aeruginosa PA01
acgcucggggugcgcggcgaa

SEQ ID NO: 1467397 - RNA, 14 nt, Pseudomonas aeruginosa PA01
acgcucugcucggc

SEQ ID NO: 1467398 - RNA, 17 nt, Pseudomonas aeruginosa PA01
acgcucucgaacagcag

SEQ ID NO: 1467399 - RNA, 17 nt, Pseudomonas aeruginosa PA01
acgcucuucaccucgau

SEQ ID NO: 1467400 - RNA, 14 nt, Pseudomonas aeruginosa PA01
acgcugccagcagg

SEQ ID NO: 1467401 - RNA, 13 nt, Pseudomonas aeruginosa PA01
acgcugcccagcc

SEQ ID NO: 1467402 - RNA, 16 nt, Pseudomonas aeruginosa PA01
acgcugcccagcccgc

SEQ ID NO: 1467403 - RNA, 13 nt, Pseudomonas aeruginosa PA01
acgcugccgagga

SEQ ID NO: 1467404 - RNA, 22 nt, Pseudomonas aeruginosa PA01
acgcugcaugcggaacaccgcc

SEQ ID NO: 1467405 - RNA, 15 nt, Pseudomonas aeruginosa PA01
acgcugaggcucagc

SEQ ID NO: 1467406 - RNA, 21 nt, Pseudomonas aeruginosa PA01
acgcugaggcucagcgcgccg

SEQ ID NO: 1467407 - RNA, 24 nt, Pseudomonas aeruginosa PA01
acgcugaggaucacgauggccggc

SEQ ID NO: 1467408 - RNA, 17 nt, Pseudomonas aeruginosa PA01
acgcugaucaucagcag

SEQ ID NO: 1467409 - RNA, 22 nt, Pseudomonas aeruginosa PA01
acgcugaucaucgagaacaggu

SEQ ID NO: 1467410 - RNA, 21 nt, Pseudomonas aeruginosa PA01
acgcugaugaugccgcggcga

SEQ ID NO: 1467411 - RNA, 15 nt, Pseudomonas aeruginosa PA01
acgcugaugccggcg

SEQ ID NO: 1467412 - RNA, 18 nt, Pseudomonas aeruginosa PA01
acgcugcaauucgucggc

SEQ ID NO: 1467413 - RNA, 22 nt, Pseudomonas aeruginosa PA01
acgcugcaauucgucggccugc

SEQ ID NO: 1467414 - RNA, 20 nt, Pseudomonas aeruginosa PA01
acgaugcgccccagcgccug

SEQ ID NO: 1467415 - RNA, 20 nt, Pseudomonas aeruginosa PA01
acgaugcuggcaacggcggg

SEQ ID NO: 1467416 - RNA, 20 nt, Pseudomonas aeruginosa PA01
acgauggccggcagcagcgc

SEQ ID NO: 1467417 - RNA, 23 nt, Pseudomonas aeruginosa PA01
acgauggccggcagcagcgccag

SEQ ID NO: 1467418 - RNA, 15 nt, Pseudomonas aeruginosa PA01
acgauggccagcccg

SEQ ID NO: 1467419 - RNA, 17 nt, Pseudomonas aeruginosa PA01
acgcacugguugaagcg

SEQ ID NO: 1467420 - RNA, 15 nt, Pseudomonas aeruginosa PA01
acgcacuucguccgc

SEQ ID NO: 1467421 - RNA, 18 nt, Pseudomonas aeruginosa PA01
acgcacuucguccgccac

SEQ ID NO: 1467422 - RNA, 22 nt, Pseudomonas aeruginosa PA01
acgcacuucguccgccaccacg

SEQ ID NO: 1467423 - RNA, 14 nt, Pseudomonas aeruginosa PA01
acgcagcucugcga

SEQ ID NO: 1467424 - RNA, 12 nt, Pseudomonas aeruginosa PA01
acgcacgcgccu

SEQ ID NO: 1467425 - RNA, 18 nt, Pseudomonas aeruginosa PA01
acgcaccucgucgagcag

SEQ ID NO: 1467426 - RNA, 17 nt, Pseudomonas aeruginosa PA01
acgaucacucccugcuc

SEQ ID NO: 1467427 - RNA, 14 nt, Pseudomonas aeruginosa PA01
acgaucacccccag

SEQ ID NO: 1467428 - RNA, 16 nt, Pseudomonas aeruginosa PA01
acgauaucggcgccgg

SEQ ID NO: 1467429 - RNA, 12 nt, Pseudomonas aeruginosa PA01
acgaugccgccg

SEQ ID NO: 1467430 - RNA, 13 nt, Pseudomonas aeruginosa PA01
acgaugccgccgc

SEQ ID NO: 1467431 - RNA, 20 nt, Pseudomonas aeruginosa PA01
acgaugccgaucucgcccag

SEQ ID NO: 1467432 - RNA, 23 nt, Pseudomonas aeruginosa PA01
acgaugccguucucggugaccac

SEQ ID NO: 1467433 - RNA, 23 nt, Pseudomonas aeruginosa PA01
acgaugccguuguagcugaccac

SEQ ID NO: 1467434 - RNA, 12 nt, Pseudomonas aeruginosa PA01
acgaucccggcg

SEQ ID NO: 1467435 - RNA, 21 nt, Pseudomonas aeruginosa PA01
acgcccauguagaccaccagc

SEQ ID NO: 1467436 - RNA, 18 nt, Pseudomonas aeruginosa PA01
acgcccaugccuugcagc

SEQ ID NO: 1467437 - RNA, 14 nt, Pseudomonas aeruginosa PA01
acgccccagcgcau

SEQ ID NO: 1467438 - RNA, 17 nt, Pseudomonas aeruginosa PA01
acgccccagcgcaucgc

SEQ ID NO: 1467439 - RNA, 20 nt, Pseudomonas aeruginosa PA01
acgcccaucgccaccagcag

SEQ ID NO: 1467440 - RNA, 13 nt, Pseudomonas aeruginosa PA01
acgcccaucggcg

SEQ ID NO: 1467441 - RNA, 20 nt, Pseudomonas aeruginosa PA01
acgcccaguugcgccgccug

SEQ ID NO: 1467442 - RNA, 21 nt, Pseudomonas aeruginosa PA01
acgcccaguugcgccgccugc

SEQ ID NO: 1467443 - RNA, 15 nt, Pseudomonas aeruginosa PA01
acgccccgucgacgc

SEQ ID NO: 1467444 - RNA, 21 nt, Pseudomonas aeruginosa PA01
acgcccggcuuuccucggcca

SEQ ID NO: 1467445 - RNA, 13 nt, Pseudomonas aeruginosa PA01
acgcccucggcga

SEQ ID NO: 1467446 - RNA, 14 nt, Pseudomonas aeruginosa PA01
acgcccucggcgac

SEQ ID NO: 1467447 - RNA, 17 nt, Pseudomonas aeruginosa PA01
acgcccggugucgacga

SEQ ID NO: 1467448 - RNA, 18 nt, Pseudomonas aeruginosa PA01
acgcccggugucgacgac

SEQ ID NO: 1467449 - RNA, 13 nt, Pseudomonas aeruginosa PA01
acgccauccgccu

SEQ ID NO: 1467450 - RNA, 15 nt, Pseudomonas aeruginosa PA01
acgccauccuucggc

SEQ ID NO: 1467451 - RNA, 16 nt, Pseudomonas aeruginosa PA01
acgccauaggcggcgc

SEQ ID NO: 1467452 - RNA, 19 nt, Pseudomonas aeruginosa PA01
acgcccaggcgcucggcga

SEQ ID NO: 1467453 - RNA, 21 nt, Pseudomonas aeruginosa PA01
acgccagcccagugcuggcgu

SEQ ID NO: 1467454 - RNA, 15 nt, Pseudomonas aeruginosa PA01
acgcaggccagcgcc

SEQ ID NO: 1467455 - RNA, 19 nt, Pseudomonas aeruginosa PA01
acgcaggccagcgccaggg

SEQ ID NO: 1467456 - RNA, 17 nt, Pseudomonas aeruginosa PA01
acgcaggcuuuccagcc

SEQ ID NO: 1467457 - RNA, 16 nt, Pseudomonas aeruginosa PA01
acgcaggccgcugccu

SEQ ID NO: 1467458 - RNA, 12 nt, Pseudomonas aeruginosa PA01
acgcaggcgcau

SEQ ID NO: 1467459 - RNA, 16 nt, Pseudomonas aeruginosa PA01
acgcaggcgcauggcg

SEQ ID NO: 1467460 - RNA, 23 nt, Pseudomonas aeruginosa PA01
acgcaggcgccgauggcugucgg

SEQ ID NO: 1467461 - RNA, 22 nt, Pseudomonas aeruginosa PA01
acgcaggaacagcuccuccagc

SEQ ID NO: 1467462 - RNA, 12 nt, Pseudomonas aeruginosa PA01
acgcaggcgcug

SEQ ID NO: 1467463 - RNA, 13 nt, Pseudomonas aeruginosa PA01
acgcagggccgga

SEQ ID NO: 1467464 - RNA, 14 nt, Pseudomonas aeruginosa PA01
acgcagggccggau

SEQ ID NO: 1467465 - RNA, 14 nt, Pseudomonas aeruginosa PA01
acgcagggcggcgc

SEQ ID NO: 1467466 - RNA, 20 nt, Pseudomonas aeruginosa PA01
acgcagggcgguacgccgcg

SEQ ID NO: 1467467 - RNA, 17 nt, Pseudomonas aeruginosa PA01
acgcaggggcaccggcg

SEQ ID NO: 1467468 - RNA, 18 nt, Pseudomonas aeruginosa PA01
acgcaggggcaccggcgg

SEQ ID NO: 1467469 - RNA, 16 nt, Pseudomonas aeruginosa PA01
acgccagaagcgacug

SEQ ID NO: 1467470 - RNA, 14 nt, Pseudomonas aeruginosa PA01
acgccagcaggcgc

SEQ ID NO: 1467471 - RNA, 15 nt, Pseudomonas aeruginosa PA01
acgccagcaggcgca

SEQ ID NO: 1467472 - RNA, 16 nt, Pseudomonas aeruginosa PA01
acgccagcaggcgcag

SEQ ID NO: 1467473 - RNA, 18 nt, Pseudomonas aeruginosa PA01
acgccagcaggcgcaggu

SEQ ID NO: 1467474 - RNA, 16 nt, Pseudomonas aeruginosa PA01
acgcauguucaugcgc

SEQ ID NO: 1467475 - RNA, 20 nt, Pseudomonas aeruginosa PA01
acgcauguucaugcgcuggu

SEQ ID NO: 1467476 - RNA, 14 nt, Pseudomonas aeruginosa PA01
acgaaaaagccggc

SEQ ID NO: 1467477 - RNA, 18 nt, Pseudomonas aeruginosa PA01
acgaaaaaggcgcgccgg

SEQ ID NO: 1467478 - RNA, 14 nt, Pseudomonas aeruginosa PA01
acgaaaagccgccc

SEQ ID NO: 1467479 - RNA, 14 nt, Pseudomonas aeruginosa PA01
acgaaaggccgcgc

SEQ ID NO: 1467480 - RNA, 17 nt, Pseudomonas aeruginosa PA01
acgaaauagucgcgggc

SEQ ID NO: 1467481 - RNA, 19 nt, Pseudomonas aeruginosa PA01
acgaaauagucgcgggccu

SEQ ID NO: 1467482 - RNA, 23 nt, Pseudomonas aeruginosa PA01
accuugaccuugucggccgacgg

SEQ ID NO: 1467483 - RNA, 22 nt, Pseudomonas aeruginosa PA01
acgaacaggugcugguggcccu

SEQ ID NO: 1467484 - RNA, 23 nt, Pseudomonas aeruginosa PA01
acgaacaggugcugguggcccug

SEQ ID NO: 1467485 - RNA, 13 nt, Pseudomonas aeruginosa PA01
acgaacaguucga

SEQ ID NO: 1467486 - RNA, 20 nt, Pseudomonas aeruginosa PA01
acgaacaguucgaugggccg

SEQ ID NO: 1467487 - RNA, 13 nt, Pseudomonas aeruginosa PA01
acgaagcgacugc

SEQ ID NO: 1467488 - RNA, 16 nt, Pseudomonas aeruginosa PA01
acgaagcgacugcgcu

SEQ ID NO: 1467489 - RNA, 22 nt, Pseudomonas aeruginosa PA01
acgaacucaacgaagugaagcg

SEQ ID NO: 1467490 - RNA, 14 nt, Pseudomonas aeruginosa PA01
acgaagaaccccgg

SEQ ID NO: 1467491 - RNA, 14 nt, Pseudomonas aeruginosa PA01
acgaagaacgccag

SEQ ID NO: 1467492 - RNA, 22 nt, Pseudomonas aeruginosa PA01
acgaagacccccugcggcccga

SEQ ID NO: 1467493 - RNA, 18 nt, Pseudomonas aeruginosa PA01
acgaagaccuugaacucg

SEQ ID NO: 1467494 - RNA, 22 nt, Pseudomonas aeruginosa PA01
accugguucaucgagcggcggc

SEQ ID NO: 1467495 - RNA, 11 nt, Pseudomonas aeruginosa PA01
accugucccga

SEQ ID NO: 1467496 - RNA, 19 nt, Pseudomonas aeruginosa PA01
accuguccgaacagggcga

SEQ ID NO: 1467497 - RNA, 20 nt, Pseudomonas aeruginosa PA01
accuguggaauguccugccg

SEQ ID NO: 1467498 - RNA, 21 nt, Pseudomonas aeruginosa PA01
accuguggauaacguccgcgu

SEQ ID NO: 1467499 - RNA, 15 nt, Pseudomonas aeruginosa PA01
accuuccugccagcg

SEQ ID NO: 1467500 - RNA, 19 nt, Pseudomonas aeruginosa PA01
accuuccugccagcgcguc

SEQ ID NO: 1467501 - RNA, 14 nt, Pseudomonas aeruginosa PA01
accuuccgccagca

SEQ ID NO: 1467502 - RNA, 22 nt, Pseudomonas aeruginosa PA01
accuuccgccagcaggcgcggg

SEQ ID NO: 1467503 - RNA, 22 nt, Pseudomonas aeruginosa PA01
accuucgacggcagguggcggg

SEQ ID NO: 1467504 - RNA, 19 nt, Pseudomonas aeruginosa PA01
accuucgcccgcugcgcug

SEQ ID NO: 1467505 - RNA, 23 nt, Pseudomonas aeruginosa PA01
accuucgcccucagcagcgccgc

SEQ ID NO: 1467506 - RNA, 16 nt, Pseudomonas aeruginosa PA01
accuucuccgaccagg

SEQ ID NO: 1467507 - RNA, 17 nt, Pseudomonas aeruginosa PA01
accugucggcucgcgcc

SEQ ID NO: 1467508 - RNA, 20 nt, Pseudomonas aeruginosa PA01
accuucugcaccgugcgcgc

SEQ ID NO: 1467509 - RNA, 22 nt, Pseudomonas aeruginosa PA01
accuggucuucgguggcggcga

SEQ ID NO: 1467510 - RNA, 17 nt, Pseudomonas aeruginosa PA01
accugguggacacccug

SEQ ID NO: 1467511 - RNA, 21 nt, Pseudomonas aeruginosa PA01
accugguggacacccugcugc

SEQ ID NO: 1467512 - RNA, 20 nt, Pseudomonas aeruginosa PA01
accugguggcgccggcugac

SEQ ID NO: 1467513 - RNA, 24 nt, Pseudomonas aeruginosa PA01
accugguggcgccggcugacgcug

SEQ ID NO: 1467514 - RNA, 16 nt, Pseudomonas aeruginosa PA01
accuggugggcggcgg

SEQ ID NO: 1467515 - RNA, 18 nt, Pseudomonas aeruginosa PA01
accguuucgccgccggcc

SEQ ID NO: 1467516 - RNA, 17 nt, Pseudomonas aeruginosa PA01
acgagauugaugaagcg

SEQ ID NO: 1467517 - RNA, 19 nt, Pseudomonas aeruginosa PA01
acgagaaaaagcccggcau

SEQ ID NO: 1467518 - RNA, 14 nt, Pseudomonas aeruginosa PA01
acgaguugggcgac

SEQ ID NO: 1467519 - RNA, 12 nt, Pseudomonas aeruginosa PA01
acgagucgaggc

SEQ ID NO: 1467520 - RNA, 12 nt, Pseudomonas aeruginosa PA01
acgagguugcuc

SEQ ID NO: 1467521 - RNA, 16 nt, Pseudomonas aeruginosa PA01
acgaggcgggcuggaa

SEQ ID NO: 1467522 - RNA, 15 nt, Pseudomonas aeruginosa PA01
acgauaccgccgccg

SEQ ID NO: 1467523 - RNA, 16 nt, Pseudomonas aeruginosa PA01
acgauaccgccgccgg

SEQ ID NO: 1467524 - RNA, 16 nt, Pseudomonas aeruginosa PA01
acgauacgcucggcgu

SEQ ID NO: 1467525 - RNA, 13 nt, Pseudomonas aeruginosa PA01
acgaaggucggcg

SEQ ID NO: 1467526 - RNA, 22 nt, Pseudomonas aeruginosa PA01
acgacaccugcaacgcccgcga

SEQ ID NO: 1467527 - RNA, 14 nt, Pseudomonas aeruginosa PA01
acgaagcgccggcg

SEQ ID NO: 1467528 - RNA, 15 nt, Pseudomonas aeruginosa PA01
acgacaucgacgccc

SEQ ID NO: 1467529 - RNA, 20 nt, Pseudomonas aeruginosa PA01
acgacagccccggcccgguc

SEQ ID NO: 1467530 - RNA, 21 nt, Pseudomonas aeruginosa PA01
acgacaggcggcgggccggcg

SEQ ID NO: 1467531 - RNA, 21 nt, Pseudomonas aeruginosa PA01
acgacgggagcgcgaggcgca

SEQ ID NO: 1467532 - RNA, 13 nt, Pseudomonas aeruginosa PA01
acgacgcuggccu

SEQ ID NO: 1467533 - RNA, 15 nt, Pseudomonas aeruginosa PA01
acgguuggccagcga

SEQ ID NO: 1467534 - RNA, 21 nt, Pseudomonas aeruginosa PA01
acgguuggccagcgaacgcac

SEQ ID NO: 1467535 - RNA, 19 nt, Pseudomonas aeruginosa PA01
acggucagcucggcaucgu

SEQ ID NO: 1467536 - RNA, 12 nt, Pseudomonas aeruginosa PA01
acggggaucacu

SEQ ID NO: 1467537 - RNA, 20 nt, Pseudomonas aeruginosa PA01
acggggaucacucgccgccg

SEQ ID NO: 1467538 - RNA, 18 nt, Pseudomonas aeruginosa PA01
acggggccccucgccgug

SEQ ID NO: 1467539 - RNA, 17 nt, Pseudomonas aeruginosa PA01
acggggcugcggccucg

SEQ ID NO: 1467540 - RNA, 22 nt, Pseudomonas aeruginosa PA01
acgguccccaguagcaucccca

SEQ ID NO: 1467541 - RNA, 22 nt, Pseudomonas aeruginosa PA01
acggugcagccacccagcagca

SEQ ID NO: 1467542 - RNA, 18 nt, Pseudomonas aeruginosa PA01
acgggagcgcgaggcgca

SEQ ID NO: 1467543 - RNA, 16 nt, Pseudomonas aeruginosa PA01
acggcuucagcgccag

SEQ ID NO: 1467544 - RNA, 19 nt, Pseudomonas aeruginosa PA01
acggcuucagcgccaggcc

SEQ ID NO: 1467545 - RNA, 20 nt, Pseudomonas aeruginosa PA01
acggcuucgaccacgacccg

SEQ ID NO: 1467546 - RNA, 14 nt, Pseudomonas aeruginosa PA01
acggcuucgcagau

SEQ ID NO: 1467547 - RNA, 12 nt, Pseudomonas aeruginosa PA01
acggcugccggu

SEQ ID NO: 1467548 - RNA, 13 nt, Pseudomonas aeruginosa PA01
acggcugccggua

SEQ ID NO: 1467549 - RNA, 18 nt, Pseudomonas aeruginosa PA01
acggcugccgguacgcac

SEQ ID NO: 1467550 - RNA, 14 nt, Pseudomonas aeruginosa PA01
acggcugcuccgga

SEQ ID NO: 1467551 - RNA, 13 nt, Pseudomonas aeruginosa PA01
acggcugaggcug

SEQ ID NO: 1467552 - RNA, 16 nt, Pseudomonas aeruginosa PA01
acggcugaggcuggcg

SEQ ID NO: 1467553 - RNA, 18 nt, Pseudomonas aeruginosa PA01
acggcugaggcuggcgac

SEQ ID NO: 1467554 - RNA, 20 nt, Pseudomonas aeruginosa PA01
acggcugaggcuggcgaccg

SEQ ID NO: 1467555 - RNA, 13 nt, Pseudomonas aeruginosa PA01
acggcucgcgcag

SEQ ID NO: 1467556 - RNA, 15 nt, Pseudomonas aeruginosa PA01
acggcucgcggguca

SEQ ID NO: 1467557 - RNA, 16 nt, Pseudomonas aeruginosa PA01
acggcuccggcuccgc

SEQ ID NO: 1467558 - RNA, 20 nt, Pseudomonas aeruginosa PA01
acggcucagaacagcggcag

SEQ ID NO: 1467559 - RNA, 22 nt, Pseudomonas aeruginosa PA01
acggcucagaacagcggcagcu

SEQ ID NO: 1467560 - RNA, 17 nt, Pseudomonas aeruginosa PA01
acggcgucacgccgauc

SEQ ID NO: 1467561 - RNA, 17 nt, Pseudomonas aeruginosa PA01
acggcaacgucgcggau

SEQ ID NO: 1467562 - RNA, 22 nt, Pseudomonas aeruginosa PA01
acggcaccagcgcgucgaagcc

SEQ ID NO: 1467563 - RNA, 16 nt, Pseudomonas aeruginosa PA01
acggcaccaccaccga

SEQ ID NO: 1467564 - RNA, 15 nt, Pseudomonas aeruginosa PA01
acggcacacgucggc

SEQ ID NO: 1467565 - RNA, 21 nt, Pseudomonas aeruginosa PA01
acggcaaggaccugcugcccg

SEQ ID NO: 1467566 - RNA, 22 nt, Pseudomonas aeruginosa PA01
acggcaaguucgcauaggcggc

SEQ ID NO: 1467567 - RNA, 21 nt, Pseudomonas aeruginosa PA01
acggcgugagggucgcgccga

SEQ ID NO: 1467568 - RNA, 16 nt, Pseudomonas aeruginosa PA01
acggcgugcagguagc

SEQ ID NO: 1467569 - RNA, 23 nt, Pseudomonas aeruginosa PA01
acggcgugccguggcucggcggc

SEQ ID NO: 1467570 - RNA, 17 nt, Pseudomonas aeruginosa PA01
acggcguuauccgccgc

SEQ ID NO: 1467571 - RNA, 19 nt, Pseudomonas aeruginosa PA01
acggcguucggggcccucc

SEQ ID NO: 1467572 - RNA, 20 nt, Pseudomonas aeruginosa PA01
acggcguucggggcccucca

SEQ ID NO: 1467573 - RNA, 17 nt, Pseudomonas aeruginosa PA01
acgugcaggaucaccug

SEQ ID NO: 1467574 - RNA, 15 nt, Pseudomonas aeruginosa PA01
acgugcagcucggca

SEQ ID NO: 1467575 - RNA, 17 nt, Pseudomonas aeruginosa PA01
acgugcacgccgugcau

SEQ ID NO: 1467576 - RNA, 23 nt, Pseudomonas aeruginosa PA01
acgugcacgccgugcaucaccgg

SEQ ID NO: 1467577 - RNA, 13 nt, Pseudomonas aeruginosa PA01
acgugcacccgcu

SEQ ID NO: 1467578 - RNA, 16 nt, Pseudomonas aeruginosa PA01
acguggccggcgcgga

SEQ ID NO: 1467579 - RNA, 15 nt, Pseudomonas aeruginosa PA01
acguggcgcuugagc

SEQ ID NO: 1467580 - RNA, 23 nt, Pseudomonas aeruginosa PA01
acguggcgcuugagcagccaggc

SEQ ID NO: 1467581 - RNA, 18 nt, Pseudomonas aeruginosa PA01
acguggauauugugcgag

SEQ ID NO: 1467582 - RNA, 14 nt, Pseudomonas aeruginosa PA01
acguggcauucguc

SEQ ID NO: 1467583 - RNA, 19 nt, Pseudomonas aeruginosa PA01
acguggcauucgucgccgc

SEQ ID NO: 1467584 - RNA, 22 nt, Pseudomonas aeruginosa PA01
acuaccuggggauggccggcgc

SEQ ID NO: 1467585 - RNA, 14 nt, Pseudomonas aeruginosa PA01
acuaucgucgaggg

SEQ ID NO: 1467586 - RNA, 20 nt, Pseudomonas aeruginosa PA01
acuaccgccgagggcgccag

SEQ ID NO: 1467587 - RNA, 20 nt, Pseudomonas aeruginosa PA01
acuauuccgccaccagccag

SEQ ID NO: 1467588 - RNA, 18 nt, Pseudomonas aeruginosa PA01
acguugacgaucgccccg

SEQ ID NO: 1467589 - RNA, 21 nt, Pseudomonas aeruginosa PA01
acguugccgcgcgggccggcg

SEQ ID NO: 1467590 - RNA, 19 nt, Pseudomonas aeruginosa PA01
acguugccauccagcgccu

SEQ ID NO: 1467591 - RNA, 20 nt, Pseudomonas aeruginosa PA01
acguugcgccgcagcggcgu

SEQ ID NO: 1467592 - RNA, 14 nt, Pseudomonas aeruginosa PA01
acgucaccguccuu

SEQ ID NO: 1467593 - RNA, 18 nt, Pseudomonas aeruginosa PA01
acgucacggauaggcggc

SEQ ID NO: 1467594 - RNA, 20 nt, Pseudomonas aeruginosa PA01
acgucacggauaggcggcgg

SEQ ID NO: 1467595 - RNA, 13 nt, Pseudomonas aeruginosa PA01
acguccggcgucc

SEQ ID NO: 1467596 - RNA, 22 nt, Pseudomonas aeruginosa PA01
acguccggcgagaaaggcugcu

SEQ ID NO: 1467597 - RNA, 14 nt, Pseudomonas aeruginosa PA01
acguaaucgccauu

SEQ ID NO: 1467598 - RNA, 14 nt, Pseudomonas aeruginosa PA01
acgguucagcagcg

SEQ ID NO: 1467599 - RNA, 14 nt, Pseudomonas aeruginosa PA01
acgguuucaggccu

SEQ ID NO: 1467600 - RNA, 17 nt, Pseudomonas aeruginosa PA01
acguaucccagcgcgug

SEQ ID NO: 1467601 - RNA, 15 nt, Pseudomonas aeruginosa PA01
acguaauucgcugac

SEQ ID NO: 1467602 - RNA, 19 nt, Pseudomonas aeruginosa PA01
acgugaccguccagcgcgc

SEQ ID NO: 1467603 - RNA, 21 nt, Pseudomonas aeruginosa PA01
acgugaccguccagcgcgccg

SEQ ID NO: 1467604 - RNA, 22 nt, Pseudomonas aeruginosa PA01
acgugaccguccagcgcgccgc

SEQ ID NO: 1467605 - RNA, 15 nt, Pseudomonas aeruginosa PA01
acgucuucaggcgcu

SEQ ID NO: 1467606 - RNA, 12 nt, Pseudomonas aeruginosa PA01
acgucucggcga

SEQ ID NO: 1467607 - RNA, 23 nt, Pseudomonas aeruginosa PA01
acgucuggccagaaggucgggga

SEQ ID NO: 1467608 - RNA, 15 nt, Pseudomonas aeruginosa PA01
acgucgccccagccu

SEQ ID NO: 1467609 - RNA, 15 nt, Pseudomonas aeruginosa PA01
acgucgccccaggga

SEQ ID NO: 1467610 - RNA, 20 nt, Pseudomonas aeruginosa PA01
acgucgcagguaacccgcgg

SEQ ID NO: 1467611 - RNA, 15 nt, Pseudomonas aeruginosa PA01
acguccucgcgccgc

SEQ ID NO: 1467612 - RNA, 18 nt, Pseudomonas aeruginosa PA01
acguccucgaugcccgcc

SEQ ID NO: 1467613 - RNA, 13 nt, Pseudomonas aeruginosa PA01
acguccuccagga

SEQ ID NO: 1467614 - RNA, 15 nt, Pseudomonas aeruginosa PA01
acguccuccaggcuc

SEQ ID NO: 1467615 - RNA, 21 nt, Pseudomonas aeruginosa PA01
acguccuggccgagccgcuug

SEQ ID NO: 1467616 - RNA, 22 nt, Pseudomonas aeruginosa PA01
acguccuggccgagccgcuugg

SEQ ID NO: 1467617 - RNA, 16 nt, Pseudomonas aeruginosa PA01
acgucgccgaccaggc

SEQ ID NO: 1467618 - RNA, 16 nt, Pseudomonas aeruginosa PA01
acgucgcgcaccuggc

SEQ ID NO: 1467619 - RNA, 16 nt, Pseudomonas aeruginosa PA01
acugcggggcgcucag

SEQ ID NO: 1467620 - RNA, 19 nt, Pseudomonas aeruginosa PA01
acugcgguuuuccugcccc

SEQ ID NO: 1467621 - RNA, 19 nt, Pseudomonas aeruginosa PA01
acugcacgcagacgucgag

SEQ ID NO: 1467622 - RNA, 22 nt, Pseudomonas aeruginosa PA01
acugggcguggcggccgccggc

SEQ ID NO: 1467623 - RNA, 22 nt, Pseudomonas aeruginosa PA01
acuggucgcgcgcggccagcuc

SEQ ID NO: 1467624 - RNA, 21 nt, Pseudomonas aeruginosa PA01
acuggucgcggcugcgcgccg

SEQ ID NO: 1467625 - RNA, 16 nt, Pseudomonas aeruginosa PA01
acuggucgcuccagcc

SEQ ID NO: 1467626 - RNA, 14 nt, Pseudomonas aeruginosa PA01
acuggucgccgcag

SEQ ID NO: 1467627 - RNA, 22 nt, Pseudomonas aeruginosa PA01
acugguaggacagggccaggcc

SEQ ID NO: 1467628 - RNA, 15 nt, Pseudomonas aeruginosa PA01
acuggucgcagccgc

SEQ ID NO: 1467629 - RNA, 13 nt, Pseudomonas aeruginosa PA01
acuggcggcuggg

SEQ ID NO: 1467630 - RNA, 20 nt, Pseudomonas aeruginosa PA01
acuggcgauggaugacccgc

SEQ ID NO: 1467631 - RNA, 20 nt, Pseudomonas aeruginosa PA01
acuggcccucucucgccucg

SEQ ID NO: 1467632 - RNA, 21 nt, Pseudomonas aeruginosa PA01
acuggccgaaauugaccaggu

SEQ ID NO: 1467633 - RNA, 15 nt, Pseudomonas aeruginosa PA01
acuggcgcugcgcgg

SEQ ID NO: 1467634 - RNA, 14 nt, Pseudomonas aeruginosa PA01
acuggcggaccgcc

SEQ ID NO: 1467635 - RNA, 18 nt, Pseudomonas aeruginosa PA01
acuggcggaucaccggcu

SEQ ID NO: 1467636 - RNA, 21 nt, Pseudomonas aeruginosa PA01
acucuccaggucggucggcgg

SEQ ID NO: 1467637 - RNA, 22 nt, Pseudomonas aeruginosa PA01
acucuccaggucggucggcggc

SEQ ID NO: 1467638 - RNA, 21 nt, Pseudomonas aeruginosa PA01
acucguccggucgcaccgcca

SEQ ID NO: 1467639 - RNA, 20 nt, Pseudomonas aeruginosa PA01
acucgucguccagcggcucg

SEQ ID NO: 1467640 - RNA, 20 nt, Pseudomonas aeruginosa PA01
acugagcgugacccgcgcuu

SEQ ID NO: 1467641 - RNA, 13 nt, Pseudomonas aeruginosa PA01
acugagggucagc

SEQ ID NO: 1467642 - RNA, 17 nt, Pseudomonas aeruginosa PA01
acugauaccgcuggcca

SEQ ID NO: 1467643 - RNA, 14 nt, Pseudomonas aeruginosa PA01
acugauauccgcuc

SEQ ID NO: 1467644 - RNA, 12 nt, Pseudomonas aeruginosa PA01
acugaccacgca

SEQ ID NO: 1467645 - RNA, 17 nt, Pseudomonas aeruginosa PA01
acugacgcgcagcgccg

SEQ ID NO: 1467646 - RNA, 20 nt, Pseudomonas aeruginosa PA01
acugacgcgcagcgccgccg

SEQ ID NO: 1467647 - RNA, 19 nt, Pseudomonas aeruginosa PA01
acucggcugcaacgccgcg

SEQ ID NO: 1467648 - RNA, 23 nt, Pseudomonas aeruginosa PA01
acucgguguagcugaggccguag

SEQ ID NO: 1467649 - RNA, 15 nt, Pseudomonas aeruginosa PA01
acucggcggggcgca

SEQ ID NO: 1467650 - RNA, 13 nt, Pseudomonas aeruginosa PA01
acucggccucggc

SEQ ID NO: 1467651 - RNA, 22 nt, Pseudomonas aeruginosa PA01
acucggccucggcgucgcgcag

SEQ ID NO: 1467652 - RNA, 13 nt, Pseudomonas aeruginosa PA01
acucggcgaccac

SEQ ID NO: 1467653 - RNA, 19 nt, Pseudomonas aeruginosa PA01
acucggcgaccacccggcg

SEQ ID NO: 1467654 - RNA, 16 nt, Pseudomonas aeruginosa PA01
acucggcggcgagcgc

SEQ ID NO: 1467655 - RNA, 15 nt, Pseudomonas aeruginosa PA01
acucggcgcugccgg

SEQ ID NO: 1467656 - RNA, 18 nt, Pseudomonas aeruginosa PA01
acucggcccgggccuggu

SEQ ID NO: 1467657 - RNA, 17 nt, Pseudomonas aeruginosa PA01
acucggccaggcgccag

SEQ ID NO: 1467658 - RNA, 14 nt, Pseudomonas aeruginosa PA01
acucacccgcugcg

SEQ ID NO: 1467659 - RNA, 14 nt, Pseudomonas aeruginosa PA01
acucauagcucagc

SEQ ID NO: 1467660 - RNA, 18 nt, Pseudomonas aeruginosa PA01
acucacggaugccgggcg

SEQ ID NO: 1467661 - RNA, 15 nt, Pseudomonas aeruginosa PA01
acuucaagcuggcgc

SEQ ID NO: 1467662 - RNA, 14 nt, Pseudomonas aeruginosa PA01
acuguucggucggu

SEQ ID NO: 1467663 - RNA, 22 nt, Pseudomonas aeruginosa PA01
acugguuggccgccuggcgcau

SEQ ID NO: 1467664 - RNA, 13 nt, Pseudomonas aeruginosa PA01
acugucucgccga

SEQ ID NO: 1467665 - RNA, 14 nt, Pseudomonas aeruginosa PA01
acugucucgccgau

SEQ ID NO: 1467666 - RNA, 12 nt, Pseudomonas aeruginosa PA01
acugucggcgga

SEQ ID NO: 1467667 - RNA, 13 nt, Pseudomonas aeruginosa PA01
acuucaggccggc

SEQ ID NO: 1467668 - RNA, 16 nt, Pseudomonas aeruginosa PA01
acuucaggccggcgcc

SEQ ID NO: 1467669 - RNA, 17 nt, Pseudomonas aeruginosa PA01
acuucaggccggcgccg

SEQ ID NO: 1467670 - RNA, 17 nt, Pseudomonas aeruginosa PA01
acuuccagcacgccgau

SEQ ID NO: 1467671 - RNA, 17 nt, Pseudomonas aeruginosa PA01
acuucccugccggcggu

SEQ ID NO: 1467672 - RNA, 18 nt, Pseudomonas aeruginosa PA01
acuuccugggaugccggg

SEQ ID NO: 1467673 - RNA, 17 nt, Pseudomonas aeruginosa PA01
acuucgcaccagccggc

SEQ ID NO: 1467674 - RNA, 21 nt, Pseudomonas aeruginosa PA01
acuucgcaccagccggccgcg

SEQ ID NO: 1467675 - RNA, 16 nt, Pseudomonas aeruginosa PA01
acuucgaagccgagcu

SEQ ID NO: 1467676 - RNA, 14 nt, Pseudomonas aeruginosa PA01
acuuccggcccggc

SEQ ID NO: 1467677 - RNA, 16 nt, Pseudomonas aeruginosa PA01
acuuccugaaggcgcg

SEQ ID NO: 1467678 - RNA, 17 nt, Pseudomonas aeruginosa PA01
acuuccucggcgaccac

SEQ ID NO: 1467679 - RNA, 18 nt, Pseudomonas aeruginosa PA01
acuuccucggcgaccacc

SEQ ID NO: 1467680 - RNA, 19 nt, Pseudomonas aeruginosa PA01
acuuccgggcugcgcucgg

SEQ ID NO: 1467681 - RNA, 22 nt, Pseudomonas aeruginosa PA01
acuucggucucguccggcgugg

SEQ ID NO: 1467682 - RNA, 15 nt, Pseudomonas aeruginosa PA01
acuucggcgcgcggc

SEQ ID NO: 1467683 - RNA, 17 nt, Pseudomonas aeruginosa PA01
acuucgugccacaggcc

SEQ ID NO: 1467684 - RNA, 13 nt, Pseudomonas aeruginosa PA01
acuucguccggcc

SEQ ID NO: 1467685 - RNA, 17 nt, Pseudomonas aeruginosa PA01
acuucguccggccgccc

SEQ ID NO: 1467686 - RNA, 13 nt, Pseudomonas aeruginosa PA01
acuuggcccggcg

SEQ ID NO: 1467687 - RNA, 17 nt, Pseudomonas aeruginosa PA01
acuuggagaagaucgcc

SEQ ID NO: 1467688 - RNA, 23 nt, Pseudomonas aeruginosa PA01
acuugccggcgccaucgaucagc

SEQ ID NO: 1467689 - RNA, 22 nt, Pseudomonas aeruginosa PA01
acuugcggcccaccaccacgac

SEQ ID NO: 1467690 - RNA, 21 nt, Pseudomonas aeruginosa PA01
acuugcgggugcgcaggcugc

SEQ ID NO: 1467691 - RNA, 23 nt, Pseudomonas aeruginosa PA01
acuugaugucgaugggcgacagc

SEQ ID NO: 1467692 - RNA, 12 nt, Pseudomonas aeruginosa PA01
acuugccgccgc

SEQ ID NO: 1467693 - RNA, 22 nt, Pseudomonas aeruginosa PA01
acuucuccagguacagccgcag

SEQ ID NO: 1467694 - RNA, 14 nt, Pseudomonas aeruginosa PA01
acuugaaccccgaa

SEQ ID NO: 1467695 - RNA, 18 nt, Pseudomonas aeruginosa PA01
acuugaaguguccguggu

SEQ ID NO: 1467696 - RNA, 13 nt, Pseudomonas aeruginosa PA01
acuugacggcgcc

SEQ ID NO: 1467697 - RNA, 14 nt, Pseudomonas aeruginosa PA01
agaaaaggccgcgu

SEQ ID NO: 1467698 - RNA, 13 nt, Pseudomonas aeruginosa PA01
acuuuggucgagu

SEQ ID NO: 1467699 - RNA, 15 nt, Pseudomonas aeruginosa PA01
acuuuccgaagcccc

SEQ ID NO: 1467700 - RNA, 16 nt, Pseudomonas aeruginosa PA01
accggucuuggcgcgc

SEQ ID NO: 1467701 - RNA, 20 nt, Pseudomonas aeruginosa PA01
accggugccgggaagcgcag

SEQ ID NO: 1467702 - RNA, 19 nt, Pseudomonas aeruginosa PA01
accggucgcaauggcggaa

SEQ ID NO: 1467703 - RNA, 13 nt, Pseudomonas aeruginosa PA01
accgguccucgcc

SEQ ID NO: 1467704 - RNA, 22 nt, Pseudomonas aeruginosa PA01
accgguggcgacgcgcaggccg

SEQ ID NO: 1467705 - RNA, 15 nt, Pseudomonas aeruginosa PA01
accgggaucagcggc

SEQ ID NO: 1467706 - RNA, 23 nt, Pseudomonas aeruginosa PA01
accgggaucagcggcggggccau

SEQ ID NO: 1467707 - RNA, 17 nt, Pseudomonas aeruginosa PA01
accgggaggcgccgcgc

SEQ ID NO: 1467708 - RNA, 20 nt, Pseudomonas aeruginosa PA01
accgggaggcgccgcgccag

SEQ ID NO: 1467709 - RNA, 16 nt, Pseudomonas aeruginosa PA01
accgggaucugccggu

SEQ ID NO: 1467710 - RNA, 17 nt, Pseudomonas aeruginosa PA01
accgggaucugccggua

SEQ ID NO: 1467711 - RNA, 15 nt, Pseudomonas aeruginosa PA01
accggcuucuggaag

SEQ ID NO: 1467712 - RNA, 13 nt, Pseudomonas aeruginosa PA01
accgggccaucgc

SEQ ID NO: 1467713 - RNA, 13 nt, Pseudomonas aeruginosa PA01
accgggcaucgcc

SEQ ID NO: 1467714 - RNA, 15 nt, Pseudomonas aeruginosa PA01
accgggcaucgccga

SEQ ID NO: 1467715 - RNA, 19 nt, Pseudomonas aeruginosa PA01
accgucacgcggacccagu

SEQ ID NO: 1467716 - RNA, 22 nt, Pseudomonas aeruginosa PA01
accgucacggcgaaaccggcca

SEQ ID NO: 1467717 - RNA, 15 nt, Pseudomonas aeruginosa PA01
accguccacggcgcg

SEQ ID NO: 1467718 - RNA, 13 nt, Pseudomonas aeruginosa PA01
accgucagccagg

SEQ ID NO: 1467719 - RNA, 20 nt, Pseudomonas aeruginosa PA01
accgucagccaggcuggcug

SEQ ID NO: 1467720 - RNA, 21 nt, Pseudomonas aeruginosa PA01
accgguuaauggcgcuccagg

SEQ ID NO: 1467721 - RNA, 17 nt, Pseudomonas aeruginosa PA01
accgguuccgcgucgcc

SEQ ID NO: 1467722 - RNA, 18 nt, Pseudomonas aeruginosa PA01
accgguuccgcgucgccu

SEQ ID NO: 1467723 - RNA, 22 nt, Pseudomonas aeruginosa PA01
accgguuucccucgagcaccgc

SEQ ID NO: 1467724 - RNA, 23 nt, Pseudomonas aeruginosa PA01
accgguuucccucgagcaccgcg

SEQ ID NO: 1467725 - RNA, 13 nt, Pseudomonas aeruginosa PA01
accgguuucgcca

SEQ ID NO: 1467726 - RNA, 19 nt, Pseudomonas aeruginosa PA01
accgguuggcuacccgcag

SEQ ID NO: 1467727 - RNA, 19 nt, Pseudomonas aeruginosa PA01
accguguugaucgccgcgc

SEQ ID NO: 1467728 - RNA, 15 nt, Pseudomonas aeruginosa PA01
accguucccagcagc

SEQ ID NO: 1467729 - RNA, 17 nt, Pseudomonas aeruginosa PA01
accguucccagcagcgc

SEQ ID NO: 1467730 - RNA, 19 nt, Pseudomonas aeruginosa PA01
accguucccagcagcgccu

SEQ ID NO: 1467731 - RNA, 20 nt, Pseudomonas aeruginosa PA01
accguucugccgcagcgccu

SEQ ID NO: 1467732 - RNA, 21 nt, Pseudomonas aeruginosa PA01
accguucugccgcagcgccuc

SEQ ID NO: 1467733 - RNA, 15 nt, Pseudomonas aeruginosa PA01
accgugucgaagccu

SEQ ID NO: 1467734 - RNA, 13 nt, Pseudomonas aeruginosa PA01
accguggcggccg

SEQ ID NO: 1467735 - RNA, 16 nt, Pseudomonas aeruginosa PA01
accguggcggccgccg

SEQ ID NO: 1467736 - RNA, 17 nt, Pseudomonas aeruginosa PA01
accguggucagcaccag

SEQ ID NO: 1467737 - RNA, 17 nt, Pseudomonas aeruginosa PA01
accguggucauggcgca

SEQ ID NO: 1467738 - RNA, 15 nt, Pseudomonas aeruginosa PA01
accguggucgccgcu

SEQ ID NO: 1467739 - RNA, 24 nt, Pseudomonas aeruginosa PA01
accguggucgccgcucauccgcug

SEQ ID NO: 1467740 - RNA, 22 nt, Pseudomonas aeruginosa PA01
accgugcccgccggcgcgccca

SEQ ID NO: 1467741 - RNA, 19 nt, Pseudomonas aeruginosa PA01
accguggaaaccucgccga

SEQ ID NO: 1467742 - RNA, 18 nt, Pseudomonas aeruginosa PA01
accguggcgcuggccgaa

SEQ ID NO: 1467743 - RNA, 19 nt, Pseudomonas aeruginosa PA01
accguggcgcuggccgaau

SEQ ID NO: 1467744 - RNA, 14 nt, Pseudomonas aeruginosa PA01
accguggcgccggc

SEQ ID NO: 1467745 - RNA, 15 nt, Pseudomonas aeruginosa PA01
accguggcgccggcg

SEQ ID NO: 1467746 - RNA, 24 nt, Pseudomonas aeruginosa PA01
accguggcgccggcgcgcuugccg

SEQ ID NO: 1467747 - RNA, 23 nt, Pseudomonas aeruginosa PA01
accgugaugcccagcggcgccag

SEQ ID NO: 1467748 - RNA, 18 nt, Pseudomonas aeruginosa PA01
accgugaggcgcaggggc

SEQ ID NO: 1467749 - RNA, 20 nt, Pseudomonas aeruginosa PA01
accgucuggcgcauccgccc

SEQ ID NO: 1467750 - RNA, 18 nt, Pseudomonas aeruginosa PA01
accgucgcgauagacgcc

SEQ ID NO: 1467751 - RNA, 20 nt, Pseudomonas aeruginosa PA01
accgucgcgauagacgccgg

SEQ ID NO: 1467752 - RNA, 22 nt, Pseudomonas aeruginosa PA01
accgucgcgauagacgccggcg

SEQ ID NO: 1467753 - RNA, 21 nt, Pseudomonas aeruginosa PA01
accgucgcggucaucgccggc

SEQ ID NO: 1467754 - RNA, 13 nt, Pseudomonas aeruginosa PA01
accgucggccggg

SEQ ID NO: 1467755 - RNA, 15 nt, Pseudomonas aeruginosa PA01
accgucgaucucgag

SEQ ID NO: 1467756 - RNA, 20 nt, Pseudomonas aeruginosa PA01
accgucgaucucgagcaugu

SEQ ID NO: 1467757 - RNA, 16 nt, Pseudomonas aeruginosa PA01
accguccgccugcgga

SEQ ID NO: 1467758 - RNA, 13 nt, Pseudomonas aeruginosa PA01
accguccgcgccg

SEQ ID NO: 1467759 - RNA, 20 nt, Pseudomonas aeruginosa PA01
accggcgaugcucagcgccg

SEQ ID NO: 1467760 - RNA, 15 nt, Pseudomonas aeruginosa PA01
accggcgauggccgg

SEQ ID NO: 1467761 - RNA, 23 nt, Pseudomonas aeruginosa PA01
accggcgauggccggcaccagca

SEQ ID NO: 1467762 - RNA, 18 nt, Pseudomonas aeruginosa PA01
accggcgccccugcggcg

SEQ ID NO: 1467763 - RNA, 15 nt, Pseudomonas aeruginosa PA01
accggcgccacccuc

SEQ ID NO: 1467764 - RNA, 18 nt, Pseudomonas aeruginosa PA01
accggcgccgccuggccg

SEQ ID NO: 1467765 - RNA, 19 nt, Pseudomonas aeruginosa PA01
accggcgccgggaucaccu

SEQ ID NO: 1467766 - RNA, 14 nt, Pseudomonas aeruginosa PA01
accggcuggcggcu

SEQ ID NO: 1467767 - RNA, 16 nt, Pseudomonas aeruginosa PA01
accggcguuauccgcc

SEQ ID NO: 1467768 - RNA, 23 nt, Pseudomonas aeruginosa PA01
accggcgggcucgcaaucagcgc

SEQ ID NO: 1467769 - RNA, 21 nt, Pseudomonas aeruginosa PA01
accggcguccacuccggcagc

SEQ ID NO: 1467770 - RNA, 17 nt, Pseudomonas aeruginosa PA01
accggcguccucggaga

SEQ ID NO: 1467771 - RNA, 14 nt, Pseudomonas aeruginosa PA01
accggcagcgccga

SEQ ID NO: 1467772 - RNA, 18 nt, Pseudomonas aeruginosa PA01
accggcagcgccgccagc

SEQ ID NO: 1467773 - RNA, 19 nt, Pseudomonas aeruginosa PA01
accggcagcgccgccagca

SEQ ID NO: 1467774 - RNA, 18 nt, Pseudomonas aeruginosa PA01
accggcaggacgaugauc

SEQ ID NO: 1467775 - RNA, 15 nt, Pseudomonas aeruginosa PA01
accggcaggaucggc

SEQ ID NO: 1467776 - RNA, 22 nt, Pseudomonas aeruginosa PA01
accggcaggucgggcaacggcu

SEQ ID NO: 1467777 - RNA, 23 nt, Pseudomonas aeruginosa PA01
accggcagucccugccaggggcu

SEQ ID NO: 1467778 - RNA, 18 nt, Pseudomonas aeruginosa PA01
accggccaucagcaccag

SEQ ID NO: 1467779 - RNA, 20 nt, Pseudomonas aeruginosa PA01
accggccaucagcaccagga

SEQ ID NO: 1467780 - RNA, 20 nt, Pseudomonas aeruginosa PA01
accggccauuacgccgagca

SEQ ID NO: 1467781 - RNA, 21 nt, Pseudomonas aeruginosa PA01
accggccacucgcagccgcgc

SEQ ID NO: 1467782 - RNA, 19 nt, Pseudomonas aeruginosa PA01
accggcauguagcgcgccg

SEQ ID NO: 1467783 - RNA, 12 nt, Pseudomonas aeruginosa PA01
accggccaggcg

SEQ ID NO: 1467784 - RNA, 18 nt, Pseudomonas aeruginosa PA01
accggccagcgcaucgag

SEQ ID NO: 1467785 - RNA, 21 nt, Pseudomonas aeruginosa PA01
accggccagcgcaucgaggcc

SEQ ID NO: 1467786 - RNA, 14 nt, Pseudomonas aeruginosa PA01
accggccagcgcgg

SEQ ID NO: 1467787 - RNA, 14 nt, Pseudomonas aeruginosa PA01
accggccaggcgcu

SEQ ID NO: 1467788 - RNA, 16 nt, Pseudomonas aeruginosa PA01
accggccaggcgcugg

SEQ ID NO: 1467789 - RNA, 17 nt, Pseudomonas aeruginosa PA01
accggccaggcgcuggu

SEQ ID NO: 1467790 - RNA, 14 nt, Pseudomonas aeruginosa PA01
accggccaggcggu

SEQ ID NO: 1467791 - RNA, 20 nt, Pseudomonas aeruginosa PA01
accggccaggcgguccagcc

SEQ ID NO: 1467792 - RNA, 15 nt, Pseudomonas aeruginosa PA01
accgcuggucggcau

SEQ ID NO: 1467793 - RNA, 17 nt, Pseudomonas aeruginosa PA01
accgcugggacggcggc

SEQ ID NO: 1467794 - RNA, 20 nt, Pseudomonas aeruginosa PA01
accgcugggacggcggcugg

SEQ ID NO: 1467795 - RNA, 12 nt, Pseudomonas aeruginosa PA01
accgcuggcgcu

SEQ ID NO: 1467796 - RNA, 17 nt, Pseudomonas aeruginosa PA01
accggaaucacgucgau

SEQ ID NO: 1467797 - RNA, 21 nt, Pseudomonas aeruginosa PA01
accggaaucacgucgaucugc

SEQ ID NO: 1467798 - RNA, 24 nt, Pseudomonas aeruginosa PA01
accggaagcgaucuccugccgcgg

SEQ ID NO: 1467799 - RNA, 22 nt, Pseudomonas aeruginosa PA01
accgcugcgcgggucuugccgg

SEQ ID NO: 1467800 - RNA, 16 nt, Pseudomonas aeruginosa PA01
accgcugcggccggcg

SEQ ID NO: 1467801 - RNA, 18 nt, Pseudomonas aeruginosa PA01
accgcugcggccggcgcg

SEQ ID NO: 1467802 - RNA, 19 nt, Pseudomonas aeruginosa PA01
accgcugcggccggcgcgu

SEQ ID NO: 1467803 - RNA, 12 nt, Pseudomonas aeruginosa PA01
accgcgucggga

SEQ ID NO: 1467804 - RNA, 23 nt, Pseudomonas aeruginosa PA01
accgcgucgggaaaggccgccac

SEQ ID NO: 1467805 - RNA, 12 nt, Pseudomonas aeruginosa PA01
accgcugcgccg

SEQ ID NO: 1467806 - RNA, 17 nt, Pseudomonas aeruginosa PA01
accgcgguggaggcggc

SEQ ID NO: 1467807 - RNA, 21 nt, Pseudomonas aeruginosa PA01
accgcguccauccccgccucg

SEQ ID NO: 1467808 - RNA, 19 nt, Pseudomonas aeruginosa PA01
accgcggcgcccucugccg

SEQ ID NO: 1467809 - RNA, 17 nt, Pseudomonas aeruginosa PA01
accgcgggcgaggucgc

SEQ ID NO: 1467810 - RNA, 22 nt, Pseudomonas aeruginosa PA01
accgcgggcgaggucgccacgc

SEQ ID NO: 1467811 - RNA, 19 nt, Pseudomonas aeruginosa PA01
accgccggguacagcgcca

SEQ ID NO: 1467812 - RNA, 22 nt, Pseudomonas aeruginosa PA01
accgccggguacagcgccacgg

SEQ ID NO: 1467813 - RNA, 15 nt, Pseudomonas aeruginosa PA01
accgccguagccguc

SEQ ID NO: 1467814 - RNA, 13 nt, Pseudomonas aeruginosa PA01
accgcggccggcu

SEQ ID NO: 1467815 - RNA, 19 nt, Pseudomonas aeruginosa PA01
accgcggccucgcuggcga

SEQ ID NO: 1467816 - RNA, 22 nt, Pseudomonas aeruginosa PA01
accgccgccuggguggcgacga

SEQ ID NO: 1467817 - RNA, 12 nt, Pseudomonas aeruginosa PA01
accgccggcggc

SEQ ID NO: 1467818 - RNA, 14 nt, Pseudomonas aeruginosa PA01
accgccggcggcga

SEQ ID NO: 1467819 - RNA, 17 nt, Pseudomonas aeruginosa PA01
accgccgccgcaaccgc

SEQ ID NO: 1467820 - RNA, 16 nt, Pseudomonas aeruginosa PA01
accgccgccggccugc

SEQ ID NO: 1467821 - RNA, 20 nt, Pseudomonas aeruginosa PA01
accgcccgccucaggccggg

SEQ ID NO: 1467822 - RNA, 14 nt, Pseudomonas aeruginosa PA01
accgccccggcagc

SEQ ID NO: 1467823 - RNA, 21 nt, Pseudomonas aeruginosa PA01
accgcccugcaacacguagcg

SEQ ID NO: 1467824 - RNA, 14 nt, Pseudomonas aeruginosa PA01
accgcccugcgcga

SEQ ID NO: 1467825 - RNA, 18 nt, Pseudomonas aeruginosa PA01
accgcccugcgcgauccc

SEQ ID NO: 1467826 - RNA, 16 nt, Pseudomonas aeruginosa PA01
accgccaucgaugguc

SEQ ID NO: 1467827 - RNA, 14 nt, Pseudomonas aeruginosa PA01
accgccauggcgcu

SEQ ID NO: 1467828 - RNA, 15 nt, Pseudomonas aeruginosa PA01
accgccauggcgcug

SEQ ID NO: 1467829 - RNA, 14 nt, Pseudomonas aeruginosa PA01
accgcccacccugc

SEQ ID NO: 1467830 - RNA, 16 nt, Pseudomonas aeruginosa PA01
accgcccacccugcgc

SEQ ID NO: 1467831 - RNA, 17 nt, Pseudomonas aeruginosa PA01
accgcccacccugcgcg

SEQ ID NO: 1467832 - RNA, 18 nt, Pseudomonas aeruginosa PA01
accgcccacccugcgcga

SEQ ID NO: 1467833 - RNA, 19 nt, Pseudomonas aeruginosa PA01
accgcccagccgagguggu

SEQ ID NO: 1467834 - RNA, 13 nt, Pseudomonas aeruginosa PA01
accgcccccggcg

SEQ ID NO: 1467835 - RNA, 16 nt, Pseudomonas aeruginosa PA01
accgcccccggcgcca

SEQ ID NO: 1467836 - RNA, 19 nt, Pseudomonas aeruginosa PA01
accgcccaggcugccgccg

SEQ ID NO: 1467837 - RNA, 13 nt, Pseudomonas aeruginosa PA01
accgauucgccgg

SEQ ID NO: 1467838 - RNA, 14 nt, Pseudomonas aeruginosa PA01
accgauucgccggc

SEQ ID NO: 1467839 - RNA, 20 nt, Pseudomonas aeruginosa PA01
accgauggcgccgcgauggu

SEQ ID NO: 1467840 - RNA, 12 nt, Pseudomonas aeruginosa PA01
accgcaccuggu

SEQ ID NO: 1467841 - RNA, 15 nt, Pseudomonas aeruginosa PA01
accgccaaggccucg

SEQ ID NO: 1467842 - RNA, 17 nt, Pseudomonas aeruginosa PA01
accgccaaggccucggc

SEQ ID NO: 1467843 - RNA, 18 nt, Pseudomonas aeruginosa PA01
accgccaaggccucggca

SEQ ID NO: 1467844 - RNA, 19 nt, Pseudomonas aeruginosa PA01
accgccaaggccucggcau

SEQ ID NO: 1467845 - RNA, 22 nt, Pseudomonas aeruginosa PA01
accgccacguacagcgcgacau

SEQ ID NO: 1467846 - RNA, 19 nt, Pseudomonas aeruginosa PA01
accgccaggaccucgaagc

SEQ ID NO: 1467847 - RNA, 20 nt, Pseudomonas aeruginosa PA01
accgccaggccgacccgcag

SEQ ID NO: 1467848 - RNA, 12 nt, Pseudomonas aeruginosa PA01
accgccaggcgg

SEQ ID NO: 1467849 - RNA, 20 nt, Pseudomonas aeruginosa PA01
accgccagggcgcucaccga

SEQ ID NO: 1467850 - RNA, 13 nt, Pseudomonas aeruginosa PA01
accgccaucagca

SEQ ID NO: 1467851 - RNA, 22 nt, Pseudomonas aeruginosa PA01
accgccagcgucgccgccgcgg

SEQ ID NO: 1467852 - RNA, 16 nt, Pseudomonas aeruginosa PA01
accgccaccagcgagu

SEQ ID NO: 1467853 - RNA, 17 nt, Pseudomonas aeruginosa PA01
accgccaccagcgaguc

SEQ ID NO: 1467854 - RNA, 21 nt, Pseudomonas aeruginosa PA01
accgccaccagcgagucgacc

SEQ ID NO: 1467855 - RNA, 17 nt, Pseudomonas aeruginosa PA01
accgccaccccgccggc

SEQ ID NO: 1467856 - RNA, 18 nt, Pseudomonas aeruginosa PA01
accgccaccccgccggcg

SEQ ID NO: 1467857 - RNA, 14 nt, Pseudomonas aeruginosa PA01
accgccaccgccgg

SEQ ID NO: 1467858 - RNA, 15 nt, Pseudomonas aeruginosa PA01
accgccaccgccgga

SEQ ID NO: 1467859 - RNA, 15 nt, Pseudomonas aeruginosa PA01
accgagacccuggcg

SEQ ID NO: 1467860 - RNA, 17 nt, Pseudomonas aeruginosa PA01
accgagacccuggcgcu

SEQ ID NO: 1467861 - RNA, 13 nt, Pseudomonas aeruginosa PA01
accgagaccgacg

SEQ ID NO: 1467862 - RNA, 20 nt, Pseudomonas aeruginosa PA01
accgagaaccaguacuugaa

SEQ ID NO: 1467863 - RNA, 21 nt, Pseudomonas aeruginosa PA01
accgacuuggcagucgccgcc

SEQ ID NO: 1467864 - RNA, 18 nt, Pseudomonas aeruginosa PA01
accgacgcucgcggcauc

SEQ ID NO: 1467865 - RNA, 22 nt, Pseudomonas aeruginosa PA01
accgacgcucgcggcaucccgc

SEQ ID NO: 1467866 - RNA, 13 nt, Pseudomonas aeruginosa PA01
accgacgccgccu

SEQ ID NO: 1467867 - RNA, 19 nt, Pseudomonas aeruginosa PA01
accgacgccgccugcgccu

SEQ ID NO: 1467868 - RNA, 16 nt, Pseudomonas aeruginosa PA01
accgaagccgcgcagc

SEQ ID NO: 1467869 - RNA, 20 nt, Pseudomonas aeruginosa PA01
accgaauccuugaucaccuu

SEQ ID NO: 1467870 - RNA, 13 nt, Pseudomonas aeruginosa PA01
accgaacggugca

SEQ ID NO: 1467871 - RNA, 16 nt, Pseudomonas aeruginosa PA01
accgaacuuccgccga

SEQ ID NO: 1467872 - RNA, 17 nt, Pseudomonas aeruginosa PA01
accgagguagucccaga

SEQ ID NO: 1467873 - RNA, 16 nt, Pseudomonas aeruginosa PA01
accgaggcgcgccgac

SEQ ID NO: 1467874 - RNA, 17 nt, Pseudomonas aeruginosa PA01
accgagggugcagagca

SEQ ID NO: 1467875 - RNA, 17 nt, Pseudomonas aeruginosa PA01
accgaguggcgcagcgc

SEQ ID NO: 1467876 - RNA, 20 nt, Pseudomonas aeruginosa PA01
accgaguggcgcagcgcccg

SEQ ID NO: 1467877 - RNA, 22 nt, Pseudomonas aeruginosa PA01
accgaggaggacgauggaacgc

SEQ ID NO: 1467878 - RNA, 12 nt, Pseudomonas aeruginosa PA01
accgauccagca

SEQ ID NO: 1467879 - RNA, 20 nt, Pseudomonas aeruginosa PA01
accgauaucucccaacuggu

SEQ ID NO: 1467880 - RNA, 18 nt, Pseudomonas aeruginosa PA01
accgauauggcuggcgca

SEQ ID NO: 1467881 - RNA, 16 nt, Pseudomonas aeruginosa PA01
accgaguuucccggcg

SEQ ID NO: 1467882 - RNA, 14 nt, Pseudomonas aeruginosa PA01
accgauggccaggg

SEQ ID NO: 1467883 - RNA, 23 nt, Pseudomonas aeruginosa PA01
accgauggccagggggccuggcu

SEQ ID NO: 1467884 - RNA, 15 nt, Pseudomonas aeruginosa PA01
acccgacaggcagcg

SEQ ID NO: 1467885 - RNA, 18 nt, Pseudomonas aeruginosa PA01
acccgacaggcagcgccg

SEQ ID NO: 1467886 - RNA, 17 nt, Pseudomonas aeruginosa PA01
acccacaggguggcggg

SEQ ID NO: 1467887 - RNA, 16 nt, Pseudomonas aeruginosa PA01
acccgcgacucgagca

SEQ ID NO: 1467888 - RNA, 15 nt, Pseudomonas aeruginosa PA01
acccgcgaggccggc

SEQ ID NO: 1467889 - RNA, 15 nt, Pseudomonas aeruginosa PA01
acccgcgaagccugc

SEQ ID NO: 1467890 - RNA, 18 nt, Pseudomonas aeruginosa PA01
acccgcaguuccuugggc

SEQ ID NO: 1467891 - RNA, 14 nt, Pseudomonas aeruginosa PA01
acccgcgccgccgc

SEQ ID NO: 1467892 - RNA, 22 nt, Pseudomonas aeruginosa PA01
acccgcgccgccgcggccagcc

SEQ ID NO: 1467893 - RNA, 14 nt, Pseudomonas aeruginosa PA01
acccgcgccggcag

SEQ ID NO: 1467894 - RNA, 13 nt, Pseudomonas aeruginosa PA01
acccgcucgccgg

SEQ ID NO: 1467895 - RNA, 14 nt, Pseudomonas aeruginosa PA01
acccgcucgccggg

SEQ ID NO: 1467896 - RNA, 15 nt, Pseudomonas aeruginosa PA01
acccgcucgccggga

SEQ ID NO: 1467897 - RNA, 17 nt, Pseudomonas aeruginosa PA01
acccgcaccuggaccgg

SEQ ID NO: 1467898 - RNA, 13 nt, Pseudomonas aeruginosa PA01
acccgcaccagcc

SEQ ID NO: 1467899 - RNA, 18 nt, Pseudomonas aeruginosa PA01
acccgcacguugaggucg

SEQ ID NO: 1467900 - RNA, 13 nt, Pseudomonas aeruginosa PA01
acccgcaccggca

SEQ ID NO: 1467901 - RNA, 17 nt, Pseudomonas aeruginosa PA01
acccgcagccgcgugcg

SEQ ID NO: 1467902 - RNA, 14 nt, Pseudomonas aeruginosa PA01
acccgcagcggcag

SEQ ID NO: 1467903 - RNA, 21 nt, Pseudomonas aeruginosa PA01
acccgcagcggcagcggcucg

SEQ ID NO: 1467904 - RNA, 18 nt, Pseudomonas aeruginosa PA01
acccgcagggcucgugcc

SEQ ID NO: 1467905 - RNA, 16 nt, Pseudomonas aeruginosa PA01
acccuagggucggcgu

SEQ ID NO: 1467906 - RNA, 19 nt, Pseudomonas aeruginosa PA01
acccucccuaucuccgccg

SEQ ID NO: 1467907 - RNA, 23 nt, Pseudomonas aeruginosa PA01
acccucaggucggcgccugcgga

SEQ ID NO: 1467908 - RNA, 22 nt, Pseudomonas aeruginosa PA01
acccucauggaaaccccggccu

SEQ ID NO: 1467909 - RNA, 13 nt, Pseudomonas aeruginosa PA01
acccguucgccgg

SEQ ID NO: 1467910 - RNA, 19 nt, Pseudomonas aeruginosa PA01
acccgguucucgccccagc

SEQ ID NO: 1467911 - RNA, 20 nt, Pseudomonas aeruginosa PA01
acccuugaaacugcgaugga

SEQ ID NO: 1467912 - RNA, 15 nt, Pseudomonas aeruginosa PA01
acccuuccagccgcc

SEQ ID NO: 1467913 - RNA, 16 nt, Pseudomonas aeruginosa PA01
acccuuccagccgccc

SEQ ID NO: 1467914 - RNA, 20 nt, Pseudomonas aeruginosa PA01
acccuuccagcguguggcga

SEQ ID NO: 1467915 - RNA, 13 nt, Pseudomonas aeruginosa PA01
acccugucccauc

SEQ ID NO: 1467916 - RNA, 18 nt, Pseudomonas aeruginosa PA01
acccugucccaucacggc

SEQ ID NO: 1467917 - RNA, 18 nt, Pseudomonas aeruginosa PA01
acccugggaauggcggau

SEQ ID NO: 1467918 - RNA, 12 nt, Pseudomonas aeruginosa PA01
acccugggccaa

SEQ ID NO: 1467919 - RNA, 19 nt, Pseudomonas aeruginosa PA01
acccuggccggccucggcg

SEQ ID NO: 1467920 - RNA, 20 nt, Pseudomonas aeruginosa PA01
acccuggccggccucggcgg

SEQ ID NO: 1467921 - RNA, 15 nt, Pseudomonas aeruginosa PA01
acccuggcgccgacc

SEQ ID NO: 1467922 - RNA, 16 nt, Pseudomonas aeruginosa PA01
acccgguacagcgccu

SEQ ID NO: 1467923 - RNA, 19 nt, Pseudomonas aeruginosa PA01
acccggucgcgcuggaccu

SEQ ID NO: 1467924 - RNA, 20 nt, Pseudomonas aeruginosa PA01
acccgggcgaccugcucgcg

SEQ ID NO: 1467925 - RNA, 19 nt, Pseudomonas aeruginosa PA01
acccgggcccaagccgagc

SEQ ID NO: 1467926 - RNA, 23 nt, Pseudomonas aeruginosa PA01
acccgggcccaagccgagcggca

SEQ ID NO: 1467927 - RNA, 22 nt, Pseudomonas aeruginosa PA01
acccgggcaacugaucagccgg

SEQ ID NO: 1467928 - RNA, 17 nt, Pseudomonas aeruginosa PA01
acccgcucggccuuagc

SEQ ID NO: 1467929 - RNA, 21 nt, Pseudomonas aeruginosa PA01
acccgcucggccuuagcgguu

SEQ ID NO: 1467930 - RNA, 22 nt, Pseudomonas aeruginosa PA01
acccgcucggccuuguccggca

SEQ ID NO: 1467931 - RNA, 20 nt, Pseudomonas aeruginosa PA01
acccgcuguuucuccaguuc

SEQ ID NO: 1467932 - RNA, 22 nt, Pseudomonas aeruginosa PA01
acccgcuguuucuccaguucgg

SEQ ID NO: 1467933 - RNA, 17 nt, Pseudomonas aeruginosa PA01
acccgcgcuucuucgac

SEQ ID NO: 1467934 - RNA, 18 nt, Pseudomonas aeruginosa PA01
acccgcugcaacuccgcc

SEQ ID NO: 1467935 - RNA, 18 nt, Pseudomonas aeruginosa PA01
acccggcugcaugccggg

SEQ ID NO: 1467936 - RNA, 20 nt, Pseudomonas aeruginosa PA01
acaucaccuucgcccucagc

SEQ ID NO: 1467937 - RNA, 23 nt, Pseudomonas aeruginosa PA01
acagguuguucggcgaguuggcc

SEQ ID NO: 1467938 - RNA, 15 nt, Pseudomonas aeruginosa PA01
acagguacucggccc

SEQ ID NO: 1467939 - RNA, 14 nt, Pseudomonas aeruginosa PA01
acagguagccccgg

SEQ ID NO: 1467940 - RNA, 16 nt, Pseudomonas aeruginosa PA01
acaggucggccggcag

SEQ ID NO: 1467941 - RNA, 22 nt, Pseudomonas aeruginosa PA01
acaggucggccggcagcuccgg

SEQ ID NO: 1467942 - RNA, 14 nt, Pseudomonas aeruginosa PA01
acaucgcccggcag

SEQ ID NO: 1467943 - RNA, 18 nt, Pseudomonas aeruginosa PA01
acaucggcgcuccgccga

SEQ ID NO: 1467944 - RNA, 23 nt, Pseudomonas aeruginosa PA01
acauccagcccuggaaaggccuc

SEQ ID NO: 1467945 - RNA, 22 nt, Pseudomonas aeruginosa PA01
acaugcugcucaguugcaccug

SEQ ID NO: 1467946 - RNA, 21 nt, Pseudomonas aeruginosa PA01
acaugcgcucguagaacucgc

SEQ ID NO: 1467947 - RNA, 22 nt, Pseudomonas aeruginosa PA01
acaugccgguucccgcagcgau

SEQ ID NO: 1467948 - RNA, 21 nt, Pseudomonas aeruginosa PA01
acauggucgagaaggcugccg

SEQ ID NO: 1467949 - RNA, 22 nt, Pseudomonas aeruginosa PA01
acauggucuucccagaccccgg

SEQ ID NO: 1467950 - RNA, 14 nt, Pseudomonas aeruginosa PA01
acauggcgcucgag

SEQ ID NO: 1467951 - RNA, 18 nt, Pseudomonas aeruginosa PA01
acaggcugugcgccaggc

SEQ ID NO: 1467952 - RNA, 19 nt, Pseudomonas aeruginosa PA01
acaggcugugcgccaggcc

SEQ ID NO: 1467953 - RNA, 21 nt, Pseudomonas aeruginosa PA01
acaggcugugcgccaggccgg

SEQ ID NO: 1467954 - RNA, 20 nt, Pseudomonas aeruginosa PA01
acagggcauuggccaucagc

SEQ ID NO: 1467955 - RNA, 16 nt, Pseudomonas aeruginosa PA01
acagggcgagcagggc

SEQ ID NO: 1467956 - RNA, 22 nt, Pseudomonas aeruginosa PA01
acaggcgucccuggagcagggc

SEQ ID NO: 1467957 - RNA, 14 nt, Pseudomonas aeruginosa PA01
acaggcgcuucagc

SEQ ID NO: 1467958 - RNA, 18 nt, Pseudomonas aeruginosa PA01
acaggcguuauccgccga

SEQ ID NO: 1467959 - RNA, 17 nt, Pseudomonas aeruginosa PA01
acaggcggcgggccggc

SEQ ID NO: 1467960 - RNA, 22 nt, Pseudomonas aeruginosa PA01
acaggcggaaggccucgguggc

SEQ ID NO: 1467961 - RNA, 15 nt, Pseudomonas aeruginosa PA01
acaggcggaucucgg

SEQ ID NO: 1467962 - RNA, 18 nt, Pseudomonas aeruginosa PA01
acaggcgauagccgacca

SEQ ID NO: 1467963 - RNA, 21 nt, Pseudomonas aeruginosa PA01
acaggccuccagcaacgccgc

SEQ ID NO: 1467964 - RNA, 15 nt, Pseudomonas aeruginosa PA01
acaggcgccagucau

SEQ ID NO: 1467965 - RNA, 19 nt, Pseudomonas aeruginosa PA01
acaggcgccagucauugcg

SEQ ID NO: 1467966 - RNA, 23 nt, Pseudomonas aeruginosa PA01
acaggccgauuuucugccgcgac

SEQ ID NO: 1467967 - RNA, 16 nt, Pseudomonas aeruginosa PA01
acaggccgaccagcag

SEQ ID NO: 1467968 - RNA, 17 nt, Pseudomonas aeruginosa PA01
acaggccgaccagcagg

SEQ ID NO: 1467969 - RNA, 17 nt, Pseudomonas aeruginosa PA01
acaggccgggcggcggc

SEQ ID NO: 1467970 - RNA, 21 nt, Pseudomonas aeruginosa PA01
acaggccggugccgccggcca

SEQ ID NO: 1467971 - RNA, 22 nt, Pseudomonas aeruginosa PA01
acaggcccuugaacaggcuggc

SEQ ID NO: 1467972 - RNA, 21 nt, Pseudomonas aeruginosa PA01
acaggcccuggaucaccgcgg

SEQ ID NO: 1467973 - RNA, 16 nt, Pseudomonas aeruginosa PA01
acaggccacccgccuc

SEQ ID NO: 1467974 - RNA, 20 nt, Pseudomonas aeruginosa PA01
acagccgggaucuccucgac

SEQ ID NO: 1467975 - RNA, 22 nt, Pseudomonas aeruginosa PA01
acagcgucugggugaccagcag

SEQ ID NO: 1467976 - RNA, 15 nt, Pseudomonas aeruginosa PA01
acagcuccuccagcc

SEQ ID NO: 1467977 - RNA, 17 nt, Pseudomonas aeruginosa PA01
acagcguggccagcgcc

SEQ ID NO: 1467978 - RNA, 20 nt, Pseudomonas aeruginosa PA01
acagcguggccagcgcccag

SEQ ID NO: 1467979 - RNA, 17 nt, Pseudomonas aeruginosa PA01
acagcuugucggugauc

SEQ ID NO: 1467980 - RNA, 14 nt, Pseudomonas aeruginosa PA01
acaggaccuucaga

SEQ ID NO: 1467981 - RNA, 18 nt, Pseudomonas aeruginosa PA01
acaggaucuccucggcca

SEQ ID NO: 1467982 - RNA, 22 nt, Pseudomonas aeruginosa PA01
acaggaugcgcuuuuccucgac

SEQ ID NO: 1467983 - RNA, 17 nt, Pseudomonas aeruginosa PA01
acagcucgcugucgccg

SEQ ID NO: 1467984 - RNA, 14 nt, Pseudomonas aeruginosa PA01
acagcugccagccc

SEQ ID NO: 1467985 - RNA, 16 nt, Pseudomonas aeruginosa PA01
acagcugccagccccg

SEQ ID NO: 1467986 - RNA, 17 nt, Pseudomonas aeruginosa PA01
acagcuguccgcgccgc

SEQ ID NO: 1467987 - RNA, 16 nt, Pseudomonas aeruginosa PA01
acagcuugaaccgcga

SEQ ID NO: 1467988 - RNA, 23 nt, Pseudomonas aeruginosa PA01
acagcagccaaggaugcgccagc

SEQ ID NO: 1467989 - RNA, 13 nt, Pseudomonas aeruginosa PA01
acagcagcgccag

SEQ ID NO: 1467990 - RNA, 18 nt, Pseudomonas aeruginosa PA01
acagaucgccagcucgcc

SEQ ID NO: 1467991 - RNA, 15 nt, Pseudomonas aeruginosa PA01
acagccgcagcggca

SEQ ID NO: 1467992 - RNA, 14 nt, Pseudomonas aeruginosa PA01
acagcaggcaggca

SEQ ID NO: 1467993 - RNA, 15 nt, Pseudomonas aeruginosa PA01
acagcaggagcgcca

SEQ ID NO: 1467994 - RNA, 15 nt, Pseudomonas aeruginosa PA01
acagcagggucaggg

SEQ ID NO: 1467995 - RNA, 16 nt, Pseudomonas aeruginosa PA01
acagaaguugcuggcg

SEQ ID NO: 1467996 - RNA, 17 nt, Pseudomonas aeruginosa PA01
acagaaguugcuggcga

SEQ ID NO: 1467997 - RNA, 14 nt, Pseudomonas aeruginosa PA01
acacgucggcgcgc

SEQ ID NO: 1467998 - RNA, 14 nt, Pseudomonas aeruginosa PA01
acaccuuggcgcga

SEQ ID NO: 1467999 - RNA, 16 nt, Pseudomonas aeruginosa PA01
acacgaaaaagccggc

SEQ ID NO: 1468000 - RNA, 14 nt, Pseudomonas aeruginosa PA01
acaccugcguggcg

SEQ ID NO: 1468001 - RNA, 17 nt, Pseudomonas aeruginosa PA01
acaccugcaacgcccgc

SEQ ID NO: 1468002 - RNA, 13 nt, Pseudomonas aeruginosa PA01
acacguagcgcag

SEQ ID NO: 1468003 - RNA, 23 nt, Pseudomonas aeruginosa PA01
acaccaccagguugaagaacggc

SEQ ID NO: 1468004 - RNA, 12 nt, Pseudomonas aeruginosa PA01
acaccggcgccg

SEQ ID NO: 1468005 - RNA, 14 nt, Pseudomonas aeruginosa PA01
acaccggcgccgcc

SEQ ID NO: 1468006 - RNA, 15 nt, Pseudomonas aeruginosa PA01
acaccgggccgccgg

SEQ ID NO: 1468007 - RNA, 19 nt, Pseudomonas aeruginosa PA01
acaccgggccgccggcgac

SEQ ID NO: 1468008 - RNA, 15 nt, Pseudomonas aeruginosa PA01
acaccuccagcggcu

SEQ ID NO: 1468009 - RNA, 14 nt, Pseudomonas aeruginosa PA01
acaccccgucucgc

SEQ ID NO: 1468010 - RNA, 13 nt, Pseudomonas aeruginosa PA01
acaccgcugcgcc

SEQ ID NO: 1468011 - RNA, 16 nt, Pseudomonas aeruginosa PA01
acaccgcugcgccgcc

SEQ ID NO: 1468012 - RNA, 12 nt, Pseudomonas aeruginosa PA01
acaccaggccga

SEQ ID NO: 1468013 - RNA, 13 nt, Pseudomonas aeruginosa PA01
acaccaggccgau

SEQ ID NO: 1468014 - RNA, 14 nt, Pseudomonas aeruginosa PA01
acaccaggccggcg

SEQ ID NO: 1468015 - RNA, 16 nt, Pseudomonas aeruginosa PA01
acaccaggcgccaggg

SEQ ID NO: 1468016 - RNA, 19 nt, Pseudomonas aeruginosa PA01
acacccagaagccgaccuu

SEQ ID NO: 1468017 - RNA, 16 nt, Pseudomonas aeruginosa PA01
acaccagguuggccag

SEQ ID NO: 1468018 - RNA, 12 nt, Pseudomonas aeruginosa PA01
acaccagcgccg

SEQ ID NO: 1468019 - RNA, 18 nt, Pseudomonas aeruginosa PA01
acaccagauggcugguca

SEQ ID NO: 1468020 - RNA, 13 nt, Pseudomonas aeruginosa PA01
accaggcggccga

SEQ ID NO: 1468021 - RNA, 15 nt, Pseudomonas aeruginosa PA01
accaggcggccggug

SEQ ID NO: 1468022 - RNA, 22 nt, Pseudomonas aeruginosa PA01
accaggcgccagggacgcgcag

SEQ ID NO: 1468023 - RNA, 16 nt, Pseudomonas aeruginosa PA01
accaggcgccgaugcc

SEQ ID NO: 1468024 - RNA, 16 nt, Pseudomonas aeruginosa PA01
accaggccgcugccgc

SEQ ID NO: 1468025 - RNA, 19 nt, Pseudomonas aeruginosa PA01
accagggaagcgcgcgcca

SEQ ID NO: 1468026 - RNA, 20 nt, Pseudomonas aeruginosa PA01
accagggaagcgcgcgccag

SEQ ID NO: 1468027 - RNA, 13 nt, Pseudomonas aeruginosa PA01
accaggcugauca

SEQ ID NO: 1468028 - RNA, 15 nt, Pseudomonas aeruginosa PA01
accaggcugaucagc

SEQ ID NO: 1468029 - RNA, 19 nt, Pseudomonas aeruginosa PA01
accaggcgguuggcccgcg

SEQ ID NO: 1468030 - RNA, 20 nt, Pseudomonas aeruginosa PA01
accaggcgguuggcccgcgc

SEQ ID NO: 1468031 - RNA, 23 nt, Pseudomonas aeruginosa PA01
accaggcgguuggcccgcgccgu

SEQ ID NO: 1468032 - RNA, 20 nt, Pseudomonas aeruginosa PA01
accaggcucgccccggcggc

SEQ ID NO: 1468033 - RNA, 15 nt, Pseudomonas aeruginosa PA01
accaggcccgccggu

SEQ ID NO: 1468034 - RNA, 22 nt, Pseudomonas aeruginosa PA01
accaggccgagcaggaagaagc

SEQ ID NO: 1468035 - RNA, 22 nt, Pseudomonas aeruginosa PA01
accaggccgccaugcucggcca

SEQ ID NO: 1468036 - RNA, 22 nt, Pseudomonas aeruginosa PA01
accagcgcgauacccuggccgg

SEQ ID NO: 1468037 - RNA, 17 nt, Pseudomonas aeruginosa PA01
accagcgcuucggcggc

SEQ ID NO: 1468038 - RNA, 19 nt, Pseudomonas aeruginosa PA01
accagcggaccgucgggca

SEQ ID NO: 1468039 - RNA, 13 nt, Pseudomonas aeruginosa PA01
accagggccgggu

SEQ ID NO: 1468040 - RNA, 14 nt, Pseudomonas aeruginosa PA01
accagggcgauggu

SEQ ID NO: 1468041 - RNA, 14 nt, Pseudomonas aeruginosa PA01
accagggccagggc

SEQ ID NO: 1468042 - RNA, 19 nt, Pseudomonas aeruginosa PA01
accagggcgggccgcucgc

SEQ ID NO: 1468043 - RNA, 21 nt, Pseudomonas aeruginosa PA01
accagggcgggccgcucgcgc

SEQ ID NO: 1468044 - RNA, 16 nt, Pseudomonas aeruginosa PA01
accaggggucgacgca

SEQ ID NO: 1468045 - RNA, 22 nt, Pseudomonas aeruginosa PA01
accagggucgggccgcgcucgg

SEQ ID NO: 1468046 - RNA, 15 nt, Pseudomonas aeruginosa PA01
accagggucuccagg

SEQ ID NO: 1468047 - RNA, 20 nt, Pseudomonas aeruginosa PA01
accaggucgccgcacaccgc

SEQ ID NO: 1468048 - RNA, 16 nt, Pseudomonas aeruginosa PA01
accagggcucggacga

SEQ ID NO: 1468049 - RNA, 13 nt, Pseudomonas aeruginosa PA01
accagggugcgcu

SEQ ID NO: 1468050 - RNA, 15 nt, Pseudomonas aeruginosa PA01
accagggugcgcucg

SEQ ID NO: 1468051 - RNA, 13 nt, Pseudomonas aeruginosa PA01
accaggguggcgg

SEQ ID NO: 1468052 - RNA, 16 nt, Pseudomonas aeruginosa PA01
accaggguggcggcgg

SEQ ID NO: 1468053 - RNA, 17 nt, Pseudomonas aeruginosa PA01
accaggucggcgcgcga

SEQ ID NO: 1468054 - RNA, 18 nt, Pseudomonas aeruginosa PA01
accagguucugccagagc

SEQ ID NO: 1468055 - RNA, 21 nt, Pseudomonas aeruginosa PA01
accagguucugccagagcgcu

SEQ ID NO: 1468056 - RNA, 21 nt, Pseudomonas aeruginosa PA01
accagguugugaucgaccucg

SEQ ID NO: 1468057 - RNA, 20 nt, Pseudomonas aeruginosa PA01
accagguuggccaguuggcc

SEQ ID NO: 1468058 - RNA, 18 nt, Pseudomonas aeruginosa PA01
accagucccuggccggcg

SEQ ID NO: 1468059 - RNA, 19 nt, Pseudomonas aeruginosa PA01
accagucccuggccggcga

SEQ ID NO: 1468060 - RNA, 22 nt, Pseudomonas aeruginosa PA01
accaguacgucgagaccgaccg

SEQ ID NO: 1468061 - RNA, 14 nt, Pseudomonas aeruginosa PA01
accaguaccagcaa

SEQ ID NO: 1468062 - RNA, 19 nt, Pseudomonas aeruginosa PA01
accaguagcgacagcaucu

SEQ ID NO: 1468063 - RNA, 18 nt, Pseudomonas aeruginosa PA01
accaugcgguucggcguc

SEQ ID NO: 1468064 - RNA, 20 nt, Pseudomonas aeruginosa PA01
accaugccuuccaccggcgu

SEQ ID NO: 1468065 - RNA, 12 nt, Pseudomonas aeruginosa PA01
accaugaucauc

SEQ ID NO: 1468066 - RNA, 21 nt, Pseudomonas aeruginosa PA01
accaugaucaucggcuggccg

SEQ ID NO: 1468067 - RNA, 17 nt, Pseudomonas aeruginosa PA01
accaucggccccaccgc

SEQ ID NO: 1468068 - RNA, 14 nt, Pseudomonas aeruginosa PA01
accaucggcggcgg

SEQ ID NO: 1468069 - RNA, 17 nt, Pseudomonas aeruginosa PA01
accauugcggcccgcca

SEQ ID NO: 1468070 - RNA, 13 nt, Pseudomonas aeruginosa PA01
accaugcuccgcc

SEQ ID NO: 1468071 - RNA, 21 nt, Pseudomonas aeruginosa PA01
accaugguguuggcggccugg

SEQ ID NO: 1468072 - RNA, 17 nt, Pseudomonas aeruginosa PA01
accauguucaccagcgc

SEQ ID NO: 1468073 - RNA, 18 nt, Pseudomonas aeruginosa PA01
accauguucaccagcgcu

SEQ ID NO: 1468074 - RNA, 18 nt, Pseudomonas aeruginosa PA01
accaguucgccgccgcgc

SEQ ID NO: 1468075 - RNA, 14 nt, Pseudomonas aeruginosa PA01
accagugccgcggu

SEQ ID NO: 1468076 - RNA, 17 nt, Pseudomonas aeruginosa PA01
accagugcaccgccggg

SEQ ID NO: 1468077 - RNA, 19 nt, Pseudomonas aeruginosa PA01
accaguuucuucgcguggg

SEQ ID NO: 1468078 - RNA, 23 nt, Pseudomonas aeruginosa PA01
accaguugcccgagugccggcgc

SEQ ID NO: 1468079 - RNA, 21 nt, Pseudomonas aeruginosa PA01
accaguugcucgcuccgagca

SEQ ID NO: 1468080 - RNA, 13 nt, Pseudomonas aeruginosa PA01
accaucgcggcga

SEQ ID NO: 1468081 - RNA, 22 nt, Pseudomonas aeruginosa PA01
accaucgcggcgauggccgcca

SEQ ID NO: 1468082 - RNA, 13 nt, Pseudomonas aeruginosa PA01
accaucgccggcg

SEQ ID NO: 1468083 - RNA, 14 nt, Pseudomonas aeruginosa PA01
accauccgccgcag

SEQ ID NO: 1468084 - RNA, 15 nt, Pseudomonas aeruginosa PA01
accaucaccgccauc

SEQ ID NO: 1468085 - RNA, 16 nt, Pseudomonas aeruginosa PA01
accaucacgucgcgca

SEQ ID NO: 1468086 - RNA, 15 nt, Pseudomonas aeruginosa PA01
accaucagccagccc

SEQ ID NO: 1468087 - RNA, 21 nt, Pseudomonas aeruginosa PA01
accaauuuuaauuuugcuacc

SEQ ID NO: 1468088 - RNA, 15 nt, Pseudomonas aeruginosa PA01
accaccacgaucugc

SEQ ID NO: 1468089 - RNA, 24 nt, Pseudomonas aeruginosa PA01
accaccacucgcgagcuggcgccg

SEQ ID NO: 1468090 - RNA, 13 nt, Pseudomonas aeruginosa PA01
accaccagcagca

SEQ ID NO: 1468091 - RNA, 13 nt, Pseudomonas aeruginosa PA01
accaccagcagga

SEQ ID NO: 1468092 - RNA, 17 nt, Pseudomonas aeruginosa PA01
accaccagcaggcccag

SEQ ID NO: 1468093 - RNA, 17 nt, Pseudomonas aeruginosa PA01
accaccagcaucaccac

SEQ ID NO: 1468094 - RNA, 23 nt, Pseudomonas aeruginosa PA01
accaccaggaaggcgucgccguc

SEQ ID NO: 1468095 - RNA, 21 nt, Pseudomonas aeruginosa PA01
accacaaccagccaugcaggc

SEQ ID NO: 1468096 - RNA, 17 nt, Pseudomonas aeruginosa PA01
accaccacgacguugcc

SEQ ID NO: 1468097 - RNA, 14 nt, Pseudomonas aeruginosa PA01
accaccaccgcgcc

SEQ ID NO: 1468098 - RNA, 15 nt, Pseudomonas aeruginosa PA01
accacaccaggucgc

SEQ ID NO: 1468099 - RNA, 19 nt, Pseudomonas aeruginosa PA01
accacaccaggucgccgca

SEQ ID NO: 1468100 - RNA, 12 nt, Pseudomonas aeruginosa PA01
accaccgccggg

SEQ ID NO: 1468101 - RNA, 19 nt, Pseudomonas aeruginosa PA01
accaccgagagcggcgcca

SEQ ID NO: 1468102 - RNA, 14 nt, Pseudomonas aeruginosa PA01
accaccgacaggcc

SEQ ID NO: 1468103 - RNA, 18 nt, Pseudomonas aeruginosa PA01
accaccgacaggccgacc

SEQ ID NO: 1468104 - RNA, 13 nt, Pseudomonas aeruginosa PA01
accaccgccgcca

SEQ ID NO: 1468105 - RNA, 14 nt, Pseudomonas aeruginosa PA01
accaccgccgccag

SEQ ID NO: 1468106 - RNA, 17 nt, Pseudomonas aeruginosa PA01
accaccgccgccagcaa

SEQ ID NO: 1468107 - RNA, 13 nt, Pseudomonas aeruginosa PA01
accaccaggucga

SEQ ID NO: 1468108 - RNA, 17 nt, Pseudomonas aeruginosa PA01
accaccaggucggcgcg

SEQ ID NO: 1468109 - RNA, 15 nt, Pseudomonas aeruginosa PA01
accaccgccaggcug

SEQ ID NO: 1468110 - RNA, 13 nt, Pseudomonas aeruginosa PA01
accacgaucucgg

SEQ ID NO: 1468111 - RNA, 18 nt, Pseudomonas aeruginosa PA01
accacgcauugucgggcg

SEQ ID NO: 1468112 - RNA, 17 nt, Pseudomonas aeruginosa PA01
accacgcagccacccgc

SEQ ID NO: 1468113 - RNA, 14 nt, Pseudomonas aeruginosa PA01
accacgcaggccag

SEQ ID NO: 1468114 - RNA, 19 nt, Pseudomonas aeruginosa PA01
accacgcaggccagcgcca

SEQ ID NO: 1468115 - RNA, 22 nt, Pseudomonas aeruginosa PA01
accacgcaggccagcgccaggg

SEQ ID NO: 1468116 - RNA, 14 nt, Pseudomonas aeruginosa PA01
accacgcaggcgcg

SEQ ID NO: 1468117 - RNA, 22 nt, Pseudomonas aeruginosa PA01
accacgcuggucaccgucugca

SEQ ID NO: 1468118 - RNA, 19 nt, Pseudomonas aeruginosa PA01
accacggugaucaggcgcu

SEQ ID NO: 1468119 - RNA, 18 nt, Pseudomonas aeruginosa PA01
accacguaguaggcgcgg

SEQ ID NO: 1468120 - RNA, 19 nt, Pseudomonas aeruginosa PA01
accacguaguaggcgcggg

SEQ ID NO: 1468121 - RNA, 22 nt, Pseudomonas aeruginosa PA01
accacguccagaugaaacugcc

SEQ ID NO: 1468122 - RNA, 13 nt, Pseudomonas aeruginosa PA01
accagaucggcgc

SEQ ID NO: 1468123 - RNA, 14 nt, Pseudomonas aeruginosa PA01
accagagccagccg

SEQ ID NO: 1468124 - RNA, 18 nt, Pseudomonas aeruginosa PA01
accagacgcucggccagc

SEQ ID NO: 1468125 - RNA, 17 nt, Pseudomonas aeruginosa PA01
accagaccgcagccggc

SEQ ID NO: 1468126 - RNA, 18 nt, Pseudomonas aeruginosa PA01
accagcaaugcccagcgc

SEQ ID NO: 1468127 - RNA, 13 nt, Pseudomonas aeruginosa PA01
accagcaccagcg

SEQ ID NO: 1468128 - RNA, 13 nt, Pseudomonas aeruginosa PA01
accagcaccaccc

SEQ ID NO: 1468129 - RNA, 17 nt, Pseudomonas aeruginosa PA01
accagcgcaagcggcgg

SEQ ID NO: 1468130 - RNA, 23 nt, Pseudomonas aeruginosa PA01
accagcgagucgacccaggccca

SEQ ID NO: 1468131 - RNA, 10 nt, Pseudomonas aeruginosa PA01
accagcccgc

SEQ ID NO: 1468132 - RNA, 14 nt, Pseudomonas aeruginosa PA01
accagcccgcgcga

SEQ ID NO: 1468133 - RNA, 15 nt, Pseudomonas aeruginosa PA01
accagcccgcgcgac

SEQ ID NO: 1468134 - RNA, 11 nt, Pseudomonas aeruginosa PA01
accagcgccgc

SEQ ID NO: 1468135 - RNA, 13 nt, Pseudomonas aeruginosa PA01
accagcgccaggc

SEQ ID NO: 1468136 - RNA, 16 nt, Pseudomonas aeruginosa PA01
accagcgccaggccgc

SEQ ID NO: 1468137 - RNA, 20 nt, Pseudomonas aeruginosa PA01
accagcgccaggccgccgaa

SEQ ID NO: 1468138 - RNA, 16 nt, Pseudomonas aeruginosa PA01
accagcgccgcggcga

SEQ ID NO: 1468139 - RNA, 17 nt, Pseudomonas aeruginosa PA01
accagcgccgucaccag

SEQ ID NO: 1468140 - RNA, 18 nt, Pseudomonas aeruginosa PA01
accagcgccgccaggcag

SEQ ID NO: 1468141 - RNA, 14 nt, Pseudomonas aeruginosa PA01
accagcgccgccac

SEQ ID NO: 1468142 - RNA, 17 nt, Pseudomonas aeruginosa PA01
accagcgccgccaccgc

SEQ ID NO: 1468143 - RNA, 18 nt, Pseudomonas aeruginosa PA01
accagcaccugcgggcug

SEQ ID NO: 1468144 - RNA, 12 nt, Pseudomonas aeruginosa PA01
accagcaccgcc

SEQ ID NO: 1468145 - RNA, 12 nt, Pseudomonas aeruginosa PA01
accagcaccgca

SEQ ID NO: 1468146 - RNA, 23 nt, Pseudomonas aeruginosa PA01
accagcacguugccauccagcgc

SEQ ID NO: 1468147 - RNA, 19 nt, Pseudomonas aeruginosa PA01
accagcaucaccaccggga

SEQ ID NO: 1468148 - RNA, 20 nt, Pseudomonas aeruginosa PA01
accagcacguagccgcccuu

SEQ ID NO: 1468149 - RNA, 14 nt, Pseudomonas aeruginosa PA01
accagcauggcggg

SEQ ID NO: 1468150 - RNA, 12 nt, Pseudomonas aeruginosa PA01
accagccagccc

SEQ ID NO: 1468151 - RNA, 17 nt, Pseudomonas aeruginosa PA01
accagccagucgagacg

SEQ ID NO: 1468152 - RNA, 15 nt, Pseudomonas aeruginosa PA01
caccgacccucggcg

SEQ ID NO: 1468153 - RNA, 23 nt, Pseudomonas aeruginosa PA01
caccgaccgcgaguucgccggcc

SEQ ID NO: 1468154 - RNA, 13 nt, Pseudomonas aeruginosa PA01
caccgacgccgga

SEQ ID NO: 1468155 - RNA, 17 nt, Pseudomonas aeruginosa PA01
caccgacaaucgccgag

SEQ ID NO: 1468156 - RNA, 18 nt, Pseudomonas aeruginosa PA01
caccgacaaucgccgaga

SEQ ID NO: 1468157 - RNA, 20 nt, Pseudomonas aeruginosa PA01
caccgacaaucgccgagaaa

SEQ ID NO: 1468158 - RNA, 18 nt, Pseudomonas aeruginosa PA01
caccgacagucccaggcc

SEQ ID NO: 1468159 - RNA, 21 nt, Pseudomonas aeruginosa PA01
caccgacagucccaggccaac

SEQ ID NO: 1468160 - RNA, 23 nt, Pseudomonas aeruginosa PA01
caccgaauccuugaucaccuugc

SEQ ID NO: 1468161 - RNA, 17 nt, Pseudomonas aeruginosa PA01
caccgaacuuccgccga

SEQ ID NO: 1468162 - RNA, 17 nt, Pseudomonas aeruginosa PA01
caccgaagucgcccgcc

SEQ ID NO: 1468163 - RNA, 18 nt, Pseudomonas aeruginosa PA01
caccgaagucgcccgccg

SEQ ID NO: 1468164 - RNA, 20 nt, Pseudomonas aeruginosa PA01
caccgaagucgcccgccggc

SEQ ID NO: 1468165 - RNA, 22 nt, Pseudomonas aeruginosa PA01
caccgaagucgcccgccggcgu

SEQ ID NO: 1468166 - RNA, 19 nt, Pseudomonas aeruginosa PA01
caccgaagcugaggccggu

SEQ ID NO: 1468167 - RNA, 12 nt, Pseudomonas aeruginosa PA01
cacccgcuccgg

SEQ ID NO: 1468168 - RNA, 13 nt, Pseudomonas aeruginosa PA01
cacccgcuccggc

SEQ ID NO: 1468169 - RNA, 17 nt, Pseudomonas aeruginosa PA01
cacccgcuccggcucuc

SEQ ID NO: 1468170 - RNA, 16 nt, Pseudomonas aeruginosa PA01
cacccgguccugcaac

SEQ ID NO: 1468171 - RNA, 18 nt, Pseudomonas aeruginosa PA01
cacccgguugaccccgcg

SEQ ID NO: 1468172 - RNA, 16 nt, Pseudomonas aeruginosa PA01
cacccguuccuugcgc

SEQ ID NO: 1468173 - RNA, 18 nt, Pseudomonas aeruginosa PA01
cacccguuccuugcgcgg

SEQ ID NO: 1468174 - RNA, 20 nt, Pseudomonas aeruginosa PA01
cacccguuccuugcgcggca

SEQ ID NO: 1468175 - RNA, 21 nt, Pseudomonas aeruginosa PA01
cacccguuccuugcgcggcag

SEQ ID NO: 1468176 - RNA, 23 nt, Pseudomonas aeruginosa PA01
cacccguuccuugcgcggcaggc

SEQ ID NO: 1468177 - RNA, 16 nt, Pseudomonas aeruginosa PA01
cacccguucgccggcc

SEQ ID NO: 1468178 - RNA, 19 nt, Pseudomonas aeruginosa PA01
cacccguucgccggccucc

SEQ ID NO: 1468179 - RNA, 22 nt, Pseudomonas aeruginosa PA01
cacccguucgccggccuccagc

SEQ ID NO: 1468180 - RNA, 16 nt, Pseudomonas aeruginosa PA01
cacccagagcaccagg

SEQ ID NO: 1468181 - RNA, 22 nt, Pseudomonas aeruginosa PA01
cacccagaccuuccagccgcgc

SEQ ID NO: 1468182 - RNA, 18 nt, Pseudomonas aeruginosa PA01
cacccagaagccgaccuu

SEQ ID NO: 1468183 - RNA, 21 nt, Pseudomonas aeruginosa PA01
cacccagaagccgaccuugcg

SEQ ID NO: 1468184 - RNA, 20 nt, Pseudomonas aeruginosa PA01
caccaggacccagaugaucu

SEQ ID NO: 1468185 - RNA, 15 nt, Pseudomonas aeruginosa PA01
caccaggucgcgcuu

SEQ ID NO: 1468186 - RNA, 19 nt, Pseudomonas aeruginosa PA01
caccaggucgcggaucagg

SEQ ID NO: 1468187 - RNA, 19 nt, Pseudomonas aeruginosa PA01
caccaggccgaugaacgcc

SEQ ID NO: 1468188 - RNA, 17 nt, Pseudomonas aeruginosa PA01
caccaggguggcgcgca

SEQ ID NO: 1468189 - RNA, 19 nt, Pseudomonas aeruginosa PA01
caccaggguggcgcgcacc

SEQ ID NO: 1468190 - RNA, 22 nt, Pseudomonas aeruginosa PA01
caccaggguggcgcgcaccacc

SEQ ID NO: 1468191 - RNA, 21 nt, Pseudomonas aeruginosa PA01
caccaggguaccgaaacaggg

SEQ ID NO: 1468192 - RNA, 16 nt, Pseudomonas aeruginosa PA01
caccagggucacgccg

SEQ ID NO: 1468193 - RNA, 18 nt, Pseudomonas aeruginosa PA01
caccagggucacgccgcg

SEQ ID NO: 1468194 - RNA, 14 nt, Pseudomonas aeruginosa PA01
caccagggucgcca

SEQ ID NO: 1468195 - RNA, 15 nt, Pseudomonas aeruginosa PA01
caccagggucggcac

SEQ ID NO: 1468196 - RNA, 23 nt, Pseudomonas aeruginosa PA01
caccagggucgggccgcgcucgg

SEQ ID NO: 1468197 - RNA, 23 nt, Pseudomonas aeruginosa PA01
caccagggucgguucgcggcgca

SEQ ID NO: 1468198 - RNA, 11 nt, Pseudomonas aeruginosa PA01
caccaggccga

SEQ ID NO: 1468199 - RNA, 16 nt, Pseudomonas aeruginosa PA01
caccaggcccgccggu

SEQ ID NO: 1468200 - RNA, 19 nt, Pseudomonas aeruginosa PA01
caccaggaucgccgggcuu

SEQ ID NO: 1468201 - RNA, 20 nt, Pseudomonas aeruginosa PA01
caccaggagcgccagcacca

SEQ ID NO: 1468202 - RNA, 17 nt, Pseudomonas aeruginosa PA01
caccaggaaggcgucgc

SEQ ID NO: 1468203 - RNA, 20 nt, Pseudomonas aeruginosa PA01
cacccgcaucgaggccgccc

SEQ ID NO: 1468204 - RNA, 15 nt, Pseudomonas aeruginosa PA01
cacccgcgaggccgg

SEQ ID NO: 1468205 - RNA, 16 nt, Pseudomonas aeruginosa PA01
cacccgcgaggccggc

SEQ ID NO: 1468206 - RNA, 18 nt, Pseudomonas aeruginosa PA01
cacccgcgaggccggccc

SEQ ID NO: 1468207 - RNA, 13 nt, Pseudomonas aeruginosa PA01
cacccgcgccgcc

SEQ ID NO: 1468208 - RNA, 15 nt, Pseudomonas aeruginosa PA01
cacccgcgccgccgc

SEQ ID NO: 1468209 - RNA, 20 nt, Pseudomonas aeruginosa PA01
cacccgcgccgccgcggcca

SEQ ID NO: 1468210 - RNA, 14 nt, Pseudomonas aeruginosa PA01
cacccgcgccugca

SEQ ID NO: 1468211 - RNA, 17 nt, Pseudomonas aeruginosa PA01
cacccccaucgcccgca

SEQ ID NO: 1468212 - RNA, 17 nt, Pseudomonas aeruginosa PA01
caccccgaccagcgcgc

SEQ ID NO: 1468213 - RNA, 22 nt, Pseudomonas aeruginosa PA01
cacccccagcaggccagccaac

SEQ ID NO: 1468214 - RNA, 19 nt, Pseudomonas aeruginosa PA01
cacccagucuucgcuggcg

SEQ ID NO: 1468215 - RNA, 13 nt, Pseudomonas aeruginosa PA01
cacccaggcgccg

SEQ ID NO: 1468216 - RNA, 16 nt, Pseudomonas aeruginosa PA01
cacccaggcgccgauc

SEQ ID NO: 1468217 - RNA, 22 nt, Pseudomonas aeruginosa PA01
cacccagggcaguacguggcgc

SEQ ID NO: 1468218 - RNA, 22 nt, Pseudomonas aeruginosa PA01
cacccaggauuuguccgcgcca

SEQ ID NO: 1468219 - RNA, 16 nt, Pseudomonas aeruginosa PA01
caccaccaucgccgcg

SEQ ID NO: 1468220 - RNA, 14 nt, Pseudomonas aeruginosa PA01
caccacccggccgc

SEQ ID NO: 1468221 - RNA, 16 nt, Pseudomonas aeruginosa PA01
caccacccggccgcgc

SEQ ID NO: 1468222 - RNA, 21 nt, Pseudomonas aeruginosa PA01
caccacccgcugcaacuccgc

SEQ ID NO: 1468223 - RNA, 14 nt, Pseudomonas aeruginosa PA01
caccacccggcgca

SEQ ID NO: 1468224 - RNA, 19 nt, Pseudomonas aeruginosa PA01
caccacccggcgcacgccg

SEQ ID NO: 1468225 - RNA, 20 nt, Pseudomonas aeruginosa PA01
caccacccggcgcacgccgg

SEQ ID NO: 1468226 - RNA, 21 nt, Pseudomonas aeruginosa PA01
caccacccggcgcacgccggc

SEQ ID NO: 1468227 - RNA, 16 nt, Pseudomonas aeruginosa PA01
caccaccagcaggccc

SEQ ID NO: 1468228 - RNA, 19 nt, Pseudomonas aeruginosa PA01
caccaccagcaucaccacc

SEQ ID NO: 1468229 - RNA, 13 nt, Pseudomonas aeruginosa PA01
caccaccaccgcg

SEQ ID NO: 1468230 - RNA, 15 nt, Pseudomonas aeruginosa PA01
caccaccaccgcgcc

SEQ ID NO: 1468231 - RNA, 22 nt, Pseudomonas aeruginosa PA01
cacacgcucccaacagucgucg

SEQ ID NO: 1468232 - RNA, 22 nt, Pseudomonas aeruginosa PA01
cacacgcuucugcuggccgcgc

SEQ ID NO: 1468233 - RNA, 12 nt, Pseudomonas aeruginosa PA01
cacacgucggca

SEQ ID NO: 1468234 - RNA, 16 nt, Pseudomonas aeruginosa PA01
cacacgucggcaucga

SEQ ID NO: 1468235 - RNA, 19 nt, Pseudomonas aeruginosa PA01
caccaccgagagcggcgcc

SEQ ID NO: 1468236 - RNA, 20 nt, Pseudomonas aeruginosa PA01
caccaccgagagcggcgcca

SEQ ID NO: 1468237 - RNA, 14 nt, Pseudomonas aeruginosa PA01
caccaccgacgccg

SEQ ID NO: 1468238 - RNA, 15 nt, Pseudomonas aeruginosa PA01
caccaccgacgccgg

SEQ ID NO: 1468239 - RNA, 20 nt, Pseudomonas aeruginosa PA01
caccaccgacgccggacgca

SEQ ID NO: 1468240 - RNA, 11 nt, Pseudomonas aeruginosa PA01
caccaccguca

SEQ ID NO: 1468241 - RNA, 17 nt, Pseudomonas aeruginosa PA01
caccaccgucuggcgca

SEQ ID NO: 1468242 - RNA, 17 nt, Pseudomonas aeruginosa PA01
caccaccgugaccagca

SEQ ID NO: 1468243 - RNA, 23 nt, Pseudomonas aeruginosa PA01
caccaccugcuugggcgccucgc

SEQ ID NO: 1468244 - RNA, 22 nt, Pseudomonas aeruginosa PA01
caccaccuggauggugcccggg

SEQ ID NO: 1468245 - RNA, 20 nt, Pseudomonas aeruginosa PA01
caccacggcgaagccgcgcc

SEQ ID NO: 1468246 - RNA, 19 nt, Pseudomonas aeruginosa PA01
caccagacgcagcaugucg

SEQ ID NO: 1468247 - RNA, 21 nt, Pseudomonas aeruginosa PA01
caccagacgcagcaugucguc

SEQ ID NO: 1468248 - RNA, 16 nt, Pseudomonas aeruginosa PA01
caccagcgucgccagg

SEQ ID NO: 1468249 - RNA, 13 nt, Pseudomonas aeruginosa PA01
caccagcuccccg

SEQ ID NO: 1468250 - RNA, 23 nt, Pseudomonas aeruginosa PA01
caccagcgugggcaacaggccga

SEQ ID NO: 1468251 - RNA, 22 nt, Pseudomonas aeruginosa PA01
caccagcgguacguagcgcggu

SEQ ID NO: 1468252 - RNA, 21 nt, Pseudomonas aeruginosa PA01
caccagcgggucgucgaagcg

SEQ ID NO: 1468253 - RNA, 17 nt, Pseudomonas aeruginosa PA01
caccagcgccaggccgc

SEQ ID NO: 1468254 - RNA, 19 nt, Pseudomonas aeruginosa PA01
caccagcgccaggccgccg

SEQ ID NO: 1468255 - RNA, 23 nt, Pseudomonas aeruginosa PA01
caccagcgccaggccgccgaaga

SEQ ID NO: 1468256 - RNA, 13 nt, Pseudomonas aeruginosa PA01
caccagcgccggc

SEQ ID NO: 1468257 - RNA, 18 nt, Pseudomonas aeruginosa PA01
caccagcgccggcggcgc

SEQ ID NO: 1468258 - RNA, 12 nt, Pseudomonas aeruginosa PA01
caccagcgccgu

SEQ ID NO: 1468259 - RNA, 20 nt, Pseudomonas aeruginosa PA01
caccagcgccgucaccagca

SEQ ID NO: 1468260 - RNA, 14 nt, Pseudomonas aeruginosa PA01
caccagcgccgcca

SEQ ID NO: 1468261 - RNA, 15 nt, Pseudomonas aeruginosa PA01
caccagcgccgccac

SEQ ID NO: 1468262 - RNA, 20 nt, Pseudomonas aeruginosa PA01
caccagcgccgccaccgcca

SEQ ID NO: 1468263 - RNA, 15 nt, Pseudomonas aeruginosa PA01
caccagcgccgccag

SEQ ID NO: 1468264 - RNA, 14 nt, Pseudomonas aeruginosa PA01
caccagcggcgagc

SEQ ID NO: 1468265 - RNA, 11 nt, Pseudomonas aeruginosa PA01
caccagcagga

SEQ ID NO: 1468266 - RNA, 14 nt, Pseudomonas aeruginosa PA01
caccagcaggaucg

SEQ ID NO: 1468267 - RNA, 18 nt, Pseudomonas aeruginosa PA01
caccagcaggaucgagcc

SEQ ID NO: 1468268 - RNA, 14 nt, Pseudomonas aeruginosa PA01
caccagcaggccga

SEQ ID NO: 1468269 - RNA, 23 nt, Pseudomonas aeruginosa PA01
caccagcaggccgaucaccagcg

SEQ ID NO: 1468270 - RNA, 19 nt, Pseudomonas aeruginosa PA01
caccagcacggugcuggcg

SEQ ID NO: 1468271 - RNA, 21 nt, Pseudomonas aeruginosa PA01
caccagcacguagccgcccuu

SEQ ID NO: 1468272 - RNA, 13 nt, Pseudomonas aeruginosa PA01
caccagcagcagc

SEQ ID NO: 1468273 - RNA, 14 nt, Pseudomonas aeruginosa PA01
caccagcacgcccu

SEQ ID NO: 1468274 - RNA, 20 nt, Pseudomonas aeruginosa PA01
caccagcacuuccggcgcgg

SEQ ID NO: 1468275 - RNA, 16 nt, Pseudomonas aeruginosa PA01
caccagcagccccgag

SEQ ID NO: 1468276 - RNA, 23 nt, Pseudomonas aeruginosa PA01
caccagcagccccgaggccagca

SEQ ID NO: 1468277 - RNA, 18 nt, Pseudomonas aeruginosa PA01
caccagauggcuggucag

SEQ ID NO: 1468278 - RNA, 20 nt, Pseudomonas aeruginosa PA01
caccagcaauugccggcgug

SEQ ID NO: 1468279 - RNA, 21 nt, Pseudomonas aeruginosa PA01
caccagcaauugccggcguga

SEQ ID NO: 1468280 - RNA, 14 nt, Pseudomonas aeruginosa PA01
caccagcaccagcg

SEQ ID NO: 1468281 - RNA, 13 nt, Pseudomonas aeruginosa PA01
caccagccacugc

SEQ ID NO: 1468282 - RNA, 14 nt, Pseudomonas aeruginosa PA01
caccagcaucacca

SEQ ID NO: 1468283 - RNA, 19 nt, Pseudomonas aeruginosa PA01
caccagcaugcccagcgug

SEQ ID NO: 1468284 - RNA, 21 nt, Pseudomonas aeruginosa PA01
caccagcaggucggcgcgacg

SEQ ID NO: 1468285 - RNA, 14 nt, Pseudomonas aeruginosa PA01
caccagccaggcgg

SEQ ID NO: 1468286 - RNA, 21 nt, Pseudomonas aeruginosa PA01
caccagccagguguucggccc

SEQ ID NO: 1468287 - RNA, 11 nt, Pseudomonas aeruginosa PA01
caccagccagu

SEQ ID NO: 1468288 - RNA, 20 nt, Pseudomonas aeruginosa PA01
caccagccaguccggcagca

SEQ ID NO: 1468289 - RNA, 14 nt, Pseudomonas aeruginosa PA01
caccagccagcccg

SEQ ID NO: 1468290 - RNA, 18 nt, Pseudomonas aeruginosa PA01
caccagccuuccggcacc

SEQ ID NO: 1468291 - RNA, 20 nt, Pseudomonas aeruginosa PA01
caccagcgaaagcgucagcg

SEQ ID NO: 1468292 - RNA, 11 nt, Pseudomonas aeruginosa PA01
caccagcccgc

SEQ ID NO: 1468293 - RNA, 20 nt, Pseudomonas aeruginosa PA01
caccagccggccgcgucgcc

SEQ ID NO: 1468294 - RNA, 15 nt, Pseudomonas aeruginosa PA01
caccagcgaagugcg

SEQ ID NO: 1468295 - RNA, 20 nt, Pseudomonas aeruginosa PA01
caccagcgacgacuugccca

SEQ ID NO: 1468296 - RNA, 16 nt, Pseudomonas aeruginosa PA01
caccgcuuucagcgcc

SEQ ID NO: 1468297 - RNA, 15 nt, Pseudomonas aeruginosa PA01
caccgcuuucguagg

SEQ ID NO: 1468298 - RNA, 17 nt, Pseudomonas aeruginosa PA01
caccggaagcguccagg

SEQ ID NO: 1468299 - RNA, 14 nt, Pseudomonas aeruginosa PA01
caccggaucgaugc

SEQ ID NO: 1468300 - RNA, 16 nt, Pseudomonas aeruginosa PA01
caccggaucgcccugg

SEQ ID NO: 1468301 - RNA, 20 nt, Pseudomonas aeruginosa PA01
caccggaucgcccuggcgcc

SEQ ID NO: 1468302 - RNA, 19 nt, Pseudomonas aeruginosa PA01
caccggacggcugaggcug

SEQ ID NO: 1468303 - RNA, 13 nt, Pseudomonas aeruginosa PA01
caccgcugcgccg

SEQ ID NO: 1468304 - RNA, 14 nt, Pseudomonas aeruginosa PA01
caccgcugcgccgc

SEQ ID NO: 1468305 - RNA, 16 nt, Pseudomonas aeruginosa PA01
caccgcugcgccgccg

SEQ ID NO: 1468306 - RNA, 17 nt, Pseudomonas aeruginosa PA01
caccgcugcgccgccgu

SEQ ID NO: 1468307 - RNA, 18 nt, Pseudomonas aeruginosa PA01
caccgcuucgagcacccc

SEQ ID NO: 1468308 - RNA, 19 nt, Pseudomonas aeruginosa PA01
caccgcuucgagcaccccg

SEQ ID NO: 1468309 - RNA, 13 nt, Pseudomonas aeruginosa PA01
caccgcuucgcgg

SEQ ID NO: 1468310 - RNA, 22 nt, Pseudomonas aeruginosa PA01
caccgcuucgcggaucaacgcc

SEQ ID NO: 1468311 - RNA, 20 nt, Pseudomonas aeruginosa PA01
caccgcucaagacggcccgc

SEQ ID NO: 1468312 - RNA, 15 nt, Pseudomonas aeruginosa PA01
caccgcuccggcgcc

SEQ ID NO: 1468313 - RNA, 16 nt, Pseudomonas aeruginosa PA01
caccgcuccggcgccg

SEQ ID NO: 1468314 - RNA, 17 nt, Pseudomonas aeruginosa PA01
caccgcuccggcgccga

SEQ ID NO: 1468315 - RNA, 20 nt, Pseudomonas aeruginosa PA01
caccgcucgaguucgcgcgg

SEQ ID NO: 1468316 - RNA, 22 nt, Pseudomonas aeruginosa PA01
caccgcucgaguucgcgcgggu

SEQ ID NO: 1468317 - RNA, 23 nt, Pseudomonas aeruginosa PA01
caccgcucgaguucgcgcggguc

SEQ ID NO: 1468318 - RNA, 14 nt, Pseudomonas aeruginosa PA01
caccgcucgccaga

SEQ ID NO: 1468319 - RNA, 14 nt, Pseudomonas aeruginosa PA01
caccggcacgccau

SEQ ID NO: 1468320 - RNA, 16 nt, Pseudomonas aeruginosa PA01
caccggcacgcccugu

SEQ ID NO: 1468321 - RNA, 19 nt, Pseudomonas aeruginosa PA01
caccggcaggaucggcgcg

SEQ ID NO: 1468322 - RNA, 20 nt, Pseudomonas aeruginosa PA01
caccggcaggaucggcgcgg

SEQ ID NO: 1468323 - RNA, 15 nt, Pseudomonas aeruginosa PA01
caccggcagcagcgg

SEQ ID NO: 1468324 - RNA, 13 nt, Pseudomonas aeruginosa PA01
caccggcagcagc

SEQ ID NO: 1468325 - RNA, 14 nt, Pseudomonas aeruginosa PA01
caccggcagggcga

SEQ ID NO: 1468326 - RNA, 21 nt, Pseudomonas aeruginosa PA01
caccggcagggcgauccgccc

SEQ ID NO: 1468327 - RNA, 19 nt, Pseudomonas aeruginosa PA01
caccggccacucgcagccg

SEQ ID NO: 1468328 - RNA, 21 nt, Pseudomonas aeruginosa PA01
caccggccacucgcagccgcg

SEQ ID NO: 1468329 - RNA, 23 nt, Pseudomonas aeruginosa PA01
caccggcauguagcgcgccgagg

SEQ ID NO: 1468330 - RNA, 14 nt, Pseudomonas aeruginosa PA01
caccggcgccaccc

SEQ ID NO: 1468331 - RNA, 20 nt, Pseudomonas aeruginosa PA01
caccggcgauggccggcacc

SEQ ID NO: 1468332 - RNA, 23 nt, Pseudomonas aeruginosa PA01
caccggcgauggccggcaccagc

SEQ ID NO: 1468333 - RNA, 21 nt, Pseudomonas aeruginosa PA01
caccggcgacgaaagacgcug

SEQ ID NO: 1468334 - RNA, 14 nt, Pseudomonas aeruginosa PA01
caccggccaggcgc

SEQ ID NO: 1468335 - RNA, 16 nt, Pseudomonas aeruginosa PA01
caccggccaggcgcug

SEQ ID NO: 1468336 - RNA, 17 nt, Pseudomonas aeruginosa PA01
caccgcguggugcugca

SEQ ID NO: 1468337 - RNA, 18 nt, Pseudomonas aeruginosa PA01
caccgcguaauaggcgaa

SEQ ID NO: 1468338 - RNA, 19 nt, Pseudomonas aeruginosa PA01
caccgcgguggaggcggcg

SEQ ID NO: 1468339 - RNA, 15 nt, Pseudomonas aeruginosa PA01
caccgcggcgagccg

SEQ ID NO: 1468340 - RNA, 20 nt, Pseudomonas aeruginosa PA01
caccgcggccucgcuggcga

SEQ ID NO: 1468341 - RNA, 20 nt, Pseudomonas aeruginosa PA01
caccgcggccuuggucucga

SEQ ID NO: 1468342 - RNA, 13 nt, Pseudomonas aeruginosa PA01
caccgcgccggga

SEQ ID NO: 1468343 - RNA, 15 nt, Pseudomonas aeruginosa PA01
caccgcggcguccgc

SEQ ID NO: 1468344 - RNA, 14 nt, Pseudomonas aeruginosa PA01
caccgaucgcccgc

SEQ ID NO: 1468345 - RNA, 17 nt, Pseudomonas aeruginosa PA01
caccgaugccgaaggcg

SEQ ID NO: 1468346 - RNA, 20 nt, Pseudomonas aeruginosa PA01
caccgaugccgaaggcgugg

SEQ ID NO: 1468347 - RNA, 21 nt, Pseudomonas aeruginosa PA01
caccgaucgcccgcgccucga

SEQ ID NO: 1468348 - RNA, 15 nt, Pseudomonas aeruginosa PA01
caccgagacgcccug

SEQ ID NO: 1468349 - RNA, 16 nt, Pseudomonas aeruginosa PA01
caccgauagcggcgcg

SEQ ID NO: 1468350 - RNA, 15 nt, Pseudomonas aeruginosa PA01
caccgagucggcaac

SEQ ID NO: 1468351 - RNA, 16 nt, Pseudomonas aeruginosa PA01
caccgagucggcaacg

SEQ ID NO: 1468352 - RNA, 14 nt, Pseudomonas aeruginosa PA01
caccgaguggcgca

SEQ ID NO: 1468353 - RNA, 20 nt, Pseudomonas aeruginosa PA01
caccgaguggcgcagcgccc

SEQ ID NO: 1468354 - RNA, 14 nt, Pseudomonas aeruginosa PA01
caccgaguugacca

SEQ ID NO: 1468355 - RNA, 16 nt, Pseudomonas aeruginosa PA01
caccgagagcggcgcc

SEQ ID NO: 1468356 - RNA, 17 nt, Pseudomonas aeruginosa PA01
caccgagagcggcgcca

SEQ ID NO: 1468357 - RNA, 13 nt, Pseudomonas aeruginosa PA01
caccgagaaccag

SEQ ID NO: 1468358 - RNA, 17 nt, Pseudomonas aeruginosa PA01
caccgcgcagcgucacc

SEQ ID NO: 1468359 - RNA, 22 nt, Pseudomonas aeruginosa PA01
caccgcgccgauguacggcacc

SEQ ID NO: 1468360 - RNA, 13 nt, Pseudomonas aeruginosa PA01
caccgcgccggcg

SEQ ID NO: 1468361 - RNA, 16 nt, Pseudomonas aeruginosa PA01
caccgcgccgaagguc

SEQ ID NO: 1468362 - RNA, 14 nt, Pseudomonas aeruginosa PA01
caccgccucgaccc

SEQ ID NO: 1468363 - RNA, 17 nt, Pseudomonas aeruginosa PA01
caccgccugcagcacca

SEQ ID NO: 1468364 - RNA, 20 nt, Pseudomonas aeruginosa PA01
caccgccggguacagcgcca

SEQ ID NO: 1468365 - RNA, 20 nt, Pseudomonas aeruginosa PA01
caccguucuugaucaccgcg

SEQ ID NO: 1468366 - RNA, 23 nt, Pseudomonas aeruginosa PA01
caccguucuugaucaccgcggug

SEQ ID NO: 1468367 - RNA, 17 nt, Pseudomonas aeruginosa PA01
caccguucccagcagcg

SEQ ID NO: 1468368 - RNA, 20 nt, Pseudomonas aeruginosa PA01
caccguucccagcagcgccu

SEQ ID NO: 1468369 - RNA, 20 nt, Pseudomonas aeruginosa PA01
caccguguugaucgccgcgc

SEQ ID NO: 1468370 - RNA, 22 nt, Pseudomonas aeruginosa PA01
caccguguugaucgccgcgccg

SEQ ID NO: 1468371 - RNA, 17 nt, Pseudomonas aeruginosa PA01
caccguggcgacgaugc

SEQ ID NO: 1468372 - RNA, 19 nt, Pseudomonas aeruginosa PA01
caccguggcgacgaugcgc

SEQ ID NO: 1468373 - RNA, 20 nt, Pseudomonas aeruginosa PA01
caccguggcgacgaugcgcc

SEQ ID NO: 1468374 - RNA, 13 nt, Pseudomonas aeruginosa PA01
caccguggcgcca

SEQ ID NO: 1468375 - RNA, 14 nt, Pseudomonas aeruginosa PA01
caccguggcgccgg

SEQ ID NO: 1468376 - RNA, 19 nt, Pseudomonas aeruginosa PA01
caccguggcgccggcgcgc

SEQ ID NO: 1468377 - RNA, 22 nt, Pseudomonas aeruginosa PA01
caccguggcgccggcgcgcuug

SEQ ID NO: 1468378 - RNA, 13 nt, Pseudomonas aeruginosa PA01
caccguggcgcug

SEQ ID NO: 1468379 - RNA, 18 nt, Pseudomonas aeruginosa PA01
caccguggcgcuggccga

SEQ ID NO: 1468380 - RNA, 19 nt, Pseudomonas aeruginosa PA01
caccguggucagcaccagg

SEQ ID NO: 1468381 - RNA, 20 nt, Pseudomonas aeruginosa PA01
caccguggaaaccucgccga

SEQ ID NO: 1468382 - RNA, 22 nt, Pseudomonas aeruginosa PA01
caccguggaaaccucgccgauc

SEQ ID NO: 1468383 - RNA, 15 nt, Pseudomonas aeruginosa PA01
caccgugcgcgcggc

SEQ ID NO: 1468384 - RNA, 17 nt, Pseudomonas aeruginosa PA01
caccgugcgcgcggccu

SEQ ID NO: 1468385 - RNA, 14 nt, Pseudomonas aeruginosa PA01
caccgugcccgccg

SEQ ID NO: 1468386 - RNA, 14 nt, Pseudomonas aeruginosa PA01
caccgugaccagca

SEQ ID NO: 1468387 - RNA, 14 nt, Pseudomonas aeruginosa PA01
caccgucuggcgca

SEQ ID NO: 1468388 - RNA, 22 nt, Pseudomonas aeruginosa PA01
caccguccuucggccgcaccag

SEQ ID NO: 1468389 - RNA, 20 nt, Pseudomonas aeruginosa PA01
caccgucgcggucaucgccg

SEQ ID NO: 1468390 - RNA, 19 nt, Pseudomonas aeruginosa PA01
caccgucggauggccgucc

SEQ ID NO: 1468391 - RNA, 19 nt, Pseudomonas aeruginosa PA01
caccggggugauccagcug

SEQ ID NO: 1468392 - RNA, 18 nt, Pseudomonas aeruginosa PA01
caccggggccuucaggcg

SEQ ID NO: 1468393 - RNA, 19 nt, Pseudomonas aeruginosa PA01
caccggggccuucaggcgc

SEQ ID NO: 1468394 - RNA, 19 nt, Pseudomonas aeruginosa PA01
caccggucuuggcgcgcga

SEQ ID NO: 1468395 - RNA, 20 nt, Pseudomonas aeruginosa PA01
caccggucuuggcgcgcgac

SEQ ID NO: 1468396 - RNA, 23 nt, Pseudomonas aeruginosa PA01
caccgguggcgacgcgcaggccg

SEQ ID NO: 1468397 - RNA, 20 nt, Pseudomonas aeruginosa PA01
caccgucaagggccaggaaa

SEQ ID NO: 1468398 - RNA, 14 nt, Pseudomonas aeruginosa PA01
caccguaggccagg

SEQ ID NO: 1468399 - RNA, 16 nt, Pseudomonas aeruginosa PA01
caccgguuucgccagu

SEQ ID NO: 1468400 - RNA, 17 nt, Pseudomonas aeruginosa PA01
caccgggaggcgccgcg

SEQ ID NO: 1468401 - RNA, 20 nt, Pseudomonas aeruginosa PA01
caccgggaggcgccgcgcca

SEQ ID NO: 1468402 - RNA, 23 nt, Pseudomonas aeruginosa PA01
caccgggaggcgccgcgccaggu

SEQ ID NO: 1468403 - RNA, 15 nt, Pseudomonas aeruginosa PA01
caccgggaucugccg

SEQ ID NO: 1468404 - RNA, 20 nt, Pseudomonas aeruginosa PA01
caccgggccgaccugcccgc

SEQ ID NO: 1468405 - RNA, 16 nt, Pseudomonas aeruginosa PA01
caccgggccgucgggc

SEQ ID NO: 1468406 - RNA, 18 nt, Pseudomonas aeruginosa PA01
caccgggauggucgaggg

SEQ ID NO: 1468407 - RNA, 19 nt, Pseudomonas aeruginosa PA01
caccgggauggucgagggc

SEQ ID NO: 1468408 - RNA, 20 nt, Pseudomonas aeruginosa PA01
caccgggauggucgagggcg

SEQ ID NO: 1468409 - RNA, 13 nt, Pseudomonas aeruginosa PA01
caccgggccgccg

SEQ ID NO: 1468410 - RNA, 15 nt, Pseudomonas aeruginosa PA01
caccgggccgccggc

SEQ ID NO: 1468411 - RNA, 17 nt, Pseudomonas aeruginosa PA01
caccgggccgccggcga

SEQ ID NO: 1468412 - RNA, 20 nt, Pseudomonas aeruginosa PA01
caccggcugcauguccgcca

SEQ ID NO: 1468413 - RNA, 13 nt, Pseudomonas aeruginosa PA01
caccggcuggcgg

SEQ ID NO: 1468414 - RNA, 17 nt, Pseudomonas aeruginosa PA01
caccggcuggcggcucg

SEQ ID NO: 1468415 - RNA, 13 nt, Pseudomonas aeruginosa PA01
caccggcuggccc

SEQ ID NO: 1468416 - RNA, 14 nt, Pseudomonas aeruginosa PA01
caccggcuggcccu

SEQ ID NO: 1468417 - RNA, 18 nt, Pseudomonas aeruginosa PA01
caccggcguuauccgccg

SEQ ID NO: 1468418 - RNA, 20 nt, Pseudomonas aeruginosa PA01
caccggcggcgccaggccgg

SEQ ID NO: 1468419 - RNA, 22 nt, Pseudomonas aeruginosa PA01
caccggcguccacuccggcagc

SEQ ID NO: 1468420 - RNA, 20 nt, Pseudomonas aeruginosa PA01
caccggcgggauguacgcca

SEQ ID NO: 1468421 - RNA, 22 nt, Pseudomonas aeruginosa PA01
caccggcggauuacuccgccgg

SEQ ID NO: 1468422 - RNA, 23 nt, Pseudomonas aeruginosa PA01
caccggcggauuacuccgccggc

SEQ ID NO: 1468423 - RNA, 17 nt, Pseudomonas aeruginosa PA01
caaugccuuccgacgcc

SEQ ID NO: 1468424 - RNA, 17 nt, Pseudomonas aeruginosa PA01
caaugcccagcgcaggc

SEQ ID NO: 1468425 - RNA, 15 nt, Pseudomonas aeruginosa PA01
caauggcgcagccgc

SEQ ID NO: 1468426 - RNA, 19 nt, Pseudomonas aeruginosa PA01
caauggcgcagccgcuggg

SEQ ID NO: 1468427 - RNA, 17 nt, Pseudomonas aeruginosa PA01
caauguccgagcagguc

SEQ ID NO: 1468428 - RNA, 21 nt, Pseudomonas aeruginosa PA01
cacaaccugccgaucgccgcg

SEQ ID NO: 1468429 - RNA, 20 nt, Pseudomonas aeruginosa PA01
caauugcaggcccggccgcc

SEQ ID NO: 1468430 - RNA, 21 nt, Pseudomonas aeruginosa PA01
caauugcaggcccggccgccu

SEQ ID NO: 1468431 - RNA, 19 nt, Pseudomonas aeruginosa PA01
cacaaugaaaaacgccggc

SEQ ID NO: 1468432 - RNA, 16 nt, Pseudomonas aeruginosa PA01
cacaaugaucgcgccg

SEQ ID NO: 1468433 - RNA, 17 nt, Pseudomonas aeruginosa PA01
cacaaugaucgcgccgg

SEQ ID NO: 1468434 - RNA, 18 nt, Pseudomonas aeruginosa PA01
cacaccgaagucgcccgc

SEQ ID NO: 1468435 - RNA, 20 nt, Pseudomonas aeruginosa PA01
cacaccgaagucgcccgccg

SEQ ID NO: 1468436 - RNA, 23 nt, Pseudomonas aeruginosa PA01
cacaccgaagucgcccgccggcg

SEQ ID NO: 1468437 - RNA, 19 nt, Pseudomonas aeruginosa PA01
cacaccgacaaucgccgag

SEQ ID NO: 1468438 - RNA, 13 nt, Pseudomonas aeruginosa PA01
cacaccgaccgcg

SEQ ID NO: 1468439 - RNA, 12 nt, Pseudomonas aeruginosa PA01
caaucccagcuc

SEQ ID NO: 1468440 - RNA, 14 nt, Pseudomonas aeruginosa PA01
caaucagcgcgauu

SEQ ID NO: 1468441 - RNA, 18 nt, Pseudomonas aeruginosa PA01
caaucagggcugggcgcc

SEQ ID NO: 1468442 - RNA, 16 nt, Pseudomonas aeruginosa PA01
caaugcccgcgccugg

SEQ ID NO: 1468443 - RNA, 22 nt, Pseudomonas aeruginosa PA01
caaugccgcccuccaucagcgc

SEQ ID NO: 1468444 - RNA, 23 nt, Pseudomonas aeruginosa PA01
caaugccgcccuccaucagcgcc

SEQ ID NO: 1468445 - RNA, 22 nt, Pseudomonas aeruginosa PA01
caaucggcgagccgcagcggcu

SEQ ID NO: 1468446 - RNA, 16 nt, Pseudomonas aeruginosa PA01
caaucggucgcccucg

SEQ ID NO: 1468447 - RNA, 19 nt, Pseudomonas aeruginosa PA01
caaucggugaacgagccca

SEQ ID NO: 1468448 - RNA, 20 nt, Pseudomonas aeruginosa PA01
caaguucgcauaggcggcca

SEQ ID NO: 1468449 - RNA, 15 nt, Pseudomonas aeruginosa PA01
caauacaccgcugcg

SEQ ID NO: 1468450 - RNA, 22 nt, Pseudomonas aeruginosa PA01
caauacaccgcugcgccgccgu

SEQ ID NO: 1468451 - RNA, 18 nt, Pseudomonas aeruginosa PA01
caauaccgaacaccagca

SEQ ID NO: 1468452 - RNA, 13 nt, Pseudomonas aeruginosa PA01
caagucggccgcc

SEQ ID NO: 1468453 - RNA, 15 nt, Pseudomonas aeruginosa PA01
caagucggccgccca

SEQ ID NO: 1468454 - RNA, 23 nt, Pseudomonas aeruginosa PA01
caagggcacgugcagcggcagcg

SEQ ID NO: 1468455 - RNA, 16 nt, Pseudomonas aeruginosa PA01
caaggcugaggccgac

SEQ ID NO: 1468456 - RNA, 14 nt, Pseudomonas aeruginosa PA01
caagggccugggcg

SEQ ID NO: 1468457 - RNA, 20 nt, Pseudomonas aeruginosa PA01
caaggccucggcauccucgc

SEQ ID NO: 1468458 - RNA, 22 nt, Pseudomonas aeruginosa PA01
caaggccucggcauccucgccc

SEQ ID NO: 1468459 - RNA, 16 nt, Pseudomonas aeruginosa PA01
caaggccgccaggccu

SEQ ID NO: 1468460 - RNA, 21 nt, Pseudomonas aeruginosa PA01
caaggcgcugaagcggccgag

SEQ ID NO: 1468461 - RNA, 22 nt, Pseudomonas aeruginosa PA01
caaggcgcugaagcggccgaga

SEQ ID NO: 1468462 - RNA, 19 nt, Pseudomonas aeruginosa PA01
caaggcggugaccagcggc

SEQ ID NO: 1468463 - RNA, 12 nt, Pseudomonas aeruginosa PA01
caaggcggccuc

SEQ ID NO: 1468464 - RNA, 14 nt, Pseudomonas aeruginosa PA01
caagcucuucgcga

SEQ ID NO: 1468465 - RNA, 16 nt, Pseudomonas aeruginosa PA01
caagcugaagcgccgc

SEQ ID NO: 1468466 - RNA, 20 nt, Pseudomonas aeruginosa PA01
caagcugcacggcgacccgc

SEQ ID NO: 1468467 - RNA, 22 nt, Pseudomonas aeruginosa PA01
caagcucgucacccgcgccugc

SEQ ID NO: 1468468 - RNA, 20 nt, Pseudomonas aeruginosa PA01
caagcgccggcaacagcagc

SEQ ID NO: 1468469 - RNA, 23 nt, Pseudomonas aeruginosa PA01
caagcgcaugaggcuggccagca

SEQ ID NO: 1468470 - RNA, 16 nt, Pseudomonas aeruginosa PA01
caagcuccccgccgcc

SEQ ID NO: 1468471 - RNA, 17 nt, Pseudomonas aeruginosa PA01
caagcuccccgccgcca

SEQ ID NO: 1468472 - RNA, 19 nt, Pseudomonas aeruginosa PA01
caagcuccccgccgccagg

SEQ ID NO: 1468473 - RNA, 21 nt, Pseudomonas aeruginosa PA01
caagcuccccgccgccaggcg

SEQ ID NO: 1468474 - RNA, 23 nt, Pseudomonas aeruginosa PA01
caagcuccccgccgccaggcgcu

SEQ ID NO: 1468475 - RNA, 15 nt, Pseudomonas aeruginosa PA01
caagcuccgcgaugu

SEQ ID NO: 1468476 - RNA, 13 nt, Pseudomonas aeruginosa PA01
caagcgcccggcg

SEQ ID NO: 1468477 - RNA, 14 nt, Pseudomonas aeruginosa PA01
caagcgcccggcga

SEQ ID NO: 1468478 - RNA, 14 nt, Pseudomonas aeruginosa PA01
caacucgccgccga

SEQ ID NO: 1468479 - RNA, 12 nt, Pseudomonas aeruginosa PA01
caagccucgccc

SEQ ID NO: 1468480 - RNA, 19 nt, Pseudomonas aeruginosa PA01
caagccuggcgcgcugcgg

SEQ ID NO: 1468481 - RNA, 20 nt, Pseudomonas aeruginosa PA01
caagccguuacgacaucgac

SEQ ID NO: 1468482 - RNA, 14 nt, Pseudomonas aeruginosa PA01
caacguccucgcgc

SEQ ID NO: 1468483 - RNA, 12 nt, Pseudomonas aeruginosa PA01
caacgucggcgu

SEQ ID NO: 1468484 - RNA, 19 nt, Pseudomonas aeruginosa PA01
caacggcuccuugaaggcu

SEQ ID NO: 1468485 - RNA, 23 nt, Pseudomonas aeruginosa PA01
caacggcugggucacguccaugu

SEQ ID NO: 1468486 - RNA, 18 nt, Pseudomonas aeruginosa PA01
caacgauaccgccgccgg

SEQ ID NO: 1468487 - RNA, 22 nt, Pseudomonas aeruginosa PA01
caaccuguggaauguccugccg

SEQ ID NO: 1468488 - RNA, 20 nt, Pseudomonas aeruginosa PA01
caacgauucgacgcagcgcg

SEQ ID NO: 1468489 - RNA, 22 nt, Pseudomonas aeruginosa PA01
caacgcgguuauccgccgcugu

SEQ ID NO: 1468490 - RNA, 15 nt, Pseudomonas aeruginosa PA01
caacgcuuccagcac

SEQ ID NO: 1468491 - RNA, 16 nt, Pseudomonas aeruginosa PA01
caacgcuuccagcacc

SEQ ID NO: 1468492 - RNA, 20 nt, Pseudomonas aeruginosa PA01
caacccgcccuugcucgcgg

SEQ ID NO: 1468493 - RNA, 15 nt, Pseudomonas aeruginosa PA01
caacccggccagccc

SEQ ID NO: 1468494 - RNA, 19 nt, Pseudomonas aeruginosa PA01
caacccggccagcccggcc

SEQ ID NO: 1468495 - RNA, 17 nt, Pseudomonas aeruginosa PA01
caacccgcuccgucgcu

SEQ ID NO: 1468496 - RNA, 20 nt, Pseudomonas aeruginosa PA01
caaccgcagacuccggcgca

SEQ ID NO: 1468497 - RNA, 11 nt, Pseudomonas aeruginosa PA01
caaccgcccga

SEQ ID NO: 1468498 - RNA, 15 nt, Pseudomonas aeruginosa PA01
caaccgcccuggucc

SEQ ID NO: 1468499 - RNA, 13 nt, Pseudomonas aeruginosa PA01
caaccgccgccgc

SEQ ID NO: 1468500 - RNA, 15 nt, Pseudomonas aeruginosa PA01
caaccgccgccgcaa

SEQ ID NO: 1468501 - RNA, 22 nt, Pseudomonas aeruginosa PA01
caaccgccgccgcaaccgcccg

SEQ ID NO: 1468502 - RNA, 17 nt, Pseudomonas aeruginosa PA01
caaccgcgauggcguga

SEQ ID NO: 1468503 - RNA, 16 nt, Pseudomonas aeruginosa PA01
caaccgcuggucggca

SEQ ID NO: 1468504 - RNA, 16 nt, Pseudomonas aeruginosa PA01
caaccgcugccgccgu

SEQ ID NO: 1468505 - RNA, 11 nt, Pseudomonas aeruginosa PA01
caaccgcggcg

SEQ ID NO: 1468506 - RNA, 17 nt, Pseudomonas aeruginosa PA01
caaccgcggcggccuca

SEQ ID NO: 1468507 - RNA, 14 nt, Pseudomonas aeruginosa PA01
caaccgggcaucgc

SEQ ID NO: 1468508 - RNA, 16 nt, Pseudomonas aeruginosa PA01
caaccgggcaucgccg

SEQ ID NO: 1468509 - RNA, 20 nt, Pseudomonas aeruginosa PA01
caaccgggcaucgccgacca

SEQ ID NO: 1468510 - RNA, 22 nt, Pseudomonas aeruginosa PA01
caaccgguuucccucgagcacc

SEQ ID NO: 1468511 - RNA, 17 nt, Pseudomonas aeruginosa PA01
caaccgguccucgcccg

SEQ ID NO: 1468512 - RNA, 14 nt, Pseudomonas aeruginosa PA01
caaccgucgcccug

SEQ ID NO: 1468513 - RNA, 15 nt, Pseudomonas aeruginosa PA01
caaccgcuugucgcc

SEQ ID NO: 1468514 - RNA, 17 nt, Pseudomonas aeruginosa PA01
caaccguuccagcgccu

SEQ ID NO: 1468515 - RNA, 19 nt, Pseudomonas aeruginosa PA01
caacacguagcgcaggucg

SEQ ID NO: 1468516 - RNA, 13 nt, Pseudomonas aeruginosa PA01
caacauggcgucg

SEQ ID NO: 1468517 - RNA, 19 nt, Pseudomonas aeruginosa PA01
caacaccuggcgcucgccg

SEQ ID NO: 1468518 - RNA, 20 nt, Pseudomonas aeruginosa PA01
caacaccuggcgcucgccgu

SEQ ID NO: 1468519 - RNA, 21 nt, Pseudomonas aeruginosa PA01
caaccaccccgaaaccggcga

SEQ ID NO: 1468520 - RNA, 14 nt, Pseudomonas aeruginosa PA01
caaccaccggcgca

SEQ ID NO: 1468521 - RNA, 16 nt, Pseudomonas aeruginosa PA01
caacccgccagcaaga

SEQ ID NO: 1468522 - RNA, 16 nt, Pseudomonas aeruginosa PA01
caaccccuucggucgc

SEQ ID NO: 1468523 - RNA, 23 nt, Pseudomonas aeruginosa PA01
caaccauucgucauuggccgaau

SEQ ID NO: 1468524 - RNA, 17 nt, Pseudomonas aeruginosa PA01
caacccagggcgcugcc

SEQ ID NO: 1468525 - RNA, 18 nt, Pseudomonas aeruginosa PA01
auuguggccccagcgcga

SEQ ID NO: 1468526 - RNA, 15 nt, Pseudomonas aeruginosa PA01
auugugcgcgcgcag

SEQ ID NO: 1468527 - RNA, 19 nt, Pseudomonas aeruginosa PA01
auugugcguguucggcggc

SEQ ID NO: 1468528 - RNA, 21 nt, Pseudomonas aeruginosa PA01
caaaccccugggaugccgcca

SEQ ID NO: 1468529 - RNA, 17 nt, Pseudomonas aeruginosa PA01
caaaggcccggcgcggu

SEQ ID NO: 1468530 - RNA, 15 nt, Pseudomonas aeruginosa PA01
caaaggcgcgcaggg

SEQ ID NO: 1468531 - RNA, 16 nt, Pseudomonas aeruginosa PA01
caaaggcgcgcagggc

SEQ ID NO: 1468532 - RNA, 18 nt, Pseudomonas aeruginosa PA01
caaaggcgcgcagggccg

SEQ ID NO: 1468533 - RNA, 19 nt, Pseudomonas aeruginosa PA01
caaagcgcgggcugccccu

SEQ ID NO: 1468534 - RNA, 19 nt, Pseudomonas aeruginosa PA01
caaaggaaucuucggcgcc

SEQ ID NO: 1468535 - RNA, 13 nt, Pseudomonas aeruginosa PA01
caaagcgagcgcc

SEQ ID NO: 1468536 - RNA, 20 nt, Pseudomonas aeruginosa PA01
auguggcgcagcaucaucuc

SEQ ID NO: 1468537 - RNA, 20 nt, Pseudomonas aeruginosa PA01
augugcuugaccgccgccug

SEQ ID NO: 1468538 - RNA, 16 nt, Pseudomonas aeruginosa PA01
augugcggcguggcga

SEQ ID NO: 1468539 - RNA, 22 nt, Pseudomonas aeruginosa PA01
auguucaccagcgcugccucgg

SEQ ID NO: 1468540 - RNA, 21 nt, Pseudomonas aeruginosa PA01
auguuccuccagagugcgcag

SEQ ID NO: 1468541 - RNA, 17 nt, Pseudomonas aeruginosa PA01
augucguagacgcccgg

SEQ ID NO: 1468542 - RNA, 19 nt, Pseudomonas aeruginosa PA01
augucguagccgcgcgcca

SEQ ID NO: 1468543 - RNA, 13 nt, Pseudomonas aeruginosa PA01
auguccaggccga

SEQ ID NO: 1468544 - RNA, 21 nt, Pseudomonas aeruginosa PA01
auguccaucagccgcgcgcug

SEQ ID NO: 1468545 - RNA, 22 nt, Pseudomonas aeruginosa PA01
augucggcgaaaugcaggccgg

SEQ ID NO: 1468546 - RNA, 21 nt, Pseudomonas aeruginosa PA01
auggccuguaccaaggugcug

SEQ ID NO: 1468547 - RNA, 14 nt, Pseudomonas aeruginosa PA01
auggccuugccggc

SEQ ID NO: 1468548 - RNA, 18 nt, Pseudomonas aeruginosa PA01
auggccuggcgcucagcg

SEQ ID NO: 1468549 - RNA, 14 nt, Pseudomonas aeruginosa PA01
auggccuggucggc

SEQ ID NO: 1468550 - RNA, 22 nt, Pseudomonas aeruginosa PA01
auggcgaggaugaucagggcac

SEQ ID NO: 1468551 - RNA, 17 nt, Pseudomonas aeruginosa PA01
auggcgaagcucggccg

SEQ ID NO: 1468552 - RNA, 18 nt, Pseudomonas aeruginosa PA01
auggcuuuccaggcgccg

SEQ ID NO: 1468553 - RNA, 17 nt, Pseudomonas aeruginosa PA01
auggcgauauggccgua

SEQ ID NO: 1468554 - RNA, 18 nt, Pseudomonas aeruginosa PA01
augggcaccgcgccggcg

SEQ ID NO: 1468555 - RNA, 19 nt, Pseudomonas aeruginosa PA01
augggcaccgcgccggcgg

SEQ ID NO: 1468556 - RNA, 16 nt, Pseudomonas aeruginosa PA01
augggccggccgacga

SEQ ID NO: 1468557 - RNA, 14 nt, Pseudomonas aeruginosa PA01
augggcgcgcgccg

SEQ ID NO: 1468558 - RNA, 15 nt, Pseudomonas aeruginosa PA01
augggcgcgcgccgg

SEQ ID NO: 1468559 - RNA, 17 nt, Pseudomonas aeruginosa PA01
augggcgaugcgccggu

SEQ ID NO: 1468560 - RNA, 16 nt, Pseudomonas aeruginosa PA01
augggcgaagccggcg

SEQ ID NO: 1468561 - RNA, 16 nt, Pseudomonas aeruginosa PA01
auggggcugccggccc

SEQ ID NO: 1468562 - RNA, 19 nt, Pseudomonas aeruginosa PA01
augggcggggugaucaguc

SEQ ID NO: 1468563 - RNA, 12 nt, Pseudomonas aeruginosa PA01
augggcguccgg

SEQ ID NO: 1468564 - RNA, 22 nt, Pseudomonas aeruginosa PA01
augggcguccgguaggagcgag

SEQ ID NO: 1468565 - RNA, 13 nt, Pseudomonas aeruginosa PA01
augguggucggca

SEQ ID NO: 1468566 - RNA, 16 nt, Pseudomonas aeruginosa PA01
augguguccggcggcg

SEQ ID NO: 1468567 - RNA, 21 nt, Pseudomonas aeruginosa PA01
augggugaugaccccggcgau

SEQ ID NO: 1468568 - RNA, 13 nt, Pseudomonas aeruginosa PA01
augggucagcgcc

SEQ ID NO: 1468569 - RNA, 18 nt, Pseudomonas aeruginosa PA01
auggguaucaugcgcccc

SEQ ID NO: 1468570 - RNA, 18 nt, Pseudomonas aeruginosa PA01
augggguucgacagcgcg

SEQ ID NO: 1468571 - RNA, 23 nt, Pseudomonas aeruginosa PA01
auggauucgaaccacugcgccau

SEQ ID NO: 1468572 - RNA, 22 nt, Pseudomonas aeruginosa PA01
auggcaacccagggcgcugccg

SEQ ID NO: 1468573 - RNA, 14 nt, Pseudomonas aeruginosa PA01
auggcagcucugcg

SEQ ID NO: 1468574 - RNA, 22 nt, Pseudomonas aeruginosa PA01
auggccauggcagagcuggaag

SEQ ID NO: 1468575 - RNA, 18 nt, Pseudomonas aeruginosa PA01
auggccccuccaccucga

SEQ ID NO: 1468576 - RNA, 20 nt, Pseudomonas aeruginosa PA01
auggccccggcgauccgcgc

SEQ ID NO: 1468577 - RNA, 22 nt, Pseudomonas aeruginosa PA01
auggcaugaggggaaucgccgu

SEQ ID NO: 1468578 - RNA, 13 nt, Pseudomonas aeruginosa PA01
auggccagccagg

SEQ ID NO: 1468579 - RNA, 22 nt, Pseudomonas aeruginosa PA01
auggccaccgaaucggacaggu

SEQ ID NO: 1468580 - RNA, 14 nt, Pseudomonas aeruginosa PA01
auggaacagcagcc

SEQ ID NO: 1468581 - RNA, 17 nt, Pseudomonas aeruginosa PA01
auggaacagcagccagg

SEQ ID NO: 1468582 - RNA, 16 nt, Pseudomonas aeruginosa PA01
auggaacagucgcgcg

SEQ ID NO: 1468583 - RNA, 21 nt, Pseudomonas aeruginosa PA01
auggaagagcgccgcggcggc

SEQ ID NO: 1468584 - RNA, 23 nt, Pseudomonas aeruginosa PA01
auggaagagcgccgcggcggcgu

SEQ ID NO: 1468585 - RNA, 18 nt, Pseudomonas aeruginosa PA01
augcuuuugaacaccagc

SEQ ID NO: 1468586 - RNA, 13 nt, Pseudomonas aeruginosa PA01
augcuugccggcg

SEQ ID NO: 1468587 - RNA, 16 nt, Pseudomonas aeruginosa PA01
augcugucagcgcccg

SEQ ID NO: 1468588 - RNA, 19 nt, Pseudomonas aeruginosa PA01
augcuguucagcaggagca

SEQ ID NO: 1468589 - RNA, 17 nt, Pseudomonas aeruginosa PA01
augcuguuccucgucga

SEQ ID NO: 1468590 - RNA, 21 nt, Pseudomonas aeruginosa PA01
auggaucggcaacuggcuggc

SEQ ID NO: 1468591 - RNA, 19 nt, Pseudomonas aeruginosa PA01
auggaucggccucgcggcg

SEQ ID NO: 1468592 - RNA, 21 nt, Pseudomonas aeruginosa PA01
auggaucaacuggucgcagcc

SEQ ID NO: 1468593 - RNA, 18 nt, Pseudomonas aeruginosa PA01
auggagacggcccgcccc

SEQ ID NO: 1468594 - RNA, 20 nt, Pseudomonas aeruginosa PA01
auggaacgcggguugcccgg

SEQ ID NO: 1468595 - RNA, 20 nt, Pseudomonas aeruginosa PA01
auggaccggcucgucggcgu

SEQ ID NO: 1468596 - RNA, 19 nt, Pseudomonas aeruginosa PA01
augcgccagcggcccggca

SEQ ID NO: 1468597 - RNA, 20 nt, Pseudomonas aeruginosa PA01
augcgccgacgccaccagcc

SEQ ID NO: 1468598 - RNA, 20 nt, Pseudomonas aeruginosa PA01
augcgcccuaccugucccgg

SEQ ID NO: 1468599 - RNA, 17 nt, Pseudomonas aeruginosa PA01
augcgccccagcgccug

SEQ ID NO: 1468600 - RNA, 20 nt, Pseudomonas aeruginosa PA01
augcggccccggcgcucgcu

SEQ ID NO: 1468601 - RNA, 16 nt, Pseudomonas aeruginosa PA01
augcggcccgccggcg

SEQ ID NO: 1468602 - RNA, 12 nt, Pseudomonas aeruginosa PA01
augcgccgggcc

SEQ ID NO: 1468603 - RNA, 15 nt, Pseudomonas aeruginosa PA01
augcgccgggccucg

SEQ ID NO: 1468604 - RNA, 17 nt, Pseudomonas aeruginosa PA01
augcgccgggccucggc

SEQ ID NO: 1468605 - RNA, 18 nt, Pseudomonas aeruginosa PA01
augcgccguuacgccggg

SEQ ID NO: 1468606 - RNA, 20 nt, Pseudomonas aeruginosa PA01
augcgccucagcggccuucg

SEQ ID NO: 1468607 - RNA, 19 nt, Pseudomonas aeruginosa PA01
augcgccuccagguagacc

SEQ ID NO: 1468608 - RNA, 16 nt, Pseudomonas aeruginosa PA01
augcgccggaucggcu

SEQ ID NO: 1468609 - RNA, 23 nt, Pseudomonas aeruginosa PA01
augcgcaccacucccggcgacga

SEQ ID NO: 1468610 - RNA, 23 nt, Pseudomonas aeruginosa PA01
augcgcaacgggacgccaggcgu

SEQ ID NO: 1468611 - RNA, 14 nt, Pseudomonas aeruginosa PA01
augcgcagcgcggg

SEQ ID NO: 1468612 - RNA, 16 nt, Pseudomonas aeruginosa PA01
augcgcaccaggucgc

SEQ ID NO: 1468613 - RNA, 21 nt, Pseudomonas aeruginosa PA01
augcugaucacccgcccgccg

SEQ ID NO: 1468614 - RNA, 17 nt, Pseudomonas aeruginosa PA01
augcguccgcgcaggcg

SEQ ID NO: 1468615 - RNA, 17 nt, Pseudomonas aeruginosa PA01
augcugaacuguucgau

SEQ ID NO: 1468616 - RNA, 15 nt, Pseudomonas aeruginosa PA01
augcugcaggccgag

SEQ ID NO: 1468617 - RNA, 22 nt, Pseudomonas aeruginosa PA01
augcugcccggagcggcugccg

SEQ ID NO: 1468618 - RNA, 13 nt, Pseudomonas aeruginosa PA01
augcugcucggca

SEQ ID NO: 1468619 - RNA, 14 nt, Pseudomonas aeruginosa PA01
augcugcucggcau

SEQ ID NO: 1468620 - RNA, 18 nt, Pseudomonas aeruginosa PA01
augcggccugcaacgccg

SEQ ID NO: 1468621 - RNA, 22 nt, Pseudomonas aeruginosa PA01
augcggcggaacuugucgccgc

SEQ ID NO: 1468622 - RNA, 21 nt, Pseudomonas aeruginosa PA01
augcggcugugcucgaggaag

SEQ ID NO: 1468623 - RNA, 20 nt, Pseudomonas aeruginosa PA01
augcggcuacucgcccgacc

SEQ ID NO: 1468624 - RNA, 18 nt, Pseudomonas aeruginosa PA01
augcgggcgggugcgcga

SEQ ID NO: 1468625 - RNA, 18 nt, Pseudomonas aeruginosa PA01
augcggggcgaccagcau

SEQ ID NO: 1468626 - RNA, 18 nt, Pseudomonas aeruginosa PA01
augcggugcgccuccagg

SEQ ID NO: 1468627 - RNA, 17 nt, Pseudomonas aeruginosa PA01
auucucccucgccgacc

SEQ ID NO: 1468628 - RNA, 18 nt, Pseudomonas aeruginosa PA01
auucgucauuggccgaau

SEQ ID NO: 1468629 - RNA, 16 nt, Pseudomonas aeruginosa PA01
auucguccagccgccg

SEQ ID NO: 1468630 - RNA, 14 nt, Pseudomonas aeruginosa PA01
auucgucgccgccg

SEQ ID NO: 1468631 - RNA, 16 nt, Pseudomonas aeruginosa PA01
auucgucgccgccgag

SEQ ID NO: 1468632 - RNA, 22 nt, Pseudomonas aeruginosa PA01
auucgucgccgccgaggcgcgc

SEQ ID NO: 1468633 - RNA, 13 nt, Pseudomonas aeruginosa PA01
auucgucggccug

SEQ ID NO: 1468634 - RNA, 16 nt, Pseudomonas aeruginosa PA01
auuccugggccccggc

SEQ ID NO: 1468635 - RNA, 21 nt, Pseudomonas aeruginosa PA01
auuccuugcgccaugcgcccg

SEQ ID NO: 1468636 - RNA, 22 nt, Pseudomonas aeruginosa PA01
auuccuugcgccaugcgcccgc

SEQ ID NO: 1468637 - RNA, 17 nt, Pseudomonas aeruginosa PA01
auucgaauggcgccggc

SEQ ID NO: 1468638 - RNA, 16 nt, Pseudomonas aeruginosa PA01
auucgccagccucggc

SEQ ID NO: 1468639 - RNA, 18 nt, Pseudomonas aeruginosa PA01
auucgaugccgcgcgccu

SEQ ID NO: 1468640 - RNA, 20 nt, Pseudomonas aeruginosa PA01
auucgacgcagcgcgcgccg

SEQ ID NO: 1468641 - RNA, 23 nt, Pseudomonas aeruginosa PA01
auucgacgcagcgcgcgccgagc

SEQ ID NO: 1468642 - RNA, 22 nt, Pseudomonas aeruginosa PA01
auucgcgcucggcgaggccggc

SEQ ID NO: 1468643 - RNA, 18 nt, Pseudomonas aeruginosa PA01
auucgcucugcgccaggc

SEQ ID NO: 1468644 - RNA, 23 nt, Pseudomonas aeruginosa PA01
auucgcugucgucggcgcggccg

SEQ ID NO: 1468645 - RNA, 11 nt, Pseudomonas aeruginosa PA01
auucgccggcc

SEQ ID NO: 1468646 - RNA, 19 nt, Pseudomonas aeruginosa PA01
auucgcgcugguugcccag

SEQ ID NO: 1468647 - RNA, 15 nt, Pseudomonas aeruginosa PA01
auucgcggacgccga

SEQ ID NO: 1468648 - RNA, 22 nt, Pseudomonas aeruginosa PA01
auucgcggacgccgaagcgggc

SEQ ID NO: 1468649 - RNA, 15 nt, Pseudomonas aeruginosa PA01
auucggccagcgcgg

SEQ ID NO: 1468650 - RNA, 16 nt, Pseudomonas aeruginosa PA01
auucggccagcgcggc

SEQ ID NO: 1468651 - RNA, 17 nt, Pseudomonas aeruginosa PA01
auucggcuuccugggcg

SEQ ID NO: 1468652 - RNA, 19 nt, Pseudomonas aeruginosa PA01
auguuggcgccuucggcga

SEQ ID NO: 1468653 - RNA, 16 nt, Pseudomonas aeruginosa PA01
auucaucucgccgucg

SEQ ID NO: 1468654 - RNA, 21 nt, Pseudomonas aeruginosa PA01
auuccgacaaggagcgcgagc

SEQ ID NO: 1468655 - RNA, 18 nt, Pseudomonas aeruginosa PA01
auuccgccaccagccagu

SEQ ID NO: 1468656 - RNA, 20 nt, Pseudomonas aeruginosa PA01
auuccgcggcacuccggcau

SEQ ID NO: 1468657 - RNA, 14 nt, Pseudomonas aeruginosa PA01
auuccgcgcaggac

SEQ ID NO: 1468658 - RNA, 21 nt, Pseudomonas aeruginosa PA01
auuccgggucgaggcugccga

SEQ ID NO: 1468659 - RNA, 23 nt, Pseudomonas aeruginosa PA01
auuggcacccuggacccgggccu

SEQ ID NO: 1468660 - RNA, 15 nt, Pseudomonas aeruginosa PA01
auuggaauugcugac

SEQ ID NO: 1468661 - RNA, 22 nt, Pseudomonas aeruginosa PA01
auuggacagcaggcugccgaga

SEQ ID NO: 1468662 - RNA, 14 nt, Pseudomonas aeruginosa PA01
auuggccgggccga

SEQ ID NO: 1468663 - RNA, 18 nt, Pseudomonas aeruginosa PA01
auuggccaggcucgcgau

SEQ ID NO: 1468664 - RNA, 21 nt, Pseudomonas aeruginosa PA01
auuggccagggucacgccaga

SEQ ID NO: 1468665 - RNA, 22 nt, Pseudomonas aeruginosa PA01
auuggccaucagcgccgccucg

SEQ ID NO: 1468666 - RNA, 23 nt, Pseudomonas aeruginosa PA01
auuggccgaaucgaacagggcga

SEQ ID NO: 1468667 - RNA, 11 nt, Pseudomonas aeruginosa PA01
auuggccgccu

SEQ ID NO: 1468668 - RNA, 21 nt, Pseudomonas aeruginosa PA01
auuggccgccugcucggccug

SEQ ID NO: 1468669 - RNA, 24 nt, Pseudomonas aeruginosa PA01
auuggccgccugcucggccugcug

SEQ ID NO: 1468670 - RNA, 16 nt, Pseudomonas aeruginosa PA01
auugucgccgccgagu

SEQ ID NO: 1468671 - RNA, 14 nt, Pseudomonas aeruginosa PA01
auuggugcugccga

SEQ ID NO: 1468672 - RNA, 15 nt, Pseudomonas aeruginosa PA01
auugcgccgccggcu

SEQ ID NO: 1468673 - RNA, 20 nt, Pseudomonas aeruginosa PA01
auugccgggcuuccuggccg

SEQ ID NO: 1468674 - RNA, 22 nt, Pseudomonas aeruginosa PA01
auugccuccgcucugcuggcca

SEQ ID NO: 1468675 - RNA, 24 nt, Pseudomonas aeruginosa PA01
auugccuccgcucugcuggccacc

SEQ ID NO: 1468676 - RNA, 15 nt, Pseudomonas aeruginosa PA01
auugcuccacccgca

SEQ ID NO: 1468677 - RNA, 12 nt, Pseudomonas aeruginosa PA01
auugcugccacu

SEQ ID NO: 1468678 - RNA, 20 nt, Pseudomonas aeruginosa PA01
auugcugccgaggccgaggu

SEQ ID NO: 1468679 - RNA, 16 nt, Pseudomonas aeruginosa PA01
auucuuggcucggcag

SEQ ID NO: 1468680 - RNA, 18 nt, Pseudomonas aeruginosa PA01
auugaacaccugaucgaa

SEQ ID NO: 1468681 - RNA, 13 nt, Pseudomonas aeruginosa PA01
auugaaggccgac

SEQ ID NO: 1468682 - RNA, 23 nt, Pseudomonas aeruginosa PA01
auugccgaugugcacgcugaaga

SEQ ID NO: 1468683 - RNA, 21 nt, Pseudomonas aeruginosa PA01
auugccagaggcugcgcucca

SEQ ID NO: 1468684 - RNA, 23 nt, Pseudomonas aeruginosa PA01
auugcccgguggccuccugcaac

SEQ ID NO: 1468685 - RNA, 18 nt, Pseudomonas aeruginosa PA01
auugcccggccaggcgcg

SEQ ID NO: 1468686 - RNA, 21 nt, Pseudomonas aeruginosa PA01
auugcccggccaggcgcggcg

SEQ ID NO: 1468687 - RNA, 17 nt, Pseudomonas aeruginosa PA01
auugcagcgucgacgcc

SEQ ID NO: 1468688 - RNA, 22 nt, Pseudomonas aeruginosa PA01
auugcagcgucgacgccgagcu

SEQ ID NO: 1468689 - RNA, 20 nt, Pseudomonas aeruginosa PA01
auugcaggcccggccgccug

SEQ ID NO: 1468690 - RNA, 16 nt, Pseudomonas aeruginosa PA01
augaaaaauggccgcu

SEQ ID NO: 1468691 - RNA, 21 nt, Pseudomonas aeruginosa PA01
augaaaaagggaugccgccgg

SEQ ID NO: 1468692 - RNA, 22 nt, Pseudomonas aeruginosa PA01
augaaaaagggaugccgccggc

SEQ ID NO: 1468693 - RNA, 19 nt, Pseudomonas aeruginosa PA01
augaaaaagggaugccggc

SEQ ID NO: 1468694 - RNA, 17 nt, Pseudomonas aeruginosa PA01
augaaaaacgccggcga

SEQ ID NO: 1468695 - RNA, 22 nt, Pseudomonas aeruginosa PA01
augaacuggucgcuccagcccc

SEQ ID NO: 1468696 - RNA, 17 nt, Pseudomonas aeruginosa PA01
augaacgccucgccaac

SEQ ID NO: 1468697 - RNA, 20 nt, Pseudomonas aeruginosa PA01
augaacgcgcggaccuucga

SEQ ID NO: 1468698 - RNA, 16 nt, Pseudomonas aeruginosa PA01
augaacagugcgcccg

SEQ ID NO: 1468699 - RNA, 16 nt, Pseudomonas aeruginosa PA01
augacgaggcccgccc

SEQ ID NO: 1468700 - RNA, 13 nt, Pseudomonas aeruginosa PA01
augaccgccccgg

SEQ ID NO: 1468701 - RNA, 15 nt, Pseudomonas aeruginosa PA01
augaccgccccggca

SEQ ID NO: 1468702 - RNA, 18 nt, Pseudomonas aeruginosa PA01
augaccgccccggcagcc

SEQ ID NO: 1468703 - RNA, 18 nt, Pseudomonas aeruginosa PA01
augaccgauggcgccgcg

SEQ ID NO: 1468704 - RNA, 18 nt, Pseudomonas aeruginosa PA01
augaccaggcugaucagc

SEQ ID NO: 1468705 - RNA, 19 nt, Pseudomonas aeruginosa PA01
augaccacgucgcgaccgg

SEQ ID NO: 1468706 - RNA, 19 nt, Pseudomonas aeruginosa PA01
augaaggggaaaccgagca

SEQ ID NO: 1468707 - RNA, 12 nt, Pseudomonas aeruginosa PA01
augaaggcgcug

SEQ ID NO: 1468708 - RNA, 19 nt, Pseudomonas aeruginosa PA01
augacgccauccuucggcg

SEQ ID NO: 1468709 - RNA, 21 nt, Pseudomonas aeruginosa PA01
augacgcaaacgccauccgcc

SEQ ID NO: 1468710 - RNA, 14 nt, Pseudomonas aeruginosa PA01
augaucgagcgcac

SEQ ID NO: 1468711 - RNA, 17 nt, Pseudomonas aeruginosa PA01
augaucaggucggccgc

SEQ ID NO: 1468712 - RNA, 16 nt, Pseudomonas aeruginosa PA01
augaucgguucccgcc

SEQ ID NO: 1468713 - RNA, 20 nt, Pseudomonas aeruginosa PA01
augaucgguucccgcccgcu

SEQ ID NO: 1468714 - RNA, 21 nt, Pseudomonas aeruginosa PA01
augauggucaacaccagcgcc

SEQ ID NO: 1468715 - RNA, 13 nt, Pseudomonas aeruginosa PA01
augaugugcgcag

SEQ ID NO: 1468716 - RNA, 15 nt, Pseudomonas aeruginosa PA01
augcagguggcgcuc

SEQ ID NO: 1468717 - RNA, 22 nt, Pseudomonas aeruginosa PA01
augcaggccggccuccagcgcc

SEQ ID NO: 1468718 - RNA, 15 nt, Pseudomonas aeruginosa PA01
augcaggcucucgcg

SEQ ID NO: 1468719 - RNA, 23 nt, Pseudomonas aeruginosa PA01
augcaggcucucgcgcagcagga

SEQ ID NO: 1468720 - RNA, 23 nt, Pseudomonas aeruginosa PA01
augcagcagguagugcucggcca

SEQ ID NO: 1468721 - RNA, 14 nt, Pseudomonas aeruginosa PA01
augcagccgauggc

SEQ ID NO: 1468722 - RNA, 21 nt, Pseudomonas aeruginosa PA01
augcaugauuucguuggccca

SEQ ID NO: 1468723 - RNA, 16 nt, Pseudomonas aeruginosa PA01
aucuauaaugcgcccc

SEQ ID NO: 1468724 - RNA, 21 nt, Pseudomonas aeruginosa PA01
aucuccaggccgcucaccgcc

SEQ ID NO: 1468725 - RNA, 21 nt, Pseudomonas aeruginosa PA01
aucuacuuaggcucacacgcc

SEQ ID NO: 1468726 - RNA, 15 nt, Pseudomonas aeruginosa PA01
aucuccugcugggcg

SEQ ID NO: 1468727 - RNA, 13 nt, Pseudomonas aeruginosa PA01
aucuccuggcgcg

SEQ ID NO: 1468728 - RNA, 14 nt, Pseudomonas aeruginosa PA01
aucucgauggugaa

SEQ ID NO: 1468729 - RNA, 20 nt, Pseudomonas aeruginosa PA01
aucuccgaguccugcugcga

SEQ ID NO: 1468730 - RNA, 18 nt, Pseudomonas aeruginosa PA01
aucuccgccaggcggccg

SEQ ID NO: 1468731 - RNA, 20 nt, Pseudomonas aeruginosa PA01
aucuccgggagcaucuggcc

SEQ ID NO: 1468732 - RNA, 21 nt, Pseudomonas aeruginosa PA01
aucuccgggagcaucuggccc

SEQ ID NO: 1468733 - RNA, 22 nt, Pseudomonas aeruginosa PA01
aucuccgggagcaucuggcccg

SEQ ID NO: 1468734 - RNA, 17 nt, Pseudomonas aeruginosa PA01
aucuccucgacggcggg

SEQ ID NO: 1468735 - RNA, 18 nt, Pseudomonas aeruginosa PA01
aucuccgcgccacgcgca

SEQ ID NO: 1468736 - RNA, 15 nt, Pseudomonas aeruginosa PA01
aucguuggcgaaguu

SEQ ID NO: 1468737 - RNA, 16 nt, Pseudomonas aeruginosa PA01
aucgucucgcgacacg

SEQ ID NO: 1468738 - RNA, 17 nt, Pseudomonas aeruginosa PA01
aucggcugcaacgccgg

SEQ ID NO: 1468739 - RNA, 22 nt, Pseudomonas aeruginosa PA01
aucggcuccucugccugcgccc

SEQ ID NO: 1468740 - RNA, 14 nt, Pseudomonas aeruginosa PA01
aucggcuccagcuu

SEQ ID NO: 1468741 - RNA, 22 nt, Pseudomonas aeruginosa PA01
aucggcggcgcggcguacucca

SEQ ID NO: 1468742 - RNA, 11 nt, Pseudomonas aeruginosa PA01
aucggcggcgg

SEQ ID NO: 1468743 - RNA, 22 nt, Pseudomonas aeruginosa PA01
aucggcgucggcuggucgaagc

SEQ ID NO: 1468744 - RNA, 15 nt, Pseudomonas aeruginosa PA01
aucggcguccgcggc

SEQ ID NO: 1468745 - RNA, 22 nt, Pseudomonas aeruginosa PA01
aucggcguguucaggugcugga

SEQ ID NO: 1468746 - RNA, 18 nt, Pseudomonas aeruginosa PA01
aucggcguuuagcgcccg

SEQ ID NO: 1468747 - RNA, 17 nt, Pseudomonas aeruginosa PA01
aucuucucgaagcgcgc

SEQ ID NO: 1468748 - RNA, 22 nt, Pseudomonas aeruginosa PA01
aucuucguaggucaugcgugcg

SEQ ID NO: 1468749 - RNA, 17 nt, Pseudomonas aeruginosa PA01
aucuucuaccuggcgcu

SEQ ID NO: 1468750 - RNA, 16 nt, Pseudomonas aeruginosa PA01
aucuucugucccggac

SEQ ID NO: 1468751 - RNA, 21 nt, Pseudomonas aeruginosa PA01
aucuugcgcccggcgcgaccg

SEQ ID NO: 1468752 - RNA, 12 nt, Pseudomonas aeruginosa PA01
aucuuggcccau

SEQ ID NO: 1468753 - RNA, 13 nt, Pseudomonas aeruginosa PA01
aucuucagcagca

SEQ ID NO: 1468754 - RNA, 19 nt, Pseudomonas aeruginosa PA01
aucuucagcaucaggucgg

SEQ ID NO: 1468755 - RNA, 17 nt, Pseudomonas aeruginosa PA01
aucugguggaacagcau

SEQ ID NO: 1468756 - RNA, 20 nt, Pseudomonas aeruginosa PA01
aucugucgauaccagcgccg

SEQ ID NO: 1468757 - RNA, 23 nt, Pseudomonas aeruginosa PA01
aucugucgauaccagcgccgcuc

SEQ ID NO: 1468758 - RNA, 20 nt, Pseudomonas aeruginosa PA01
aucugugcggugccgcgcag

SEQ ID NO: 1468759 - RNA, 16 nt, Pseudomonas aeruginosa PA01
aucuggcugucgccga

SEQ ID NO: 1468760 - RNA, 17 nt, Pseudomonas aeruginosa PA01
aucuggaauucgccgcg

SEQ ID NO: 1468761 - RNA, 22 nt, Pseudomonas aeruginosa PA01
aucuggcccuuuuccucgggga

SEQ ID NO: 1468762 - RNA, 21 nt, Pseudomonas aeruginosa PA01
aucucggugcgccccaggugc

SEQ ID NO: 1468763 - RNA, 16 nt, Pseudomonas aeruginosa PA01
aucucgccgucggcgg

SEQ ID NO: 1468764 - RNA, 19 nt, Pseudomonas aeruginosa PA01
aucucgccgcgcacgucga

SEQ ID NO: 1468765 - RNA, 14 nt, Pseudomonas aeruginosa PA01
aucucgcggcgcgg

SEQ ID NO: 1468766 - RNA, 16 nt, Pseudomonas aeruginosa PA01
aucucgcguuccagca

SEQ ID NO: 1468767 - RNA, 23 nt, Pseudomonas aeruginosa PA01
aucugcugcagcaucaggcgcuc

SEQ ID NO: 1468768 - RNA, 21 nt, Pseudomonas aeruginosa PA01
aucugcucguccaggccgcag

SEQ ID NO: 1468769 - RNA, 16 nt, Pseudomonas aeruginosa PA01
auccguuaccgcgggc

SEQ ID NO: 1468770 - RNA, 14 nt, Pseudomonas aeruginosa PA01
auccuccgccagcg

SEQ ID NO: 1468771 - RNA, 17 nt, Pseudomonas aeruginosa PA01
auccuccggacgccgaa

SEQ ID NO: 1468772 - RNA, 13 nt, Pseudomonas aeruginosa PA01
auccuccagcacu

SEQ ID NO: 1468773 - RNA, 21 nt, Pseudomonas aeruginosa PA01
auccgugacgucggcggcgga

SEQ ID NO: 1468774 - RNA, 14 nt, Pseudomonas aeruginosa PA01
auccgugccaggcg

SEQ ID NO: 1468775 - RNA, 16 nt, Pseudomonas aeruginosa PA01
auccgugccaggcgcu

SEQ ID NO: 1468776 - RNA, 14 nt, Pseudomonas aeruginosa PA01
auccgugcgccggg

SEQ ID NO: 1468777 - RNA, 15 nt, Pseudomonas aeruginosa PA01
auccgugcgccgggc

SEQ ID NO: 1468778 - RNA, 16 nt, Pseudomonas aeruginosa PA01
auccguggcgagcgcg

SEQ ID NO: 1468779 - RNA, 16 nt, Pseudomonas aeruginosa PA01
auccggguggagaggc

SEQ ID NO: 1468780 - RNA, 14 nt, Pseudomonas aeruginosa PA01
auccggcuggcgcc

SEQ ID NO: 1468781 - RNA, 13 nt, Pseudomonas aeruginosa PA01
auccgggcggcgg

SEQ ID NO: 1468782 - RNA, 22 nt, Pseudomonas aeruginosa PA01
auccgggcguagggcgaauaac

SEQ ID NO: 1468783 - RNA, 20 nt, Pseudomonas aeruginosa PA01
auccgggcccaggcuggcgg

SEQ ID NO: 1468784 - RNA, 23 nt, Pseudomonas aeruginosa PA01
auccgggcccaggcuggcggcca

SEQ ID NO: 1468785 - RNA, 18 nt, Pseudomonas aeruginosa PA01
auccggaguucgcccgcc

SEQ ID NO: 1468786 - RNA, 20 nt, Pseudomonas aeruginosa PA01
auccgcguggcgugcucggc

SEQ ID NO: 1468787 - RNA, 22 nt, Pseudomonas aeruginosa PA01
auccgcguuaccguccgcgccg

SEQ ID NO: 1468788 - RNA, 14 nt, Pseudomonas aeruginosa PA01
auccgcuccagcag

SEQ ID NO: 1468789 - RNA, 16 nt, Pseudomonas aeruginosa PA01
auccgcuccagcgccu

SEQ ID NO: 1468790 - RNA, 22 nt, Pseudomonas aeruginosa PA01
auccgcuccaggcugugggcga

SEQ ID NO: 1468791 - RNA, 13 nt, Pseudomonas aeruginosa PA01
auccgcucgaucc

SEQ ID NO: 1468792 - RNA, 20 nt, Pseudomonas aeruginosa PA01
auccgcucgaucccggcgcg

SEQ ID NO: 1468793 - RNA, 21 nt, Pseudomonas aeruginosa PA01
auccgccgauugugcagggcc

SEQ ID NO: 1468794 - RNA, 16 nt, Pseudomonas aeruginosa PA01
auccgcggccuuuugc

SEQ ID NO: 1468795 - RNA, 16 nt, Pseudomonas aeruginosa PA01
auccgcuuacuggcga

SEQ ID NO: 1468796 - RNA, 15 nt, Pseudomonas aeruginosa PA01
auccgcugggccuug

SEQ ID NO: 1468797 - RNA, 20 nt, Pseudomonas aeruginosa PA01
auccgccgauacagcgcgcg

SEQ ID NO: 1468798 - RNA, 13 nt, Pseudomonas aeruginosa PA01
auccgccagcaga

SEQ ID NO: 1468799 - RNA, 16 nt, Pseudomonas aeruginosa PA01
auccgcacccgcgacu

SEQ ID NO: 1468800 - RNA, 17 nt, Pseudomonas aeruginosa PA01
auccgcacccgcgacuc

SEQ ID NO: 1468801 - RNA, 14 nt, Pseudomonas aeruginosa PA01
auccgcacccgggc

SEQ ID NO: 1468802 - RNA, 16 nt, Pseudomonas aeruginosa PA01
auccgcaccauccgcc

SEQ ID NO: 1468803 - RNA, 18 nt, Pseudomonas aeruginosa PA01
auccgcaccauccgccgc

SEQ ID NO: 1468804 - RNA, 19 nt, Pseudomonas aeruginosa PA01
auccgcaccauccgccgca

SEQ ID NO: 1468805 - RNA, 15 nt, Pseudomonas aeruginosa PA01
auccgauuccgcgca

SEQ ID NO: 1468806 - RNA, 14 nt, Pseudomonas aeruginosa PA01
auccgacgccggcu

SEQ ID NO: 1468807 - RNA, 22 nt, Pseudomonas aeruginosa PA01
aucccuucguccucguggcgcg

SEQ ID NO: 1468808 - RNA, 18 nt, Pseudomonas aeruginosa PA01
aucccuucgugcuggcgg

SEQ ID NO: 1468809 - RNA, 21 nt, Pseudomonas aeruginosa PA01
aucccugcuucgaccagggca

SEQ ID NO: 1468810 - RNA, 12 nt, Pseudomonas aeruginosa PA01
aucagcggcggg

SEQ ID NO: 1468811 - RNA, 23 nt, Pseudomonas aeruginosa PA01
aucagcggguaacccagggugcg

SEQ ID NO: 1468812 - RNA, 19 nt, Pseudomonas aeruginosa PA01
aucagcgcuuccagggugg

SEQ ID NO: 1468813 - RNA, 14 nt, Pseudomonas aeruginosa PA01
aucgaacccccgac

SEQ ID NO: 1468814 - RNA, 14 nt, Pseudomonas aeruginosa PA01
aucgaaaugccgca

SEQ ID NO: 1468815 - RNA, 21 nt, Pseudomonas aeruginosa PA01
auccucggccauaccuccagc

SEQ ID NO: 1468816 - RNA, 22 nt, Pseudomonas aeruginosa PA01
auccugaccccggccuggcugg

SEQ ID NO: 1468817 - RNA, 18 nt, Pseudomonas aeruginosa PA01
auccucgcgcaccgccuc

SEQ ID NO: 1468818 - RNA, 20 nt, Pseudomonas aeruginosa PA01
auccucgcggaagucggcgg

SEQ ID NO: 1468819 - RNA, 21 nt, Pseudomonas aeruginosa PA01
auccucgcggaagucggcggg

SEQ ID NO: 1468820 - RNA, 16 nt, Pseudomonas aeruginosa PA01
auccucgccucgcgcc

SEQ ID NO: 1468821 - RNA, 14 nt, Pseudomonas aeruginosa PA01
auccucccugcccg

SEQ ID NO: 1468822 - RNA, 17 nt, Pseudomonas aeruginosa PA01
auccuccgaggccacca

SEQ ID NO: 1468823 - RNA, 23 nt, Pseudomonas aeruginosa PA01
auccugcccguaccacguccaga

SEQ ID NO: 1468824 - RNA, 16 nt, Pseudomonas aeruginosa PA01
auccucgucgauccgc

SEQ ID NO: 1468825 - RNA, 15 nt, Pseudomonas aeruginosa PA01
auccuggccggcggc

SEQ ID NO: 1468826 - RNA, 12 nt, Pseudomonas aeruginosa PA01
auccuggcggca

SEQ ID NO: 1468827 - RNA, 13 nt, Pseudomonas aeruginosa PA01
auccugcgcgccu

SEQ ID NO: 1468828 - RNA, 16 nt, Pseudomonas aeruginosa PA01
aucgaacuggccagca

SEQ ID NO: 1468829 - RNA, 15 nt, Pseudomonas aeruginosa PA01
aucgacaccccgguc

SEQ ID NO: 1468830 - RNA, 17 nt, Pseudomonas aeruginosa PA01
aucgacaauagcgccac

SEQ ID NO: 1468831 - RNA, 19 nt, Pseudomonas aeruginosa PA01
aucgacgcccucggcgacg

SEQ ID NO: 1468832 - RNA, 18 nt, Pseudomonas aeruginosa PA01
aucgacgccgcuggcggc

SEQ ID NO: 1468833 - RNA, 17 nt, Pseudomonas aeruginosa PA01
aucgacgccucggcgcg

SEQ ID NO: 1468834 - RNA, 21 nt, Pseudomonas aeruginosa PA01
aucgacgccuucguggccgcg

SEQ ID NO: 1468835 - RNA, 21 nt, Pseudomonas aeruginosa PA01
aucgaccuugcccucggcgcc

SEQ ID NO: 1468836 - RNA, 24 nt, Pseudomonas aeruginosa PA01
aucgaccacacaugcaggucgugc

SEQ ID NO: 1468837 - RNA, 17 nt, Pseudomonas aeruginosa PA01
aucgaccagacgcagca

SEQ ID NO: 1468838 - RNA, 16 nt, Pseudomonas aeruginosa PA01
aucgaccagggccggg

SEQ ID NO: 1468839 - RNA, 17 nt, Pseudomonas aeruginosa PA01
aucgaccaggucgccau

SEQ ID NO: 1468840 - RNA, 15 nt, Pseudomonas aeruginosa PA01
aucgacccagccgca

SEQ ID NO: 1468841 - RNA, 20 nt, Pseudomonas aeruginosa PA01
aucgacccagccgcacgccc

SEQ ID NO: 1468842 - RNA, 13 nt, Pseudomonas aeruginosa PA01
aucgcgcugggcg

SEQ ID NO: 1468843 - RNA, 15 nt, Pseudomonas aeruginosa PA01
aucgcgcugggcgca

SEQ ID NO: 1468844 - RNA, 20 nt, Pseudomonas aeruginosa PA01
aucgcgcuuggacagcucgc

SEQ ID NO: 1468845 - RNA, 14 nt, Pseudomonas aeruginosa PA01
aucgcgccgccgaa

SEQ ID NO: 1468846 - RNA, 16 nt, Pseudomonas aeruginosa PA01
aucgcgccgccgaagc

SEQ ID NO: 1468847 - RNA, 22 nt, Pseudomonas aeruginosa PA01
aucgcgccgccgaagccgacgc

SEQ ID NO: 1468848 - RNA, 21 nt, Pseudomonas aeruginosa PA01
aucgcgccggaugggcgagcu

SEQ ID NO: 1468849 - RNA, 13 nt, Pseudomonas aeruginosa PA01
aucgcuggcgcag

SEQ ID NO: 1468850 - RNA, 21 nt, Pseudomonas aeruginosa PA01
aucgcuggcgcagccgcugcu

SEQ ID NO: 1468851 - RNA, 12 nt, Pseudomonas aeruginosa PA01
aucgcuggcgcc

SEQ ID NO: 1468852 - RNA, 23 nt, Pseudomonas aeruginosa PA01
aucgcugcggguucagucggcca

SEQ ID NO: 1468853 - RNA, 22 nt, Pseudomonas aeruginosa PA01
aucgcugaccuggaagcggguu

SEQ ID NO: 1468854 - RNA, 21 nt, Pseudomonas aeruginosa PA01
aucgcucaugugggcuaccgc

SEQ ID NO: 1468855 - RNA, 17 nt, Pseudomonas aeruginosa PA01
aucgcucaacggcgugc

SEQ ID NO: 1468856 - RNA, 18 nt, Pseudomonas aeruginosa PA01
aucgcucaacggcgugcc

SEQ ID NO: 1468857 - RNA, 12 nt, Pseudomonas aeruginosa PA01
aucgcucaccgg

SEQ ID NO: 1468858 - RNA, 20 nt, Pseudomonas aeruginosa PA01
aucggccccaccgcacuggu

SEQ ID NO: 1468859 - RNA, 17 nt, Pseudomonas aeruginosa PA01
aucggccccaccuggcg

SEQ ID NO: 1468860 - RNA, 23 nt, Pseudomonas aeruginosa PA01
aucggccaguccggucagcagca

SEQ ID NO: 1468861 - RNA, 12 nt, Pseudomonas aeruginosa PA01
aucggcccggcg

SEQ ID NO: 1468862 - RNA, 14 nt, Pseudomonas aeruginosa PA01
aucggcccggcuuc

SEQ ID NO: 1468863 - RNA, 21 nt, Pseudomonas aeruginosa PA01
aucggcccggcuucgcgggug

SEQ ID NO: 1468864 - RNA, 21 nt, Pseudomonas aeruginosa PA01
aucggcccgggcgccaccgcg

SEQ ID NO: 1468865 - RNA, 12 nt, Pseudomonas aeruginosa PA01
aucggcccuggg

SEQ ID NO: 1468866 - RNA, 21 nt, Pseudomonas aeruginosa PA01
aucggcccugggcguggcaaa

SEQ ID NO: 1468867 - RNA, 15 nt, Pseudomonas aeruginosa PA01
aucggcccuucgaca

SEQ ID NO: 1468868 - RNA, 21 nt, Pseudomonas aeruginosa PA01
aucggccgacagagcggccgg

SEQ ID NO: 1468869 - RNA, 15 nt, Pseudomonas aeruginosa PA01
aucggccgccaggcu

SEQ ID NO: 1468870 - RNA, 13 nt, Pseudomonas aeruginosa PA01
aucggccgccagu

SEQ ID NO: 1468871 - RNA, 17 nt, Pseudomonas aeruginosa PA01
aucggcaacgagcagga

SEQ ID NO: 1468872 - RNA, 12 nt, Pseudomonas aeruginosa PA01
aucggccucgcg

SEQ ID NO: 1468873 - RNA, 17 nt, Pseudomonas aeruginosa PA01
aucggccucgcggcgcu

SEQ ID NO: 1468874 - RNA, 17 nt, Pseudomonas aeruginosa PA01
aucggccuuaaggugac

SEQ ID NO: 1468875 - RNA, 22 nt, Pseudomonas aeruginosa PA01
aucggccugguuguaggcgccg

SEQ ID NO: 1468876 - RNA, 18 nt, Pseudomonas aeruginosa PA01
aucggcgagccgcagcgg

SEQ ID NO: 1468877 - RNA, 22 nt, Pseudomonas aeruginosa PA01
aucggcgccgcgcaccugggcg

SEQ ID NO: 1468878 - RNA, 23 nt, Pseudomonas aeruginosa PA01
aucggcgccgcgcaccugggcgu

SEQ ID NO: 1468879 - RNA, 12 nt, Pseudomonas aeruginosa PA01
aucggcgccggc

SEQ ID NO: 1468880 - RNA, 22 nt, Pseudomonas aeruginosa PA01
aucggcgccucccagggucgcc

SEQ ID NO: 1468881 - RNA, 18 nt, Pseudomonas aeruginosa PA01
aucggcgcgcagggccag

SEQ ID NO: 1468882 - RNA, 17 nt, Pseudomonas aeruginosa PA01
aucggcggcaggccgau

SEQ ID NO: 1468883 - RNA, 18 nt, Pseudomonas aeruginosa PA01
aucggcggcaggccgaug

SEQ ID NO: 1468884 - RNA, 16 nt, Pseudomonas aeruginosa PA01
aucggcggcaggcgca

SEQ ID NO: 1468885 - RNA, 17 nt, Pseudomonas aeruginosa PA01
aucggcgcuccgccgaa

SEQ ID NO: 1468886 - RNA, 21 nt, Pseudomonas aeruginosa PA01
aucggcggauaacgccgcugg

SEQ ID NO: 1468887 - RNA, 16 nt, Pseudomonas aeruginosa PA01
aucgccauuggccagg

SEQ ID NO: 1468888 - RNA, 15 nt, Pseudomonas aeruginosa PA01
aucgagcggcccgcg

SEQ ID NO: 1468889 - RNA, 23 nt, Pseudomonas aeruginosa PA01
aucgagcggcggccgucgcuggc

SEQ ID NO: 1468890 - RNA, 15 nt, Pseudomonas aeruginosa PA01
aucgagcugcucgau

SEQ ID NO: 1468891 - RNA, 22 nt, Pseudomonas aeruginosa PA01
aucgcccgcaguuccucgccgc

SEQ ID NO: 1468892 - RNA, 13 nt, Pseudomonas aeruginosa PA01
aucgcccgcgccu

SEQ ID NO: 1468893 - RNA, 19 nt, Pseudomonas aeruginosa PA01
aucgcccagcggcuggcgg

SEQ ID NO: 1468894 - RNA, 14 nt, Pseudomonas aeruginosa PA01
aucgcccagggcca

SEQ ID NO: 1468895 - RNA, 22 nt, Pseudomonas aeruginosa PA01
aucgacugcaugaugccgugca

SEQ ID NO: 1468896 - RNA, 20 nt, Pseudomonas aeruginosa PA01
aucgagaaauaggcgcugcg

SEQ ID NO: 1468897 - RNA, 20 nt, Pseudomonas aeruginosa PA01
aucgacgguuucaggccuug

SEQ ID NO: 1468898 - RNA, 20 nt, Pseudomonas aeruginosa PA01
aucgagcaguuccaggcguc

SEQ ID NO: 1468899 - RNA, 19 nt, Pseudomonas aeruginosa PA01
aucgagcagcggcgccaac

SEQ ID NO: 1468900 - RNA, 17 nt, Pseudomonas aeruginosa PA01
aucgagcaacagcagga

SEQ ID NO: 1468901 - RNA, 19 nt, Pseudomonas aeruginosa PA01
aucgcgcacaugccgagcg

SEQ ID NO: 1468902 - RNA, 22 nt, Pseudomonas aeruginosa PA01
aucgcgcacuuccggacugccc

SEQ ID NO: 1468903 - RNA, 17 nt, Pseudomonas aeruginosa PA01
aucgcgcagaucgccgc

SEQ ID NO: 1468904 - RNA, 22 nt, Pseudomonas aeruginosa PA01
aucgccggguugccgcuggccu

SEQ ID NO: 1468905 - RNA, 15 nt, Pseudomonas aeruginosa PA01
aucgccgguccucga

SEQ ID NO: 1468906 - RNA, 16 nt, Pseudomonas aeruginosa PA01
aucgccgguccucgac

SEQ ID NO: 1468907 - RNA, 18 nt, Pseudomonas aeruginosa PA01
aucgccguucucgaucaa

SEQ ID NO: 1468908 - RNA, 19 nt, Pseudomonas aeruginosa PA01
aucgccuccaccagcgccg

SEQ ID NO: 1468909 - RNA, 21 nt, Pseudomonas aeruginosa PA01
aucgccuccaccagcgccggc

SEQ ID NO: 1468910 - RNA, 19 nt, Pseudomonas aeruginosa PA01
aucgccuccacggcggccu

SEQ ID NO: 1468911 - RNA, 20 nt, Pseudomonas aeruginosa PA01
aucgccuccacggcggccuc

SEQ ID NO: 1468912 - RNA, 16 nt, Pseudomonas aeruginosa PA01
aucgccguccuggaga

SEQ ID NO: 1468913 - RNA, 20 nt, Pseudomonas aeruginosa PA01
aucgccgcggcgaagcgcuc

SEQ ID NO: 1468914 - RNA, 20 nt, Pseudomonas aeruginosa PA01
aucgccgcguagcgccaggc

SEQ ID NO: 1468915 - RNA, 14 nt, Pseudomonas aeruginosa PA01
aucgccggcgagcc

SEQ ID NO: 1468916 - RNA, 19 nt, Pseudomonas aeruginosa PA01
aucgccggcgagccgcugg

SEQ ID NO: 1468917 - RNA, 14 nt, Pseudomonas aeruginosa PA01
aucgcccggcugca

SEQ ID NO: 1468918 - RNA, 16 nt, Pseudomonas aeruginosa PA01
aucgccgccaggcaga

SEQ ID NO: 1468919 - RNA, 22 nt, Pseudomonas aeruginosa PA01
aucgccgccaggcagaccugca

SEQ ID NO: 1468920 - RNA, 14 nt, Pseudomonas aeruginosa PA01
aucgccgccuugcg

SEQ ID NO: 1468921 - RNA, 15 nt, Pseudomonas aeruginosa PA01
aucgccgcgccgccg

SEQ ID NO: 1468922 - RNA, 17 nt, Pseudomonas aeruginosa PA01
aucgccgcgccgccgag

SEQ ID NO: 1468923 - RNA, 19 nt, Pseudomonas aeruginosa PA01
agcguuguguagucauggc

SEQ ID NO: 1468924 - RNA, 21 nt, Pseudomonas aeruginosa PA01
agcguuucgaagccgccgccg

SEQ ID NO: 1468925 - RNA, 16 nt, Pseudomonas aeruginosa PA01
agcguugcgccagacc

SEQ ID NO: 1468926 - RNA, 19 nt, Pseudomonas aeruginosa PA01
agcguugggccucgcugcg

SEQ ID NO: 1468927 - RNA, 20 nt, Pseudomonas aeruginosa PA01
agcguugcgcgagcaccgcg

SEQ ID NO: 1468928 - RNA, 19 nt, Pseudomonas aeruginosa PA01
agcguuguucuucgacgcu

SEQ ID NO: 1468929 - RNA, 23 nt, Pseudomonas aeruginosa PA01
agcguuguucuucgacgcugguc

SEQ ID NO: 1468930 - RNA, 17 nt, Pseudomonas aeruginosa PA01
agcuaccgucggccugc

SEQ ID NO: 1468931 - RNA, 17 nt, Pseudomonas aeruginosa PA01
agcuccaccgauggcgc

SEQ ID NO: 1468932 - RNA, 15 nt, Pseudomonas aeruginosa PA01
agcuccagcaccggc

SEQ ID NO: 1468933 - RNA, 16 nt, Pseudomonas aeruginosa PA01
agcuccagcaccggcg

SEQ ID NO: 1468934 - RNA, 11 nt, Pseudomonas aeruginosa PA01
agcuccagcag

SEQ ID NO: 1468935 - RNA, 13 nt, Pseudomonas aeruginosa PA01
agcuccaggccga

SEQ ID NO: 1468936 - RNA, 13 nt, Pseudomonas aeruginosa PA01
agcuccagcgccc

SEQ ID NO: 1468937 - RNA, 14 nt, Pseudomonas aeruginosa PA01
agcuccacgucggc

SEQ ID NO: 1468938 - RNA, 16 nt, Pseudomonas aeruginosa PA01
agcuccacgucggccc

SEQ ID NO: 1468939 - RNA, 17 nt, Pseudomonas aeruginosa PA01
agcucauggagcaacag

SEQ ID NO: 1468940 - RNA, 20 nt, Pseudomonas aeruginosa PA01
agcucagcuccaggccgcgg

SEQ ID NO: 1468941 - RNA, 12 nt, Pseudomonas aeruginosa PA01
agcucagcaggu

SEQ ID NO: 1468942 - RNA, 13 nt, Pseudomonas aeruginosa PA01
agcucagcagguc

SEQ ID NO: 1468943 - RNA, 15 nt, Pseudomonas aeruginosa PA01
agcucagcaggucgc

SEQ ID NO: 1468944 - RNA, 21 nt, Pseudomonas aeruginosa PA01
agcuccuugcgcuccuuggcu

SEQ ID NO: 1468945 - RNA, 20 nt, Pseudomonas aeruginosa PA01
agcucgaacagcaccgagca

SEQ ID NO: 1468946 - RNA, 15 nt, Pseudomonas aeruginosa PA01
agcuccucggcgugg

SEQ ID NO: 1468947 - RNA, 15 nt, Pseudomonas aeruginosa PA01
agcuccggcgggcgg

SEQ ID NO: 1468948 - RNA, 21 nt, Pseudomonas aeruginosa PA01
agcuccgggcuggccaccagc

SEQ ID NO: 1468949 - RNA, 22 nt, Pseudomonas aeruginosa PA01
agcuccgggcuggccaccagca

SEQ ID NO: 1468950 - RNA, 21 nt, Pseudomonas aeruginosa PA01
agcuccgucuguucggccagg

SEQ ID NO: 1468951 - RNA, 13 nt, Pseudomonas aeruginosa PA01
agcuccuccagcg

SEQ ID NO: 1468952 - RNA, 17 nt, Pseudomonas aeruginosa PA01
agcuccuccagcguggc

SEQ ID NO: 1468953 - RNA, 20 nt, Pseudomonas aeruginosa PA01
agcuccuccagcguggcgga

SEQ ID NO: 1468954 - RNA, 13 nt, Pseudomonas aeruginosa PA01
agcuccggcagca

SEQ ID NO: 1468955 - RNA, 16 nt, Pseudomonas aeruginosa PA01
agcucccugccgcccu

SEQ ID NO: 1468956 - RNA, 18 nt, Pseudomonas aeruginosa PA01
agcuccccgccgccaggc

SEQ ID NO: 1468957 - RNA, 22 nt, Pseudomonas aeruginosa PA01
agcuccccgccgccaggcgcug

SEQ ID NO: 1468958 - RNA, 19 nt, Pseudomonas aeruginosa PA01
agcucccaggcgucgccga

SEQ ID NO: 1468959 - RNA, 20 nt, Pseudomonas aeruginosa PA01
agcucccaggcgucgccgac

SEQ ID NO: 1468960 - RNA, 15 nt, Pseudomonas aeruginosa PA01
agcucgaagccgccg

SEQ ID NO: 1468961 - RNA, 14 nt, Pseudomonas aeruginosa PA01
agcucgacccgccc

SEQ ID NO: 1468962 - RNA, 17 nt, Pseudomonas aeruginosa PA01
agcucgacccgcccgcc

SEQ ID NO: 1468963 - RNA, 23 nt, Pseudomonas aeruginosa PA01
agcucgacccgcccgccguccuc

SEQ ID NO: 1468964 - RNA, 22 nt, Pseudomonas aeruginosa PA01
agcucgaucucauggucgggca

SEQ ID NO: 1468965 - RNA, 17 nt, Pseudomonas aeruginosa PA01
agcucgaucagcccgcc

SEQ ID NO: 1468966 - RNA, 18 nt, Pseudomonas aeruginosa PA01
agcucgccgagguugcug

SEQ ID NO: 1468967 - RNA, 19 nt, Pseudomonas aeruginosa PA01
agcucggcacgcagcagcu

SEQ ID NO: 1468968 - RNA, 20 nt, Pseudomonas aeruginosa PA01
agcucggcacgcagcagcuu

SEQ ID NO: 1468969 - RNA, 16 nt, Pseudomonas aeruginosa PA01
agcucgcuguccagca

SEQ ID NO: 1468970 - RNA, 13 nt, Pseudomonas aeruginosa PA01
agcucgcugucgc

SEQ ID NO: 1468971 - RNA, 22 nt, Pseudomonas aeruginosa PA01
agcucggacaagggccagagca

SEQ ID NO: 1468972 - RNA, 20 nt, Pseudomonas aeruginosa PA01
agcucggcgacauagccggc

SEQ ID NO: 1468973 - RNA, 18 nt, Pseudomonas aeruginosa PA01
agcucggccgagggcagc

SEQ ID NO: 1468974 - RNA, 15 nt, Pseudomonas aeruginosa PA01
agcucggccuggucc

SEQ ID NO: 1468975 - RNA, 19 nt, Pseudomonas aeruginosa PA01
agcucggccugguccggca

SEQ ID NO: 1468976 - RNA, 16 nt, Pseudomonas aeruginosa PA01
agcucggcgcccuggc

SEQ ID NO: 1468977 - RNA, 17 nt, Pseudomonas aeruginosa PA01
agcucggcgcccuggcc

SEQ ID NO: 1468978 - RNA, 21 nt, Pseudomonas aeruginosa PA01
agcucggcgcccuggccgcca

SEQ ID NO: 1468979 - RNA, 22 nt, Pseudomonas aeruginosa PA01
agcucggcgcgaugaugccgcc

SEQ ID NO: 1468980 - RNA, 14 nt, Pseudomonas aeruginosa PA01
agcucggcgauggc

SEQ ID NO: 1468981 - RNA, 18 nt, Pseudomonas aeruginosa PA01
agcucggcgauggcgcgc

SEQ ID NO: 1468982 - RNA, 19 nt, Pseudomonas aeruginosa PA01
agcucggcgauggcgcgcg

SEQ ID NO: 1468983 - RNA, 11 nt, Pseudomonas aeruginosa PA01
agcucggccau

SEQ ID NO: 1468984 - RNA, 18 nt, Pseudomonas aeruginosa PA01
agcucggccaucagcgcc

SEQ ID NO: 1468985 - RNA, 20 nt, Pseudomonas aeruginosa PA01
agcucggccaucagcgccag

SEQ ID NO: 1468986 - RNA, 19 nt, Pseudomonas aeruginosa PA01
agcucggcgggacggcgca

SEQ ID NO: 1468987 - RNA, 18 nt, Pseudomonas aeruginosa PA01
agcucggugagcaggcgc

SEQ ID NO: 1468988 - RNA, 20 nt, Pseudomonas aeruginosa PA01
agcucggugagcaggcgccg

SEQ ID NO: 1468989 - RNA, 22 nt, Pseudomonas aeruginosa PA01
agcucggugagcaggcgccgga

SEQ ID NO: 1468990 - RNA, 18 nt, Pseudomonas aeruginosa PA01
agcucggucagcggcgca

SEQ ID NO: 1468991 - RNA, 19 nt, Pseudomonas aeruginosa PA01
agcucggucagcggcgcag

SEQ ID NO: 1468992 - RNA, 14 nt, Pseudomonas aeruginosa PA01
agcucgucacccgc

SEQ ID NO: 1468993 - RNA, 18 nt, Pseudomonas aeruginosa PA01
agcucgucacccgcgccu

SEQ ID NO: 1468994 - RNA, 15 nt, Pseudomonas aeruginosa PA01
agcucuuccagguga

SEQ ID NO: 1468995 - RNA, 12 nt, Pseudomonas aeruginosa PA01
agcucucgccgc

SEQ ID NO: 1468996 - RNA, 12 nt, Pseudomonas aeruginosa PA01
agcucucgcugg

SEQ ID NO: 1468997 - RNA, 18 nt, Pseudomonas aeruginosa PA01
agcucugcgaucagggcc

SEQ ID NO: 1468998 - RNA, 23 nt, Pseudomonas aeruginosa PA01
agcucugcgaucagggccucgcc

SEQ ID NO: 1468999 - RNA, 19 nt, Pseudomonas aeruginosa PA01
agcucguugcacagcgccc

SEQ ID NO: 1469000 - RNA, 15 nt, Pseudomonas aeruginosa PA01
agcucguugcccggc

SEQ ID NO: 1469001 - RNA, 21 nt, Pseudomonas aeruginosa PA01
agcucguugcccggcuugccg

SEQ ID NO: 1469002 - RNA, 16 nt, Pseudomonas aeruginosa PA01
agcugaggccguagcc

SEQ ID NO: 1469003 - RNA, 14 nt, Pseudomonas aeruginosa PA01
agcugagcaggccg

SEQ ID NO: 1469004 - RNA, 15 nt, Pseudomonas aeruginosa PA01
agcugagcaggccga

SEQ ID NO: 1469005 - RNA, 17 nt, Pseudomonas aeruginosa PA01
agcugagcaggccgacg

SEQ ID NO: 1469006 - RNA, 16 nt, Pseudomonas aeruginosa PA01
agcugacgaacaucgc

SEQ ID NO: 1469007 - RNA, 20 nt, Pseudomonas aeruginosa PA01
agcugaagcgccgcggcccg

SEQ ID NO: 1469008 - RNA, 15 nt, Pseudomonas aeruginosa PA01
agcugaccacgacga

SEQ ID NO: 1469009 - RNA, 15 nt, Pseudomonas aeruginosa PA01
agcggaucggcggug

SEQ ID NO: 1469010 - RNA, 15 nt, Pseudomonas aeruginosa PA01
agcggaucgucgcgg

SEQ ID NO: 1469011 - RNA, 13 nt, Pseudomonas aeruginosa PA01
agcggaucggcgg

SEQ ID NO: 1469012 - RNA, 15 nt, Pseudomonas aeruginosa PA01
agcggaugcuggcgg

SEQ ID NO: 1469013 - RNA, 17 nt, Pseudomonas aeruginosa PA01
agcggaucucgucgccg

SEQ ID NO: 1469014 - RNA, 22 nt, Pseudomonas aeruginosa PA01
agcgcuuguagcagccgcagga

SEQ ID NO: 1469015 - RNA, 17 nt, Pseudomonas aeruginosa PA01
agcggaaaugcucgccg

SEQ ID NO: 1469016 - RNA, 19 nt, Pseudomonas aeruginosa PA01
agcggauguucuucaccuu

SEQ ID NO: 1469017 - RNA, 15 nt, Pseudomonas aeruginosa PA01
agcggcaacgcgccc

SEQ ID NO: 1469018 - RNA, 13 nt, Pseudomonas aeruginosa PA01
agcggcaaaggcc

SEQ ID NO: 1469019 - RNA, 16 nt, Pseudomonas aeruginosa PA01
agcggcgccucgaagc

SEQ ID NO: 1469020 - RNA, 23 nt, Pseudomonas aeruginosa PA01
agcggcgccucgaagcggaucuc

SEQ ID NO: 1469021 - RNA, 14 nt, Pseudomonas aeruginosa PA01
agcggcgccagcuc

SEQ ID NO: 1469022 - RNA, 14 nt, Pseudomonas aeruginosa PA01
agcggcgccaggcg

SEQ ID NO: 1469023 - RNA, 19 nt, Pseudomonas aeruginosa PA01
agcggcgccaggcguucca

SEQ ID NO: 1469024 - RNA, 16 nt, Pseudomonas aeruginosa PA01
agcggcgcagccucgc

SEQ ID NO: 1469025 - RNA, 19 nt, Pseudomonas aeruginosa PA01
agcggcgcaccgacgccgc

SEQ ID NO: 1469026 - RNA, 20 nt, Pseudomonas aeruginosa PA01
agcggcgcaccgacgccgcc

SEQ ID NO: 1469027 - RNA, 14 nt, Pseudomonas aeruginosa PA01
agcggcgucugccg

SEQ ID NO: 1469028 - RNA, 17 nt, Pseudomonas aeruginosa PA01
agcggcgugaagccgcc

SEQ ID NO: 1469029 - RNA, 18 nt, Pseudomonas aeruginosa PA01
agcggcgugaagccgccg

SEQ ID NO: 1469030 - RNA, 19 nt, Pseudomonas aeruginosa PA01
agcggcguauccucggcca

SEQ ID NO: 1469031 - RNA, 20 nt, Pseudomonas aeruginosa PA01
agcggcguauccucggccau

SEQ ID NO: 1469032 - RNA, 20 nt, Pseudomonas aeruginosa PA01
agcggcgcgaggccguacca

SEQ ID NO: 1469033 - RNA, 15 nt, Pseudomonas aeruginosa PA01
agcggcugccgaggc

SEQ ID NO: 1469034 - RNA, 14 nt, Pseudomonas aeruginosa PA01
agcggcucgccgaa

SEQ ID NO: 1469035 - RNA, 23 nt, Pseudomonas aeruginosa PA01
agcggcucgcugaaauccaccag

SEQ ID NO: 1469036 - RNA, 16 nt, Pseudomonas aeruginosa PA01
agcggcucggccaggg

SEQ ID NO: 1469037 - RNA, 19 nt, Pseudomonas aeruginosa PA01
agcggcucgucaucgucca

SEQ ID NO: 1469038 - RNA, 16 nt, Pseudomonas aeruginosa PA01
agcggcguucgccgag

SEQ ID NO: 1469039 - RNA, 15 nt, Pseudomonas aeruginosa PA01
agcggcguaugcgcc

SEQ ID NO: 1469040 - RNA, 16 nt, Pseudomonas aeruginosa PA01
agcggcuccucggccu

SEQ ID NO: 1469041 - RNA, 16 nt, Pseudomonas aeruginosa PA01
agcggcuccuggaugc

SEQ ID NO: 1469042 - RNA, 14 nt, Pseudomonas aeruginosa PA01
agcggcugcugucg

SEQ ID NO: 1469043 - RNA, 12 nt, Pseudomonas aeruginosa PA01
agcggcuggcga

SEQ ID NO: 1469044 - RNA, 23 nt, Pseudomonas aeruginosa PA01
agcggcuggcgcuugccgcgccc

SEQ ID NO: 1469045 - RNA, 15 nt, Pseudomonas aeruginosa PA01
agcggcuguugccgg

SEQ ID NO: 1469046 - RNA, 18 nt, Pseudomonas aeruginosa PA01
agcgggaaggucggcagc

SEQ ID NO: 1469047 - RNA, 16 nt, Pseudomonas aeruginosa PA01
agcggcuugcagucga

SEQ ID NO: 1469048 - RNA, 13 nt, Pseudomonas aeruginosa PA01
agcgggucggcga

SEQ ID NO: 1469049 - RNA, 23 nt, Pseudomonas aeruginosa PA01
agcgggucgucgaagcgcagcag

SEQ ID NO: 1469050 - RNA, 19 nt, Pseudomonas aeruginosa PA01
agcggguccuggguggcga

SEQ ID NO: 1469051 - RNA, 18 nt, Pseudomonas aeruginosa PA01
agcgggucgagccaggcg

SEQ ID NO: 1469052 - RNA, 18 nt, Pseudomonas aeruginosa PA01
agcgggucgaucaggcgc

SEQ ID NO: 1469053 - RNA, 13 nt, Pseudomonas aeruginosa PA01
agcgggccaggcg

SEQ ID NO: 1469054 - RNA, 21 nt, Pseudomonas aeruginosa PA01
agcgggccgagggugaucagc

SEQ ID NO: 1469055 - RNA, 14 nt, Pseudomonas aeruginosa PA01
agcggguagcgccg

SEQ ID NO: 1469056 - RNA, 19 nt, Pseudomonas aeruginosa PA01
agcggguaguagaucagcu

SEQ ID NO: 1469057 - RNA, 16 nt, Pseudomonas aeruginosa PA01
agcggguauugcagac

SEQ ID NO: 1469058 - RNA, 19 nt, Pseudomonas aeruginosa PA01
agcggcuuguccuggcgca

SEQ ID NO: 1469059 - RNA, 17 nt, Pseudomonas aeruginosa PA01
agcgggacagcuugccg

SEQ ID NO: 1469060 - RNA, 15 nt, Pseudomonas aeruginosa PA01
agcgggacgaugccg

SEQ ID NO: 1469061 - RNA, 23 nt, Pseudomonas aeruginosa PA01
agcgggacgaugccgaucucgcc

SEQ ID NO: 1469062 - RNA, 19 nt, Pseudomonas aeruginosa PA01
agcgggaugugcaccagca

SEQ ID NO: 1469063 - RNA, 23 nt, Pseudomonas aeruginosa PA01
agcgugccgccaucgccucgccg

SEQ ID NO: 1469064 - RNA, 23 nt, Pseudomonas aeruginosa PA01
agcgugcggccgaucaucggcug

SEQ ID NO: 1469065 - RNA, 13 nt, Pseudomonas aeruginosa PA01
agcguggccagcg

SEQ ID NO: 1469066 - RNA, 15 nt, Pseudomonas aeruginosa PA01
agcguggccagcgcc

SEQ ID NO: 1469067 - RNA, 18 nt, Pseudomonas aeruginosa PA01
agcguggccagcgcccag

SEQ ID NO: 1469068 - RNA, 13 nt, Pseudomonas aeruginosa PA01
agcgugacccgcg

SEQ ID NO: 1469069 - RNA, 15 nt, Pseudomonas aeruginosa PA01
agcguuaucgccggu

SEQ ID NO: 1469070 - RNA, 16 nt, Pseudomonas aeruginosa PA01
agcguuaucgccgguc

SEQ ID NO: 1469071 - RNA, 17 nt, Pseudomonas aeruginosa PA01
agcguuccagcgcuggc

SEQ ID NO: 1469072 - RNA, 22 nt, Pseudomonas aeruginosa PA01
agcguuccaugaacucuucccc

SEQ ID NO: 1469073 - RNA, 18 nt, Pseudomonas aeruginosa PA01
agcguuccuggcgcgcgg

SEQ ID NO: 1469074 - RNA, 21 nt, Pseudomonas aeruginosa PA01
agcguuccuggcgcgcggccg

SEQ ID NO: 1469075 - RNA, 13 nt, Pseudomonas aeruginosa PA01
agcguucgccgag

SEQ ID NO: 1469076 - RNA, 21 nt, Pseudomonas aeruginosa PA01
agcguucgccgagggcaaggu

SEQ ID NO: 1469077 - RNA, 17 nt, Pseudomonas aeruginosa PA01
agcguucggcgcuggcg

SEQ ID NO: 1469078 - RNA, 18 nt, Pseudomonas aeruginosa PA01
agcguucggaucggcccg

SEQ ID NO: 1469079 - RNA, 21 nt, Pseudomonas aeruginosa PA01
agcguucggaucggcccggcg

SEQ ID NO: 1469080 - RNA, 21 nt, Pseudomonas aeruginosa PA01
agcguggugcuaucgaugcuc

SEQ ID NO: 1469081 - RNA, 15 nt, Pseudomonas aeruginosa PA01
agcgugggcggccgg

SEQ ID NO: 1469082 - RNA, 21 nt, Pseudomonas aeruginosa PA01
agcgugggcggccggccaggu

SEQ ID NO: 1469083 - RNA, 17 nt, Pseudomonas aeruginosa PA01
agcgugguaccgcugcg

SEQ ID NO: 1469084 - RNA, 14 nt, Pseudomonas aeruginosa PA01
agcguggcgcgcau

SEQ ID NO: 1469085 - RNA, 16 nt, Pseudomonas aeruginosa PA01
agcgucgagcuggcgc

SEQ ID NO: 1469086 - RNA, 10 nt, Pseudomonas aeruginosa PA01
agcgucgagu

SEQ ID NO: 1469087 - RNA, 14 nt, Pseudomonas aeruginosa PA01
agcgguuagccggc

SEQ ID NO: 1469088 - RNA, 15 nt, Pseudomonas aeruginosa PA01
agcgguuagccggcg

SEQ ID NO: 1469089 - RNA, 13 nt, Pseudomonas aeruginosa PA01
agcgguuauucgc

SEQ ID NO: 1469090 - RNA, 20 nt, Pseudomonas aeruginosa PA01
agcguccucagccucacccu

SEQ ID NO: 1469091 - RNA, 18 nt, Pseudomonas aeruginosa PA01
agcgucgccaacgcgccg

SEQ ID NO: 1469092 - RNA, 13 nt, Pseudomonas aeruginosa PA01
agcgucgccgccg

SEQ ID NO: 1469093 - RNA, 13 nt, Pseudomonas aeruginosa PA01
agcgucgccggcc

SEQ ID NO: 1469094 - RNA, 20 nt, Pseudomonas aeruginosa PA01
agcgucgccggccgcugucg

SEQ ID NO: 1469095 - RNA, 21 nt, Pseudomonas aeruginosa PA01
agcgucgcgucggccuggcgc

SEQ ID NO: 1469096 - RNA, 22 nt, Pseudomonas aeruginosa PA01
agcgucggaagcgucagccgcg

SEQ ID NO: 1469097 - RNA, 24 nt, Pseudomonas aeruginosa PA01
agcgucggaagcgucagccgcggc

SEQ ID NO: 1469098 - RNA, 13 nt, Pseudomonas aeruginosa PA01
agcgucgcgcggc

SEQ ID NO: 1469099 - RNA, 17 nt, Pseudomonas aeruginosa PA01
agcgucgcgcggccagc

SEQ ID NO: 1469100 - RNA, 18 nt, Pseudomonas aeruginosa PA01
agcgucgcgcggccagcg

SEQ ID NO: 1469101 - RNA, 19 nt, Pseudomonas aeruginosa PA01
agcgucgcgcggccagcgu

SEQ ID NO: 1469102 - RNA, 23 nt, Pseudomonas aeruginosa PA01
agcgucgcgcgugccccguggcg

SEQ ID NO: 1469103 - RNA, 18 nt, Pseudomonas aeruginosa PA01
agcgggucagcagcaccg

SEQ ID NO: 1469104 - RNA, 18 nt, Pseudomonas aeruginosa PA01
agcggguucccugcgccu

SEQ ID NO: 1469105 - RNA, 22 nt, Pseudomonas aeruginosa PA01
agcggguucccugcgccucgac

SEQ ID NO: 1469106 - RNA, 17 nt, Pseudomonas aeruginosa PA01
agcggucgccggcgcgc

SEQ ID NO: 1469107 - RNA, 19 nt, Pseudomonas aeruginosa PA01
agcggucgccggcgcgcac

SEQ ID NO: 1469108 - RNA, 13 nt, Pseudomonas aeruginosa PA01
agcggucgccggu

SEQ ID NO: 1469109 - RNA, 15 nt, Pseudomonas aeruginosa PA01
agcggucgccggucg

SEQ ID NO: 1469110 - RNA, 20 nt, Pseudomonas aeruginosa PA01
agcggugaagguccgcgcca

SEQ ID NO: 1469111 - RNA, 13 nt, Pseudomonas aeruginosa PA01
agcggugccgcgu

SEQ ID NO: 1469112 - RNA, 20 nt, Pseudomonas aeruginosa PA01
agcggucguagcccaugguc

SEQ ID NO: 1469113 - RNA, 13 nt, Pseudomonas aeruginosa PA01
agcggucgugcag

SEQ ID NO: 1469114 - RNA, 16 nt, Pseudomonas aeruginosa PA01
agcggucgugcagcag

SEQ ID NO: 1469115 - RNA, 19 nt, Pseudomonas aeruginosa PA01
agcggaacgaaggacaggu

SEQ ID NO: 1469116 - RNA, 21 nt, Pseudomonas aeruginosa PA01
agcggaacuugcgccgaccgc

SEQ ID NO: 1469117 - RNA, 18 nt, Pseudomonas aeruginosa PA01
agcggaagcccagcaggu

SEQ ID NO: 1469118 - RNA, 13 nt, Pseudomonas aeruginosa PA01
agcggaagccguc

SEQ ID NO: 1469119 - RNA, 16 nt, Pseudomonas aeruginosa PA01
agcggaagccgucggc

SEQ ID NO: 1469120 - RNA, 22 nt, Pseudomonas aeruginosa PA01
agcggaagcgcagccauucgcc

SEQ ID NO: 1469121 - RNA, 16 nt, Pseudomonas aeruginosa PA01
agcggaaacaagcucu

SEQ ID NO: 1469122 - RNA, 15 nt, Pseudomonas aeruginosa PA01
agcgcuugaacgcgc

SEQ ID NO: 1469123 - RNA, 19 nt, Pseudomonas aeruginosa PA01
agcgcuugaacgcgcgccu

SEQ ID NO: 1469124 - RNA, 14 nt, Pseudomonas aeruginosa PA01
agcgcuucucggca

SEQ ID NO: 1469125 - RNA, 16 nt, Pseudomonas aeruginosa PA01
agcgcuugcuggcgcg

SEQ ID NO: 1469126 - RNA, 13 nt, Pseudomonas aeruginosa PA01
agcgcucgcgcuu

SEQ ID NO: 1469127 - RNA, 22 nt, Pseudomonas aeruginosa PA01
agcgcuucgggagucaacgccu

SEQ ID NO: 1469128 - RNA, 14 nt, Pseudomonas aeruginosa PA01
agcgcugacgaaac

SEQ ID NO: 1469129 - RNA, 18 nt, Pseudomonas aeruginosa PA01
agcgcuccuguucgucgc

SEQ ID NO: 1469130 - RNA, 18 nt, Pseudomonas aeruginosa PA01
agcgcucgaacgccgccc

SEQ ID NO: 1469131 - RNA, 22 nt, Pseudomonas aeruginosa PA01
agcgcucgaacgccgcccgucg

SEQ ID NO: 1469132 - RNA, 21 nt, Pseudomonas aeruginosa PA01
agcgcucgacauacuccgccg

SEQ ID NO: 1469133 - RNA, 22 nt, Pseudomonas aeruginosa PA01
agcgcucgacauacuccgccgc

SEQ ID NO: 1469134 - RNA, 13 nt, Pseudomonas aeruginosa PA01
agcgcuccaccgc

SEQ ID NO: 1469135 - RNA, 20 nt, Pseudomonas aeruginosa PA01
agcgcuccucgcgcugcccg

SEQ ID NO: 1469136 - RNA, 14 nt, Pseudomonas aeruginosa PA01
agcgcucgguggca

SEQ ID NO: 1469137 - RNA, 14 nt, Pseudomonas aeruginosa PA01
agcgcgucgcgguc

SEQ ID NO: 1469138 - RNA, 16 nt, Pseudomonas aeruginosa PA01
agcgcgucaucaggcu

SEQ ID NO: 1469139 - RNA, 14 nt, Pseudomonas aeruginosa PA01
agcgcucacgcacc

SEQ ID NO: 1469140 - RNA, 21 nt, Pseudomonas aeruginosa PA01
agcgcucacgcaccucgucga

SEQ ID NO: 1469141 - RNA, 14 nt, Pseudomonas aeruginosa PA01
agcgcuacgcaggc

SEQ ID NO: 1469142 - RNA, 21 nt, Pseudomonas aeruginosa PA01
agcgcguacucaggccgggcg

SEQ ID NO: 1469143 - RNA, 21 nt, Pseudomonas aeruginosa PA01
agcgcgucacucgacaggcca

SEQ ID NO: 1469144 - RNA, 21 nt, Pseudomonas aeruginosa PA01
agcgcggccuucagcgguggc

SEQ ID NO: 1469145 - RNA, 19 nt, Pseudomonas aeruginosa PA01
agcgcggcgccccaggcgc

SEQ ID NO: 1469146 - RNA, 21 nt, Pseudomonas aeruginosa PA01
agcgcggccggccacgcgacc

SEQ ID NO: 1469147 - RNA, 17 nt, Pseudomonas aeruginosa PA01
agcgcgcgucggcgaac

SEQ ID NO: 1469148 - RNA, 15 nt, Pseudomonas aeruginosa PA01
agcgcgcgucggcgg

SEQ ID NO: 1469149 - RNA, 23 nt, Pseudomonas aeruginosa PA01
agcgcgcguuccaggucgcugcu

SEQ ID NO: 1469150 - RNA, 13 nt, Pseudomonas aeruginosa PA01
agcgcggcggcgg

SEQ ID NO: 1469151 - RNA, 15 nt, Pseudomonas aeruginosa PA01
agcgcggcggcggcc

SEQ ID NO: 1469152 - RNA, 22 nt, Pseudomonas aeruginosa PA01
agcgcggcggcggccagcagca

SEQ ID NO: 1469153 - RNA, 16 nt, Pseudomonas aeruginosa PA01
agcgcggcggcggccg

SEQ ID NO: 1469154 - RNA, 23 nt, Pseudomonas aeruginosa PA01
agcgcggcggcggccgcaugccg

SEQ ID NO: 1469155 - RNA, 22 nt, Pseudomonas aeruginosa PA01
agcgcggcggugcagaacgcgu

SEQ ID NO: 1469156 - RNA, 16 nt, Pseudomonas aeruginosa PA01
agcgcggcgcuuggcg

SEQ ID NO: 1469157 - RNA, 21 nt, Pseudomonas aeruginosa PA01
agcgcgauaucgcaggccagg

SEQ ID NO: 1469158 - RNA, 23 nt, Pseudomonas aeruginosa PA01
agcgcgauaucgcaggccaggcc

SEQ ID NO: 1469159 - RNA, 15 nt, Pseudomonas aeruginosa PA01
agcgcgaucagccgc

SEQ ID NO: 1469160 - RNA, 13 nt, Pseudomonas aeruginosa PA01
agcgcgaggcgag

SEQ ID NO: 1469161 - RNA, 18 nt, Pseudomonas aeruginosa PA01
agcgcgauacccuggccg

SEQ ID NO: 1469162 - RNA, 12 nt, Pseudomonas aeruginosa PA01
agcgcgccgggu

SEQ ID NO: 1469163 - RNA, 20 nt, Pseudomonas aeruginosa PA01
agcgccagcgagacgggcga

SEQ ID NO: 1469164 - RNA, 22 nt, Pseudomonas aeruginosa PA01
agcgccagccagcgcggcucgg

SEQ ID NO: 1469165 - RNA, 13 nt, Pseudomonas aeruginosa PA01
agcgccagccagg

SEQ ID NO: 1469166 - RNA, 14 nt, Pseudomonas aeruginosa PA01
agcgccagcggcag

SEQ ID NO: 1469167 - RNA, 22 nt, Pseudomonas aeruginosa PA01
agcgccagcagguacagcagcu

SEQ ID NO: 1469168 - RNA, 22 nt, Pseudomonas aeruginosa PA01
agcgccagcaggucgcgcuggg

SEQ ID NO: 1469169 - RNA, 23 nt, Pseudomonas aeruginosa PA01
agcgccagcagguggucgauggg

SEQ ID NO: 1469170 - RNA, 16 nt, Pseudomonas aeruginosa PA01
agcgccagcagucguu

SEQ ID NO: 1469171 - RNA, 16 nt, Pseudomonas aeruginosa PA01
agcgccccaccaggcu

SEQ ID NO: 1469172 - RNA, 19 nt, Pseudomonas aeruginosa PA01
agcgccccggccgcgccag

SEQ ID NO: 1469173 - RNA, 16 nt, Pseudomonas aeruginosa PA01
agcgccccgccuaccg

SEQ ID NO: 1469174 - RNA, 14 nt, Pseudomonas aeruginosa PA01
agcgcccgacggcu

SEQ ID NO: 1469175 - RNA, 21 nt, Pseudomonas aeruginosa PA01
agcgcccgagucccuugcggc

SEQ ID NO: 1469176 - RNA, 16 nt, Pseudomonas aeruginosa PA01
agcgcccgcgcaugga

SEQ ID NO: 1469177 - RNA, 18 nt, Pseudomonas aeruginosa PA01
agcgccaccagcagggcc

SEQ ID NO: 1469178 - RNA, 21 nt, Pseudomonas aeruginosa PA01
agcgccaccagcaugcccagc

SEQ ID NO: 1469179 - RNA, 16 nt, Pseudomonas aeruginosa PA01
agcgccacgccgcugu

SEQ ID NO: 1469180 - RNA, 17 nt, Pseudomonas aeruginosa PA01
agcgccacuuccagcuu

SEQ ID NO: 1469181 - RNA, 23 nt, Pseudomonas aeruginosa PA01
agcgccacuuccagcuugcgcuc

SEQ ID NO: 1469182 - RNA, 18 nt, Pseudomonas aeruginosa PA01
agcgccacggcgaucgcc

SEQ ID NO: 1469183 - RNA, 14 nt, Pseudomonas aeruginosa PA01
agcgccacggcgcg

SEQ ID NO: 1469184 - RNA, 13 nt, Pseudomonas aeruginosa PA01
agcgccagcacca

SEQ ID NO: 1469185 - RNA, 16 nt, Pseudomonas aeruginosa PA01
agcgccagcaccagca

SEQ ID NO: 1469186 - RNA, 14 nt, Pseudomonas aeruginosa PA01
agcgcaucgcgcac

SEQ ID NO: 1469187 - RNA, 13 nt, Pseudomonas aeruginosa PA01
agcgccaccagca

SEQ ID NO: 1469188 - RNA, 14 nt, Pseudomonas aeruginosa PA01
agcgcaugaggcug

SEQ ID NO: 1469189 - RNA, 13 nt, Pseudomonas aeruginosa PA01
agcgcccggcugu

SEQ ID NO: 1469190 - RNA, 14 nt, Pseudomonas aeruginosa PA01
agcgcccggcugug

SEQ ID NO: 1469191 - RNA, 14 nt, Pseudomonas aeruginosa PA01
agcgcccggcgaac

SEQ ID NO: 1469192 - RNA, 19 nt, Pseudomonas aeruginosa PA01
agcgcccggcgaacagcgc

SEQ ID NO: 1469193 - RNA, 20 nt, Pseudomonas aeruginosa PA01
agcgcccggcgaacagcgcu

SEQ ID NO: 1469194 - RNA, 15 nt, Pseudomonas aeruginosa PA01
agcgccgcggcccgg

SEQ ID NO: 1469195 - RNA, 23 nt, Pseudomonas aeruginosa PA01
agcgccgcggcccggcgcugccc

SEQ ID NO: 1469196 - RNA, 15 nt, Pseudomonas aeruginosa PA01
agcgccgcucggcga

SEQ ID NO: 1469197 - RNA, 18 nt, Pseudomonas aeruginosa PA01
agcgccgcuccuccucgc

SEQ ID NO: 1469198 - RNA, 15 nt, Pseudomonas aeruginosa PA01
agcgccgcggcggcg

SEQ ID NO: 1469199 - RNA, 16 nt, Pseudomonas aeruginosa PA01
agcgccgcggcggcgu

SEQ ID NO: 1469200 - RNA, 14 nt, Pseudomonas aeruginosa PA01
agcgccgcggcugg

SEQ ID NO: 1469201 - RNA, 17 nt, Pseudomonas aeruginosa PA01
agcgccgcggcuggcca

SEQ ID NO: 1469202 - RNA, 21 nt, Pseudomonas aeruginosa PA01
agcgccgcguaguaggcacag

SEQ ID NO: 1469203 - RNA, 22 nt, Pseudomonas aeruginosa PA01
agcgccgcggcgaacaucaucc

SEQ ID NO: 1469204 - RNA, 15 nt, Pseudomonas aeruginosa PA01
agcgccgcggcgacc

SEQ ID NO: 1469205 - RNA, 15 nt, Pseudomonas aeruginosa PA01
agcgccucgaucgcc

SEQ ID NO: 1469206 - RNA, 18 nt, Pseudomonas aeruginosa PA01
agcgcgacuuggacagcg

SEQ ID NO: 1469207 - RNA, 22 nt, Pseudomonas aeruginosa PA01
agcgcgacucgguaaagcccag

SEQ ID NO: 1469208 - RNA, 18 nt, Pseudomonas aeruginosa PA01
agcgccuggcgcaguuca

SEQ ID NO: 1469209 - RNA, 13 nt, Pseudomonas aeruginosa PA01
agcgccuggcgca

SEQ ID NO: 1469210 - RNA, 20 nt, Pseudomonas aeruginosa PA01
agcgccuggcgcaacgccgg

SEQ ID NO: 1469211 - RNA, 21 nt, Pseudomonas aeruginosa PA01
agcgccuggcgcaacgccggc

SEQ ID NO: 1469212 - RNA, 14 nt, Pseudomonas aeruginosa PA01
agcgccuggcgcag

SEQ ID NO: 1469213 - RNA, 19 nt, Pseudomonas aeruginosa PA01
agcgccccuuggccagcac

SEQ ID NO: 1469214 - RNA, 13 nt, Pseudomonas aeruginosa PA01
agcgccucgccga

SEQ ID NO: 1469215 - RNA, 14 nt, Pseudomonas aeruginosa PA01
agcgccucgccgag

SEQ ID NO: 1469216 - RNA, 15 nt, Pseudomonas aeruginosa PA01
agcgccucgccgagc

SEQ ID NO: 1469217 - RNA, 12 nt, Pseudomonas aeruginosa PA01
agcgccucggca

SEQ ID NO: 1469218 - RNA, 14 nt, Pseudomonas aeruginosa PA01
agcgccucggcggc

SEQ ID NO: 1469219 - RNA, 12 nt, Pseudomonas aeruginosa PA01
agcgccugcugc

SEQ ID NO: 1469220 - RNA, 21 nt, Pseudomonas aeruginosa PA01
agccgccgccgagaacccggc

SEQ ID NO: 1469221 - RNA, 19 nt, Pseudomonas aeruginosa PA01
agccgcgacggcugcuccg

SEQ ID NO: 1469222 - RNA, 13 nt, Pseudomonas aeruginosa PA01
agccgcgccagug

SEQ ID NO: 1469223 - RNA, 22 nt, Pseudomonas aeruginosa PA01
agccgcgccaucggucgcgccc

SEQ ID NO: 1469224 - RNA, 17 nt, Pseudomonas aeruginosa PA01
agccguccugcggccgc

SEQ ID NO: 1469225 - RNA, 18 nt, Pseudomonas aeruginosa PA01
agccgucgaacagcagcu

SEQ ID NO: 1469226 - RNA, 12 nt, Pseudomonas aeruginosa PA01
agccgcgcccca

SEQ ID NO: 1469227 - RNA, 20 nt, Pseudomonas aeruginosa PA01
agccguccgcccaguucgcc

SEQ ID NO: 1469228 - RNA, 14 nt, Pseudomonas aeruginosa PA01
agccgcgcgccagc

SEQ ID NO: 1469229 - RNA, 13 nt, Pseudomonas aeruginosa PA01
agccgcgccggcc

SEQ ID NO: 1469230 - RNA, 14 nt, Pseudomonas aeruginosa PA01
agccgcgccggccg

SEQ ID NO: 1469231 - RNA, 18 nt, Pseudomonas aeruginosa PA01
agccgcgccuucgagcgc

SEQ ID NO: 1469232 - RNA, 22 nt, Pseudomonas aeruginosa PA01
agccgcgccuucgagcgcgguu

SEQ ID NO: 1469233 - RNA, 22 nt, Pseudomonas aeruginosa PA01
agccgucggugaucgagacgcc

SEQ ID NO: 1469234 - RNA, 17 nt, Pseudomonas aeruginosa PA01
agccgucguagcgcagc

SEQ ID NO: 1469235 - RNA, 22 nt, Pseudomonas aeruginosa PA01
agccguuacgacaucgacgccc

SEQ ID NO: 1469236 - RNA, 18 nt, Pseudomonas aeruginosa PA01
agccguggcacccaggcc

SEQ ID NO: 1469237 - RNA, 20 nt, Pseudomonas aeruginosa PA01
agccguggcacccaggccac

SEQ ID NO: 1469238 - RNA, 23 nt, Pseudomonas aeruginosa PA01
agccguggcacccaggccacgcc

SEQ ID NO: 1469239 - RNA, 17 nt, Pseudomonas aeruginosa PA01
agccguggcaggcgccc

SEQ ID NO: 1469240 - RNA, 15 nt, Pseudomonas aeruginosa PA01
agccgugcagcagcg

SEQ ID NO: 1469241 - RNA, 17 nt, Pseudomonas aeruginosa PA01
agcgaaugcuugccggc

SEQ ID NO: 1469242 - RNA, 19 nt, Pseudomonas aeruginosa PA01
agccguuguagaucggcag

SEQ ID NO: 1469243 - RNA, 21 nt, Pseudomonas aeruginosa PA01
agccguuggccagcaggcgcc

SEQ ID NO: 1469244 - RNA, 16 nt, Pseudomonas aeruginosa PA01
agccuucgagccacuc

SEQ ID NO: 1469245 - RNA, 19 nt, Pseudomonas aeruginosa PA01
agccuucgcaaagcgagcg

SEQ ID NO: 1469246 - RNA, 22 nt, Pseudomonas aeruginosa PA01
agccuucgcaaagcgagcgccc

SEQ ID NO: 1469247 - RNA, 12 nt, Pseudomonas aeruginosa PA01
agccuucgcccg

SEQ ID NO: 1469248 - RNA, 14 nt, Pseudomonas aeruginosa PA01
agccuucgcccggc

SEQ ID NO: 1469249 - RNA, 15 nt, Pseudomonas aeruginosa PA01
agccuucgcccggcu

SEQ ID NO: 1469250 - RNA, 17 nt, Pseudomonas aeruginosa PA01
agccuugagccuugccc

SEQ ID NO: 1469251 - RNA, 13 nt, Pseudomonas aeruginosa PA01
agccguggcgcga

SEQ ID NO: 1469252 - RNA, 21 nt, Pseudomonas aeruginosa PA01
agccguggcgggccaugcgcu

SEQ ID NO: 1469253 - RNA, 15 nt, Pseudomonas aeruginosa PA01
agccguucgcuggac

SEQ ID NO: 1469254 - RNA, 17 nt, Pseudomonas aeruginosa PA01
agccguugaggccgucg

SEQ ID NO: 1469255 - RNA, 18 nt, Pseudomonas aeruginosa PA01
agccguugaggccgucga

SEQ ID NO: 1469256 - RNA, 20 nt, Pseudomonas aeruginosa PA01
agccguugaaacgcucggcg

SEQ ID NO: 1469257 - RNA, 21 nt, Pseudomonas aeruginosa PA01
agccguugaaacgcucggcgu

SEQ ID NO: 1469258 - RNA, 22 nt, Pseudomonas aeruginosa PA01
agccguugaaacgcucggcguc

SEQ ID NO: 1469259 - RNA, 13 nt, Pseudomonas aeruginosa PA01
agcgcagcggcag

SEQ ID NO: 1469260 - RNA, 18 nt, Pseudomonas aeruginosa PA01
agcgcagcggcaggccac

SEQ ID NO: 1469261 - RNA, 15 nt, Pseudomonas aeruginosa PA01
agcgcaguucgccgc

SEQ ID NO: 1469262 - RNA, 17 nt, Pseudomonas aeruginosa PA01
agcgcaguucgccgccg

SEQ ID NO: 1469263 - RNA, 18 nt, Pseudomonas aeruginosa PA01
agcgcaguucgccgccga

SEQ ID NO: 1469264 - RNA, 12 nt, Pseudomonas aeruginosa PA01
agcgcaguucgu

SEQ ID NO: 1469265 - RNA, 16 nt, Pseudomonas aeruginosa PA01
agcgcaguugccagga

SEQ ID NO: 1469266 - RNA, 18 nt, Pseudomonas aeruginosa PA01
agcgcauaggccugggcg

SEQ ID NO: 1469267 - RNA, 19 nt, Pseudomonas aeruginosa PA01
agcgcauacgaaaacggcc

SEQ ID NO: 1469268 - RNA, 14 nt, Pseudomonas aeruginosa PA01
agcgcaggccgccg

SEQ ID NO: 1469269 - RNA, 16 nt, Pseudomonas aeruginosa PA01
agcgcaggccgccggc

SEQ ID NO: 1469270 - RNA, 20 nt, Pseudomonas aeruginosa PA01
agcgcagccauucgccgcga

SEQ ID NO: 1469271 - RNA, 13 nt, Pseudomonas aeruginosa PA01
agcgcaggcggcu

SEQ ID NO: 1469272 - RNA, 17 nt, Pseudomonas aeruginosa PA01
agcgcaggcggcuggcg

SEQ ID NO: 1469273 - RNA, 19 nt, Pseudomonas aeruginosa PA01
agcgcaggcggcuggcgcg

SEQ ID NO: 1469274 - RNA, 20 nt, Pseudomonas aeruginosa PA01
agcgcagggucgcguuggcg

SEQ ID NO: 1469275 - RNA, 22 nt, Pseudomonas aeruginosa PA01
agcgcaggugcaccgcgcugga

SEQ ID NO: 1469276 - RNA, 19 nt, Pseudomonas aeruginosa PA01
agcgcagguugcgcuggcg

SEQ ID NO: 1469277 - RNA, 20 nt, Pseudomonas aeruginosa PA01
agcgcagguugcgcuggcgc

SEQ ID NO: 1469278 - RNA, 20 nt, Pseudomonas aeruginosa PA01
agcgcaguacccggccgccu

SEQ ID NO: 1469279 - RNA, 22 nt, Pseudomonas aeruginosa PA01
agcgcaguccgguagcgcgccu

SEQ ID NO: 1469280 - RNA, 18 nt, Pseudomonas aeruginosa PA01
agcgcaucgaggccggca

SEQ ID NO: 1469281 - RNA, 15 nt, Pseudomonas aeruginosa PA01
agcgcaucggcgccu

SEQ ID NO: 1469282 - RNA, 22 nt, Pseudomonas aeruginosa PA01
agcgcaucggcgccucccaggg

SEQ ID NO: 1469283 - RNA, 13 nt, Pseudomonas aeruginosa PA01
agcgcagcacgau

SEQ ID NO: 1469284 - RNA, 13 nt, Pseudomonas aeruginosa PA01
agcgcagccgcuc

SEQ ID NO: 1469285 - RNA, 15 nt, Pseudomonas aeruginosa PA01
agcgcagccugcugg

SEQ ID NO: 1469286 - RNA, 18 nt, Pseudomonas aeruginosa PA01
agcgcagccugcuggccu

SEQ ID NO: 1469287 - RNA, 13 nt, Pseudomonas aeruginosa PA01
agcgcaccauccu

SEQ ID NO: 1469288 - RNA, 16 nt, Pseudomonas aeruginosa PA01
agcgcaccgccaagga

SEQ ID NO: 1469289 - RNA, 19 nt, Pseudomonas aeruginosa PA01
agcgcaccuacuaccgcug

SEQ ID NO: 1469290 - RNA, 20 nt, Pseudomonas aeruginosa PA01
agcgaguccgacccgcuccg

SEQ ID NO: 1469291 - RNA, 23 nt, Pseudomonas aeruginosa PA01
agcgaguccgacccgcuccggac

SEQ ID NO: 1469292 - RNA, 20 nt, Pseudomonas aeruginosa PA01
agcgaguaggcgaagcccag

SEQ ID NO: 1469293 - RNA, 13 nt, Pseudomonas aeruginosa PA01
agcgagucgccgu

SEQ ID NO: 1469294 - RNA, 21 nt, Pseudomonas aeruginosa PA01
agcgagugcaggaaguggcgg

SEQ ID NO: 1469295 - RNA, 17 nt, Pseudomonas aeruginosa PA01
agcgauaggccuugccu

SEQ ID NO: 1469296 - RNA, 21 nt, Pseudomonas aeruginosa PA01
agcgaucccaggucggcgggc

SEQ ID NO: 1469297 - RNA, 16 nt, Pseudomonas aeruginosa PA01
agcgcacaacgccuuc

SEQ ID NO: 1469298 - RNA, 23 nt, Pseudomonas aeruginosa PA01
agcgaucggaagaucgcccgccu

SEQ ID NO: 1469299 - RNA, 16 nt, Pseudomonas aeruginosa PA01
agcgcaagucggccug

SEQ ID NO: 1469300 - RNA, 21 nt, Pseudomonas aeruginosa PA01
agcgaccaccaccaggucggc

SEQ ID NO: 1469301 - RNA, 23 nt, Pseudomonas aeruginosa PA01
agcgaccaccaccaggucggcgc

SEQ ID NO: 1469302 - RNA, 23 nt, Pseudomonas aeruginosa PA01
agcgagaggggcgcucguugcgc

SEQ ID NO: 1469303 - RNA, 22 nt, Pseudomonas aeruginosa PA01
agcgacaggcccuugaacaggc

SEQ ID NO: 1469304 - RNA, 16 nt, Pseudomonas aeruginosa PA01
agcgagcuucgccgcg

SEQ ID NO: 1469305 - RNA, 16 nt, Pseudomonas aeruginosa PA01
agcgaggcccgcgccg

SEQ ID NO: 1469306 - RNA, 13 nt, Pseudomonas aeruginosa PA01
agcgagcgauguc

SEQ ID NO: 1469307 - RNA, 13 nt, Pseudomonas aeruginosa PA01
agcgagcgggcga

SEQ ID NO: 1469308 - RNA, 21 nt, Pseudomonas aeruginosa PA01
agcgagcgggcgagggcggcg

SEQ ID NO: 1469309 - RNA, 22 nt, Pseudomonas aeruginosa PA01
agcgagcggucggccauggcau

SEQ ID NO: 1469310 - RNA, 18 nt, Pseudomonas aeruginosa PA01
agccgcccacgggcggcu

SEQ ID NO: 1469311 - RNA, 18 nt, Pseudomonas aeruginosa PA01
agccgccaggacggcagg

SEQ ID NO: 1469312 - RNA, 18 nt, Pseudomonas aeruginosa PA01
agccgccaucaccagcgg

SEQ ID NO: 1469313 - RNA, 22 nt, Pseudomonas aeruginosa PA01
agccgcccucggggccgagguc

SEQ ID NO: 1469314 - RNA, 21 nt, Pseudomonas aeruginosa PA01
agccgcccuggcucugggcca

SEQ ID NO: 1469315 - RNA, 15 nt, Pseudomonas aeruginosa PA01
agccgccgaacacgc

SEQ ID NO: 1469316 - RNA, 15 nt, Pseudomonas aeruginosa PA01
agccgccgcccagca

SEQ ID NO: 1469317 - RNA, 16 nt, Pseudomonas aeruginosa PA01
agccgacgaaggcgag

SEQ ID NO: 1469318 - RNA, 15 nt, Pseudomonas aeruginosa PA01
agccgagcugccggg

SEQ ID NO: 1469319 - RNA, 22 nt, Pseudomonas aeruginosa PA01
agccgacgauccggccgaucuc

SEQ ID NO: 1469320 - RNA, 18 nt, Pseudomonas aeruginosa PA01
agccgacgccgagcagca

SEQ ID NO: 1469321 - RNA, 18 nt, Pseudomonas aeruginosa PA01
agccgaccggcgccggga

SEQ ID NO: 1469322 - RNA, 21 nt, Pseudomonas aeruginosa PA01
agccgagguucuugcccagca

SEQ ID NO: 1469323 - RNA, 22 nt, Pseudomonas aeruginosa PA01
agccgagguucuugcccagcaa

SEQ ID NO: 1469324 - RNA, 17 nt, Pseudomonas aeruginosa PA01
agccgaggcagccgucg

SEQ ID NO: 1469325 - RNA, 12 nt, Pseudomonas aeruginosa PA01
agccgaggcggc

SEQ ID NO: 1469326 - RNA, 14 nt, Pseudomonas aeruginosa PA01
agccgaggcggccg

SEQ ID NO: 1469327 - RNA, 18 nt, Pseudomonas aeruginosa PA01
agccgaggcuuuccagca

SEQ ID NO: 1469328 - RNA, 19 nt, Pseudomonas aeruginosa PA01
agccgaggucgccgccagc

SEQ ID NO: 1469329 - RNA, 15 nt, Pseudomonas aeruginosa PA01
agccgauacccuggg

SEQ ID NO: 1469330 - RNA, 23 nt, Pseudomonas aeruginosa PA01
agccgauacccugggagccgccg

SEQ ID NO: 1469331 - RNA, 18 nt, Pseudomonas aeruginosa PA01
agccgaucaacgcggcca

SEQ ID NO: 1469332 - RNA, 17 nt, Pseudomonas aeruginosa PA01
agccgaucaccaccagc

SEQ ID NO: 1469333 - RNA, 18 nt, Pseudomonas aeruginosa PA01
agccgaucaccaccagca

SEQ ID NO: 1469334 - RNA, 14 nt, Pseudomonas aeruginosa PA01
agcccuucgcgcuc

SEQ ID NO: 1469335 - RNA, 20 nt, Pseudomonas aeruginosa PA01
agcccugggcgccgccggug

SEQ ID NO: 1469336 - RNA, 21 nt, Pseudomonas aeruginosa PA01
agcccugguaggugcgcuggc

SEQ ID NO: 1469337 - RNA, 22 nt, Pseudomonas aeruginosa PA01
agccgaccacucgcgagauggc

SEQ ID NO: 1469338 - RNA, 15 nt, Pseudomonas aeruginosa PA01
agcccugcuggcgca

SEQ ID NO: 1469339 - RNA, 20 nt, Pseudomonas aeruginosa PA01
agcccuggaaaggccucggc

SEQ ID NO: 1469340 - RNA, 17 nt, Pseudomonas aeruginosa PA01
agcccuggcguggccgg

SEQ ID NO: 1469341 - RNA, 20 nt, Pseudomonas aeruginosa PA01
agcccuggcguggccggcga

SEQ ID NO: 1469342 - RNA, 16 nt, Pseudomonas aeruginosa PA01
agcccugcugcucgcc

SEQ ID NO: 1469343 - RNA, 18 nt, Pseudomonas aeruginosa PA01
agcccugcugcucgccau

SEQ ID NO: 1469344 - RNA, 14 nt, Pseudomonas aeruginosa PA01
agcccucggcccgg

SEQ ID NO: 1469345 - RNA, 15 nt, Pseudomonas aeruginosa PA01
agcccggccgcugcc

SEQ ID NO: 1469346 - RNA, 16 nt, Pseudomonas aeruginosa PA01
agcccggccgcugccg

SEQ ID NO: 1469347 - RNA, 18 nt, Pseudomonas aeruginosa PA01
agcccggccgcugccggg

SEQ ID NO: 1469348 - RNA, 12 nt, Pseudomonas aeruginosa PA01
agcccggccggg

SEQ ID NO: 1469349 - RNA, 13 nt, Pseudomonas aeruginosa PA01
agcccggccucgc

SEQ ID NO: 1469350 - RNA, 20 nt, Pseudomonas aeruginosa PA01
agcccggccauccuggccgg

SEQ ID NO: 1469351 - RNA, 20 nt, Pseudomonas aeruginosa PA01
agcccggcaaaugccgggcu

SEQ ID NO: 1469352 - RNA, 20 nt, Pseudomonas aeruginosa PA01
agcccggcaauagccgggcu

SEQ ID NO: 1469353 - RNA, 15 nt, Pseudomonas aeruginosa PA01
agcccggcauucgcc

SEQ ID NO: 1469354 - RNA, 13 nt, Pseudomonas aeruginosa PA01
agcccgcuccgca

SEQ ID NO: 1469355 - RNA, 15 nt, Pseudomonas aeruginosa PA01
agcccgcggcgagca

SEQ ID NO: 1469356 - RNA, 16 nt, Pseudomonas aeruginosa PA01
agcccgcggcgagcag

SEQ ID NO: 1469357 - RNA, 20 nt, Pseudomonas aeruginosa PA01
agcccgcggcaucggccugg

SEQ ID NO: 1469358 - RNA, 23 nt, Pseudomonas aeruginosa PA01
agcccgcgcucggccgccuggcg

SEQ ID NO: 1469359 - RNA, 17 nt, Pseudomonas aeruginosa PA01
agcccgcgccgcgaggg

SEQ ID NO: 1469360 - RNA, 21 nt, Pseudomonas aeruginosa PA01
agcccgccuugauggcgggcu

SEQ ID NO: 1469361 - RNA, 15 nt, Pseudomonas aeruginosa PA01
agcccagaacagcaa

SEQ ID NO: 1469362 - RNA, 19 nt, Pseudomonas aeruginosa PA01
agcccagcaggucgaucuc

SEQ ID NO: 1469363 - RNA, 19 nt, Pseudomonas aeruginosa PA01
agcccaggcagaucgcgcc

SEQ ID NO: 1469364 - RNA, 21 nt, Pseudomonas aeruginosa PA01
agcccaggcagaucgcgccga

SEQ ID NO: 1469365 - RNA, 22 nt, Pseudomonas aeruginosa PA01
agcccaggcagaucgcgccgag

SEQ ID NO: 1469366 - RNA, 14 nt, Pseudomonas aeruginosa PA01
agcccaggccgaag

SEQ ID NO: 1469367 - RNA, 12 nt, Pseudomonas aeruginosa PA01
agcccagcgccu

SEQ ID NO: 1469368 - RNA, 19 nt, Pseudomonas aeruginosa PA01
agcccagcggcagggcggc

SEQ ID NO: 1469369 - RNA, 21 nt, Pseudomonas aeruginosa PA01
agcccagcggcagggcggcga

SEQ ID NO: 1469370 - RNA, 23 nt, Pseudomonas aeruginosa PA01
agccauuucugcugugcucuucg

SEQ ID NO: 1469371 - RNA, 13 nt, Pseudomonas aeruginosa PA01
agccauucgccgc

SEQ ID NO: 1469372 - RNA, 15 nt, Pseudomonas aeruginosa PA01
agcccaccaccaccg

SEQ ID NO: 1469373 - RNA, 20 nt, Pseudomonas aeruginosa PA01
agcccacccccggcccggcc

SEQ ID NO: 1469374 - RNA, 20 nt, Pseudomonas aeruginosa PA01
agccccagaagaucgccugc

SEQ ID NO: 1469375 - RNA, 15 nt, Pseudomonas aeruginosa PA01
agccccagccucggc

SEQ ID NO: 1469376 - RNA, 17 nt, Pseudomonas aeruginosa PA01
agccccagccucggcag

SEQ ID NO: 1469377 - RNA, 17 nt, Pseudomonas aeruginosa PA01
agccccagcacgccgag

SEQ ID NO: 1469378 - RNA, 18 nt, Pseudomonas aeruginosa PA01
agccccagcccagggcga

SEQ ID NO: 1469379 - RNA, 16 nt, Pseudomonas aeruginosa PA01
agcccauggucagcgg

SEQ ID NO: 1469380 - RNA, 23 nt, Pseudomonas aeruginosa PA01
agccccacgucguuucucggcga

SEQ ID NO: 1469381 - RNA, 16 nt, Pseudomonas aeruginosa PA01
agcccauacaccaggc

SEQ ID NO: 1469382 - RNA, 18 nt, Pseudomonas aeruginosa PA01
agcccagguggcaggccu

SEQ ID NO: 1469383 - RNA, 20 nt, Pseudomonas aeruginosa PA01
agcccagguggcaggccugg

SEQ ID NO: 1469384 - RNA, 17 nt, Pseudomonas aeruginosa PA01
agcccaggcgucgcgcc

SEQ ID NO: 1469385 - RNA, 21 nt, Pseudomonas aeruginosa PA01
agcccaggcgucgcgccagca

SEQ ID NO: 1469386 - RNA, 23 nt, Pseudomonas aeruginosa PA01
agcccaggcgucgcgccagcacc

SEQ ID NO: 1469387 - RNA, 20 nt, Pseudomonas aeruginosa PA01
agcccaggcugacccggucg

SEQ ID NO: 1469388 - RNA, 18 nt, Pseudomonas aeruginosa PA01
agcccagguacugggcga

SEQ ID NO: 1469389 - RNA, 19 nt, Pseudomonas aeruginosa PA01
agcccaggcgcucggcggc

SEQ ID NO: 1469390 - RNA, 21 nt, Pseudomonas aeruginosa PA01
agcccaggcgcucggcggcgc

SEQ ID NO: 1469391 - RNA, 21 nt, Pseudomonas aeruginosa PA01
agcccgcacgaggcgggcugg

SEQ ID NO: 1469392 - RNA, 22 nt, Pseudomonas aeruginosa PA01
agcccgccaccgacccucggcg

SEQ ID NO: 1469393 - RNA, 23 nt, Pseudomonas aeruginosa PA01
agcccgccaccgacccucggcga

SEQ ID NO: 1469394 - RNA, 16 nt, Pseudomonas aeruginosa PA01
agcccgccaccuggcg

SEQ ID NO: 1469395 - RNA, 13 nt, Pseudomonas aeruginosa PA01
agccccggcccgg

SEQ ID NO: 1469396 - RNA, 16 nt, Pseudomonas aeruginosa PA01
agccccuggcgcuggg

SEQ ID NO: 1469397 - RNA, 24 nt, Pseudomonas aeruginosa PA01
agccccugcgaccgugaggcgcag

SEQ ID NO: 1469398 - RNA, 23 nt, Pseudomonas aeruginosa PA01
agccccucgcgcaucuggcugcg

SEQ ID NO: 1469399 - RNA, 19 nt, Pseudomonas aeruginosa PA01
agccccuugcgcucuggcg

SEQ ID NO: 1469400 - RNA, 19 nt, Pseudomonas aeruginosa PA01
agccccgccgaagcggggc

SEQ ID NO: 1469401 - RNA, 20 nt, Pseudomonas aeruginosa PA01
agccccgcucgucauggcgc

SEQ ID NO: 1469402 - RNA, 15 nt, Pseudomonas aeruginosa PA01
agcccccgccgcuga

SEQ ID NO: 1469403 - RNA, 15 nt, Pseudomonas aeruginosa PA01
agccccgaggccagc

SEQ ID NO: 1469404 - RNA, 16 nt, Pseudomonas aeruginosa PA01
agccccgaggccagca

SEQ ID NO: 1469405 - RNA, 17 nt, Pseudomonas aeruginosa PA01
agccccgaggccagcag

SEQ ID NO: 1469406 - RNA, 16 nt, Pseudomonas aeruginosa PA01
agcccccauaccgccu

SEQ ID NO: 1469407 - RNA, 14 nt, Pseudomonas aeruginosa PA01
agcccccggcgccc

SEQ ID NO: 1469408 - RNA, 18 nt, Pseudomonas aeruginosa PA01
agccaacgcccgggccgg

SEQ ID NO: 1469409 - RNA, 19 nt, Pseudomonas aeruginosa PA01
agccaacugcuucaggcgc

SEQ ID NO: 1469410 - RNA, 14 nt, Pseudomonas aeruginosa PA01
agccaaggaugcgc

SEQ ID NO: 1469411 - RNA, 15 nt, Pseudomonas aeruginosa PA01
agccacggacgcgca

SEQ ID NO: 1469412 - RNA, 20 nt, Pseudomonas aeruginosa PA01
agccacggauaugcgccgcc

SEQ ID NO: 1469413 - RNA, 13 nt, Pseudomonas aeruginosa PA01
agccagccgagca

SEQ ID NO: 1469414 - RNA, 19 nt, Pseudomonas aeruginosa PA01
agccagcaaacccgggccc

SEQ ID NO: 1469415 - RNA, 14 nt, Pseudomonas aeruginosa PA01
agccagccaggucg

SEQ ID NO: 1469416 - RNA, 19 nt, Pseudomonas aeruginosa PA01
agccagacguccggcaggu

SEQ ID NO: 1469417 - RNA, 14 nt, Pseudomonas aeruginosa PA01
agccagagcagcgu

SEQ ID NO: 1469418 - RNA, 14 nt, Pseudomonas aeruginosa PA01
agccagagcccguc

SEQ ID NO: 1469419 - RNA, 21 nt, Pseudomonas aeruginosa PA01
agccagagcguaucgaugcgc

SEQ ID NO: 1469420 - RNA, 15 nt, Pseudomonas aeruginosa PA01
agccagagcuccagg

SEQ ID NO: 1469421 - RNA, 19 nt, Pseudomonas aeruginosa PA01
agccagaggucgagcuggg

SEQ ID NO: 1469422 - RNA, 13 nt, Pseudomonas aeruginosa PA01
agccacucccggc

SEQ ID NO: 1469423 - RNA, 18 nt, Pseudomonas aeruginosa PA01
agccacgggcgccagcgg

SEQ ID NO: 1469424 - RNA, 19 nt, Pseudomonas aeruginosa PA01
agccacggcacacgucggc

SEQ ID NO: 1469425 - RNA, 20 nt, Pseudomonas aeruginosa PA01
agccagaccggcagcgccgc

SEQ ID NO: 1469426 - RNA, 17 nt, Pseudomonas aeruginosa PA01
agccacucggccaggcg

SEQ ID NO: 1469427 - RNA, 20 nt, Pseudomonas aeruginosa PA01
agccacugccgccucagcga

SEQ ID NO: 1469428 - RNA, 15 nt, Pseudomonas aeruginosa PA01
agccaugcaggcugc

SEQ ID NO: 1469429 - RNA, 19 nt, Pseudomonas aeruginosa PA01
agccaugcccagacgccgc

SEQ ID NO: 1469430 - RNA, 14 nt, Pseudomonas aeruginosa PA01
agccaugggccggc

SEQ ID NO: 1469431 - RNA, 13 nt, Pseudomonas aeruginosa PA01
agccagucggcgg

SEQ ID NO: 1469432 - RNA, 18 nt, Pseudomonas aeruginosa PA01
agccaguaguccuccgcg

SEQ ID NO: 1469433 - RNA, 16 nt, Pseudomonas aeruginosa PA01
agccaguccggcagca

SEQ ID NO: 1469434 - RNA, 19 nt, Pseudomonas aeruginosa PA01
agccagguuuccggcagca

SEQ ID NO: 1469435 - RNA, 16 nt, Pseudomonas aeruginosa PA01
agccauagcgccggca

SEQ ID NO: 1469436 - RNA, 12 nt, Pseudomonas aeruginosa PA01
agccagcgcggc

SEQ ID NO: 1469437 - RNA, 22 nt, Pseudomonas aeruginosa PA01
agccagcgcucgaacgccgccc

SEQ ID NO: 1469438 - RNA, 18 nt, Pseudomonas aeruginosa PA01
agccagcuucagccgacc

SEQ ID NO: 1469439 - RNA, 16 nt, Pseudomonas aeruginosa PA01
agccagccgcgcgccg

SEQ ID NO: 1469440 - RNA, 12 nt, Pseudomonas aeruginosa PA01
agccagccgccu

SEQ ID NO: 1469441 - RNA, 13 nt, Pseudomonas aeruginosa PA01
agccagccgccuu

SEQ ID NO: 1469442 - RNA, 11 nt, Pseudomonas aeruginosa PA01
agccagccguc

SEQ ID NO: 1469443 - RNA, 15 nt, Pseudomonas aeruginosa PA01
agccagcucggcgag

SEQ ID NO: 1469444 - RNA, 14 nt, Pseudomonas aeruginosa PA01
agccaggcccgguu

SEQ ID NO: 1469445 - RNA, 20 nt, Pseudomonas aeruginosa PA01
agccagggcaacgccaggcu

SEQ ID NO: 1469446 - RNA, 16 nt, Pseudomonas aeruginosa PA01
agccagggcagcaggu

SEQ ID NO: 1469447 - RNA, 19 nt, Pseudomonas aeruginosa PA01
agccagggcagcaggucgc

SEQ ID NO: 1469448 - RNA, 19 nt, Pseudomonas aeruginosa PA01
agccaggggcacgcuggcg

SEQ ID NO: 1469449 - RNA, 21 nt, Pseudomonas aeruginosa PA01
agccaggggcacgcuggcgag

SEQ ID NO: 1469450 - RNA, 16 nt, Pseudomonas aeruginosa PA01
agccaggggucaggcc

SEQ ID NO: 1469451 - RNA, 17 nt, Pseudomonas aeruginosa PA01
agccaggcgcucucgcc

SEQ ID NO: 1469452 - RNA, 10 nt, Pseudomonas aeruginosa PA01
agccaggcgg

SEQ ID NO: 1469453 - RNA, 22 nt, Pseudomonas aeruginosa PA01
agccaggcguauucggcgacca

SEQ ID NO: 1469454 - RNA, 15 nt, Pseudomonas aeruginosa PA01
agccaggcuggcugg

SEQ ID NO: 1469455 - RNA, 21 nt, Pseudomonas aeruginosa PA01
agccaggcuggcugguaacgg

SEQ ID NO: 1469456 - RNA, 22 nt, Pseudomonas aeruginosa PA01
agccaggcgaagcggcuggccg

SEQ ID NO: 1469457 - RNA, 14 nt, Pseudomonas aeruginosa PA01
agccaggcgaaggc

SEQ ID NO: 1469458 - RNA, 14 nt, Pseudomonas aeruginosa PA01
agccaggcgauggu

SEQ ID NO: 1469459 - RNA, 20 nt, Pseudomonas aeruginosa PA01
agccaggcgauggugcgcuc

SEQ ID NO: 1469460 - RNA, 13 nt, Pseudomonas aeruginosa PA01
agcaggucgucgg

SEQ ID NO: 1469461 - RNA, 16 nt, Pseudomonas aeruginosa PA01
agcaggucgucggcga

SEQ ID NO: 1469462 - RNA, 17 nt, Pseudomonas aeruginosa PA01
agcaggucucaccgccc

SEQ ID NO: 1469463 - RNA, 17 nt, Pseudomonas aeruginosa PA01
agcaggugcauguagcg

SEQ ID NO: 1469464 - RNA, 16 nt, Pseudomonas aeruginosa PA01
agcagguugcuggcga

SEQ ID NO: 1469465 - RNA, 18 nt, Pseudomonas aeruginosa PA01
agcaggucuuccaccgcg

SEQ ID NO: 1469466 - RNA, 23 nt, Pseudomonas aeruginosa PA01
agcagguggucgaugggcgagcg

SEQ ID NO: 1469467 - RNA, 21 nt, Pseudomonas aeruginosa PA01
agcaggcuggcggcaucggcg

SEQ ID NO: 1469468 - RNA, 14 nt, Pseudomonas aeruginosa PA01
agcagggaggcgca

SEQ ID NO: 1469469 - RNA, 14 nt, Pseudomonas aeruginosa PA01
agcaggcggccguc

SEQ ID NO: 1469470 - RNA, 21 nt, Pseudomonas aeruginosa PA01
agcaggcgcucggggaugucc

SEQ ID NO: 1469471 - RNA, 22 nt, Pseudomonas aeruginosa PA01
agcaggcggaaaaagcgcggag

SEQ ID NO: 1469472 - RNA, 16 nt, Pseudomonas aeruginosa PA01
agcaggcguucggcga

SEQ ID NO: 1469473 - RNA, 20 nt, Pseudomonas aeruginosa PA01
agcaggcguugcagugcgcc

SEQ ID NO: 1469474 - RNA, 24 nt, Pseudomonas aeruginosa PA01
agcaggcguugcagugcgccgcag

SEQ ID NO: 1469475 - RNA, 20 nt, Pseudomonas aeruginosa PA01
agcagggcgaugaacaccgc

SEQ ID NO: 1469476 - RNA, 14 nt, Pseudomonas aeruginosa PA01
agcagggcgccgau

SEQ ID NO: 1469477 - RNA, 21 nt, Pseudomonas aeruginosa PA01
agcagggcgccgaucaggcgu

SEQ ID NO: 1469478 - RNA, 19 nt, Pseudomonas aeruginosa PA01
agcagggccagcagcgcug

SEQ ID NO: 1469479 - RNA, 22 nt, Pseudomonas aeruginosa PA01
agcagggccaggccgagcgcgc

SEQ ID NO: 1469480 - RNA, 13 nt, Pseudomonas aeruginosa PA01
agcagggccgccg

SEQ ID NO: 1469481 - RNA, 15 nt, Pseudomonas aeruginosa PA01
agcagggccgccgag

SEQ ID NO: 1469482 - RNA, 21 nt, Pseudomonas aeruginosa PA01
agcagggccgccgaggucagu

SEQ ID NO: 1469483 - RNA, 13 nt, Pseudomonas aeruginosa PA01
agcagccaggcga

SEQ ID NO: 1469484 - RNA, 22 nt, Pseudomonas aeruginosa PA01
agcagccaggcgaagcggcugg

SEQ ID NO: 1469485 - RNA, 18 nt, Pseudomonas aeruginosa PA01
agcagcaugucgccgggg

SEQ ID NO: 1469486 - RNA, 20 nt, Pseudomonas aeruginosa PA01
agcagccaaggaugcgccag

SEQ ID NO: 1469487 - RNA, 21 nt, Pseudomonas aeruginosa PA01
agcagccgacgauccggccga

SEQ ID NO: 1469488 - RNA, 14 nt, Pseudomonas aeruginosa PA01
agcagcccagcgcu

SEQ ID NO: 1469489 - RNA, 14 nt, Pseudomonas aeruginosa PA01
agcagcccggccug

SEQ ID NO: 1469490 - RNA, 15 nt, Pseudomonas aeruginosa PA01
agcagcccggccugg

SEQ ID NO: 1469491 - RNA, 14 nt, Pseudomonas aeruginosa PA01
agcaggcgccggcg

SEQ ID NO: 1469492 - RNA, 13 nt, Pseudomonas aeruginosa PA01
agcaggcgcgcca

SEQ ID NO: 1469493 - RNA, 16 nt, Pseudomonas aeruginosa PA01
agcaggcgcgccaggc

SEQ ID NO: 1469494 - RNA, 13 nt, Pseudomonas aeruginosa PA01
agcaggcgcgccc

SEQ ID NO: 1469495 - RNA, 15 nt, Pseudomonas aeruginosa PA01
agcaggcggaucgcc

SEQ ID NO: 1469496 - RNA, 18 nt, Pseudomonas aeruginosa PA01
agcaggcggaucgccgcc

SEQ ID NO: 1469497 - RNA, 16 nt, Pseudomonas aeruginosa PA01
agcaggcgcucggcga

SEQ ID NO: 1469498 - RNA, 19 nt, Pseudomonas aeruginosa PA01
agcaggcgcucggcgacgc

SEQ ID NO: 1469499 - RNA, 19 nt, Pseudomonas aeruginosa PA01
agcaggcgcgggcuggcca

SEQ ID NO: 1469500 - RNA, 18 nt, Pseudomonas aeruginosa PA01
agcaugccgaggaacgcc

SEQ ID NO: 1469501 - RNA, 22 nt, Pseudomonas aeruginosa PA01
agcaugccgaggaacgccgaca

SEQ ID NO: 1469502 - RNA, 18 nt, Pseudomonas aeruginosa PA01
agcaugauggugccgccg

SEQ ID NO: 1469503 - RNA, 21 nt, Pseudomonas aeruginosa PA01
agcaugacgauaucggcgccg

SEQ ID NO: 1469504 - RNA, 21 nt, Pseudomonas aeruginosa PA01
agcaugaauguggugucgcag

SEQ ID NO: 1469505 - RNA, 17 nt, Pseudomonas aeruginosa PA01
agcaucaccaccgggau

SEQ ID NO: 1469506 - RNA, 17 nt, Pseudomonas aeruginosa PA01
agcaucaggucggcgcg

SEQ ID NO: 1469507 - RNA, 17 nt, Pseudomonas aeruginosa PA01
agcagguuggucugcuc

SEQ ID NO: 1469508 - RNA, 19 nt, Pseudomonas aeruginosa PA01
agcagucgcacagccaggg

SEQ ID NO: 1469509 - RNA, 15 nt, Pseudomonas aeruginosa PA01
agcagucgccuggcc

SEQ ID NO: 1469510 - RNA, 18 nt, Pseudomonas aeruginosa PA01
agaaaccgaucagcaccg

SEQ ID NO: 1469511 - RNA, 18 nt, Pseudomonas aeruginosa PA01
agacgucgagguagucgg

SEQ ID NO: 1469512 - RNA, 14 nt, Pseudomonas aeruginosa PA01
agaaacggcugccg

SEQ ID NO: 1469513 - RNA, 19 nt, Pseudomonas aeruginosa PA01
agacguggcauucgucgcc

SEQ ID NO: 1469514 - RNA, 13 nt, Pseudomonas aeruginosa PA01
agagacugaacuc

SEQ ID NO: 1469515 - RNA, 24 nt, Pseudomonas aeruginosa PA01
agagacgcagcgcuagcgcauggc

SEQ ID NO: 1469516 - RNA, 13 nt, Pseudomonas aeruginosa PA01
agagaggcuggcg

SEQ ID NO: 1469517 - RNA, 14 nt, Pseudomonas aeruginosa PA01
agagcaccuugucg

SEQ ID NO: 1469518 - RNA, 22 nt, Pseudomonas aeruginosa PA01
agagcaccuugucgcugaccgg

SEQ ID NO: 1469519 - RNA, 16 nt, Pseudomonas aeruginosa PA01
agagcacgccgucgcg

SEQ ID NO: 1469520 - RNA, 16 nt, Pseudomonas aeruginosa PA01
agagcagcgcggcggc

SEQ ID NO: 1469521 - RNA, 17 nt, Pseudomonas aeruginosa PA01
agagcagcgcggcggcg

SEQ ID NO: 1469522 - RNA, 21 nt, Pseudomonas aeruginosa PA01
agagcuggacgacgcuggccu

SEQ ID NO: 1469523 - RNA, 12 nt, Pseudomonas aeruginosa PA01
agagcuggcggc

SEQ ID NO: 1469524 - RNA, 20 nt, Pseudomonas aeruginosa PA01
agagcuucucgucgccgccg

SEQ ID NO: 1469525 - RNA, 23 nt, Pseudomonas aeruginosa PA01
agagcuucugcuggauccucgcc

SEQ ID NO: 1469526 - RNA, 19 nt, Pseudomonas aeruginosa PA01
agagcuaguuauugaagug

SEQ ID NO: 1469527 - RNA, 14 nt, Pseudomonas aeruginosa PA01
agagcgugcggccg

SEQ ID NO: 1469528 - RNA, 13 nt, Pseudomonas aeruginosa PA01
agagcguccggca

SEQ ID NO: 1469529 - RNA, 16 nt, Pseudomonas aeruginosa PA01
agaguacucggcuacg

SEQ ID NO: 1469530 - RNA, 12 nt, Pseudomonas aeruginosa PA01
agagggcggcga

SEQ ID NO: 1469531 - RNA, 20 nt, Pseudomonas aeruginosa PA01
agagggcggcgaccggccuc

SEQ ID NO: 1469532 - RNA, 19 nt, Pseudomonas aeruginosa PA01
agagggcguagugcaucag

SEQ ID NO: 1469533 - RNA, 11 nt, Pseudomonas aeruginosa PA01
agaggucggcg

SEQ ID NO: 1469534 - RNA, 14 nt, Pseudomonas aeruginosa PA01
agaggucggcgcgc

SEQ ID NO: 1469535 - RNA, 15 nt, Pseudomonas aeruginosa PA01
agagggucagcaggc

SEQ ID NO: 1469536 - RNA, 16 nt, Pseudomonas aeruginosa PA01
agagggucagcaggcu

SEQ ID NO: 1469537 - RNA, 20 nt, Pseudomonas aeruginosa PA01
agagggucagcaggcugccg

SEQ ID NO: 1469538 - RNA, 15 nt, Pseudomonas aeruginosa PA01
agagggucagccggc

SEQ ID NO: 1469539 - RNA, 16 nt, Pseudomonas aeruginosa PA01
agaggcccucggcgcc

SEQ ID NO: 1469540 - RNA, 17 nt, Pseudomonas aeruginosa PA01
agaggcccucggcgccg

SEQ ID NO: 1469541 - RNA, 15 nt, Pseudomonas aeruginosa PA01
agaggcucagccgau

SEQ ID NO: 1469542 - RNA, 15 nt, Pseudomonas aeruginosa PA01
agaggcucggcggcc

SEQ ID NO: 1469543 - RNA, 16 nt, Pseudomonas aeruginosa PA01
agaggcucggcggcca

SEQ ID NO: 1469544 - RNA, 19 nt, Pseudomonas aeruginosa PA01
agaugccgcccugcggcag

SEQ ID NO: 1469545 - RNA, 23 nt, Pseudomonas aeruginosa PA01
agaugcguccguugaggcguucg

SEQ ID NO: 1469546 - RNA, 14 nt, Pseudomonas aeruginosa PA01
agaugcucgcgcag

SEQ ID NO: 1469547 - RNA, 17 nt, Pseudomonas aeruginosa PA01
agauguagucgacgccg

SEQ ID NO: 1469548 - RNA, 12 nt, Pseudomonas aeruginosa PA01
agauggcacagu

SEQ ID NO: 1469549 - RNA, 18 nt, Pseudomonas aeruginosa PA01
agaugaucaggccgagca

SEQ ID NO: 1469550 - RNA, 15 nt, Pseudomonas aeruginosa PA01
agaugaucgccaccg

SEQ ID NO: 1469551 - RNA, 15 nt, Pseudomonas aeruginosa PA01
agaugcccuugccgg

SEQ ID NO: 1469552 - RNA, 19 nt, Pseudomonas aeruginosa PA01
agaugcagcgucgcgcguc

SEQ ID NO: 1469553 - RNA, 13 nt, Pseudomonas aeruginosa PA01
agaugcacaccag

SEQ ID NO: 1469554 - RNA, 16 nt, Pseudomonas aeruginosa PA01
agaucugcgaauagac

SEQ ID NO: 1469555 - RNA, 15 nt, Pseudomonas aeruginosa PA01
agaucuucaggccga

SEQ ID NO: 1469556 - RNA, 16 nt, Pseudomonas aeruginosa PA01
agaugaaacugcccgg

SEQ ID NO: 1469557 - RNA, 17 nt, Pseudomonas aeruginosa PA01
agaucuuuucgauggug

SEQ ID NO: 1469558 - RNA, 13 nt, Pseudomonas aeruginosa PA01
agagucgcucgcg

SEQ ID NO: 1469559 - RNA, 22 nt, Pseudomonas aeruginosa PA01
agaucgucuuucucgaucucgu

SEQ ID NO: 1469560 - RNA, 19 nt, Pseudomonas aeruginosa PA01
agaucggcagcaucagccg

SEQ ID NO: 1469561 - RNA, 20 nt, Pseudomonas aeruginosa PA01
agaucggcagcaucagccgc

SEQ ID NO: 1469562 - RNA, 12 nt, Pseudomonas aeruginosa PA01
agaucggcggcg

SEQ ID NO: 1469563 - RNA, 14 nt, Pseudomonas aeruginosa PA01
agaucggcggcgcg

SEQ ID NO: 1469564 - RNA, 16 nt, Pseudomonas aeruginosa PA01
agaucggcggcgcggc

SEQ ID NO: 1469565 - RNA, 15 nt, Pseudomonas aeruginosa PA01
agaucgacaggccgc

SEQ ID NO: 1469566 - RNA, 22 nt, Pseudomonas aeruginosa PA01
agaucgaugcuguggguggugc

SEQ ID NO: 1469567 - RNA, 21 nt, Pseudomonas aeruginosa PA01
agaucgcauuguugcggucgc

SEQ ID NO: 1469568 - RNA, 18 nt, Pseudomonas aeruginosa PA01
agaucgccagcgccagca

SEQ ID NO: 1469569 - RNA, 21 nt, Pseudomonas aeruginosa PA01
agaucgccagcgccagcaggu

SEQ ID NO: 1469570 - RNA, 13 nt, Pseudomonas aeruginosa PA01
agaucgccagcuc

SEQ ID NO: 1469571 - RNA, 21 nt, Pseudomonas aeruginosa PA01
agaucgccagcucgccgcgcu

SEQ ID NO: 1469572 - RNA, 17 nt, Pseudomonas aeruginosa PA01
agaucgccugcuggccg

SEQ ID NO: 1469573 - RNA, 12 nt, Pseudomonas aeruginosa PA01
agaucgcgccga

SEQ ID NO: 1469574 - RNA, 15 nt, Pseudomonas aeruginosa PA01
agaucgcgccgagcu

SEQ ID NO: 1469575 - RNA, 23 nt, Pseudomonas aeruginosa PA01
agaucgcgccgagcuggcgcgcg

SEQ ID NO: 1469576 - RNA, 14 nt, Pseudomonas aeruginosa PA01
agaugugcgcggug

SEQ ID NO: 1469577 - RNA, 14 nt, Pseudomonas aeruginosa PA01
agauguucgccgcc

SEQ ID NO: 1469578 - RNA, 15 nt, Pseudomonas aeruginosa PA01
agcaacccaugccgc

SEQ ID NO: 1469579 - RNA, 14 nt, Pseudomonas aeruginosa PA01
agcaacaccgcgca

SEQ ID NO: 1469580 - RNA, 16 nt, Pseudomonas aeruginosa PA01
agcaacaccgcgcaga

SEQ ID NO: 1469581 - RNA, 23 nt, Pseudomonas aeruginosa PA01
agcaacaccgcgcagaugaucgc

SEQ ID NO: 1469582 - RNA, 15 nt, Pseudomonas aeruginosa PA01
agcaacaccggaagc

SEQ ID NO: 1469583 - RNA, 23 nt, Pseudomonas aeruginosa PA01
agcaacgggucgggcucaugggc

SEQ ID NO: 1469584 - RNA, 12 nt, Pseudomonas aeruginosa PA01
agcaacgccgcc

SEQ ID NO: 1469585 - RNA, 11 nt, Pseudomonas aeruginosa PA01
agcaacggcau

SEQ ID NO: 1469586 - RNA, 18 nt, Pseudomonas aeruginosa PA01
agcaacgcgugauacagc

SEQ ID NO: 1469587 - RNA, 13 nt, Pseudomonas aeruginosa PA01
agcaaugcccgcg

SEQ ID NO: 1469588 - RNA, 16 nt, Pseudomonas aeruginosa PA01
agcaaugccagcgcca

SEQ ID NO: 1469589 - RNA, 22 nt, Pseudomonas aeruginosa PA01
agcaauugccgcugcacgccuu

SEQ ID NO: 1469590 - RNA, 14 nt, Pseudomonas aeruginosa PA01
agcaauugccggcg

SEQ ID NO: 1469591 - RNA, 17 nt, Pseudomonas aeruginosa PA01
agcaacugaccuggccg

SEQ ID NO: 1469592 - RNA, 14 nt, Pseudomonas aeruginosa PA01
agcaacucgccgcc

SEQ ID NO: 1469593 - RNA, 15 nt, Pseudomonas aeruginosa PA01
agcaacucgccgccg

SEQ ID NO: 1469594 - RNA, 15 nt, Pseudomonas aeruginosa PA01
agcaagacggucccc

SEQ ID NO: 1469595 - RNA, 19 nt, Pseudomonas aeruginosa PA01
agcaauccggcgcugccga

SEQ ID NO: 1469596 - RNA, 16 nt, Pseudomonas aeruginosa PA01
agcaccaggcuggcca

SEQ ID NO: 1469597 - RNA, 17 nt, Pseudomonas aeruginosa PA01
agcaccaggcuggccag

SEQ ID NO: 1469598 - RNA, 16 nt, Pseudomonas aeruginosa PA01
agcaccagcaggagca

SEQ ID NO: 1469599 - RNA, 14 nt, Pseudomonas aeruginosa PA01
agcaccagcaccag

SEQ ID NO: 1469600 - RNA, 17 nt, Pseudomonas aeruginosa PA01
agcaccagcacgcccuu

SEQ ID NO: 1469601 - RNA, 13 nt, Pseudomonas aeruginosa PA01
agcaccaucagcc

SEQ ID NO: 1469602 - RNA, 15 nt, Pseudomonas aeruginosa PA01
agcaccagucccugg

SEQ ID NO: 1469603 - RNA, 18 nt, Pseudomonas aeruginosa PA01
agcaccagucccuggccg

SEQ ID NO: 1469604 - RNA, 20 nt, Pseudomonas aeruginosa PA01
agcaccagucccuggccggc

SEQ ID NO: 1469605 - RNA, 21 nt, Pseudomonas aeruginosa PA01
agcaccagucccuggccggcg

SEQ ID NO: 1469606 - RNA, 22 nt, Pseudomonas aeruginosa PA01
agcacccccagcaggccagcca

SEQ ID NO: 1469607 - RNA, 16 nt, Pseudomonas aeruginosa PA01
agcaccaugcgcggca

SEQ ID NO: 1469608 - RNA, 15 nt, Pseudomonas aeruginosa PA01
agcacccgguagccg

SEQ ID NO: 1469609 - RNA, 19 nt, Pseudomonas aeruginosa PA01
agcacccgcaccagccggc

SEQ ID NO: 1469610 - RNA, 20 nt, Pseudomonas aeruginosa PA01
agcacccgcaccagccggcg

SEQ ID NO: 1469611 - RNA, 23 nt, Pseudomonas aeruginosa PA01
agcacccgcaccagccggcgcuc

SEQ ID NO: 1469612 - RNA, 13 nt, Pseudomonas aeruginosa PA01
agcacccgcaccg

SEQ ID NO: 1469613 - RNA, 20 nt, Pseudomonas aeruginosa PA01
agcaccgacucgcccuuggg

SEQ ID NO: 1469614 - RNA, 18 nt, Pseudomonas aeruginosa PA01
agcaccgagacgcccugg

SEQ ID NO: 1469615 - RNA, 14 nt, Pseudomonas aeruginosa PA01
agcacccuggccac

SEQ ID NO: 1469616 - RNA, 21 nt, Pseudomonas aeruginosa PA01
agcaccgagcugaucgcgcag

SEQ ID NO: 1469617 - RNA, 16 nt, Pseudomonas aeruginosa PA01
agcaccgauuucccca

SEQ ID NO: 1469618 - RNA, 20 nt, Pseudomonas aeruginosa PA01
agcaccgauuuccccaaggc

SEQ ID NO: 1469619 - RNA, 23 nt, Pseudomonas aeruginosa PA01
agcacggcggcuacccgcgccuu

SEQ ID NO: 1469620 - RNA, 20 nt, Pseudomonas aeruginosa PA01
agcacggugacacccugccg

SEQ ID NO: 1469621 - RNA, 15 nt, Pseudomonas aeruginosa PA01
agcacgguccgcgaa

SEQ ID NO: 1469622 - RNA, 12 nt, Pseudomonas aeruginosa PA01
agcacgucgagc

SEQ ID NO: 1469623 - RNA, 18 nt, Pseudomonas aeruginosa PA01
agcacggugcuggcgucg

SEQ ID NO: 1469624 - RNA, 20 nt, Pseudomonas aeruginosa PA01
agcacggcgauacccaggcc

SEQ ID NO: 1469625 - RNA, 12 nt, Pseudomonas aeruginosa PA01
agcacggccucg

SEQ ID NO: 1469626 - RNA, 18 nt, Pseudomonas aeruginosa PA01
agcacggccucgcgugcg

SEQ ID NO: 1469627 - RNA, 20 nt, Pseudomonas aeruginosa PA01
agcacggcgaacaccgggcc

SEQ ID NO: 1469628 - RNA, 17 nt, Pseudomonas aeruginosa PA01
agcacggcgacgaaggc

SEQ ID NO: 1469629 - RNA, 13 nt, Pseudomonas aeruginosa PA01
agcacggcgacgg

SEQ ID NO: 1469630 - RNA, 18 nt, Pseudomonas aeruginosa PA01
agcacggcgacggugccg

SEQ ID NO: 1469631 - RNA, 11 nt, Pseudomonas aeruginosa PA01
agcacgucgau

SEQ ID NO: 1469632 - RNA, 23 nt, Pseudomonas aeruginosa PA01
agcacguugccauccagcgccug

SEQ ID NO: 1469633 - RNA, 13 nt, Pseudomonas aeruginosa PA01
agcacuacgccca

SEQ ID NO: 1469634 - RNA, 15 nt, Pseudomonas aeruginosa PA01
agcagacggcacgac

SEQ ID NO: 1469635 - RNA, 20 nt, Pseudomonas aeruginosa PA01
agcagacggcacgacgccgg

SEQ ID NO: 1469636 - RNA, 14 nt, Pseudomonas aeruginosa PA01
agcagcagcgccau

SEQ ID NO: 1469637 - RNA, 13 nt, Pseudomonas aeruginosa PA01
agcagcaggcgcu

SEQ ID NO: 1469638 - RNA, 19 nt, Pseudomonas aeruginosa PA01
agcagcaggcgcucgggga

SEQ ID NO: 1469639 - RNA, 16 nt, Pseudomonas aeruginosa PA01
agcagcaggccggcga

SEQ ID NO: 1469640 - RNA, 12 nt, Pseudomonas aeruginosa PA01
agcagcacggug

SEQ ID NO: 1469641 - RNA, 17 nt, Pseudomonas aeruginosa PA01
aggccguaggcgauggc

SEQ ID NO: 1469642 - RNA, 24 nt, Pseudomonas aeruginosa PA01
aggccguaggcgauggccuggucg

SEQ ID NO: 1469643 - RNA, 17 nt, Pseudomonas aeruginosa PA01
aggccguagaccaccag

SEQ ID NO: 1469644 - RNA, 14 nt, Pseudomonas aeruginosa PA01
aggccgggcggcgg

SEQ ID NO: 1469645 - RNA, 20 nt, Pseudomonas aeruginosa PA01
aggccggugaucucgcggcg

SEQ ID NO: 1469646 - RNA, 16 nt, Pseudomonas aeruginosa PA01
aggccggugccgccgg

SEQ ID NO: 1469647 - RNA, 16 nt, Pseudomonas aeruginosa PA01
aggccgguugcgaccg

SEQ ID NO: 1469648 - RNA, 22 nt, Pseudomonas aeruginosa PA01
aggcgauguugacgauggcgcc

SEQ ID NO: 1469649 - RNA, 13 nt, Pseudomonas aeruginosa PA01
aggcgcaugccau

SEQ ID NO: 1469650 - RNA, 13 nt, Pseudomonas aeruginosa PA01
aggcgcaugccca

SEQ ID NO: 1469651 - RNA, 16 nt, Pseudomonas aeruginosa PA01
aggcgcauggacaggu

SEQ ID NO: 1469652 - RNA, 22 nt, Pseudomonas aeruginosa PA01
aggcgcauggacaggucgacgg

SEQ ID NO: 1469653 - RNA, 18 nt, Pseudomonas aeruginosa PA01
aggcgccagccuacuggg

SEQ ID NO: 1469654 - RNA, 19 nt, Pseudomonas aeruginosa PA01
aggcgccagggacgcgcag

SEQ ID NO: 1469655 - RNA, 20 nt, Pseudomonas aeruginosa PA01
aggcgccagggacgcgcagc

SEQ ID NO: 1469656 - RNA, 21 nt, Pseudomonas aeruginosa PA01
aggcgccagguagugccgccc

SEQ ID NO: 1469657 - RNA, 11 nt, Pseudomonas aeruginosa PA01
aggcgccaguc

SEQ ID NO: 1469658 - RNA, 22 nt, Pseudomonas aeruginosa PA01
aggcgccagucauugcgcuccg

SEQ ID NO: 1469659 - RNA, 15 nt, Pseudomonas aeruginosa PA01
aggcgauggugcgcu

SEQ ID NO: 1469660 - RNA, 21 nt, Pseudomonas aeruginosa PA01
aggcgauggccuggucggcgc

SEQ ID NO: 1469661 - RNA, 15 nt, Pseudomonas aeruginosa PA01
aggcgaugcgccgga

SEQ ID NO: 1469662 - RNA, 16 nt, Pseudomonas aeruginosa PA01
aggcgaugcgccggau

SEQ ID NO: 1469663 - RNA, 14 nt, Pseudomonas aeruginosa PA01
aggcgaugccgacg

SEQ ID NO: 1469664 - RNA, 15 nt, Pseudomonas aeruginosa PA01
aggcgaugaccgccc

SEQ ID NO: 1469665 - RNA, 17 nt, Pseudomonas aeruginosa PA01
aggcgaugaccgccccg

SEQ ID NO: 1469666 - RNA, 15 nt, Pseudomonas aeruginosa PA01
aggcgauccacagca

SEQ ID NO: 1469667 - RNA, 14 nt, Pseudomonas aeruginosa PA01
aggcgaucgccgcg

SEQ ID NO: 1469668 - RNA, 17 nt, Pseudomonas aeruginosa PA01
aggcgaucgccgcggcg

SEQ ID NO: 1469669 - RNA, 14 nt, Pseudomonas aeruginosa PA01
aggcgaucuggcga

SEQ ID NO: 1469670 - RNA, 17 nt, Pseudomonas aeruginosa PA01
aggcgaugaacggcguc

SEQ ID NO: 1469671 - RNA, 18 nt, Pseudomonas aeruginosa PA01
aggcgauaucccgccgcc

SEQ ID NO: 1469672 - RNA, 19 nt, Pseudomonas aeruginosa PA01
aggcgauaucccgccgccg

SEQ ID NO: 1469673 - RNA, 18 nt, Pseudomonas aeruginosa PA01
aggcgaucaucgccaccg

SEQ ID NO: 1469674 - RNA, 21 nt, Pseudomonas aeruginosa PA01
aggcgaucaucgccaccggua

SEQ ID NO: 1469675 - RNA, 22 nt, Pseudomonas aeruginosa PA01
aggcgaucccguagaccggcuc

SEQ ID NO: 1469676 - RNA, 14 nt, Pseudomonas aeruginosa PA01
aggcgaucgacgcc

SEQ ID NO: 1469677 - RNA, 17 nt, Pseudomonas aeruginosa PA01
aggcgcucucgccgccu

SEQ ID NO: 1469678 - RNA, 18 nt, Pseudomonas aeruginosa PA01
aggcgcucucgccgccuu

SEQ ID NO: 1469679 - RNA, 18 nt, Pseudomonas aeruginosa PA01
aggcgcugcaaucgcugc

SEQ ID NO: 1469680 - RNA, 20 nt, Pseudomonas aeruginosa PA01
aggcgcugcaaucgcugccg

SEQ ID NO: 1469681 - RNA, 14 nt, Pseudomonas aeruginosa PA01
aggcgcugccguag

SEQ ID NO: 1469682 - RNA, 21 nt, Pseudomonas aeruginosa PA01
aggcgcugccguagaggucgc

SEQ ID NO: 1469683 - RNA, 17 nt, Pseudomonas aeruginosa PA01
aggcgcugcgcggccug

SEQ ID NO: 1469684 - RNA, 23 nt, Pseudomonas aeruginosa PA01
aggcgcugcgguaccagcgcacc

SEQ ID NO: 1469685 - RNA, 17 nt, Pseudomonas aeruginosa PA01
aggcgcugaagcggccg

SEQ ID NO: 1469686 - RNA, 13 nt, Pseudomonas aeruginosa PA01
aggcgcuggcgcc

SEQ ID NO: 1469687 - RNA, 14 nt, Pseudomonas aeruginosa PA01
aggcgcuggcgccg

SEQ ID NO: 1469688 - RNA, 23 nt, Pseudomonas aeruginosa PA01
aggcgcuggcgcuguaggcgagc

SEQ ID NO: 1469689 - RNA, 17 nt, Pseudomonas aeruginosa PA01
aggcgcugguccagcac

SEQ ID NO: 1469690 - RNA, 14 nt, Pseudomonas aeruginosa PA01
aggcgcuccaccgc

SEQ ID NO: 1469691 - RNA, 15 nt, Pseudomonas aeruginosa PA01
aggcgcuccaccgcc

SEQ ID NO: 1469692 - RNA, 21 nt, Pseudomonas aeruginosa PA01
aggcgcuccaccgcccccggc

SEQ ID NO: 1469693 - RNA, 12 nt, Pseudomonas aeruginosa PA01
aggcgcuccaga

SEQ ID NO: 1469694 - RNA, 16 nt, Pseudomonas aeruginosa PA01
aggcgcuccagggcau

SEQ ID NO: 1469695 - RNA, 16 nt, Pseudomonas aeruginosa PA01
aggcgcuccggaacgc

SEQ ID NO: 1469696 - RNA, 16 nt, Pseudomonas aeruginosa PA01
aggcgcuccuccagcg

SEQ ID NO: 1469697 - RNA, 20 nt, Pseudomonas aeruginosa PA01
aggcgcuccuccagcgccgc

SEQ ID NO: 1469698 - RNA, 23 nt, Pseudomonas aeruginosa PA01
aggcgcuccuccagcgccgccag

SEQ ID NO: 1469699 - RNA, 18 nt, Pseudomonas aeruginosa PA01
aggcgcuccuggugcggc

SEQ ID NO: 1469700 - RNA, 19 nt, Pseudomonas aeruginosa PA01
aggcgcuccuugagcagcu

SEQ ID NO: 1469701 - RNA, 19 nt, Pseudomonas aeruginosa PA01
aggcgcucgacgaucaggu

SEQ ID NO: 1469702 - RNA, 13 nt, Pseudomonas aeruginosa PA01
aggcgcucggcga

SEQ ID NO: 1469703 - RNA, 14 nt, Pseudomonas aeruginosa PA01
aggcgcucggcgac

SEQ ID NO: 1469704 - RNA, 23 nt, Pseudomonas aeruginosa PA01
aggcgcucggcgaccuugcgcac

SEQ ID NO: 1469705 - RNA, 18 nt, Pseudomonas aeruginosa PA01
aggcgcucggcggcgcgc

SEQ ID NO: 1469706 - RNA, 20 nt, Pseudomonas aeruginosa PA01
aggcgcucgcgggccgccug

SEQ ID NO: 1469707 - RNA, 17 nt, Pseudomonas aeruginosa PA01
aggcgccgcgcauccuc

SEQ ID NO: 1469708 - RNA, 20 nt, Pseudomonas aeruginosa PA01
aggcgccgcgcauccucggc

SEQ ID NO: 1469709 - RNA, 14 nt, Pseudomonas aeruginosa PA01
aggcgccgcgccag

SEQ ID NO: 1469710 - RNA, 12 nt, Pseudomonas aeruginosa PA01
aggcgccgccgu

SEQ ID NO: 1469711 - RNA, 14 nt, Pseudomonas aeruginosa PA01
aggcgccgcccccg

SEQ ID NO: 1469712 - RNA, 18 nt, Pseudomonas aeruginosa PA01
aggcgccgaugcccaggc

SEQ ID NO: 1469713 - RNA, 22 nt, Pseudomonas aeruginosa PA01
aggcgccgaugcccaggccgau

SEQ ID NO: 1469714 - RNA, 17 nt, Pseudomonas aeruginosa PA01
aggcgccgauggcuguc

SEQ ID NO: 1469715 - RNA, 15 nt, Pseudomonas aeruginosa PA01
aggcgcccaggcagc

SEQ ID NO: 1469716 - RNA, 17 nt, Pseudomonas aeruginosa PA01
aggcgcccaggcagcag

SEQ ID NO: 1469717 - RNA, 14 nt, Pseudomonas aeruginosa PA01
aggcgcccuggccg

SEQ ID NO: 1469718 - RNA, 17 nt, Pseudomonas aeruginosa PA01
aggcgcccuggccgucg

SEQ ID NO: 1469719 - RNA, 14 nt, Pseudomonas aeruginosa PA01
aggcgcccuugacg

SEQ ID NO: 1469720 - RNA, 22 nt, Pseudomonas aeruginosa PA01
aggcgcccuugacguucaggcu

SEQ ID NO: 1469721 - RNA, 24 nt, Pseudomonas aeruginosa PA01
aggcgccgaccgcaccgccagcgu

SEQ ID NO: 1469722 - RNA, 13 nt, Pseudomonas aeruginosa PA01
aggcgcccggugg

SEQ ID NO: 1469723 - RNA, 23 nt, Pseudomonas aeruginosa PA01
aggcgcgggucuucaggccgcag

SEQ ID NO: 1469724 - RNA, 22 nt, Pseudomonas aeruginosa PA01
aggcgcggguggcgucgaucag

SEQ ID NO: 1469725 - RNA, 21 nt, Pseudomonas aeruginosa PA01
aggcgcguugcuuccaggcac

SEQ ID NO: 1469726 - RNA, 16 nt, Pseudomonas aeruginosa PA01
aggcgcccgccggccg

SEQ ID NO: 1469727 - RNA, 15 nt, Pseudomonas aeruginosa PA01
aggcgcgggcggcgg

SEQ ID NO: 1469728 - RNA, 13 nt, Pseudomonas aeruginosa PA01
aggcgcgggcugg

SEQ ID NO: 1469729 - RNA, 18 nt, Pseudomonas aeruginosa PA01
aggcgcgggcuggccacc

SEQ ID NO: 1469730 - RNA, 18 nt, Pseudomonas aeruginosa PA01
aggcgcgcggccagcgcg

SEQ ID NO: 1469731 - RNA, 18 nt, Pseudomonas aeruginosa PA01
aggcgcgcucgaucaggu

SEQ ID NO: 1469732 - RNA, 19 nt, Pseudomonas aeruginosa PA01
aggcgcgcuggaugcccuc

SEQ ID NO: 1469733 - RNA, 20 nt, Pseudomonas aeruginosa PA01
aggcuuuccaccgccagcac

SEQ ID NO: 1469734 - RNA, 20 nt, Pseudomonas aeruginosa PA01
aggcuuuccagcaggcgcuc

SEQ ID NO: 1469735 - RNA, 17 nt, Pseudomonas aeruginosa PA01
aggcuuuccgccgagcg

SEQ ID NO: 1469736 - RNA, 20 nt, Pseudomonas aeruginosa PA01
aggcuuggucagggucgagu

SEQ ID NO: 1469737 - RNA, 16 nt, Pseudomonas aeruginosa PA01
aggcuuguccuuggcc

SEQ ID NO: 1469738 - RNA, 17 nt, Pseudomonas aeruginosa PA01
aggcuggccgagcgccg

SEQ ID NO: 1469739 - RNA, 20 nt, Pseudomonas aeruginosa PA01
aggcuggccgagcgccgccu

SEQ ID NO: 1469740 - RNA, 18 nt, Pseudomonas aeruginosa PA01
agggaaacaccaggccga

SEQ ID NO: 1469741 - RNA, 16 nt, Pseudomonas aeruginosa PA01
agggaaacacgucgau

SEQ ID NO: 1469742 - RNA, 21 nt, Pseudomonas aeruginosa PA01
agggaaccauccggaguucgc

SEQ ID NO: 1469743 - RNA, 17 nt, Pseudomonas aeruginosa PA01
agggaacgucuggccag

SEQ ID NO: 1469744 - RNA, 17 nt, Pseudomonas aeruginosa PA01
agggaagcgcgcgccag

SEQ ID NO: 1469745 - RNA, 21 nt, Pseudomonas aeruginosa PA01
agggaagcgcgcgccaguccc

SEQ ID NO: 1469746 - RNA, 20 nt, Pseudomonas aeruginosa PA01
agggacgcgcagcggcgccg

SEQ ID NO: 1469747 - RNA, 16 nt, Pseudomonas aeruginosa PA01
agggacaugucgaggg

SEQ ID NO: 1469748 - RNA, 13 nt, Pseudomonas aeruginosa PA01
agggagccaggcg

SEQ ID NO: 1469749 - RNA, 15 nt, Pseudomonas aeruginosa PA01
agggagccaggcggc

SEQ ID NO: 1469750 - RNA, 17 nt, Pseudomonas aeruginosa PA01
agggacggugcaggccg

SEQ ID NO: 1469751 - RNA, 17 nt, Pseudomonas aeruginosa PA01
agggaauggaugcgcgg

SEQ ID NO: 1469752 - RNA, 15 nt, Pseudomonas aeruginosa PA01
agggaguccgccagc

SEQ ID NO: 1469753 - RNA, 17 nt, Pseudomonas aeruginosa PA01
agggaguccgccagccg

SEQ ID NO: 1469754 - RNA, 16 nt, Pseudomonas aeruginosa PA01
agggagucgcuggcca

SEQ ID NO: 1469755 - RNA, 18 nt, Pseudomonas aeruginosa PA01
aggcugcucaugccguug

SEQ ID NO: 1469756 - RNA, 20 nt, Pseudomonas aeruginosa PA01
aggcugcggcggaaggcggc

SEQ ID NO: 1469757 - RNA, 22 nt, Pseudomonas aeruginosa PA01
aggcugcggcggaaggcggcgu

SEQ ID NO: 1469758 - RNA, 15 nt, Pseudomonas aeruginosa PA01
aggcugcaucggcuc

SEQ ID NO: 1469759 - RNA, 22 nt, Pseudomonas aeruginosa PA01
aggcugcccagguagccggcga

SEQ ID NO: 1469760 - RNA, 18 nt, Pseudomonas aeruginosa PA01
aggcugcgauauggccga

SEQ ID NO: 1469761 - RNA, 19 nt, Pseudomonas aeruginosa PA01
aggcugcgcaccucggcca

SEQ ID NO: 1469762 - RNA, 13 nt, Pseudomonas aeruginosa PA01
aggcugccgagca

SEQ ID NO: 1469763 - RNA, 17 nt, Pseudomonas aeruginosa PA01
aggcugccgagcagggu

SEQ ID NO: 1469764 - RNA, 17 nt, Pseudomonas aeruginosa PA01
aggcugccgccgccguc

SEQ ID NO: 1469765 - RNA, 14 nt, Pseudomonas aeruginosa PA01
aggcugccgccuuc

SEQ ID NO: 1469766 - RNA, 14 nt, Pseudomonas aeruginosa PA01
aggcugaucggcgc

SEQ ID NO: 1469767 - RNA, 18 nt, Pseudomonas aeruginosa PA01
aggcugaucggcgcgccg

SEQ ID NO: 1469768 - RNA, 16 nt, Pseudomonas aeruginosa PA01
aggcucagcucggcga

SEQ ID NO: 1469769 - RNA, 13 nt, Pseudomonas aeruginosa PA01
aggcucaggccgg

SEQ ID NO: 1469770 - RNA, 19 nt, Pseudomonas aeruginosa PA01
aggcucacgcguucggcga

SEQ ID NO: 1469771 - RNA, 17 nt, Pseudomonas aeruginosa PA01
aggcucaaucaaucggu

SEQ ID NO: 1469772 - RNA, 22 nt, Pseudomonas aeruginosa PA01
aggcucaaucaaucggucguga

SEQ ID NO: 1469773 - RNA, 23 nt, Pseudomonas aeruginosa PA01
aggcgugcaguacuuggccagca

SEQ ID NO: 1469774 - RNA, 13 nt, Pseudomonas aeruginosa PA01
aggcgugcuggcu

SEQ ID NO: 1469775 - RNA, 16 nt, Pseudomonas aeruginosa PA01
aggcgugggcgccggc

SEQ ID NO: 1469776 - RNA, 18 nt, Pseudomonas aeruginosa PA01
aggcguggggcgaauaac

SEQ ID NO: 1469777 - RNA, 20 nt, Pseudomonas aeruginosa PA01
aggcguucaugaaagccagc

SEQ ID NO: 1469778 - RNA, 17 nt, Pseudomonas aeruginosa PA01
aggcguuccaccaggcg

SEQ ID NO: 1469779 - RNA, 14 nt, Pseudomonas aeruginosa PA01
aggcguuccagcuc

SEQ ID NO: 1469780 - RNA, 14 nt, Pseudomonas aeruginosa PA01
aggcguucggcgau

SEQ ID NO: 1469781 - RNA, 14 nt, Pseudomonas aeruginosa PA01
aggcguucgucgac

SEQ ID NO: 1469782 - RNA, 16 nt, Pseudomonas aeruginosa PA01
aggcgguagcgccgcg

SEQ ID NO: 1469783 - RNA, 17 nt, Pseudomonas aeruginosa PA01
aggcgggcacgucgcgg

SEQ ID NO: 1469784 - RNA, 13 nt, Pseudomonas aeruginosa PA01
aggcgggcuggaa

SEQ ID NO: 1469785 - RNA, 17 nt, Pseudomonas aeruginosa PA01
aggcgggccagcagggu

SEQ ID NO: 1469786 - RNA, 18 nt, Pseudomonas aeruginosa PA01
aggcggacacgcaggcgc

SEQ ID NO: 1469787 - RNA, 19 nt, Pseudomonas aeruginosa PA01
aggcggacacgcaggcgcc

SEQ ID NO: 1469788 - RNA, 15 nt, Pseudomonas aeruginosa PA01
aggcggagaagccgc

SEQ ID NO: 1469789 - RNA, 14 nt, Pseudomonas aeruginosa PA01
aggcggagcauggu

SEQ ID NO: 1469790 - RNA, 20 nt, Pseudomonas aeruginosa PA01
aggcggaguagccggcggcg

SEQ ID NO: 1469791 - RNA, 17 nt, Pseudomonas aeruginosa PA01
aggcggugaccagcggc

SEQ ID NO: 1469792 - RNA, 21 nt, Pseudomonas aeruginosa PA01
aggcgguguagaccaccagca

SEQ ID NO: 1469793 - RNA, 21 nt, Pseudomonas aeruginosa PA01
aggcggugucgcgguugcgcu

SEQ ID NO: 1469794 - RNA, 21 nt, Pseudomonas aeruginosa PA01
aggcgguggcgaucagcgaaa

SEQ ID NO: 1469795 - RNA, 14 nt, Pseudomonas aeruginosa PA01
aggcgucguugccg

SEQ ID NO: 1469796 - RNA, 19 nt, Pseudomonas aeruginosa PA01
aggcgguuggcccgcgccg

SEQ ID NO: 1469797 - RNA, 19 nt, Pseudomonas aeruginosa PA01
aggcggucgccgaacagcc

SEQ ID NO: 1469798 - RNA, 12 nt, Pseudomonas aeruginosa PA01
aggcggucgcgg

SEQ ID NO: 1469799 - RNA, 21 nt, Pseudomonas aeruginosa PA01
aggcggucuuuuugcagggaa

SEQ ID NO: 1469800 - RNA, 16 nt, Pseudomonas aeruginosa PA01
aggauggucaggccgg

SEQ ID NO: 1469801 - RNA, 21 nt, Pseudomonas aeruginosa PA01
aggauggucaggccggcgcga

SEQ ID NO: 1469802 - RNA, 15 nt, Pseudomonas aeruginosa PA01
aggauggacagcuug

SEQ ID NO: 1469803 - RNA, 13 nt, Pseudomonas aeruginosa PA01
aggaugccgccug

SEQ ID NO: 1469804 - RNA, 13 nt, Pseudomonas aeruginosa PA01
agcugcggcggca

SEQ ID NO: 1469805 - RNA, 17 nt, Pseudomonas aeruginosa PA01
agcugcgcucggauucc

SEQ ID NO: 1469806 - RNA, 13 nt, Pseudomonas aeruginosa PA01
agcugcgccgccu

SEQ ID NO: 1469807 - RNA, 20 nt, Pseudomonas aeruginosa PA01
agcugcgcagggcgccgucg

SEQ ID NO: 1469808 - RNA, 22 nt, Pseudomonas aeruginosa PA01
agcugcgccugcagcucgguga

SEQ ID NO: 1469809 - RNA, 15 nt, Pseudomonas aeruginosa PA01
agcugccuuccagca

SEQ ID NO: 1469810 - RNA, 17 nt, Pseudomonas aeruginosa PA01
agcugccuuccagcagg

SEQ ID NO: 1469811 - RNA, 20 nt, Pseudomonas aeruginosa PA01
agcugcaaggcuucggcggu

SEQ ID NO: 1469812 - RNA, 12 nt, Pseudomonas aeruginosa PA01
agcugcagcgcc

SEQ ID NO: 1469813 - RNA, 20 nt, Pseudomonas aeruginosa PA01
agcugcagcgccccagcacc

SEQ ID NO: 1469814 - RNA, 19 nt, Pseudomonas aeruginosa PA01
agcugcaugagugucgcca

SEQ ID NO: 1469815 - RNA, 20 nt, Pseudomonas aeruginosa PA01
agcugcaugagugucgccau

SEQ ID NO: 1469816 - RNA, 17 nt, Pseudomonas aeruginosa PA01
agcugccccacaggccc

SEQ ID NO: 1469817 - RNA, 16 nt, Pseudomonas aeruginosa PA01
agcugccgcuucggcu

SEQ ID NO: 1469818 - RNA, 18 nt, Pseudomonas aeruginosa PA01
agcugccgcuucggcugc

SEQ ID NO: 1469819 - RNA, 15 nt, Pseudomonas aeruginosa PA01
agcugccggcgucgu

SEQ ID NO: 1469820 - RNA, 21 nt, Pseudomonas aeruginosa PA01
agcugccggcgucguccugcg

SEQ ID NO: 1469821 - RNA, 18 nt, Pseudomonas aeruginosa PA01
aggccagcuuccaggcgc

SEQ ID NO: 1469822 - RNA, 22 nt, Pseudomonas aeruginosa PA01
aggccaguucgcugacccagcg

SEQ ID NO: 1469823 - RNA, 20 nt, Pseudomonas aeruginosa PA01
aggccauagcgcgccggguu

SEQ ID NO: 1469824 - RNA, 17 nt, Pseudomonas aeruginosa PA01
aggccaggaucgucggc

SEQ ID NO: 1469825 - RNA, 21 nt, Pseudomonas aeruginosa PA01
aggccaggccccagggccggc

SEQ ID NO: 1469826 - RNA, 15 nt, Pseudomonas aeruginosa PA01
aggccagggcggcgc

SEQ ID NO: 1469827 - RNA, 16 nt, Pseudomonas aeruginosa PA01
aggccagggcggcgcc

SEQ ID NO: 1469828 - RNA, 17 nt, Pseudomonas aeruginosa PA01
aggccagggcggcgccg

SEQ ID NO: 1469829 - RNA, 14 nt, Pseudomonas aeruginosa PA01
aggccagcucgccc

SEQ ID NO: 1469830 - RNA, 17 nt, Pseudomonas aeruginosa PA01
aggccagcucgucgccc

SEQ ID NO: 1469831 - RNA, 16 nt, Pseudomonas aeruginosa PA01
aggccaggccgagcgc

SEQ ID NO: 1469832 - RNA, 13 nt, Pseudomonas aeruginosa PA01
aggccaggccggc

SEQ ID NO: 1469833 - RNA, 17 nt, Pseudomonas aeruginosa PA01
aggccaggccggcgccu

SEQ ID NO: 1469834 - RNA, 21 nt, Pseudomonas aeruginosa PA01
aggccaggcgauacgcggccc

SEQ ID NO: 1469835 - RNA, 18 nt, Pseudomonas aeruginosa PA01
aggccaggcgcagugccu

SEQ ID NO: 1469836 - RNA, 23 nt, Pseudomonas aeruginosa PA01
aggccaggcucgguucugcgcac

SEQ ID NO: 1469837 - RNA, 20 nt, Pseudomonas aeruginosa PA01
aggccaugggugucggcgau

SEQ ID NO: 1469838 - RNA, 17 nt, Pseudomonas aeruginosa PA01
aggccaguccggcaccg

SEQ ID NO: 1469839 - RNA, 14 nt, Pseudomonas aeruginosa PA01
aggccaugaucauc

SEQ ID NO: 1469840 - RNA, 23 nt, Pseudomonas aeruginosa PA01
aggccaugaucaucgccugcugg

SEQ ID NO: 1469841 - RNA, 15 nt, Pseudomonas aeruginosa PA01
aggcccacgccgaag

SEQ ID NO: 1469842 - RNA, 17 nt, Pseudomonas aeruginosa PA01
aggauuuccgcggccgg

SEQ ID NO: 1469843 - RNA, 17 nt, Pseudomonas aeruginosa PA01
aggcaucgacgccagcg

SEQ ID NO: 1469844 - RNA, 18 nt, Pseudomonas aeruginosa PA01
aggcaucgacgccagcgg

SEQ ID NO: 1469845 - RNA, 16 nt, Pseudomonas aeruginosa PA01
aggcauugccguccgu

SEQ ID NO: 1469846 - RNA, 14 nt, Pseudomonas aeruginosa PA01
aggccaagcaugaa

SEQ ID NO: 1469847 - RNA, 16 nt, Pseudomonas aeruginosa PA01
aggcccugggcggcgg

SEQ ID NO: 1469848 - RNA, 15 nt, Pseudomonas aeruginosa PA01
aggccgacggcgcgc

SEQ ID NO: 1469849 - RNA, 17 nt, Pseudomonas aeruginosa PA01
aggccgacgaacagcca

SEQ ID NO: 1469850 - RNA, 19 nt, Pseudomonas aeruginosa PA01
aggccgacgaacagccaga

SEQ ID NO: 1469851 - RNA, 17 nt, Pseudomonas aeruginosa PA01
aggccgaccagcagggc

SEQ ID NO: 1469852 - RNA, 16 nt, Pseudomonas aeruginosa PA01
aggccgaccagcgccg

SEQ ID NO: 1469853 - RNA, 18 nt, Pseudomonas aeruginosa PA01
aggccgaccagcgccgac

SEQ ID NO: 1469854 - RNA, 22 nt, Pseudomonas aeruginosa PA01
aggccgacccgcaggccggcca

SEQ ID NO: 1469855 - RNA, 18 nt, Pseudomonas aeruginosa PA01
aggccgaccucggcgguc

SEQ ID NO: 1469856 - RNA, 13 nt, Pseudomonas aeruginosa PA01
aggccgcccagcg

SEQ ID NO: 1469857 - RNA, 16 nt, Pseudomonas aeruginosa PA01
aggccgcccagcgcag

SEQ ID NO: 1469858 - RNA, 14 nt, Pseudomonas aeruginosa PA01
aggccgccacggcg

SEQ ID NO: 1469859 - RNA, 15 nt, Pseudomonas aeruginosa PA01
aggccgccacggcgg

SEQ ID NO: 1469860 - RNA, 19 nt, Pseudomonas aeruginosa PA01
aggccgagaaaccgccauc

SEQ ID NO: 1469861 - RNA, 14 nt, Pseudomonas aeruginosa PA01
aggccgagaagguu

SEQ ID NO: 1469862 - RNA, 13 nt, Pseudomonas aeruginosa PA01
aggccgcauccgc

SEQ ID NO: 1469863 - RNA, 15 nt, Pseudomonas aeruginosa PA01
aggccgccgcgggca

SEQ ID NO: 1469864 - RNA, 22 nt, Pseudomonas aeruginosa PA01
aggccgccgaagaacucggcgc

SEQ ID NO: 1469865 - RNA, 19 nt, Pseudomonas aeruginosa PA01
aggccgccgauccaggaac

SEQ ID NO: 1469866 - RNA, 21 nt, Pseudomonas aeruginosa PA01
aggccgccgaucccgacgccc

SEQ ID NO: 1469867 - RNA, 21 nt, Pseudomonas aeruginosa PA01
aggccgccguagaguucggcu

SEQ ID NO: 1469868 - RNA, 15 nt, Pseudomonas aeruginosa PA01
aggccgccggcgacc

SEQ ID NO: 1469869 - RNA, 16 nt, Pseudomonas aeruginosa PA01
aggccgccggcgaccg

SEQ ID NO: 1469870 - RNA, 22 nt, Pseudomonas aeruginosa PA01
aggcccagccauugcgccagga

SEQ ID NO: 1469871 - RNA, 14 nt, Pseudomonas aeruginosa PA01
aggccccaggccgc

SEQ ID NO: 1469872 - RNA, 14 nt, Pseudomonas aeruginosa PA01
aggccccaggcgau

SEQ ID NO: 1469873 - RNA, 17 nt, Pseudomonas aeruginosa PA01
aggccccagggccggcg

SEQ ID NO: 1469874 - RNA, 22 nt, Pseudomonas aeruginosa PA01
aggcccauuucguagcccaggc

SEQ ID NO: 1469875 - RNA, 13 nt, Pseudomonas aeruginosa PA01
aggcccaguucgc

SEQ ID NO: 1469876 - RNA, 15 nt, Pseudomonas aeruginosa PA01
aggcccauccuggcg

SEQ ID NO: 1469877 - RNA, 14 nt, Pseudomonas aeruginosa PA01
aggcccucggcgac

SEQ ID NO: 1469878 - RNA, 15 nt, Pseudomonas aeruginosa PA01
aggcccucggcgacc

SEQ ID NO: 1469879 - RNA, 19 nt, Pseudomonas aeruginosa PA01
aggcccucggcgccgagca

SEQ ID NO: 1469880 - RNA, 13 nt, Pseudomonas aeruginosa PA01
aggcccucggcgg

SEQ ID NO: 1469881 - RNA, 15 nt, Pseudomonas aeruginosa PA01
aggcccucggcggcg

SEQ ID NO: 1469882 - RNA, 16 nt, Pseudomonas aeruginosa PA01
aggcccugcugcaggg

SEQ ID NO: 1469883 - RNA, 22 nt, Pseudomonas aeruginosa PA01
aggcccugcugcagggccucgc

SEQ ID NO: 1469884 - RNA, 16 nt, Pseudomonas aeruginosa PA01
aggcccuuggucaggc

SEQ ID NO: 1469885 - RNA, 17 nt, Pseudomonas aeruginosa PA01
aggcccuuggucaggcc

SEQ ID NO: 1469886 - RNA, 16 nt, Pseudomonas aeruginosa PA01
aggccgaagaggcccu

SEQ ID NO: 1469887 - RNA, 22 nt, Pseudomonas aeruginosa PA01
aggccgaagaggcccucggcgc

SEQ ID NO: 1469888 - RNA, 16 nt, Pseudomonas aeruginosa PA01
aggccgaagccgccgg

SEQ ID NO: 1469889 - RNA, 18 nt, Pseudomonas aeruginosa PA01
aggccgaagccgccggga

SEQ ID NO: 1469890 - RNA, 18 nt, Pseudomonas aeruginosa PA01
aggccgaagcgugggcgg

SEQ ID NO: 1469891 - RNA, 20 nt, Pseudomonas aeruginosa PA01
aggccgaagcugucgagcac

SEQ ID NO: 1469892 - RNA, 15 nt, Pseudomonas aeruginosa PA01
aggccgaaggccagg

SEQ ID NO: 1469893 - RNA, 17 nt, Pseudomonas aeruginosa PA01
aggccgaauccgccggc

SEQ ID NO: 1469894 - RNA, 22 nt, Pseudomonas aeruginosa PA01
aggccgacaccucgaucagcgg

SEQ ID NO: 1469895 - RNA, 13 nt, Pseudomonas aeruginosa PA01
aggccgacagcgg

SEQ ID NO: 1469896 - RNA, 22 nt, Pseudomonas aeruginosa PA01
aggccgaacgguagguagcguu

SEQ ID NO: 1469897 - RNA, 16 nt, Pseudomonas aeruginosa PA01
aggccggcgccuugcg

SEQ ID NO: 1469898 - RNA, 20 nt, Pseudomonas aeruginosa PA01
aggccggcgcgauccuggcg

SEQ ID NO: 1469899 - RNA, 12 nt, Pseudomonas aeruginosa PA01
aggccggcgccg

SEQ ID NO: 1469900 - RNA, 14 nt, Pseudomonas aeruginosa PA01
aggccggcgccgau

SEQ ID NO: 1469901 - RNA, 17 nt, Pseudomonas aeruginosa PA01
aggccggcgccgccgaa

SEQ ID NO: 1469902 - RNA, 15 nt, Pseudomonas aeruginosa PA01
aggccgggcaggccg

SEQ ID NO: 1469903 - RNA, 19 nt, Pseudomonas aeruginosa PA01
aggccggcgagggcggcga

SEQ ID NO: 1469904 - RNA, 20 nt, Pseudomonas aeruginosa PA01
aggccggcgagggcggcgac

SEQ ID NO: 1469905 - RNA, 21 nt, Pseudomonas aeruginosa PA01
aggccggcgagggcggcgacc

SEQ ID NO: 1469906 - RNA, 18 nt, Pseudomonas aeruginosa PA01
aggccggcgcaucgucga

SEQ ID NO: 1469907 - RNA, 17 nt, Pseudomonas aeruginosa PA01
aggccggagccgcguuc

SEQ ID NO: 1469908 - RNA, 19 nt, Pseudomonas aeruginosa PA01
aggccggcgaccagcgucg

SEQ ID NO: 1469909 - RNA, 17 nt, Pseudomonas aeruginosa PA01
aggccggccuccagcgc

SEQ ID NO: 1469910 - RNA, 11 nt, Pseudomonas aeruginosa PA01
aggccgcgcag

SEQ ID NO: 1469911 - RNA, 19 nt, Pseudomonas aeruginosa PA01
aggccgcgcagcaacggcg

SEQ ID NO: 1469912 - RNA, 15 nt, Pseudomonas aeruginosa PA01
aggccgcgcgauggc

SEQ ID NO: 1469913 - RNA, 13 nt, Pseudomonas aeruginosa PA01
aggccgcgccgga

SEQ ID NO: 1469914 - RNA, 15 nt, Pseudomonas aeruginosa PA01
aggccgcgccggauc

SEQ ID NO: 1469915 - RNA, 18 nt, Pseudomonas aeruginosa PA01
aggccgcggagcaccgcg

SEQ ID NO: 1469916 - RNA, 15 nt, Pseudomonas aeruginosa PA01
aggccgcggcccugc

SEQ ID NO: 1469917 - RNA, 15 nt, Pseudomonas aeruginosa PA01
aggccgcugccgccg

SEQ ID NO: 1469918 - RNA, 21 nt, Pseudomonas aeruginosa PA01
aggccgcuggcgacgcuuucc

SEQ ID NO: 1469919 - RNA, 18 nt, Pseudomonas aeruginosa PA01
aggccgcuuacgcggccu

SEQ ID NO: 1469920 - RNA, 17 nt, Pseudomonas aeruginosa PA01
aggccgcuucgccgccc

SEQ ID NO: 1469921 - RNA, 21 nt, Pseudomonas aeruginosa PA01
aggccgcuucgccgcccucgc

SEQ ID NO: 1469922 - RNA, 18 nt, Pseudomonas aeruginosa PA01
aggccgcuuggccauggc

SEQ ID NO: 1469923 - RNA, 19 nt, Pseudomonas aeruginosa PA01
aggccgcuuggccauggcg

SEQ ID NO: 1469924 - RNA, 16 nt, Pseudomonas aeruginosa PA01
aggucguugcgccggc

SEQ ID NO: 1469925 - RNA, 22 nt, Pseudomonas aeruginosa PA01
aggucguugcgccggcccagca

SEQ ID NO: 1469926 - RNA, 20 nt, Pseudomonas aeruginosa PA01
aggucguuggccaggcgcga

SEQ ID NO: 1469927 - RNA, 14 nt, Pseudomonas aeruginosa PA01
aggucucgauggug

SEQ ID NO: 1469928 - RNA, 14 nt, Pseudomonas aeruginosa PA01
aggucugccccggc

SEQ ID NO: 1469929 - RNA, 14 nt, Pseudomonas aeruginosa PA01
aggucugcccgacg

SEQ ID NO: 1469930 - RNA, 20 nt, Pseudomonas aeruginosa PA01
aggucugccucgccgaggcg

SEQ ID NO: 1469931 - RNA, 17 nt, Pseudomonas aeruginosa PA01
aggugagcgacccgcug

SEQ ID NO: 1469932 - RNA, 18 nt, Pseudomonas aeruginosa PA01
aggucuuggccagccgcg

SEQ ID NO: 1469933 - RNA, 15 nt, Pseudomonas aeruginosa PA01
aggugaagcccaggc

SEQ ID NO: 1469934 - RNA, 16 nt, Pseudomonas aeruginosa PA01
aggugaagcccaggcg

SEQ ID NO: 1469935 - RNA, 12 nt, Pseudomonas aeruginosa PA01
aggugcccugga

SEQ ID NO: 1469936 - RNA, 20 nt, Pseudomonas aeruginosa PA01
aggugcgagucaccccgacc

SEQ ID NO: 1469937 - RNA, 16 nt, Pseudomonas aeruginosa PA01
aggugccgcucgucca

SEQ ID NO: 1469938 - RNA, 17 nt, Pseudomonas aeruginosa PA01
aggugcauguagcgcuc

SEQ ID NO: 1469939 - RNA, 19 nt, Pseudomonas aeruginosa PA01
aggugcaggaagcgccggg

SEQ ID NO: 1469940 - RNA, 13 nt, Pseudomonas aeruginosa PA01
aggugcaggccgc

SEQ ID NO: 1469941 - RNA, 19 nt, Pseudomonas aeruginosa PA01
aggugcaggccgcgcgaug

SEQ ID NO: 1469942 - RNA, 16 nt, Pseudomonas aeruginosa PA01
aggucgacgccauggc

SEQ ID NO: 1469943 - RNA, 17 nt, Pseudomonas aeruginosa PA01
aggucgacgccgccgag

SEQ ID NO: 1469944 - RNA, 19 nt, Pseudomonas aeruginosa PA01
aggucgacgccgccgagca

SEQ ID NO: 1469945 - RNA, 14 nt, Pseudomonas aeruginosa PA01
aggucgacggcggc

SEQ ID NO: 1469946 - RNA, 20 nt, Pseudomonas aeruginosa PA01
aggucgacggcggccgccau

SEQ ID NO: 1469947 - RNA, 18 nt, Pseudomonas aeruginosa PA01
aggucgagcaguuccggc

SEQ ID NO: 1469948 - RNA, 14 nt, Pseudomonas aeruginosa PA01
aggucgaggcgcuc

SEQ ID NO: 1469949 - RNA, 18 nt, Pseudomonas aeruginosa PA01
aggucgcacgcagcgccg

SEQ ID NO: 1469950 - RNA, 19 nt, Pseudomonas aeruginosa PA01
aggucgcacgcagcgccgc

SEQ ID NO: 1469951 - RNA, 16 nt, Pseudomonas aeruginosa PA01
aggucgcagcguucca

SEQ ID NO: 1469952 - RNA, 13 nt, Pseudomonas aeruginosa PA01
aggucgccagcgc

SEQ ID NO: 1469953 - RNA, 22 nt, Pseudomonas aeruginosa PA01
aggucgaccagccagucggcgg

SEQ ID NO: 1469954 - RNA, 20 nt, Pseudomonas aeruginosa PA01
aggucgaacugcacccgccg

SEQ ID NO: 1469955 - RNA, 15 nt, Pseudomonas aeruginosa PA01
aggucaugcccaggc

SEQ ID NO: 1469956 - RNA, 16 nt, Pseudomonas aeruginosa PA01
aggucgguccgccgau

SEQ ID NO: 1469957 - RNA, 14 nt, Pseudomonas aeruginosa PA01
aggucggucggcgg

SEQ ID NO: 1469958 - RNA, 22 nt, Pseudomonas aeruginosa PA01
aggucggucucgccaccccgcu

SEQ ID NO: 1469959 - RNA, 12 nt, Pseudomonas aeruginosa PA01
aggucgucgagg

SEQ ID NO: 1469960 - RNA, 17 nt, Pseudomonas aeruginosa PA01
aggucgucgggcagagu

SEQ ID NO: 1469961 - RNA, 22 nt, Pseudomonas aeruginosa PA01
aggucgucgcgcuugagcaggg

SEQ ID NO: 1469962 - RNA, 21 nt, Pseudomonas aeruginosa PA01
aggucgucgucacgcaggcuu

SEQ ID NO: 1469963 - RNA, 20 nt, Pseudomonas aeruginosa PA01
aggucgucucagaccuuccu

SEQ ID NO: 1469964 - RNA, 14 nt, Pseudomonas aeruginosa PA01
aggucggcggcggg

SEQ ID NO: 1469965 - RNA, 14 nt, Pseudomonas aeruginosa PA01
aggucggcgcgcac

SEQ ID NO: 1469966 - RNA, 11 nt, Pseudomonas aeruginosa PA01
aggucggcggc

SEQ ID NO: 1469967 - RNA, 22 nt, Pseudomonas aeruginosa PA01
aggucggcggcagcugcggcgg

SEQ ID NO: 1469968 - RNA, 14 nt, Pseudomonas aeruginosa PA01
aggucggcgccggu

SEQ ID NO: 1469969 - RNA, 15 nt, Pseudomonas aeruginosa PA01
aggucggcgccggug

SEQ ID NO: 1469970 - RNA, 21 nt, Pseudomonas aeruginosa PA01
aggucggcgucuuccggcucg

SEQ ID NO: 1469971 - RNA, 16 nt, Pseudomonas aeruginosa PA01
aggucgggcaacggcu

SEQ ID NO: 1469972 - RNA, 19 nt, Pseudomonas aeruginosa PA01
agggcaccgacgaugggca

SEQ ID NO: 1469973 - RNA, 24 nt, Pseudomonas aeruginosa PA01
agggcaagguaguccaucaccgcg

SEQ ID NO: 1469974 - RNA, 16 nt, Pseudomonas aeruginosa PA01
agggcaacgccaggcu

SEQ ID NO: 1469975 - RNA, 14 nt, Pseudomonas aeruginosa PA01
agggcaaaggcgcg

SEQ ID NO: 1469976 - RNA, 15 nt, Pseudomonas aeruginosa PA01
agggcaaaggcgcgc

SEQ ID NO: 1469977 - RNA, 16 nt, Pseudomonas aeruginosa PA01
agggaucgcgcggcug

SEQ ID NO: 1469978 - RNA, 17 nt, Pseudomonas aeruginosa PA01
agggaucgcgcggcugg

SEQ ID NO: 1469979 - RNA, 18 nt, Pseudomonas aeruginosa PA01
agggaucgcgcggcuggc

SEQ ID NO: 1469980 - RNA, 22 nt, Pseudomonas aeruginosa PA01
agggaugccggcggcaucccuu

SEQ ID NO: 1469981 - RNA, 19 nt, Pseudomonas aeruginosa PA01
agggauguuccaggcccgc

SEQ ID NO: 1469982 - RNA, 21 nt, Pseudomonas aeruginosa PA01
agggauguuccaggcccgccg

SEQ ID NO: 1469983 - RNA, 19 nt, Pseudomonas aeruginosa PA01
agggcaugaccgauggcgc

SEQ ID NO: 1469984 - RNA, 14 nt, Pseudomonas aeruginosa PA01
agggcaucgacgau

SEQ ID NO: 1469985 - RNA, 17 nt, Pseudomonas aeruginosa PA01
agggcauauucauagcc

SEQ ID NO: 1469986 - RNA, 17 nt, Pseudomonas aeruginosa PA01
agggcauccagggucgc

SEQ ID NO: 1469987 - RNA, 23 nt, Pseudomonas aeruginosa PA01
agggcauuggccaucagcgccgc

SEQ ID NO: 1469988 - RNA, 12 nt, Pseudomonas aeruginosa PA01
agggcauggguc

SEQ ID NO: 1469989 - RNA, 20 nt, Pseudomonas aeruginosa PA01
agggcaugggucagcgccag

SEQ ID NO: 1469990 - RNA, 13 nt, Pseudomonas aeruginosa PA01
agggcagcagguc

SEQ ID NO: 1469991 - RNA, 20 nt, Pseudomonas aeruginosa PA01
agggcagggaguccgccagc

SEQ ID NO: 1469992 - RNA, 18 nt, Pseudomonas aeruginosa PA01
agggcaguacguggcgcu

SEQ ID NO: 1469993 - RNA, 15 nt, Pseudomonas aeruginosa PA01
agggguggccaggcg

SEQ ID NO: 1469994 - RNA, 22 nt, Pseudomonas aeruginosa PA01
agggguggccaggcgcaccagc

SEQ ID NO: 1469995 - RNA, 14 nt, Pseudomonas aeruginosa PA01
aggguagcgccgcg

SEQ ID NO: 1469996 - RNA, 23 nt, Pseudomonas aeruginosa PA01
aggggcuuucuucgccuggcgcg

SEQ ID NO: 1469997 - RNA, 21 nt, Pseudomonas aeruginosa PA01
aggggcuuuuucguauccgcg

SEQ ID NO: 1469998 - RNA, 16 nt, Pseudomonas aeruginosa PA01
agggggaucgcgaaga

SEQ ID NO: 1469999 - RNA, 23 nt, Pseudomonas aeruginosa PA01
agggggugaagcgcaggcggcug

SEQ ID NO: 1470000 - RNA, 15 nt, Pseudomonas aeruginosa PA01
agggcaucgccgaca

SEQ ID NO: 1470001 - RNA, 13 nt, Pseudomonas aeruginosa PA01
agggccagccaga

SEQ ID NO: 1470002 - RNA, 17 nt, Pseudomonas aeruginosa PA01
aggggcuacuucgccgg

SEQ ID NO: 1470003 - RNA, 17 nt, Pseudomonas aeruginosa PA01
aggggcuagucgcgcag

SEQ ID NO: 1470004 - RNA, 18 nt, Pseudomonas aeruginosa PA01
aggggcugaacagcgcca

SEQ ID NO: 1470005 - RNA, 19 nt, Pseudomonas aeruginosa PA01
agggccaggaaaucgagcg

SEQ ID NO: 1470006 - RNA, 20 nt, Pseudomonas aeruginosa PA01
agggccaggagcaucggcgc

SEQ ID NO: 1470007 - RNA, 12 nt, Pseudomonas aeruginosa PA01
agggccaggccg

SEQ ID NO: 1470008 - RNA, 19 nt, Pseudomonas aeruginosa PA01
agggccaggccgagcgcgc

SEQ ID NO: 1470009 - RNA, 21 nt, Pseudomonas aeruginosa PA01
agggccaggccgagcgcgccg

SEQ ID NO: 1470010 - RNA, 22 nt, Pseudomonas aeruginosa PA01
agggccagggaggcgcuggcca

SEQ ID NO: 1470011 - RNA, 13 nt, Pseudomonas aeruginosa PA01
agggccagcgccu

SEQ ID NO: 1470012 - RNA, 13 nt, Pseudomonas aeruginosa PA01
agggucacgcugg

SEQ ID NO: 1470013 - RNA, 17 nt, Pseudomonas aeruginosa PA01
agggucacgcugggcag

SEQ ID NO: 1470014 - RNA, 12 nt, Pseudomonas aeruginosa PA01
agggucagcagc

SEQ ID NO: 1470015 - RNA, 13 nt, Pseudomonas aeruginosa PA01
agggucagcagcg

SEQ ID NO: 1470016 - RNA, 19 nt, Pseudomonas aeruginosa PA01
agggucagcagcgccagua

SEQ ID NO: 1470017 - RNA, 14 nt, Pseudomonas aeruginosa PA01
agggugcugcccag

SEQ ID NO: 1470018 - RNA, 14 nt, Pseudomonas aeruginosa PA01
aggguggccagggu

SEQ ID NO: 1470019 - RNA, 16 nt, Pseudomonas aeruginosa PA01
agggugcgggcgcggg

SEQ ID NO: 1470020 - RNA, 17 nt, Pseudomonas aeruginosa PA01
aggguggcgaccgccgu

SEQ ID NO: 1470021 - RNA, 19 nt, Pseudomonas aeruginosa PA01
aggguggcgcccaugccgc

SEQ ID NO: 1470022 - RNA, 11 nt, Pseudomonas aeruginosa PA01
aggguggcgcu

SEQ ID NO: 1470023 - RNA, 15 nt, Pseudomonas aeruginosa PA01
aggguggcgcugccu

SEQ ID NO: 1470024 - RNA, 18 nt, Pseudomonas aeruginosa PA01
aggguggcgcugccuucg

SEQ ID NO: 1470025 - RNA, 14 nt, Pseudomonas aeruginosa PA01
aggguggcgcuggc

SEQ ID NO: 1470026 - RNA, 21 nt, Pseudomonas aeruginosa PA01
aggguguacuugacggcgccg

SEQ ID NO: 1470027 - RNA, 23 nt, Pseudomonas aeruginosa PA01
aggguguacuugacggcgccgau

SEQ ID NO: 1470028 - RNA, 18 nt, Pseudomonas aeruginosa PA01
aggguguagguauccgcc

SEQ ID NO: 1470029 - RNA, 19 nt, Pseudomonas aeruginosa PA01
aggguguagguauccgccg

SEQ ID NO: 1470030 - RNA, 16 nt, Pseudomonas aeruginosa PA01
aggguggucagccagc

SEQ ID NO: 1470031 - RNA, 23 nt, Pseudomonas aeruginosa PA01
aggguggucagccagccgagcaa

SEQ ID NO: 1470032 - RNA, 16 nt, Pseudomonas aeruginosa PA01
agguacaacggcaucg

SEQ ID NO: 1470033 - RNA, 19 nt, Pseudomonas aeruginosa PA01
agguacaccaggguggcgc

SEQ ID NO: 1470034 - RNA, 16 nt, Pseudomonas aeruginosa PA01
agguagcgcugcgcca

SEQ ID NO: 1470035 - RNA, 20 nt, Pseudomonas aeruginosa PA01
agguagaaauagaaggucac

SEQ ID NO: 1470036 - RNA, 20 nt, Pseudomonas aeruginosa PA01
agguagaagaacaucggcgc

SEQ ID NO: 1470037 - RNA, 22 nt, Pseudomonas aeruginosa PA01
agguagaccacgcaggccagcg

SEQ ID NO: 1470038 - RNA, 14 nt, Pseudomonas aeruginosa PA01
agguagccgcgccg

SEQ ID NO: 1470039 - RNA, 16 nt, Pseudomonas aeruginosa PA01
agguagccgcgccggc

SEQ ID NO: 1470040 - RNA, 18 nt, Pseudomonas aeruginosa PA01
agguagccgcgccggccg

SEQ ID NO: 1470041 - RNA, 19 nt, Pseudomonas aeruginosa PA01
agguagccugcggccagcg

SEQ ID NO: 1470042 - RNA, 22 nt, Pseudomonas aeruginosa PA01
agguagccugcggccagcgcca

SEQ ID NO: 1470043 - RNA, 13 nt, Pseudomonas aeruginosa PA01
agguacggcgccg

SEQ ID NO: 1470044 - RNA, 14 nt, Pseudomonas aeruginosa PA01
agguagaccgccuc

SEQ ID NO: 1470045 - RNA, 19 nt, Pseudomonas aeruginosa PA01
agguagagaugcagcaggu

SEQ ID NO: 1470046 - RNA, 18 nt, Pseudomonas aeruginosa PA01
agguagagcacgccgucg

SEQ ID NO: 1470047 - RNA, 14 nt, Pseudomonas aeruginosa PA01
agguacucgccggc

SEQ ID NO: 1470048 - RNA, 15 nt, Pseudomonas aeruginosa PA01
agguacucgccggcg

SEQ ID NO: 1470049 - RNA, 18 nt, Pseudomonas aeruginosa PA01
agguagcugcgccgccuu

SEQ ID NO: 1470050 - RNA, 13 nt, Pseudomonas aeruginosa PA01
agguaggcgcggg

SEQ ID NO: 1470051 - RNA, 23 nt, Pseudomonas aeruginosa PA01
aggucaaugccacgugcggggug

SEQ ID NO: 1470052 - RNA, 14 nt, Pseudomonas aeruginosa PA01
aggucaccgcgccg

SEQ ID NO: 1470053 - RNA, 19 nt, Pseudomonas aeruginosa PA01
aggucaccagguugcccgg

SEQ ID NO: 1470054 - RNA, 21 nt, Pseudomonas aeruginosa PA01
aggucaccagguugcccggcu

SEQ ID NO: 1470055 - RNA, 23 nt, Pseudomonas aeruginosa PA01
aggucaccagguugcccggcuug

SEQ ID NO: 1470056 - RNA, 13 nt, Pseudomonas aeruginosa PA01
aggucagcccgug

SEQ ID NO: 1470057 - RNA, 22 nt, Pseudomonas aeruginosa PA01
aggucagcccguguucggccag

SEQ ID NO: 1470058 - RNA, 15 nt, Pseudomonas aeruginosa PA01
aggucagcacgccuu

SEQ ID NO: 1470059 - RNA, 16 nt, Pseudomonas aeruginosa PA01
aggucagccaccugcu

SEQ ID NO: 1470060 - RNA, 15 nt, Pseudomonas aeruginosa PA01
aguccgccagccggc

SEQ ID NO: 1470061 - RNA, 13 nt, Pseudomonas aeruginosa PA01
agucccgccaggc

SEQ ID NO: 1470062 - RNA, 17 nt, Pseudomonas aeruginosa PA01
agucccuggccggcgau

SEQ ID NO: 1470063 - RNA, 17 nt, Pseudomonas aeruginosa PA01
aguccgcgcgcgcgcuc

SEQ ID NO: 1470064 - RNA, 15 nt, Pseudomonas aeruginosa PA01
aguccugcugcgaca

SEQ ID NO: 1470065 - RNA, 22 nt, Pseudomonas aeruginosa PA01
aguccugcugcgacaguucgcg

SEQ ID NO: 1470066 - RNA, 16 nt, Pseudomonas aeruginosa PA01
aguccuggccgagcau

SEQ ID NO: 1470067 - RNA, 17 nt, Pseudomonas aeruginosa PA01
aguccuggcgguagccc

SEQ ID NO: 1470068 - RNA, 17 nt, Pseudomonas aeruginosa PA01
aguccaccaggcgccgg

SEQ ID NO: 1470069 - RNA, 17 nt, Pseudomonas aeruginosa PA01
agucccgcaaagcccgc

SEQ ID NO: 1470070 - RNA, 13 nt, Pseudomonas aeruginosa PA01
agucauaggucac

SEQ ID NO: 1470071 - RNA, 15 nt, Pseudomonas aeruginosa PA01
aguaagugccgacca

SEQ ID NO: 1470072 - RNA, 15 nt, Pseudomonas aeruginosa PA01
aguaauuuuguggag

SEQ ID NO: 1470073 - RNA, 14 nt, Pseudomonas aeruginosa PA01
aguaccgccggcag

SEQ ID NO: 1470074 - RNA, 15 nt, Pseudomonas aeruginosa PA01
aguacagcucggcgc

SEQ ID NO: 1470075 - RNA, 17 nt, Pseudomonas aeruginosa PA01
aguacagcucggcgccc

SEQ ID NO: 1470076 - RNA, 15 nt, Pseudomonas aeruginosa PA01
aguaucgcccuggcc

SEQ ID NO: 1470077 - RNA, 21 nt, Pseudomonas aeruginosa PA01
agguucaggguggcgaucacg

SEQ ID NO: 1470078 - RNA, 14 nt, Pseudomonas aeruginosa PA01
agguucaggucgau

SEQ ID NO: 1470079 - RNA, 16 nt, Pseudomonas aeruginosa PA01
agguucaucgccgcca

SEQ ID NO: 1470080 - RNA, 20 nt, Pseudomonas aeruginosa PA01
agguucaucgccgccaggca

SEQ ID NO: 1470081 - RNA, 16 nt, Pseudomonas aeruginosa PA01
agguucaggccgggca

SEQ ID NO: 1470082 - RNA, 21 nt, Pseudomonas aeruginosa PA01
agguucaggccgggcaggccg

SEQ ID NO: 1470083 - RNA, 12 nt, Pseudomonas aeruginosa PA01
aggugucgccgc

SEQ ID NO: 1470084 - RNA, 16 nt, Pseudomonas aeruginosa PA01
agguguucggcggcgu

SEQ ID NO: 1470085 - RNA, 19 nt, Pseudomonas aeruginosa PA01
agguguucguccagaugcu

SEQ ID NO: 1470086 - RNA, 13 nt, Pseudomonas aeruginosa PA01
aggugugcagguu

SEQ ID NO: 1470087 - RNA, 14 nt, Pseudomonas aeruginosa PA01
aggugggcgcgccg

SEQ ID NO: 1470088 - RNA, 23 nt, Pseudomonas aeruginosa PA01
agguggcguugcagggugcguac

SEQ ID NO: 1470089 - RNA, 14 nt, Pseudomonas aeruginosa PA01
agguggcuggucag

SEQ ID NO: 1470090 - RNA, 17 nt, Pseudomonas aeruginosa PA01
agguggcuuuccagcau

SEQ ID NO: 1470091 - RNA, 20 nt, Pseudomonas aeruginosa PA01
aggugggcagcagcgaacgc

SEQ ID NO: 1470092 - RNA, 14 nt, Pseudomonas aeruginosa PA01
agguggcgccgccg

SEQ ID NO: 1470093 - RNA, 16 nt, Pseudomonas aeruginosa PA01
agguggcgccgccggc

SEQ ID NO: 1470094 - RNA, 23 nt, Pseudomonas aeruginosa PA01
agguggcgccgccggcgaacggc

SEQ ID NO: 1470095 - RNA, 20 nt, Pseudomonas aeruginosa PA01
agguggcgcucacgcucgac

SEQ ID NO: 1470096 - RNA, 18 nt, Pseudomonas aeruginosa PA01
agguggcgggucggcgga

SEQ ID NO: 1470097 - RNA, 20 nt, Pseudomonas aeruginosa PA01
aggugcgccgagcgcucgcc

SEQ ID NO: 1470098 - RNA, 18 nt, Pseudomonas aeruginosa PA01
agguggauugcagcgucg

SEQ ID NO: 1470099 - RNA, 17 nt, Pseudomonas aeruginosa PA01
agguggaucgcggcgua

SEQ ID NO: 1470100 - RNA, 17 nt, Pseudomonas aeruginosa PA01
aggugcuuggcaccgcg

SEQ ID NO: 1470101 - RNA, 15 nt, Pseudomonas aeruginosa PA01
agguggaagcgcgcg

SEQ ID NO: 1470102 - RNA, 16 nt, Pseudomonas aeruginosa PA01
agguucuggucgccga

SEQ ID NO: 1470103 - RNA, 16 nt, Pseudomonas aeruginosa PA01
agguucugccagagcg

SEQ ID NO: 1470104 - RNA, 22 nt, Pseudomonas aeruginosa PA01
agguucugccagagcgcugccu

SEQ ID NO: 1470105 - RNA, 17 nt, Pseudomonas aeruginosa PA01
agguuccgcggcgacgg

SEQ ID NO: 1470106 - RNA, 19 nt, Pseudomonas aeruginosa PA01
agguuccgcggcgacggcu

SEQ ID NO: 1470107 - RNA, 22 nt, Pseudomonas aeruginosa PA01
agguucgcguggcccggcgcgg

SEQ ID NO: 1470108 - RNA, 13 nt, Pseudomonas aeruginosa PA01
agguucggcaggu

SEQ ID NO: 1470109 - RNA, 19 nt, Pseudomonas aeruginosa PA01
agguucgaaugcugcccgg

SEQ ID NO: 1470110 - RNA, 18 nt, Pseudomonas aeruginosa PA01
agguugaccccgcggccg

SEQ ID NO: 1470111 - RNA, 21 nt, Pseudomonas aeruginosa PA01
agguugccgccgaucagcgcg

SEQ ID NO: 1470112 - RNA, 16 nt, Pseudomonas aeruginosa PA01
agguugccggcgugca

SEQ ID NO: 1470113 - RNA, 22 nt, Pseudomonas aeruginosa PA01
agguugccgugcagcuuggcga

SEQ ID NO: 1470114 - RNA, 20 nt, Pseudomonas aeruginosa PA01
agguugcgcaaccagcgcuc

SEQ ID NO: 1470115 - RNA, 14 nt, Pseudomonas aeruginosa PA01
agguugcgcuggcg

SEQ ID NO: 1470116 - RNA, 20 nt, Pseudomonas aeruginosa PA01
agguugcuguagaaugcgcg

SEQ ID NO: 1470117 - RNA, 19 nt, Pseudomonas aeruginosa PA01
agguuggccuggcccggcg

SEQ ID NO: 1470118 - RNA, 16 nt, Pseudomonas aeruginosa PA01
agguuggcgccgggcg

SEQ ID NO: 1470119 - RNA, 19 nt, Pseudomonas aeruginosa PA01
agguuggcgccgggcgcga

SEQ ID NO: 1470120 - RNA, 21 nt, Pseudomonas aeruginosa PA01
agguuggcgccgggcgcgaug

SEQ ID NO: 1470121 - RNA, 20 nt, Pseudomonas aeruginosa PA01
agguuggucugcucggcgau

SEQ ID NO: 1470122 - RNA, 16 nt, Pseudomonas aeruginosa PA01
agguuguccagggcau

SEQ ID NO: 1470123 - RNA, 18 nt, Pseudomonas aeruginosa PA01
agguugugaucgaccucg

SEQ ID NO: 1470124 - RNA, 23 nt, Pseudomonas aeruginosa PA01
agguugugcucgaucaccaccac

SEQ ID NO: 1470125 - RNA, 15 nt, Pseudomonas aeruginosa PA01
aguuccacgaagaac

SEQ ID NO: 1470126 - RNA, 16 nt, Pseudomonas aeruginosa PA01
aguucaucgagcaggu

SEQ ID NO: 1470127 - RNA, 23 nt, Pseudomonas aeruginosa PA01
agugucgcgaacucggcgccgau

SEQ ID NO: 1470128 - RNA, 17 nt, Pseudomonas aeruginosa PA01
aguucagggcguagcgg

SEQ ID NO: 1470129 - RNA, 21 nt, Pseudomonas aeruginosa PA01
agugguuccaggagggcugcu

SEQ ID NO: 1470130 - RNA, 16 nt, Pseudomonas aeruginosa PA01
agugguugcgcacgcu

SEQ ID NO: 1470131 - RNA, 17 nt, Pseudomonas aeruginosa PA01
aguggugaugcguugca

SEQ ID NO: 1470132 - RNA, 17 nt, Pseudomonas aeruginosa PA01
agucgacccaggcccag

SEQ ID NO: 1470133 - RNA, 13 nt, Pseudomonas aeruginosa PA01
agucgacgccggu

SEQ ID NO: 1470134 - RNA, 21 nt, Pseudomonas aeruginosa PA01
agucgagcaguucccccagca

SEQ ID NO: 1470135 - RNA, 13 nt, Pseudomonas aeruginosa PA01
agucgagcauguc

SEQ ID NO: 1470136 - RNA, 13 nt, Pseudomonas aeruginosa PA01
agucgagccggau

SEQ ID NO: 1470137 - RNA, 21 nt, Pseudomonas aeruginosa PA01
agucgaugaacaagugcucga

SEQ ID NO: 1470138 - RNA, 15 nt, Pseudomonas aeruginosa PA01
agucgaucaggucgc

SEQ ID NO: 1470139 - RNA, 20 nt, Pseudomonas aeruginosa PA01
agucgaucaggucgccgccg

SEQ ID NO: 1470140 - RNA, 23 nt, Pseudomonas aeruginosa PA01
agucgagagcggguagcgccggu

SEQ ID NO: 1470141 - RNA, 21 nt, Pseudomonas aeruginosa PA01
agucgaugacgaggcccgccc

SEQ ID NO: 1470142 - RNA, 15 nt, Pseudomonas aeruginosa PA01
agucgcagcucggug

SEQ ID NO: 1470143 - RNA, 21 nt, Pseudomonas aeruginosa PA01
aguucgucgaugaugccgucu

SEQ ID NO: 1470144 - RNA, 16 nt, Pseudomonas aeruginosa PA01
aguucgucgccacgcc

SEQ ID NO: 1470145 - RNA, 21 nt, Pseudomonas aeruginosa PA01
aguucgucgccacgcccgccg

SEQ ID NO: 1470146 - RNA, 15 nt, Pseudomonas aeruginosa PA01
aguucggugccgccg

SEQ ID NO: 1470147 - RNA, 17 nt, Pseudomonas aeruginosa PA01
aguucggugccgccggc

SEQ ID NO: 1470148 - RNA, 19 nt, Pseudomonas aeruginosa PA01
aguucggggucggccugcg

SEQ ID NO: 1470149 - RNA, 18 nt, Pseudomonas aeruginosa PA01
aguuccgacugcgagccg

SEQ ID NO: 1470150 - RNA, 12 nt, Pseudomonas aeruginosa PA01
aguuccgcgcaa

SEQ ID NO: 1470151 - RNA, 23 nt, Pseudomonas aeruginosa PA01
aguucccgccgcucugcuggccg

SEQ ID NO: 1470152 - RNA, 20 nt, Pseudomonas aeruginosa PA01
aguuccucgcggaagcguug

SEQ ID NO: 1470153 - RNA, 14 nt, Pseudomonas aeruginosa PA01
aguugacgucgccg

SEQ ID NO: 1470154 - RNA, 16 nt, Pseudomonas aeruginosa PA01
aguugacgucgccgau

SEQ ID NO: 1470155 - RNA, 18 nt, Pseudomonas aeruginosa PA01
aguugauggucaggcugg

SEQ ID NO: 1470156 - RNA, 20 nt, Pseudomonas aeruginosa PA01
aguugcaggccagcgccagg

SEQ ID NO: 1470157 - RNA, 13 nt, Pseudomonas aeruginosa PA01
aguugcaggccgg

SEQ ID NO: 1470158 - RNA, 13 nt, Pseudomonas aeruginosa PA01
aguugcagcaccc

SEQ ID NO: 1470159 - RNA, 14 nt, Pseudomonas aeruginosa PA01
aguugcaacagcgc

SEQ ID NO: 1470160 - RNA, 17 nt, Pseudomonas aeruginosa PA01
aguugcaacagcgcggc

SEQ ID NO: 1470161 - RNA, 15 nt, Pseudomonas aeruginosa PA01
aguucgucaaccagc

SEQ ID NO: 1470162 - RNA, 22 nt, Pseudomonas aeruginosa PA01
aguucguugggccggaacggcu

SEQ ID NO: 1470163 - RNA, 21 nt, Pseudomonas aeruginosa PA01
aguucugggcggccagguuga

SEQ ID NO: 1470164 - RNA, 22 nt, Pseudomonas aeruginosa PA01
aguucuucgccgcccgcgccuc

SEQ ID NO: 1470165 - RNA, 13 nt, Pseudomonas aeruginosa PA01
aguuuagccgcca

SEQ ID NO: 1470166 - RNA, 21 nt, Pseudomonas aeruginosa PA01
aguuguuccggguugguggcc

SEQ ID NO: 1470167 - RNA, 15 nt, Pseudomonas aeruginosa PA01
aguuggugcacgcgc

SEQ ID NO: 1470168 - RNA, 23 nt, Pseudomonas aeruginosa PA01
aguugccgagcuugaccuugccg

SEQ ID NO: 1470169 - RNA, 17 nt, Pseudomonas aeruginosa PA01
aguugccgccagcgcgg

SEQ ID NO: 1470170 - RNA, 13 nt, Pseudomonas aeruginosa PA01
auaaugcgcacca

SEQ ID NO: 1470171 - RNA, 22 nt, Pseudomonas aeruginosa PA01
auaaugcgcaccacucccggcg

SEQ ID NO: 1470172 - RNA, 17 nt, Pseudomonas aeruginosa PA01
auacccuggccggccuc

SEQ ID NO: 1470173 - RNA, 18 nt, Pseudomonas aeruginosa PA01
auacccugggagccgccg

SEQ ID NO: 1470174 - RNA, 23 nt, Pseudomonas aeruginosa PA01
auaccgagggugcagagcagagu

SEQ ID NO: 1470175 - RNA, 20 nt, Pseudomonas aeruginosa PA01
auaccccgguugugcgcccg

SEQ ID NO: 1470176 - RNA, 19 nt, Pseudomonas aeruginosa PA01
auaccccguuguacccggc

SEQ ID NO: 1470177 - RNA, 13 nt, Pseudomonas aeruginosa PA01
auacccagcgggc

SEQ ID NO: 1470178 - RNA, 13 nt, Pseudomonas aeruginosa PA01
auacccggcgccc

SEQ ID NO: 1470179 - RNA, 11 nt, Pseudomonas aeruginosa PA01
auaccgcugcg

SEQ ID NO: 1470180 - RNA, 21 nt, Pseudomonas aeruginosa PA01
auacgucuucgauggcggccg

SEQ ID NO: 1470181 - RNA, 23 nt, Pseudomonas aeruginosa PA01
auagaugaaggcuugccacugcg

SEQ ID NO: 1470182 - RNA, 22 nt, Pseudomonas aeruginosa PA01
auagagugcccaggcgcuggcg

SEQ ID NO: 1470183 - RNA, 17 nt, Pseudomonas aeruginosa PA01
auagcagcgccgcgccu

SEQ ID NO: 1470184 - RNA, 22 nt, Pseudomonas aeruginosa PA01
auacuccuucaaccacuccagc

SEQ ID NO: 1470185 - RNA, 14 nt, Pseudomonas aeruginosa PA01
auacugcacgccca

SEQ ID NO: 1470186 - RNA, 20 nt, Pseudomonas aeruginosa PA01
aucaacuccgccaggcgcuc

SEQ ID NO: 1470187 - RNA, 14 nt, Pseudomonas aeruginosa PA01
auagcgccacacgg

SEQ ID NO: 1470188 - RNA, 22 nt, Pseudomonas aeruginosa PA01
auagccguugaggccgucgaag

SEQ ID NO: 1470189 - RNA, 14 nt, Pseudomonas aeruginosa PA01
auagccggcgcgcc

SEQ ID NO: 1470190 - RNA, 15 nt, Pseudomonas aeruginosa PA01
auagccggcgcgccc

SEQ ID NO: 1470191 - RNA, 23 nt, Pseudomonas aeruginosa PA01
auauggaccggcucgucggcguu

SEQ ID NO: 1470192 - RNA, 15 nt, Pseudomonas aeruginosa PA01
aucagcagcgccagc

SEQ ID NO: 1470193 - RNA, 16 nt, Pseudomonas aeruginosa PA01
aucagcagcgccagca

SEQ ID NO: 1470194 - RNA, 19 nt, Pseudomonas aeruginosa PA01
aucagcaggaugcagucgg

SEQ ID NO: 1470195 - RNA, 20 nt, Pseudomonas aeruginosa PA01
aucagcaggaugcagucggc

SEQ ID NO: 1470196 - RNA, 15 nt, Pseudomonas aeruginosa PA01
aucagcaguccgcca

SEQ ID NO: 1470197 - RNA, 22 nt, Pseudomonas aeruginosa PA01
aucagcacgucguccagcgccg

SEQ ID NO: 1470198 - RNA, 13 nt, Pseudomonas aeruginosa PA01
aucagcagcagcg

SEQ ID NO: 1470199 - RNA, 15 nt, Pseudomonas aeruginosa PA01
aucagcagcagcgcc

SEQ ID NO: 1470200 - RNA, 21 nt, Pseudomonas aeruginosa PA01
aucagcgcauaggccugggcg

SEQ ID NO: 1470201 - RNA, 20 nt, Pseudomonas aeruginosa PA01
aucagcgagcuucgccgcgc

SEQ ID NO: 1470202 - RNA, 14 nt, Pseudomonas aeruginosa PA01
aucagcgcccggca

SEQ ID NO: 1470203 - RNA, 13 nt, Pseudomonas aeruginosa PA01
aucagcgccgccu

SEQ ID NO: 1470204 - RNA, 13 nt, Pseudomonas aeruginosa PA01
aucagcgcgccuu

SEQ ID NO: 1470205 - RNA, 20 nt, Pseudomonas aeruginosa PA01
aucagcgcgcguuccagguc

SEQ ID NO: 1470206 - RNA, 22 nt, Pseudomonas aeruginosa PA01
aucagcgcgcguuccaggucgc

SEQ ID NO: 1470207 - RNA, 19 nt, Pseudomonas aeruginosa PA01
aucagcccuucgcgcucga

SEQ ID NO: 1470208 - RNA, 21 nt, Pseudomonas aeruginosa PA01
aucagcccuucgcgcucgacg

SEQ ID NO: 1470209 - RNA, 22 nt, Pseudomonas aeruginosa PA01
aucagcccuucgcgcucgacga

SEQ ID NO: 1470210 - RNA, 16 nt, Pseudomonas aeruginosa PA01
aucagccgcgcgcugg

SEQ ID NO: 1470211 - RNA, 17 nt, Pseudomonas aeruginosa PA01
aucagccgcgcgcugga

SEQ ID NO: 1470212 - RNA, 21 nt, Pseudomonas aeruginosa PA01
aucagccgcgacgacugcggc

SEQ ID NO: 1470213 - RNA, 18 nt, Pseudomonas aeruginosa PA01
aucagcccgucggccucg

SEQ ID NO: 1470214 - RNA, 21 nt, Pseudomonas aeruginosa PA01
aucagcccgucggccucgccg

SEQ ID NO: 1470215 - RNA, 19 nt, Pseudomonas aeruginosa PA01
aucagccccucggccagga

SEQ ID NO: 1470216 - RNA, 13 nt, Pseudomonas aeruginosa PA01
aucagccagccca

SEQ ID NO: 1470217 - RNA, 14 nt, Pseudomonas aeruginosa PA01
aucagccagggcaa

SEQ ID NO: 1470218 - RNA, 12 nt, Pseudomonas aeruginosa PA01
aucacucgccgc

SEQ ID NO: 1470219 - RNA, 16 nt, Pseudomonas aeruginosa PA01
aucacucgccgccguc

SEQ ID NO: 1470220 - RNA, 14 nt, Pseudomonas aeruginosa PA01
aucacugccuggca

SEQ ID NO: 1470221 - RNA, 17 nt, Pseudomonas aeruginosa PA01
aucagcacccggucggc

SEQ ID NO: 1470222 - RNA, 22 nt, Pseudomonas aeruginosa PA01
aucacguugaacacaucgacca

SEQ ID NO: 1470223 - RNA, 22 nt, Pseudomonas aeruginosa PA01
aucacgucgcgcaccuggcggu

SEQ ID NO: 1470224 - RNA, 15 nt, Pseudomonas aeruginosa PA01
aucacguacggcgcc

SEQ ID NO: 1470225 - RNA, 17 nt, Pseudomonas aeruginosa PA01
aucacguacggcgccuc

SEQ ID NO: 1470226 - RNA, 19 nt, Pseudomonas aeruginosa PA01
aucacguacggcgccucga

SEQ ID NO: 1470227 - RNA, 19 nt, Pseudomonas aeruginosa PA01
aucacguaggacaggucgg

SEQ ID NO: 1470228 - RNA, 18 nt, Pseudomonas aeruginosa PA01
aucacgcaagugcccugg

SEQ ID NO: 1470229 - RNA, 14 nt, Pseudomonas aeruginosa PA01
aucacgcagcaggc

SEQ ID NO: 1470230 - RNA, 16 nt, Pseudomonas aeruginosa PA01
aucacgauggccggca

SEQ ID NO: 1470231 - RNA, 17 nt, Pseudomonas aeruginosa PA01
aucacgauggccggcag

SEQ ID NO: 1470232 - RNA, 18 nt, Pseudomonas aeruginosa PA01
aucacgcugcucgcagcc

SEQ ID NO: 1470233 - RNA, 15 nt, Pseudomonas aeruginosa PA01
aucaccuucgccagc

SEQ ID NO: 1470234 - RNA, 14 nt, Pseudomonas aeruginosa PA01
aucaccuucgcccu

SEQ ID NO: 1470235 - RNA, 19 nt, Pseudomonas aeruginosa PA01
aucaccuggaucgccaggc

SEQ ID NO: 1470236 - RNA, 21 nt, Pseudomonas aeruginosa PA01
aucacgaagcggucgccggcg

SEQ ID NO: 1470237 - RNA, 15 nt, Pseudomonas aeruginosa PA01
aucaccggcuggccc

SEQ ID NO: 1470238 - RNA, 22 nt, Pseudomonas aeruginosa PA01
aucaccggcaggaucggcgcgg

SEQ ID NO: 1470239 - RNA, 13 nt, Pseudomonas aeruginosa PA01
aucaccagcgcca

SEQ ID NO: 1470240 - RNA, 19 nt, Pseudomonas aeruginosa PA01
aucaccagcgccaggccgc

SEQ ID NO: 1470241 - RNA, 14 nt, Pseudomonas aeruginosa PA01
aucaccagcgccgu

SEQ ID NO: 1470242 - RNA, 20 nt, Pseudomonas aeruginosa PA01
aucaccagcaauugccggcg

SEQ ID NO: 1470243 - RNA, 15 nt, Pseudomonas aeruginosa PA01
aucaccgccuuggca

SEQ ID NO: 1470244 - RNA, 22 nt, Pseudomonas aeruginosa PA01
aucaccgccuuggcaucgccgc

SEQ ID NO: 1470245 - RNA, 22 nt, Pseudomonas aeruginosa PA01
aucaccgcgguggaggcggcgg

SEQ ID NO: 1470246 - RNA, 21 nt, Pseudomonas aeruginosa PA01
aucaccgcaucgaaggcgccg

SEQ ID NO: 1470247 - RNA, 20 nt, Pseudomonas aeruginosa PA01
aucacaccgaagucgcccgc

SEQ ID NO: 1470248 - RNA, 19 nt, Pseudomonas aeruginosa PA01
aucacacuguccagggcga

SEQ ID NO: 1470249 - RNA, 17 nt, Pseudomonas aeruginosa PA01
aucaccaccggcuggcg

SEQ ID NO: 1470250 - RNA, 18 nt, Pseudomonas aeruginosa PA01
aucaccaccgggaucgcu

SEQ ID NO: 1470251 - RNA, 16 nt, Pseudomonas aeruginosa PA01
aucaccagaccgucau

SEQ ID NO: 1470252 - RNA, 16 nt, Pseudomonas aeruginosa PA01
aucaccaccagcgccg

SEQ ID NO: 1470253 - RNA, 18 nt, Pseudomonas aeruginosa PA01
cccuuggcgucgcggcuu

SEQ ID NO: 1470254 - RNA, 16 nt, Pseudomonas aeruginosa PA01
cccuugcggcgcggcc

SEQ ID NO: 1470255 - RNA, 15 nt, Pseudomonas aeruginosa PA01
cccuuggccagcgcg

SEQ ID NO: 1470256 - RNA, 14 nt, Pseudomonas aeruginosa PA01
cccuuggagccgcc

SEQ ID NO: 1470257 - RNA, 22 nt, Pseudomonas aeruginosa PA01
cccuuggccagcaccaugcgcg

SEQ ID NO: 1470258 - RNA, 12 nt, Pseudomonas aeruginosa PA01
cccuugccgguc

SEQ ID NO: 1470259 - RNA, 17 nt, Pseudomonas aeruginosa PA01
cccuugcaaccgccgcc

SEQ ID NO: 1470260 - RNA, 14 nt, Pseudomonas aeruginosa PA01
cccuugcagccagc

SEQ ID NO: 1470261 - RNA, 22 nt, Pseudomonas aeruginosa PA01
cccuugagggccucggcgaagu

SEQ ID NO: 1470262 - RNA, 15 nt, Pseudomonas aeruginosa PA01
cccuucgugggccug

SEQ ID NO: 1470263 - RNA, 24 nt, Pseudomonas aeruginosa PA01
cccuucggcugcaacuuccacucg

SEQ ID NO: 1470264 - RNA, 18 nt, Pseudomonas aeruginosa PA01
cccuuccuccucgccgcu

SEQ ID NO: 1470265 - RNA, 23 nt, Pseudomonas aeruginosa PA01
cccuucgacaugggccgcgcaga

SEQ ID NO: 1470266 - RNA, 21 nt, Pseudomonas aeruginosa PA01
cccuucgacgacaccugcaac

SEQ ID NO: 1470267 - RNA, 12 nt, Pseudomonas aeruginosa PA01
cccuucgagcaa

SEQ ID NO: 1470268 - RNA, 16 nt, Pseudomonas aeruginosa PA01
cccuguuccgggccca

SEQ ID NO: 1470269 - RNA, 14 nt, Pseudomonas aeruginosa PA01
cccuguucggcggg

SEQ ID NO: 1470270 - RNA, 20 nt, Pseudomonas aeruginosa PA01
cccuguucggcgggaucgac

SEQ ID NO: 1470271 - RNA, 21 nt, Pseudomonas aeruginosa PA01
cccuguucggcgggaucgacg

SEQ ID NO: 1470272 - RNA, 22 nt, Pseudomonas aeruginosa PA01
cccuguggucaggcgccaggac

SEQ ID NO: 1470273 - RNA, 17 nt, Pseudomonas aeruginosa PA01
cccuucagcgcaccgcc

SEQ ID NO: 1470274 - RNA, 22 nt, Pseudomonas aeruginosa PA01
cccugcguggaaccgcggcgcc

SEQ ID NO: 1470275 - RNA, 17 nt, Pseudomonas aeruginosa PA01
cccugcucuuccagcgg

SEQ ID NO: 1470276 - RNA, 13 nt, Pseudomonas aeruginosa PA01
cccugcugggcgg

SEQ ID NO: 1470277 - RNA, 14 nt, Pseudomonas aeruginosa PA01
cccugcuggccggu

SEQ ID NO: 1470278 - RNA, 16 nt, Pseudomonas aeruginosa PA01
cccugcugcggcaacg

SEQ ID NO: 1470279 - RNA, 21 nt, Pseudomonas aeruginosa PA01
cccuggacccgggccuccugg

SEQ ID NO: 1470280 - RNA, 20 nt, Pseudomonas aeruginosa PA01
cccuggaaaggccucggcga

SEQ ID NO: 1470281 - RNA, 14 nt, Pseudomonas aeruginosa PA01
cccuggaagccggc

SEQ ID NO: 1470282 - RNA, 21 nt, Pseudomonas aeruginosa PA01
cccugcuggcgcagccaggcg

SEQ ID NO: 1470283 - RNA, 21 nt, Pseudomonas aeruginosa PA01
cccugcuucgaacgugcgcgc

SEQ ID NO: 1470284 - RNA, 13 nt, Pseudomonas aeruginosa PA01
ccgaacgcgcuga

SEQ ID NO: 1470285 - RNA, 19 nt, Pseudomonas aeruginosa PA01
ccgaacggcagcuggaucc

SEQ ID NO: 1470286 - RNA, 13 nt, Pseudomonas aeruginosa PA01
ccgaacgcgaggu

SEQ ID NO: 1470287 - RNA, 23 nt, Pseudomonas aeruginosa PA01
ccgaacucaugcccagcuuggcc

SEQ ID NO: 1470288 - RNA, 20 nt, Pseudomonas aeruginosa PA01
ccgaacggguagagcgggcc

SEQ ID NO: 1470289 - RNA, 22 nt, Pseudomonas aeruginosa PA01
ccgaacuccggugucaggccga

SEQ ID NO: 1470290 - RNA, 16 nt, Pseudomonas aeruginosa PA01
ccgaacugcagggcgu

SEQ ID NO: 1470291 - RNA, 22 nt, Pseudomonas aeruginosa PA01
ccgaacugcagggcgucgccgg

SEQ ID NO: 1470292 - RNA, 22 nt, Pseudomonas aeruginosa PA01
ccgaagaacgguaucggcuugc

SEQ ID NO: 1470293 - RNA, 21 nt, Pseudomonas aeruginosa PA01
ccgaagaacucggcgcugccg

SEQ ID NO: 1470294 - RNA, 14 nt, Pseudomonas aeruginosa PA01
ccgaacagccgccc

SEQ ID NO: 1470295 - RNA, 19 nt, Pseudomonas aeruginosa PA01
ccgaacagcaacaccgcgc

SEQ ID NO: 1470296 - RNA, 21 nt, Pseudomonas aeruginosa PA01
ccgaacagaggaaggcgccgg

SEQ ID NO: 1470297 - RNA, 22 nt, Pseudomonas aeruginosa PA01
ccgaacagaggaaggcgccggc

SEQ ID NO: 1470298 - RNA, 23 nt, Pseudomonas aeruginosa PA01
ccgaacagaggaaggcgccggca

SEQ ID NO: 1470299 - RNA, 15 nt, Pseudomonas aeruginosa PA01
ccgaacagcgcgcca

SEQ ID NO: 1470300 - RNA, 12 nt, Pseudomonas aeruginosa PA01
ccgaacgccgac

SEQ ID NO: 1470301 - RNA, 13 nt, Pseudomonas aeruginosa PA01
ccgaacagggcga

SEQ ID NO: 1470302 - RNA, 14 nt, Pseudomonas aeruginosa PA01
ccgaacagggcgag

SEQ ID NO: 1470303 - RNA, 17 nt, Pseudomonas aeruginosa PA01
cccuacgaaagcgccuu

SEQ ID NO: 1470304 - RNA, 17 nt, Pseudomonas aeruginosa PA01
cccuaggcgacccggca

SEQ ID NO: 1470305 - RNA, 13 nt, Pseudomonas aeruginosa PA01
cccucaaccggcg

SEQ ID NO: 1470306 - RNA, 22 nt, Pseudomonas aeruginosa PA01
cccuacggggacaugucgaggg

SEQ ID NO: 1470307 - RNA, 22 nt, Pseudomonas aeruginosa PA01
cccuacgggggcgugucgaggg

SEQ ID NO: 1470308 - RNA, 20 nt, Pseudomonas aeruginosa PA01
cccuacuccaggggucggca

SEQ ID NO: 1470309 - RNA, 17 nt, Pseudomonas aeruginosa PA01
cccguuugccgucggcg

SEQ ID NO: 1470310 - RNA, 22 nt, Pseudomonas aeruginosa PA01
cccuaccagcgcaaccgguuuc

SEQ ID NO: 1470311 - RNA, 20 nt, Pseudomonas aeruginosa PA01
cccuaccccaggggucggca

SEQ ID NO: 1470312 - RNA, 15 nt, Pseudomonas aeruginosa PA01
cccguugcgccucgc

SEQ ID NO: 1470313 - RNA, 19 nt, Pseudomonas aeruginosa PA01
cccguugcgccucgccgcc

SEQ ID NO: 1470314 - RNA, 14 nt, Pseudomonas aeruginosa PA01
cccggugucgacga

SEQ ID NO: 1470315 - RNA, 20 nt, Pseudomonas aeruginosa PA01
cccgguggaauaccgcugcg

SEQ ID NO: 1470316 - RNA, 21 nt, Pseudomonas aeruginosa PA01
cccgguggaauaccgcugcgc

SEQ ID NO: 1470317 - RNA, 22 nt, Pseudomonas aeruginosa PA01
cccgguggaauaccgcugcgcg

SEQ ID NO: 1470318 - RNA, 19 nt, Pseudomonas aeruginosa PA01
cccggucgagguugcgcgg

SEQ ID NO: 1470319 - RNA, 21 nt, Pseudomonas aeruginosa PA01
cccggucgagguugcgcggca

SEQ ID NO: 1470320 - RNA, 16 nt, Pseudomonas aeruginosa PA01
cccgguuaccggcgac

SEQ ID NO: 1470321 - RNA, 18 nt, Pseudomonas aeruginosa PA01
cccgguuacucgccggca

SEQ ID NO: 1470322 - RNA, 20 nt, Pseudomonas aeruginosa PA01
cccgguuacucgccggcauu

SEQ ID NO: 1470323 - RNA, 15 nt, Pseudomonas aeruginosa PA01
cccggugugcgcugc

SEQ ID NO: 1470324 - RNA, 12 nt, Pseudomonas aeruginosa PA01
cccugcagcgcg

SEQ ID NO: 1470325 - RNA, 20 nt, Pseudomonas aeruginosa PA01
cccugcaaagcggcgacgcc

SEQ ID NO: 1470326 - RNA, 22 nt, Pseudomonas aeruginosa PA01
cccugcaaagcggcgacgccac

SEQ ID NO: 1470327 - RNA, 18 nt, Pseudomonas aeruginosa PA01
cccugcaacacguagcgc

SEQ ID NO: 1470328 - RNA, 17 nt, Pseudomonas aeruginosa PA01
cccugcaacaggaccca

SEQ ID NO: 1470329 - RNA, 22 nt, Pseudomonas aeruginosa PA01
cccugcaauggggcggccggcg

SEQ ID NO: 1470330 - RNA, 16 nt, Pseudomonas aeruginosa PA01
cccugcacagggacgc

SEQ ID NO: 1470331 - RNA, 21 nt, Pseudomonas aeruginosa PA01
cccugcacaucaccuucgccc

SEQ ID NO: 1470332 - RNA, 23 nt, Pseudomonas aeruginosa PA01
cccugcacaucaccuucgcccuc

SEQ ID NO: 1470333 - RNA, 18 nt, Pseudomonas aeruginosa PA01
cccugcucgccggcgcgg

SEQ ID NO: 1470334 - RNA, 24 nt, Pseudomonas aeruginosa PA01
cccugcgggacccagacaggccug

SEQ ID NO: 1470335 - RNA, 12 nt, Pseudomonas aeruginosa PA01
cccugcaucgcg

SEQ ID NO: 1470336 - RNA, 21 nt, Pseudomonas aeruginosa PA01
cccugccacuugcgggugcgc

SEQ ID NO: 1470337 - RNA, 13 nt, Pseudomonas aeruginosa PA01
cccugccagcggg

SEQ ID NO: 1470338 - RNA, 15 nt, Pseudomonas aeruginosa PA01
cccugccagcgggcg

SEQ ID NO: 1470339 - RNA, 16 nt, Pseudomonas aeruginosa PA01
cccugccagcgggcgc

SEQ ID NO: 1470340 - RNA, 19 nt, Pseudomonas aeruginosa PA01
cccugccagcgggcgccgc

SEQ ID NO: 1470341 - RNA, 17 nt, Pseudomonas aeruginosa PA01
cccucgcccaggugcgc

SEQ ID NO: 1470342 - RNA, 14 nt, Pseudomonas aeruginosa PA01
cccucgcagccggc

SEQ ID NO: 1470343 - RNA, 20 nt, Pseudomonas aeruginosa PA01
cccucgcaguacagcucggc

SEQ ID NO: 1470344 - RNA, 17 nt, Pseudomonas aeruginosa PA01
cccucgauguaggccuc

SEQ ID NO: 1470345 - RNA, 18 nt, Pseudomonas aeruginosa PA01
cccuauucgcugucaggg

SEQ ID NO: 1470346 - RNA, 12 nt, Pseudomonas aeruginosa PA01
cccucagcggcg

SEQ ID NO: 1470347 - RNA, 16 nt, Pseudomonas aeruginosa PA01
cccucacaccaccagc

SEQ ID NO: 1470348 - RNA, 17 nt, Pseudomonas aeruginosa PA01
cccucacaccaccagca

SEQ ID NO: 1470349 - RNA, 17 nt, Pseudomonas aeruginosa PA01
cccucggcgccgagcau

SEQ ID NO: 1470350 - RNA, 15 nt, Pseudomonas aeruginosa PA01
cccucggcgcuggcc

SEQ ID NO: 1470351 - RNA, 16 nt, Pseudomonas aeruginosa PA01
cccucggcgcuggcca

SEQ ID NO: 1470352 - RNA, 12 nt, Pseudomonas aeruginosa PA01
cccucggcggcg

SEQ ID NO: 1470353 - RNA, 13 nt, Pseudomonas aeruginosa PA01
cccucggcguuca

SEQ ID NO: 1470354 - RNA, 15 nt, Pseudomonas aeruginosa PA01
cccucggcuucgucc

SEQ ID NO: 1470355 - RNA, 22 nt, Pseudomonas aeruginosa PA01
cccucggcgaccaacagggcgu

SEQ ID NO: 1470356 - RNA, 14 nt, Pseudomonas aeruginosa PA01
cccucggcgagggu

SEQ ID NO: 1470357 - RNA, 19 nt, Pseudomonas aeruginosa PA01
cccucgcgcuggacccgca

SEQ ID NO: 1470358 - RNA, 18 nt, Pseudomonas aeruginosa PA01
cccucgcggacgcuggcg

SEQ ID NO: 1470359 - RNA, 16 nt, Pseudomonas aeruginosa PA01
cccucggaugccgcac

SEQ ID NO: 1470360 - RNA, 17 nt, Pseudomonas aeruginosa PA01
cccucggccaggaccag

SEQ ID NO: 1470361 - RNA, 15 nt, Pseudomonas aeruginosa PA01
cccucggccaggcau

SEQ ID NO: 1470362 - RNA, 13 nt, Pseudomonas aeruginosa PA01
cccucgcggcggc

SEQ ID NO: 1470363 - RNA, 22 nt, Pseudomonas aeruginosa PA01
cccucgcggcggcaggccagcu

SEQ ID NO: 1470364 - RNA, 14 nt, Pseudomonas aeruginosa PA01
ccgaccggcgccgg

SEQ ID NO: 1470365 - RNA, 14 nt, Pseudomonas aeruginosa PA01
ccgaccgccaggcc

SEQ ID NO: 1470366 - RNA, 22 nt, Pseudomonas aeruginosa PA01
ccgaccgccaggccgacccgca

SEQ ID NO: 1470367 - RNA, 17 nt, Pseudomonas aeruginosa PA01
ccgaccgcaccgccagc

SEQ ID NO: 1470368 - RNA, 20 nt, Pseudomonas aeruginosa PA01
ccgaccggggaguucgaccc

SEQ ID NO: 1470369 - RNA, 13 nt, Pseudomonas aeruginosa PA01
ccgaccucggccg

SEQ ID NO: 1470370 - RNA, 15 nt, Pseudomonas aeruginosa PA01
ccgaccucggccgcc

SEQ ID NO: 1470371 - RNA, 16 nt, Pseudomonas aeruginosa PA01
ccgaccucggccgcca

SEQ ID NO: 1470372 - RNA, 14 nt, Pseudomonas aeruginosa PA01
ccgaccuugccggu

SEQ ID NO: 1470373 - RNA, 16 nt, Pseudomonas aeruginosa PA01
ccgaccuugcgucuuc

SEQ ID NO: 1470374 - RNA, 16 nt, Pseudomonas aeruginosa PA01
ccgacgaacagccaga

SEQ ID NO: 1470375 - RNA, 18 nt, Pseudomonas aeruginosa PA01
ccgaccuucaccaccagc

SEQ ID NO: 1470376 - RNA, 22 nt, Pseudomonas aeruginosa PA01
ccgaccuucaccaccagcgagg

SEQ ID NO: 1470377 - RNA, 17 nt, Pseudomonas aeruginosa PA01
ccgaccuucaucaggcg

SEQ ID NO: 1470378 - RNA, 14 nt, Pseudomonas aeruginosa PA01
ccgaccgccaaggu

SEQ ID NO: 1470379 - RNA, 20 nt, Pseudomonas aeruginosa PA01
ccgaccgagcagcggacgca

SEQ ID NO: 1470380 - RNA, 15 nt, Pseudomonas aeruginosa PA01
ccgacccgugcgccg

SEQ ID NO: 1470381 - RNA, 16 nt, Pseudomonas aeruginosa PA01
ccgacccucggcgagg

SEQ ID NO: 1470382 - RNA, 15 nt, Pseudomonas aeruginosa PA01
ccgaccccacgccgg

SEQ ID NO: 1470383 - RNA, 21 nt, Pseudomonas aeruginosa PA01
ccgaccccacgccggccggcu

SEQ ID NO: 1470384 - RNA, 13 nt, Pseudomonas aeruginosa PA01
ccgacccgcagcg

SEQ ID NO: 1470385 - RNA, 15 nt, Pseudomonas aeruginosa PA01
ccgacccgcagcggc

SEQ ID NO: 1470386 - RNA, 17 nt, Pseudomonas aeruginosa PA01
ccgacccgcagcggcgc

SEQ ID NO: 1470387 - RNA, 13 nt, Pseudomonas aeruginosa PA01
ccgacccggccga

SEQ ID NO: 1470388 - RNA, 15 nt, Pseudomonas aeruginosa PA01
ccgacccggccgacc

SEQ ID NO: 1470389 - RNA, 21 nt, Pseudomonas aeruginosa PA01
ccgaccaggcggccgucggcc

SEQ ID NO: 1470390 - RNA, 22 nt, Pseudomonas aeruginosa PA01
ccgaccaggcggccgucggccu

SEQ ID NO: 1470391 - RNA, 14 nt, Pseudomonas aeruginosa PA01
ccgaccaggucgcu

SEQ ID NO: 1470392 - RNA, 20 nt, Pseudomonas aeruginosa PA01
ccgaccaggucgcuggcacc

SEQ ID NO: 1470393 - RNA, 16 nt, Pseudomonas aeruginosa PA01
ccgacccacuugaaca

SEQ ID NO: 1470394 - RNA, 17 nt, Pseudomonas aeruginosa PA01
ccgacccacuugaacac

SEQ ID NO: 1470395 - RNA, 20 nt, Pseudomonas aeruginosa PA01
ccgacccagagcgcgcccug

SEQ ID NO: 1470396 - RNA, 13 nt, Pseudomonas aeruginosa PA01
ccgaccaggccga

SEQ ID NO: 1470397 - RNA, 13 nt, Pseudomonas aeruginosa PA01
ccgaccagcgcgc

SEQ ID NO: 1470398 - RNA, 12 nt, Pseudomonas aeruginosa PA01
ccgaccagcgcc

SEQ ID NO: 1470399 - RNA, 13 nt, Pseudomonas aeruginosa PA01
ccgaccagcgccg

SEQ ID NO: 1470400 - RNA, 19 nt, Pseudomonas aeruginosa PA01
ccgaccagcgccgacuugc

SEQ ID NO: 1470401 - RNA, 21 nt, Pseudomonas aeruginosa PA01
ccgaccagcagggccagcagc

SEQ ID NO: 1470402 - RNA, 17 nt, Pseudomonas aeruginosa PA01
ccgaccacuucggcggu

SEQ ID NO: 1470403 - RNA, 19 nt, Pseudomonas aeruginosa PA01
ccgacagcacgauggcgag

SEQ ID NO: 1470404 - RNA, 14 nt, Pseudomonas aeruginosa PA01
ccgacagcggcugg

SEQ ID NO: 1470405 - RNA, 16 nt, Pseudomonas aeruginosa PA01
ccgacagcggcuggcg

SEQ ID NO: 1470406 - RNA, 16 nt, Pseudomonas aeruginosa PA01
ccgacaggcagcgccg

SEQ ID NO: 1470407 - RNA, 17 nt, Pseudomonas aeruginosa PA01
ccgacaggcagcgccgc

SEQ ID NO: 1470408 - RNA, 23 nt, Pseudomonas aeruginosa PA01
ccgacaggucgcuuucgcgcaga

SEQ ID NO: 1470409 - RNA, 19 nt, Pseudomonas aeruginosa PA01
ccgacaggucggccggcag

SEQ ID NO: 1470410 - RNA, 14 nt, Pseudomonas aeruginosa PA01
ccgacaggccggug

SEQ ID NO: 1470411 - RNA, 15 nt, Pseudomonas aeruginosa PA01
ccgacaggccggugc

SEQ ID NO: 1470412 - RNA, 15 nt, Pseudomonas aeruginosa PA01
ccgacaggcuggugc

SEQ ID NO: 1470413 - RNA, 18 nt, Pseudomonas aeruginosa PA01
ccgacaggccgaccagca

SEQ ID NO: 1470414 - RNA, 12 nt, Pseudomonas aeruginosa PA01
ccgacaggccgg

SEQ ID NO: 1470415 - RNA, 18 nt, Pseudomonas aeruginosa PA01
ccgaccaccuucaggcug

SEQ ID NO: 1470416 - RNA, 19 nt, Pseudomonas aeruginosa PA01
ccgaccaccuucaggcugc

SEQ ID NO: 1470417 - RNA, 13 nt, Pseudomonas aeruginosa PA01
ccgaccaccauca

SEQ ID NO: 1470418 - RNA, 19 nt, Pseudomonas aeruginosa PA01
ccgacaugccccgccgacu

SEQ ID NO: 1470419 - RNA, 20 nt, Pseudomonas aeruginosa PA01
ccgaccacaugggcgaccgg

SEQ ID NO: 1470420 - RNA, 21 nt, Pseudomonas aeruginosa PA01
ccgacacgugugucgacaccu

SEQ ID NO: 1470421 - RNA, 17 nt, Pseudomonas aeruginosa PA01
ccgacacguucaggcgu

SEQ ID NO: 1470422 - RNA, 18 nt, Pseudomonas aeruginosa PA01
ccgacagagcggccggcg

SEQ ID NO: 1470423 - RNA, 20 nt, Pseudomonas aeruginosa PA01
ccgacagagcggccggcgcg

SEQ ID NO: 1470424 - RNA, 21 nt, Pseudomonas aeruginosa PA01
ccgacagagcggccggcgcgg

SEQ ID NO: 1470425 - RNA, 18 nt, Pseudomonas aeruginosa PA01
ccgacaccucgaucagcg

SEQ ID NO: 1470426 - RNA, 23 nt, Pseudomonas aeruginosa PA01
ccgacacgcacucauagcucagc

SEQ ID NO: 1470427 - RNA, 14 nt, Pseudomonas aeruginosa PA01
ccgacacccgcgcc

SEQ ID NO: 1470428 - RNA, 15 nt, Pseudomonas aeruginosa PA01
ccgaagugaucuggc

SEQ ID NO: 1470429 - RNA, 22 nt, Pseudomonas aeruginosa PA01
ccgaagucgcccgccggcgugc

SEQ ID NO: 1470430 - RNA, 14 nt, Pseudomonas aeruginosa PA01
ccgaagaggcccuc

SEQ ID NO: 1470431 - RNA, 21 nt, Pseudomonas aeruginosa PA01
ccgaagaggcccucggcgccg

SEQ ID NO: 1470432 - RNA, 23 nt, Pseudomonas aeruginosa PA01
ccgaagaggcccucggcgccgag

SEQ ID NO: 1470433 - RNA, 18 nt, Pseudomonas aeruginosa PA01
ccgaagauccgcuccagg

SEQ ID NO: 1470434 - RNA, 18 nt, Pseudomonas aeruginosa PA01
ccgaagcgugggcggccg

SEQ ID NO: 1470435 - RNA, 19 nt, Pseudomonas aeruginosa PA01
ccgaagcgugggcggccgg

SEQ ID NO: 1470436 - RNA, 22 nt, Pseudomonas aeruginosa PA01
ccgaagggaaacaccaggccga

SEQ ID NO: 1470437 - RNA, 18 nt, Pseudomonas aeruginosa PA01
ccgaaguagucgccccgg

SEQ ID NO: 1470438 - RNA, 19 nt, Pseudomonas aeruginosa PA01
ccgaaggucaaugccacgu

SEQ ID NO: 1470439 - RNA, 17 nt, Pseudomonas aeruginosa PA01
ccgaaggcgucauccgc

SEQ ID NO: 1470440 - RNA, 18 nt, Pseudomonas aeruginosa PA01
ccgaaggcgugggcgccg

SEQ ID NO: 1470441 - RNA, 15 nt, Pseudomonas aeruginosa PA01
ccgaaggccuggccg

SEQ ID NO: 1470442 - RNA, 16 nt, Pseudomonas aeruginosa PA01
ccgaaggacaggccgu

SEQ ID NO: 1470443 - RNA, 16 nt, Pseudomonas aeruginosa PA01
ccgaaggccaggccgg

SEQ ID NO: 1470444 - RNA, 16 nt, Pseudomonas aeruginosa PA01
ccgaagcugaggccgg

SEQ ID NO: 1470445 - RNA, 13 nt, Pseudomonas aeruginosa PA01
cccgcgccgccgc

SEQ ID NO: 1470446 - RNA, 12 nt, Pseudomonas aeruginosa PA01
cccgcgccggca

SEQ ID NO: 1470447 - RNA, 14 nt, Pseudomonas aeruginosa PA01
cccgcgccgccgga

SEQ ID NO: 1470448 - RNA, 14 nt, Pseudomonas aeruginosa PA01
cccgcgccgccggu

SEQ ID NO: 1470449 - RNA, 15 nt, Pseudomonas aeruginosa PA01
cccgcgccgccucga

SEQ ID NO: 1470450 - RNA, 15 nt, Pseudomonas aeruginosa PA01
cccgcgcauggagac

SEQ ID NO: 1470451 - RNA, 15 nt, Pseudomonas aeruginosa PA01
cccgcgccagcgccg

SEQ ID NO: 1470452 - RNA, 21 nt, Pseudomonas aeruginosa PA01
cccgcgccugcaggucgaggc

SEQ ID NO: 1470453 - RNA, 13 nt, Pseudomonas aeruginosa PA01
cccgcgccugggc

SEQ ID NO: 1470454 - RNA, 17 nt, Pseudomonas aeruginosa PA01
cccgcggaucgcgccgu

SEQ ID NO: 1470455 - RNA, 19 nt, Pseudomonas aeruginosa PA01
cccgcggcccgccgccggg

SEQ ID NO: 1470456 - RNA, 14 nt, Pseudomonas aeruginosa PA01
cccgcgccggcagc

SEQ ID NO: 1470457 - RNA, 18 nt, Pseudomonas aeruginosa PA01
cccgcgccggcagcucgg

SEQ ID NO: 1470458 - RNA, 17 nt, Pseudomonas aeruginosa PA01
cccgcgccuccaggcgc

SEQ ID NO: 1470459 - RNA, 13 nt, Pseudomonas aeruginosa PA01
cccgccgcgcauc

SEQ ID NO: 1470460 - RNA, 11 nt, Pseudomonas aeruginosa PA01
cccgccgcgcc

SEQ ID NO: 1470461 - RNA, 12 nt, Pseudomonas aeruginosa PA01
cccgccgcgcau

SEQ ID NO: 1470462 - RNA, 13 nt, Pseudomonas aeruginosa PA01
cccgccgcucugc

SEQ ID NO: 1470463 - RNA, 13 nt, Pseudomonas aeruginosa PA01
cccgccgcgccgc

SEQ ID NO: 1470464 - RNA, 18 nt, Pseudomonas aeruginosa PA01
cccgccguccuccagcaa

SEQ ID NO: 1470465 - RNA, 13 nt, Pseudomonas aeruginosa PA01
cccgccgucgccc

SEQ ID NO: 1470466 - RNA, 13 nt, Pseudomonas aeruginosa PA01
cccgccucgucgc

SEQ ID NO: 1470467 - RNA, 12 nt, Pseudomonas aeruginosa PA01
cccgccgugcgc

SEQ ID NO: 1470468 - RNA, 17 nt, Pseudomonas aeruginosa PA01
cccgccgugcgcuccgc

SEQ ID NO: 1470469 - RNA, 21 nt, Pseudomonas aeruginosa PA01
cccgccuggaaggcgcugggc

SEQ ID NO: 1470470 - RNA, 23 nt, Pseudomonas aeruginosa PA01
cccgccuggaaggcgcugggcgg

SEQ ID NO: 1470471 - RNA, 18 nt, Pseudomonas aeruginosa PA01
cccgccuuguucgccagc

SEQ ID NO: 1470472 - RNA, 24 nt, Pseudomonas aeruginosa PA01
cccgccuuguucgccagcaccucg

SEQ ID NO: 1470473 - RNA, 15 nt, Pseudomonas aeruginosa PA01
cccgcuacccugccc

SEQ ID NO: 1470474 - RNA, 19 nt, Pseudomonas aeruginosa PA01
cccgcuacccugccccagc

SEQ ID NO: 1470475 - RNA, 22 nt, Pseudomonas aeruginosa PA01
cccgcucaugagauccgccagc

SEQ ID NO: 1470476 - RNA, 22 nt, Pseudomonas aeruginosa PA01
cccgcgggcagcagucgcagcu

SEQ ID NO: 1470477 - RNA, 20 nt, Pseudomonas aeruginosa PA01
cccgcggcggcgacgcuggc

SEQ ID NO: 1470478 - RNA, 15 nt, Pseudomonas aeruginosa PA01
cccgcggcgagcagc

SEQ ID NO: 1470479 - RNA, 16 nt, Pseudomonas aeruginosa PA01
cccgcucccgcggccc

SEQ ID NO: 1470480 - RNA, 13 nt, Pseudomonas aeruginosa PA01
cccgcuccagccg

SEQ ID NO: 1470481 - RNA, 14 nt, Pseudomonas aeruginosa PA01
cccgcuccagccgg

SEQ ID NO: 1470482 - RNA, 18 nt, Pseudomonas aeruginosa PA01
cccgcuccagccggcaag

SEQ ID NO: 1470483 - RNA, 13 nt, Pseudomonas aeruginosa PA01
cccgcugcaacuc

SEQ ID NO: 1470484 - RNA, 21 nt, Pseudomonas aeruginosa PA01
cccgcugcgcugccagcgccg

SEQ ID NO: 1470485 - RNA, 18 nt, Pseudomonas aeruginosa PA01
cccgcugcaugugccagg

SEQ ID NO: 1470486 - RNA, 17 nt, Pseudomonas aeruginosa PA01
cccgcccuuggcggcgc

SEQ ID NO: 1470487 - RNA, 19 nt, Pseudomonas aeruginosa PA01
cccgccgaggaagccgacc

SEQ ID NO: 1470488 - RNA, 21 nt, Pseudomonas aeruginosa PA01
cccgccgaggaagccgaccgg

SEQ ID NO: 1470489 - RNA, 23 nt, Pseudomonas aeruginosa PA01
cccgccgaggaagccgaccggcg

SEQ ID NO: 1470490 - RNA, 12 nt, Pseudomonas aeruginosa PA01
cccgccgccagg

SEQ ID NO: 1470491 - RNA, 14 nt, Pseudomonas aeruginosa PA01
cccgccgccaggcg

SEQ ID NO: 1470492 - RNA, 20 nt, Pseudomonas aeruginosa PA01
cccgccgccaggcggcaagg

SEQ ID NO: 1470493 - RNA, 12 nt, Pseudomonas aeruginosa PA01
cccgcagcggca

SEQ ID NO: 1470494 - RNA, 15 nt, Pseudomonas aeruginosa PA01
cccgcagcggcagcg

SEQ ID NO: 1470495 - RNA, 17 nt, Pseudomonas aeruginosa PA01
cccgcagcggcagcggc

SEQ ID NO: 1470496 - RNA, 21 nt, Pseudomonas aeruginosa PA01
cccgcagcggcagcggcucgu

SEQ ID NO: 1470497 - RNA, 14 nt, Pseudomonas aeruginosa PA01
cccgcaccuugccc

SEQ ID NO: 1470498 - RNA, 21 nt, Pseudomonas aeruginosa PA01
cccgcagccacaggcgccagu

SEQ ID NO: 1470499 - RNA, 19 nt, Pseudomonas aeruginosa PA01
cccgcagccacggcacacg

SEQ ID NO: 1470500 - RNA, 17 nt, Pseudomonas aeruginosa PA01
cccgcagaucuuccccg

SEQ ID NO: 1470501 - RNA, 23 nt, Pseudomonas aeruginosa PA01
cccgcagaucuuccccguugccg

SEQ ID NO: 1470502 - RNA, 13 nt, Pseudomonas aeruginosa PA01
ccccggccggcag

SEQ ID NO: 1470503 - RNA, 20 nt, Pseudomonas aeruginosa PA01
ccccggcaggcaggccuggg

SEQ ID NO: 1470504 - RNA, 15 nt, Pseudomonas aeruginosa PA01
ccccggcccgggcgu

SEQ ID NO: 1470505 - RNA, 22 nt, Pseudomonas aeruginosa PA01
ccccggccucaacgaccgccca

SEQ ID NO: 1470506 - RNA, 13 nt, Pseudomonas aeruginosa PA01
ccccggccuggcg

SEQ ID NO: 1470507 - RNA, 14 nt, Pseudomonas aeruginosa PA01
ccccggcgcccaga

SEQ ID NO: 1470508 - RNA, 15 nt, Pseudomonas aeruginosa PA01
ccccggcgccgaccg

SEQ ID NO: 1470509 - RNA, 20 nt, Pseudomonas aeruginosa PA01
ccccggcggguucagcccgc

SEQ ID NO: 1470510 - RNA, 18 nt, Pseudomonas aeruginosa PA01
ccccggcucauggccggg

SEQ ID NO: 1470511 - RNA, 13 nt, Pseudomonas aeruginosa PA01
cccgaucaccgga

SEQ ID NO: 1470512 - RNA, 12 nt, Pseudomonas aeruginosa PA01
cccgaucgccuc

SEQ ID NO: 1470513 - RNA, 15 nt, Pseudomonas aeruginosa PA01
cccgaucgccucggc

SEQ ID NO: 1470514 - RNA, 15 nt, Pseudomonas aeruginosa PA01
cccgcaccggcgcgc

SEQ ID NO: 1470515 - RNA, 17 nt, Pseudomonas aeruginosa PA01
cccgcaccugccgucac

SEQ ID NO: 1470516 - RNA, 13 nt, Pseudomonas aeruginosa PA01
cccgcaccagccg

SEQ ID NO: 1470517 - RNA, 12 nt, Pseudomonas aeruginosa PA01
cccggcucggcg

SEQ ID NO: 1470518 - RNA, 16 nt, Pseudomonas aeruginosa PA01
cccgggccuccuggcg

SEQ ID NO: 1470519 - RNA, 21 nt, Pseudomonas aeruginosa PA01
cccgggccuccuggcggcgug

SEQ ID NO: 1470520 - RNA, 22 nt, Pseudomonas aeruginosa PA01
cccgggcgaccugcucgcgcac

SEQ ID NO: 1470521 - RNA, 12 nt, Pseudomonas aeruginosa PA01
cccgggcgccac

SEQ ID NO: 1470522 - RNA, 14 nt, Pseudomonas aeruginosa PA01
cccgggcgccaccg

SEQ ID NO: 1470523 - RNA, 17 nt, Pseudomonas aeruginosa PA01
cccgggcgccaccgcgu

SEQ ID NO: 1470524 - RNA, 21 nt, Pseudomonas aeruginosa PA01
cccggucaccacccagccgcg

SEQ ID NO: 1470525 - RNA, 20 nt, Pseudomonas aeruginosa PA01
cccggucagcuucgccgccc

SEQ ID NO: 1470526 - RNA, 23 nt, Pseudomonas aeruginosa PA01
cccggucaggccgaucaccacca

SEQ ID NO: 1470527 - RNA, 21 nt, Pseudomonas aeruginosa PA01
cccggucagguuggacagguc

SEQ ID NO: 1470528 - RNA, 18 nt, Pseudomonas aeruginosa PA01
cccgguccguccagcgcg

SEQ ID NO: 1470529 - RNA, 21 nt, Pseudomonas aeruginosa PA01
cccgguccguccagcgcgccc

SEQ ID NO: 1470530 - RNA, 17 nt, Pseudomonas aeruginosa PA01
cccgguccugcaacugg

SEQ ID NO: 1470531 - RNA, 23 nt, Pseudomonas aeruginosa PA01
cccgguccugcaacuggaaggcc

SEQ ID NO: 1470532 - RNA, 23 nt, Pseudomonas aeruginosa PA01
cccggguuuccgugugcagcagg

SEQ ID NO: 1470533 - RNA, 16 nt, Pseudomonas aeruginosa PA01
cccggguucugcucga

SEQ ID NO: 1470534 - RNA, 24 nt, Pseudomonas aeruginosa PA01
cccggguugagguagagcacgccg

SEQ ID NO: 1470535 - RNA, 15 nt, Pseudomonas aeruginosa PA01
cccggguugccguag

SEQ ID NO: 1470536 - RNA, 21 nt, Pseudomonas aeruginosa PA01
cccggguugccguagcgaugc

SEQ ID NO: 1470537 - RNA, 15 nt, Pseudomonas aeruginosa PA01
cccgguacagcgccu

SEQ ID NO: 1470538 - RNA, 16 nt, Pseudomonas aeruginosa PA01
cccgguacagcgccug

SEQ ID NO: 1470539 - RNA, 21 nt, Pseudomonas aeruginosa PA01
cccgguacuccuccagcaucc

SEQ ID NO: 1470540 - RNA, 14 nt, Pseudomonas aeruginosa PA01
cccggcgucggcgc

SEQ ID NO: 1470541 - RNA, 20 nt, Pseudomonas aeruginosa PA01
cccggcgucggcgcgggcgc

SEQ ID NO: 1470542 - RNA, 23 nt, Pseudomonas aeruginosa PA01
cccggcgucggcgcgggcgccga

SEQ ID NO: 1470543 - RNA, 22 nt, Pseudomonas aeruginosa PA01
cccggcgugagcagggccgagc

SEQ ID NO: 1470544 - RNA, 14 nt, Pseudomonas aeruginosa PA01
cccggcguccucgc

SEQ ID NO: 1470545 - RNA, 15 nt, Pseudomonas aeruginosa PA01
cccggcguccucgcg

SEQ ID NO: 1470546 - RNA, 21 nt, Pseudomonas aeruginosa PA01
cccggcguccucgcgacaccg

SEQ ID NO: 1470547 - RNA, 12 nt, Pseudomonas aeruginosa PA01
cccggcgguccg

SEQ ID NO: 1470548 - RNA, 16 nt, Pseudomonas aeruginosa PA01
cccggcgguccgccgc

SEQ ID NO: 1470549 - RNA, 18 nt, Pseudomonas aeruginosa PA01
cccggcguuucgccgggc

SEQ ID NO: 1470550 - RNA, 24 nt, Pseudomonas aeruginosa PA01
cccggcuaucgcuuucagcaauca

SEQ ID NO: 1470551 - RNA, 20 nt, Pseudomonas aeruginosa PA01
cccggcucgcccaugcgcgg

SEQ ID NO: 1470552 - RNA, 13 nt, Pseudomonas aeruginosa PA01
cccggcucgccga

SEQ ID NO: 1470553 - RNA, 16 nt, Pseudomonas aeruginosa PA01
cccggcucgccgccgg

SEQ ID NO: 1470554 - RNA, 16 nt, Pseudomonas aeruginosa PA01
cccggcuccagccggg

SEQ ID NO: 1470555 - RNA, 15 nt, Pseudomonas aeruginosa PA01
cccggcgagagcguc

SEQ ID NO: 1470556 - RNA, 22 nt, Pseudomonas aeruginosa PA01
cccggcgagagcguccggcagg

SEQ ID NO: 1470557 - RNA, 13 nt, Pseudomonas aeruginosa PA01
cccggcggcggca

SEQ ID NO: 1470558 - RNA, 15 nt, Pseudomonas aeruginosa PA01
cccggcggcggcacc

SEQ ID NO: 1470559 - RNA, 16 nt, Pseudomonas aeruginosa PA01
cccggcgaacagcgcu

SEQ ID NO: 1470560 - RNA, 22 nt, Pseudomonas aeruginosa PA01
cccggccucgccugcggcgccu

SEQ ID NO: 1470561 - RNA, 15 nt, Pseudomonas aeruginosa PA01
cccggccuggcgccg

SEQ ID NO: 1470562 - RNA, 15 nt, Pseudomonas aeruginosa PA01
cccggccuggcuggc

SEQ ID NO: 1470563 - RNA, 18 nt, Pseudomonas aeruginosa PA01
cccggccugguaggccuc

SEQ ID NO: 1470564 - RNA, 17 nt, Pseudomonas aeruginosa PA01
cccggccuggugccggg

SEQ ID NO: 1470565 - RNA, 16 nt, Pseudomonas aeruginosa PA01
cccggcauaggcgcca

SEQ ID NO: 1470566 - RNA, 18 nt, Pseudomonas aeruginosa PA01
cccggcauaggcgccagc

SEQ ID NO: 1470567 - RNA, 14 nt, Pseudomonas aeruginosa PA01
cccggcaucgccgg

SEQ ID NO: 1470568 - RNA, 13 nt, Pseudomonas aeruginosa PA01
cccggcauucgcc

SEQ ID NO: 1470569 - RNA, 17 nt, Pseudomonas aeruginosa PA01
cccggcauucgccgggc

SEQ ID NO: 1470570 - RNA, 20 nt, Pseudomonas aeruginosa PA01
cccggcagcucccuugccgc

SEQ ID NO: 1470571 - RNA, 16 nt, Pseudomonas aeruginosa PA01
cccggcagcgccgggc

SEQ ID NO: 1470572 - RNA, 13 nt, Pseudomonas aeruginosa PA01
cccggcagcggcu

SEQ ID NO: 1470573 - RNA, 19 nt, Pseudomonas aeruginosa PA01
cccggcaggcagugccggg

SEQ ID NO: 1470574 - RNA, 12 nt, Pseudomonas aeruginosa PA01
cccggcagggcc

SEQ ID NO: 1470575 - RNA, 19 nt, Pseudomonas aeruginosa PA01
cccggcaaucaggcgcgau

SEQ ID NO: 1470576 - RNA, 16 nt, Pseudomonas aeruginosa PA01
cccggauucgccgagg

SEQ ID NO: 1470577 - RNA, 17 nt, Pseudomonas aeruginosa PA01
cccggauucgccgagga

SEQ ID NO: 1470578 - RNA, 15 nt, Pseudomonas aeruginosa PA01
cccggaccugggcac

SEQ ID NO: 1470579 - RNA, 21 nt, Pseudomonas aeruginosa PA01
cccgcuggcccaacagcggug

SEQ ID NO: 1470580 - RNA, 16 nt, Pseudomonas aeruginosa PA01
cccggaccagggcgcc

SEQ ID NO: 1470581 - RNA, 14 nt, Pseudomonas aeruginosa PA01
cccggcccauggcg

SEQ ID NO: 1470582 - RNA, 16 nt, Pseudomonas aeruginosa PA01
cccggcccauggcgac

SEQ ID NO: 1470583 - RNA, 15 nt, Pseudomonas aeruginosa PA01
cccggcccgcgccgc

SEQ ID NO: 1470584 - RNA, 17 nt, Pseudomonas aeruginosa PA01
cccggcccagcguucgg

SEQ ID NO: 1470585 - RNA, 15 nt, Pseudomonas aeruginosa PA01
cccggcccagccgcg

SEQ ID NO: 1470586 - RNA, 18 nt, Pseudomonas aeruginosa PA01
cccggcccagccgcggcg

SEQ ID NO: 1470587 - RNA, 19 nt, Pseudomonas aeruginosa PA01
cccggcccagccgcggcgc

SEQ ID NO: 1470588 - RNA, 22 nt, Pseudomonas aeruginosa PA01
cccggcccagccgcggcgccac

SEQ ID NO: 1470589 - RNA, 19 nt, Pseudomonas aeruginosa PA01
cccggccauccuggccggu

SEQ ID NO: 1470590 - RNA, 21 nt, Pseudomonas aeruginosa PA01
cccggccauccuggccggucg

SEQ ID NO: 1470591 - RNA, 18 nt, Pseudomonas aeruginosa PA01
cccggccaugccgccgac

SEQ ID NO: 1470592 - RNA, 18 nt, Pseudomonas aeruginosa PA01
cccggccauggcggguca

SEQ ID NO: 1470593 - RNA, 22 nt, Pseudomonas aeruginosa PA01
cccggccauggcgggucacgcc

SEQ ID NO: 1470594 - RNA, 24 nt, Pseudomonas aeruginosa PA01
cccggccagguacuggcgauggau

SEQ ID NO: 1470595 - RNA, 17 nt, Pseudomonas aeruginosa PA01
cccggccagguaggcga

SEQ ID NO: 1470596 - RNA, 18 nt, Pseudomonas aeruginosa PA01
cccggccagguaggcgac

SEQ ID NO: 1470597 - RNA, 20 nt, Pseudomonas aeruginosa PA01
cccggccagguaggcgacga

SEQ ID NO: 1470598 - RNA, 15 nt, Pseudomonas aeruginosa PA01
cccggccaggcgcgg

SEQ ID NO: 1470599 - RNA, 22 nt, Pseudomonas aeruginosa PA01
cccggccaggcccucagcggcg

SEQ ID NO: 1470600 - RNA, 16 nt, Pseudomonas aeruginosa PA01
cccggccaggccgccc

SEQ ID NO: 1470601 - RNA, 15 nt, Pseudomonas aeruginosa PA01
cccggccaggcgaua

SEQ ID NO: 1470602 - RNA, 13 nt, Pseudomonas aeruginosa PA01
cccggccaggcgc

SEQ ID NO: 1470603 - RNA, 18 nt, Pseudomonas aeruginosa PA01
cccggcaucgugccgcgg

SEQ ID NO: 1470604 - RNA, 12 nt, Pseudomonas aeruginosa PA01
cccggccagccc

SEQ ID NO: 1470605 - RNA, 14 nt, Pseudomonas aeruginosa PA01
cccggccagcccgg

SEQ ID NO: 1470606 - RNA, 15 nt, Pseudomonas aeruginosa PA01
cccggccagcccggc

SEQ ID NO: 1470607 - RNA, 21 nt, Pseudomonas aeruginosa PA01
cccggccagcccggccucgcc

SEQ ID NO: 1470608 - RNA, 13 nt, Pseudomonas aeruginosa PA01
cccggccggcagg

SEQ ID NO: 1470609 - RNA, 11 nt, Pseudomonas aeruginosa PA01
cccggccggca

SEQ ID NO: 1470610 - RNA, 17 nt, Pseudomonas aeruginosa PA01
cccggccgccuuccucg

SEQ ID NO: 1470611 - RNA, 20 nt, Pseudomonas aeruginosa PA01
cccggccgccuuccucggcc

SEQ ID NO: 1470612 - RNA, 13 nt, Pseudomonas aeruginosa PA01
cccggccgaugga

SEQ ID NO: 1470613 - RNA, 22 nt, Pseudomonas aeruginosa PA01
cccggccgauggaaaucggcca

SEQ ID NO: 1470614 - RNA, 15 nt, Pseudomonas aeruginosa PA01
cccggccgcgccagc

SEQ ID NO: 1470615 - RNA, 14 nt, Pseudomonas aeruginosa PA01
cccggccgaccagg

SEQ ID NO: 1470616 - RNA, 13 nt, Pseudomonas aeruginosa PA01
cccggcccggcca

SEQ ID NO: 1470617 - RNA, 15 nt, Pseudomonas aeruginosa PA01
cccggcccggccauc

SEQ ID NO: 1470618 - RNA, 17 nt, Pseudomonas aeruginosa PA01
cccaucacggccccgag

SEQ ID NO: 1470619 - RNA, 14 nt, Pseudomonas aeruginosa PA01
cccaguaccgccac

SEQ ID NO: 1470620 - RNA, 23 nt, Pseudomonas aeruginosa PA01
cccaguagggcccgugguagucg

SEQ ID NO: 1470621 - RNA, 20 nt, Pseudomonas aeruginosa PA01
cccaguccucguacaugcgc

SEQ ID NO: 1470622 - RNA, 17 nt, Pseudomonas aeruginosa PA01
cccagucggcguccgcc

SEQ ID NO: 1470623 - RNA, 18 nt, Pseudomonas aeruginosa PA01
cccagugcgagucggcga

SEQ ID NO: 1470624 - RNA, 20 nt, Pseudomonas aeruginosa PA01
cccagugcgagucggcgacg

SEQ ID NO: 1470625 - RNA, 22 nt, Pseudomonas aeruginosa PA01
cccaggcagaucgcgccgagcu

SEQ ID NO: 1470626 - RNA, 12 nt, Pseudomonas aeruginosa PA01
cccaggccaacc

SEQ ID NO: 1470627 - RNA, 16 nt, Pseudomonas aeruginosa PA01
cccaggcccagccggu

SEQ ID NO: 1470628 - RNA, 18 nt, Pseudomonas aeruginosa PA01
cccaggcaacggagcugg

SEQ ID NO: 1470629 - RNA, 21 nt, Pseudomonas aeruginosa PA01
cccaggcaccguaggccaggc

SEQ ID NO: 1470630 - RNA, 22 nt, Pseudomonas aeruginosa PA01
cccaggcacggcuucagcgcca

SEQ ID NO: 1470631 - RNA, 13 nt, Pseudomonas aeruginosa PA01
cccaggccgccga

SEQ ID NO: 1470632 - RNA, 14 nt, Pseudomonas aeruginosa PA01
cccaggccgccgau

SEQ ID NO: 1470633 - RNA, 15 nt, Pseudomonas aeruginosa PA01
cccaggccgaaggcc

SEQ ID NO: 1470634 - RNA, 21 nt, Pseudomonas aeruginosa PA01
cccagguucuggucgccgaca

SEQ ID NO: 1470635 - RNA, 13 nt, Pseudomonas aeruginosa PA01
cccaggccgcgca

SEQ ID NO: 1470636 - RNA, 15 nt, Pseudomonas aeruginosa PA01
cccaggccgcgcagc

SEQ ID NO: 1470637 - RNA, 17 nt, Pseudomonas aeruginosa PA01
cccagcgcuuccucggg

SEQ ID NO: 1470638 - RNA, 14 nt, Pseudomonas aeruginosa PA01
cccagcggaugcgc

SEQ ID NO: 1470639 - RNA, 13 nt, Pseudomonas aeruginosa PA01
cccagcggcaggc

SEQ ID NO: 1470640 - RNA, 20 nt, Pseudomonas aeruginosa PA01
cccagcgcgccgccgaggug

SEQ ID NO: 1470641 - RNA, 17 nt, Pseudomonas aeruginosa PA01
cccagcgcugguugacg

SEQ ID NO: 1470642 - RNA, 14 nt, Pseudomonas aeruginosa PA01
cccagcgggcaacc

SEQ ID NO: 1470643 - RNA, 14 nt, Pseudomonas aeruginosa PA01
cccagcggcagguc

SEQ ID NO: 1470644 - RNA, 15 nt, Pseudomonas aeruginosa PA01
cccagcggcgcggcg

SEQ ID NO: 1470645 - RNA, 21 nt, Pseudomonas aeruginosa PA01
cccagcggcgcggcguaccag

SEQ ID NO: 1470646 - RNA, 17 nt, Pseudomonas aeruginosa PA01
cccagcggcgccagcuc

SEQ ID NO: 1470647 - RNA, 14 nt, Pseudomonas aeruginosa PA01
cccagcggcuggcg

SEQ ID NO: 1470648 - RNA, 16 nt, Pseudomonas aeruginosa PA01
cccagcucagcagguc

SEQ ID NO: 1470649 - RNA, 15 nt, Pseudomonas aeruginosa PA01
cccagcaccucgccg

SEQ ID NO: 1470650 - RNA, 19 nt, Pseudomonas aeruginosa PA01
cccagcacgccgagcaacg

SEQ ID NO: 1470651 - RNA, 23 nt, Pseudomonas aeruginosa PA01
cccagcagcgccucggcaucgac

SEQ ID NO: 1470652 - RNA, 19 nt, Pseudomonas aeruginosa PA01
cccagcagcaggccggcga

SEQ ID NO: 1470653 - RNA, 15 nt, Pseudomonas aeruginosa PA01
cccagcaccuggacg

SEQ ID NO: 1470654 - RNA, 15 nt, Pseudomonas aeruginosa PA01
cccagcagcaacagc

SEQ ID NO: 1470655 - RNA, 13 nt, Pseudomonas aeruginosa PA01
cccagcagcggca

SEQ ID NO: 1470656 - RNA, 15 nt, Pseudomonas aeruginosa PA01
ccauucgccgcgacg

SEQ ID NO: 1470657 - RNA, 16 nt, Pseudomonas aeruginosa PA01
ccauucgcugucgagc

SEQ ID NO: 1470658 - RNA, 18 nt, Pseudomonas aeruginosa PA01
ccauucgaauggcgccgg

SEQ ID NO: 1470659 - RNA, 19 nt, Pseudomonas aeruginosa PA01
ccauucgaauggcgccggc

SEQ ID NO: 1470660 - RNA, 23 nt, Pseudomonas aeruginosa PA01
ccauucgaauggcgccggccaga

SEQ ID NO: 1470661 - RNA, 17 nt, Pseudomonas aeruginosa PA01
ccauucgaugccgcgcg

SEQ ID NO: 1470662 - RNA, 13 nt, Pseudomonas aeruginosa PA01
ccauucucgccau

SEQ ID NO: 1470663 - RNA, 14 nt, Pseudomonas aeruginosa PA01
ccauugcccggcca

SEQ ID NO: 1470664 - RNA, 14 nt, Pseudomonas aeruginosa PA01
ccauugcaucugcg

SEQ ID NO: 1470665 - RNA, 18 nt, Pseudomonas aeruginosa PA01
cccaccgcgcggcacagg

SEQ ID NO: 1470666 - RNA, 20 nt, Pseudomonas aeruginosa PA01
cccaccgggaucugccggua

SEQ ID NO: 1470667 - RNA, 16 nt, Pseudomonas aeruginosa PA01
cccaccggucuuggcg

SEQ ID NO: 1470668 - RNA, 19 nt, Pseudomonas aeruginosa PA01
cccaccgcuuucagcgccg

SEQ ID NO: 1470669 - RNA, 15 nt, Pseudomonas aeruginosa PA01
cccacccgucccgcg

SEQ ID NO: 1470670 - RNA, 14 nt, Pseudomonas aeruginosa PA01
cccagauauccagg

SEQ ID NO: 1470671 - RNA, 20 nt, Pseudomonas aeruginosa PA01
cccagauggguaagguugcc

SEQ ID NO: 1470672 - RNA, 15 nt, Pseudomonas aeruginosa PA01
cccagagcagcacca

SEQ ID NO: 1470673 - RNA, 17 nt, Pseudomonas aeruginosa PA01
cccagaguucgcccagc

SEQ ID NO: 1470674 - RNA, 21 nt, Pseudomonas aeruginosa PA01
cccagaguucgcccagcucgc

SEQ ID NO: 1470675 - RNA, 15 nt, Pseudomonas aeruginosa PA01
cccacgggcggccga

SEQ ID NO: 1470676 - RNA, 22 nt, Pseudomonas aeruginosa PA01
cccacgguagagacggcggcga

SEQ ID NO: 1470677 - RNA, 22 nt, Pseudomonas aeruginosa PA01
cccagaccuuccagccgcgcgc

SEQ ID NO: 1470678 - RNA, 13 nt, Pseudomonas aeruginosa PA01
cccacgcccaucg

SEQ ID NO: 1470679 - RNA, 18 nt, Pseudomonas aeruginosa PA01
cccacgcccaucggcguc

SEQ ID NO: 1470680 - RNA, 18 nt, Pseudomonas aeruginosa PA01
cccacgcgccuggccguc

SEQ ID NO: 1470681 - RNA, 14 nt, Pseudomonas aeruginosa PA01
cccaccugaacgcg

SEQ ID NO: 1470682 - RNA, 20 nt, Pseudomonas aeruginosa PA01
ccccagcacgccgagcaacg

SEQ ID NO: 1470683 - RNA, 16 nt, Pseudomonas aeruginosa PA01
ccccagcaucgccggc

SEQ ID NO: 1470684 - RNA, 20 nt, Pseudomonas aeruginosa PA01
ccccagcaucgccggcagcg

SEQ ID NO: 1470685 - RNA, 23 nt, Pseudomonas aeruginosa PA01
ccccagacccaggugcgcaggcg

SEQ ID NO: 1470686 - RNA, 23 nt, Pseudomonas aeruginosa PA01
ccccagaccguggauuucagcag

SEQ ID NO: 1470687 - RNA, 20 nt, Pseudomonas aeruginosa PA01
ccccacuggaagaaggcgau

SEQ ID NO: 1470688 - RNA, 18 nt, Pseudomonas aeruginosa PA01
ccccagaucgccagcgcc

SEQ ID NO: 1470689 - RNA, 14 nt, Pseudomonas aeruginosa PA01
ccccacaggcccug

SEQ ID NO: 1470690 - RNA, 15 nt, Pseudomonas aeruginosa PA01
ccccacaggcccugc

SEQ ID NO: 1470691 - RNA, 18 nt, Pseudomonas aeruginosa PA01
ccccacaggcccugcagc

SEQ ID NO: 1470692 - RNA, 15 nt, Pseudomonas aeruginosa PA01
ccccacggcgcggcc

SEQ ID NO: 1470693 - RNA, 13 nt, Pseudomonas aeruginosa PA01
ccccacgggcgac

SEQ ID NO: 1470694 - RNA, 21 nt, Pseudomonas aeruginosa PA01
ccccacgguagagacggcggc

SEQ ID NO: 1470695 - RNA, 22 nt, Pseudomonas aeruginosa PA01
ccccacgguagagacggcggcg

SEQ ID NO: 1470696 - RNA, 23 nt, Pseudomonas aeruginosa PA01
cccauugcaucugcgccgggaug

SEQ ID NO: 1470697 - RNA, 23 nt, Pseudomonas aeruginosa PA01
cccaucgcccgcagccacaggcg

SEQ ID NO: 1470698 - RNA, 21 nt, Pseudomonas aeruginosa PA01
ccccaauugccguagggcgaa

SEQ ID NO: 1470699 - RNA, 22 nt, Pseudomonas aeruginosa PA01
ccccaacaucaacccaccgacc

SEQ ID NO: 1470700 - RNA, 21 nt, Pseudomonas aeruginosa PA01
ccccagguaggcgaaggcgau

SEQ ID NO: 1470701 - RNA, 14 nt, Pseudomonas aeruginosa PA01
ccccaggugcagcg

SEQ ID NO: 1470702 - RNA, 18 nt, Pseudomonas aeruginosa PA01
ccccaggugcagcgaggg

SEQ ID NO: 1470703 - RNA, 15 nt, Pseudomonas aeruginosa PA01
ccccagcgcgagcgu

SEQ ID NO: 1470704 - RNA, 14 nt, Pseudomonas aeruginosa PA01
ccccaggccgccgc

SEQ ID NO: 1470705 - RNA, 15 nt, Pseudomonas aeruginosa PA01
ccccaggcgcccagg

SEQ ID NO: 1470706 - RNA, 18 nt, Pseudomonas aeruginosa PA01
ccccaggcgcccaggcag

SEQ ID NO: 1470707 - RNA, 12 nt, Pseudomonas aeruginosa PA01
ccccagcgcccg

SEQ ID NO: 1470708 - RNA, 13 nt, Pseudomonas aeruginosa PA01
ccccagcgccugg

SEQ ID NO: 1470709 - RNA, 13 nt, Pseudomonas aeruginosa PA01
ccccagcggcagg

SEQ ID NO: 1470710 - RNA, 23 nt, Pseudomonas aeruginosa PA01
ccccagcggcaggcacgcugcca

SEQ ID NO: 1470711 - RNA, 12 nt, Pseudomonas aeruginosa PA01
ccccagcaccug

SEQ ID NO: 1470712 - RNA, 13 nt, Pseudomonas aeruginosa PA01
ccccccgcgaagc

SEQ ID NO: 1470713 - RNA, 14 nt, Pseudomonas aeruginosa PA01
cccccaccgggcca

SEQ ID NO: 1470714 - RNA, 22 nt, Pseudomonas aeruginosa PA01
ccccaugcccggccuggcgucc

SEQ ID NO: 1470715 - RNA, 19 nt, Pseudomonas aeruginosa PA01
ccccaugaaaaaggccggu

SEQ ID NO: 1470716 - RNA, 16 nt, Pseudomonas aeruginosa PA01
ccccaguagcgcuucg

SEQ ID NO: 1470717 - RNA, 22 nt, Pseudomonas aeruginosa PA01
ccccaguccucguacaugcgcg

SEQ ID NO: 1470718 - RNA, 18 nt, Pseudomonas aeruginosa PA01
ccccgccacuuccagcac

SEQ ID NO: 1470719 - RNA, 11 nt, Pseudomonas aeruginosa PA01
ccccgccgacu

SEQ ID NO: 1470720 - RNA, 12 nt, Pseudomonas aeruginosa PA01
ccccgccgcuga

SEQ ID NO: 1470721 - RNA, 14 nt, Pseudomonas aeruginosa PA01
ccccgcgccgccgg

SEQ ID NO: 1470722 - RNA, 15 nt, Pseudomonas aeruginosa PA01
ccccgcgccgccgga

SEQ ID NO: 1470723 - RNA, 20 nt, Pseudomonas aeruginosa PA01
ccccgcgaagcgacggcgca

SEQ ID NO: 1470724 - RNA, 17 nt, Pseudomonas aeruginosa PA01
ccccgccgggagcggcc

SEQ ID NO: 1470725 - RNA, 15 nt, Pseudomonas aeruginosa PA01
ccccgccggcguucg

SEQ ID NO: 1470726 - RNA, 13 nt, Pseudomonas aeruginosa PA01
ccccgcuauggcg

SEQ ID NO: 1470727 - RNA, 15 nt, Pseudomonas aeruginosa PA01
ccccgcuucggcggg

SEQ ID NO: 1470728 - RNA, 12 nt, Pseudomonas aeruginosa PA01
ccccgcggccga

SEQ ID NO: 1470729 - RNA, 19 nt, Pseudomonas aeruginosa PA01
ccccgcguguucgaccggg

SEQ ID NO: 1470730 - RNA, 20 nt, Pseudomonas aeruginosa PA01
ccccggccagcagcgccucc

SEQ ID NO: 1470731 - RNA, 18 nt, Pseudomonas aeruginosa PA01
ccccggcaucgccggggc

SEQ ID NO: 1470732 - RNA, 15 nt, Pseudomonas aeruginosa PA01
ccccggcccagccgc

SEQ ID NO: 1470733 - RNA, 16 nt, Pseudomonas aeruginosa PA01
ccccggcccgcgccgc

SEQ ID NO: 1470734 - RNA, 13 nt, Pseudomonas aeruginosa PA01
ccccggcccggcg

SEQ ID NO: 1470735 - RNA, 14 nt, Pseudomonas aeruginosa PA01
ccccggcccggcca

SEQ ID NO: 1470736 - RNA, 16 nt, Pseudomonas aeruginosa PA01
ccccggaccggcucuc

SEQ ID NO: 1470737 - RNA, 15 nt, Pseudomonas aeruginosa PA01
ccccggacugcccga

SEQ ID NO: 1470738 - RNA, 16 nt, Pseudomonas aeruginosa PA01
ccccggcaagggccug

SEQ ID NO: 1470739 - RNA, 15 nt, Pseudomonas aeruginosa PA01
ccccgaaaccggcga

SEQ ID NO: 1470740 - RNA, 17 nt, Pseudomonas aeruginosa PA01
ccccgaaaccggcgaug

SEQ ID NO: 1470741 - RNA, 12 nt, Pseudomonas aeruginosa PA01
cccccgccggcc

SEQ ID NO: 1470742 - RNA, 14 nt, Pseudomonas aeruginosa PA01
cccccgccggccgg

SEQ ID NO: 1470743 - RNA, 14 nt, Pseudomonas aeruginosa PA01
cccccggcgccacc

SEQ ID NO: 1470744 - RNA, 12 nt, Pseudomonas aeruginosa PA01
ccccgcagccgc

SEQ ID NO: 1470745 - RNA, 13 nt, Pseudomonas aeruginosa PA01
ccccgcaaccgcu

SEQ ID NO: 1470746 - RNA, 16 nt, Pseudomonas aeruginosa PA01
ccccgagaaaacccug

SEQ ID NO: 1470747 - RNA, 16 nt, Pseudomonas aeruginosa PA01
ccccgagcccggccgg

SEQ ID NO: 1470748 - RNA, 12 nt, Pseudomonas aeruginosa PA01
ccccgaccagcg

SEQ ID NO: 1470749 - RNA, 20 nt, Pseudomonas aeruginosa PA01
ccccgaccaggucgcuggca

SEQ ID NO: 1470750 - RNA, 15 nt, Pseudomonas aeruginosa PA01
ccccgaggucggcga

SEQ ID NO: 1470751 - RNA, 14 nt, Pseudomonas aeruginosa PA01
ccauccuccagcac

SEQ ID NO: 1470752 - RNA, 21 nt, Pseudomonas aeruginosa PA01
ccauccuccagcacuacgccc

SEQ ID NO: 1470753 - RNA, 19 nt, Pseudomonas aeruginosa PA01
ccauccggggugggcauag

SEQ ID NO: 1470754 - RNA, 20 nt, Pseudomonas aeruginosa PA01
ccaucgaaaucgcccaccag

SEQ ID NO: 1470755 - RNA, 13 nt, Pseudomonas aeruginosa PA01
ccauccucgccgg

SEQ ID NO: 1470756 - RNA, 15 nt, Pseudomonas aeruginosa PA01
ccauccuggccgguc

SEQ ID NO: 1470757 - RNA, 18 nt, Pseudomonas aeruginosa PA01
ccaucccugcuucgacca

SEQ ID NO: 1470758 - RNA, 19 nt, Pseudomonas aeruginosa PA01
ccaucccuucgugcuggcg

SEQ ID NO: 1470759 - RNA, 16 nt, Pseudomonas aeruginosa PA01
ccauccgacgccggcu

SEQ ID NO: 1470760 - RNA, 17 nt, Pseudomonas aeruginosa PA01
ccauccgacgccggcuu

SEQ ID NO: 1470761 - RNA, 13 nt, Pseudomonas aeruginosa PA01
ccauccgcgccga

SEQ ID NO: 1470762 - RNA, 14 nt, Pseudomonas aeruginosa PA01
ccauccgccgcagg

SEQ ID NO: 1470763 - RNA, 16 nt, Pseudomonas aeruginosa PA01
ccauccggaguucgcc

SEQ ID NO: 1470764 - RNA, 16 nt, Pseudomonas aeruginosa PA01
ccauccgcgccgacca

SEQ ID NO: 1470765 - RNA, 22 nt, Pseudomonas aeruginosa PA01
ccauccgcgccgaccagccgca

SEQ ID NO: 1470766 - RNA, 14 nt, Pseudomonas aeruginosa PA01
ccaucgccgcggaa

SEQ ID NO: 1470767 - RNA, 15 nt, Pseudomonas aeruginosa PA01
ccaucgccgcggcga

SEQ ID NO: 1470768 - RNA, 13 nt, Pseudomonas aeruginosa PA01
ccaucgccggccc

SEQ ID NO: 1470769 - RNA, 16 nt, Pseudomonas aeruginosa PA01
ccaucgccggcccgcg

SEQ ID NO: 1470770 - RNA, 16 nt, Pseudomonas aeruginosa PA01
ccaucgccuccacggc

SEQ ID NO: 1470771 - RNA, 17 nt, Pseudomonas aeruginosa PA01
ccaucgccucgccggcc

SEQ ID NO: 1470772 - RNA, 18 nt, Pseudomonas aeruginosa PA01
ccaucgccucgccggcca

SEQ ID NO: 1470773 - RNA, 19 nt, Pseudomonas aeruginosa PA01
ccaucgccucgccggccag

SEQ ID NO: 1470774 - RNA, 15 nt, Pseudomonas aeruginosa PA01
ccaucgccucgcgga

SEQ ID NO: 1470775 - RNA, 21 nt, Pseudomonas aeruginosa PA01
ccaucgccagggucuugccga

SEQ ID NO: 1470776 - RNA, 15 nt, Pseudomonas aeruginosa PA01
ccaucgccaccagca

SEQ ID NO: 1470777 - RNA, 16 nt, Pseudomonas aeruginosa PA01
ccaucgccaccagcag

SEQ ID NO: 1470778 - RNA, 17 nt, Pseudomonas aeruginosa PA01
ccaucgccaccagcagg

SEQ ID NO: 1470779 - RNA, 18 nt, Pseudomonas aeruginosa PA01
ccaucgcaggcagcgcgc

SEQ ID NO: 1470780 - RNA, 16 nt, Pseudomonas aeruginosa PA01
ccaucgcauagccggc

SEQ ID NO: 1470781 - RNA, 18 nt, Pseudomonas aeruginosa PA01
ccaucgcauagccggcgc

SEQ ID NO: 1470782 - RNA, 20 nt, Pseudomonas aeruginosa PA01
ccaucgcauagccggcgcgc

SEQ ID NO: 1470783 - RNA, 19 nt, Pseudomonas aeruginosa PA01
ccaucgaucagcagcgcca

SEQ ID NO: 1470784 - RNA, 17 nt, Pseudomonas aeruginosa PA01
ccaucgaggccaggccg

SEQ ID NO: 1470785 - RNA, 19 nt, Pseudomonas aeruginosa PA01
ccaucgaggccaggccgag

SEQ ID NO: 1470786 - RNA, 17 nt, Pseudomonas aeruginosa PA01
ccauaccuccagccagc

SEQ ID NO: 1470787 - RNA, 17 nt, Pseudomonas aeruginosa PA01
ccauaauggccgcuacg

SEQ ID NO: 1470788 - RNA, 14 nt, Pseudomonas aeruginosa PA01
ccaguugggccagg

SEQ ID NO: 1470789 - RNA, 23 nt, Pseudomonas aeruginosa PA01
ccauacaccaggccggcggccga

SEQ ID NO: 1470790 - RNA, 23 nt, Pseudomonas aeruginosa PA01
ccaucaggccgcggcccugcgcc

SEQ ID NO: 1470791 - RNA, 14 nt, Pseudomonas aeruginosa PA01
ccaucaguugcgcg

SEQ ID NO: 1470792 - RNA, 21 nt, Pseudomonas aeruginosa PA01
ccauccagucuucgccggccu

SEQ ID NO: 1470793 - RNA, 12 nt, Pseudomonas aeruginosa PA01
ccauccagcgcc

SEQ ID NO: 1470794 - RNA, 15 nt, Pseudomonas aeruginosa PA01
ccaucuuuuccugcu

SEQ ID NO: 1470795 - RNA, 20 nt, Pseudomonas aeruginosa PA01
ccaugaaaaagccccgccga

SEQ ID NO: 1470796 - RNA, 21 nt, Pseudomonas aeruginosa PA01
ccaugaaaaagcccggccugg

SEQ ID NO: 1470797 - RNA, 17 nt, Pseudomonas aeruginosa PA01
ccaugaaaaaggcgccc

SEQ ID NO: 1470798 - RNA, 15 nt, Pseudomonas aeruginosa PA01
ccaucuucagcauca

SEQ ID NO: 1470799 - RNA, 15 nt, Pseudomonas aeruginosa PA01
ccaucuucaggccgu

SEQ ID NO: 1470800 - RNA, 19 nt, Pseudomonas aeruginosa PA01
ccaucuucucgaagcgcgc

SEQ ID NO: 1470801 - RNA, 15 nt, Pseudomonas aeruginosa PA01
ccaucgcggcgaugg

SEQ ID NO: 1470802 - RNA, 21 nt, Pseudomonas aeruginosa PA01
ccaucgcggcgauggccgcca

SEQ ID NO: 1470803 - RNA, 18 nt, Pseudomonas aeruginosa PA01
ccaugaccucggccagcc

SEQ ID NO: 1470804 - RNA, 15 nt, Pseudomonas aeruginosa PA01
ccaugacacaccacg

SEQ ID NO: 1470805 - RNA, 21 nt, Pseudomonas aeruginosa PA01
ccaugcaagaacgccgacccu

SEQ ID NO: 1470806 - RNA, 12 nt, Pseudomonas aeruginosa PA01
ccaugauccggu

SEQ ID NO: 1470807 - RNA, 14 nt, Pseudomonas aeruginosa PA01
ccaugaucgccacc

SEQ ID NO: 1470808 - RNA, 17 nt, Pseudomonas aeruginosa PA01
ccauuagcgucgcgcgg

SEQ ID NO: 1470809 - RNA, 15 nt, Pseudomonas aeruginosa PA01
ccauggccggcgugc

SEQ ID NO: 1470810 - RNA, 14 nt, Pseudomonas aeruginosa PA01
ccauggcauccccu

SEQ ID NO: 1470811 - RNA, 20 nt, Pseudomonas aeruginosa PA01
ccauggcaugaggggaaucg

SEQ ID NO: 1470812 - RNA, 22 nt, Pseudomonas aeruginosa PA01
ccaugcuguugccguggcggcg

SEQ ID NO: 1470813 - RNA, 15 nt, Pseudomonas aeruginosa PA01
ccaugcccgccccgc

SEQ ID NO: 1470814 - RNA, 16 nt, Pseudomonas aeruginosa PA01
ccaugcccggcuggcg

SEQ ID NO: 1470815 - RNA, 13 nt, Pseudomonas aeruginosa PA01
ccaugcccagacg

SEQ ID NO: 1470816 - RNA, 17 nt, Pseudomonas aeruginosa PA01
ccaugcccagacgccgc

SEQ ID NO: 1470817 - RNA, 23 nt, Pseudomonas aeruginosa PA01
ccaugccgcaagcuccccgccgc

SEQ ID NO: 1470818 - RNA, 16 nt, Pseudomonas aeruginosa PA01
ccaugccgcccggccg

SEQ ID NO: 1470819 - RNA, 17 nt, Pseudomonas aeruginosa PA01
ccaugccgcccggccgc

SEQ ID NO: 1470820 - RNA, 13 nt, Pseudomonas aeruginosa PA01
ccaugcagcggca

SEQ ID NO: 1470821 - RNA, 20 nt, Pseudomonas aeruginosa PA01
ccaugcaggcugccggacgc

SEQ ID NO: 1470822 - RNA, 21 nt, Pseudomonas aeruginosa PA01
ccaugcucggccagcucgccg

SEQ ID NO: 1470823 - RNA, 13 nt, Pseudomonas aeruginosa PA01
ccaugccggcgcc

SEQ ID NO: 1470824 - RNA, 19 nt, Pseudomonas aeruginosa PA01
ccaugcucaggucgaacug

SEQ ID NO: 1470825 - RNA, 13 nt, Pseudomonas aeruginosa PA01
ccaugcuccgccu

SEQ ID NO: 1470826 - RNA, 16 nt, Pseudomonas aeruginosa PA01
ccaugcuccgccuggc

SEQ ID NO: 1470827 - RNA, 20 nt, Pseudomonas aeruginosa PA01
ccaugcuccgccuggcggau

SEQ ID NO: 1470828 - RNA, 14 nt, Pseudomonas aeruginosa PA01
ccaggugauccaug

SEQ ID NO: 1470829 - RNA, 20 nt, Pseudomonas aeruginosa PA01
ccagguucuggucgccgaca

SEQ ID NO: 1470830 - RNA, 16 nt, Pseudomonas aeruginosa PA01
ccagguugaagaacgg

SEQ ID NO: 1470831 - RNA, 17 nt, Pseudomonas aeruginosa PA01
ccagguugaagaacggc

SEQ ID NO: 1470832 - RNA, 22 nt, Pseudomonas aeruginosa PA01
ccagguugaagaacggcccgcu

SEQ ID NO: 1470833 - RNA, 16 nt, Pseudomonas aeruginosa PA01
ccaggugcagcgaggg

SEQ ID NO: 1470834 - RNA, 17 nt, Pseudomonas aeruginosa PA01
ccaggugcacggccagg

SEQ ID NO: 1470835 - RNA, 18 nt, Pseudomonas aeruginosa PA01
ccaggugcacggccaggc

SEQ ID NO: 1470836 - RNA, 20 nt, Pseudomonas aeruginosa PA01
ccaggugcacggccaggcca

SEQ ID NO: 1470837 - RNA, 19 nt, Pseudomonas aeruginosa PA01
ccaggucuguggaggcgca

SEQ ID NO: 1470838 - RNA, 17 nt, Pseudomonas aeruginosa PA01
ccaggucguugcgccgg

SEQ ID NO: 1470839 - RNA, 18 nt, Pseudomonas aeruginosa PA01
ccaggucguugcgccggc

SEQ ID NO: 1470840 - RNA, 19 nt, Pseudomonas aeruginosa PA01
ccaggucguugcgccggcc

SEQ ID NO: 1470841 - RNA, 18 nt, Pseudomonas aeruginosa PA01
ccagguucugccagagcg

SEQ ID NO: 1470842 - RNA, 14 nt, Pseudomonas aeruginosa PA01
ccagguugcccggc

SEQ ID NO: 1470843 - RNA, 16 nt, Pseudomonas aeruginosa PA01
ccagguugcccggcuu

SEQ ID NO: 1470844 - RNA, 21 nt, Pseudomonas aeruginosa PA01
ccagguugcgcaaccagcgcu

SEQ ID NO: 1470845 - RNA, 14 nt, Pseudomonas aeruginosa PA01
ccagguuggccagu

SEQ ID NO: 1470846 - RNA, 15 nt, Pseudomonas aeruginosa PA01
ccagguuggccaguu

SEQ ID NO: 1470847 - RNA, 17 nt, Pseudomonas aeruginosa PA01
ccagguuggccuggccc

SEQ ID NO: 1470848 - RNA, 20 nt, Pseudomonas aeruginosa PA01
ccagguuggccuggcccggc

SEQ ID NO: 1470849 - RNA, 22 nt, Pseudomonas aeruginosa PA01
ccagguuggccuggcccggcgc

SEQ ID NO: 1470850 - RNA, 20 nt, Pseudomonas aeruginosa PA01
ccagguugugcucgaucacc

SEQ ID NO: 1470851 - RNA, 14 nt, Pseudomonas aeruginosa PA01
ccagucggcgcugg

SEQ ID NO: 1470852 - RNA, 22 nt, Pseudomonas aeruginosa PA01
ccagucggcggucuugaucacg

SEQ ID NO: 1470853 - RNA, 20 nt, Pseudomonas aeruginosa PA01
ccagucggggcaggcgcagg

SEQ ID NO: 1470854 - RNA, 19 nt, Pseudomonas aeruginosa PA01
ccagucggccguugcgggc

SEQ ID NO: 1470855 - RNA, 13 nt, Pseudomonas aeruginosa PA01
ccagucggccugg

SEQ ID NO: 1470856 - RNA, 16 nt, Pseudomonas aeruginosa PA01
ccagucgagacgccag

SEQ ID NO: 1470857 - RNA, 21 nt, Pseudomonas aeruginosa PA01
ccagucgagacgccagccgcc

SEQ ID NO: 1470858 - RNA, 15 nt, Pseudomonas aeruginosa PA01
ccagucgagagcggg

SEQ ID NO: 1470859 - RNA, 19 nt, Pseudomonas aeruginosa PA01
ccagucccuggccggcgau

SEQ ID NO: 1470860 - RNA, 17 nt, Pseudomonas aeruginosa PA01
ccagucccuucagcgca

SEQ ID NO: 1470861 - RNA, 21 nt, Pseudomonas aeruginosa PA01
ccagucccuucagcgcaccgc

SEQ ID NO: 1470862 - RNA, 20 nt, Pseudomonas aeruginosa PA01
ccaguccggcagcacggcga

SEQ ID NO: 1470863 - RNA, 19 nt, Pseudomonas aeruginosa PA01
ccaguugcagcacccccag

SEQ ID NO: 1470864 - RNA, 16 nt, Pseudomonas aeruginosa PA01
ccaguugcccggccug

SEQ ID NO: 1470865 - RNA, 13 nt, Pseudomonas aeruginosa PA01
ccaguugccgagc

SEQ ID NO: 1470866 - RNA, 15 nt, Pseudomonas aeruginosa PA01
ccaguugcgcggcga

SEQ ID NO: 1470867 - RNA, 20 nt, Pseudomonas aeruginosa PA01
ccaguugcgcuccgguggcg

SEQ ID NO: 1470868 - RNA, 19 nt, Pseudomonas aeruginosa PA01
ccaguuggugcacgcgccg

SEQ ID NO: 1470869 - RNA, 20 nt, Pseudomonas aeruginosa PA01
ccaguuggugcacgcgccgg

SEQ ID NO: 1470870 - RNA, 21 nt, Pseudomonas aeruginosa PA01
ccaguuggugcacgcgccggg

SEQ ID NO: 1470871 - RNA, 15 nt, Pseudomonas aeruginosa PA01
ccaguugcugggcga

SEQ ID NO: 1470872 - RNA, 17 nt, Pseudomonas aeruginosa PA01
ccaguucuucgccgccc

SEQ ID NO: 1470873 - RNA, 22 nt, Pseudomonas aeruginosa PA01
ccaguucuucgccgcccgcgcc

SEQ ID NO: 1470874 - RNA, 14 nt, Pseudomonas aeruginosa PA01
ccagucuucgccgg

SEQ ID NO: 1470875 - RNA, 23 nt, Pseudomonas aeruginosa PA01
ccaguguggcggcguggcucgau

SEQ ID NO: 1470876 - RNA, 14 nt, Pseudomonas aeruginosa PA01
ccaguggcgccgcc

SEQ ID NO: 1470877 - RNA, 16 nt, Pseudomonas aeruginosa PA01
ccaguggcgccgccau

SEQ ID NO: 1470878 - RNA, 16 nt, Pseudomonas aeruginosa PA01
ccagugggccaccggc

SEQ ID NO: 1470879 - RNA, 18 nt, Pseudomonas aeruginosa PA01
ccagggcuucccaggcca

SEQ ID NO: 1470880 - RNA, 20 nt, Pseudomonas aeruginosa PA01
ccagggcuucccaggccagc

SEQ ID NO: 1470881 - RNA, 17 nt, Pseudomonas aeruginosa PA01
ccagggcuucgcgcaga

SEQ ID NO: 1470882 - RNA, 18 nt, Pseudomonas aeruginosa PA01
ccaggggagcgccggcgc

SEQ ID NO: 1470883 - RNA, 19 nt, Pseudomonas aeruginosa PA01
ccaggggagcgccggcgcg

SEQ ID NO: 1470884 - RNA, 18 nt, Pseudomonas aeruginosa PA01
ccaggggauggucgguga

SEQ ID NO: 1470885 - RNA, 16 nt, Pseudomonas aeruginosa PA01
ccagggcucggacgac

SEQ ID NO: 1470886 - RNA, 20 nt, Pseudomonas aeruginosa PA01
ccagggcugccaccgagggc

SEQ ID NO: 1470887 - RNA, 16 nt, Pseudomonas aeruginosa PA01
ccaggggucgacgcag

SEQ ID NO: 1470888 - RNA, 18 nt, Pseudomonas aeruginosa PA01
ccaggggucgacgcaggg

SEQ ID NO: 1470889 - RNA, 19 nt, Pseudomonas aeruginosa PA01
ccaggggucgacgcagggc

SEQ ID NO: 1470890 - RNA, 16 nt, Pseudomonas aeruginosa PA01
ccaggggucggcaucg

SEQ ID NO: 1470891 - RNA, 19 nt, Pseudomonas aeruginosa PA01
ccaggggucggcaucgcgu

SEQ ID NO: 1470892 - RNA, 22 nt, Pseudomonas aeruginosa PA01
ccaggguaccgaaacagggcga

SEQ ID NO: 1470893 - RNA, 22 nt, Pseudomonas aeruginosa PA01
ccaggguaccguugcgcaggcg

SEQ ID NO: 1470894 - RNA, 20 nt, Pseudomonas aeruginosa PA01
ccaggggcuagucgcgcagc

SEQ ID NO: 1470895 - RNA, 21 nt, Pseudomonas aeruginosa PA01
ccaggggcuagucgcgcagcg

SEQ ID NO: 1470896 - RNA, 21 nt, Pseudomonas aeruginosa PA01
ccaggggcugaacagcgccac

SEQ ID NO: 1470897 - RNA, 19 nt, Pseudomonas aeruginosa PA01
ccaggggcauguccaccgc

SEQ ID NO: 1470898 - RNA, 14 nt, Pseudomonas aeruginosa PA01
ccagguagccggcg

SEQ ID NO: 1470899 - RNA, 15 nt, Pseudomonas aeruginosa PA01
ccagguagccggcga

SEQ ID NO: 1470900 - RNA, 22 nt, Pseudomonas aeruginosa PA01
ccagguagcgcugcgccaggcu

SEQ ID NO: 1470901 - RNA, 19 nt, Pseudomonas aeruginosa PA01
ccagguagcggaccccggc

SEQ ID NO: 1470902 - RNA, 22 nt, Pseudomonas aeruginosa PA01
ccagguagcggcguucgccgag

SEQ ID NO: 1470903 - RNA, 14 nt, Pseudomonas aeruginosa PA01
ccaggguggcgcgc

SEQ ID NO: 1470904 - RNA, 19 nt, Pseudomonas aeruginosa PA01
ccagggggcgacauagcgg

SEQ ID NO: 1470905 - RNA, 15 nt, Pseudomonas aeruginosa PA01
ccagggucuugccga

SEQ ID NO: 1470906 - RNA, 22 nt, Pseudomonas aeruginosa PA01
ccagggugacgcucuucaccuc

SEQ ID NO: 1470907 - RNA, 23 nt, Pseudomonas aeruginosa PA01
ccagggugaucgacucgauggcg

SEQ ID NO: 1470908 - RNA, 17 nt, Pseudomonas aeruginosa PA01
ccaggguagcgccgcgg

SEQ ID NO: 1470909 - RNA, 14 nt, Pseudomonas aeruginosa PA01
ccaggguaucgcug

SEQ ID NO: 1470910 - RNA, 21 nt, Pseudomonas aeruginosa PA01
ccaggguaucgcugucgcccg

SEQ ID NO: 1470911 - RNA, 17 nt, Pseudomonas aeruginosa PA01
ccagggucacgccgcgg

SEQ ID NO: 1470912 - RNA, 18 nt, Pseudomonas aeruginosa PA01
ccagggucacgccgcggc

SEQ ID NO: 1470913 - RNA, 20 nt, Pseudomonas aeruginosa PA01
ccagggucacgccgcggcug

SEQ ID NO: 1470914 - RNA, 16 nt, Pseudomonas aeruginosa PA01
ccagggucagcuggcg

SEQ ID NO: 1470915 - RNA, 17 nt, Pseudomonas aeruginosa PA01
ccagggucagcuggcgc

SEQ ID NO: 1470916 - RNA, 20 nt, Pseudomonas aeruginosa PA01
ccaggguccgcuucagcgcg

SEQ ID NO: 1470917 - RNA, 12 nt, Pseudomonas aeruginosa PA01
ccagggucgccc

SEQ ID NO: 1470918 - RNA, 21 nt, Pseudomonas aeruginosa PA01
ccagggucgguucgcggcgca

SEQ ID NO: 1470919 - RNA, 16 nt, Pseudomonas aeruginosa PA01
ccaggucgguccgccg

SEQ ID NO: 1470920 - RNA, 17 nt, Pseudomonas aeruginosa PA01
ccaggucgguccgccga

SEQ ID NO: 1470921 - RNA, 12 nt, Pseudomonas aeruginosa PA01
ccaggucggcgg

SEQ ID NO: 1470922 - RNA, 23 nt, Pseudomonas aeruginosa PA01
ccagguccgccacuucaagcugg

SEQ ID NO: 1470923 - RNA, 15 nt, Pseudomonas aeruginosa PA01
ccagguccggcagcg

SEQ ID NO: 1470924 - RNA, 16 nt, Pseudomonas aeruginosa PA01
ccagguagucgcccag

SEQ ID NO: 1470925 - RNA, 18 nt, Pseudomonas aeruginosa PA01
ccagguagucgcccagcg

SEQ ID NO: 1470926 - RNA, 22 nt, Pseudomonas aeruginosa PA01
ccagggugggcggugcggcauu

SEQ ID NO: 1470927 - RNA, 18 nt, Pseudomonas aeruginosa PA01
ccagguagaccuugccgu

SEQ ID NO: 1470928 - RNA, 15 nt, Pseudomonas aeruginosa PA01
ccagguaggcgacga

SEQ ID NO: 1470929 - RNA, 15 nt, Pseudomonas aeruginosa PA01
ccagguaggcgaugc

SEQ ID NO: 1470930 - RNA, 15 nt, Pseudomonas aeruginosa PA01
ccagguaggcgcccu

SEQ ID NO: 1470931 - RNA, 22 nt, Pseudomonas aeruginosa PA01
ccaggucagccaccugcucgcu

SEQ ID NO: 1470932 - RNA, 19 nt, Pseudomonas aeruginosa PA01
ccaggaggauucgccagcc

SEQ ID NO: 1470933 - RNA, 22 nt, Pseudomonas aeruginosa PA01
ccaggaucgaccccgccggggc

SEQ ID NO: 1470934 - RNA, 12 nt, Pseudomonas aeruginosa PA01
ccaggaucgccg

SEQ ID NO: 1470935 - RNA, 13 nt, Pseudomonas aeruginosa PA01
ccaggaucgccgg

SEQ ID NO: 1470936 - RNA, 14 nt, Pseudomonas aeruginosa PA01
ccaggaucgccggg

SEQ ID NO: 1470937 - RNA, 21 nt, Pseudomonas aeruginosa PA01
ccagggcagggaguccgccag

SEQ ID NO: 1470938 - RNA, 20 nt, Pseudomonas aeruginosa PA01
ccagggcaguacguggcgcu

SEQ ID NO: 1470939 - RNA, 21 nt, Pseudomonas aeruginosa PA01
ccagggcauguuccuccagag

SEQ ID NO: 1470940 - RNA, 21 nt, Pseudomonas aeruginosa PA01
ccagggccagcuuggucggga

SEQ ID NO: 1470941 - RNA, 15 nt, Pseudomonas aeruginosa PA01
ccagggccaggagca

SEQ ID NO: 1470942 - RNA, 21 nt, Pseudomonas aeruginosa PA01
ccagggccaggagcaucggcg

SEQ ID NO: 1470943 - RNA, 23 nt, Pseudomonas aeruginosa PA01
ccagggccaggaugaccaggcug

SEQ ID NO: 1470944 - RNA, 14 nt, Pseudomonas aeruginosa PA01
ccagggccagggcg

SEQ ID NO: 1470945 - RNA, 21 nt, Pseudomonas aeruginosa PA01
ccagggcccacagugccaggc

SEQ ID NO: 1470946 - RNA, 22 nt, Pseudomonas aeruginosa PA01
ccagggcccacagugccaggcu

SEQ ID NO: 1470947 - RNA, 23 nt, Pseudomonas aeruginosa PA01
ccagggccgggucaucaccggca

SEQ ID NO: 1470948 - RNA, 14 nt, Pseudomonas aeruginosa PA01
ccagggccgcucga

SEQ ID NO: 1470949 - RNA, 22 nt, Pseudomonas aeruginosa PA01
ccagggccagcagcggcggcgc

SEQ ID NO: 1470950 - RNA, 14 nt, Pseudomonas aeruginosa PA01
ccagggccagcggg

SEQ ID NO: 1470951 - RNA, 16 nt, Pseudomonas aeruginosa PA01
ccagggccucggggcc

SEQ ID NO: 1470952 - RNA, 21 nt, Pseudomonas aeruginosa PA01
ccagggccugcuccagcggag

SEQ ID NO: 1470953 - RNA, 14 nt, Pseudomonas aeruginosa PA01
ccagggccuggcgc

SEQ ID NO: 1470954 - RNA, 20 nt, Pseudomonas aeruginosa PA01
ccagggccuggcgcacggcc

SEQ ID NO: 1470955 - RNA, 20 nt, Pseudomonas aeruginosa PA01
ccagggcgaacagcgccgcg

SEQ ID NO: 1470956 - RNA, 20 nt, Pseudomonas aeruginosa PA01
ccagggcgaagucggcgcgc

SEQ ID NO: 1470957 - RNA, 18 nt, Pseudomonas aeruginosa PA01
ccagggcgaauaccagug

SEQ ID NO: 1470958 - RNA, 12 nt, Pseudomonas aeruginosa PA01
ccagggccgagc

SEQ ID NO: 1470959 - RNA, 20 nt, Pseudomonas aeruginosa PA01
ccagggcgcgguagggaucg

SEQ ID NO: 1470960 - RNA, 12 nt, Pseudomonas aeruginosa PA01
ccagggcgcugc

SEQ ID NO: 1470961 - RNA, 21 nt, Pseudomonas aeruginosa PA01
ccagggcgcugccgaucagcc

SEQ ID NO: 1470962 - RNA, 12 nt, Pseudomonas aeruginosa PA01
ccagggcggcgc

SEQ ID NO: 1470963 - RNA, 15 nt, Pseudomonas aeruginosa PA01
ccagggcggcgcgga

SEQ ID NO: 1470964 - RNA, 15 nt, Pseudomonas aeruginosa PA01
ccagggcggcggcga

SEQ ID NO: 1470965 - RNA, 18 nt, Pseudomonas aeruginosa PA01
ccagggcgggccgcucgc

SEQ ID NO: 1470966 - RNA, 19 nt, Pseudomonas aeruginosa PA01
ccagggcgggccgcucgcg

SEQ ID NO: 1470967 - RNA, 15 nt, Pseudomonas aeruginosa PA01
ccagggcgucggaga

SEQ ID NO: 1470968 - RNA, 12 nt, Pseudomonas aeruginosa PA01
ccagggcgaucg

SEQ ID NO: 1470969 - RNA, 21 nt, Pseudomonas aeruginosa PA01
ccagggcgaggaucacgcagc

SEQ ID NO: 1470970 - RNA, 22 nt, Pseudomonas aeruginosa PA01
ccagggcgaggaucacgcagca

SEQ ID NO: 1470971 - RNA, 19 nt, Pseudomonas aeruginosa PA01
ccagaggcugcgcuccagg

SEQ ID NO: 1470972 - RNA, 14 nt, Pseudomonas aeruginosa PA01
ccagagcagcgucg

SEQ ID NO: 1470973 - RNA, 13 nt, Pseudomonas aeruginosa PA01
ccagagccgcucg

SEQ ID NO: 1470974 - RNA, 14 nt, Pseudomonas aeruginosa PA01
ccagagccagccgc

SEQ ID NO: 1470975 - RNA, 17 nt, Pseudomonas aeruginosa PA01
ccagagccagccgcgag

SEQ ID NO: 1470976 - RNA, 18 nt, Pseudomonas aeruginosa PA01
ccagagccagccgcgagu

SEQ ID NO: 1470977 - RNA, 19 nt, Pseudomonas aeruginosa PA01
ccagagcccgucgaagcca

SEQ ID NO: 1470978 - RNA, 13 nt, Pseudomonas aeruginosa PA01
ccagagccgccga

SEQ ID NO: 1470979 - RNA, 15 nt, Pseudomonas aeruginosa PA01
ccagagccgccgaac

SEQ ID NO: 1470980 - RNA, 13 nt, Pseudomonas aeruginosa PA01
ccagagcuccagg

SEQ ID NO: 1470981 - RNA, 21 nt, Pseudomonas aeruginosa PA01
ccagagcgcgcccugcaggcc

SEQ ID NO: 1470982 - RNA, 14 nt, Pseudomonas aeruginosa PA01
ccagcaacaggcaa

SEQ ID NO: 1470983 - RNA, 17 nt, Pseudomonas aeruginosa PA01
ccagcaaacgggacagg

SEQ ID NO: 1470984 - RNA, 19 nt, Pseudomonas aeruginosa PA01
ccagcaacaccggaagcgu

SEQ ID NO: 1470985 - RNA, 15 nt, Pseudomonas aeruginosa PA01
ccagcaaacccgggc

SEQ ID NO: 1470986 - RNA, 16 nt, Pseudomonas aeruginosa PA01
ccagcaacccaugccg

SEQ ID NO: 1470987 - RNA, 14 nt, Pseudomonas aeruginosa PA01
ccagcaacgggucg

SEQ ID NO: 1470988 - RNA, 19 nt, Pseudomonas aeruginosa PA01
ccagcaagccguagaacgc

SEQ ID NO: 1470989 - RNA, 12 nt, Pseudomonas aeruginosa PA01
ccagcacccagg

SEQ ID NO: 1470990 - RNA, 18 nt, Pseudomonas aeruginosa PA01
ccagcaccaugcgcggca

SEQ ID NO: 1470991 - RNA, 17 nt, Pseudomonas aeruginosa PA01
ccagcaccagcaggagc

SEQ ID NO: 1470992 - RNA, 21 nt, Pseudomonas aeruginosa PA01
ccagcaccagucccuggccgg

SEQ ID NO: 1470993 - RNA, 23 nt, Pseudomonas aeruginosa PA01
ccagcaccagucccuggccggcg

SEQ ID NO: 1470994 - RNA, 17 nt, Pseudomonas aeruginosa PA01
ccagcaauacccgccgc

SEQ ID NO: 1470995 - RNA, 17 nt, Pseudomonas aeruginosa PA01
ccagcaccacccggccg

SEQ ID NO: 1470996 - RNA, 21 nt, Pseudomonas aeruginosa PA01
ccagcaccacccggccgcgcu

SEQ ID NO: 1470997 - RNA, 17 nt, Pseudomonas aeruginosa PA01
ccagcaccacccggcgc

SEQ ID NO: 1470998 - RNA, 19 nt, Pseudomonas aeruginosa PA01
ccagcaaggugcgggcgac

SEQ ID NO: 1470999 - RNA, 14 nt, Pseudomonas aeruginosa PA01
ccagcaaugccagc

SEQ ID NO: 1471000 - RNA, 17 nt, Pseudomonas aeruginosa PA01
ccagcaaugccagcgcc

SEQ ID NO: 1471001 - RNA, 18 nt, Pseudomonas aeruginosa PA01
ccagcaaugccagcgcca

SEQ ID NO: 1471002 - RNA, 22 nt, Pseudomonas aeruginosa PA01
ccagcaaugccagcgccacgcc

SEQ ID NO: 1471003 - RNA, 14 nt, Pseudomonas aeruginosa PA01
ccagcaaugcccag

SEQ ID NO: 1471004 - RNA, 18 nt, Pseudomonas aeruginosa PA01
ccagcaauuccacgcgac

SEQ ID NO: 1471005 - RNA, 16 nt, Pseudomonas aeruginosa PA01
ccagcaauugccggcg

SEQ ID NO: 1471006 - RNA, 17 nt, Pseudomonas aeruginosa PA01
ccagcaauugccggcgu

SEQ ID NO: 1471007 - RNA, 17 nt, Pseudomonas aeruginosa PA01
ccagcaccucccccagc

SEQ ID NO: 1471008 - RNA, 22 nt, Pseudomonas aeruginosa PA01
ccagcaccucccccagcgggcg

SEQ ID NO: 1471009 - RNA, 13 nt, Pseudomonas aeruginosa PA01
ccagcaccguggu

SEQ ID NO: 1471010 - RNA, 15 nt, Pseudomonas aeruginosa PA01
ccagcaccggcggcg

SEQ ID NO: 1471011 - RNA, 16 nt, Pseudomonas aeruginosa PA01
ccagcaccgagcugau

SEQ ID NO: 1471012 - RNA, 21 nt, Pseudomonas aeruginosa PA01
ccagcaccgagcugaucgcgc

SEQ ID NO: 1471013 - RNA, 22 nt, Pseudomonas aeruginosa PA01
ccagcaccgagcugaucgcgca

SEQ ID NO: 1471014 - RNA, 14 nt, Pseudomonas aeruginosa PA01
ccagcaccgccugc

SEQ ID NO: 1471015 - RNA, 15 nt, Pseudomonas aeruginosa PA01
ccagcaccgccugca

SEQ ID NO: 1471016 - RNA, 21 nt, Pseudomonas aeruginosa PA01
ccagcaccgccugcaacucgu

SEQ ID NO: 1471017 - RNA, 15 nt, Pseudomonas aeruginosa PA01
ccagcacgcuggcga

SEQ ID NO: 1471018 - RNA, 18 nt, Pseudomonas aeruginosa PA01
ccagcacggcgcagggca

SEQ ID NO: 1471019 - RNA, 22 nt, Pseudomonas aeruginosa PA01
ccagcacggcgaauucgucgcc

SEQ ID NO: 1471020 - RNA, 24 nt, Pseudomonas aeruginosa PA01
ccagcacggcgaauucgucgccgc

SEQ ID NO: 1471021 - RNA, 17 nt, Pseudomonas aeruginosa PA01
ccagcacggugaaccag

SEQ ID NO: 1471022 - RNA, 21 nt, Pseudomonas aeruginosa PA01
ccagcacggugaaccaggcgc

SEQ ID NO: 1471023 - RNA, 17 nt, Pseudomonas aeruginosa PA01
ccagcagcacggcgacg

SEQ ID NO: 1471024 - RNA, 17 nt, Pseudomonas aeruginosa PA01
ccagcagcccggccugg

SEQ ID NO: 1471025 - RNA, 19 nt, Pseudomonas aeruginosa PA01
ccagcagcaugggauggcg

SEQ ID NO: 1471026 - RNA, 17 nt, Pseudomonas aeruginosa PA01
ccagcagcaggccggcg

SEQ ID NO: 1471027 - RNA, 22 nt, Pseudomonas aeruginosa PA01
ccagcagcaggccggcgaccag

SEQ ID NO: 1471028 - RNA, 14 nt, Pseudomonas aeruginosa PA01
ccagcagcaggucg

SEQ ID NO: 1471029 - RNA, 21 nt, Pseudomonas aeruginosa PA01
ccagcagcaggucgucggcga

SEQ ID NO: 1471030 - RNA, 12 nt, Pseudomonas aeruginosa PA01
ccagcaggucga

SEQ ID NO: 1471031 - RNA, 20 nt, Pseudomonas aeruginosa PA01
ccagcaggucggcagcgucg

SEQ ID NO: 1471032 - RNA, 17 nt, Pseudomonas aeruginosa PA01
ccagcaggucggccugc

SEQ ID NO: 1471033 - RNA, 15 nt, Pseudomonas aeruginosa PA01
ccagcaggucggcgc

SEQ ID NO: 1471034 - RNA, 19 nt, Pseudomonas aeruginosa PA01
ccagcaggucggcgcgacg

SEQ ID NO: 1471035 - RNA, 17 nt, Pseudomonas aeruginosa PA01
ccagcaguagugcgacg

SEQ ID NO: 1471036 - RNA, 21 nt, Pseudomonas aeruginosa PA01
ccagcaguagugcgacgcagc

SEQ ID NO: 1471037 - RNA, 13 nt, Pseudomonas aeruginosa PA01
ccagcaggccagc

SEQ ID NO: 1471038 - RNA, 15 nt, Pseudomonas aeruginosa PA01
ccagcaggaucgaca

SEQ ID NO: 1471039 - RNA, 20 nt, Pseudomonas aeruginosa PA01
ccagcaggaucgacagcagc

SEQ ID NO: 1471040 - RNA, 23 nt, Pseudomonas aeruginosa PA01
ccagcagguagccugcggccagc

SEQ ID NO: 1471041 - RNA, 12 nt, Pseudomonas aeruginosa PA01
ccagcaggucgg

SEQ ID NO: 1471042 - RNA, 18 nt, Pseudomonas aeruginosa PA01
ccagcaggucgagggcgu

SEQ ID NO: 1471043 - RNA, 20 nt, Pseudomonas aeruginosa PA01
ccagcaggucgagggcgucc

SEQ ID NO: 1471044 - RNA, 15 nt, Pseudomonas aeruginosa PA01
ccagcaggucgaggu

SEQ ID NO: 1471045 - RNA, 17 nt, Pseudomonas aeruginosa PA01
ccagcagucgcacagcc

SEQ ID NO: 1471046 - RNA, 20 nt, Pseudomonas aeruginosa PA01
ccagcagucgcacagccagg

SEQ ID NO: 1471047 - RNA, 13 nt, Pseudomonas aeruginosa PA01
ccagcagucgcgg

SEQ ID NO: 1471048 - RNA, 15 nt, Pseudomonas aeruginosa PA01
ccagcagucgcggcc

SEQ ID NO: 1471049 - RNA, 14 nt, Pseudomonas aeruginosa PA01
ccagcaucgccggc

SEQ ID NO: 1471050 - RNA, 18 nt, Pseudomonas aeruginosa PA01
ccagcaucgccggcagcg

SEQ ID NO: 1471051 - RNA, 13 nt, Pseudomonas aeruginosa PA01
ccagcagguggcg

SEQ ID NO: 1471052 - RNA, 18 nt, Pseudomonas aeruginosa PA01
ccagcagcggcggcgccg

SEQ ID NO: 1471053 - RNA, 19 nt, Pseudomonas aeruginosa PA01
ccagcagcggcggcgccgg

SEQ ID NO: 1471054 - RNA, 16 nt, Pseudomonas aeruginosa PA01
ccagcagcggcucacg

SEQ ID NO: 1471055 - RNA, 18 nt, Pseudomonas aeruginosa PA01
ccagcagcuccgggcugg

SEQ ID NO: 1471056 - RNA, 14 nt, Pseudomonas aeruginosa PA01
ccagcaggaagccg

SEQ ID NO: 1471057 - RNA, 16 nt, Pseudomonas aeruginosa PA01
ccagcagggucgccug

SEQ ID NO: 1471058 - RNA, 17 nt, Pseudomonas aeruginosa PA01
ccagcagggucgccugg

SEQ ID NO: 1471059 - RNA, 22 nt, Pseudomonas aeruginosa PA01
ccagcagggucgcuuccucggc

SEQ ID NO: 1471060 - RNA, 20 nt, Pseudomonas aeruginosa PA01
ccagcagggugcggauggcg

SEQ ID NO: 1471061 - RNA, 22 nt, Pseudomonas aeruginosa PA01
ccagcagggugcggauggcgau

SEQ ID NO: 1471062 - RNA, 17 nt, Pseudomonas aeruginosa PA01
ccagcaggguggccagg

SEQ ID NO: 1471063 - RNA, 17 nt, Pseudomonas aeruginosa PA01
ccagcaggaccuggccg

SEQ ID NO: 1471064 - RNA, 18 nt, Pseudomonas aeruginosa PA01
ccagcaggaccuggccgu

SEQ ID NO: 1471065 - RNA, 14 nt, Pseudomonas aeruginosa PA01
ccacgcucaccggu

SEQ ID NO: 1471066 - RNA, 20 nt, Pseudomonas aeruginosa PA01
ccacgcucuugaucgucucg

SEQ ID NO: 1471067 - RNA, 24 nt, Pseudomonas aeruginosa PA01
ccacgcugaggcucagcgcgccga

SEQ ID NO: 1471068 - RNA, 18 nt, Pseudomonas aeruginosa PA01
ccacgcucagugcgccgg

SEQ ID NO: 1471069 - RNA, 19 nt, Pseudomonas aeruginosa PA01
ccacgcucagugcgccggg

SEQ ID NO: 1471070 - RNA, 20 nt, Pseudomonas aeruginosa PA01
ccacgcuccuuuggcgucga

SEQ ID NO: 1471071 - RNA, 16 nt, Pseudomonas aeruginosa PA01
ccaccggucuuggcgc

SEQ ID NO: 1471072 - RNA, 18 nt, Pseudomonas aeruginosa PA01
ccaccggucuuggcgcgc

SEQ ID NO: 1471073 - RNA, 18 nt, Pseudomonas aeruginosa PA01
ccaccgguacgcucacca

SEQ ID NO: 1471074 - RNA, 21 nt, Pseudomonas aeruginosa PA01
ccaccggucaaaccauggcgu

SEQ ID NO: 1471075 - RNA, 15 nt, Pseudomonas aeruginosa PA01
ccaccgguggacugg

SEQ ID NO: 1471076 - RNA, 17 nt, Pseudomonas aeruginosa PA01
ccaccgguggcgacgcg

SEQ ID NO: 1471077 - RNA, 16 nt, Pseudomonas aeruginosa PA01
ccaccgguuucgccag

SEQ ID NO: 1471078 - RNA, 20 nt, Pseudomonas aeruginosa PA01
ccaccgguuugcugaccgga

SEQ ID NO: 1471079 - RNA, 19 nt, Pseudomonas aeruginosa PA01
ccacggaggccuucgccga

SEQ ID NO: 1471080 - RNA, 15 nt, Pseudomonas aeruginosa PA01
ccacggagaagcguc

SEQ ID NO: 1471081 - RNA, 16 nt, Pseudomonas aeruginosa PA01
ccacggagaagcgucc

SEQ ID NO: 1471082 - RNA, 17 nt, Pseudomonas aeruginosa PA01
ccacggagaagcguccg

SEQ ID NO: 1471083 - RNA, 19 nt, Pseudomonas aeruginosa PA01
ccacggauaugcgccgcca

SEQ ID NO: 1471084 - RNA, 22 nt, Pseudomonas aeruginosa PA01
ccacggauaugcgccgccacgu

SEQ ID NO: 1471085 - RNA, 13 nt, Pseudomonas aeruginosa PA01
ccacgcuggucac

SEQ ID NO: 1471086 - RNA, 15 nt, Pseudomonas aeruginosa PA01
ccacgcugugcggca

SEQ ID NO: 1471087 - RNA, 16 nt, Pseudomonas aeruginosa PA01
ccacgcugugcggcag

SEQ ID NO: 1471088 - RNA, 21 nt, Pseudomonas aeruginosa PA01
ccacggaaggccacgccgccg

SEQ ID NO: 1471089 - RNA, 22 nt, Pseudomonas aeruginosa PA01
ccacggaaggccacgccgccgu

SEQ ID NO: 1471090 - RNA, 15 nt, Pseudomonas aeruginosa PA01
ccacgcuucugcgcc

SEQ ID NO: 1471091 - RNA, 14 nt, Pseudomonas aeruginosa PA01
ccacguagggcgug

SEQ ID NO: 1471092 - RNA, 23 nt, Pseudomonas aeruginosa PA01
ccacguagggcgugguguagccg

SEQ ID NO: 1471093 - RNA, 14 nt, Pseudomonas aeruginosa PA01
ccacguccagcggc

SEQ ID NO: 1471094 - RNA, 14 nt, Pseudomonas aeruginosa PA01
ccacguacuccagc

SEQ ID NO: 1471095 - RNA, 22 nt, Pseudomonas aeruginosa PA01
ccacguacuccagcaacggcau

SEQ ID NO: 1471096 - RNA, 14 nt, Pseudomonas aeruginosa PA01
ccacgguguugccg

SEQ ID NO: 1471097 - RNA, 24 nt, Pseudomonas aeruginosa PA01
ccacgguguugccguggucgcgca

SEQ ID NO: 1471098 - RNA, 19 nt, Pseudomonas aeruginosa PA01
ccacgguagagacggcggc

SEQ ID NO: 1471099 - RNA, 14 nt, Pseudomonas aeruginosa PA01
ccacgggcggccga

SEQ ID NO: 1471100 - RNA, 22 nt, Pseudomonas aeruginosa PA01
ccacgggcggccgacgugcacc

SEQ ID NO: 1471101 - RNA, 18 nt, Pseudomonas aeruginosa PA01
ccacgggcgacccaggcc

SEQ ID NO: 1471102 - RNA, 22 nt, Pseudomonas aeruginosa PA01
ccacgggcgacccaggccgaca

SEQ ID NO: 1471103 - RNA, 19 nt, Pseudomonas aeruginosa PA01
ccacgggcaguuccaggcc

SEQ ID NO: 1471104 - RNA, 13 nt, Pseudomonas aeruginosa PA01
ccacgggcgccag

SEQ ID NO: 1471105 - RNA, 18 nt, Pseudomonas aeruginosa PA01
ccacggcgagagcgccga

SEQ ID NO: 1471106 - RNA, 12 nt, Pseudomonas aeruginosa PA01
ccacggccggcg

SEQ ID NO: 1471107 - RNA, 21 nt, Pseudomonas aeruginosa PA01
ccacggccggcgaggcguucc

SEQ ID NO: 1471108 - RNA, 12 nt, Pseudomonas aeruginosa PA01
ccacgggaaugg

SEQ ID NO: 1471109 - RNA, 23 nt, Pseudomonas aeruginosa PA01
ccacgggaauggcggauaaccgc

SEQ ID NO: 1471110 - RNA, 16 nt, Pseudomonas aeruginosa PA01
ccacggcacacgucgg

SEQ ID NO: 1471111 - RNA, 16 nt, Pseudomonas aeruginosa PA01
ccacggccgcugcgca

SEQ ID NO: 1471112 - RNA, 20 nt, Pseudomonas aeruginosa PA01
ccacggccgcugcgcaggcc

SEQ ID NO: 1471113 - RNA, 14 nt, Pseudomonas aeruginosa PA01
ccacggccagcagg

SEQ ID NO: 1471114 - RNA, 15 nt, Pseudomonas aeruginosa PA01
ccacggccaggccca

SEQ ID NO: 1471115 - RNA, 23 nt, Pseudomonas aeruginosa PA01
ccacuuaggcggauaacgccagg

SEQ ID NO: 1471116 - RNA, 13 nt, Pseudomonas aeruginosa PA01
ccacuuccagcuu

SEQ ID NO: 1471117 - RNA, 21 nt, Pseudomonas aeruginosa PA01
ccacuucguccggccgcccga

SEQ ID NO: 1471118 - RNA, 18 nt, Pseudomonas aeruginosa PA01
ccacuuccggcccggcca

SEQ ID NO: 1471119 - RNA, 14 nt, Pseudomonas aeruginosa PA01
ccacuucccggcgc

SEQ ID NO: 1471120 - RNA, 18 nt, Pseudomonas aeruginosa PA01
ccacuucgaagccgagcu

SEQ ID NO: 1471121 - RNA, 14 nt, Pseudomonas aeruginosa PA01
ccacuugccgccgc

SEQ ID NO: 1471122 - RNA, 23 nt, Pseudomonas aeruginosa PA01
ccacuucgcggaccacgucccag

SEQ ID NO: 1471123 - RNA, 14 nt, Pseudomonas aeruginosa PA01
ccacucgcagccgc

SEQ ID NO: 1471124 - RNA, 23 nt, Pseudomonas aeruginosa PA01
ccacucgccagcgcgcgccgaca

SEQ ID NO: 1471125 - RNA, 13 nt, Pseudomonas aeruginosa PA01
ccacucggccagg

SEQ ID NO: 1471126 - RNA, 16 nt, Pseudomonas aeruginosa PA01
ccacucggcgcuuucg

SEQ ID NO: 1471127 - RNA, 17 nt, Pseudomonas aeruginosa PA01
ccacucggcgugccggg

SEQ ID NO: 1471128 - RNA, 16 nt, Pseudomonas aeruginosa PA01
ccacuccuccgccugc

SEQ ID NO: 1471129 - RNA, 22 nt, Pseudomonas aeruginosa PA01
ccacgucgaugccuucggcggc

SEQ ID NO: 1471130 - RNA, 13 nt, Pseudomonas aeruginosa PA01
ccacucccggccc

SEQ ID NO: 1471131 - RNA, 19 nt, Pseudomonas aeruginosa PA01
ccacugauaccgcuggcca

SEQ ID NO: 1471132 - RNA, 21 nt, Pseudomonas aeruginosa PA01
ccacugauaccgcuggccagg

SEQ ID NO: 1471133 - RNA, 18 nt, Pseudomonas aeruginosa PA01
ccacugaacuggaucggc

SEQ ID NO: 1471134 - RNA, 15 nt, Pseudomonas aeruginosa PA01
ccacugacgcgcagc

SEQ ID NO: 1471135 - RNA, 21 nt, Pseudomonas aeruginosa PA01
ccacugacgcgcagcgccgcc

SEQ ID NO: 1471136 - RNA, 22 nt, Pseudomonas aeruginosa PA01
ccacugacgcgcagcgccgccg

SEQ ID NO: 1471137 - RNA, 23 nt, Pseudomonas aeruginosa PA01
ccagaagccccagagcccgccga

SEQ ID NO: 1471138 - RNA, 19 nt, Pseudomonas aeruginosa PA01
ccagaaggcuucuuccugg

SEQ ID NO: 1471139 - RNA, 22 nt, Pseudomonas aeruginosa PA01
ccagaagaucgccugcuggccg

SEQ ID NO: 1471140 - RNA, 21 nt, Pseudomonas aeruginosa PA01
ccagaagcggccgaccaggcc

SEQ ID NO: 1471141 - RNA, 17 nt, Pseudomonas aeruginosa PA01
ccagaaggccugcgcuu

SEQ ID NO: 1471142 - RNA, 22 nt, Pseudomonas aeruginosa PA01
ccagaacgaaaaaggcgcgccg

SEQ ID NO: 1471143 - RNA, 13 nt, Pseudomonas aeruginosa PA01
ccagaacgccgcg

SEQ ID NO: 1471144 - RNA, 16 nt, Pseudomonas aeruginosa PA01
ccagaacgccgcgcac

SEQ ID NO: 1471145 - RNA, 19 nt, Pseudomonas aeruginosa PA01
ccagaaagccucaggcgcu

SEQ ID NO: 1471146 - RNA, 14 nt, Pseudomonas aeruginosa PA01
ccagaaaccgauca

SEQ ID NO: 1471147 - RNA, 15 nt, Pseudomonas aeruginosa PA01
ccagaaacggcugcc

SEQ ID NO: 1471148 - RNA, 15 nt, Pseudomonas aeruginosa PA01
ccagaacaccugcgu

SEQ ID NO: 1471149 - RNA, 17 nt, Pseudomonas aeruginosa PA01
ccagaauuccagcaggu

SEQ ID NO: 1471150 - RNA, 15 nt, Pseudomonas aeruginosa PA01
ccagacguccggcag

SEQ ID NO: 1471151 - RNA, 16 nt, Pseudomonas aeruginosa PA01
ccagacguccggcagg

SEQ ID NO: 1471152 - RNA, 16 nt, Pseudomonas aeruginosa PA01
ccagacguccagcgcc

SEQ ID NO: 1471153 - RNA, 15 nt, Pseudomonas aeruginosa PA01
ccagacguccagcgc

SEQ ID NO: 1471154 - RNA, 17 nt, Pseudomonas aeruginosa PA01
ccagacgcucggccagc

SEQ ID NO: 1471155 - RNA, 17 nt, Pseudomonas aeruginosa PA01
ccagacuuccgggcugc

SEQ ID NO: 1471156 - RNA, 13 nt, Pseudomonas aeruginosa PA01
ccagcucgccgcg

SEQ ID NO: 1471157 - RNA, 15 nt, Pseudomonas aeruginosa PA01
ccagcucgccgcgcu

SEQ ID NO: 1471158 - RNA, 17 nt, Pseudomonas aeruginosa PA01
ccagcucggacaagggc

SEQ ID NO: 1471159 - RNA, 13 nt, Pseudomonas aeruginosa PA01
ccagcucggccgg

SEQ ID NO: 1471160 - RNA, 15 nt, Pseudomonas aeruginosa PA01
ccagcucggccggca

SEQ ID NO: 1471161 - RNA, 16 nt, Pseudomonas aeruginosa PA01
ccagcucggccggcag

SEQ ID NO: 1471162 - RNA, 17 nt, Pseudomonas aeruginosa PA01
ccagcucggccggcagg

SEQ ID NO: 1471163 - RNA, 13 nt, Pseudomonas aeruginosa PA01
ccagcucggccug

SEQ ID NO: 1471164 - RNA, 15 nt, Pseudomonas aeruginosa PA01
ccagcucggcgaucc

SEQ ID NO: 1471165 - RNA, 16 nt, Pseudomonas aeruginosa PA01
ccagcucggcgauccg

SEQ ID NO: 1471166 - RNA, 22 nt, Pseudomonas aeruginosa PA01
ccagcucggcgauccgcgcuuc

SEQ ID NO: 1471167 - RNA, 18 nt, Pseudomonas aeruginosa PA01
ccagcucggugccgucau

SEQ ID NO: 1471168 - RNA, 19 nt, Pseudomonas aeruginosa PA01
ccagcucguccaggcaagc

SEQ ID NO: 1471169 - RNA, 17 nt, Pseudomonas aeruginosa PA01
ccagcucggucagcggc

SEQ ID NO: 1471170 - RNA, 18 nt, Pseudomonas aeruginosa PA01
ccagcucggucagcggcg

SEQ ID NO: 1471171 - RNA, 20 nt, Pseudomonas aeruginosa PA01
ccagcucggucagcggcgca

SEQ ID NO: 1471172 - RNA, 23 nt, Pseudomonas aeruginosa PA01
ccagcucggucagcggcgcagcc

SEQ ID NO: 1471173 - RNA, 19 nt, Pseudomonas aeruginosa PA01
ccagcucggcgggacggcg

SEQ ID NO: 1471174 - RNA, 13 nt, Pseudomonas aeruginosa PA01
ccagcuccuccag

SEQ ID NO: 1471175 - RNA, 22 nt, Pseudomonas aeruginosa PA01
ccagcuccgucuguucggccag

SEQ ID NO: 1471176 - RNA, 16 nt, Pseudomonas aeruginosa PA01
ccagcucgaccuugcc

SEQ ID NO: 1471177 - RNA, 14 nt, Pseudomonas aeruginosa PA01
ccagcucgaacagc

SEQ ID NO: 1471178 - RNA, 16 nt, Pseudomonas aeruginosa PA01
ccagcucgaagccgcc

SEQ ID NO: 1471179 - RNA, 18 nt, Pseudomonas aeruginosa PA01
ccagcucgaagccgccgu

SEQ ID NO: 1471180 - RNA, 12 nt, Pseudomonas aeruginosa PA01
ccagcucgccga

SEQ ID NO: 1471181 - RNA, 13 nt, Pseudomonas aeruginosa PA01
ccagcucgccgaa

SEQ ID NO: 1471182 - RNA, 16 nt, Pseudomonas aeruginosa PA01
ccagcucgccgaacag

SEQ ID NO: 1471183 - RNA, 21 nt, Pseudomonas aeruginosa PA01
ccagcuccgaagggaacccgc

SEQ ID NO: 1471184 - RNA, 13 nt, Pseudomonas aeruginosa PA01
ccagcucccggcu

SEQ ID NO: 1471185 - RNA, 14 nt, Pseudomonas aeruginosa PA01
ccagcucccggcuc

SEQ ID NO: 1471186 - RNA, 16 nt, Pseudomonas aeruginosa PA01
ccagcuccagcgccca

SEQ ID NO: 1471187 - RNA, 21 nt, Pseudomonas aeruginosa PA01
ccagcucauggagcaacagcg

SEQ ID NO: 1471188 - RNA, 16 nt, Pseudomonas aeruginosa PA01
ccagcuccaccaggcc

SEQ ID NO: 1471189 - RNA, 15 nt, Pseudomonas aeruginosa PA01
ccagcuccagcaccg

SEQ ID NO: 1471190 - RNA, 21 nt, Pseudomonas aeruginosa PA01
ccagcuccagcaccggcggcg

SEQ ID NO: 1471191 - RNA, 21 nt, Pseudomonas aeruginosa PA01
ccagcguggcggacaacccgg

SEQ ID NO: 1471192 - RNA, 18 nt, Pseudomonas aeruginosa PA01
ccagcgugggcaacaggc

SEQ ID NO: 1471193 - RNA, 21 nt, Pseudomonas aeruginosa PA01
ccagcgugggcaacaggccga

SEQ ID NO: 1471194 - RNA, 22 nt, Pseudomonas aeruginosa PA01
ccagcggcgguagcuccaggcc

SEQ ID NO: 1471195 - RNA, 14 nt, Pseudomonas aeruginosa PA01
ccagcggcgcggcg

SEQ ID NO: 1471196 - RNA, 15 nt, Pseudomonas aeruginosa PA01
ccagcggcgaucgcc

SEQ ID NO: 1471197 - RNA, 13 nt, Pseudomonas aeruginosa PA01
ccagcggccgcga

SEQ ID NO: 1471198 - RNA, 14 nt, Pseudomonas aeruginosa PA01
ccagcggccgcgag

SEQ ID NO: 1471199 - RNA, 15 nt, Pseudomonas aeruginosa PA01
ccagcggccgcgagg

SEQ ID NO: 1471200 - RNA, 13 nt, Pseudomonas aeruginosa PA01
ccagcggccgcgc

SEQ ID NO: 1471201 - RNA, 14 nt, Pseudomonas aeruginosa PA01
ccagcuaccggcag

SEQ ID NO: 1471202 - RNA, 19 nt, Pseudomonas aeruginosa PA01
ccagcguuucgaagccgcc

SEQ ID NO: 1471203 - RNA, 21 nt, Pseudomonas aeruginosa PA01
ccagcguuucgaagccgccgc

SEQ ID NO: 1471204 - RNA, 16 nt, Pseudomonas aeruginosa PA01
ccagcguuguccucgg

SEQ ID NO: 1471205 - RNA, 17 nt, Pseudomonas aeruginosa PA01
ccagcguuguccucggc

SEQ ID NO: 1471206 - RNA, 18 nt, Pseudomonas aeruginosa PA01
ccagcguuguccucggcg

SEQ ID NO: 1471207 - RNA, 19 nt, Pseudomonas aeruginosa PA01
ccagcguuguccucggcgg

SEQ ID NO: 1471208 - RNA, 20 nt, Pseudomonas aeruginosa PA01
ccagcguuguccucggcggc

SEQ ID NO: 1471209 - RNA, 21 nt, Pseudomonas aeruginosa PA01
ccagcguuguccucggcggcu

SEQ ID NO: 1471210 - RNA, 13 nt, Pseudomonas aeruginosa PA01
ccagcucagcagg

SEQ ID NO: 1471211 - RNA, 18 nt, Pseudomonas aeruginosa PA01
ccagcucagcuccaggcc

SEQ ID NO: 1471212 - RNA, 17 nt, Pseudomonas aeruginosa PA01
ccagcguucggcgcugg

SEQ ID NO: 1471213 - RNA, 19 nt, Pseudomonas aeruginosa PA01
ccagcguucggcgcuggcg

SEQ ID NO: 1471214 - RNA, 14 nt, Pseudomonas aeruginosa PA01
ccaggacggcaggg

SEQ ID NO: 1471215 - RNA, 23 nt, Pseudomonas aeruginosa PA01
ccaggacggcagggucagccgau

SEQ ID NO: 1471216 - RNA, 18 nt, Pseudomonas aeruginosa PA01
ccaggacgccaccaggcc

SEQ ID NO: 1471217 - RNA, 21 nt, Pseudomonas aeruginosa PA01
ccaggacgccaccaggccgcu

SEQ ID NO: 1471218 - RNA, 14 nt, Pseudomonas aeruginosa PA01
ccaggaccuccugc

SEQ ID NO: 1471219 - RNA, 13 nt, Pseudomonas aeruginosa PA01
ccaggaccggcag

SEQ ID NO: 1471220 - RNA, 15 nt, Pseudomonas aeruginosa PA01
ccaggaccaguucgc

SEQ ID NO: 1471221 - RNA, 15 nt, Pseudomonas aeruginosa PA01
ccaggaccaucggca

SEQ ID NO: 1471222 - RNA, 19 nt, Pseudomonas aeruginosa PA01
ccaggacguuauccguccu

SEQ ID NO: 1471223 - RNA, 21 nt, Pseudomonas aeruginosa PA01
ccaggagcacgccgugcaggg

SEQ ID NO: 1471224 - RNA, 22 nt, Pseudomonas aeruginosa PA01
ccaggagcagggcgccgaucag

SEQ ID NO: 1471225 - RNA, 15 nt, Pseudomonas aeruginosa PA01
ccaggacacuuccag

SEQ ID NO: 1471226 - RNA, 17 nt, Pseudomonas aeruginosa PA01
ccaggacaacgacagcc

SEQ ID NO: 1471227 - RNA, 13 nt, Pseudomonas aeruginosa PA01
ccaggaccagccc

SEQ ID NO: 1471228 - RNA, 12 nt, Pseudomonas aeruginosa PA01
ccaggaccagcg

SEQ ID NO: 1471229 - RNA, 19 nt, Pseudomonas aeruginosa PA01
ccaggaauccuccgccagc

SEQ ID NO: 1471230 - RNA, 21 nt, Pseudomonas aeruginosa PA01
ccaggaauccuccgccagcgu

SEQ ID NO: 1471231 - RNA, 16 nt, Pseudomonas aeruginosa PA01
ccaggaauuccuggcc

SEQ ID NO: 1471232 - RNA, 19 nt, Pseudomonas aeruginosa PA01
ccaggaauuccuggccggu

SEQ ID NO: 1471233 - RNA, 14 nt, Pseudomonas aeruginosa PA01
ccaggaaggccgcu

SEQ ID NO: 1471234 - RNA, 22 nt, Pseudomonas aeruginosa PA01
ccaggaaggccgcuucgccgcc

SEQ ID NO: 1471235 - RNA, 23 nt, Pseudomonas aeruginosa PA01
ccaggaaggccgcuucgccgccc

SEQ ID NO: 1471236 - RNA, 14 nt, Pseudomonas aeruginosa PA01
ccaggaaggccggg

SEQ ID NO: 1471237 - RNA, 15 nt, Pseudomonas aeruginosa PA01
ccaggaaggccgggc

SEQ ID NO: 1471238 - RNA, 16 nt, Pseudomonas aeruginosa PA01
ccaggaaggccgggcc

SEQ ID NO: 1471239 - RNA, 19 nt, Pseudomonas aeruginosa PA01
ccaggaaggcguagaccuc

SEQ ID NO: 1471240 - RNA, 14 nt, Pseudomonas aeruginosa PA01
ccaggaaggcgucg

SEQ ID NO: 1471241 - RNA, 20 nt, Pseudomonas aeruginosa PA01
ccaggaaggcgucgccgucg

SEQ ID NO: 1471242 - RNA, 21 nt, Pseudomonas aeruginosa PA01
ccaggaagccgcgccccagcg

SEQ ID NO: 1471243 - RNA, 15 nt, Pseudomonas aeruginosa PA01
ccaggaaaucgccgu

SEQ ID NO: 1471244 - RNA, 16 nt, Pseudomonas aeruginosa PA01
ccagcuugucgucggc

SEQ ID NO: 1471245 - RNA, 15 nt, Pseudomonas aeruginosa PA01
ccagcuuguggccgg

SEQ ID NO: 1471246 - RNA, 17 nt, Pseudomonas aeruginosa PA01
ccagcuugggcacgcgg

SEQ ID NO: 1471247 - RNA, 23 nt, Pseudomonas aeruginosa PA01
ccagcuugggcacgcggaucugg

SEQ ID NO: 1471248 - RNA, 16 nt, Pseudomonas aeruginosa PA01
ccagcuuggucgggau

SEQ ID NO: 1471249 - RNA, 21 nt, Pseudomonas aeruginosa PA01
ccagcuuggucgggauggcga

SEQ ID NO: 1471250 - RNA, 15 nt, Pseudomonas aeruginosa PA01
ccagcuugucgccuu

SEQ ID NO: 1471251 - RNA, 20 nt, Pseudomonas aeruginosa PA01
ccagcuugucgccuuccucg

SEQ ID NO: 1471252 - RNA, 17 nt, Pseudomonas aeruginosa PA01
ccaggaacgccucugcg

SEQ ID NO: 1471253 - RNA, 23 nt, Pseudomonas aeruginosa PA01
ccaggaagcggcgguacauggcc

SEQ ID NO: 1471254 - RNA, 21 nt, Pseudomonas aeruginosa PA01
ccaggaagcgucgugcgccgg

SEQ ID NO: 1471255 - RNA, 23 nt, Pseudomonas aeruginosa PA01
ccaggaagcgucgugcgccggcc

SEQ ID NO: 1471256 - RNA, 15 nt, Pseudomonas aeruginosa PA01
ccaggaagcucggca

SEQ ID NO: 1471257 - RNA, 20 nt, Pseudomonas aeruginosa PA01
ccaggaagcucggcagcacg

SEQ ID NO: 1471258 - RNA, 21 nt, Pseudomonas aeruginosa PA01
ccagcugcgccugcagcucgg

SEQ ID NO: 1471259 - RNA, 22 nt, Pseudomonas aeruginosa PA01
ccagcuggcgcguugugccgcc

SEQ ID NO: 1471260 - RNA, 14 nt, Pseudomonas aeruginosa PA01
ccagcuggcgcagc

SEQ ID NO: 1471261 - RNA, 17 nt, Pseudomonas aeruginosa PA01
ccagcuuggcacggccg

SEQ ID NO: 1471262 - RNA, 20 nt, Pseudomonas aeruginosa PA01
ccagcuuggcacggccggcg

SEQ ID NO: 1471263 - RNA, 23 nt, Pseudomonas aeruginosa PA01
ccagcuuggcacggccggcggug

SEQ ID NO: 1471264 - RNA, 19 nt, Pseudomonas aeruginosa PA01
ccagcuuggccacguccuu

SEQ ID NO: 1471265 - RNA, 22 nt, Pseudomonas aeruginosa PA01
ccagcuucuucugcagcucggc

SEQ ID NO: 1471266 - RNA, 19 nt, Pseudomonas aeruginosa PA01
ccagcuucuuggcccggug

SEQ ID NO: 1471267 - RNA, 17 nt, Pseudomonas aeruginosa PA01
ccagcuucagccgaccg

SEQ ID NO: 1471268 - RNA, 18 nt, Pseudomonas aeruginosa PA01
ccagcuucagccgaccgu

SEQ ID NO: 1471269 - RNA, 14 nt, Pseudomonas aeruginosa PA01
ccagcuucaccggu

SEQ ID NO: 1471270 - RNA, 16 nt, Pseudomonas aeruginosa PA01
ccagcuuccaggcgcg

SEQ ID NO: 1471271 - RNA, 16 nt, Pseudomonas aeruginosa PA01
ccagcugccagugcuc

SEQ ID NO: 1471272 - RNA, 15 nt, Pseudomonas aeruginosa PA01
ccagcugcgccugca

SEQ ID NO: 1471273 - RNA, 14 nt, Pseudomonas aeruginosa PA01
ccagcucgucgaug

SEQ ID NO: 1471274 - RNA, 14 nt, Pseudomonas aeruginosa PA01
ccagcucgucgagc

SEQ ID NO: 1471275 - RNA, 16 nt, Pseudomonas aeruginosa PA01
ccagcucucgcuggug

SEQ ID NO: 1471276 - RNA, 14 nt, Pseudomonas aeruginosa PA01
ccagcgcaagcggc

SEQ ID NO: 1471277 - RNA, 16 nt, Pseudomonas aeruginosa PA01
ccagcgcaagcggcgg

SEQ ID NO: 1471278 - RNA, 13 nt, Pseudomonas aeruginosa PA01
ccagcgcaaccgg

SEQ ID NO: 1471279 - RNA, 17 nt, Pseudomonas aeruginosa PA01
ccagcgccaccagcagg

SEQ ID NO: 1471280 - RNA, 13 nt, Pseudomonas aeruginosa PA01
ccagcgccacgcc

SEQ ID NO: 1471281 - RNA, 22 nt, Pseudomonas aeruginosa PA01
ccagcgccacggcgaucgccgg

SEQ ID NO: 1471282 - RNA, 19 nt, Pseudomonas aeruginosa PA01
ccagcgccacggcgcggaa

SEQ ID NO: 1471283 - RNA, 14 nt, Pseudomonas aeruginosa PA01
ccagcgccaggagc

SEQ ID NO: 1471284 - RNA, 16 nt, Pseudomonas aeruginosa PA01
ccagcgccaggagcag

SEQ ID NO: 1471285 - RNA, 18 nt, Pseudomonas aeruginosa PA01
ccagcgccaggagcaggg

SEQ ID NO: 1471286 - RNA, 14 nt, Pseudomonas aeruginosa PA01
ccagcgccagcagg

SEQ ID NO: 1471287 - RNA, 19 nt, Pseudomonas aeruginosa PA01
ccagcgccccgccuaccgg

SEQ ID NO: 1471288 - RNA, 20 nt, Pseudomonas aeruginosa PA01
ccagcgcccgcaccacccgc

SEQ ID NO: 1471289 - RNA, 22 nt, Pseudomonas aeruginosa PA01
ccagcgcccgcaccacccgcug

SEQ ID NO: 1471290 - RNA, 14 nt, Pseudomonas aeruginosa PA01
ccagcgcccaggcc

SEQ ID NO: 1471291 - RNA, 16 nt, Pseudomonas aeruginosa PA01
ccagcgcccaggccgg

SEQ ID NO: 1471292 - RNA, 18 nt, Pseudomonas aeruginosa PA01
ccagcgcccaggccgggu

SEQ ID NO: 1471293 - RNA, 21 nt, Pseudomonas aeruginosa PA01
ccagcgcccaggccgggucgc

SEQ ID NO: 1471294 - RNA, 14 nt, Pseudomonas aeruginosa PA01
ccagcgccaggccg

SEQ ID NO: 1471295 - RNA, 16 nt, Pseudomonas aeruginosa PA01
ccagcgccaggccgcc

SEQ ID NO: 1471296 - RNA, 14 nt, Pseudomonas aeruginosa PA01
ccagcgccaggcgc

SEQ ID NO: 1471297 - RNA, 19 nt, Pseudomonas aeruginosa PA01
ccagcgcgcucuucgccgc

SEQ ID NO: 1471298 - RNA, 20 nt, Pseudomonas aeruginosa PA01
ccagcgcgcucuucgccgcg

SEQ ID NO: 1471299 - RNA, 16 nt, Pseudomonas aeruginosa PA01
ccagcgccugggccgc

SEQ ID NO: 1471300 - RNA, 12 nt, Pseudomonas aeruginosa PA01
ccagcgcgcagc

SEQ ID NO: 1471301 - RNA, 13 nt, Pseudomonas aeruginosa PA01
ccagcgcgcagcg

SEQ ID NO: 1471302 - RNA, 15 nt, Pseudomonas aeruginosa PA01
ccagcgccuggcgca

SEQ ID NO: 1471303 - RNA, 20 nt, Pseudomonas aeruginosa PA01
ccagcgccuggaugaucgcg

SEQ ID NO: 1471304 - RNA, 23 nt, Pseudomonas aeruginosa PA01
ccagcgcguagcuuuccgcggcg

SEQ ID NO: 1471305 - RNA, 21 nt, Pseudomonas aeruginosa PA01
ccagcgcgucggcacgccgaa

SEQ ID NO: 1471306 - RNA, 14 nt, Pseudomonas aeruginosa PA01
ccagcgcggugcgc

SEQ ID NO: 1471307 - RNA, 16 nt, Pseudomonas aeruginosa PA01
ccagcgcggugcgcgc

SEQ ID NO: 1471308 - RNA, 23 nt, Pseudomonas aeruginosa PA01
ccagcgcggucucuucgucgguc

SEQ ID NO: 1471309 - RNA, 15 nt, Pseudomonas aeruginosa PA01
ccagcgcggccgccg

SEQ ID NO: 1471310 - RNA, 23 nt, Pseudomonas aeruginosa PA01
ccagcgcggccgccgccgacagg

SEQ ID NO: 1471311 - RNA, 23 nt, Pseudomonas aeruginosa PA01
ccagcgcggcggacaggcagccg

SEQ ID NO: 1471312 - RNA, 14 nt, Pseudomonas aeruginosa PA01
ccagcgcggcgccc

SEQ ID NO: 1471313 - RNA, 18 nt, Pseudomonas aeruginosa PA01
ccagcgcggcgccccagg

SEQ ID NO: 1471314 - RNA, 13 nt, Pseudomonas aeruginosa PA01
ccagcgcggcgcg

SEQ ID NO: 1471315 - RNA, 14 nt, Pseudomonas aeruginosa PA01
ccagcgcggcgcgc

SEQ ID NO: 1471316 - RNA, 13 nt, Pseudomonas aeruginosa PA01
ccagcgcggcgcu

SEQ ID NO: 1471317 - RNA, 19 nt, Pseudomonas aeruginosa PA01
ccagcgcggcucgggcggc

SEQ ID NO: 1471318 - RNA, 21 nt, Pseudomonas aeruginosa PA01
ccagcgcggcucgggcggcaa

SEQ ID NO: 1471319 - RNA, 19 nt, Pseudomonas aeruginosa PA01
ccagcgcuugaacgcgcgc

SEQ ID NO: 1471320 - RNA, 15 nt, Pseudomonas aeruginosa PA01
ccagcgcuucggcgg

SEQ ID NO: 1471321 - RNA, 22 nt, Pseudomonas aeruginosa PA01
ccagcgcuuccucgggcagcuc

SEQ ID NO: 1471322 - RNA, 14 nt, Pseudomonas aeruginosa PA01
ccagcgcuucgcga

SEQ ID NO: 1471323 - RNA, 16 nt, Pseudomonas aeruginosa PA01
ccagcggaaucgcgcc

SEQ ID NO: 1471324 - RNA, 14 nt, Pseudomonas aeruginosa PA01
ccagcggaccgucg

SEQ ID NO: 1471325 - RNA, 15 nt, Pseudomonas aeruginosa PA01
ccagcggaccgucgg

SEQ ID NO: 1471326 - RNA, 14 nt, Pseudomonas aeruginosa PA01
ccagcggacgcuug

SEQ ID NO: 1471327 - RNA, 14 nt, Pseudomonas aeruginosa PA01
ccagcggagcgucg

SEQ ID NO: 1471328 - RNA, 17 nt, Pseudomonas aeruginosa PA01
ccagcggagcgucgggc

SEQ ID NO: 1471329 - RNA, 15 nt, Pseudomonas aeruginosa PA01
ccagcgcuccuugcg

SEQ ID NO: 1471330 - RNA, 20 nt, Pseudomonas aeruginosa PA01
ccagcgcucgaacgccgccc

SEQ ID NO: 1471331 - RNA, 19 nt, Pseudomonas aeruginosa PA01
ccagcgcucguagccggcg

SEQ ID NO: 1471332 - RNA, 16 nt, Pseudomonas aeruginosa PA01
ccagcgcugccucggu

SEQ ID NO: 1471333 - RNA, 22 nt, Pseudomonas aeruginosa PA01
ccagccggugaaacggaucacg

SEQ ID NO: 1471334 - RNA, 17 nt, Pseudomonas aeruginosa PA01
ccagccggggcugagcg

SEQ ID NO: 1471335 - RNA, 12 nt, Pseudomonas aeruginosa PA01
ccagccggcgcc

SEQ ID NO: 1471336 - RNA, 19 nt, Pseudomonas aeruginosa PA01
ccagccggcgcucggccag

SEQ ID NO: 1471337 - RNA, 20 nt, Pseudomonas aeruginosa PA01
ccagccggcgcucggccagg

SEQ ID NO: 1471338 - RNA, 14 nt, Pseudomonas aeruginosa PA01
ccagccggcgcuuc

SEQ ID NO: 1471339 - RNA, 21 nt, Pseudomonas aeruginosa PA01
ccagccggcgcuucugcgagc

SEQ ID NO: 1471340 - RNA, 13 nt, Pseudomonas aeruginosa PA01
ccagccggcugug

SEQ ID NO: 1471341 - RNA, 20 nt, Pseudomonas aeruginosa PA01
ccagccggcugugaccgaga

SEQ ID NO: 1471342 - RNA, 20 nt, Pseudomonas aeruginosa PA01
ccagccgggcuccgccgcga

SEQ ID NO: 1471343 - RNA, 21 nt, Pseudomonas aeruginosa PA01
ccagccgggcuccgccgcgag

SEQ ID NO: 1471344 - RNA, 16 nt, Pseudomonas aeruginosa PA01
ccagccggccauccag

SEQ ID NO: 1471345 - RNA, 19 nt, Pseudomonas aeruginosa PA01
ccagccggccauccagcca

SEQ ID NO: 1471346 - RNA, 13 nt, Pseudomonas aeruginosa PA01
ccagccggcgacg

SEQ ID NO: 1471347 - RNA, 14 nt, Pseudomonas aeruginosa PA01
ccagccggcgacgc

SEQ ID NO: 1471348 - RNA, 15 nt, Pseudomonas aeruginosa PA01
ccagccggcgacgca

SEQ ID NO: 1471349 - RNA, 13 nt, Pseudomonas aeruginosa PA01
ccagccggccgcg

SEQ ID NO: 1471350 - RNA, 21 nt, Pseudomonas aeruginosa PA01
ccagccggccgcgucgcccag

SEQ ID NO: 1471351 - RNA, 22 nt, Pseudomonas aeruginosa PA01
ccagccgcugcagggcggcgcu

SEQ ID NO: 1471352 - RNA, 14 nt, Pseudomonas aeruginosa PA01
ccagccuugagccu

SEQ ID NO: 1471353 - RNA, 16 nt, Pseudomonas aeruginosa PA01
ccagccuugagccuug

SEQ ID NO: 1471354 - RNA, 15 nt, Pseudomonas aeruginosa PA01
ccagcgaaagcguca

SEQ ID NO: 1471355 - RNA, 20 nt, Pseudomonas aeruginosa PA01
ccagcgaaagcgucagcgcg

SEQ ID NO: 1471356 - RNA, 16 nt, Pseudomonas aeruginosa PA01
ccagcgaacccaggcc

SEQ ID NO: 1471357 - RNA, 15 nt, Pseudomonas aeruginosa PA01
ccagccuuccucggg

SEQ ID NO: 1471358 - RNA, 23 nt, Pseudomonas aeruginosa PA01
ccagccgucgucguccaccgagu

SEQ ID NO: 1471359 - RNA, 17 nt, Pseudomonas aeruginosa PA01
ccagccucauucgcucu

SEQ ID NO: 1471360 - RNA, 19 nt, Pseudomonas aeruginosa PA01
ccagccucauucgcucugc

SEQ ID NO: 1471361 - RNA, 18 nt, Pseudomonas aeruginosa PA01
ccagccguggcaggcgcc

SEQ ID NO: 1471362 - RNA, 16 nt, Pseudomonas aeruginosa PA01
ccagccuacugggcgu

SEQ ID NO: 1471363 - RNA, 14 nt, Pseudomonas aeruginosa PA01
ccagccucggcagg

SEQ ID NO: 1471364 - RNA, 22 nt, Pseudomonas aeruginosa PA01
ccagccucggcagggcgcccgc

SEQ ID NO: 1471365 - RNA, 22 nt, Pseudomonas aeruginosa PA01
ccagccguucgcuggacaggcg

SEQ ID NO: 1471366 - RNA, 17 nt, Pseudomonas aeruginosa PA01
ccagcgaauggacaggc

SEQ ID NO: 1471367 - RNA, 13 nt, Pseudomonas aeruginosa PA01
ccagcgaaccgcc

SEQ ID NO: 1471368 - RNA, 15 nt, Pseudomonas aeruginosa PA01
ccagcgaaccgccgg

SEQ ID NO: 1471369 - RNA, 17 nt, Pseudomonas aeruginosa PA01
ccagcgaaccgccggcc

SEQ ID NO: 1471370 - RNA, 22 nt, Pseudomonas aeruginosa PA01
ccagcgaguagucgcggggcgg

SEQ ID NO: 1471371 - RNA, 16 nt, Pseudomonas aeruginosa PA01
ccagcgaccgucgaac

SEQ ID NO: 1471372 - RNA, 17 nt, Pseudomonas aeruginosa PA01
ccagcgagucgacccag

SEQ ID NO: 1471373 - RNA, 20 nt, Pseudomonas aeruginosa PA01
ccagcgagucgacccaggcc

SEQ ID NO: 1471374 - RNA, 22 nt, Pseudomonas aeruginosa PA01
ccagcgagucgacccaggccca

SEQ ID NO: 1471375 - RNA, 12 nt, Pseudomonas aeruginosa PA01
cauucagcgcgc

SEQ ID NO: 1471376 - RNA, 22 nt, Pseudomonas aeruginosa PA01
cauuccuugauuugcccggcga

SEQ ID NO: 1471377 - RNA, 17 nt, Pseudomonas aeruginosa PA01
cauucgaugccgcgcgc

SEQ ID NO: 1471378 - RNA, 15 nt, Pseudomonas aeruginosa PA01
cauucgacagcaggu

SEQ ID NO: 1471379 - RNA, 19 nt, Pseudomonas aeruginosa PA01
cauucgacccgccgaccag

SEQ ID NO: 1471380 - RNA, 20 nt, Pseudomonas aeruginosa PA01
cauucggccuggcaguugca

SEQ ID NO: 1471381 - RNA, 21 nt, Pseudomonas aeruginosa PA01
cauucgcugucgucggcgcgg

SEQ ID NO: 1471382 - RNA, 15 nt, Pseudomonas aeruginosa PA01
cauucgcuucggcca

SEQ ID NO: 1471383 - RNA, 17 nt, Pseudomonas aeruginosa PA01
cauuagcgucgcgcggc

SEQ ID NO: 1471384 - RNA, 18 nt, Pseudomonas aeruginosa PA01
cauuagcgucgcgcggcc

SEQ ID NO: 1471385 - RNA, 22 nt, Pseudomonas aeruginosa PA01
cauguuguuauggccgacccgu

SEQ ID NO: 1471386 - RNA, 19 nt, Pseudomonas aeruginosa PA01
cauguugcagggucgccgg

SEQ ID NO: 1471387 - RNA, 14 nt, Pseudomonas aeruginosa PA01
cauuaccggcgacc

SEQ ID NO: 1471388 - RNA, 21 nt, Pseudomonas aeruginosa PA01
ccaacaggcauugccguccgu

SEQ ID NO: 1471389 - RNA, 22 nt, Pseudomonas aeruginosa PA01
ccaacagcagguagaccacgca

SEQ ID NO: 1471390 - RNA, 14 nt, Pseudomonas aeruginosa PA01
ccaacagccggcgg

SEQ ID NO: 1471391 - RNA, 13 nt, Pseudomonas aeruginosa PA01
ccaacagggcguc

SEQ ID NO: 1471392 - RNA, 12 nt, Pseudomonas aeruginosa PA01
cauuucguugcg

SEQ ID NO: 1471393 - RNA, 22 nt, Pseudomonas aeruginosa PA01
cauuucccgcgagcagccgacg

SEQ ID NO: 1471394 - RNA, 14 nt, Pseudomonas aeruginosa PA01
cauuuccgccggau

SEQ ID NO: 1471395 - RNA, 21 nt, Pseudomonas aeruginosa PA01
cauugagcgcgcccaggcagg

SEQ ID NO: 1471396 - RNA, 21 nt, Pseudomonas aeruginosa PA01
cauuguugcggucgcgcccgc

SEQ ID NO: 1471397 - RNA, 18 nt, Pseudomonas aeruginosa PA01
cauuguuggcgcucggcc

SEQ ID NO: 1471398 - RNA, 14 nt, Pseudomonas aeruginosa PA01
cauggccuugccgg

SEQ ID NO: 1471399 - RNA, 19 nt, Pseudomonas aeruginosa PA01
cauggcgaagcucggccgc

SEQ ID NO: 1471400 - RNA, 14 nt, Pseudomonas aeruginosa PA01
cauggccggcgugc

SEQ ID NO: 1471401 - RNA, 13 nt, Pseudomonas aeruginosa PA01
cauggccuggcgc

SEQ ID NO: 1471402 - RNA, 14 nt, Pseudomonas aeruginosa PA01
cauggccuggcgcu

SEQ ID NO: 1471403 - RNA, 16 nt, Pseudomonas aeruginosa PA01
cauggccuggcgcuca

SEQ ID NO: 1471404 - RNA, 20 nt, Pseudomonas aeruginosa PA01
cauggccuggcgcucagcgc

SEQ ID NO: 1471405 - RNA, 21 nt, Pseudomonas aeruginosa PA01
cauggccuggcgcucagcgcc

SEQ ID NO: 1471406 - RNA, 22 nt, Pseudomonas aeruginosa PA01
cauggccuggcgcucagcgccg

SEQ ID NO: 1471407 - RNA, 18 nt, Pseudomonas aeruginosa PA01
caugcucgggcugccgca

SEQ ID NO: 1471408 - RNA, 14 nt, Pseudomonas aeruginosa PA01
caugcuccgccugg

SEQ ID NO: 1471409 - RNA, 14 nt, Pseudomonas aeruginosa PA01
caugcucgccaccu

SEQ ID NO: 1471410 - RNA, 19 nt, Pseudomonas aeruginosa PA01
caugcucuucaggcugucg

SEQ ID NO: 1471411 - RNA, 22 nt, Pseudomonas aeruginosa PA01
caugcucggccagcucgccgaa

SEQ ID NO: 1471412 - RNA, 15 nt, Pseudomonas aeruginosa PA01
caugcucacugcgag

SEQ ID NO: 1471413 - RNA, 14 nt, Pseudomonas aeruginosa PA01
caugggguucgaca

SEQ ID NO: 1471414 - RNA, 14 nt, Pseudomonas aeruginosa PA01
caugggggccagca

SEQ ID NO: 1471415 - RNA, 16 nt, Pseudomonas aeruginosa PA01
caugggggccagcagg

SEQ ID NO: 1471416 - RNA, 15 nt, Pseudomonas aeruginosa PA01
caugggauggcgcgg

SEQ ID NO: 1471417 - RNA, 18 nt, Pseudomonas aeruginosa PA01
caugggcgcguucucccu

SEQ ID NO: 1471418 - RNA, 16 nt, Pseudomonas aeruginosa PA01
caugggcgcgcgccgg

SEQ ID NO: 1471419 - RNA, 18 nt, Pseudomonas aeruginosa PA01
caugggcgcgcgccgggc

SEQ ID NO: 1471420 - RNA, 13 nt, Pseudomonas aeruginosa PA01
cauggcgccacuc

SEQ ID NO: 1471421 - RNA, 18 nt, Pseudomonas aeruginosa PA01
cauggcgccacucggcgu

SEQ ID NO: 1471422 - RNA, 23 nt, Pseudomonas aeruginosa PA01
cauggcgccacucggcgugccgg

SEQ ID NO: 1471423 - RNA, 12 nt, Pseudomonas aeruginosa PA01
cauggcuucggg

SEQ ID NO: 1471424 - RNA, 13 nt, Pseudomonas aeruginosa PA01
caugggcacgccg

SEQ ID NO: 1471425 - RNA, 13 nt, Pseudomonas aeruginosa PA01
cauggcuggugcg

SEQ ID NO: 1471426 - RNA, 19 nt, Pseudomonas aeruginosa PA01
cauggcuguagcucugcug

SEQ ID NO: 1471427 - RNA, 21 nt, Pseudomonas aeruginosa PA01
cauggcuguagcucugcuggc

SEQ ID NO: 1471428 - RNA, 19 nt, Pseudomonas aeruginosa PA01
cauggcgaucuccgggagc

SEQ ID NO: 1471429 - RNA, 15 nt, Pseudomonas aeruginosa PA01
cauguaggcgcacca

SEQ ID NO: 1471430 - RNA, 18 nt, Pseudomonas aeruginosa PA01
cauguaggcgcaccaggc

SEQ ID NO: 1471431 - RNA, 23 nt, Pseudomonas aeruginosa PA01
caugguuuccgccggacccugcc

SEQ ID NO: 1471432 - RNA, 17 nt, Pseudomonas aeruginosa PA01
cauguagcgcuccucgc

SEQ ID NO: 1471433 - RNA, 21 nt, Pseudomonas aeruginosa PA01
caugucgcuccagaccuccag

SEQ ID NO: 1471434 - RNA, 23 nt, Pseudomonas aeruginosa PA01
caugucgcugagcggcugguggc

SEQ ID NO: 1471435 - RNA, 16 nt, Pseudomonas aeruginosa PA01
caugguguuggcggcc

SEQ ID NO: 1471436 - RNA, 18 nt, Pseudomonas aeruginosa PA01
caugguguuggcggccug

SEQ ID NO: 1471437 - RNA, 19 nt, Pseudomonas aeruginosa PA01
caugguguuggcggccugg

SEQ ID NO: 1471438 - RNA, 14 nt, Pseudomonas aeruginosa PA01
caugguguugggca

SEQ ID NO: 1471439 - RNA, 13 nt, Pseudomonas aeruginosa PA01
caugugcuggcgg

SEQ ID NO: 1471440 - RNA, 23 nt, Pseudomonas aeruginosa PA01
cauguuccuccagagugcgcagc

SEQ ID NO: 1471441 - RNA, 11 nt, Pseudomonas aeruginosa PA01
cauguucacca

SEQ ID NO: 1471442 - RNA, 14 nt, Pseudomonas aeruginosa PA01
caucggcgccgcgc

SEQ ID NO: 1471443 - RNA, 19 nt, Pseudomonas aeruginosa PA01
caucggcgcuccgccgaac

SEQ ID NO: 1471444 - RNA, 13 nt, Pseudomonas aeruginosa PA01
caucggcgcgccg

SEQ ID NO: 1471445 - RNA, 14 nt, Pseudomonas aeruginosa PA01
caucggcgcgccga

SEQ ID NO: 1471446 - RNA, 20 nt, Pseudomonas aeruginosa PA01
caucggcggcggcccgcaca

SEQ ID NO: 1471447 - RNA, 13 nt, Pseudomonas aeruginosa PA01
caucggcggcagg

SEQ ID NO: 1471448 - RNA, 16 nt, Pseudomonas aeruginosa PA01
caucggcggcaggccg

SEQ ID NO: 1471449 - RNA, 13 nt, Pseudomonas aeruginosa PA01
caucggcgcggcc

SEQ ID NO: 1471450 - RNA, 22 nt, Pseudomonas aeruginosa PA01
caugaugugcgcaggcuggccg

SEQ ID NO: 1471451 - RNA, 14 nt, Pseudomonas aeruginosa PA01
caugauggucggca

SEQ ID NO: 1471452 - RNA, 12 nt, Pseudomonas aeruginosa PA01
caugauggugcc

SEQ ID NO: 1471453 - RNA, 13 nt, Pseudomonas aeruginosa PA01
caucggcuggccg

SEQ ID NO: 1471454 - RNA, 14 nt, Pseudomonas aeruginosa PA01
caucggcuggccga

SEQ ID NO: 1471455 - RNA, 12 nt, Pseudomonas aeruginosa PA01
caugcaccaccu

SEQ ID NO: 1471456 - RNA, 17 nt, Pseudomonas aeruginosa PA01
caugcaagaacgccgac

SEQ ID NO: 1471457 - RNA, 18 nt, Pseudomonas aeruginosa PA01
caugcaccaggccgccau

SEQ ID NO: 1471458 - RNA, 15 nt, Pseudomonas aeruginosa PA01
caugcacgcccugga

SEQ ID NO: 1471459 - RNA, 21 nt, Pseudomonas aeruginosa PA01
caugcccagcguggccagcga

SEQ ID NO: 1471460 - RNA, 21 nt, Pseudomonas aeruginosa PA01
caugcccagcuucaccggugc

SEQ ID NO: 1471461 - RNA, 22 nt, Pseudomonas aeruginosa PA01
caugcccagcuucaccggugcc

SEQ ID NO: 1471462 - RNA, 19 nt, Pseudomonas aeruginosa PA01
caugcccagggccagcagc

SEQ ID NO: 1471463 - RNA, 20 nt, Pseudomonas aeruginosa PA01
caugcccgcgucgcgcgcgg

SEQ ID NO: 1471464 - RNA, 14 nt, Pseudomonas aeruginosa PA01
caugcccgccccgc

SEQ ID NO: 1471465 - RNA, 16 nt, Pseudomonas aeruginosa PA01
caugcccgccccgcac

SEQ ID NO: 1471466 - RNA, 16 nt, Pseudomonas aeruginosa PA01
caugcgugcgauucag

SEQ ID NO: 1471467 - RNA, 13 nt, Pseudomonas aeruginosa PA01
caugcucagccgc

SEQ ID NO: 1471468 - RNA, 16 nt, Pseudomonas aeruginosa PA01
caugcucagccgcgcc

SEQ ID NO: 1471469 - RNA, 18 nt, Pseudomonas aeruginosa PA01
caugcgggagagcgccgu

SEQ ID NO: 1471470 - RNA, 20 nt, Pseudomonas aeruginosa PA01
caugcggaacaccgccugga

SEQ ID NO: 1471471 - RNA, 17 nt, Pseudomonas aeruginosa PA01
caugcggaagcagccau

SEQ ID NO: 1471472 - RNA, 17 nt, Pseudomonas aeruginosa PA01
caugcggcuacucgccc

SEQ ID NO: 1471473 - RNA, 18 nt, Pseudomonas aeruginosa PA01
caugcggcuacucgcccg

SEQ ID NO: 1471474 - RNA, 19 nt, Pseudomonas aeruginosa PA01
caugcggcuacucgcccga

SEQ ID NO: 1471475 - RNA, 17 nt, Pseudomonas aeruginosa PA01
caugcggcaggccuucc

SEQ ID NO: 1471476 - RNA, 20 nt, Pseudomonas aeruginosa PA01
caugcggcaggccuuccacg

SEQ ID NO: 1471477 - RNA, 17 nt, Pseudomonas aeruginosa PA01
caugcggccccggcgcu

SEQ ID NO: 1471478 - RNA, 17 nt, Pseudomonas aeruginosa PA01
caugccgggguccgccg

SEQ ID NO: 1471479 - RNA, 18 nt, Pseudomonas aeruginosa PA01
caugccgggguccgccgg

SEQ ID NO: 1471480 - RNA, 21 nt, Pseudomonas aeruginosa PA01
caugccgggguccgccgguca

SEQ ID NO: 1471481 - RNA, 18 nt, Pseudomonas aeruginosa PA01
caugcgcugguagcgcuc

SEQ ID NO: 1471482 - RNA, 20 nt, Pseudomonas aeruginosa PA01
caugcgcugguagcgcucca

SEQ ID NO: 1471483 - RNA, 22 nt, Pseudomonas aeruginosa PA01
caugcgcugguagcgcuccagc

SEQ ID NO: 1471484 - RNA, 17 nt, Pseudomonas aeruginosa PA01
caugccgcucugccaga

SEQ ID NO: 1471485 - RNA, 19 nt, Pseudomonas aeruginosa PA01
caugccgcucugccagaag

SEQ ID NO: 1471486 - RNA, 20 nt, Pseudomonas aeruginosa PA01
caugccgcucugccagaagg

SEQ ID NO: 1471487 - RNA, 16 nt, Pseudomonas aeruginosa PA01
caugccggccgucgcg

SEQ ID NO: 1471488 - RNA, 15 nt, Pseudomonas aeruginosa PA01
caugcccgcugggca

SEQ ID NO: 1471489 - RNA, 16 nt, Pseudomonas aeruginosa PA01
caugcccggcuggcgu

SEQ ID NO: 1471490 - RNA, 17 nt, Pseudomonas aeruginosa PA01
caugcccggcuggcgua

SEQ ID NO: 1471491 - RNA, 15 nt, Pseudomonas aeruginosa PA01
caugccgcccggccg

SEQ ID NO: 1471492 - RNA, 18 nt, Pseudomonas aeruginosa PA01
caugccgccaucgaccag

SEQ ID NO: 1471493 - RNA, 20 nt, Pseudomonas aeruginosa PA01
caugccgccaucgaccagga

SEQ ID NO: 1471494 - RNA, 22 nt, Pseudomonas aeruginosa PA01
caugccgccaucgaccaggaau

SEQ ID NO: 1471495 - RNA, 14 nt, Pseudomonas aeruginosa PA01
caugccgccgacgc

SEQ ID NO: 1471496 - RNA, 20 nt, Pseudomonas aeruginosa PA01
caugccgccgucgcggccau

SEQ ID NO: 1471497 - RNA, 21 nt, Pseudomonas aeruginosa PA01
caugccgccgucgcggccauc

SEQ ID NO: 1471498 - RNA, 18 nt, Pseudomonas aeruginosa PA01
ccaaggaugcgccagcgg

SEQ ID NO: 1471499 - RNA, 23 nt, Pseudomonas aeruginosa PA01
ccaaggaugcgccagcggcccgg

SEQ ID NO: 1471500 - RNA, 21 nt, Pseudomonas aeruginosa PA01
ccaaggccucggcauccucgc

SEQ ID NO: 1471501 - RNA, 12 nt, Pseudomonas aeruginosa PA01
ccaaggccgcca

SEQ ID NO: 1471502 - RNA, 19 nt, Pseudomonas aeruginosa PA01
ccaaccaugguuuccgccg

SEQ ID NO: 1471503 - RNA, 19 nt, Pseudomonas aeruginosa PA01
ccaaccacuccgccacccg

SEQ ID NO: 1471504 - RNA, 14 nt, Pseudomonas aeruginosa PA01
ccaagggccugggc

SEQ ID NO: 1471505 - RNA, 16 nt, Pseudomonas aeruginosa PA01
ccaagggccugggcgc

SEQ ID NO: 1471506 - RNA, 15 nt, Pseudomonas aeruginosa PA01
ccaaggggccgcgcu

SEQ ID NO: 1471507 - RNA, 17 nt, Pseudomonas aeruginosa PA01
ccaauccgauuccgcgc

SEQ ID NO: 1471508 - RNA, 22 nt, Pseudomonas aeruginosa PA01
ccaauccgauuccgcgcaggac

SEQ ID NO: 1471509 - RNA, 17 nt, Pseudomonas aeruginosa PA01
ccacaaccagccaugca

SEQ ID NO: 1471510 - RNA, 23 nt, Pseudomonas aeruginosa PA01
ccacaaaccccugggaugccgcc

SEQ ID NO: 1471511 - RNA, 20 nt, Pseudomonas aeruginosa PA01
ccaauugcccguagggcgaa

SEQ ID NO: 1471512 - RNA, 19 nt, Pseudomonas aeruginosa PA01
ccaauugccguagggcgaa

SEQ ID NO: 1471513 - RNA, 11 nt, Pseudomonas aeruginosa PA01
ccaaugcgugg

SEQ ID NO: 1471514 - RNA, 20 nt, Pseudomonas aeruginosa PA01
ccaaugccagugccucgcgc

SEQ ID NO: 1471515 - RNA, 15 nt, Pseudomonas aeruginosa PA01
ccaccacgacguugc

SEQ ID NO: 1471516 - RNA, 21 nt, Pseudomonas aeruginosa PA01
ccaccaccggaccgggcgccu

SEQ ID NO: 1471517 - RNA, 22 nt, Pseudomonas aeruginosa PA01
ccaccacggcgaagccgcgccc

SEQ ID NO: 1471518 - RNA, 18 nt, Pseudomonas aeruginosa PA01
ccaccacgccgucgccgc

SEQ ID NO: 1471519 - RNA, 22 nt, Pseudomonas aeruginosa PA01
ccacagugccaggcucgccgcc

SEQ ID NO: 1471520 - RNA, 17 nt, Pseudomonas aeruginosa PA01
ccaccaccaugccuucc

SEQ ID NO: 1471521 - RNA, 13 nt, Pseudomonas aeruginosa PA01
ccaccaccaggac

SEQ ID NO: 1471522 - RNA, 18 nt, Pseudomonas aeruginosa PA01
ccacagguggaucgcggc

SEQ ID NO: 1471523 - RNA, 19 nt, Pseudomonas aeruginosa PA01
ccacagguggaucgcggcg

SEQ ID NO: 1471524 - RNA, 20 nt, Pseudomonas aeruginosa PA01
ccacaggcguuauccgccga

SEQ ID NO: 1471525 - RNA, 21 nt, Pseudomonas aeruginosa PA01
ccacaggcguuauccgccgau

SEQ ID NO: 1471526 - RNA, 20 nt, Pseudomonas aeruginosa PA01
ccacaggcguuauccgccgc

SEQ ID NO: 1471527 - RNA, 23 nt, Pseudomonas aeruginosa PA01
ccacaggcguuauccgccgccga

SEQ ID NO: 1471528 - RNA, 13 nt, Pseudomonas aeruginosa PA01
ccacaggccggcu

SEQ ID NO: 1471529 - RNA, 21 nt, Pseudomonas aeruginosa PA01
ccacaggccggcuaaccgcga

SEQ ID NO: 1471530 - RNA, 22 nt, Pseudomonas aeruginosa PA01
ccacaggccggcuaaccgcgaa

SEQ ID NO: 1471531 - RNA, 14 nt, Pseudomonas aeruginosa PA01
ccacaggcccugca

SEQ ID NO: 1471532 - RNA, 19 nt, Pseudomonas aeruginosa PA01
ccacagcgugcagaccagg

SEQ ID NO: 1471533 - RNA, 15 nt, Pseudomonas aeruginosa PA01
ccacaccaggucgcc

SEQ ID NO: 1471534 - RNA, 21 nt, Pseudomonas aeruginosa PA01
ccacagaucgccagcucgccg

SEQ ID NO: 1471535 - RNA, 13 nt, Pseudomonas aeruginosa PA01
ccaccgccgccag

SEQ ID NO: 1471536 - RNA, 12 nt, Pseudomonas aeruginosa PA01
ccaccgccugcc

SEQ ID NO: 1471537 - RNA, 12 nt, Pseudomonas aeruginosa PA01
ccaccgccugga

SEQ ID NO: 1471538 - RNA, 18 nt, Pseudomonas aeruginosa PA01
ccaccgccuggaccaggu

SEQ ID NO: 1471539 - RNA, 13 nt, Pseudomonas aeruginosa PA01
ccaccgccagggc

SEQ ID NO: 1471540 - RNA, 16 nt, Pseudomonas aeruginosa PA01
ccaccgccagggcgcu

SEQ ID NO: 1471541 - RNA, 11 nt, Pseudomonas aeruginosa PA01
ccaccgccagg

SEQ ID NO: 1471542 - RNA, 12 nt, Pseudomonas aeruginosa PA01
ccaccgccaggc

SEQ ID NO: 1471543 - RNA, 13 nt, Pseudomonas aeruginosa PA01
ccaccgccaccug

SEQ ID NO: 1471544 - RNA, 12 nt, Pseudomonas aeruginosa PA01
ccaccgcgccga

SEQ ID NO: 1471545 - RNA, 14 nt, Pseudomonas aeruginosa PA01
ccaccgcgacgcgc

SEQ ID NO: 1471546 - RNA, 21 nt, Pseudomonas aeruginosa PA01
ccaccgcgacgcgcuggacca

SEQ ID NO: 1471547 - RNA, 11 nt, Pseudomonas aeruginosa PA01
ccaccgcgacg

SEQ ID NO: 1471548 - RNA, 16 nt, Pseudomonas aeruginosa PA01
ccaccgcggcguccgc

SEQ ID NO: 1471549 - RNA, 13 nt, Pseudomonas aeruginosa PA01
ccaccgcgcgccc

SEQ ID NO: 1471550 - RNA, 14 nt, Pseudomonas aeruginosa PA01
ccaccgcgcggcac

SEQ ID NO: 1471551 - RNA, 21 nt, Pseudomonas aeruginosa PA01
ccaccgcgcggcacaggcggc

SEQ ID NO: 1471552 - RNA, 12 nt, Pseudomonas aeruginosa PA01
ccaccggccgcg

SEQ ID NO: 1471553 - RNA, 16 nt, Pseudomonas aeruginosa PA01
ccaccggcguccacuc

SEQ ID NO: 1471554 - RNA, 20 nt, Pseudomonas aeruginosa PA01
ccaccggcguccacuccggc

SEQ ID NO: 1471555 - RNA, 19 nt, Pseudomonas aeruginosa PA01
ccaccggcguuauccgccg

SEQ ID NO: 1471556 - RNA, 20 nt, Pseudomonas aeruginosa PA01
ccaccggcguuauccgccga

SEQ ID NO: 1471557 - RNA, 21 nt, Pseudomonas aeruginosa PA01
ccaccggcguuauccgccgau

SEQ ID NO: 1471558 - RNA, 15 nt, Pseudomonas aeruginosa PA01
ccaccggcucgcucu

SEQ ID NO: 1471559 - RNA, 14 nt, Pseudomonas aeruginosa PA01
ccaccggcuggccg

SEQ ID NO: 1471560 - RNA, 15 nt, Pseudomonas aeruginosa PA01
ccaccggcuggccgc

SEQ ID NO: 1471561 - RNA, 17 nt, Pseudomonas aeruginosa PA01
ccaccggcuggccgcga

SEQ ID NO: 1471562 - RNA, 21 nt, Pseudomonas aeruginosa PA01
ccaccggcuggcggcucggcu

SEQ ID NO: 1471563 - RNA, 23 nt, Pseudomonas aeruginosa PA01
ccaccgggccgucgggcauggcg

SEQ ID NO: 1471564 - RNA, 12 nt, Pseudomonas aeruginosa PA01
ccaccgggaucg

SEQ ID NO: 1471565 - RNA, 23 nt, Pseudomonas aeruginosa PA01
ccaccgggaucgcuaccgacagg

SEQ ID NO: 1471566 - RNA, 18 nt, Pseudomonas aeruginosa PA01
ccaccgggaucugccggu

SEQ ID NO: 1471567 - RNA, 21 nt, Pseudomonas aeruginosa PA01
ccaccgggaucuggcccugca

SEQ ID NO: 1471568 - RNA, 16 nt, Pseudomonas aeruginosa PA01
ccaccggaccgggcgc

SEQ ID NO: 1471569 - RNA, 18 nt, Pseudomonas aeruginosa PA01
ccaccgcuuucagcgccg

SEQ ID NO: 1471570 - RNA, 22 nt, Pseudomonas aeruginosa PA01
ccaccgcuuucagcgccgcucg

SEQ ID NO: 1471571 - RNA, 13 nt, Pseudomonas aeruginosa PA01
ccaccgcuucgcg

SEQ ID NO: 1471572 - RNA, 14 nt, Pseudomonas aeruginosa PA01
ccaccggcacgcca

SEQ ID NO: 1471573 - RNA, 16 nt, Pseudomonas aeruginosa PA01
ccaccggcacgccauc

SEQ ID NO: 1471574 - RNA, 21 nt, Pseudomonas aeruginosa PA01
ccaccggcacgccauccuccg

SEQ ID NO: 1471575 - RNA, 15 nt, Pseudomonas aeruginosa PA01
ccaccgcuccggcgc

SEQ ID NO: 1471576 - RNA, 20 nt, Pseudomonas aeruginosa PA01
ccaccgcuccggcgccgagg

SEQ ID NO: 1471577 - RNA, 11 nt, Pseudomonas aeruginosa PA01
ccaccgcucga

SEQ ID NO: 1471578 - RNA, 20 nt, Pseudomonas aeruginosa PA01
ccaccgcucgaguucgcgcg

SEQ ID NO: 1471579 - RNA, 21 nt, Pseudomonas aeruginosa PA01
ccaccgcucgaguucgcgcgg

SEQ ID NO: 1471580 - RNA, 22 nt, Pseudomonas aeruginosa PA01
ccacccgcaucgaggccgccca

SEQ ID NO: 1471581 - RNA, 14 nt, Pseudomonas aeruginosa PA01
ccacccgcagccgc

SEQ ID NO: 1471582 - RNA, 15 nt, Pseudomonas aeruginosa PA01
ccaccccgcuccgcu

SEQ ID NO: 1471583 - RNA, 15 nt, Pseudomonas aeruginosa PA01
ccacccaggcgccga

SEQ ID NO: 1471584 - RNA, 17 nt, Pseudomonas aeruginosa PA01
ccacccccaucgcccgc

SEQ ID NO: 1471585 - RNA, 19 nt, Pseudomonas aeruginosa PA01
ccaccccaggguuggcggc

SEQ ID NO: 1471586 - RNA, 23 nt, Pseudomonas aeruginosa PA01
ccaccccaggguuggcggcaucg

SEQ ID NO: 1471587 - RNA, 20 nt, Pseudomonas aeruginosa PA01
ccaccccgccgcuggcggca

SEQ ID NO: 1471588 - RNA, 14 nt, Pseudomonas aeruginosa PA01
ccaccccgccggcg

SEQ ID NO: 1471589 - RNA, 16 nt, Pseudomonas aeruginosa PA01
ccacccaucugccggc

SEQ ID NO: 1471590 - RNA, 18 nt, Pseudomonas aeruginosa PA01
ccacccaucugccggcca

SEQ ID NO: 1471591 - RNA, 12 nt, Pseudomonas aeruginosa PA01
ccaccagcgccg

SEQ ID NO: 1471592 - RNA, 14 nt, Pseudomonas aeruginosa PA01
ccaccagcgccgcc

SEQ ID NO: 1471593 - RNA, 19 nt, Pseudomonas aeruginosa PA01
ccaccagcgccgccaccgc

SEQ ID NO: 1471594 - RNA, 12 nt, Pseudomonas aeruginosa PA01
ccaccagcgagu

SEQ ID NO: 1471595 - RNA, 21 nt, Pseudomonas aeruginosa PA01
ccaccagcgagucgacccagg

SEQ ID NO: 1471596 - RNA, 13 nt, Pseudomonas aeruginosa PA01
ccaccagcgccgg

SEQ ID NO: 1471597 - RNA, 15 nt, Pseudomonas aeruginosa PA01
ccaccagcgccggcg

SEQ ID NO: 1471598 - RNA, 14 nt, Pseudomonas aeruginosa PA01
ccaccagcgucgcc

SEQ ID NO: 1471599 - RNA, 15 nt, Pseudomonas aeruginosa PA01
ccaccagcgucgcca

SEQ ID NO: 1471600 - RNA, 21 nt, Pseudomonas aeruginosa PA01
ccaccaggaaggcgucgccgu

SEQ ID NO: 1471601 - RNA, 19 nt, Pseudomonas aeruginosa PA01
ccaccaggccauagcgcgc

SEQ ID NO: 1471602 - RNA, 22 nt, Pseudomonas aeruginosa PA01
ccaccaggccauagcgcgccgg

SEQ ID NO: 1471603 - RNA, 23 nt, Pseudomonas aeruginosa PA01
ccaccaggccauagcgcgccggg

SEQ ID NO: 1471604 - RNA, 18 nt, Pseudomonas aeruginosa PA01
ccacccgccucgucgcca

SEQ ID NO: 1471605 - RNA, 12 nt, Pseudomonas aeruginosa PA01
ccacccggccgc

SEQ ID NO: 1471606 - RNA, 18 nt, Pseudomonas aeruginosa PA01
ccacccggcgcccggcgc

SEQ ID NO: 1471607 - RNA, 13 nt, Pseudomonas aeruginosa PA01
ccacccggccgcg

SEQ ID NO: 1471608 - RNA, 15 nt, Pseudomonas aeruginosa PA01
ccacccggccgcgcu

SEQ ID NO: 1471609 - RNA, 20 nt, Pseudomonas aeruginosa PA01
ccacccggcgcacgccggcc

SEQ ID NO: 1471610 - RNA, 21 nt, Pseudomonas aeruginosa PA01
ccacccggcgcacgccggccu

SEQ ID NO: 1471611 - RNA, 12 nt, Pseudomonas aeruginosa PA01
ccacccgcucga

SEQ ID NO: 1471612 - RNA, 14 nt, Pseudomonas aeruginosa PA01
ccacccgucccgcg

SEQ ID NO: 1471613 - RNA, 16 nt, Pseudomonas aeruginosa PA01
ccacccgucccgcgcg

SEQ ID NO: 1471614 - RNA, 17 nt, Pseudomonas aeruginosa PA01
ccacccgucccgcgcgc

SEQ ID NO: 1471615 - RNA, 20 nt, Pseudomonas aeruginosa PA01
ccacccgucccgcgcgccga

SEQ ID NO: 1471616 - RNA, 20 nt, Pseudomonas aeruginosa PA01
ccacccggcgguccgccgcg

SEQ ID NO: 1471617 - RNA, 21 nt, Pseudomonas aeruginosa PA01
ccacccuugggucaucgaaca

SEQ ID NO: 1471618 - RNA, 13 nt, Pseudomonas aeruginosa PA01
ccacccugcgcga

SEQ ID NO: 1471619 - RNA, 12 nt, Pseudomonas aeruginosa PA01
ccacccucggcu

SEQ ID NO: 1471620 - RNA, 13 nt, Pseudomonas aeruginosa PA01
ccacccguuccuu

SEQ ID NO: 1471621 - RNA, 18 nt, Pseudomonas aeruginosa PA01
ccaccgaauaccagggcu

SEQ ID NO: 1471622 - RNA, 22 nt, Pseudomonas aeruginosa PA01
ccaccgacggcuccggauggcu

SEQ ID NO: 1471623 - RNA, 17 nt, Pseudomonas aeruginosa PA01
ccaccgacgggucgcca

SEQ ID NO: 1471624 - RNA, 15 nt, Pseudomonas aeruginosa PA01
ccaccgauggcgcgc

SEQ ID NO: 1471625 - RNA, 19 nt, Pseudomonas aeruginosa PA01
ccaccgauggcgcgcuuuc

SEQ ID NO: 1471626 - RNA, 16 nt, Pseudomonas aeruginosa PA01
ccaccgauucgccggc

SEQ ID NO: 1471627 - RNA, 18 nt, Pseudomonas aeruginosa PA01
ccaccgauucgccggcca

SEQ ID NO: 1471628 - RNA, 14 nt, Pseudomonas aeruginosa PA01
ccaccgauagcggc

SEQ ID NO: 1471629 - RNA, 18 nt, Pseudomonas aeruginosa PA01
ccaccgauagcggcgcga

SEQ ID NO: 1471630 - RNA, 16 nt, Pseudomonas aeruginosa PA01
ccaccgacgccggacg

SEQ ID NO: 1471631 - RNA, 17 nt, Pseudomonas aeruginosa PA01
ccaccgacgccggacgc

SEQ ID NO: 1471632 - RNA, 16 nt, Pseudomonas aeruginosa PA01
ccaccgacccucggcg

SEQ ID NO: 1471633 - RNA, 12 nt, Pseudomonas aeruginosa PA01
caggcggccgcu

SEQ ID NO: 1471634 - RNA, 19 nt, Pseudomonas aeruginosa PA01
caggcggccguccucggga

SEQ ID NO: 1471635 - RNA, 18 nt, Pseudomonas aeruginosa PA01
caggcggccgucggccug

SEQ ID NO: 1471636 - RNA, 17 nt, Pseudomonas aeruginosa PA01
caggcggcuggcgcgau

SEQ ID NO: 1471637 - RNA, 14 nt, Pseudomonas aeruginosa PA01
caggcggcgggccg

SEQ ID NO: 1471638 - RNA, 22 nt, Pseudomonas aeruginosa PA01
caggcggcgggccggcguccag

SEQ ID NO: 1471639 - RNA, 15 nt, Pseudomonas aeruginosa PA01
caggcggcgguagcc

SEQ ID NO: 1471640 - RNA, 13 nt, Pseudomonas aeruginosa PA01
caggcggccacca

SEQ ID NO: 1471641 - RNA, 14 nt, Pseudomonas aeruginosa PA01
caggcggcccaugc

SEQ ID NO: 1471642 - RNA, 22 nt, Pseudomonas aeruginosa PA01
caggcggcccaugcggaucgcc

SEQ ID NO: 1471643 - RNA, 12 nt, Pseudomonas aeruginosa PA01
caggcggccgaa

SEQ ID NO: 1471644 - RNA, 16 nt, Pseudomonas aeruginosa PA01
caggcggccgaacugg

SEQ ID NO: 1471645 - RNA, 13 nt, Pseudomonas aeruginosa PA01
caggcggccgaau

SEQ ID NO: 1471646 - RNA, 23 nt, Pseudomonas aeruginosa PA01
caggcgcuuguccgagaccggca

SEQ ID NO: 1471647 - RNA, 18 nt, Pseudomonas aeruginosa PA01
caggcggaaaaagcgcgg

SEQ ID NO: 1471648 - RNA, 15 nt, Pseudomonas aeruginosa PA01
caggcggaaggccuc

SEQ ID NO: 1471649 - RNA, 18 nt, Pseudomonas aeruginosa PA01
caggcggacacgcaggcg

SEQ ID NO: 1471650 - RNA, 20 nt, Pseudomonas aeruginosa PA01
caggcggagauugcggcgaa

SEQ ID NO: 1471651 - RNA, 18 nt, Pseudomonas aeruginosa PA01
caggcggaguagccggcg

SEQ ID NO: 1471652 - RNA, 21 nt, Pseudomonas aeruginosa PA01
caggcggaguagccggcggcg

SEQ ID NO: 1471653 - RNA, 22 nt, Pseudomonas aeruginosa PA01
caggcggaguagccggcggcga

SEQ ID NO: 1471654 - RNA, 19 nt, Pseudomonas aeruginosa PA01
caggcggcagccgcggcug

SEQ ID NO: 1471655 - RNA, 22 nt, Pseudomonas aeruginosa PA01
caggcggauuuccugcggcacg

SEQ ID NO: 1471656 - RNA, 17 nt, Pseudomonas aeruginosa PA01
caggcggcacucggcga

SEQ ID NO: 1471657 - RNA, 18 nt, Pseudomonas aeruginosa PA01
caggcggaucgcccggcg

SEQ ID NO: 1471658 - RNA, 14 nt, Pseudomonas aeruginosa PA01
caggcggaucgccg

SEQ ID NO: 1471659 - RNA, 17 nt, Pseudomonas aeruginosa PA01
caggcggaucgccgccu

SEQ ID NO: 1471660 - RNA, 23 nt, Pseudomonas aeruginosa PA01
caggcggaucucggugucgguga

SEQ ID NO: 1471661 - RNA, 23 nt, Pseudomonas aeruginosa PA01
caggcgccgcucgaugcccgcca

SEQ ID NO: 1471662 - RNA, 15 nt, Pseudomonas aeruginosa PA01
caggcgccgcugucu

SEQ ID NO: 1471663 - RNA, 12 nt, Pseudomonas aeruginosa PA01
caggcgccggcc

SEQ ID NO: 1471664 - RNA, 19 nt, Pseudomonas aeruginosa PA01
caggcgcguugcuuccagg

SEQ ID NO: 1471665 - RNA, 14 nt, Pseudomonas aeruginosa PA01
caggcgcuccagac

SEQ ID NO: 1471666 - RNA, 14 nt, Pseudomonas aeruginosa PA01
caggcgccggccuc

SEQ ID NO: 1471667 - RNA, 15 nt, Pseudomonas aeruginosa PA01
caggcgccggcggau

SEQ ID NO: 1471668 - RNA, 13 nt, Pseudomonas aeruginosa PA01
caggcgcugcgcg

SEQ ID NO: 1471669 - RNA, 15 nt, Pseudomonas aeruginosa PA01
caggcgcugcgcggc

SEQ ID NO: 1471670 - RNA, 18 nt, Pseudomonas aeruginosa PA01
caggcgcugcgcggccug

SEQ ID NO: 1471671 - RNA, 22 nt, Pseudomonas aeruginosa PA01
caggcgcugcguuccuguucgc

SEQ ID NO: 1471672 - RNA, 13 nt, Pseudomonas aeruginosa PA01
caggcgcuggccg

SEQ ID NO: 1471673 - RNA, 13 nt, Pseudomonas aeruginosa PA01
caggcgcuggucc

SEQ ID NO: 1471674 - RNA, 22 nt, Pseudomonas aeruginosa PA01
caggcgcuguccuguggcgcuu

SEQ ID NO: 1471675 - RNA, 17 nt, Pseudomonas aeruginosa PA01
caggcgcuucagcgccu

SEQ ID NO: 1471676 - RNA, 21 nt, Pseudomonas aeruginosa PA01
caggcgcuucagcgccucgac

SEQ ID NO: 1471677 - RNA, 17 nt, Pseudomonas aeruginosa PA01
caggcgcuucagcucga

SEQ ID NO: 1471678 - RNA, 20 nt, Pseudomonas aeruginosa PA01
caggcgcuucagcucgaggc

SEQ ID NO: 1471679 - RNA, 14 nt, Pseudomonas aeruginosa PA01
caggcgcucgucga

SEQ ID NO: 1471680 - RNA, 16 nt, Pseudomonas aeruginosa PA01
caggcgcucucgccgc

SEQ ID NO: 1471681 - RNA, 17 nt, Pseudomonas aeruginosa PA01
caggcgcucucgccgcc

SEQ ID NO: 1471682 - RNA, 22 nt, Pseudomonas aeruginosa PA01
caggcgcucucgccgccuucgg

SEQ ID NO: 1471683 - RNA, 21 nt, Pseudomonas aeruginosa PA01
caggcgcuccuccagcgccgc

SEQ ID NO: 1471684 - RNA, 15 nt, Pseudomonas aeruginosa PA01
caggcgcuccuggug

SEQ ID NO: 1471685 - RNA, 17 nt, Pseudomonas aeruginosa PA01
caggcgcuauccgccgu

SEQ ID NO: 1471686 - RNA, 18 nt, Pseudomonas aeruginosa PA01
caggcgcuauccgccguu

SEQ ID NO: 1471687 - RNA, 17 nt, Pseudomonas aeruginosa PA01
caggcgcucgcgggccg

SEQ ID NO: 1471688 - RNA, 18 nt, Pseudomonas aeruginosa PA01
caggcgcucgcgggccgc

SEQ ID NO: 1471689 - RNA, 16 nt, Pseudomonas aeruginosa PA01
caggcgcucggcgacg

SEQ ID NO: 1471690 - RNA, 23 nt, Pseudomonas aeruginosa PA01
caggcgcucggcggcgcgcagcg

SEQ ID NO: 1471691 - RNA, 17 nt, Pseudomonas aeruginosa PA01
caggccguagcgcucga

SEQ ID NO: 1471692 - RNA, 20 nt, Pseudomonas aeruginosa PA01
caggccguagaagaucggau

SEQ ID NO: 1471693 - RNA, 17 nt, Pseudomonas aeruginosa PA01
caggccguucaggcggg

SEQ ID NO: 1471694 - RNA, 17 nt, Pseudomonas aeruginosa PA01
caggccgugggccggcg

SEQ ID NO: 1471695 - RNA, 20 nt, Pseudomonas aeruginosa PA01
caggccgugggccggcgcgc

SEQ ID NO: 1471696 - RNA, 16 nt, Pseudomonas aeruginosa PA01
caggcgacgccgcgcu

SEQ ID NO: 1471697 - RNA, 18 nt, Pseudomonas aeruginosa PA01
caggcgacgccgcgcugc

SEQ ID NO: 1471698 - RNA, 21 nt, Pseudomonas aeruginosa PA01
caggcgacgccgcgcugcaag

SEQ ID NO: 1471699 - RNA, 13 nt, Pseudomonas aeruginosa PA01
caggcgaucgccg

SEQ ID NO: 1471700 - RNA, 15 nt, Pseudomonas aeruginosa PA01
caggcgaugcgccgg

SEQ ID NO: 1471701 - RNA, 16 nt, Pseudomonas aeruginosa PA01
caggcgaugaccgccc

SEQ ID NO: 1471702 - RNA, 18 nt, Pseudomonas aeruginosa PA01
caggcgaugaccgccccg

SEQ ID NO: 1471703 - RNA, 20 nt, Pseudomonas aeruginosa PA01
caggcgaugaccgccccggc

SEQ ID NO: 1471704 - RNA, 21 nt, Pseudomonas aeruginosa PA01
caggcgaugaccgccccggca

SEQ ID NO: 1471705 - RNA, 17 nt, Pseudomonas aeruginosa PA01
caggcgaugaucagccc

SEQ ID NO: 1471706 - RNA, 19 nt, Pseudomonas aeruginosa PA01
caggcgaggaacagcgaga

SEQ ID NO: 1471707 - RNA, 16 nt, Pseudomonas aeruginosa PA01
caggcgauacaccgca

SEQ ID NO: 1471708 - RNA, 17 nt, Pseudomonas aeruginosa PA01
caggcgauacaccgcau

SEQ ID NO: 1471709 - RNA, 21 nt, Pseudomonas aeruginosa PA01
caggcgauagccgaccaggcc

SEQ ID NO: 1471710 - RNA, 18 nt, Pseudomonas aeruginosa PA01
caggcgauaucccgccgc

SEQ ID NO: 1471711 - RNA, 20 nt, Pseudomonas aeruginosa PA01
caggcgauaucccgccgccg

SEQ ID NO: 1471712 - RNA, 23 nt, Pseudomonas aeruginosa PA01
caggcgauaucccgccgccgcgc

SEQ ID NO: 1471713 - RNA, 16 nt, Pseudomonas aeruginosa PA01
caggcgauccacagca

SEQ ID NO: 1471714 - RNA, 15 nt, Pseudomonas aeruginosa PA01
caggcgcccaggcag

SEQ ID NO: 1471715 - RNA, 17 nt, Pseudomonas aeruginosa PA01
caggcgcccaggcagca

SEQ ID NO: 1471716 - RNA, 16 nt, Pseudomonas aeruginosa PA01
caggcgccccuggucc

SEQ ID NO: 1471717 - RNA, 19 nt, Pseudomonas aeruginosa PA01
caggcgccaauccgggcgu

SEQ ID NO: 1471718 - RNA, 16 nt, Pseudomonas aeruginosa PA01
caggcgccaggccuca

SEQ ID NO: 1471719 - RNA, 21 nt, Pseudomonas aeruginosa PA01
caggcgccagggacgcgcagc

SEQ ID NO: 1471720 - RNA, 17 nt, Pseudomonas aeruginosa PA01
caggcgccagggccggg

SEQ ID NO: 1471721 - RNA, 16 nt, Pseudomonas aeruginosa PA01
caggcgcccuggccgu

SEQ ID NO: 1471722 - RNA, 21 nt, Pseudomonas aeruginosa PA01
caggcgcccuggccgucggcc

SEQ ID NO: 1471723 - RNA, 13 nt, Pseudomonas aeruginosa PA01
caggcgccgauca

SEQ ID NO: 1471724 - RNA, 19 nt, Pseudomonas aeruginosa PA01
caggcgccgaugcccaggc

SEQ ID NO: 1471725 - RNA, 20 nt, Pseudomonas aeruginosa PA01
caggcgccgaugcccaggcc

SEQ ID NO: 1471726 - RNA, 23 nt, Pseudomonas aeruginosa PA01
caggcgccgauggcugucggcgc

SEQ ID NO: 1471727 - RNA, 22 nt, Pseudomonas aeruginosa PA01
caggcgccgcgcauccucggca

SEQ ID NO: 1471728 - RNA, 24 nt, Pseudomonas aeruginosa PA01
caggcgcccgguggaggucugcca

SEQ ID NO: 1471729 - RNA, 13 nt, Pseudomonas aeruginosa PA01
caggccggugguc

SEQ ID NO: 1471730 - RNA, 21 nt, Pseudomonas aeruginosa PA01
caggccggugaucucgcggcg

SEQ ID NO: 1471731 - RNA, 18 nt, Pseudomonas aeruginosa PA01
caggccggugccgccggc

SEQ ID NO: 1471732 - RNA, 19 nt, Pseudomonas aeruginosa PA01
caggccggugccgccggcc

SEQ ID NO: 1471733 - RNA, 18 nt, Pseudomonas aeruginosa PA01
caggccgggaauggagau

SEQ ID NO: 1471734 - RNA, 14 nt, Pseudomonas aeruginosa PA01
caggccggcgucga

SEQ ID NO: 1471735 - RNA, 12 nt, Pseudomonas aeruginosa PA01
caggccgggcgg

SEQ ID NO: 1471736 - RNA, 13 nt, Pseudomonas aeruginosa PA01
caggccgggcgga

SEQ ID NO: 1471737 - RNA, 21 nt, Pseudomonas aeruginosa PA01
caggccgggcggacgcugggc

SEQ ID NO: 1471738 - RNA, 22 nt, Pseudomonas aeruginosa PA01
caggccgggcggacgcugggcu

SEQ ID NO: 1471739 - RNA, 16 nt, Pseudomonas aeruginosa PA01
caggccgggcggauga

SEQ ID NO: 1471740 - RNA, 16 nt, Pseudomonas aeruginosa PA01
caggccgggcggcggc

SEQ ID NO: 1471741 - RNA, 17 nt, Pseudomonas aeruginosa PA01
caggccgggcggcggcg

SEQ ID NO: 1471742 - RNA, 18 nt, Pseudomonas aeruginosa PA01
caggccgggcggcggcgc

SEQ ID NO: 1471743 - RNA, 13 nt, Pseudomonas aeruginosa PA01
caggccgggcugg

SEQ ID NO: 1471744 - RNA, 22 nt, Pseudomonas aeruginosa PA01
caggccgggcuggccaccgcca

SEQ ID NO: 1471745 - RNA, 16 nt, Pseudomonas aeruginosa PA01
caggccgggucgcagc

SEQ ID NO: 1471746 - RNA, 17 nt, Pseudomonas aeruginosa PA01
caggccgggucgcagcc

SEQ ID NO: 1471747 - RNA, 13 nt, Pseudomonas aeruginosa PA01
caggccggcgcga

SEQ ID NO: 1471748 - RNA, 21 nt, Pseudomonas aeruginosa PA01
caggccggcgcgauccuggcg

SEQ ID NO: 1471749 - RNA, 15 nt, Pseudomonas aeruginosa PA01
caggccggcggccga

SEQ ID NO: 1471750 - RNA, 21 nt, Pseudomonas aeruginosa PA01
caggccgggcaccccgagcgg

SEQ ID NO: 1471751 - RNA, 15 nt, Pseudomonas aeruginosa PA01
caggccgggcaggcc

SEQ ID NO: 1471752 - RNA, 16 nt, Pseudomonas aeruginosa PA01
caggccgggcaggccg

SEQ ID NO: 1471753 - RNA, 18 nt, Pseudomonas aeruginosa PA01
caggccgggcaggccgag

SEQ ID NO: 1471754 - RNA, 11 nt, Pseudomonas aeruginosa PA01
caggccgggcg

SEQ ID NO: 1471755 - RNA, 20 nt, Pseudomonas aeruginosa PA01
caggccggcgagggcggcga

SEQ ID NO: 1471756 - RNA, 14 nt, Pseudomonas aeruginosa PA01
caggccggcgccgc

SEQ ID NO: 1471757 - RNA, 16 nt, Pseudomonas aeruginosa PA01
caggccggccuccagc

SEQ ID NO: 1471758 - RNA, 18 nt, Pseudomonas aeruginosa PA01
caggccggccuccagcgc

SEQ ID NO: 1471759 - RNA, 23 nt, Pseudomonas aeruginosa PA01
caggccggccuccagcgccucgc

SEQ ID NO: 1471760 - RNA, 17 nt, Pseudomonas aeruginosa PA01
caggccggcgaccagcg

SEQ ID NO: 1471761 - RNA, 17 nt, Pseudomonas aeruginosa PA01
caggccgacgaagaccu

SEQ ID NO: 1471762 - RNA, 17 nt, Pseudomonas aeruginosa PA01
caggccgacggcgcgcu

SEQ ID NO: 1471763 - RNA, 14 nt, Pseudomonas aeruginosa PA01
caggccgagcgcca

SEQ ID NO: 1471764 - RNA, 15 nt, Pseudomonas aeruginosa PA01
caggccgagcgccag

SEQ ID NO: 1471765 - RNA, 17 nt, Pseudomonas aeruginosa PA01
caggccgagcgcgccgc

SEQ ID NO: 1471766 - RNA, 23 nt, Pseudomonas aeruginosa PA01
caggccgagcgcgccgccgaucu

SEQ ID NO: 1471767 - RNA, 19 nt, Pseudomonas aeruginosa PA01
caggccgagaaaccgccau

SEQ ID NO: 1471768 - RNA, 22 nt, Pseudomonas aeruginosa PA01
caggccgagaaaccgccaucga

SEQ ID NO: 1471769 - RNA, 15 nt, Pseudomonas aeruginosa PA01
caggccgagaccgca

SEQ ID NO: 1471770 - RNA, 18 nt, Pseudomonas aeruginosa PA01
caggccgagaccgcagcc

SEQ ID NO: 1471771 - RNA, 12 nt, Pseudomonas aeruginosa PA01
caggccgagcac

SEQ ID NO: 1471772 - RNA, 14 nt, Pseudomonas aeruginosa PA01
caggccgagcaccg

SEQ ID NO: 1471773 - RNA, 17 nt, Pseudomonas aeruginosa PA01
caggccgagcaccggca

SEQ ID NO: 1471774 - RNA, 19 nt, Pseudomonas aeruginosa PA01
caggccgagcaccggcagg

SEQ ID NO: 1471775 - RNA, 15 nt, Pseudomonas aeruginosa PA01
caggccgagcagcgc

SEQ ID NO: 1471776 - RNA, 15 nt, Pseudomonas aeruginosa PA01
caggccgagcccgag

SEQ ID NO: 1471777 - RNA, 19 nt, Pseudomonas aeruginosa PA01
caggccgagcccgagugcg

SEQ ID NO: 1471778 - RNA, 23 nt, Pseudomonas aeruginosa PA01
caggccgaggcgcuucugcucgg

SEQ ID NO: 1471779 - RNA, 14 nt, Pseudomonas aeruginosa PA01
caggccgaggccgg

SEQ ID NO: 1471780 - RNA, 16 nt, Pseudomonas aeruginosa PA01
caggccgaggccggcg

SEQ ID NO: 1471781 - RNA, 17 nt, Pseudomonas aeruginosa PA01
caggccgagggcugccg

SEQ ID NO: 1471782 - RNA, 18 nt, Pseudomonas aeruginosa PA01
caggccgagggcugccgc

SEQ ID NO: 1471783 - RNA, 21 nt, Pseudomonas aeruginosa PA01
caggccgagggcugccgcccg

SEQ ID NO: 1471784 - RNA, 22 nt, Pseudomonas aeruginosa PA01
caggccgagggcugccgcccgg

SEQ ID NO: 1471785 - RNA, 17 nt, Pseudomonas aeruginosa PA01
caggccgaggucggcgg

SEQ ID NO: 1471786 - RNA, 19 nt, Pseudomonas aeruginosa PA01
caggccgaggucggcggcg

SEQ ID NO: 1471787 - RNA, 18 nt, Pseudomonas aeruginosa PA01
caggccgagguugacgaa

SEQ ID NO: 1471788 - RNA, 15 nt, Pseudomonas aeruginosa PA01
caggccggccagccu

SEQ ID NO: 1471789 - RNA, 16 nt, Pseudomonas aeruginosa PA01
caggccggccagccuu

SEQ ID NO: 1471790 - RNA, 21 nt, Pseudomonas aeruginosa PA01
caggccggccagccuucccgg

SEQ ID NO: 1471791 - RNA, 18 nt, Pseudomonas aeruginosa PA01
caggccgaguccgcgcgc

SEQ ID NO: 1471792 - RNA, 14 nt, Pseudomonas aeruginosa PA01
caggccgaucacca

SEQ ID NO: 1471793 - RNA, 19 nt, Pseudomonas aeruginosa PA01
caggccgaucaccaccagc

SEQ ID NO: 1471794 - RNA, 20 nt, Pseudomonas aeruginosa PA01
caggccgaucaccaccagcg

SEQ ID NO: 1471795 - RNA, 23 nt, Pseudomonas aeruginosa PA01
caggccgaucaccaccagcgccg

SEQ ID NO: 1471796 - RNA, 17 nt, Pseudomonas aeruginosa PA01
caggccgaucaccagcg

SEQ ID NO: 1471797 - RNA, 12 nt, Pseudomonas aeruginosa PA01
caggccggagcc

SEQ ID NO: 1471798 - RNA, 15 nt, Pseudomonas aeruginosa PA01
caggccggagccgcg

SEQ ID NO: 1471799 - RNA, 16 nt, Pseudomonas aeruginosa PA01
caggccccuugcgcug

SEQ ID NO: 1471800 - RNA, 20 nt, Pseudomonas aeruginosa PA01
caggcccauccuggcgauca

SEQ ID NO: 1471801 - RNA, 13 nt, Pseudomonas aeruginosa PA01
caggcccgccgcg

SEQ ID NO: 1471802 - RNA, 17 nt, Pseudomonas aeruginosa PA01
caggcccgccgcggcga

SEQ ID NO: 1471803 - RNA, 21 nt, Pseudomonas aeruginosa PA01
caggccgacagcggcuggcgc

SEQ ID NO: 1471804 - RNA, 15 nt, Pseudomonas aeruginosa PA01
caggccgaccagcag

SEQ ID NO: 1471805 - RNA, 23 nt, Pseudomonas aeruginosa PA01
caggccgaccagcagggccagca

SEQ ID NO: 1471806 - RNA, 16 nt, Pseudomonas aeruginosa PA01
caggccgacccgcagg

SEQ ID NO: 1471807 - RNA, 20 nt, Pseudomonas aeruginosa PA01
caggccgacccgcaggccgg

SEQ ID NO: 1471808 - RNA, 16 nt, Pseudomonas aeruginosa PA01
caggcccugcagcgcc

SEQ ID NO: 1471809 - RNA, 17 nt, Pseudomonas aeruginosa PA01
caggcccugcagcgcca

SEQ ID NO: 1471810 - RNA, 14 nt, Pseudomonas aeruginosa PA01
caggcccucggcga

SEQ ID NO: 1471811 - RNA, 20 nt, Pseudomonas aeruginosa PA01
caggcccucggcgaccaaca

SEQ ID NO: 1471812 - RNA, 16 nt, Pseudomonas aeruginosa PA01
caggcccagccgguga

SEQ ID NO: 1471813 - RNA, 22 nt, Pseudomonas aeruginosa PA01
caggcacgaauuuccuggcgcg

SEQ ID NO: 1471814 - RNA, 14 nt, Pseudomonas aeruginosa PA01
caggcccagcgcgg

SEQ ID NO: 1471815 - RNA, 15 nt, Pseudomonas aeruginosa PA01
caggcccagcgcggc

SEQ ID NO: 1471816 - RNA, 17 nt, Pseudomonas aeruginosa PA01
caggcccagcgcggcgc

SEQ ID NO: 1471817 - RNA, 18 nt, Pseudomonas aeruginosa PA01
caggcccagcgcggcgcc

SEQ ID NO: 1471818 - RNA, 13 nt, Pseudomonas aeruginosa PA01
caggccccaggcc

SEQ ID NO: 1471819 - RNA, 14 nt, Pseudomonas aeruginosa PA01
caggccccagggcc

SEQ ID NO: 1471820 - RNA, 18 nt, Pseudomonas aeruginosa PA01
caggccccagggccggcg

SEQ ID NO: 1471821 - RNA, 15 nt, Pseudomonas aeruginosa PA01
caggcacagggcgac

SEQ ID NO: 1471822 - RNA, 15 nt, Pseudomonas aeruginosa PA01
caggcacccgcggua

SEQ ID NO: 1471823 - RNA, 19 nt, Pseudomonas aeruginosa PA01
caggcaccgaagcugaggc

SEQ ID NO: 1471824 - RNA, 22 nt, Pseudomonas aeruginosa PA01
caggcaccgaagcugaggccgg

SEQ ID NO: 1471825 - RNA, 15 nt, Pseudomonas aeruginosa PA01
caggcuuacccgcga

SEQ ID NO: 1471826 - RNA, 20 nt, Pseudomonas aeruginosa PA01
caggcugugcaggaaggcga

SEQ ID NO: 1471827 - RNA, 17 nt, Pseudomonas aeruginosa PA01
caggcugugcgccaggc

SEQ ID NO: 1471828 - RNA, 18 nt, Pseudomonas aeruginosa PA01
caggcugugcgccaggcc

SEQ ID NO: 1471829 - RNA, 15 nt, Pseudomonas aeruginosa PA01
caggcuguggcgcgg

SEQ ID NO: 1471830 - RNA, 19 nt, Pseudomonas aeruginosa PA01
caggcuguggcgcggcugg

SEQ ID NO: 1471831 - RNA, 12 nt, Pseudomonas aeruginosa PA01
caggcuucgagc

SEQ ID NO: 1471832 - RNA, 19 nt, Pseudomonas aeruginosa PA01
caggcuucgagcacuuccc

SEQ ID NO: 1471833 - RNA, 21 nt, Pseudomonas aeruginosa PA01
caggcuucgagcacuucccag

SEQ ID NO: 1471834 - RNA, 14 nt, Pseudomonas aeruginosa PA01
caggcuucggcgcg

SEQ ID NO: 1471835 - RNA, 17 nt, Pseudomonas aeruginosa PA01
caggcuucggcgcgcug

SEQ ID NO: 1471836 - RNA, 18 nt, Pseudomonas aeruginosa PA01
caggcuucggcgcgcugg

SEQ ID NO: 1471837 - RNA, 17 nt, Pseudomonas aeruginosa PA01
caggcugucagggcgca

SEQ ID NO: 1471838 - RNA, 16 nt, Pseudomonas aeruginosa PA01
caggcugucggccagc

SEQ ID NO: 1471839 - RNA, 20 nt, Pseudomonas aeruginosa PA01
caggcugucggccaucgccg

SEQ ID NO: 1471840 - RNA, 17 nt, Pseudomonas aeruginosa PA01
caggcugguaugcagca

SEQ ID NO: 1471841 - RNA, 17 nt, Pseudomonas aeruginosa PA01
caggcugguggucaccg

SEQ ID NO: 1471842 - RNA, 17 nt, Pseudomonas aeruginosa PA01
caggcuguacagcagga

SEQ ID NO: 1471843 - RNA, 23 nt, Pseudomonas aeruginosa PA01
caggcuguacagcaggagcgcca

SEQ ID NO: 1471844 - RNA, 15 nt, Pseudomonas aeruginosa PA01
caggcuguagccggc

SEQ ID NO: 1471845 - RNA, 16 nt, Pseudomonas aeruginosa PA01
caggcuguagccggcg

SEQ ID NO: 1471846 - RNA, 17 nt, Pseudomonas aeruginosa PA01
caggcuguagccggcga

SEQ ID NO: 1471847 - RNA, 24 nt, Pseudomonas aeruginosa PA01
caggcuguagccucccgccgcggc

SEQ ID NO: 1471848 - RNA, 16 nt, Pseudomonas aeruginosa PA01
caggcugggccgaacc

SEQ ID NO: 1471849 - RNA, 22 nt, Pseudomonas aeruginosa PA01
caggcuggcgucgacgccgaag

SEQ ID NO: 1471850 - RNA, 23 nt, Pseudomonas aeruginosa PA01
caggcuggcgucgacgccgaagc

SEQ ID NO: 1471851 - RNA, 23 nt, Pseudomonas aeruginosa PA01
caggcugggguugcggcgcccgc

SEQ ID NO: 1471852 - RNA, 18 nt, Pseudomonas aeruginosa PA01
caggcuggguuggcgcga

SEQ ID NO: 1471853 - RNA, 20 nt, Pseudomonas aeruginosa PA01
caggcuuuccaccgccagca

SEQ ID NO: 1471854 - RNA, 17 nt, Pseudomonas aeruginosa PA01
caggcuuuccagcccgg

SEQ ID NO: 1471855 - RNA, 20 nt, Pseudomonas aeruginosa PA01
caggcuuuccagcccggcgu

SEQ ID NO: 1471856 - RNA, 20 nt, Pseudomonas aeruginosa PA01
cagggaaaucgguugcgaca

SEQ ID NO: 1471857 - RNA, 21 nt, Pseudomonas aeruginosa PA01
cagggaagaugcacaccagcu

SEQ ID NO: 1471858 - RNA, 18 nt, Pseudomonas aeruginosa PA01
cagggaagcgcgcgccag

SEQ ID NO: 1471859 - RNA, 23 nt, Pseudomonas aeruginosa PA01
cagggaagcgcgcgccagucccg

SEQ ID NO: 1471860 - RNA, 15 nt, Pseudomonas aeruginosa PA01
caggcuuugcggcaa

SEQ ID NO: 1471861 - RNA, 21 nt, Pseudomonas aeruginosa PA01
caggcuuugcggcaaggcgau

SEQ ID NO: 1471862 - RNA, 17 nt, Pseudomonas aeruginosa PA01
cagggacaugucgaggg

SEQ ID NO: 1471863 - RNA, 23 nt, Pseudomonas aeruginosa PA01
cagggaauggaugcgcggcagca

SEQ ID NO: 1471864 - RNA, 16 nt, Pseudomonas aeruginosa PA01
cagggacgcgcagcgg

SEQ ID NO: 1471865 - RNA, 19 nt, Pseudomonas aeruginosa PA01
cagggacgcgcagcggcgc

SEQ ID NO: 1471866 - RNA, 20 nt, Pseudomonas aeruginosa PA01
cagggacgcgcagcggcgcc

SEQ ID NO: 1471867 - RNA, 14 nt, Pseudomonas aeruginosa PA01
cagggacgcgccgg

SEQ ID NO: 1471868 - RNA, 16 nt, Pseudomonas aeruginosa PA01
cagggacgcgccggcg

SEQ ID NO: 1471869 - RNA, 19 nt, Pseudomonas aeruginosa PA01
cagggacgcgccggcggau

SEQ ID NO: 1471870 - RNA, 20 nt, Pseudomonas aeruginosa PA01
cagggauacucaugcaggcg

SEQ ID NO: 1471871 - RNA, 16 nt, Pseudomonas aeruginosa PA01
cagggaggagggcgag

SEQ ID NO: 1471872 - RNA, 17 nt, Pseudomonas aeruginosa PA01
cagggagaaccaggcgg

SEQ ID NO: 1471873 - RNA, 22 nt, Pseudomonas aeruginosa PA01
cagggagaacgcuucgaagcuc

SEQ ID NO: 1471874 - RNA, 14 nt, Pseudomonas aeruginosa PA01
cagggagcgcucgc

SEQ ID NO: 1471875 - RNA, 19 nt, Pseudomonas aeruginosa PA01
cagggcgaaggccaccauc

SEQ ID NO: 1471876 - RNA, 24 nt, Pseudomonas aeruginosa PA01
cagggcgaagucggcgcgccagaa

SEQ ID NO: 1471877 - RNA, 16 nt, Pseudomonas aeruginosa PA01
cagggcgaccagaagg

SEQ ID NO: 1471878 - RNA, 16 nt, Pseudomonas aeruginosa PA01
cagggcgaacagcgcc

SEQ ID NO: 1471879 - RNA, 18 nt, Pseudomonas aeruginosa PA01
cagggcgaacagcgccgc

SEQ ID NO: 1471880 - RNA, 19 nt, Pseudomonas aeruginosa PA01
cagggcgaaccacucggcg

SEQ ID NO: 1471881 - RNA, 20 nt, Pseudomonas aeruginosa PA01
cagggcgaaccacucggcgc

SEQ ID NO: 1471882 - RNA, 19 nt, Pseudomonas aeruginosa PA01
cagggcguaggcgucgcga

SEQ ID NO: 1471883 - RNA, 17 nt, Pseudomonas aeruginosa PA01
cagggcguagugcuccu

SEQ ID NO: 1471884 - RNA, 17 nt, Pseudomonas aeruginosa PA01
cagggcguccaguagcg

SEQ ID NO: 1471885 - RNA, 19 nt, Pseudomonas aeruginosa PA01
cagggcgucccguuccggc

SEQ ID NO: 1471886 - RNA, 22 nt, Pseudomonas aeruginosa PA01
cagggcgucgaaggcggcgcgg

SEQ ID NO: 1471887 - RNA, 23 nt, Pseudomonas aeruginosa PA01
cagggcgucgcccucggcgcugg

SEQ ID NO: 1471888 - RNA, 17 nt, Pseudomonas aeruginosa PA01
cagggcgucggagagau

SEQ ID NO: 1471889 - RNA, 14 nt, Pseudomonas aeruginosa PA01
cagggcgucggcgu

SEQ ID NO: 1471890 - RNA, 19 nt, Pseudomonas aeruginosa PA01
cagggcgucggcgugcugg

SEQ ID NO: 1471891 - RNA, 23 nt, Pseudomonas aeruginosa PA01
cagggcuccgaugaagcaggcgg

SEQ ID NO: 1471892 - RNA, 20 nt, Pseudomonas aeruginosa PA01
cagggcguggucggcggccu

SEQ ID NO: 1471893 - RNA, 13 nt, Pseudomonas aeruginosa PA01
cagggcgucggcg

SEQ ID NO: 1471894 - RNA, 21 nt, Pseudomonas aeruginosa PA01
cagggccucggggccguccgc

SEQ ID NO: 1471895 - RNA, 14 nt, Pseudomonas aeruginosa PA01
cagggccuggcccu

SEQ ID NO: 1471896 - RNA, 13 nt, Pseudomonas aeruginosa PA01
cagggccuggcgc

SEQ ID NO: 1471897 - RNA, 16 nt, Pseudomonas aeruginosa PA01
cagggccuggcgcacg

SEQ ID NO: 1471898 - RNA, 19 nt, Pseudomonas aeruginosa PA01
cagggccuugccgcgaccg

SEQ ID NO: 1471899 - RNA, 22 nt, Pseudomonas aeruginosa PA01
cagggccucuucgcaacggccg

SEQ ID NO: 1471900 - RNA, 17 nt, Pseudomonas aeruginosa PA01
cagggccugcuccagcg

SEQ ID NO: 1471901 - RNA, 18 nt, Pseudomonas aeruginosa PA01
cagggccugcuccagcgg

SEQ ID NO: 1471902 - RNA, 19 nt, Pseudomonas aeruginosa PA01
cagggccugcuccagcgga

SEQ ID NO: 1471903 - RNA, 13 nt, Pseudomonas aeruginosa PA01
cagggcagcgcga

SEQ ID NO: 1471904 - RNA, 22 nt, Pseudomonas aeruginosa PA01
cagggccgggucaucaccggca

SEQ ID NO: 1471905 - RNA, 18 nt, Pseudomonas aeruginosa PA01
cagggcauagaugccgcc

SEQ ID NO: 1471906 - RNA, 19 nt, Pseudomonas aeruginosa PA01
cagggcauagaugccgccc

SEQ ID NO: 1471907 - RNA, 21 nt, Pseudomonas aeruginosa PA01
cagggcauagaugccgcccug

SEQ ID NO: 1471908 - RNA, 16 nt, Pseudomonas aeruginosa PA01
cagggcaacgccaggc

SEQ ID NO: 1471909 - RNA, 18 nt, Pseudomonas aeruginosa PA01
cagggcaacgccaggcug

SEQ ID NO: 1471910 - RNA, 16 nt, Pseudomonas aeruginosa PA01
cagggcagcaggucgc

SEQ ID NO: 1471911 - RNA, 12 nt, Pseudomonas aeruginosa PA01
cagggcaccgcc

SEQ ID NO: 1471912 - RNA, 16 nt, Pseudomonas aeruginosa PA01
cagggcaccgccgagg

SEQ ID NO: 1471913 - RNA, 17 nt, Pseudomonas aeruginosa PA01
caggcgggcuccgccgc

SEQ ID NO: 1471914 - RNA, 19 nt, Pseudomonas aeruginosa PA01
caggcgggcuccgccgccg

SEQ ID NO: 1471915 - RNA, 21 nt, Pseudomonas aeruginosa PA01
caggcggggcguauagcccgg

SEQ ID NO: 1471916 - RNA, 19 nt, Pseudomonas aeruginosa PA01
caggcgggccagcuggcga

SEQ ID NO: 1471917 - RNA, 14 nt, Pseudomonas aeruginosa PA01
caggcgggcgccau

SEQ ID NO: 1471918 - RNA, 16 nt, Pseudomonas aeruginosa PA01
caggcguauucggcga

SEQ ID NO: 1471919 - RNA, 17 nt, Pseudomonas aeruginosa PA01
caggcguauucggcgac

SEQ ID NO: 1471920 - RNA, 15 nt, Pseudomonas aeruginosa PA01
caggcguacgucgau

SEQ ID NO: 1471921 - RNA, 17 nt, Pseudomonas aeruginosa PA01
caggcgguucucgucga

SEQ ID NO: 1471922 - RNA, 23 nt, Pseudomonas aeruginosa PA01
caggcgguuggcccgcgccgugu

SEQ ID NO: 1471923 - RNA, 16 nt, Pseudomonas aeruginosa PA01
caggcgguagcgccgc

SEQ ID NO: 1471924 - RNA, 17 nt, Pseudomonas aeruginosa PA01
caggcgguagcgccgcg

SEQ ID NO: 1471925 - RNA, 16 nt, Pseudomonas aeruginosa PA01
caggcggucagcgcgu

SEQ ID NO: 1471926 - RNA, 17 nt, Pseudomonas aeruginosa PA01
caggcgguccagccaga

SEQ ID NO: 1471927 - RNA, 16 nt, Pseudomonas aeruginosa PA01
caggcggucgccgaac

SEQ ID NO: 1471928 - RNA, 19 nt, Pseudomonas aeruginosa PA01
caggcggucggaaagcagg

SEQ ID NO: 1471929 - RNA, 22 nt, Pseudomonas aeruginosa PA01
caggcggucggaaagcagggcg

SEQ ID NO: 1471930 - RNA, 22 nt, Pseudomonas aeruginosa PA01
caggcggucggccaucuggcug

SEQ ID NO: 1471931 - RNA, 17 nt, Pseudomonas aeruginosa PA01
caggcguugccggacuu

SEQ ID NO: 1471932 - RNA, 17 nt, Pseudomonas aeruginosa PA01
caggcguuccggggugc

SEQ ID NO: 1471933 - RNA, 17 nt, Pseudomonas aeruginosa PA01
caggcguuccucgacga

SEQ ID NO: 1471934 - RNA, 14 nt, Pseudomonas aeruginosa PA01
caggcguucggcga

SEQ ID NO: 1471935 - RNA, 17 nt, Pseudomonas aeruginosa PA01
caggcguuauccgccga

SEQ ID NO: 1471936 - RNA, 18 nt, Pseudomonas aeruginosa PA01
caggcguuauccgccgau

SEQ ID NO: 1471937 - RNA, 19 nt, Pseudomonas aeruginosa PA01
caggcguuauccgccgaua

SEQ ID NO: 1471938 - RNA, 17 nt, Pseudomonas aeruginosa PA01
caggcguuauccgccgc

SEQ ID NO: 1471939 - RNA, 18 nt, Pseudomonas aeruginosa PA01
caggcguuauccgccgcc

SEQ ID NO: 1471940 - RNA, 19 nt, Pseudomonas aeruginosa PA01
caggcguuauccgccgccg

SEQ ID NO: 1471941 - RNA, 20 nt, Pseudomonas aeruginosa PA01
caggcguuauccgccgccga

SEQ ID NO: 1471942 - RNA, 21 nt, Pseudomonas aeruginosa PA01
caggcguuauccgccgccgac

SEQ ID NO: 1471943 - RNA, 22 nt, Pseudomonas aeruginosa PA01
caggcguuccaccaggcgucgc

SEQ ID NO: 1471944 - RNA, 20 nt, Pseudomonas aeruginosa PA01
caggcguuccagcucggcga

SEQ ID NO: 1471945 - RNA, 12 nt, Pseudomonas aeruginosa PA01
caggcgugccug

SEQ ID NO: 1471946 - RNA, 16 nt, Pseudomonas aeruginosa PA01
caggcgugcugcacgg

SEQ ID NO: 1471947 - RNA, 19 nt, Pseudomonas aeruginosa PA01
caggcgugggccagcccag

SEQ ID NO: 1471948 - RNA, 14 nt, Pseudomonas aeruginosa PA01
caggcguggggcga

SEQ ID NO: 1471949 - RNA, 15 nt, Pseudomonas aeruginosa PA01
caggcguggggcgaa

SEQ ID NO: 1471950 - RNA, 16 nt, Pseudomonas aeruginosa PA01
caggcgucuucggcga

SEQ ID NO: 1471951 - RNA, 16 nt, Pseudomonas aeruginosa PA01
caggcguaggccgucg

SEQ ID NO: 1471952 - RNA, 23 nt, Pseudomonas aeruginosa PA01
caggcgucccgcuccagccggca

SEQ ID NO: 1471953 - RNA, 23 nt, Pseudomonas aeruginosa PA01
caggcgucccguuccgcucacca

SEQ ID NO: 1471954 - RNA, 17 nt, Pseudomonas aeruginosa PA01
caggcgucccuggagca

SEQ ID NO: 1471955 - RNA, 23 nt, Pseudomonas aeruginosa PA01
caggcgucccuggagcagggcga

SEQ ID NO: 1471956 - RNA, 15 nt, Pseudomonas aeruginosa PA01
caggcgucgguccag

SEQ ID NO: 1471957 - RNA, 14 nt, Pseudomonas aeruginosa PA01
caggcgucggcgcc

SEQ ID NO: 1471958 - RNA, 15 nt, Pseudomonas aeruginosa PA01
caggcgucgcgccag

SEQ ID NO: 1471959 - RNA, 18 nt, Pseudomonas aeruginosa PA01
caggcgucgcgccagcac

SEQ ID NO: 1471960 - RNA, 16 nt, Pseudomonas aeruginosa PA01
caggcucucgcgcagc

SEQ ID NO: 1471961 - RNA, 19 nt, Pseudomonas aeruginosa PA01
caggcucgacaggucggcg

SEQ ID NO: 1471962 - RNA, 21 nt, Pseudomonas aeruginosa PA01
caggcucgacaggucggcgaa

SEQ ID NO: 1471963 - RNA, 13 nt, Pseudomonas aeruginosa PA01
caggcucgccgcc

SEQ ID NO: 1471964 - RNA, 15 nt, Pseudomonas aeruginosa PA01
caggcucgccgccag

SEQ ID NO: 1471965 - RNA, 16 nt, Pseudomonas aeruginosa PA01
caggcucgccgccagc

SEQ ID NO: 1471966 - RNA, 19 nt, Pseudomonas aeruginosa PA01
caggcucgccgccagcagg

SEQ ID NO: 1471967 - RNA, 14 nt, Pseudomonas aeruginosa PA01
caggcucgaggccg

SEQ ID NO: 1471968 - RNA, 21 nt, Pseudomonas aeruginosa PA01
caggcucgaggccgagccggc

SEQ ID NO: 1471969 - RNA, 13 nt, Pseudomonas aeruginosa PA01
caggcucgccccg

SEQ ID NO: 1471970 - RNA, 18 nt, Pseudomonas aeruginosa PA01
caggcucgccccggcggc

SEQ ID NO: 1471971 - RNA, 20 nt, Pseudomonas aeruginosa PA01
caggcucgccccggcggcga

SEQ ID NO: 1471972 - RNA, 21 nt, Pseudomonas aeruginosa PA01
caggcucagggucucgcgggc

SEQ ID NO: 1471973 - RNA, 16 nt, Pseudomonas aeruginosa PA01
caggcucaguucggcc

SEQ ID NO: 1471974 - RNA, 21 nt, Pseudomonas aeruginosa PA01
caggcucaguucggccagcgg

SEQ ID NO: 1471975 - RNA, 23 nt, Pseudomonas aeruginosa PA01
caggcucaguucggccagcggca

SEQ ID NO: 1471976 - RNA, 20 nt, Pseudomonas aeruginosa PA01
caggcucacgcguucggcga

SEQ ID NO: 1471977 - RNA, 20 nt, Pseudomonas aeruginosa PA01
caggcucagcucggcgaugc

SEQ ID NO: 1471978 - RNA, 21 nt, Pseudomonas aeruginosa PA01
caggcucagcucucccgaggc

SEQ ID NO: 1471979 - RNA, 14 nt, Pseudomonas aeruginosa PA01
caggcucaggccgg

SEQ ID NO: 1471980 - RNA, 18 nt, Pseudomonas aeruginosa PA01
caggcucaggccgggcac

SEQ ID NO: 1471981 - RNA, 11 nt, Pseudomonas aeruginosa PA01
caggcuggccg

SEQ ID NO: 1471982 - RNA, 17 nt, Pseudomonas aeruginosa PA01
caggcuggccgagcgcc

SEQ ID NO: 1471983 - RNA, 20 nt, Pseudomonas aeruginosa PA01
caggcuggccacgaacaggc

SEQ ID NO: 1471984 - RNA, 12 nt, Pseudomonas aeruginosa PA01
caggcuggccag

SEQ ID NO: 1471985 - RNA, 12 nt, Pseudomonas aeruginosa PA01
caggcuggcgua

SEQ ID NO: 1471986 - RNA, 13 nt, Pseudomonas aeruginosa PA01
caggcuggcggca

SEQ ID NO: 1471987 - RNA, 14 nt, Pseudomonas aeruginosa PA01
caggcuggcggcau

SEQ ID NO: 1471988 - RNA, 15 nt, Pseudomonas aeruginosa PA01
caggcuggcggcauc

SEQ ID NO: 1471989 - RNA, 22 nt, Pseudomonas aeruginosa PA01
caggcuggcggcaucggcgccg

SEQ ID NO: 1471990 - RNA, 21 nt, Pseudomonas aeruginosa PA01
caggcuggcggccagggcaug

SEQ ID NO: 1471991 - RNA, 15 nt, Pseudomonas aeruginosa PA01
caggcugcugcugcg

SEQ ID NO: 1471992 - RNA, 19 nt, Pseudomonas aeruginosa PA01
caggcugcugcugcggcgg

SEQ ID NO: 1471993 - RNA, 13 nt, Pseudomonas aeruginosa PA01
caggcugcggcgg

SEQ ID NO: 1471994 - RNA, 22 nt, Pseudomonas aeruginosa PA01
caggcugcggcggaaggcggcg

SEQ ID NO: 1471995 - RNA, 17 nt, Pseudomonas aeruginosa PA01
caggcugcgccgcugcg

SEQ ID NO: 1471996 - RNA, 22 nt, Pseudomonas aeruginosa PA01
caggcugcgccgcugcggcugc

SEQ ID NO: 1471997 - RNA, 19 nt, Pseudomonas aeruginosa PA01
caggcugccguccaggcgc

SEQ ID NO: 1471998 - RNA, 11 nt, Pseudomonas aeruginosa PA01
caggcugcgca

SEQ ID NO: 1471999 - RNA, 14 nt, Pseudomonas aeruginosa PA01
caggcugcgcaccu

SEQ ID NO: 1472000 - RNA, 20 nt, Pseudomonas aeruginosa PA01
caggcugcgcaccucggcca

SEQ ID NO: 1472001 - RNA, 22 nt, Pseudomonas aeruginosa PA01
caggcugaucggcgcgccggcc

SEQ ID NO: 1472002 - RNA, 14 nt, Pseudomonas aeruginosa PA01
caggcucggccugu

SEQ ID NO: 1472003 - RNA, 19 nt, Pseudomonas aeruginosa PA01
caggcugaguucgucgagc

SEQ ID NO: 1472004 - RNA, 20 nt, Pseudomonas aeruginosa PA01
caggcugaucuugccgcugg

SEQ ID NO: 1472005 - RNA, 14 nt, Pseudomonas aeruginosa PA01
caggcugacgucga

SEQ ID NO: 1472006 - RNA, 18 nt, Pseudomonas aeruginosa PA01
caggcugaccgcgugggc

SEQ ID NO: 1472007 - RNA, 18 nt, Pseudomonas aeruginosa PA01
caggcugcaucggcucgg

SEQ ID NO: 1472008 - RNA, 21 nt, Pseudomonas aeruginosa PA01
caggcugcccagguagccggc

SEQ ID NO: 1472009 - RNA, 15 nt, Pseudomonas aeruginosa PA01
caggcugccggacgc

SEQ ID NO: 1472010 - RNA, 16 nt, Pseudomonas aeruginosa PA01
caggcugccggacgcg

SEQ ID NO: 1472011 - RNA, 15 nt, Pseudomonas aeruginosa PA01
caggcugccggccag

SEQ ID NO: 1472012 - RNA, 16 nt, Pseudomonas aeruginosa PA01
caggcugccggccagg

SEQ ID NO: 1472013 - RNA, 13 nt, Pseudomonas aeruginosa PA01
caggcugccgaag

SEQ ID NO: 1472014 - RNA, 17 nt, Pseudomonas aeruginosa PA01
caggcugccgagcaggg

SEQ ID NO: 1472015 - RNA, 14 nt, Pseudomonas aeruginosa PA01
caggcugccgccgc

SEQ ID NO: 1472016 - RNA, 15 nt, Pseudomonas aeruginosa PA01
caggcugccgccgcc

SEQ ID NO: 1472017 - RNA, 22 nt, Pseudomonas aeruginosa PA01
caggcugccgccgccgucgaca

SEQ ID NO: 1472018 - RNA, 15 nt, Pseudomonas aeruginosa PA01
caggcugccgccgua

SEQ ID NO: 1472019 - RNA, 19 nt, Pseudomonas aeruginosa PA01
caggcugccgccguagaag

SEQ ID NO: 1472020 - RNA, 21 nt, Pseudomonas aeruginosa PA01
caggcugccgccuucgcgggc

SEQ ID NO: 1472021 - RNA, 22 nt, Pseudomonas aeruginosa PA01
cagcuugacccguugcgccucg

SEQ ID NO: 1472022 - RNA, 14 nt, Pseudomonas aeruginosa PA01
cagcuugacgaucu

SEQ ID NO: 1472023 - RNA, 23 nt, Pseudomonas aeruginosa PA01
cagcuugauguaggacaggccga

SEQ ID NO: 1472024 - RNA, 13 nt, Pseudomonas aeruginosa PA01
cagcuugccguug

SEQ ID NO: 1472025 - RNA, 20 nt, Pseudomonas aeruginosa PA01
cagcuugccguuggcgucgc

SEQ ID NO: 1472026 - RNA, 17 nt, Pseudomonas aeruginosa PA01
cagcuugccuuccaggc

SEQ ID NO: 1472027 - RNA, 23 nt, Pseudomonas aeruginosa PA01
cagcuugcgccagagcaggcgga

SEQ ID NO: 1472028 - RNA, 13 nt, Pseudomonas aeruginosa PA01
cagcuucggcgcg

SEQ ID NO: 1472029 - RNA, 15 nt, Pseudomonas aeruginosa PA01
cagcuucggcgcgac

SEQ ID NO: 1472030 - RNA, 22 nt, Pseudomonas aeruginosa PA01
cagcuucugcagggcggcuucc

SEQ ID NO: 1472031 - RNA, 20 nt, Pseudomonas aeruginosa PA01
cagcuucucuuucaccuggu

SEQ ID NO: 1472032 - RNA, 23 nt, Pseudomonas aeruginosa PA01
cagcuucucuuucaccuggucgc

SEQ ID NO: 1472033 - RNA, 23 nt, Pseudomonas aeruginosa PA01
cagcuggauagaguacucggcua

SEQ ID NO: 1472034 - RNA, 22 nt, Pseudomonas aeruginosa PA01
cagcugccagccccgcucguca

SEQ ID NO: 1472035 - RNA, 23 nt, Pseudomonas aeruginosa PA01
cagcugccagccccgcucgucau

SEQ ID NO: 1472036 - RNA, 14 nt, Pseudomonas aeruginosa PA01
cagcugcaccgcgc

SEQ ID NO: 1472037 - RNA, 14 nt, Pseudomonas aeruginosa PA01
cagcucugcgauca

SEQ ID NO: 1472038 - RNA, 15 nt, Pseudomonas aeruginosa PA01
cagcucgucguggaa

SEQ ID NO: 1472039 - RNA, 17 nt, Pseudomonas aeruginosa PA01
cagcucguggcuggcgc

SEQ ID NO: 1472040 - RNA, 21 nt, Pseudomonas aeruginosa PA01
cagcucguggcuggcgccgcg

SEQ ID NO: 1472041 - RNA, 23 nt, Pseudomonas aeruginosa PA01
cagcucguggcuggcgccgcggg

SEQ ID NO: 1472042 - RNA, 19 nt, Pseudomonas aeruginosa PA01
cagcucguuggccaccugc

SEQ ID NO: 1472043 - RNA, 18 nt, Pseudomonas aeruginosa PA01
cagcucuaccgagaucac

SEQ ID NO: 1472044 - RNA, 20 nt, Pseudomonas aeruginosa PA01
cagcucguugcacagcgccc

SEQ ID NO: 1472045 - RNA, 22 nt, Pseudomonas aeruginosa PA01
cagcucguugcacagcgcccag

SEQ ID NO: 1472046 - RNA, 17 nt, Pseudomonas aeruginosa PA01
cagcucguugcccggcu

SEQ ID NO: 1472047 - RNA, 23 nt, Pseudomonas aeruginosa PA01
cagcucguugcccggcuugccgu

SEQ ID NO: 1472048 - RNA, 20 nt, Pseudomonas aeruginosa PA01
cagcucggcguagcgcuggg

SEQ ID NO: 1472049 - RNA, 15 nt, Pseudomonas aeruginosa PA01
cagcucggucucgau

SEQ ID NO: 1472050 - RNA, 23 nt, Pseudomonas aeruginosa PA01
cagcucggucucgaucggcccgg

SEQ ID NO: 1472051 - RNA, 19 nt, Pseudomonas aeruginosa PA01
cagcucggugagcaggcgc

SEQ ID NO: 1472052 - RNA, 20 nt, Pseudomonas aeruginosa PA01
cagcucggugagcaggcgcc

SEQ ID NO: 1472053 - RNA, 15 nt, Pseudomonas aeruginosa PA01
cagcucggccggcag

SEQ ID NO: 1472054 - RNA, 17 nt, Pseudomonas aeruginosa PA01
cagcucguccaggcaag

SEQ ID NO: 1472055 - RNA, 22 nt, Pseudomonas aeruginosa PA01
cagcucguccaggcaagcgcau

SEQ ID NO: 1472056 - RNA, 23 nt, Pseudomonas aeruginosa PA01
cagcucgucgagcugcucggcgg

SEQ ID NO: 1472057 - RNA, 14 nt, Pseudomonas aeruginosa PA01
cagcucgucgcccu

SEQ ID NO: 1472058 - RNA, 16 nt, Pseudomonas aeruginosa PA01
cagcucgucgcccuuc

SEQ ID NO: 1472059 - RNA, 19 nt, Pseudomonas aeruginosa PA01
caggauaucgcccagggcc

SEQ ID NO: 1472060 - RNA, 16 nt, Pseudomonas aeruginosa PA01
caggauagccggcgcg

SEQ ID NO: 1472061 - RNA, 17 nt, Pseudomonas aeruginosa PA01
caggaggaucgccagga

SEQ ID NO: 1472062 - RNA, 19 nt, Pseudomonas aeruginosa PA01
caggaggaucgccaggacg

SEQ ID NO: 1472063 - RNA, 19 nt, Pseudomonas aeruginosa PA01
caggaggauucgccagccu

SEQ ID NO: 1472064 - RNA, 20 nt, Pseudomonas aeruginosa PA01
caggaccucgaagcuggcca

SEQ ID NO: 1472065 - RNA, 16 nt, Pseudomonas aeruginosa PA01
caggagggcugcuguc

SEQ ID NO: 1472066 - RNA, 16 nt, Pseudomonas aeruginosa PA01
caggaguaggcaucga

SEQ ID NO: 1472067 - RNA, 16 nt, Pseudomonas aeruginosa PA01
caggcaaagaccgacc

SEQ ID NO: 1472068 - RNA, 23 nt, Pseudomonas aeruginosa PA01
caggauguggccgucgcgccgcg

SEQ ID NO: 1472069 - RNA, 17 nt, Pseudomonas aeruginosa PA01
caggauguucgccgagg

SEQ ID NO: 1472070 - RNA, 21 nt, Pseudomonas aeruginosa PA01
caggauguugaacaggcucga

SEQ ID NO: 1472071 - RNA, 23 nt, Pseudomonas aeruginosa PA01
caggauguugacgauggcccaga

SEQ ID NO: 1472072 - RNA, 16 nt, Pseudomonas aeruginosa PA01
caggaagcgccgggcc

SEQ ID NO: 1472073 - RNA, 17 nt, Pseudomonas aeruginosa PA01
caggaagccgcgcccca

SEQ ID NO: 1472074 - RNA, 23 nt, Pseudomonas aeruginosa PA01
caggaagccgcgccccagcggca

SEQ ID NO: 1472075 - RNA, 13 nt, Pseudomonas aeruginosa PA01
cagcuuggccuug

SEQ ID NO: 1472076 - RNA, 21 nt, Pseudomonas aeruginosa PA01
cagcuuggcgacguccugcgg

SEQ ID NO: 1472077 - RNA, 19 nt, Pseudomonas aeruginosa PA01
caggaagcgggccucggcg

SEQ ID NO: 1472078 - RNA, 17 nt, Pseudomonas aeruginosa PA01
caggaagcugcgcucgg

SEQ ID NO: 1472079 - RNA, 21 nt, Pseudomonas aeruginosa PA01
caggaaggaaugcugccaccc

SEQ ID NO: 1472080 - RNA, 15 nt, Pseudomonas aeruginosa PA01
caggaaggcuuccgg

SEQ ID NO: 1472081 - RNA, 23 nt, Pseudomonas aeruginosa PA01
caggaaggccgcuucgccgcccu

SEQ ID NO: 1472082 - RNA, 20 nt, Pseudomonas aeruginosa PA01
caggaaggcgaagccguugu

SEQ ID NO: 1472083 - RNA, 20 nt, Pseudomonas aeruginosa PA01
caggaaggucucgccgccgg

SEQ ID NO: 1472084 - RNA, 20 nt, Pseudomonas aeruginosa PA01
cagcuuggccagcaggccga

SEQ ID NO: 1472085 - RNA, 22 nt, Pseudomonas aeruginosa PA01
cagcuuggcacggccggcggug

SEQ ID NO: 1472086 - RNA, 20 nt, Pseudomonas aeruginosa PA01
cagcuugcuggcguagaagu

SEQ ID NO: 1472087 - RNA, 16 nt, Pseudomonas aeruginosa PA01
cagcuugcgcgccagg

SEQ ID NO: 1472088 - RNA, 23 nt, Pseudomonas aeruginosa PA01
cagcuugcgucccuuggcgucgc

SEQ ID NO: 1472089 - RNA, 21 nt, Pseudomonas aeruginosa PA01
cagcuugcucgaugccaucga

SEQ ID NO: 1472090 - RNA, 19 nt, Pseudomonas aeruginosa PA01
caggacaacgacagccccg

SEQ ID NO: 1472091 - RNA, 14 nt, Pseudomonas aeruginosa PA01
caggaauuccuggc

SEQ ID NO: 1472092 - RNA, 17 nt, Pseudomonas aeruginosa PA01
caggaaguggcggaugc

SEQ ID NO: 1472093 - RNA, 22 nt, Pseudomonas aeruginosa PA01
caggaaguugauggucaggcug

SEQ ID NO: 1472094 - RNA, 18 nt, Pseudomonas aeruginosa PA01
caggaauccuccgccagc

SEQ ID NO: 1472095 - RNA, 19 nt, Pseudomonas aeruginosa PA01
caggaaucgacccagccgc

SEQ ID NO: 1472096 - RNA, 19 nt, Pseudomonas aeruginosa PA01
caggaccuggccguuggcg

SEQ ID NO: 1472097 - RNA, 18 nt, Pseudomonas aeruginosa PA01
caggaccggcaggucggg

SEQ ID NO: 1472098 - RNA, 14 nt, Pseudomonas aeruginosa PA01
caggaccgccaugg

SEQ ID NO: 1472099 - RNA, 19 nt, Pseudomonas aeruginosa PA01
caggaccgccauggcgcug

SEQ ID NO: 1472100 - RNA, 20 nt, Pseudomonas aeruginosa PA01
caggaccgccauggcgcuga

SEQ ID NO: 1472101 - RNA, 16 nt, Pseudomonas aeruginosa PA01
caggacccgcgacucg

SEQ ID NO: 1472102 - RNA, 14 nt, Pseudomonas aeruginosa PA01
caggacccuuccag

SEQ ID NO: 1472103 - RNA, 17 nt, Pseudomonas aeruginosa PA01
caggacccuuccagcgu

SEQ ID NO: 1472104 - RNA, 19 nt, Pseudomonas aeruginosa PA01
caggaccagggcgggccgc

SEQ ID NO: 1472105 - RNA, 15 nt, Pseudomonas aeruginosa PA01
caggaccaucggcac

SEQ ID NO: 1472106 - RNA, 16 nt, Pseudomonas aeruginosa PA01
caggaccaucggcacc

SEQ ID NO: 1472107 - RNA, 18 nt, Pseudomonas aeruginosa PA01
caggaccacgcuggucac

SEQ ID NO: 1472108 - RNA, 14 nt, Pseudomonas aeruginosa PA01
caggaccagcgccu

SEQ ID NO: 1472109 - RNA, 16 nt, Pseudomonas aeruginosa PA01
cagcggugggaagagc

SEQ ID NO: 1472110 - RNA, 17 nt, Pseudomonas aeruginosa PA01
cagcggugugcucaggc

SEQ ID NO: 1472111 - RNA, 22 nt, Pseudomonas aeruginosa PA01
cagcggugugcucaggcgaacc

SEQ ID NO: 1472112 - RNA, 16 nt, Pseudomonas aeruginosa PA01
cagcggucgccggucg

SEQ ID NO: 1472113 - RNA, 22 nt, Pseudomonas aeruginosa PA01
cagcggugaagguccgcgccau

SEQ ID NO: 1472114 - RNA, 17 nt, Pseudomonas aeruginosa PA01
cagcguccgaacgcgcu

SEQ ID NO: 1472115 - RNA, 14 nt, Pseudomonas aeruginosa PA01
cagcguccuucggc

SEQ ID NO: 1472116 - RNA, 19 nt, Pseudomonas aeruginosa PA01
cagcguccuucggcgcucu

SEQ ID NO: 1472117 - RNA, 17 nt, Pseudomonas aeruginosa PA01
cagcgucgacgccgagc

SEQ ID NO: 1472118 - RNA, 20 nt, Pseudomonas aeruginosa PA01
cagcgucgacgccgagcuga

SEQ ID NO: 1472119 - RNA, 13 nt, Pseudomonas aeruginosa PA01
cagcguccucagc

SEQ ID NO: 1472120 - RNA, 14 nt, Pseudomonas aeruginosa PA01
cagcguccucagcc

SEQ ID NO: 1472121 - RNA, 20 nt, Pseudomonas aeruginosa PA01
cagcguccucagccucaccc

SEQ ID NO: 1472122 - RNA, 23 nt, Pseudomonas aeruginosa PA01
cagcguccugcccuccugcucga

SEQ ID NO: 1472123 - RNA, 18 nt, Pseudomonas aeruginosa PA01
cagcgucgagcuggcgca

SEQ ID NO: 1472124 - RNA, 12 nt, Pseudomonas aeruginosa PA01
cagcgucgccgg

SEQ ID NO: 1472125 - RNA, 13 nt, Pseudomonas aeruginosa PA01
cagcgucgccggg

SEQ ID NO: 1472126 - RNA, 14 nt, Pseudomonas aeruginosa PA01
cagcgucgccgggc

SEQ ID NO: 1472127 - RNA, 15 nt, Pseudomonas aeruginosa PA01
cagcgucgccgggcg

SEQ ID NO: 1472128 - RNA, 16 nt, Pseudomonas aeruginosa PA01
cagcgucgccgggcgu

SEQ ID NO: 1472129 - RNA, 19 nt, Pseudomonas aeruginosa PA01
cagcgucgccugccaggcg

SEQ ID NO: 1472130 - RNA, 19 nt, Pseudomonas aeruginosa PA01
cagcgucgcgcguccagcc

SEQ ID NO: 1472131 - RNA, 21 nt, Pseudomonas aeruginosa PA01
cagcgucgcgcguccagccgg

SEQ ID NO: 1472132 - RNA, 17 nt, Pseudomonas aeruginosa PA01
cagcgcgccccggcgag

SEQ ID NO: 1472133 - RNA, 13 nt, Pseudomonas aeruginosa PA01
cagcgcgccgagu

SEQ ID NO: 1472134 - RNA, 20 nt, Pseudomonas aeruginosa PA01
cagcgcgccgaguucgccgc

SEQ ID NO: 1472135 - RNA, 22 nt, Pseudomonas aeruginosa PA01
cagcgcgccgaguucgccgcga

SEQ ID NO: 1472136 - RNA, 20 nt, Pseudomonas aeruginosa PA01
cagcgggaugugcaccagca

SEQ ID NO: 1472137 - RNA, 23 nt, Pseudomonas aeruginosa PA01
cagcgggaugugcaccagcaacu

SEQ ID NO: 1472138 - RNA, 13 nt, Pseudomonas aeruginosa PA01
cagcgcgccgagc

SEQ ID NO: 1472139 - RNA, 16 nt, Pseudomonas aeruginosa PA01
cagcgcgccgagccag

SEQ ID NO: 1472140 - RNA, 21 nt, Pseudomonas aeruginosa PA01
cagcgcgauacccuggccggc

SEQ ID NO: 1472141 - RNA, 19 nt, Pseudomonas aeruginosa PA01
cagcgcgauaucgcaggcc

SEQ ID NO: 1472142 - RNA, 13 nt, Pseudomonas aeruginosa PA01
cagcgcgccagca

SEQ ID NO: 1472143 - RNA, 19 nt, Pseudomonas aeruginosa PA01
cagcgcgauuuugggcuca

SEQ ID NO: 1472144 - RNA, 20 nt, Pseudomonas aeruginosa PA01
cagcgcgauuuugggcucag

SEQ ID NO: 1472145 - RNA, 23 nt, Pseudomonas aeruginosa PA01
cagcgggcugaagugggucgccg

SEQ ID NO: 1472146 - RNA, 23 nt, Pseudomonas aeruginosa PA01
cagcgggcauauggaucggccuc

SEQ ID NO: 1472147 - RNA, 15 nt, Pseudomonas aeruginosa PA01
cagcgguaggcgcgu

SEQ ID NO: 1472148 - RNA, 16 nt, Pseudomonas aeruginosa PA01
cagcgguacggucgag

SEQ ID NO: 1472149 - RNA, 16 nt, Pseudomonas aeruginosa PA01
cagcgguacaggcgga

SEQ ID NO: 1472150 - RNA, 17 nt, Pseudomonas aeruginosa PA01
cagcgguacaggcggau

SEQ ID NO: 1472151 - RNA, 16 nt, Pseudomonas aeruginosa PA01
cagcgguaccagcagc

SEQ ID NO: 1472152 - RNA, 19 nt, Pseudomonas aeruginosa PA01
cagcgguacccgccggcca

SEQ ID NO: 1472153 - RNA, 12 nt, Pseudomonas aeruginosa PA01
cagcgggcggau

SEQ ID NO: 1472154 - RNA, 19 nt, Pseudomonas aeruginosa PA01
cagcgggcguccggcgagc

SEQ ID NO: 1472155 - RNA, 14 nt, Pseudomonas aeruginosa PA01
cagcgggcggucgc

SEQ ID NO: 1472156 - RNA, 14 nt, Pseudomonas aeruginosa PA01
cagcgggcgcggua

SEQ ID NO: 1472157 - RNA, 15 nt, Pseudomonas aeruginosa PA01
cagcgggccgauccg

SEQ ID NO: 1472158 - RNA, 18 nt, Pseudomonas aeruginosa PA01
cagcgggccgauccgcga

SEQ ID NO: 1472159 - RNA, 15 nt, Pseudomonas aeruginosa PA01
cagcguucggcgcug

SEQ ID NO: 1472160 - RNA, 19 nt, Pseudomonas aeruginosa PA01
cagcguucggcgcuggcgc

SEQ ID NO: 1472161 - RNA, 21 nt, Pseudomonas aeruginosa PA01
cagcguucggcgcuggcgcgg

SEQ ID NO: 1472162 - RNA, 23 nt, Pseudomonas aeruginosa PA01
cagcgucgcgucggccuggcgca

SEQ ID NO: 1472163 - RNA, 15 nt, Pseudomonas aeruginosa PA01
cagcgugcaccagca

SEQ ID NO: 1472164 - RNA, 13 nt, Pseudomonas aeruginosa PA01
cagcucccaggcg

SEQ ID NO: 1472165 - RNA, 17 nt, Pseudomonas aeruginosa PA01
cagcucccaggcgucgc

SEQ ID NO: 1472166 - RNA, 22 nt, Pseudomonas aeruginosa PA01
cagcucccccacguacuccagc

SEQ ID NO: 1472167 - RNA, 17 nt, Pseudomonas aeruginosa PA01
cagcuccagcagucgca

SEQ ID NO: 1472168 - RNA, 16 nt, Pseudomonas aeruginosa PA01
cagcuccagcggaauc

SEQ ID NO: 1472169 - RNA, 17 nt, Pseudomonas aeruginosa PA01
cagcuccaggccgcggg

SEQ ID NO: 1472170 - RNA, 19 nt, Pseudomonas aeruginosa PA01
cagcuccaggccgcggguc

SEQ ID NO: 1472171 - RNA, 12 nt, Pseudomonas aeruginosa PA01
cagcuccagcag

SEQ ID NO: 1472172 - RNA, 16 nt, Pseudomonas aeruginosa PA01
cagcucggccaucagc

SEQ ID NO: 1472173 - RNA, 18 nt, Pseudomonas aeruginosa PA01
cagcucggccaucagcgc

SEQ ID NO: 1472174 - RNA, 22 nt, Pseudomonas aeruginosa PA01
cagcucggccaucagcgccagg

SEQ ID NO: 1472175 - RNA, 15 nt, Pseudomonas aeruginosa PA01
cagcucggcgauccg

SEQ ID NO: 1472176 - RNA, 18 nt, Pseudomonas aeruginosa PA01
cagcucggcgauccgcgc

SEQ ID NO: 1472177 - RNA, 16 nt, Pseudomonas aeruginosa PA01
cagcucggccuggucc

SEQ ID NO: 1472178 - RNA, 19 nt, Pseudomonas aeruginosa PA01
cagcucggcgaugccgccg

SEQ ID NO: 1472179 - RNA, 20 nt, Pseudomonas aeruginosa PA01
cagcucggcgaugccgccgg

SEQ ID NO: 1472180 - RNA, 22 nt, Pseudomonas aeruginosa PA01
cagcucggcgaugccgccgggc

SEQ ID NO: 1472181 - RNA, 24 nt, Pseudomonas aeruginosa PA01
cagcucggcgaugccgccgggcau

SEQ ID NO: 1472182 - RNA, 14 nt, Pseudomonas aeruginosa PA01
cagcucggcgcccu

SEQ ID NO: 1472183 - RNA, 21 nt, Pseudomonas aeruginosa PA01
cagcucgcgcaaccagccgga

SEQ ID NO: 1472184 - RNA, 13 nt, Pseudomonas aeruginosa PA01
cagcucgcgggac

SEQ ID NO: 1472185 - RNA, 23 nt, Pseudomonas aeruginosa PA01
cagcucggacaagggccagagca

SEQ ID NO: 1472186 - RNA, 14 nt, Pseudomonas aeruginosa PA01
cagcucgcugucca

SEQ ID NO: 1472187 - RNA, 17 nt, Pseudomonas aeruginosa PA01
cagcucgcuguccagca

SEQ ID NO: 1472188 - RNA, 15 nt, Pseudomonas aeruginosa PA01
cagcucgcugucgcc

SEQ ID NO: 1472189 - RNA, 19 nt, Pseudomonas aeruginosa PA01
cagcucgcugucgccgagc

SEQ ID NO: 1472190 - RNA, 14 nt, Pseudomonas aeruginosa PA01
cagcucgccggcgu

SEQ ID NO: 1472191 - RNA, 14 nt, Pseudomonas aeruginosa PA01
cagcucgcccgccu

SEQ ID NO: 1472192 - RNA, 16 nt, Pseudomonas aeruginosa PA01
cagcucgcccgccucg

SEQ ID NO: 1472193 - RNA, 13 nt, Pseudomonas aeruginosa PA01
cagcucgccgaag

SEQ ID NO: 1472194 - RNA, 16 nt, Pseudomonas aeruginosa PA01
cagcucgaagccgccg

SEQ ID NO: 1472195 - RNA, 16 nt, Pseudomonas aeruginosa PA01
cagcucgaaauccggu

SEQ ID NO: 1472196 - RNA, 15 nt, Pseudomonas aeruginosa PA01
cagcucgaacagcac

SEQ ID NO: 1472197 - RNA, 17 nt, Pseudomonas aeruginosa PA01
cagcucgaacagcaccg

SEQ ID NO: 1472198 - RNA, 20 nt, Pseudomonas aeruginosa PA01
cagcucgaacagcaccgagc

SEQ ID NO: 1472199 - RNA, 13 nt, Pseudomonas aeruginosa PA01
cagcucgaggcca

SEQ ID NO: 1472200 - RNA, 19 nt, Pseudomonas aeruginosa PA01
cagcucgaucagcccgcca

SEQ ID NO: 1472201 - RNA, 20 nt, Pseudomonas aeruginosa PA01
cagcucgaucagcccgccaa

SEQ ID NO: 1472202 - RNA, 17 nt, Pseudomonas aeruginosa PA01
cagcucgaucucauggu

SEQ ID NO: 1472203 - RNA, 22 nt, Pseudomonas aeruginosa PA01
caguuccugcuccuccgacgcc

SEQ ID NO: 1472204 - RNA, 19 nt, Pseudomonas aeruginosa PA01
caguuccuguaccagggga

SEQ ID NO: 1472205 - RNA, 20 nt, Pseudomonas aeruginosa PA01
caguuccuguaccaggggau

SEQ ID NO: 1472206 - RNA, 13 nt, Pseudomonas aeruginosa PA01
caguuccuucacg

SEQ ID NO: 1472207 - RNA, 17 nt, Pseudomonas aeruginosa PA01
caguuccuucgccgaaa

SEQ ID NO: 1472208 - RNA, 20 nt, Pseudomonas aeruginosa PA01
caguucgaccuccaggccga

SEQ ID NO: 1472209 - RNA, 23 nt, Pseudomonas aeruginosa PA01
caguucgaccuccaggccgaagc

SEQ ID NO: 1472210 - RNA, 18 nt, Pseudomonas aeruginosa PA01
caguucgaugggccggua

SEQ ID NO: 1472211 - RNA, 23 nt, Pseudomonas aeruginosa PA01
caguucgcugacccagcgcacgc

SEQ ID NO: 1472212 - RNA, 20 nt, Pseudomonas aeruginosa PA01
caguucgcugccgccgcgcu

SEQ ID NO: 1472213 - RNA, 13 nt, Pseudomonas aeruginosa PA01
caguucgcgggcc

SEQ ID NO: 1472214 - RNA, 15 nt, Pseudomonas aeruginosa PA01
caguucgcgggccgc

SEQ ID NO: 1472215 - RNA, 23 nt, Pseudomonas aeruginosa PA01
caguucgccgcccgaggcgaccu

SEQ ID NO: 1472216 - RNA, 13 nt, Pseudomonas aeruginosa PA01
caguucgccggcc

SEQ ID NO: 1472217 - RNA, 19 nt, Pseudomonas aeruginosa PA01
caguucgccccgccgccag

SEQ ID NO: 1472218 - RNA, 20 nt, Pseudomonas aeruginosa PA01
caguucgccccgccgccagg

SEQ ID NO: 1472219 - RNA, 23 nt, Pseudomonas aeruginosa PA01
caguucgccccgccgccaggcgg

SEQ ID NO: 1472220 - RNA, 13 nt, Pseudomonas aeruginosa PA01
cagugcucccgca

SEQ ID NO: 1472221 - RNA, 20 nt, Pseudomonas aeruginosa PA01
cagugucgcgaacucggcgc

SEQ ID NO: 1472222 - RNA, 18 nt, Pseudomonas aeruginosa PA01
cagugcacguuccagcuc

SEQ ID NO: 1472223 - RNA, 22 nt, Pseudomonas aeruginosa PA01
cagugagccccggcgucggcgc

SEQ ID NO: 1472224 - RNA, 17 nt, Pseudomonas aeruginosa PA01
cagugacugaccgucgg

SEQ ID NO: 1472225 - RNA, 17 nt, Pseudomonas aeruginosa PA01
cagugcccggcagaucu

SEQ ID NO: 1472226 - RNA, 16 nt, Pseudomonas aeruginosa PA01
cagugcggggcgcucg

SEQ ID NO: 1472227 - RNA, 19 nt, Pseudomonas aeruginosa PA01
cagugcggggcgcucgccc

SEQ ID NO: 1472228 - RNA, 13 nt, Pseudomonas aeruginosa PA01
cagugccagcaga

SEQ ID NO: 1472229 - RNA, 17 nt, Pseudomonas aeruginosa PA01
cagugccaggcucgccg

SEQ ID NO: 1472230 - RNA, 20 nt, Pseudomonas aeruginosa PA01
cagugccaggcucgccgcca

SEQ ID NO: 1472231 - RNA, 15 nt, Pseudomonas aeruginosa PA01
cagugcaucggccgc

SEQ ID NO: 1472232 - RNA, 16 nt, Pseudomonas aeruginosa PA01
cagugcaucggccgcc

SEQ ID NO: 1472233 - RNA, 17 nt, Pseudomonas aeruginosa PA01
cagugcaucggccgcca

SEQ ID NO: 1472234 - RNA, 19 nt, Pseudomonas aeruginosa PA01
cagugcaucggccgccagg

SEQ ID NO: 1472235 - RNA, 14 nt, Pseudomonas aeruginosa PA01
cagugcaccgccgg

SEQ ID NO: 1472236 - RNA, 15 nt, Pseudomonas aeruginosa PA01
cauacaccaggccgg

SEQ ID NO: 1472237 - RNA, 17 nt, Pseudomonas aeruginosa PA01
cauacaccaggccggcg

SEQ ID NO: 1472238 - RNA, 21 nt, Pseudomonas aeruginosa PA01
cauagaccagcagcgagcagg

SEQ ID NO: 1472239 - RNA, 17 nt, Pseudomonas aeruginosa PA01
caguucuucgccgcccg

SEQ ID NO: 1472240 - RNA, 18 nt, Pseudomonas aeruginosa PA01
caguucgucgccacgccc

SEQ ID NO: 1472241 - RNA, 17 nt, Pseudomonas aeruginosa PA01
caguucugggcggccag

SEQ ID NO: 1472242 - RNA, 18 nt, Pseudomonas aeruginosa PA01
caguucugggcggccagg

SEQ ID NO: 1472243 - RNA, 15 nt, Pseudomonas aeruginosa PA01
caguucggccgcggc

SEQ ID NO: 1472244 - RNA, 17 nt, Pseudomonas aeruginosa PA01
caguucggccagcggca

SEQ ID NO: 1472245 - RNA, 20 nt, Pseudomonas aeruginosa PA01
caguucggccaucagcacgu

SEQ ID NO: 1472246 - RNA, 20 nt, Pseudomonas aeruginosa PA01
caguucggcccagcagcgcu

SEQ ID NO: 1472247 - RNA, 14 nt, Pseudomonas aeruginosa PA01
caguucggcggugg

SEQ ID NO: 1472248 - RNA, 24 nt, Pseudomonas aeruginosa PA01
caguucggcgaugaccagcucggc

SEQ ID NO: 1472249 - RNA, 19 nt, Pseudomonas aeruginosa PA01
caguucggggucggccugc

SEQ ID NO: 1472250 - RNA, 16 nt, Pseudomonas aeruginosa PA01
caguucggugccgccg

SEQ ID NO: 1472251 - RNA, 19 nt, Pseudomonas aeruginosa PA01
caguucggugccgccggcg

SEQ ID NO: 1472252 - RNA, 19 nt, Pseudomonas aeruginosa PA01
caguucgucuuccagcggc

SEQ ID NO: 1472253 - RNA, 23 nt, Pseudomonas aeruginosa PA01
caguucguucugggucgcgcagg

SEQ ID NO: 1472254 - RNA, 15 nt, Pseudomonas aeruginosa PA01
caguucguugagcag

SEQ ID NO: 1472255 - RNA, 13 nt, Pseudomonas aeruginosa PA01
cagucuucgccgg

SEQ ID NO: 1472256 - RNA, 14 nt, Pseudomonas aeruginosa PA01
cagucuucgccggc

SEQ ID NO: 1472257 - RNA, 22 nt, Pseudomonas aeruginosa PA01
cagucuucgccggccugcgcgc

SEQ ID NO: 1472258 - RNA, 23 nt, Pseudomonas aeruginosa PA01
cagucuucgccggccugcgcgca

SEQ ID NO: 1472259 - RNA, 16 nt, Pseudomonas aeruginosa PA01
cagucuucgcuggcga

SEQ ID NO: 1472260 - RNA, 22 nt, Pseudomonas aeruginosa PA01
cagugacauccucccugcccgc

SEQ ID NO: 1472261 - RNA, 17 nt, Pseudomonas aeruginosa PA01
cagucgaaaaccggcgg

SEQ ID NO: 1472262 - RNA, 22 nt, Pseudomonas aeruginosa PA01
cagucgguuagaauaccggccu

SEQ ID NO: 1472263 - RNA, 16 nt, Pseudomonas aeruginosa PA01
cagucgucgcagccga

SEQ ID NO: 1472264 - RNA, 18 nt, Pseudomonas aeruginosa PA01
cagucguaggucugcccg

SEQ ID NO: 1472265 - RNA, 19 nt, Pseudomonas aeruginosa PA01
cagucguaggucugcccga

SEQ ID NO: 1472266 - RNA, 22 nt, Pseudomonas aeruginosa PA01
cagucguaggucugcccgacga

SEQ ID NO: 1472267 - RNA, 15 nt, Pseudomonas aeruginosa PA01
cagucgcacagccag

SEQ ID NO: 1472268 - RNA, 18 nt, Pseudomonas aeruginosa PA01
cagucgcacagccagggg

SEQ ID NO: 1472269 - RNA, 22 nt, Pseudomonas aeruginosa PA01
cagucgaugacgaggcccgccc

SEQ ID NO: 1472270 - RNA, 20 nt, Pseudomonas aeruginosa PA01
cagucggcaccgaucgcccg

SEQ ID NO: 1472271 - RNA, 21 nt, Pseudomonas aeruginosa PA01
cagucggcaccgaucgcccgc

SEQ ID NO: 1472272 - RNA, 17 nt, Pseudomonas aeruginosa PA01
cagucgcuuccgcgcgg

SEQ ID NO: 1472273 - RNA, 16 nt, Pseudomonas aeruginosa PA01
cagucggccaggcgcc

SEQ ID NO: 1472274 - RNA, 18 nt, Pseudomonas aeruginosa PA01
cagucggccaggcgccag

SEQ ID NO: 1472275 - RNA, 20 nt, Pseudomonas aeruginosa PA01
cagucggccaggcgccaggu

SEQ ID NO: 1472276 - RNA, 19 nt, Pseudomonas aeruginosa PA01
cagucggcguccgccucgc

SEQ ID NO: 1472277 - RNA, 16 nt, Pseudomonas aeruginosa PA01
cagucggggcaggcgc

SEQ ID NO: 1472278 - RNA, 22 nt, Pseudomonas aeruginosa PA01
cagucggggcaggcgcaggcga

SEQ ID NO: 1472279 - RNA, 21 nt, Pseudomonas aeruginosa PA01
caguccucguacaugcgcgag

SEQ ID NO: 1472280 - RNA, 21 nt, Pseudomonas aeruginosa PA01
caguccuugagcgccagcagg

SEQ ID NO: 1472281 - RNA, 17 nt, Pseudomonas aeruginosa PA01
cagucgagcaugucgcu

SEQ ID NO: 1472282 - RNA, 18 nt, Pseudomonas aeruginosa PA01
cagucgagacgccagccg

SEQ ID NO: 1472283 - RNA, 19 nt, Pseudomonas aeruginosa PA01
cagucgagacgccagccgc

SEQ ID NO: 1472284 - RNA, 17 nt, Pseudomonas aeruginosa PA01
cagucaggaucggcgcc

SEQ ID NO: 1472285 - RNA, 14 nt, Pseudomonas aeruginosa PA01
cagucaccaggucg

SEQ ID NO: 1472286 - RNA, 15 nt, Pseudomonas aeruginosa PA01
cagucaccaggucgc

SEQ ID NO: 1472287 - RNA, 22 nt, Pseudomonas aeruginosa PA01
caguagggggugaagcgcaggc

SEQ ID NO: 1472288 - RNA, 23 nt, Pseudomonas aeruginosa PA01
caguagcucgccgagguugcugc

SEQ ID NO: 1472289 - RNA, 15 nt, Pseudomonas aeruginosa PA01
caguaggccagcggc

SEQ ID NO: 1472290 - RNA, 14 nt, Pseudomonas aeruginosa PA01
cagguugcacggcc

SEQ ID NO: 1472291 - RNA, 16 nt, Pseudomonas aeruginosa PA01
cagguugcacggccgg

SEQ ID NO: 1472292 - RNA, 17 nt, Pseudomonas aeruginosa PA01
cagguugcacggccggu

SEQ ID NO: 1472293 - RNA, 14 nt, Pseudomonas aeruginosa PA01
cagguugcgcaacc

SEQ ID NO: 1472294 - RNA, 17 nt, Pseudomonas aeruginosa PA01
cagguugaagaacggcc

SEQ ID NO: 1472295 - RNA, 18 nt, Pseudomonas aeruginosa PA01
cagguugaagaacggccc

SEQ ID NO: 1472296 - RNA, 19 nt, Pseudomonas aeruginosa PA01
cagguugaagaacggcccg

SEQ ID NO: 1472297 - RNA, 20 nt, Pseudomonas aeruginosa PA01
cagguugauccugggcgcca

SEQ ID NO: 1472298 - RNA, 18 nt, Pseudomonas aeruginosa PA01
cagguugacgaugcggcc

SEQ ID NO: 1472299 - RNA, 21 nt, Pseudomonas aeruginosa PA01
cagguugacgaugcggcccgc

SEQ ID NO: 1472300 - RNA, 20 nt, Pseudomonas aeruginosa PA01
caggugcggcugggugucga

SEQ ID NO: 1472301 - RNA, 14 nt, Pseudomonas aeruginosa PA01
caggugcuugucac

SEQ ID NO: 1472302 - RNA, 22 nt, Pseudomonas aeruginosa PA01
caggugcuugucacgcucggca

SEQ ID NO: 1472303 - RNA, 16 nt, Pseudomonas aeruginosa PA01
caggugcuuggcaccg

SEQ ID NO: 1472304 - RNA, 16 nt, Pseudomonas aeruginosa PA01
cagguggaagcgcgcg

SEQ ID NO: 1472305 - RNA, 22 nt, Pseudomonas aeruginosa PA01
cagguggaagcgcgcgucggcg

SEQ ID NO: 1472306 - RNA, 23 nt, Pseudomonas aeruginosa PA01
cagguggaagcgcgcgucggcgg

SEQ ID NO: 1472307 - RNA, 12 nt, Pseudomonas aeruginosa PA01
caggugcggcug

SEQ ID NO: 1472308 - RNA, 12 nt, Pseudomonas aeruginosa PA01
caggugcgcugg

SEQ ID NO: 1472309 - RNA, 19 nt, Pseudomonas aeruginosa PA01
caggugcgcugguuggcga

SEQ ID NO: 1472310 - RNA, 22 nt, Pseudomonas aeruginosa PA01
caggugcgcugguuggcgaggu

SEQ ID NO: 1472311 - RNA, 18 nt, Pseudomonas aeruginosa PA01
caggugagggcgacccag

SEQ ID NO: 1472312 - RNA, 21 nt, Pseudomonas aeruginosa PA01
cagguucugccagagcgcugc

SEQ ID NO: 1472313 - RNA, 17 nt, Pseudomonas aeruginosa PA01
cagguucuggucgccga

SEQ ID NO: 1472314 - RNA, 16 nt, Pseudomonas aeruginosa PA01
cagguucggcagcgcc

SEQ ID NO: 1472315 - RNA, 17 nt, Pseudomonas aeruginosa PA01
cagguucggcagcgccu

SEQ ID NO: 1472316 - RNA, 21 nt, Pseudomonas aeruginosa PA01
cagguuccuccugggccgacg

SEQ ID NO: 1472317 - RNA, 20 nt, Pseudomonas aeruginosa PA01
cagguucaccgccucggaga

SEQ ID NO: 1472318 - RNA, 16 nt, Pseudomonas aeruginosa PA01
cagguggaucgcggcg

SEQ ID NO: 1472319 - RNA, 16 nt, Pseudomonas aeruginosa PA01
cagguguucggccccg

SEQ ID NO: 1472320 - RNA, 18 nt, Pseudomonas aeruginosa PA01
cagguguucggccccggc

SEQ ID NO: 1472321 - RNA, 16 nt, Pseudomonas aeruginosa PA01
cagguguucggcggcg

SEQ ID NO: 1472322 - RNA, 19 nt, Pseudomonas aeruginosa PA01
cagguguucggcggcgugc

SEQ ID NO: 1472323 - RNA, 13 nt, Pseudomonas aeruginosa PA01
caggucucgacgc

SEQ ID NO: 1472324 - RNA, 16 nt, Pseudomonas aeruginosa PA01
caggucggcggcacgc

SEQ ID NO: 1472325 - RNA, 22 nt, Pseudomonas aeruginosa PA01
caggucggcgggcaccgccagc

SEQ ID NO: 1472326 - RNA, 20 nt, Pseudomonas aeruginosa PA01
caggucuguggaggcgcaaa

SEQ ID NO: 1472327 - RNA, 18 nt, Pseudomonas aeruginosa PA01
caggucuugucgcggguc

SEQ ID NO: 1472328 - RNA, 13 nt, Pseudomonas aeruginosa PA01
caggucggccucg

SEQ ID NO: 1472329 - RNA, 16 nt, Pseudomonas aeruginosa PA01
caggucggccucggcg

SEQ ID NO: 1472330 - RNA, 14 nt, Pseudomonas aeruginosa PA01
caggucggcgccgg

SEQ ID NO: 1472331 - RNA, 15 nt, Pseudomonas aeruginosa PA01
caggucggcgccggu

SEQ ID NO: 1472332 - RNA, 12 nt, Pseudomonas aeruginosa PA01
caggucggcgcg

SEQ ID NO: 1472333 - RNA, 14 nt, Pseudomonas aeruginosa PA01
caggucggcgcgcg

SEQ ID NO: 1472334 - RNA, 14 nt, Pseudomonas aeruginosa PA01
caggucggccgccu

SEQ ID NO: 1472335 - RNA, 17 nt, Pseudomonas aeruginosa PA01
caggucggccgccucgg

SEQ ID NO: 1472336 - RNA, 12 nt, Pseudomonas aeruginosa PA01
caggucggccgg

SEQ ID NO: 1472337 - RNA, 17 nt, Pseudomonas aeruginosa PA01
caggucggccggcagcu

SEQ ID NO: 1472338 - RNA, 20 nt, Pseudomonas aeruginosa PA01
caggucggccggcagcuccg

SEQ ID NO: 1472339 - RNA, 19 nt, Pseudomonas aeruginosa PA01
caggucgcuguccuccagc

SEQ ID NO: 1472340 - RNA, 22 nt, Pseudomonas aeruginosa PA01
caggucgcuguccuccagcggc

SEQ ID NO: 1472341 - RNA, 13 nt, Pseudomonas aeruginosa PA01
caggucggacagg

SEQ ID NO: 1472342 - RNA, 23 nt, Pseudomonas aeruginosa PA01
caggucggacaggcauuccgggc

SEQ ID NO: 1472343 - RNA, 21 nt, Pseudomonas aeruginosa PA01
caggucgcgacugaccacgca

SEQ ID NO: 1472344 - RNA, 16 nt, Pseudomonas aeruginosa PA01
caggucgcgcagggcc

SEQ ID NO: 1472345 - RNA, 14 nt, Pseudomonas aeruginosa PA01
caggucgcgcggcg

SEQ ID NO: 1472346 - RNA, 14 nt, Pseudomonas aeruginosa PA01
caggucgcgcuggg

SEQ ID NO: 1472347 - RNA, 20 nt, Pseudomonas aeruginosa PA01
caggucgcggaacucgauga

SEQ ID NO: 1472348 - RNA, 16 nt, Pseudomonas aeruginosa PA01
caggucgcggagccaa

SEQ ID NO: 1472349 - RNA, 16 nt, Pseudomonas aeruginosa PA01
caggucgcggaucagg

SEQ ID NO: 1472350 - RNA, 17 nt, Pseudomonas aeruginosa PA01
caggucgcggccccagc

SEQ ID NO: 1472351 - RNA, 19 nt, Pseudomonas aeruginosa PA01
caggucgccaugcccgucg

SEQ ID NO: 1472352 - RNA, 20 nt, Pseudomonas aeruginosa PA01
caggucgccaugcccgucga

SEQ ID NO: 1472353 - RNA, 19 nt, Pseudomonas aeruginosa PA01
caggucgccagcgccuucg

SEQ ID NO: 1472354 - RNA, 16 nt, Pseudomonas aeruginosa PA01
caggucgccgccgccg

SEQ ID NO: 1472355 - RNA, 17 nt, Pseudomonas aeruginosa PA01
caggucgccgccgccgg

SEQ ID NO: 1472356 - RNA, 22 nt, Pseudomonas aeruginosa PA01
cauccccccgcgaagcgacggc

SEQ ID NO: 1472357 - RNA, 21 nt, Pseudomonas aeruginosa PA01
cauccccgccucgaccagcgc

SEQ ID NO: 1472358 - RNA, 23 nt, Pseudomonas aeruginosa PA01
cauccccgccucgaccagcgccg

SEQ ID NO: 1472359 - RNA, 14 nt, Pseudomonas aeruginosa PA01
cauccgcgccgacc

SEQ ID NO: 1472360 - RNA, 17 nt, Pseudomonas aeruginosa PA01
cauccgcgccgaccagc

SEQ ID NO: 1472361 - RNA, 15 nt, Pseudomonas aeruginosa PA01
cauccgcggccccgg

SEQ ID NO: 1472362 - RNA, 16 nt, Pseudomonas aeruginosa PA01
cauccgcggccccggc

SEQ ID NO: 1472363 - RNA, 19 nt, Pseudomonas aeruginosa PA01
cauccgcggccccggcguc

SEQ ID NO: 1472364 - RNA, 14 nt, Pseudomonas aeruginosa PA01
cauccgcguggcga

SEQ ID NO: 1472365 - RNA, 16 nt, Pseudomonas aeruginosa PA01
cauccgcucggcgagu

SEQ ID NO: 1472366 - RNA, 23 nt, Pseudomonas aeruginosa PA01
cauccgcugguagcccaggccga

SEQ ID NO: 1472367 - RNA, 17 nt, Pseudomonas aeruginosa PA01
cauccggaguucgcccg

SEQ ID NO: 1472368 - RNA, 21 nt, Pseudomonas aeruginosa PA01
cauccggaguucgcccgcccc

SEQ ID NO: 1472369 - RNA, 12 nt, Pseudomonas aeruginosa PA01
cauccucgccgc

SEQ ID NO: 1472370 - RNA, 17 nt, Pseudomonas aeruginosa PA01
cauccucgccgcuggcg

SEQ ID NO: 1472371 - RNA, 19 nt, Pseudomonas aeruginosa PA01
cauccucgccgcuggcgcu

SEQ ID NO: 1472372 - RNA, 17 nt, Pseudomonas aeruginosa PA01
cauccuccagcgccgca

SEQ ID NO: 1472373 - RNA, 18 nt, Pseudomonas aeruginosa PA01
cauccucccugcccgcuc

SEQ ID NO: 1472374 - RNA, 14 nt, Pseudomonas aeruginosa PA01
cauccuggccgguc

SEQ ID NO: 1472375 - RNA, 20 nt, Pseudomonas aeruginosa PA01
cauccuggccggucguucgc

SEQ ID NO: 1472376 - RNA, 20 nt, Pseudomonas aeruginosa PA01
cauccugaaaagcgcugcgg

SEQ ID NO: 1472377 - RNA, 15 nt, Pseudomonas aeruginosa PA01
caucgaaaucgccca

SEQ ID NO: 1472378 - RNA, 17 nt, Pseudomonas aeruginosa PA01
caucgaaggcgccggca

SEQ ID NO: 1472379 - RNA, 19 nt, Pseudomonas aeruginosa PA01
caucgaaggcgccggcaug

SEQ ID NO: 1472380 - RNA, 23 nt, Pseudomonas aeruginosa PA01
caucgacaccccggucaggccga

SEQ ID NO: 1472381 - RNA, 18 nt, Pseudomonas aeruginosa PA01
caucagcuccacgucggc

SEQ ID NO: 1472382 - RNA, 20 nt, Pseudomonas aeruginosa PA01
caucagcuccacgucggccc

SEQ ID NO: 1472383 - RNA, 22 nt, Pseudomonas aeruginosa PA01
caucagcuccacgucggcccgg

SEQ ID NO: 1472384 - RNA, 22 nt, Pseudomonas aeruginosa PA01
caucaggaucagguugaagagc

SEQ ID NO: 1472385 - RNA, 16 nt, Pseudomonas aeruginosa PA01
cauccagccugcgcug

SEQ ID NO: 1472386 - RNA, 17 nt, Pseudomonas aeruginosa PA01
cauccagcauccgugcg

SEQ ID NO: 1472387 - RNA, 12 nt, Pseudomonas aeruginosa PA01
cauccagccccc

SEQ ID NO: 1472388 - RNA, 16 nt, Pseudomonas aeruginosa PA01
cauccaggacaccccg

SEQ ID NO: 1472389 - RNA, 14 nt, Pseudomonas aeruginosa PA01
cauccagucggcgc

SEQ ID NO: 1472390 - RNA, 20 nt, Pseudomonas aeruginosa PA01
cauccagucuucgccggccu

SEQ ID NO: 1472391 - RNA, 20 nt, Pseudomonas aeruginosa PA01
cauccaguuccugcaccacg

SEQ ID NO: 1472392 - RNA, 18 nt, Pseudomonas aeruginosa PA01
caucagcaauuccgcagc

SEQ ID NO: 1472393 - RNA, 19 nt, Pseudomonas aeruginosa PA01
caucagcaauuccgcagcc

SEQ ID NO: 1472394 - RNA, 22 nt, Pseudomonas aeruginosa PA01
caucagcacgucguccagcgcc

SEQ ID NO: 1472395 - RNA, 16 nt, Pseudomonas aeruginosa PA01
caucagcaguccgcca

SEQ ID NO: 1472396 - RNA, 16 nt, Pseudomonas aeruginosa PA01
caucagcagcgccagc

SEQ ID NO: 1472397 - RNA, 14 nt, Pseudomonas aeruginosa PA01
caucagccccucgg

SEQ ID NO: 1472398 - RNA, 19 nt, Pseudomonas aeruginosa PA01
caucagccccucggccagg

SEQ ID NO: 1472399 - RNA, 13 nt, Pseudomonas aeruginosa PA01
caucagcgccgcc

SEQ ID NO: 1472400 - RNA, 23 nt, Pseudomonas aeruginosa PA01
caucagcgaccaguugcucgcuc

SEQ ID NO: 1472401 - RNA, 20 nt, Pseudomonas aeruginosa PA01
caucacgcuuuccggcuuga

SEQ ID NO: 1472402 - RNA, 14 nt, Pseudomonas aeruginosa PA01
caucaccggcggga

SEQ ID NO: 1472403 - RNA, 16 nt, Pseudomonas aeruginosa PA01
caucaccuucgccagc

SEQ ID NO: 1472404 - RNA, 17 nt, Pseudomonas aeruginosa PA01
caucaccuucgccagca

SEQ ID NO: 1472405 - RNA, 23 nt, Pseudomonas aeruginosa PA01
caucaccuucgccagcaggcuca

SEQ ID NO: 1472406 - RNA, 16 nt, Pseudomonas aeruginosa PA01
cauaggcccggcgugc

SEQ ID NO: 1472407 - RNA, 22 nt, Pseudomonas aeruginosa PA01
cauaggacugccaacuggcguc

SEQ ID NO: 1472408 - RNA, 20 nt, Pseudomonas aeruginosa PA01
cauaggccagcaccucgacg

SEQ ID NO: 1472409 - RNA, 13 nt, Pseudomonas aeruginosa PA01
cauagccaccgcc

SEQ ID NO: 1472410 - RNA, 24 nt, Pseudomonas aeruginosa PA01
cauagcaggccuggagcgccucga

SEQ ID NO: 1472411 - RNA, 20 nt, Pseudomonas aeruginosa PA01
cauagagugcccaggcgcug

SEQ ID NO: 1472412 - RNA, 13 nt, Pseudomonas aeruginosa PA01
cauagccggcgcg

SEQ ID NO: 1472413 - RNA, 16 nt, Pseudomonas aeruginosa PA01
cauagccggcgcgccc

SEQ ID NO: 1472414 - RNA, 14 nt, Pseudomonas aeruginosa PA01
cauagcgcagcacc

SEQ ID NO: 1472415 - RNA, 21 nt, Pseudomonas aeruginosa PA01
caucggccgggauacagcagc

SEQ ID NO: 1472416 - RNA, 23 nt, Pseudomonas aeruginosa PA01
caucggccgggauacagcagcca

SEQ ID NO: 1472417 - RNA, 16 nt, Pseudomonas aeruginosa PA01
caucggccccaccgca

SEQ ID NO: 1472418 - RNA, 15 nt, Pseudomonas aeruginosa PA01
caucggcccugggcg

SEQ ID NO: 1472419 - RNA, 23 nt, Pseudomonas aeruginosa PA01
caucggccgacagagcggccggc

SEQ ID NO: 1472420 - RNA, 15 nt, Pseudomonas aeruginosa PA01
caucggccgccaggc

SEQ ID NO: 1472421 - RNA, 23 nt, Pseudomonas aeruginosa PA01
caucggccaguccggucagcagc

SEQ ID NO: 1472422 - RNA, 22 nt, Pseudomonas aeruginosa PA01
caucggccauucggccuggcag

SEQ ID NO: 1472423 - RNA, 20 nt, Pseudomonas aeruginosa PA01
caucggccaccuucgcccgc

SEQ ID NO: 1472424 - RNA, 20 nt, Pseudomonas aeruginosa PA01
caucggccacuaucgccaac

SEQ ID NO: 1472425 - RNA, 23 nt, Pseudomonas aeruginosa PA01
caucggccacuaucgccaacgcc

SEQ ID NO: 1472426 - RNA, 15 nt, Pseudomonas aeruginosa PA01
caucgcugaccucga

SEQ ID NO: 1472427 - RNA, 23 nt, Pseudomonas aeruginosa PA01
caucgcuuucaggcgcucgucga

SEQ ID NO: 1472428 - RNA, 16 nt, Pseudomonas aeruginosa PA01
caucgcguagggcgca

SEQ ID NO: 1472429 - RNA, 23 nt, Pseudomonas aeruginosa PA01
caucgcguagguggcgccgccgg

SEQ ID NO: 1472430 - RNA, 13 nt, Pseudomonas aeruginosa PA01
caucgcgucgccg

SEQ ID NO: 1472431 - RNA, 14 nt, Pseudomonas aeruginosa PA01
caucgcgucgccga

SEQ ID NO: 1472432 - RNA, 16 nt, Pseudomonas aeruginosa PA01
caucgcgucgccgaac

SEQ ID NO: 1472433 - RNA, 17 nt, Pseudomonas aeruginosa PA01
caucggagugcaugccg

SEQ ID NO: 1472434 - RNA, 17 nt, Pseudomonas aeruginosa PA01
caucggacgccguagcg

SEQ ID NO: 1472435 - RNA, 17 nt, Pseudomonas aeruginosa PA01
caucgcuuuccuggccg

SEQ ID NO: 1472436 - RNA, 22 nt, Pseudomonas aeruginosa PA01
caucgcuuuccuggccgacccg

SEQ ID NO: 1472437 - RNA, 22 nt, Pseudomonas aeruginosa PA01
caucgccggcgagccgcuggca

SEQ ID NO: 1472438 - RNA, 14 nt, Pseudomonas aeruginosa PA01
caucgccucgcgga

SEQ ID NO: 1472439 - RNA, 16 nt, Pseudomonas aeruginosa PA01
caucgccucgcggacc

SEQ ID NO: 1472440 - RNA, 19 nt, Pseudomonas aeruginosa PA01
caucgcgaaaacucccggc

SEQ ID NO: 1472441 - RNA, 21 nt, Pseudomonas aeruginosa PA01
caucgcgaaaacucccggccu

SEQ ID NO: 1472442 - RNA, 22 nt, Pseudomonas aeruginosa PA01
caucgcgaaaacucccggccug

SEQ ID NO: 1472443 - RNA, 21 nt, Pseudomonas aeruginosa PA01
caucgccugggccggcguaug

SEQ ID NO: 1472444 - RNA, 17 nt, Pseudomonas aeruginosa PA01
caucgcgaucuaccugc

SEQ ID NO: 1472445 - RNA, 22 nt, Pseudomonas aeruginosa PA01
caucgcgaucuaccugcgugcg

SEQ ID NO: 1472446 - RNA, 19 nt, Pseudomonas aeruginosa PA01
caucgcgcacaugccgagc

SEQ ID NO: 1472447 - RNA, 13 nt, Pseudomonas aeruginosa PA01
caucgcgccgccg

SEQ ID NO: 1472448 - RNA, 20 nt, Pseudomonas aeruginosa PA01
caucgcgccaaugccgucga

SEQ ID NO: 1472449 - RNA, 20 nt, Pseudomonas aeruginosa PA01
caucgcgggcgugcuccagc

SEQ ID NO: 1472450 - RNA, 17 nt, Pseudomonas aeruginosa PA01
caucgcgguuauccgcc

SEQ ID NO: 1472451 - RNA, 18 nt, Pseudomonas aeruginosa PA01
caucgcgguuauccgccg

SEQ ID NO: 1472452 - RNA, 21 nt, Pseudomonas aeruginosa PA01
caucgcgguuauccgccggcu

SEQ ID NO: 1472453 - RNA, 16 nt, Pseudomonas aeruginosa PA01
caucgcggacaccgcg

SEQ ID NO: 1472454 - RNA, 17 nt, Pseudomonas aeruginosa PA01
caucgcggacaccgcgg

SEQ ID NO: 1472455 - RNA, 13 nt, Pseudomonas aeruginosa PA01
caucgcggcgaug

SEQ ID NO: 1472456 - RNA, 16 nt, Pseudomonas aeruginosa PA01
caucgcggcgauggcc

SEQ ID NO: 1472457 - RNA, 16 nt, Pseudomonas aeruginosa PA01
caucgccggcagcgcc

SEQ ID NO: 1472458 - RNA, 17 nt, Pseudomonas aeruginosa PA01
caucgccggcagcgccg

SEQ ID NO: 1472459 - RNA, 15 nt, Pseudomonas aeruginosa PA01
caucgccggcccgcg

SEQ ID NO: 1472460 - RNA, 23 nt, Pseudomonas aeruginosa PA01
caucgccgcggcgaagcgcucga

SEQ ID NO: 1472461 - RNA, 23 nt, Pseudomonas aeruginosa PA01
caucgccgcggaaaacgccgcga

SEQ ID NO: 1472462 - RNA, 18 nt, Pseudomonas aeruginosa PA01
caucgccgucucguagac

SEQ ID NO: 1472463 - RNA, 19 nt, Pseudomonas aeruginosa PA01
caucgcccauugccgggcu

SEQ ID NO: 1472464 - RNA, 21 nt, Pseudomonas aeruginosa PA01
caucgcccggcagcaggccgc

SEQ ID NO: 1472465 - RNA, 15 nt, Pseudomonas aeruginosa PA01
caucgccgccaggca

SEQ ID NO: 1472466 - RNA, 17 nt, Pseudomonas aeruginosa PA01
caucgccaguugcaggg

SEQ ID NO: 1472467 - RNA, 13 nt, Pseudomonas aeruginosa PA01
caucgcccgcagc

SEQ ID NO: 1472468 - RNA, 17 nt, Pseudomonas aeruginosa PA01
caucgcccgcagccaca

SEQ ID NO: 1472469 - RNA, 24 nt, Pseudomonas aeruginosa PA01
caucgcccgcagccacaggcgcca

SEQ ID NO: 1472470 - RNA, 19 nt, Pseudomonas aeruginosa PA01
caucgcccgcccucgucgc

SEQ ID NO: 1472471 - RNA, 19 nt, Pseudomonas aeruginosa PA01
caucgccaccagcaggaag

SEQ ID NO: 1472472 - RNA, 13 nt, Pseudomonas aeruginosa PA01
caucgccaccgcg

SEQ ID NO: 1472473 - RNA, 23 nt, Pseudomonas aeruginosa PA01
caucgccaccgguacgcucacca

SEQ ID NO: 1472474 - RNA, 20 nt, Pseudomonas aeruginosa PA01
caucgagcaguuccaggcgu

SEQ ID NO: 1472475 - RNA, 20 nt, Pseudomonas aeruginosa PA01
caucgagcgcuccaccgcgc

SEQ ID NO: 1472476 - RNA, 15 nt, Pseudomonas aeruginosa PA01
caucgagcggcggcc

SEQ ID NO: 1472477 - RNA, 19 nt, Pseudomonas aeruginosa PA01
caucgagcggcggccgucg

SEQ ID NO: 1472478 - RNA, 21 nt, Pseudomonas aeruginosa PA01
caucgagcggcggccgucgcu

SEQ ID NO: 1472479 - RNA, 13 nt, Pseudomonas aeruginosa PA01
caucgacgccagc

SEQ ID NO: 1472480 - RNA, 15 nt, Pseudomonas aeruginosa PA01
caucgacgcccucgg

SEQ ID NO: 1472481 - RNA, 21 nt, Pseudomonas aeruginosa PA01
caucgacgauguacugcucgg

SEQ ID NO: 1472482 - RNA, 12 nt, Pseudomonas aeruginosa PA01
caucgacgccag

SEQ ID NO: 1472483 - RNA, 23 nt, Pseudomonas aeruginosa PA01
caucgaccaggaauuccuggccg

SEQ ID NO: 1472484 - RNA, 16 nt, Pseudomonas aeruginosa PA01
caucgaccaggucgcc

SEQ ID NO: 1472485 - RNA, 21 nt, Pseudomonas aeruginosa PA01
caucgaccuugcccucggcgc

SEQ ID NO: 1472486 - RNA, 22 nt, Pseudomonas aeruginosa PA01
caucgaccuugcccucggcgcc

SEQ ID NO: 1472487 - RNA, 23 nt, Pseudomonas aeruginosa PA01
caucgaccuugcccucggcgccc

SEQ ID NO: 1472488 - RNA, 20 nt, Pseudomonas aeruginosa PA01
caucgauggucacuggcgag

SEQ ID NO: 1472489 - RNA, 15 nt, Pseudomonas aeruginosa PA01
caucgaugaccuucg

SEQ ID NO: 1472490 - RNA, 16 nt, Pseudomonas aeruginosa PA01
caucgcauagccggcg

SEQ ID NO: 1472491 - RNA, 14 nt, Pseudomonas aeruginosa PA01
caucgcaggcagcg

SEQ ID NO: 1472492 - RNA, 22 nt, Pseudomonas aeruginosa PA01
caucgaggccaggccgagcgcc

SEQ ID NO: 1472493 - RNA, 18 nt, Pseudomonas aeruginosa PA01
caucgaggccauccccga

SEQ ID NO: 1472494 - RNA, 16 nt, Pseudomonas aeruginosa PA01
caucgaggccgcccag

SEQ ID NO: 1472495 - RNA, 19 nt, Pseudomonas aeruginosa PA01
caucgaggccgcccagcgc

SEQ ID NO: 1472496 - RNA, 21 nt, Pseudomonas aeruginosa PA01
caucgaggccgcccagcgcag

SEQ ID NO: 1472497 - RNA, 18 nt, Pseudomonas aeruginosa PA01
caucgauaacaccaggag

SEQ ID NO: 1472498 - RNA, 23 nt, Pseudomonas aeruginosa PA01
caucgauaacaccaggagcgcca

SEQ ID NO: 1472499 - RNA, 16 nt, Pseudomonas aeruginosa PA01
caucgaucagcagcgc

SEQ ID NO: 1472500 - RNA, 18 nt, Pseudomonas aeruginosa PA01
cagcacguagccgcccuu

SEQ ID NO: 1472501 - RNA, 15 nt, Pseudomonas aeruginosa PA01
cagcacgucuugcag

SEQ ID NO: 1472502 - RNA, 20 nt, Pseudomonas aeruginosa PA01
cagcacggugaaccaggcgc

SEQ ID NO: 1472503 - RNA, 22 nt, Pseudomonas aeruginosa PA01
cagcacggugaaccaggcgccg

SEQ ID NO: 1472504 - RNA, 23 nt, Pseudomonas aeruginosa PA01
cagcacggcgcggguguccucga

SEQ ID NO: 1472505 - RNA, 13 nt, Pseudomonas aeruginosa PA01
cagcacggcggcu

SEQ ID NO: 1472506 - RNA, 16 nt, Pseudomonas aeruginosa PA01
cagcaagccgcagcgc

SEQ ID NO: 1472507 - RNA, 19 nt, Pseudomonas aeruginosa PA01
cagcaacccaugccgcaag

SEQ ID NO: 1472508 - RNA, 22 nt, Pseudomonas aeruginosa PA01
cagcaaggcgucauagcagcgc

SEQ ID NO: 1472509 - RNA, 23 nt, Pseudomonas aeruginosa PA01
cagcaagucgaacaggcccuuga

SEQ ID NO: 1472510 - RNA, 15 nt, Pseudomonas aeruginosa PA01
cagcagcccggccug

SEQ ID NO: 1472511 - RNA, 13 nt, Pseudomonas aeruginosa PA01
cagcagcccggcc

SEQ ID NO: 1472512 - RNA, 12 nt, Pseudomonas aeruginosa PA01
cagcagccccga

SEQ ID NO: 1472513 - RNA, 22 nt, Pseudomonas aeruginosa PA01
cagcagccccgaggccagcagg

SEQ ID NO: 1472514 - RNA, 12 nt, Pseudomonas aeruginosa PA01
cagcagccaggc

SEQ ID NO: 1472515 - RNA, 13 nt, Pseudomonas aeruginosa PA01
cagcagccaggcc

SEQ ID NO: 1472516 - RNA, 16 nt, Pseudomonas aeruginosa PA01
cagcagcaccgcgagc

SEQ ID NO: 1472517 - RNA, 16 nt, Pseudomonas aeruginosa PA01
cagcagcaccgcgcgc

SEQ ID NO: 1472518 - RNA, 20 nt, Pseudomonas aeruginosa PA01
cagcagcaacagcgccgcgc

SEQ ID NO: 1472519 - RNA, 21 nt, Pseudomonas aeruginosa PA01
cagcacuuccugaaggcgcgg

SEQ ID NO: 1472520 - RNA, 14 nt, Pseudomonas aeruginosa PA01
cagcagcaagccga

SEQ ID NO: 1472521 - RNA, 13 nt, Pseudomonas aeruginosa PA01
cagcagcaccgcg

SEQ ID NO: 1472522 - RNA, 18 nt, Pseudomonas aeruginosa PA01
cagcagcaccaucagcca

SEQ ID NO: 1472523 - RNA, 23 nt, Pseudomonas aeruginosa PA01
cagcagcaccaucagccagccca

SEQ ID NO: 1472524 - RNA, 14 nt, Pseudomonas aeruginosa PA01
cagcacuucggcgc

SEQ ID NO: 1472525 - RNA, 17 nt, Pseudomonas aeruginosa PA01
cagcacuucggcgcgcg

SEQ ID NO: 1472526 - RNA, 20 nt, Pseudomonas aeruginosa PA01
cagcacuucggcgcgcggca

SEQ ID NO: 1472527 - RNA, 23 nt, Pseudomonas aeruginosa PA01
cagcacuacgcccauggcgguga

SEQ ID NO: 1472528 - RNA, 20 nt, Pseudomonas aeruginosa PA01
cagcacguugccauccagcg

SEQ ID NO: 1472529 - RNA, 22 nt, Pseudomonas aeruginosa PA01
cagcacguugccauccagcgcc

SEQ ID NO: 1472530 - RNA, 17 nt, Pseudomonas aeruginosa PA01
cagcagucgcagcucgg

SEQ ID NO: 1472531 - RNA, 15 nt, Pseudomonas aeruginosa PA01
cagcagucgcggccc

SEQ ID NO: 1472532 - RNA, 16 nt, Pseudomonas aeruginosa PA01
cagcagucgcggcccu

SEQ ID NO: 1472533 - RNA, 14 nt, Pseudomonas aeruginosa PA01
cagcagugcggggc

SEQ ID NO: 1472534 - RNA, 20 nt, Pseudomonas aeruginosa PA01
cagcagugcggggcgcucgc

SEQ ID NO: 1472535 - RNA, 21 nt, Pseudomonas aeruginosa PA01
cagcagguugaccccgcggcc

SEQ ID NO: 1472536 - RNA, 15 nt, Pseudomonas aeruginosa PA01
cagcagguugcuggc

SEQ ID NO: 1472537 - RNA, 23 nt, Pseudomonas aeruginosa PA01
cagcagguggcuggucaguucgg

SEQ ID NO: 1472538 - RNA, 16 nt, Pseudomonas aeruginosa PA01
cagcagguggucgaug

SEQ ID NO: 1472539 - RNA, 23 nt, Pseudomonas aeruginosa PA01
cagcagguucgaaugcugcccgg

SEQ ID NO: 1472540 - RNA, 15 nt, Pseudomonas aeruginosa PA01
cagcaggucucaccg

SEQ ID NO: 1472541 - RNA, 17 nt, Pseudomonas aeruginosa PA01
cagcaggucucaccgcc

SEQ ID NO: 1472542 - RNA, 19 nt, Pseudomonas aeruginosa PA01
cagcaggucuuccaccgcg

SEQ ID NO: 1472543 - RNA, 14 nt, Pseudomonas aeruginosa PA01
cagcaggucggcgc

SEQ ID NO: 1472544 - RNA, 15 nt, Pseudomonas aeruginosa PA01
cagcaggucggcgcg

SEQ ID NO: 1472545 - RNA, 16 nt, Pseudomonas aeruginosa PA01
cagcaggucggcgcga

SEQ ID NO: 1472546 - RNA, 21 nt, Pseudomonas aeruginosa PA01
cagcaggucggcgcgacggcc

SEQ ID NO: 1472547 - RNA, 19 nt, Pseudomonas aeruginosa PA01
cagcagguagccagggguc

SEQ ID NO: 1472548 - RNA, 15 nt, Pseudomonas aeruginosa PA01
cagcagguagccugc

SEQ ID NO: 1472549 - RNA, 17 nt, Pseudomonas aeruginosa PA01
cagcagguagugcucgg

SEQ ID NO: 1472550 - RNA, 22 nt, Pseudomonas aeruginosa PA01
cagcagguagugcucggccagu

SEQ ID NO: 1472551 - RNA, 18 nt, Pseudomonas aeruginosa PA01
cagcaggucgagggcguc

SEQ ID NO: 1472552 - RNA, 14 nt, Pseudomonas aeruginosa PA01
cagcaggucgaggu

SEQ ID NO: 1472553 - RNA, 16 nt, Pseudomonas aeruginosa PA01
cagcaggucgcggccc

SEQ ID NO: 1472554 - RNA, 21 nt, Pseudomonas aeruginosa PA01
cagcaggucgcggccccagca

SEQ ID NO: 1472555 - RNA, 16 nt, Pseudomonas aeruginosa PA01
cagcaggucgcggugc

SEQ ID NO: 1472556 - RNA, 18 nt, Pseudomonas aeruginosa PA01
cagcaggucggcagcguc

SEQ ID NO: 1472557 - RNA, 22 nt, Pseudomonas aeruginosa PA01
cagcaggucggcagcgucgagc

SEQ ID NO: 1472558 - RNA, 15 nt, Pseudomonas aeruginosa PA01
cagcaggucggccug

SEQ ID NO: 1472559 - RNA, 17 nt, Pseudomonas aeruginosa PA01
cagcaggucgucggcga

SEQ ID NO: 1472560 - RNA, 18 nt, Pseudomonas aeruginosa PA01
cagcaggucgucggcgaa

SEQ ID NO: 1472561 - RNA, 20 nt, Pseudomonas aeruginosa PA01
cagcaggucgucggcgaaag

SEQ ID NO: 1472562 - RNA, 22 nt, Pseudomonas aeruginosa PA01
cagcagggucuucaggcgccgu

SEQ ID NO: 1472563 - RNA, 14 nt, Pseudomonas aeruginosa PA01
cagcaggguggcca

SEQ ID NO: 1472564 - RNA, 18 nt, Pseudomonas aeruginosa PA01
cagcagguagacgcaggu

SEQ ID NO: 1472565 - RNA, 20 nt, Pseudomonas aeruginosa PA01
cagcagguagacgcaggugc

SEQ ID NO: 1472566 - RNA, 17 nt, Pseudomonas aeruginosa PA01
cagcagguacagcagcu

SEQ ID NO: 1472567 - RNA, 15 nt, Pseudomonas aeruginosa PA01
cagcagguagaagaa

SEQ ID NO: 1472568 - RNA, 19 nt, Pseudomonas aeruginosa PA01
cagcaggguaccgcuggcg

SEQ ID NO: 1472569 - RNA, 16 nt, Pseudomonas aeruginosa PA01
cagcagggucagcagc

SEQ ID NO: 1472570 - RNA, 19 nt, Pseudomonas aeruginosa PA01
cagcagggucagcagcgcc

SEQ ID NO: 1472571 - RNA, 15 nt, Pseudomonas aeruginosa PA01
cagcagggucgccug

SEQ ID NO: 1472572 - RNA, 17 nt, Pseudomonas aeruginosa PA01
cagcagggucgccuggg

SEQ ID NO: 1472573 - RNA, 16 nt, Pseudomonas aeruginosa PA01
cagcagggucgcgccg

SEQ ID NO: 1472574 - RNA, 22 nt, Pseudomonas aeruginosa PA01
cagcagggcguaggcgucgcga

SEQ ID NO: 1472575 - RNA, 12 nt, Pseudomonas aeruginosa PA01
cagcagggcguc

SEQ ID NO: 1472576 - RNA, 14 nt, Pseudomonas aeruginosa PA01
cagcagggcgucgg

SEQ ID NO: 1472577 - RNA, 15 nt, Pseudomonas aeruginosa PA01
cagcagggcgucggc

SEQ ID NO: 1472578 - RNA, 18 nt, Pseudomonas aeruginosa PA01
cagcagggcgucggcgug

SEQ ID NO: 1472579 - RNA, 13 nt, Pseudomonas aeruginosa PA01
cagcagcgaacgc

SEQ ID NO: 1472580 - RNA, 22 nt, Pseudomonas aeruginosa PA01
cagcagcggcggcgccggcagg

SEQ ID NO: 1472581 - RNA, 21 nt, Pseudomonas aeruginosa PA01
cagcagcggcgacaccgccag

SEQ ID NO: 1472582 - RNA, 22 nt, Pseudomonas aeruginosa PA01
cagcagcggcgacaccgccagc

SEQ ID NO: 1472583 - RNA, 14 nt, Pseudomonas aeruginosa PA01
cagcagcggcagga

SEQ ID NO: 1472584 - RNA, 17 nt, Pseudomonas aeruginosa PA01
cagcagcggcaccagca

SEQ ID NO: 1472585 - RNA, 13 nt, Pseudomonas aeruginosa PA01
cagcagcggcagc

SEQ ID NO: 1472586 - RNA, 22 nt, Pseudomonas aeruginosa PA01
cagcagcgggcguccggcgagc

SEQ ID NO: 1472587 - RNA, 13 nt, Pseudomonas aeruginosa PA01
cagcaggccgaag

SEQ ID NO: 1472588 - RNA, 12 nt, Pseudomonas aeruginosa PA01
cagcaggccgag

SEQ ID NO: 1472589 - RNA, 23 nt, Pseudomonas aeruginosa PA01
cagcaggccgaucaccagcgcca

SEQ ID NO: 1472590 - RNA, 20 nt, Pseudomonas aeruginosa PA01
cagcaggccgaucagcggcg

SEQ ID NO: 1472591 - RNA, 14 nt, Pseudomonas aeruginosa PA01
cagcaggccgcugg

SEQ ID NO: 1472592 - RNA, 21 nt, Pseudomonas aeruginosa PA01
cagcaggccgugggccggcgc

SEQ ID NO: 1472593 - RNA, 20 nt, Pseudomonas aeruginosa PA01
cagcaggcugcugcugcggc

SEQ ID NO: 1472594 - RNA, 14 nt, Pseudomonas aeruginosa PA01
cagcaggcuggcgg

SEQ ID NO: 1472595 - RNA, 13 nt, Pseudomonas aeruginosa PA01
cagcagggaggcg

SEQ ID NO: 1472596 - RNA, 17 nt, Pseudomonas aeruginosa PA01
cagcagggaggcgcaca

SEQ ID NO: 1472597 - RNA, 21 nt, Pseudomonas aeruginosa PA01
cagcagggaggcgcacaucac

SEQ ID NO: 1472598 - RNA, 19 nt, Pseudomonas aeruginosa PA01
cagcagggccaggccgagc

SEQ ID NO: 1472599 - RNA, 15 nt, Pseudomonas aeruginosa PA01
cagcagggccgccga

SEQ ID NO: 1472600 - RNA, 18 nt, Pseudomonas aeruginosa PA01
cagcagggccgccgaggu

SEQ ID NO: 1472601 - RNA, 14 nt, Pseudomonas aeruginosa PA01
cagcagggccagcc

SEQ ID NO: 1472602 - RNA, 16 nt, Pseudomonas aeruginosa PA01
cagcagggccagccag

SEQ ID NO: 1472603 - RNA, 17 nt, Pseudomonas aeruginosa PA01
cagcagggccagccaga

SEQ ID NO: 1472604 - RNA, 17 nt, Pseudomonas aeruginosa PA01
cagcagggccagcgccu

SEQ ID NO: 1472605 - RNA, 19 nt, Pseudomonas aeruginosa PA01
cagcagggccagcgccugg

SEQ ID NO: 1472606 - RNA, 21 nt, Pseudomonas aeruginosa PA01
cagcagggccagcgccuggcg

SEQ ID NO: 1472607 - RNA, 13 nt, Pseudomonas aeruginosa PA01
cagcagggccagg

SEQ ID NO: 1472608 - RNA, 17 nt, Pseudomonas aeruginosa PA01
cagcaggcucuuggucg

SEQ ID NO: 1472609 - RNA, 14 nt, Pseudomonas aeruginosa PA01
cagcaggcugccgu

SEQ ID NO: 1472610 - RNA, 15 nt, Pseudomonas aeruginosa PA01
cagcaggcucaucgc

SEQ ID NO: 1472611 - RNA, 16 nt, Pseudomonas aeruginosa PA01
cagcaggcucaucgcc

SEQ ID NO: 1472612 - RNA, 13 nt, Pseudomonas aeruginosa PA01
cagcaggcgcucg

SEQ ID NO: 1472613 - RNA, 14 nt, Pseudomonas aeruginosa PA01
cagcaggcgcucgc

SEQ ID NO: 1472614 - RNA, 18 nt, Pseudomonas aeruginosa PA01
cagcaggcgcucggcgac

SEQ ID NO: 1472615 - RNA, 11 nt, Pseudomonas aeruginosa PA01
cagcaggcgau

SEQ ID NO: 1472616 - RNA, 22 nt, Pseudomonas aeruginosa PA01
cagcaggcgcaaccagaccagc

SEQ ID NO: 1472617 - RNA, 24 nt, Pseudomonas aeruginosa PA01
cagcaggcgacggucaggccgagc

SEQ ID NO: 1472618 - RNA, 16 nt, Pseudomonas aeruginosa PA01
cagcaggccggccagc

SEQ ID NO: 1472619 - RNA, 18 nt, Pseudomonas aeruginosa PA01
cagcaggcgcagcagcga

SEQ ID NO: 1472620 - RNA, 14 nt, Pseudomonas aeruginosa PA01
cagcaggcgcaggu

SEQ ID NO: 1472621 - RNA, 16 nt, Pseudomonas aeruginosa PA01
cagcaggcgccgcgca

SEQ ID NO: 1472622 - RNA, 13 nt, Pseudomonas aeruginosa PA01
cagcaggcgccgg

SEQ ID NO: 1472623 - RNA, 14 nt, Pseudomonas aeruginosa PA01
cagcaggcgccggc

SEQ ID NO: 1472624 - RNA, 16 nt, Pseudomonas aeruginosa PA01
cagcaggcgccggcgg

SEQ ID NO: 1472625 - RNA, 23 nt, Pseudomonas aeruginosa PA01
cagcaggcgccggcggaucagcc

SEQ ID NO: 1472626 - RNA, 18 nt, Pseudomonas aeruginosa PA01
cagcccgcgccgcgaggg

SEQ ID NO: 1472627 - RNA, 16 nt, Pseudomonas aeruginosa PA01
cagcccgcgcgacagc

SEQ ID NO: 1472628 - RNA, 22 nt, Pseudomonas aeruginosa PA01
cagcccgcgcgacagcucuggg

SEQ ID NO: 1472629 - RNA, 17 nt, Pseudomonas aeruginosa PA01
cagcccgcgcucggccg

SEQ ID NO: 1472630 - RNA, 18 nt, Pseudomonas aeruginosa PA01
cagcccgcgcucggccgc

SEQ ID NO: 1472631 - RNA, 24 nt, Pseudomonas aeruginosa PA01
cagcccgcgcucggccgccuggcg

SEQ ID NO: 1472632 - RNA, 12 nt, Pseudomonas aeruginosa PA01
cagcccggagcc

SEQ ID NO: 1472633 - RNA, 12 nt, Pseudomonas aeruginosa PA01
cagcccggcacc

SEQ ID NO: 1472634 - RNA, 16 nt, Pseudomonas aeruginosa PA01
cagcccggcaccaggc

SEQ ID NO: 1472635 - RNA, 19 nt, Pseudomonas aeruginosa PA01
cagcccggcaccaggccga

SEQ ID NO: 1472636 - RNA, 14 nt, Pseudomonas aeruginosa PA01
cagcccggccaucc

SEQ ID NO: 1472637 - RNA, 16 nt, Pseudomonas aeruginosa PA01
cagcccuucgcgcucg

SEQ ID NO: 1472638 - RNA, 17 nt, Pseudomonas aeruginosa PA01
cagcccuucgcgcucga

SEQ ID NO: 1472639 - RNA, 21 nt, Pseudomonas aeruginosa PA01
cagcccuugcaaccgccgccg

SEQ ID NO: 1472640 - RNA, 16 nt, Pseudomonas aeruginosa PA01
cagccgaacaguucgg

SEQ ID NO: 1472641 - RNA, 18 nt, Pseudomonas aeruginosa PA01
cagcccuuucagcggcug

SEQ ID NO: 1472642 - RNA, 21 nt, Pseudomonas aeruginosa PA01
cagcccuuucagcggcugccc

SEQ ID NO: 1472643 - RNA, 19 nt, Pseudomonas aeruginosa PA01
cagcccuggcguggccggc

SEQ ID NO: 1472644 - RNA, 23 nt, Pseudomonas aeruginosa PA01
cagcccugguaggugcgcuggcg

SEQ ID NO: 1472645 - RNA, 15 nt, Pseudomonas aeruginosa PA01
cagccgaccaccuuc

SEQ ID NO: 1472646 - RNA, 19 nt, Pseudomonas aeruginosa PA01
cagccgaccaccuucaggc

SEQ ID NO: 1472647 - RNA, 19 nt, Pseudomonas aeruginosa PA01
cagccgagcaacucggcgg

SEQ ID NO: 1472648 - RNA, 20 nt, Pseudomonas aeruginosa PA01
cagccgagcaacucggcggc

SEQ ID NO: 1472649 - RNA, 23 nt, Pseudomonas aeruginosa PA01
cagccgagcaacucggcggcgag

SEQ ID NO: 1472650 - RNA, 20 nt, Pseudomonas aeruginosa PA01
cagccgacguagggcaucgc

SEQ ID NO: 1472651 - RNA, 14 nt, Pseudomonas aeruginosa PA01
cagccgacuggcgg

SEQ ID NO: 1472652 - RNA, 16 nt, Pseudomonas aeruginosa PA01
cagccgacuggcggua

SEQ ID NO: 1472653 - RNA, 23 nt, Pseudomonas aeruginosa PA01
cagccccuccuggaaagaccggc

SEQ ID NO: 1472654 - RNA, 14 nt, Pseudomonas aeruginosa PA01
cagccccucggcca

SEQ ID NO: 1472655 - RNA, 17 nt, Pseudomonas aeruginosa PA01
cagccccucggccagga

SEQ ID NO: 1472656 - RNA, 22 nt, Pseudomonas aeruginosa PA01
cagccccgcucgucauggcgca

SEQ ID NO: 1472657 - RNA, 19 nt, Pseudomonas aeruginosa PA01
cagccccuugcgcucuggc

SEQ ID NO: 1472658 - RNA, 12 nt, Pseudomonas aeruginosa PA01
cagccccgccgg

SEQ ID NO: 1472659 - RNA, 13 nt, Pseudomonas aeruginosa PA01
cagccccgccgga

SEQ ID NO: 1472660 - RNA, 14 nt, Pseudomonas aeruginosa PA01
cagccccgaggcca

SEQ ID NO: 1472661 - RNA, 13 nt, Pseudomonas aeruginosa PA01
cagccccgaucgc

SEQ ID NO: 1472662 - RNA, 15 nt, Pseudomonas aeruginosa PA01
cagcccccgccggcc

SEQ ID NO: 1472663 - RNA, 14 nt, Pseudomonas aeruginosa PA01
cagccccaggcgcg

SEQ ID NO: 1472664 - RNA, 13 nt, Pseudomonas aeruginosa PA01
cagccccaggcgc

SEQ ID NO: 1472665 - RNA, 14 nt, Pseudomonas aeruginosa PA01
cagcccccaggcac

SEQ ID NO: 1472666 - RNA, 16 nt, Pseudomonas aeruginosa PA01
cagccauagcaauaca

SEQ ID NO: 1472667 - RNA, 18 nt, Pseudomonas aeruginosa PA01
cagccauagcgccggcac

SEQ ID NO: 1472668 - RNA, 16 nt, Pseudomonas aeruginosa PA01
cagccauagugcuggg

SEQ ID NO: 1472669 - RNA, 18 nt, Pseudomonas aeruginosa PA01
cagccauagugcugggcg

SEQ ID NO: 1472670 - RNA, 19 nt, Pseudomonas aeruginosa PA01
cagccaguuggaaguugcc

SEQ ID NO: 1472671 - RNA, 20 nt, Pseudomonas aeruginosa PA01
cagccagguguucggccccg

SEQ ID NO: 1472672 - RNA, 17 nt, Pseudomonas aeruginosa PA01
cagccaguaguccuccg

SEQ ID NO: 1472673 - RNA, 22 nt, Pseudomonas aeruginosa PA01
cagccaguaguccuccgcgccc

SEQ ID NO: 1472674 - RNA, 21 nt, Pseudomonas aeruginosa PA01
cagccaggggcacgcuggcga

SEQ ID NO: 1472675 - RNA, 15 nt, Pseudomonas aeruginosa PA01
cagccagggccgcga

SEQ ID NO: 1472676 - RNA, 19 nt, Pseudomonas aeruginosa PA01
cagccagggccgcgagagg

SEQ ID NO: 1472677 - RNA, 20 nt, Pseudomonas aeruginosa PA01
cagccagggccgcgagaggu

SEQ ID NO: 1472678 - RNA, 15 nt, Pseudomonas aeruginosa PA01
cagccacugccgccu

SEQ ID NO: 1472679 - RNA, 14 nt, Pseudomonas aeruginosa PA01
cagccaggcgcucu

SEQ ID NO: 1472680 - RNA, 22 nt, Pseudomonas aeruginosa PA01
cagccaggcgcucucgccgccu

SEQ ID NO: 1472681 - RNA, 15 nt, Pseudomonas aeruginosa PA01
cagccaggcggccac

SEQ ID NO: 1472682 - RNA, 14 nt, Pseudomonas aeruginosa PA01
cagccaggcuggcu

SEQ ID NO: 1472683 - RNA, 14 nt, Pseudomonas aeruginosa PA01
cagccagggcaacg

SEQ ID NO: 1472684 - RNA, 17 nt, Pseudomonas aeruginosa PA01
cagccacucggccaggc

SEQ ID NO: 1472685 - RNA, 20 nt, Pseudomonas aeruginosa PA01
cagccacucggccaggcgcc

SEQ ID NO: 1472686 - RNA, 18 nt, Pseudomonas aeruginosa PA01
cagccacgggcgccagcg

SEQ ID NO: 1472687 - RNA, 13 nt, Pseudomonas aeruginosa PA01
cagccaggcgaag

SEQ ID NO: 1472688 - RNA, 14 nt, Pseudomonas aeruginosa PA01
cagccaggcgaagc

SEQ ID NO: 1472689 - RNA, 15 nt, Pseudomonas aeruginosa PA01
cagccaggcgaagcg

SEQ ID NO: 1472690 - RNA, 19 nt, Pseudomonas aeruginosa PA01
cagccaggcgaagcggcug

SEQ ID NO: 1472691 - RNA, 21 nt, Pseudomonas aeruginosa PA01
cagccaggcgaagcggcuggc

SEQ ID NO: 1472692 - RNA, 21 nt, Pseudomonas aeruginosa PA01
cagccaggcgaaggcgauccc

SEQ ID NO: 1472693 - RNA, 15 nt, Pseudomonas aeruginosa PA01
cagccacggacgcgc

SEQ ID NO: 1472694 - RNA, 17 nt, Pseudomonas aeruginosa PA01
cagccacggcacacguc

SEQ ID NO: 1472695 - RNA, 21 nt, Pseudomonas aeruginosa PA01
cagccacggcacacgucggca

SEQ ID NO: 1472696 - RNA, 18 nt, Pseudomonas aeruginosa PA01
cagccacccgcucgaccu

SEQ ID NO: 1472697 - RNA, 14 nt, Pseudomonas aeruginosa PA01
cagccacaggcgcc

SEQ ID NO: 1472698 - RNA, 15 nt, Pseudomonas aeruginosa PA01
cagccacaggcgcca

SEQ ID NO: 1472699 - RNA, 12 nt, Pseudomonas aeruginosa PA01
cagcauggugaa

SEQ ID NO: 1472700 - RNA, 22 nt, Pseudomonas aeruginosa PA01
cagcauguuguuauggccgacc

SEQ ID NO: 1472701 - RNA, 23 nt, Pseudomonas aeruginosa PA01
cagcauguuguuauggccgaccc

SEQ ID NO: 1472702 - RNA, 19 nt, Pseudomonas aeruginosa PA01
cagccaaggaugcgccagc

SEQ ID NO: 1472703 - RNA, 22 nt, Pseudomonas aeruginosa PA01
cagccaaggaugcgccagcggc

SEQ ID NO: 1472704 - RNA, 14 nt, Pseudomonas aeruginosa PA01
cagcauuaccccga

SEQ ID NO: 1472705 - RNA, 22 nt, Pseudomonas aeruginosa PA01
cagcaucguagggagcgacacc

SEQ ID NO: 1472706 - RNA, 20 nt, Pseudomonas aeruginosa PA01
cagcaucgccggcagcgccg

SEQ ID NO: 1472707 - RNA, 18 nt, Pseudomonas aeruginosa PA01
cagcaguucgucgccacg

SEQ ID NO: 1472708 - RNA, 15 nt, Pseudomonas aeruginosa PA01
cagcaguugccgggu

SEQ ID NO: 1472709 - RNA, 14 nt, Pseudomonas aeruginosa PA01
cagcaucgcaucgg

SEQ ID NO: 1472710 - RNA, 20 nt, Pseudomonas aeruginosa PA01
cagcauaaccccuuugccga

SEQ ID NO: 1472711 - RNA, 14 nt, Pseudomonas aeruginosa PA01
cagcgcaccgcccu

SEQ ID NO: 1472712 - RNA, 17 nt, Pseudomonas aeruginosa PA01
cagcgcaccgcccugca

SEQ ID NO: 1472713 - RNA, 12 nt, Pseudomonas aeruginosa PA01
cagcgcaccagg

SEQ ID NO: 1472714 - RNA, 12 nt, Pseudomonas aeruginosa PA01
cagcgcaccauc

SEQ ID NO: 1472715 - RNA, 18 nt, Pseudomonas aeruginosa PA01
cagcgaucagcaccagcg

SEQ ID NO: 1472716 - RNA, 14 nt, Pseudomonas aeruginosa PA01
cagcgaucgccgcc

SEQ ID NO: 1472717 - RNA, 16 nt, Pseudomonas aeruginosa PA01
cagcgaucgccgccau

SEQ ID NO: 1472718 - RNA, 13 nt, Pseudomonas aeruginosa PA01
cagcgaucgccgc

SEQ ID NO: 1472719 - RNA, 19 nt, Pseudomonas aeruginosa PA01
cagcgaugccuccggcuuu

SEQ ID NO: 1472720 - RNA, 18 nt, Pseudomonas aeruginosa PA01
cagcgcaagucggccugc

SEQ ID NO: 1472721 - RNA, 15 nt, Pseudomonas aeruginosa PA01
cagcgcaagcggcgg

SEQ ID NO: 1472722 - RNA, 16 nt, Pseudomonas aeruginosa PA01
cagcgcaagcggcggc

SEQ ID NO: 1472723 - RNA, 24 nt, Pseudomonas aeruginosa PA01
cagcgauucccgaggguggcgcug

SEQ ID NO: 1472724 - RNA, 14 nt, Pseudomonas aeruginosa PA01
cagcgagcaggcga

SEQ ID NO: 1472725 - RNA, 15 nt, Pseudomonas aeruginosa PA01
cagcgaacccaggcc

SEQ ID NO: 1472726 - RNA, 17 nt, Pseudomonas aeruginosa PA01
cagcgaacccaggccgc

SEQ ID NO: 1472727 - RNA, 20 nt, Pseudomonas aeruginosa PA01
cagcgaacccaggccgcgca

SEQ ID NO: 1472728 - RNA, 22 nt, Pseudomonas aeruginosa PA01
cagcgaaauggucaccaugauc

SEQ ID NO: 1472729 - RNA, 23 nt, Pseudomonas aeruginosa PA01
cagcgaaauggucaccaugauca

SEQ ID NO: 1472730 - RNA, 16 nt, Pseudomonas aeruginosa PA01
cagcgacagcauggcc

SEQ ID NO: 1472731 - RNA, 22 nt, Pseudomonas aeruginosa PA01
cagcgacagcauggccuugccg

SEQ ID NO: 1472732 - RNA, 20 nt, Pseudomonas aeruginosa PA01
cagcgaccaccaccaggucg

SEQ ID NO: 1472733 - RNA, 21 nt, Pseudomonas aeruginosa PA01
cagcgaccaccaccaggucgg

SEQ ID NO: 1472734 - RNA, 21 nt, Pseudomonas aeruginosa PA01
cagcgagcuaucgccucccgc

SEQ ID NO: 1472735 - RNA, 16 nt, Pseudomonas aeruginosa PA01
cagcgagcuucgccgc

SEQ ID NO: 1472736 - RNA, 21 nt, Pseudomonas aeruginosa PA01
cagcgagcuucgccgcgcaag

SEQ ID NO: 1472737 - RNA, 23 nt, Pseudomonas aeruginosa PA01
cagcgagacgggcgaggcuaacg

SEQ ID NO: 1472738 - RNA, 18 nt, Pseudomonas aeruginosa PA01
cagcgagaggggcgcucg

SEQ ID NO: 1472739 - RNA, 14 nt, Pseudomonas aeruginosa PA01
cagcgagccgagca

SEQ ID NO: 1472740 - RNA, 18 nt, Pseudomonas aeruginosa PA01
cagcgagccgaucaccag

SEQ ID NO: 1472741 - RNA, 20 nt, Pseudomonas aeruginosa PA01
cagcgagccgaucaccagca

SEQ ID NO: 1472742 - RNA, 18 nt, Pseudomonas aeruginosa PA01
cagcgagcgggucagcag

SEQ ID NO: 1472743 - RNA, 20 nt, Pseudomonas aeruginosa PA01
cagcgaguagucgcggggcg

SEQ ID NO: 1472744 - RNA, 22 nt, Pseudomonas aeruginosa PA01
cagcgaguagucgcggggcgga

SEQ ID NO: 1472745 - RNA, 15 nt, Pseudomonas aeruginosa PA01
cagcgaggcgggcgc

SEQ ID NO: 1472746 - RNA, 17 nt, Pseudomonas aeruginosa PA01
cagcgaguugaccuugg

SEQ ID NO: 1472747 - RNA, 16 nt, Pseudomonas aeruginosa PA01
cagcgagucgacccag

SEQ ID NO: 1472748 - RNA, 18 nt, Pseudomonas aeruginosa PA01
cagcgagucgacccaggc

SEQ ID NO: 1472749 - RNA, 14 nt, Pseudomonas aeruginosa PA01
cagcgagucgccgu

SEQ ID NO: 1472750 - RNA, 23 nt, Pseudomonas aeruginosa PA01
cagccggguucccaguugcuggg

SEQ ID NO: 1472751 - RNA, 19 nt, Pseudomonas aeruginosa PA01
cagccgguacugcgccagu

SEQ ID NO: 1472752 - RNA, 17 nt, Pseudomonas aeruginosa PA01
cagccgguaggggccga

SEQ ID NO: 1472753 - RNA, 22 nt, Pseudomonas aeruginosa PA01
cagccgguaggggccgacgaag

SEQ ID NO: 1472754 - RNA, 16 nt, Pseudomonas aeruginosa PA01
cagccgggcuccgccg

SEQ ID NO: 1472755 - RNA, 17 nt, Pseudomonas aeruginosa PA01
cagccgggcuccgccgc

SEQ ID NO: 1472756 - RNA, 18 nt, Pseudomonas aeruginosa PA01
cagccgggcuccgccgcg

SEQ ID NO: 1472757 - RNA, 14 nt, Pseudomonas aeruginosa PA01
cagccgggcagccg

SEQ ID NO: 1472758 - RNA, 23 nt, Pseudomonas aeruginosa PA01
cagccgggcagccguuggcguca

SEQ ID NO: 1472759 - RNA, 18 nt, Pseudomonas aeruginosa PA01
cagccgggccgcagcgca

SEQ ID NO: 1472760 - RNA, 15 nt, Pseudomonas aeruginosa PA01
cagccggcggcgaau

SEQ ID NO: 1472761 - RNA, 19 nt, Pseudomonas aeruginosa PA01
cagccgaucgaagaaggcu

SEQ ID NO: 1472762 - RNA, 15 nt, Pseudomonas aeruginosa PA01
cagccgaugcucgcg

SEQ ID NO: 1472763 - RNA, 20 nt, Pseudomonas aeruginosa PA01
cagccgaugcucgcgccagc

SEQ ID NO: 1472764 - RNA, 21 nt, Pseudomonas aeruginosa PA01
cagccgaugcucgcgccagcc

SEQ ID NO: 1472765 - RNA, 22 nt, Pseudomonas aeruginosa PA01
cagccgaugcucgcgccagccc

SEQ ID NO: 1472766 - RNA, 14 nt, Pseudomonas aeruginosa PA01
cagccgaggcagcc

SEQ ID NO: 1472767 - RNA, 17 nt, Pseudomonas aeruginosa PA01
cagccgaggcagccguc

SEQ ID NO: 1472768 - RNA, 20 nt, Pseudomonas aeruginosa PA01
cagccgaggucgccgccagc

SEQ ID NO: 1472769 - RNA, 23 nt, Pseudomonas aeruginosa PA01
cagccgagguucuugcccagcaa

SEQ ID NO: 1472770 - RNA, 17 nt, Pseudomonas aeruginosa PA01
cagccguucgcuggaca

SEQ ID NO: 1472771 - RNA, 21 nt, Pseudomonas aeruginosa PA01
cagccguucgcuggacaggcg

SEQ ID NO: 1472772 - RNA, 15 nt, Pseudomonas aeruginosa PA01
cagccguucccgguc

SEQ ID NO: 1472773 - RNA, 23 nt, Pseudomonas aeruginosa PA01
cagccgguugcguuuccggucac

SEQ ID NO: 1472774 - RNA, 17 nt, Pseudomonas aeruginosa PA01
cagccguggcaggcgcc

SEQ ID NO: 1472775 - RNA, 15 nt, Pseudomonas aeruginosa PA01
cagccgugggcguag

SEQ ID NO: 1472776 - RNA, 16 nt, Pseudomonas aeruginosa PA01
cagccgugggcguaga

SEQ ID NO: 1472777 - RNA, 18 nt, Pseudomonas aeruginosa PA01
cagccgguggucuucagc

SEQ ID NO: 1472778 - RNA, 19 nt, Pseudomonas aeruginosa PA01
cagccgguggucuucagca

SEQ ID NO: 1472779 - RNA, 21 nt, Pseudomonas aeruginosa PA01
cagccgguggucuucagcaca

SEQ ID NO: 1472780 - RNA, 13 nt, Pseudomonas aeruginosa PA01
cagccguuggcca

SEQ ID NO: 1472781 - RNA, 19 nt, Pseudomonas aeruginosa PA01
cagccguuggccagcaggc

SEQ ID NO: 1472782 - RNA, 19 nt, Pseudomonas aeruginosa PA01
cagccuggggugcagcagg

SEQ ID NO: 1472783 - RNA, 20 nt, Pseudomonas aeruginosa PA01
cagccuggucauccuggccc

SEQ ID NO: 1472784 - RNA, 17 nt, Pseudomonas aeruginosa PA01
cagccugucacucaggc

SEQ ID NO: 1472785 - RNA, 14 nt, Pseudomonas aeruginosa PA01
cagccuacugggcg

SEQ ID NO: 1472786 - RNA, 20 nt, Pseudomonas aeruginosa PA01
cagccuacugggcguggcgg

SEQ ID NO: 1472787 - RNA, 18 nt, Pseudomonas aeruginosa PA01
cagccuuggccacggcau

SEQ ID NO: 1472788 - RNA, 17 nt, Pseudomonas aeruginosa PA01
cagccuugagccuugcc

SEQ ID NO: 1472789 - RNA, 12 nt, Pseudomonas aeruginosa PA01
cagccuuccggc

SEQ ID NO: 1472790 - RNA, 22 nt, Pseudomonas aeruginosa PA01
cagcgccuggcgcaguucaucg

SEQ ID NO: 1472791 - RNA, 18 nt, Pseudomonas aeruginosa PA01
cagcgccugggccgcgcu

SEQ ID NO: 1472792 - RNA, 17 nt, Pseudomonas aeruginosa PA01
cagcgccuugaccucga

SEQ ID NO: 1472793 - RNA, 19 nt, Pseudomonas aeruginosa PA01
cagcgccuuuuccgcaucu

SEQ ID NO: 1472794 - RNA, 17 nt, Pseudomonas aeruginosa PA01
cagcgccuggucggcgg

SEQ ID NO: 1472795 - RNA, 19 nt, Pseudomonas aeruginosa PA01
cagcgccuggucggcggcc

SEQ ID NO: 1472796 - RNA, 15 nt, Pseudomonas aeruginosa PA01
cagcgccuguuccag

SEQ ID NO: 1472797 - RNA, 21 nt, Pseudomonas aeruginosa PA01
cagcgccuguuccagggccug

SEQ ID NO: 1472798 - RNA, 12 nt, Pseudomonas aeruginosa PA01
cagcgccuggcg

SEQ ID NO: 1472799 - RNA, 14 nt, Pseudomonas aeruginosa PA01
cagcgccuggcgca

SEQ ID NO: 1472800 - RNA, 22 nt, Pseudomonas aeruginosa PA01
cagcgcgaacaguuccgacugc

SEQ ID NO: 1472801 - RNA, 17 nt, Pseudomonas aeruginosa PA01
cagcgccuccagcaccg

SEQ ID NO: 1472802 - RNA, 18 nt, Pseudomonas aeruginosa PA01
cagcgccuccagcaccgg

SEQ ID NO: 1472803 - RNA, 19 nt, Pseudomonas aeruginosa PA01
cagcgccuccagcaccggg

SEQ ID NO: 1472804 - RNA, 20 nt, Pseudomonas aeruginosa PA01
cagcgccuccagcaccggga

SEQ ID NO: 1472805 - RNA, 14 nt, Pseudomonas aeruginosa PA01
cagcgccuccucua

SEQ ID NO: 1472806 - RNA, 20 nt, Pseudomonas aeruginosa PA01
cagcgccuccucuaccaggc

SEQ ID NO: 1472807 - RNA, 15 nt, Pseudomonas aeruginosa PA01
cagcgccuccagcac

SEQ ID NO: 1472808 - RNA, 16 nt, Pseudomonas aeruginosa PA01
cagcgccuccagcacc

SEQ ID NO: 1472809 - RNA, 13 nt, Pseudomonas aeruginosa PA01
cagcgccucgacc

SEQ ID NO: 1472810 - RNA, 14 nt, Pseudomonas aeruginosa PA01
cagcgccucgaccu

SEQ ID NO: 1472811 - RNA, 21 nt, Pseudomonas aeruginosa PA01
cagcgccucgaccucggccgc

SEQ ID NO: 1472812 - RNA, 16 nt, Pseudomonas aeruginosa PA01
cagcgccucgccgagc

SEQ ID NO: 1472813 - RNA, 17 nt, Pseudomonas aeruginosa PA01
cagcgccucgccgagca

SEQ ID NO: 1472814 - RNA, 23 nt, Pseudomonas aeruginosa PA01
cagcgccucgccgagcauccagg

SEQ ID NO: 1472815 - RNA, 13 nt, Pseudomonas aeruginosa PA01
cagcgccucgcgg

SEQ ID NO: 1472816 - RNA, 16 nt, Pseudomonas aeruginosa PA01
cagcgccuggaugauc

SEQ ID NO: 1472817 - RNA, 18 nt, Pseudomonas aeruginosa PA01
cagcgccuggaugaucgc

SEQ ID NO: 1472818 - RNA, 11 nt, Pseudomonas aeruginosa PA01
cagcgccuggc

SEQ ID NO: 1472819 - RNA, 22 nt, Pseudomonas aeruginosa PA01
cagcgccucguggaacagcgcg

SEQ ID NO: 1472820 - RNA, 17 nt, Pseudomonas aeruginosa PA01
cagcgccgccaccgcca

SEQ ID NO: 1472821 - RNA, 18 nt, Pseudomonas aeruginosa PA01
cagcgccgccaccgccac

SEQ ID NO: 1472822 - RNA, 13 nt, Pseudomonas aeruginosa PA01
cagcgccgccgcg

SEQ ID NO: 1472823 - RNA, 14 nt, Pseudomonas aeruginosa PA01
cagcgccgcccugu

SEQ ID NO: 1472824 - RNA, 14 nt, Pseudomonas aeruginosa PA01
cagcgccgccagca

SEQ ID NO: 1472825 - RNA, 17 nt, Pseudomonas aeruginosa PA01
cagcgccgccagcaggu

SEQ ID NO: 1472826 - RNA, 13 nt, Pseudomonas aeruginosa PA01
cagcgccgccagg

SEQ ID NO: 1472827 - RNA, 15 nt, Pseudomonas aeruginosa PA01
cagcgccgccaggca

SEQ ID NO: 1472828 - RNA, 15 nt, Pseudomonas aeruginosa PA01
cagcgccgccaggcg

SEQ ID NO: 1472829 - RNA, 17 nt, Pseudomonas aeruginosa PA01
cagcgccgccaggcgcg

SEQ ID NO: 1472830 - RNA, 13 nt, Pseudomonas aeruginosa PA01
cagcgccgccagu

SEQ ID NO: 1472831 - RNA, 14 nt, Pseudomonas aeruginosa PA01
cagcgccgcgcgcu

SEQ ID NO: 1472832 - RNA, 15 nt, Pseudomonas aeruginosa PA01
cagcgccgcgcggca

SEQ ID NO: 1472833 - RNA, 16 nt, Pseudomonas aeruginosa PA01
cagcgccgcgcggcaa

SEQ ID NO: 1472834 - RNA, 17 nt, Pseudomonas aeruginosa PA01
cagcgccgcgcggcaac

SEQ ID NO: 1472835 - RNA, 17 nt, Pseudomonas aeruginosa PA01
cagcgccgcgcugcgug

SEQ ID NO: 1472836 - RNA, 14 nt, Pseudomonas aeruginosa PA01
cagcgccgcggcga

SEQ ID NO: 1472837 - RNA, 16 nt, Pseudomonas aeruginosa PA01
cagcgccgcggcgacc

SEQ ID NO: 1472838 - RNA, 20 nt, Pseudomonas aeruginosa PA01
cagcgccgcggcgaccagcg

SEQ ID NO: 1472839 - RNA, 12 nt, Pseudomonas aeruginosa PA01
cagcgccgcggc

SEQ ID NO: 1472840 - RNA, 14 nt, Pseudomonas aeruginosa PA01
cagcgccgccgggc

SEQ ID NO: 1472841 - RNA, 15 nt, Pseudomonas aeruginosa PA01
cagcgccgccgggcg

SEQ ID NO: 1472842 - RNA, 23 nt, Pseudomonas aeruginosa PA01
cagcgccgccucgaaggccggca

SEQ ID NO: 1472843 - RNA, 18 nt, Pseudomonas aeruginosa PA01
cagcgccgccucgcuggg

SEQ ID NO: 1472844 - RNA, 15 nt, Pseudomonas aeruginosa PA01
cagcgccgccugcug

SEQ ID NO: 1472845 - RNA, 17 nt, Pseudomonas aeruginosa PA01
cagcgccgccugcuggc

SEQ ID NO: 1472846 - RNA, 22 nt, Pseudomonas aeruginosa PA01
cagcgccgccugcuggcugccc

SEQ ID NO: 1472847 - RNA, 15 nt, Pseudomonas aeruginosa PA01
cagcgccgccgcugc

SEQ ID NO: 1472848 - RNA, 19 nt, Pseudomonas aeruginosa PA01
cagcgccgcucggcgagcc

SEQ ID NO: 1472849 - RNA, 23 nt, Pseudomonas aeruginosa PA01
cagcgccgcucggcgagccgccg

SEQ ID NO: 1472850 - RNA, 18 nt, Pseudomonas aeruginosa PA01
cagcgccggaaucgacgg

SEQ ID NO: 1472851 - RNA, 23 nt, Pseudomonas aeruginosa PA01
cagcgccgggucgaccuugccga

SEQ ID NO: 1472852 - RNA, 19 nt, Pseudomonas aeruginosa PA01
cagcgccgguagcggcgca

SEQ ID NO: 1472853 - RNA, 19 nt, Pseudomonas aeruginosa PA01
cagcgccgucaccagcagc

SEQ ID NO: 1472854 - RNA, 20 nt, Pseudomonas aeruginosa PA01
cagcgccgucaccagcagcc

SEQ ID NO: 1472855 - RNA, 12 nt, Pseudomonas aeruginosa PA01
cagcgccgggca

SEQ ID NO: 1472856 - RNA, 16 nt, Pseudomonas aeruginosa PA01
cagcgccgggcauucg

SEQ ID NO: 1472857 - RNA, 18 nt, Pseudomonas aeruginosa PA01
cagcgccgggcauucgca

SEQ ID NO: 1472858 - RNA, 18 nt, Pseudomonas aeruginosa PA01
cagcgccguucacgccug

SEQ ID NO: 1472859 - RNA, 21 nt, Pseudomonas aeruginosa PA01
cagcgccguucacgccuggcg

SEQ ID NO: 1472860 - RNA, 15 nt, Pseudomonas aeruginosa PA01
cagcgccguugcggc

SEQ ID NO: 1472861 - RNA, 22 nt, Pseudomonas aeruginosa PA01
cagcgccguugcggcagcaucc

SEQ ID NO: 1472862 - RNA, 15 nt, Pseudomonas aeruginosa PA01
cagcgcccggcacgc

SEQ ID NO: 1472863 - RNA, 20 nt, Pseudomonas aeruginosa PA01
cagcgcccggcacgcuccag

SEQ ID NO: 1472864 - RNA, 22 nt, Pseudomonas aeruginosa PA01
cagcgcccggcacgcuccaggg

SEQ ID NO: 1472865 - RNA, 22 nt, Pseudomonas aeruginosa PA01
cagcgcccgcaccacccgcugc

SEQ ID NO: 1472866 - RNA, 12 nt, Pseudomonas aeruginosa PA01
cagcgcccggcu

SEQ ID NO: 1472867 - RNA, 17 nt, Pseudomonas aeruginosa PA01
cagcgcccggcugugcu

SEQ ID NO: 1472868 - RNA, 19 nt, Pseudomonas aeruginosa PA01
cagcgcccgauaggcgccg

SEQ ID NO: 1472869 - RNA, 22 nt, Pseudomonas aeruginosa PA01
cagcgccgagacgaucagcagg

SEQ ID NO: 1472870 - RNA, 19 nt, Pseudomonas aeruginosa PA01
cagcgccgcauuggccagg

SEQ ID NO: 1472871 - RNA, 14 nt, Pseudomonas aeruginosa PA01
cagcgccaggccgc

SEQ ID NO: 1472872 - RNA, 16 nt, Pseudomonas aeruginosa PA01
cagcgccaggccgccg

SEQ ID NO: 1472873 - RNA, 17 nt, Pseudomonas aeruginosa PA01
cagcgccaggccgccga

SEQ ID NO: 1472874 - RNA, 12 nt, Pseudomonas aeruginosa PA01
cagcgccaggcc

SEQ ID NO: 1472875 - RNA, 17 nt, Pseudomonas aeruginosa PA01
cagcgccaggaagccgc

SEQ ID NO: 1472876 - RNA, 13 nt, Pseudomonas aeruginosa PA01
cagcgccaggagc

SEQ ID NO: 1472877 - RNA, 16 nt, Pseudomonas aeruginosa PA01
cagcgccaggagcagg

SEQ ID NO: 1472878 - RNA, 19 nt, Pseudomonas aeruginosa PA01
cagcgccaggagcagggcg

SEQ ID NO: 1472879 - RNA, 21 nt, Pseudomonas aeruginosa PA01
cagcgccaguacuccgagggc

SEQ ID NO: 1472880 - RNA, 18 nt, Pseudomonas aeruginosa PA01
cagcgccaguuggacgcg

SEQ ID NO: 1472881 - RNA, 18 nt, Pseudomonas aeruginosa PA01
cagcgccccaccaggcuc

SEQ ID NO: 1472882 - RNA, 14 nt, Pseudomonas aeruginosa PA01
cagcgccccagcac

SEQ ID NO: 1472883 - RNA, 15 nt, Pseudomonas aeruginosa PA01
cagcgccccgccuac

SEQ ID NO: 1472884 - RNA, 21 nt, Pseudomonas aeruginosa PA01
cagcgccccgccuaccggggc

SEQ ID NO: 1472885 - RNA, 14 nt, Pseudomonas aeruginosa PA01
cagcgcccaggccg

SEQ ID NO: 1472886 - RNA, 15 nt, Pseudomonas aeruginosa PA01
cagcgcccaggccgg

SEQ ID NO: 1472887 - RNA, 16 nt, Pseudomonas aeruginosa PA01
cagcgcccaggccggg

SEQ ID NO: 1472888 - RNA, 17 nt, Pseudomonas aeruginosa PA01
cagcgccaucaggcccu

SEQ ID NO: 1472889 - RNA, 19 nt, Pseudomonas aeruginosa PA01
cagcgccaugcucuucagg

SEQ ID NO: 1472890 - RNA, 20 nt, Pseudomonas aeruginosa PA01
cagcgccaugcucuucaggc

SEQ ID NO: 1472891 - RNA, 15 nt, Pseudomonas aeruginosa PA01
cagcgccaccagcag

SEQ ID NO: 1472892 - RNA, 13 nt, Pseudomonas aeruginosa PA01
cagcgccaccagc

SEQ ID NO: 1472893 - RNA, 14 nt, Pseudomonas aeruginosa PA01
cagcgcaugcggaa

SEQ ID NO: 1472894 - RNA, 13 nt, Pseudomonas aeruginosa PA01
cagcgcaucggcg

SEQ ID NO: 1472895 - RNA, 15 nt, Pseudomonas aeruginosa PA01
cagcgcaucggcgcc

SEQ ID NO: 1472896 - RNA, 16 nt, Pseudomonas aeruginosa PA01
cagcgcaucgaggccg

SEQ ID NO: 1472897 - RNA, 18 nt, Pseudomonas aeruginosa PA01
cagcgcaucgaggccggc

SEQ ID NO: 1472898 - RNA, 16 nt, Pseudomonas aeruginosa PA01
cagcgcagccugcugg

SEQ ID NO: 1472899 - RNA, 16 nt, Pseudomonas aeruginosa PA01
cagcgcaggccgaucu

SEQ ID NO: 1472900 - RNA, 16 nt, Pseudomonas aeruginosa PA01
cagcgccagcggcagc

SEQ ID NO: 1472901 - RNA, 17 nt, Pseudomonas aeruginosa PA01
cagcgccagcggcagcg

SEQ ID NO: 1472902 - RNA, 18 nt, Pseudomonas aeruginosa PA01
cagcgccagcggcagcgg

SEQ ID NO: 1472903 - RNA, 14 nt, Pseudomonas aeruginosa PA01
cagcgccagcaggu

SEQ ID NO: 1472904 - RNA, 21 nt, Pseudomonas aeruginosa PA01
cagcgccagcaggucgcgcug

SEQ ID NO: 1472905 - RNA, 13 nt, Pseudomonas aeruginosa PA01
cagcgccagccag

SEQ ID NO: 1472906 - RNA, 13 nt, Pseudomonas aeruginosa PA01
cagcgccacggcc

SEQ ID NO: 1472907 - RNA, 20 nt, Pseudomonas aeruginosa PA01
cagcgccacggcgcggaaca

SEQ ID NO: 1472908 - RNA, 23 nt, Pseudomonas aeruginosa PA01
cagcgccacggcgcggaacaucg

SEQ ID NO: 1472909 - RNA, 15 nt, Pseudomonas aeruginosa PA01
cagcgccacuuccag

SEQ ID NO: 1472910 - RNA, 18 nt, Pseudomonas aeruginosa PA01
cagcgccacuuccagcuu

SEQ ID NO: 1472911 - RNA, 16 nt, Pseudomonas aeruginosa PA01
cagcgccaccagcagg

SEQ ID NO: 1472912 - RNA, 17 nt, Pseudomonas aeruginosa PA01
cagcgccaccagcaugc

SEQ ID NO: 1472913 - RNA, 12 nt, Pseudomonas aeruginosa PA01
cacgccgagcaa

SEQ ID NO: 1472914 - RNA, 18 nt, Pseudomonas aeruginosa PA01
cacgccgaucccggcggc

SEQ ID NO: 1472915 - RNA, 20 nt, Pseudomonas aeruginosa PA01
cacgccgaucccggcggcga

SEQ ID NO: 1472916 - RNA, 22 nt, Pseudomonas aeruginosa PA01
cacgccgaucccggcggcgacc

SEQ ID NO: 1472917 - RNA, 20 nt, Pseudomonas aeruginosa PA01
cacgccgauaccggccucga

SEQ ID NO: 1472918 - RNA, 12 nt, Pseudomonas aeruginosa PA01
cacgccgagggc

SEQ ID NO: 1472919 - RNA, 21 nt, Pseudomonas aeruginosa PA01
cacgccgagggcgcggcgcca

SEQ ID NO: 1472920 - RNA, 22 nt, Pseudomonas aeruginosa PA01
cacgccgaacuuguagggcucg

SEQ ID NO: 1472921 - RNA, 19 nt, Pseudomonas aeruginosa PA01
cacgccgaaguccugcaac

SEQ ID NO: 1472922 - RNA, 19 nt, Pseudomonas aeruginosa PA01
cacgccgaagucggcgagc

SEQ ID NO: 1472923 - RNA, 22 nt, Pseudomonas aeruginosa PA01
cacgccgaagucggcgagccgg

SEQ ID NO: 1472924 - RNA, 17 nt, Pseudomonas aeruginosa PA01
cacgccggccucgcgca

SEQ ID NO: 1472925 - RNA, 16 nt, Pseudomonas aeruginosa PA01
caccucaugcugcgcg

SEQ ID NO: 1472926 - RNA, 18 nt, Pseudomonas aeruginosa PA01
caccucaugcugcgcggg

SEQ ID NO: 1472927 - RNA, 13 nt, Pseudomonas aeruginosa PA01
cacgccauucgaa

SEQ ID NO: 1472928 - RNA, 20 nt, Pseudomonas aeruginosa PA01
cacgcccaucgccaccagca

SEQ ID NO: 1472929 - RNA, 23 nt, Pseudomonas aeruginosa PA01
cacgcccaucgccaccagcagga

SEQ ID NO: 1472930 - RNA, 19 nt, Pseudomonas aeruginosa PA01
cacgcccaucggcgucggc

SEQ ID NO: 1472931 - RNA, 20 nt, Pseudomonas aeruginosa PA01
cacgcccaucggcgucggcu

SEQ ID NO: 1472932 - RNA, 13 nt, Pseudomonas aeruginosa PA01
cacgccccauccg

SEQ ID NO: 1472933 - RNA, 17 nt, Pseudomonas aeruginosa PA01
cacgccccagcgcaucg

SEQ ID NO: 1472934 - RNA, 21 nt, Pseudomonas aeruginosa PA01
cacgcccaguugcgccgccug

SEQ ID NO: 1472935 - RNA, 18 nt, Pseudomonas aeruginosa PA01
cacgcccaggcgcucggc

SEQ ID NO: 1472936 - RNA, 23 nt, Pseudomonas aeruginosa PA01
cacgccgucgccgcugaugcgcu

SEQ ID NO: 1472937 - RNA, 16 nt, Pseudomonas aeruginosa PA01
cacgcggaucuggccc

SEQ ID NO: 1472938 - RNA, 23 nt, Pseudomonas aeruginosa PA01
cacgcggaccuugucgccgguga

SEQ ID NO: 1472939 - RNA, 23 nt, Pseudomonas aeruginosa PA01
cacgcggacccaguugggccagg

SEQ ID NO: 1472940 - RNA, 14 nt, Pseudomonas aeruginosa PA01
cacgcgcuggagua

SEQ ID NO: 1472941 - RNA, 15 nt, Pseudomonas aeruginosa PA01
cacgccugccaucga

SEQ ID NO: 1472942 - RNA, 17 nt, Pseudomonas aeruginosa PA01
cacgccguggaccagga

SEQ ID NO: 1472943 - RNA, 17 nt, Pseudomonas aeruginosa PA01
cacgccucaaggcaucg

SEQ ID NO: 1472944 - RNA, 19 nt, Pseudomonas aeruginosa PA01
cacgccgguggccaggcuc

SEQ ID NO: 1472945 - RNA, 22 nt, Pseudomonas aeruginosa PA01
cacgccggugauguaggacgcc

SEQ ID NO: 1472946 - RNA, 14 nt, Pseudomonas aeruginosa PA01
cacgcucaggcagc

SEQ ID NO: 1472947 - RNA, 22 nt, Pseudomonas aeruginosa PA01
cacgcucaggucggucgaacug

SEQ ID NO: 1472948 - RNA, 18 nt, Pseudomonas aeruginosa PA01
cacgcucagugcgccggg

SEQ ID NO: 1472949 - RNA, 14 nt, Pseudomonas aeruginosa PA01
cacgcucaugcgcg

SEQ ID NO: 1472950 - RNA, 14 nt, Pseudomonas aeruginosa PA01
cacgcguccgacca

SEQ ID NO: 1472951 - RNA, 17 nt, Pseudomonas aeruginosa PA01
cacgcucucgaacagca

SEQ ID NO: 1472952 - RNA, 20 nt, Pseudomonas aeruginosa PA01
cacgcucuguuucgggucgc

SEQ ID NO: 1472953 - RNA, 20 nt, Pseudomonas aeruginosa PA01
cacgcugaagaucgccacga

SEQ ID NO: 1472954 - RNA, 19 nt, Pseudomonas aeruginosa PA01
cacgcugaggcucagcgcg

SEQ ID NO: 1472955 - RNA, 18 nt, Pseudomonas aeruginosa PA01
cacgcugacgccggcacc

SEQ ID NO: 1472956 - RNA, 13 nt, Pseudomonas aeruginosa PA01
cacgcugccagca

SEQ ID NO: 1472957 - RNA, 18 nt, Pseudomonas aeruginosa PA01
cacgcugcucgcagccgg

SEQ ID NO: 1472958 - RNA, 13 nt, Pseudomonas aeruginosa PA01
cacgcugcgccgg

SEQ ID NO: 1472959 - RNA, 15 nt, Pseudomonas aeruginosa PA01
cacgcugcgccggcg

SEQ ID NO: 1472960 - RNA, 22 nt, Pseudomonas aeruginosa PA01
cacggaagcgcugcucgaccac

SEQ ID NO: 1472961 - RNA, 16 nt, Pseudomonas aeruginosa PA01
cacggaaggccacgcc

SEQ ID NO: 1472962 - RNA, 20 nt, Pseudomonas aeruginosa PA01
cacgcuugucguggcgggcu

SEQ ID NO: 1472963 - RNA, 19 nt, Pseudomonas aeruginosa PA01
cacgcuucuccucggccga

SEQ ID NO: 1472964 - RNA, 18 nt, Pseudomonas aeruginosa PA01
cacgcuucugcuggccgc

SEQ ID NO: 1472965 - RNA, 19 nt, Pseudomonas aeruginosa PA01
cacgcuucugcuggccgcg

SEQ ID NO: 1472966 - RNA, 21 nt, Pseudomonas aeruginosa PA01
cacgcuucugcuggccgcgca

SEQ ID NO: 1472967 - RNA, 16 nt, Pseudomonas aeruginosa PA01
cacggcauaaccgucg

SEQ ID NO: 1472968 - RNA, 16 nt, Pseudomonas aeruginosa PA01
cacggcauccuggcgg

SEQ ID NO: 1472969 - RNA, 17 nt, Pseudomonas aeruginosa PA01
cacggacgcgcaggguc

SEQ ID NO: 1472970 - RNA, 14 nt, Pseudomonas aeruginosa PA01
cacgcugccgccga

SEQ ID NO: 1472971 - RNA, 14 nt, Pseudomonas aeruginosa PA01
cacgcuggcgagga

SEQ ID NO: 1472972 - RNA, 20 nt, Pseudomonas aeruginosa PA01
cacgcuggcgaggacgccgg

SEQ ID NO: 1472973 - RNA, 22 nt, Pseudomonas aeruginosa PA01
cacgcugggcagguguucgcaa

SEQ ID NO: 1472974 - RNA, 15 nt, Pseudomonas aeruginosa PA01
cacgcuggcgucggg

SEQ ID NO: 1472975 - RNA, 20 nt, Pseudomonas aeruginosa PA01
cacgcuggucaccgucugca

SEQ ID NO: 1472976 - RNA, 23 nt, Pseudomonas aeruginosa PA01
cacgcuggugccgacgcugauca

SEQ ID NO: 1472977 - RNA, 17 nt, Pseudomonas aeruginosa PA01
cacgcugugcggcagca

SEQ ID NO: 1472978 - RNA, 20 nt, Pseudomonas aeruginosa PA01
cacgcugugcggcagcaggc

SEQ ID NO: 1472979 - RNA, 12 nt, Pseudomonas aeruginosa PA01
cacgggaauggc

SEQ ID NO: 1472980 - RNA, 15 nt, Pseudomonas aeruginosa PA01
cacgggaauggcgga

SEQ ID NO: 1472981 - RNA, 16 nt, Pseudomonas aeruginosa PA01
cacgggaauggcggau

SEQ ID NO: 1472982 - RNA, 16 nt, Pseudomonas aeruginosa PA01
cacgggcagaccuucg

SEQ ID NO: 1472983 - RNA, 19 nt, Pseudomonas aeruginosa PA01
cacgggcgacccaggccga

SEQ ID NO: 1472984 - RNA, 16 nt, Pseudomonas aeruginosa PA01
cacggccuucggcagg

SEQ ID NO: 1472985 - RNA, 19 nt, Pseudomonas aeruginosa PA01
cacggcgagagcgccgacc

SEQ ID NO: 1472986 - RNA, 23 nt, Pseudomonas aeruginosa PA01
cacggcgaacaccgggccgccgg

SEQ ID NO: 1472987 - RNA, 13 nt, Pseudomonas aeruginosa PA01
cacggcgacccgc

SEQ ID NO: 1472988 - RNA, 23 nt, Pseudomonas aeruginosa PA01
cacggcgaagaacagcgggucgc

SEQ ID NO: 1472989 - RNA, 17 nt, Pseudomonas aeruginosa PA01
cacggcgaagccgcgcc

SEQ ID NO: 1472990 - RNA, 22 nt, Pseudomonas aeruginosa PA01
cacggcgaagccgcgcccggcc

SEQ ID NO: 1472991 - RNA, 16 nt, Pseudomonas aeruginosa PA01
cacggcgaagcggccc

SEQ ID NO: 1472992 - RNA, 14 nt, Pseudomonas aeruginosa PA01
cacggccagcagga

SEQ ID NO: 1472993 - RNA, 22 nt, Pseudomonas aeruginosa PA01
cacggccaggccacggccggcg

SEQ ID NO: 1472994 - RNA, 20 nt, Pseudomonas aeruginosa PA01
cacggccucgcgugcgcugg

SEQ ID NO: 1472995 - RNA, 13 nt, Pseudomonas aeruginosa PA01
cacggccugcacc

SEQ ID NO: 1472996 - RNA, 13 nt, Pseudomonas aeruginosa PA01
cacggcgaaaccg

SEQ ID NO: 1472997 - RNA, 17 nt, Pseudomonas aeruginosa PA01
cacggcgaaaccggcca

SEQ ID NO: 1472998 - RNA, 19 nt, Pseudomonas aeruginosa PA01
cacggcgaaaccggccagc

SEQ ID NO: 1472999 - RNA, 20 nt, Pseudomonas aeruginosa PA01
cacggcgaaaccggccagcg

SEQ ID NO: 1473000 - RNA, 22 nt, Pseudomonas aeruginosa PA01
cacggcgaaaccggccagcgcg

SEQ ID NO: 1473001 - RNA, 16 nt, Pseudomonas aeruginosa PA01
cacguaguaggcgcgg

SEQ ID NO: 1473002 - RNA, 14 nt, Pseudomonas aeruginosa PA01
cacguagcgcaggu

SEQ ID NO: 1473003 - RNA, 17 nt, Pseudomonas aeruginosa PA01
cacguagcgcaggucgc

SEQ ID NO: 1473004 - RNA, 22 nt, Pseudomonas aeruginosa PA01
cacgucaccguccuucggccgc

SEQ ID NO: 1473005 - RNA, 18 nt, Pseudomonas aeruginosa PA01
cacguaggacaggucggu

SEQ ID NO: 1473006 - RNA, 15 nt, Pseudomonas aeruginosa PA01
cacguaggagccggc

SEQ ID NO: 1473007 - RNA, 17 nt, Pseudomonas aeruginosa PA01
cacguaggagccggcca

SEQ ID NO: 1473008 - RNA, 15 nt, Pseudomonas aeruginosa PA01
cacguagggcguggu

SEQ ID NO: 1473009 - RNA, 19 nt, Pseudomonas aeruginosa PA01
cacguacuccagcaacggc

SEQ ID NO: 1473010 - RNA, 17 nt, Pseudomonas aeruginosa PA01
cacguagaugccggugc

SEQ ID NO: 1473011 - RNA, 16 nt, Pseudomonas aeruginosa PA01
cacguagcccccgccg

SEQ ID NO: 1473012 - RNA, 12 nt, Pseudomonas aeruginosa PA01
cacguagccggc

SEQ ID NO: 1473013 - RNA, 18 nt, Pseudomonas aeruginosa PA01
cacggucuccggggagau

SEQ ID NO: 1473014 - RNA, 19 nt, Pseudomonas aeruginosa PA01
cacggucgugcuugcaguc

SEQ ID NO: 1473015 - RNA, 13 nt, Pseudomonas aeruginosa PA01
cacggucgagacc

SEQ ID NO: 1473016 - RNA, 15 nt, Pseudomonas aeruginosa PA01
cacggucgagacccg

SEQ ID NO: 1473017 - RNA, 15 nt, Pseudomonas aeruginosa PA01
cacggucgcaggggc

SEQ ID NO: 1473018 - RNA, 17 nt, Pseudomonas aeruginosa PA01
cacgguccgcgaaccgc

SEQ ID NO: 1473019 - RNA, 20 nt, Pseudomonas aeruginosa PA01
cacggucauggccagcucga

SEQ ID NO: 1473020 - RNA, 23 nt, Pseudomonas aeruginosa PA01
cacggucauggccagcucgaccu

SEQ ID NO: 1473021 - RNA, 14 nt, Pseudomonas aeruginosa PA01
cacuaccgccgagg

SEQ ID NO: 1473022 - RNA, 23 nt, Pseudomonas aeruginosa PA01
cacucaggaaaaaacgccgguca

SEQ ID NO: 1473023 - RNA, 15 nt, Pseudomonas aeruginosa PA01
cacguuguucaccgu

SEQ ID NO: 1473024 - RNA, 14 nt, Pseudomonas aeruginosa PA01
cacguuguugccca

SEQ ID NO: 1473025 - RNA, 20 nt, Pseudomonas aeruginosa PA01
cacguugagcaucaccgcgg

SEQ ID NO: 1473026 - RNA, 13 nt, Pseudomonas aeruginosa PA01
cacguuccagcuc

SEQ ID NO: 1473027 - RNA, 18 nt, Pseudomonas aeruginosa PA01
cacguugaacacaucgac

SEQ ID NO: 1473028 - RNA, 14 nt, Pseudomonas aeruginosa PA01
cacguugcgccgca

SEQ ID NO: 1473029 - RNA, 15 nt, Pseudomonas aeruginosa PA01
cacguugcgccgcag

SEQ ID NO: 1473030 - RNA, 13 nt, Pseudomonas aeruginosa PA01
cacguggccgccc

SEQ ID NO: 1473031 - RNA, 14 nt, Pseudomonas aeruginosa PA01
cacguggccgccca

SEQ ID NO: 1473032 - RNA, 19 nt, Pseudomonas aeruginosa PA01
cacgugcggggugcgcugg

SEQ ID NO: 1473033 - RNA, 21 nt, Pseudomonas aeruginosa PA01
cacgugugucgacaccuggca

SEQ ID NO: 1473034 - RNA, 23 nt, Pseudomonas aeruginosa PA01
cacguccuugguguagccgaccc

SEQ ID NO: 1473035 - RNA, 19 nt, Pseudomonas aeruginosa PA01
cacgucgagcacgccgucc

SEQ ID NO: 1473036 - RNA, 19 nt, Pseudomonas aeruginosa PA01
cacgucgauauccagcggc

SEQ ID NO: 1473037 - RNA, 20 nt, Pseudomonas aeruginosa PA01
cacgucgauauccagcggca

SEQ ID NO: 1473038 - RNA, 23 nt, Pseudomonas aeruginosa PA01
cacgucgauauccagcggcagcc

SEQ ID NO: 1473039 - RNA, 13 nt, Pseudomonas aeruginosa PA01
cacgucgccgacc

SEQ ID NO: 1473040 - RNA, 14 nt, Pseudomonas aeruginosa PA01
cacgucgccgacca

SEQ ID NO: 1473041 - RNA, 19 nt, Pseudomonas aeruginosa PA01
cacgucgccgaccaggcgg

SEQ ID NO: 1473042 - RNA, 20 nt, Pseudomonas aeruginosa PA01
cacgucgccgaccaggcggc

SEQ ID NO: 1473043 - RNA, 15 nt, Pseudomonas aeruginosa PA01
cacgucgaucugcuc

SEQ ID NO: 1473044 - RNA, 23 nt, Pseudomonas aeruginosa PA01
cacgucgaucugcucguccaggc

SEQ ID NO: 1473045 - RNA, 22 nt, Pseudomonas aeruginosa PA01
cacgucgaugccuucggcggcc

SEQ ID NO: 1473046 - RNA, 13 nt, Pseudomonas aeruginosa PA01
cacgugcagcggc

SEQ ID NO: 1473047 - RNA, 14 nt, Pseudomonas aeruginosa PA01
cacgugcagcggca

SEQ ID NO: 1473048 - RNA, 16 nt, Pseudomonas aeruginosa PA01
cacgugcagcggcagc

SEQ ID NO: 1473049 - RNA, 16 nt, Pseudomonas aeruginosa PA01
cacgugcagcucggca

SEQ ID NO: 1473050 - RNA, 17 nt, Pseudomonas aeruginosa PA01
cacgugcagcucggcac

SEQ ID NO: 1473051 - RNA, 19 nt, Pseudomonas aeruginosa PA01
cacgugcagcucggcacgc

SEQ ID NO: 1473052 - RNA, 17 nt, Pseudomonas aeruginosa PA01
cacgugccccaggccga

SEQ ID NO: 1473053 - RNA, 13 nt, Pseudomonas aeruginosa PA01
cagacgcugccga

SEQ ID NO: 1473054 - RNA, 19 nt, Pseudomonas aeruginosa PA01
cagacgcggauuggccggg

SEQ ID NO: 1473055 - RNA, 16 nt, Pseudomonas aeruginosa PA01
cagacgcuccuuguag

SEQ ID NO: 1473056 - RNA, 19 nt, Pseudomonas aeruginosa PA01
cagacgcucggccagcguc

SEQ ID NO: 1473057 - RNA, 21 nt, Pseudomonas aeruginosa PA01
cagacgcucggccagcguccu

SEQ ID NO: 1473058 - RNA, 15 nt, Pseudomonas aeruginosa PA01
cagacgcucggcuuc

SEQ ID NO: 1473059 - RNA, 19 nt, Pseudomonas aeruginosa PA01
cagacgcucggcuucgcgu

SEQ ID NO: 1473060 - RNA, 16 nt, Pseudomonas aeruginosa PA01
cagacgguucagcagc

SEQ ID NO: 1473061 - RNA, 17 nt, Pseudomonas aeruginosa PA01
cagacgguucagcagcg

SEQ ID NO: 1473062 - RNA, 18 nt, Pseudomonas aeruginosa PA01
cagacgguucagcagcgg

SEQ ID NO: 1473063 - RNA, 20 nt, Pseudomonas aeruginosa PA01
cagacuccggcgcagcccag

SEQ ID NO: 1473064 - RNA, 15 nt, Pseudomonas aeruginosa PA01
cagacguccagcgcc

SEQ ID NO: 1473065 - RNA, 21 nt, Pseudomonas aeruginosa PA01
cagacguugcgcaucugcgcg

SEQ ID NO: 1473066 - RNA, 18 nt, Pseudomonas aeruginosa PA01
cagagaucgcccagcggc

SEQ ID NO: 1473067 - RNA, 19 nt, Pseudomonas aeruginosa PA01
cagagaucgcccagcggcu

SEQ ID NO: 1473068 - RNA, 14 nt, Pseudomonas aeruginosa PA01
cagagaucggcggc

SEQ ID NO: 1473069 - RNA, 15 nt, Pseudomonas aeruginosa PA01
cagagaucggcggcg

SEQ ID NO: 1473070 - RNA, 19 nt, Pseudomonas aeruginosa PA01
cagagcccgccgaacagca

SEQ ID NO: 1473071 - RNA, 21 nt, Pseudomonas aeruginosa PA01
cagagacgcagcgcuagcgca

SEQ ID NO: 1473072 - RNA, 13 nt, Pseudomonas aeruginosa PA01
cagagccagccgc

SEQ ID NO: 1473073 - RNA, 16 nt, Pseudomonas aeruginosa PA01
cagagccagccgcagc

SEQ ID NO: 1473074 - RNA, 19 nt, Pseudomonas aeruginosa PA01
cagagccagccgcagcccg

SEQ ID NO: 1473075 - RNA, 16 nt, Pseudomonas aeruginosa PA01
cagagccagccgcgag

SEQ ID NO: 1473076 - RNA, 16 nt, Pseudomonas aeruginosa PA01
cagagccaugggccgg

SEQ ID NO: 1473077 - RNA, 18 nt, Pseudomonas aeruginosa PA01
cagagccaugggccggcc

SEQ ID NO: 1473078 - RNA, 19 nt, Pseudomonas aeruginosa PA01
cagagccaugggccggccg

SEQ ID NO: 1473079 - RNA, 21 nt, Pseudomonas aeruginosa PA01
cagagccaugggccggccgac

SEQ ID NO: 1473080 - RNA, 20 nt, Pseudomonas aeruginosa PA01
cagagcaggcggaucgccgc

SEQ ID NO: 1473081 - RNA, 17 nt, Pseudomonas aeruginosa PA01
cagagcagagucgccgg

SEQ ID NO: 1473082 - RNA, 17 nt, Pseudomonas aeruginosa PA01
cagagcagcaccagcac

SEQ ID NO: 1473083 - RNA, 18 nt, Pseudomonas aeruginosa PA01
cagagcagcaccagcacc

SEQ ID NO: 1473084 - RNA, 14 nt, Pseudomonas aeruginosa PA01
cagaggcugcgcuc

SEQ ID NO: 1473085 - RNA, 19 nt, Pseudomonas aeruginosa PA01
cagaggcugcgcuccaggc

SEQ ID NO: 1473086 - RNA, 13 nt, Pseudomonas aeruginosa PA01
cagagggucgcca

SEQ ID NO: 1473087 - RNA, 17 nt, Pseudomonas aeruginosa PA01
cagagggucgccagcga

SEQ ID NO: 1473088 - RNA, 18 nt, Pseudomonas aeruginosa PA01
cagagggucgccagcgag

SEQ ID NO: 1473089 - RNA, 14 nt, Pseudomonas aeruginosa PA01
cagagggugaggcg

SEQ ID NO: 1473090 - RNA, 13 nt, Pseudomonas aeruginosa PA01
cagaggucgcuga

SEQ ID NO: 1473091 - RNA, 15 nt, Pseudomonas aeruginosa PA01
cagaggaaggcgccg

SEQ ID NO: 1473092 - RNA, 17 nt, Pseudomonas aeruginosa PA01
cagaggaaggcgccggc

SEQ ID NO: 1473093 - RNA, 20 nt, Pseudomonas aeruginosa PA01
cagaggcaacaccaucggcc

SEQ ID NO: 1473094 - RNA, 21 nt, Pseudomonas aeruginosa PA01
cagaggcauucaucaccagcu

SEQ ID NO: 1473095 - RNA, 24 nt, Pseudomonas aeruginosa PA01
cagaggcauucaucaccagcucgc

SEQ ID NO: 1473096 - RNA, 11 nt, Pseudomonas aeruginosa PA01
cagaggcgacc

SEQ ID NO: 1473097 - RNA, 17 nt, Pseudomonas aeruginosa PA01
cagaggcgaccagccgg

SEQ ID NO: 1473098 - RNA, 20 nt, Pseudomonas aeruginosa PA01
cagaggcgaccagccggggc

SEQ ID NO: 1473099 - RNA, 19 nt, Pseudomonas aeruginosa PA01
cagagcguaucgaugcgcg

SEQ ID NO: 1473100 - RNA, 20 nt, Pseudomonas aeruginosa PA01
cagagcguaucgaugcgcgc

SEQ ID NO: 1473101 - RNA, 14 nt, Pseudomonas aeruginosa PA01
cagagcgccagcca

SEQ ID NO: 1473102 - RNA, 20 nt, Pseudomonas aeruginosa PA01
cagagcgccagccagcgcgg

SEQ ID NO: 1473103 - RNA, 22 nt, Pseudomonas aeruginosa PA01
cagagcgccaugacccgcggca

SEQ ID NO: 1473104 - RNA, 16 nt, Pseudomonas aeruginosa PA01
cagagcggcaggccgc

SEQ ID NO: 1473105 - RNA, 19 nt, Pseudomonas aeruginosa PA01
cagagcggcaggccgccga

SEQ ID NO: 1473106 - RNA, 21 nt, Pseudomonas aeruginosa PA01
cagagcgcugccugcaccggg

SEQ ID NO: 1473107 - RNA, 14 nt, Pseudomonas aeruginosa PA01
cagcaacagcgccg

SEQ ID NO: 1473108 - RNA, 15 nt, Pseudomonas aeruginosa PA01
cagcaacagcgccgc

SEQ ID NO: 1473109 - RNA, 17 nt, Pseudomonas aeruginosa PA01
cagcaacaguugccgca

SEQ ID NO: 1473110 - RNA, 17 nt, Pseudomonas aeruginosa PA01
cagaugaaacugcccgg

SEQ ID NO: 1473111 - RNA, 21 nt, Pseudomonas aeruginosa PA01
cagaugaccagcgcaucggcg

SEQ ID NO: 1473112 - RNA, 12 nt, Pseudomonas aeruginosa PA01
cagaucggcgcg

SEQ ID NO: 1473113 - RNA, 23 nt, Pseudomonas aeruginosa PA01
cagaucggcgcgcagggccagca

SEQ ID NO: 1473114 - RNA, 17 nt, Pseudomonas aeruginosa PA01
cagaucggcauggccga

SEQ ID NO: 1473115 - RNA, 20 nt, Pseudomonas aeruginosa PA01
cagaucggcauggccgaccg

SEQ ID NO: 1473116 - RNA, 19 nt, Pseudomonas aeruginosa PA01
cagaucgcguccagggugc

SEQ ID NO: 1473117 - RNA, 14 nt, Pseudomonas aeruginosa PA01
cagaucgcggcgca

SEQ ID NO: 1473118 - RNA, 17 nt, Pseudomonas aeruginosa PA01
cagaucgcggcgcaggc

SEQ ID NO: 1473119 - RNA, 19 nt, Pseudomonas aeruginosa PA01
cagauccgggaaggccuga

SEQ ID NO: 1473120 - RNA, 20 nt, Pseudomonas aeruginosa PA01
cagaucgaggaccgacggca

SEQ ID NO: 1473121 - RNA, 23 nt, Pseudomonas aeruginosa PA01
cagaucgcauuguugcggucgcg

SEQ ID NO: 1473122 - RNA, 16 nt, Pseudomonas aeruginosa PA01
cagaucgccagcgcca

SEQ ID NO: 1473123 - RNA, 16 nt, Pseudomonas aeruginosa PA01
cagaucgccagcucgc

SEQ ID NO: 1473124 - RNA, 20 nt, Pseudomonas aeruginosa PA01
cagaucgccagcucgccgcg

SEQ ID NO: 1473125 - RNA, 22 nt, Pseudomonas aeruginosa PA01
cagaucgccaccccgccgcugg

SEQ ID NO: 1473126 - RNA, 13 nt, Pseudomonas aeruginosa PA01
cagaguucgccca

SEQ ID NO: 1473127 - RNA, 12 nt, Pseudomonas aeruginosa PA01
cagagucgccgg

SEQ ID NO: 1473128 - RNA, 14 nt, Pseudomonas aeruginosa PA01
cagagugcgcagca

SEQ ID NO: 1473129 - RNA, 16 nt, Pseudomonas aeruginosa PA01
cagagugcgcagcagc

SEQ ID NO: 1473130 - RNA, 22 nt, Pseudomonas aeruginosa PA01
cagaguuucucggucgccgcca

SEQ ID NO: 1473131 - RNA, 16 nt, Pseudomonas aeruginosa PA01
cagaguuuagccgcca

SEQ ID NO: 1473132 - RNA, 17 nt, Pseudomonas aeruginosa PA01
cagaguuuagccgccag

SEQ ID NO: 1473133 - RNA, 19 nt, Pseudomonas aeruginosa PA01
cagaucauguagagcaggc

SEQ ID NO: 1473134 - RNA, 13 nt, Pseudomonas aeruginosa PA01
cagauccagcggc

SEQ ID NO: 1473135 - RNA, 14 nt, Pseudomonas aeruginosa PA01
cagaucccaucgcc

SEQ ID NO: 1473136 - RNA, 15 nt, Pseudomonas aeruginosa PA01
cagaucccaucgccc

SEQ ID NO: 1473137 - RNA, 22 nt, Pseudomonas aeruginosa PA01
cagaccguggcgcuacgcucgc

SEQ ID NO: 1473138 - RNA, 21 nt, Pseudomonas aeruginosa PA01
cagaccgucgaucucgagcau

SEQ ID NO: 1473139 - RNA, 11 nt, Pseudomonas aeruginosa PA01
cagaccugcaa

SEQ ID NO: 1473140 - RNA, 21 nt, Pseudomonas aeruginosa PA01
cagaccugcaauuccaccggc

SEQ ID NO: 1473141 - RNA, 15 nt, Pseudomonas aeruginosa PA01
cagaccugcagcagg

SEQ ID NO: 1473142 - RNA, 14 nt, Pseudomonas aeruginosa PA01
cagaccugccgccc

SEQ ID NO: 1473143 - RNA, 15 nt, Pseudomonas aeruginosa PA01
cagaccugccgcccg

SEQ ID NO: 1473144 - RNA, 15 nt, Pseudomonas aeruginosa PA01
cagaccuggccgcug

SEQ ID NO: 1473145 - RNA, 16 nt, Pseudomonas aeruginosa PA01
cagaccuggccgcugu

SEQ ID NO: 1473146 - RNA, 16 nt, Pseudomonas aeruginosa PA01
cagaccggcagcgccg

SEQ ID NO: 1473147 - RNA, 19 nt, Pseudomonas aeruginosa PA01
cagaccggcagcgccgcca

SEQ ID NO: 1473148 - RNA, 22 nt, Pseudomonas aeruginosa PA01
cagaccggcagcgccgccagca

SEQ ID NO: 1473149 - RNA, 20 nt, Pseudomonas aeruginosa PA01
cagaccuuccagccgcgcgc

SEQ ID NO: 1473150 - RNA, 18 nt, Pseudomonas aeruginosa PA01
cagaccuucgaagacccc

SEQ ID NO: 1473151 - RNA, 18 nt, Pseudomonas aeruginosa PA01
cagacgaucuggcagucg

SEQ ID NO: 1473152 - RNA, 16 nt, Pseudomonas aeruginosa PA01
cagacgaucagcggcc

SEQ ID NO: 1473153 - RNA, 13 nt, Pseudomonas aeruginosa PA01
cagacgcagcagc

SEQ ID NO: 1473154 - RNA, 22 nt, Pseudomonas aeruginosa PA01
cagacgcagccguuggccagca

SEQ ID NO: 1473155 - RNA, 18 nt, Pseudomonas aeruginosa PA01
cagacacgccucaaggca

SEQ ID NO: 1473156 - RNA, 22 nt, Pseudomonas aeruginosa PA01
cagacacgaaaaagccggcgca

SEQ ID NO: 1473157 - RNA, 23 nt, Pseudomonas aeruginosa PA01
cagacacgaaaaagccggcgcau

SEQ ID NO: 1473158 - RNA, 15 nt, Pseudomonas aeruginosa PA01
cagaccacgcccugc

SEQ ID NO: 1473159 - RNA, 18 nt, Pseudomonas aeruginosa PA01
cagaccacgcccugcgcc

SEQ ID NO: 1473160 - RNA, 20 nt, Pseudomonas aeruginosa PA01
cagaccacgcccugcgccag

SEQ ID NO: 1473161 - RNA, 13 nt, Pseudomonas aeruginosa PA01
cagaccaggccga

SEQ ID NO: 1473162 - RNA, 13 nt, Pseudomonas aeruginosa PA01
cagacccaggugc

SEQ ID NO: 1473163 - RNA, 18 nt, Pseudomonas aeruginosa PA01
cagacccaggugcgcagg

SEQ ID NO: 1473164 - RNA, 21 nt, Pseudomonas aeruginosa PA01
cagacccaggugcgcaggcgc

SEQ ID NO: 1473165 - RNA, 22 nt, Pseudomonas aeruginosa PA01
cagacccaggugcgcaggcgcu

SEQ ID NO: 1473166 - RNA, 19 nt, Pseudomonas aeruginosa PA01
cagaccagcccuggcgcgg

SEQ ID NO: 1473167 - RNA, 15 nt, Pseudomonas aeruginosa PA01
cagaccagcgaaccg

SEQ ID NO: 1473168 - RNA, 19 nt, Pseudomonas aeruginosa PA01
cagaccagcgaaccgccgg

SEQ ID NO: 1473169 - RNA, 21 nt, Pseudomonas aeruginosa PA01
cagaccagcgaaccgccggcc

SEQ ID NO: 1473170 - RNA, 20 nt, Pseudomonas aeruginosa PA01
cagaccagcgcaagcggcgg

SEQ ID NO: 1473171 - RNA, 18 nt, Pseudomonas aeruginosa PA01
cagaccagcagcgcacca

SEQ ID NO: 1473172 - RNA, 18 nt, Pseudomonas aeruginosa PA01
cagaccagcagcggcagc

SEQ ID NO: 1473173 - RNA, 13 nt, Pseudomonas aeruginosa PA01
cagaccagcccca

SEQ ID NO: 1473174 - RNA, 14 nt, Pseudomonas aeruginosa PA01
cagaccgcagccgg

SEQ ID NO: 1473175 - RNA, 15 nt, Pseudomonas aeruginosa PA01
cagaccgcagccggc

SEQ ID NO: 1473176 - RNA, 13 nt, Pseudomonas aeruginosa PA01
cagaccgacccuc

SEQ ID NO: 1473177 - RNA, 20 nt, Pseudomonas aeruginosa PA01
cagaccgagauuggccgccu

SEQ ID NO: 1473178 - RNA, 19 nt, Pseudomonas aeruginosa PA01
cacucggcgaccacccggc

SEQ ID NO: 1473179 - RNA, 14 nt, Pseudomonas aeruginosa PA01
cacucggccaggcg

SEQ ID NO: 1473180 - RNA, 19 nt, Pseudomonas aeruginosa PA01
cacucggccaggcgccagg

SEQ ID NO: 1473181 - RNA, 20 nt, Pseudomonas aeruginosa PA01
cacucggccaggcgccaggg

SEQ ID NO: 1473182 - RNA, 15 nt, Pseudomonas aeruginosa PA01
cacuccggcagcacc

SEQ ID NO: 1473183 - RNA, 16 nt, Pseudomonas aeruginosa PA01
cacuccggcaggcgcu

SEQ ID NO: 1473184 - RNA, 13 nt, Pseudomonas aeruginosa PA01
cacuccaggcggc

SEQ ID NO: 1473185 - RNA, 17 nt, Pseudomonas aeruginosa PA01
cacucccguccagcgcu

SEQ ID NO: 1473186 - RNA, 19 nt, Pseudomonas aeruginosa PA01
cacucccaggcuggcggca

SEQ ID NO: 1473187 - RNA, 12 nt, Pseudomonas aeruginosa PA01
cacuucggcgcg

SEQ ID NO: 1473188 - RNA, 23 nt, Pseudomonas aeruginosa PA01
cacuucggcgguggggccgccga

SEQ ID NO: 1473189 - RNA, 17 nt, Pseudomonas aeruginosa PA01
cacuucguccggccgcc

SEQ ID NO: 1473190 - RNA, 20 nt, Pseudomonas aeruginosa PA01
cacuucguccggccgcccga

SEQ ID NO: 1473191 - RNA, 14 nt, Pseudomonas aeruginosa PA01
cacuugccgccgcc

SEQ ID NO: 1473192 - RNA, 22 nt, Pseudomonas aeruginosa PA01
cacuugccguccuucaggacga

SEQ ID NO: 1473193 - RNA, 17 nt, Pseudomonas aeruginosa PA01
cacucgugcaacggcac

SEQ ID NO: 1473194 - RNA, 17 nt, Pseudomonas aeruginosa PA01
cacuuccgucacgcccu

SEQ ID NO: 1473195 - RNA, 14 nt, Pseudomonas aeruginosa PA01
cacuuccucggcga

SEQ ID NO: 1473196 - RNA, 22 nt, Pseudomonas aeruginosa PA01
cacuuccggacugcccagcgcc

SEQ ID NO: 1473197 - RNA, 19 nt, Pseudomonas aeruginosa PA01
cacuuccggcccggccagg

SEQ ID NO: 1473198 - RNA, 23 nt, Pseudomonas aeruginosa PA01
cacuuccuucucccggcugguca

SEQ ID NO: 1473199 - RNA, 15 nt, Pseudomonas aeruginosa PA01
cacuucgcgcggggu

SEQ ID NO: 1473200 - RNA, 16 nt, Pseudomonas aeruginosa PA01
cacuuccuugcgaucg

SEQ ID NO: 1473201 - RNA, 23 nt, Pseudomonas aeruginosa PA01
cacuuccuuggugaucaccgccu

SEQ ID NO: 1473202 - RNA, 12 nt, Pseudomonas aeruginosa PA01
cacuucgaagcc

SEQ ID NO: 1473203 - RNA, 14 nt, Pseudomonas aeruginosa PA01
cacuucgaagccga

SEQ ID NO: 1473204 - RNA, 21 nt, Pseudomonas aeruginosa PA01
cagaacgucggcggggugauc

SEQ ID NO: 1473205 - RNA, 13 nt, Pseudomonas aeruginosa PA01
cagaagccgaccu

SEQ ID NO: 1473206 - RNA, 15 nt, Pseudomonas aeruginosa PA01
cagaagccgaccuug

SEQ ID NO: 1473207 - RNA, 14 nt, Pseudomonas aeruginosa PA01
cagaagccggccgg

SEQ ID NO: 1473208 - RNA, 15 nt, Pseudomonas aeruginosa PA01
cagaagccggccggg

SEQ ID NO: 1473209 - RNA, 18 nt, Pseudomonas aeruginosa PA01
cagaacuugcgcaccgcg

SEQ ID NO: 1473210 - RNA, 21 nt, Pseudomonas aeruginosa PA01
cagaacuugcgcaccgcgccg

SEQ ID NO: 1473211 - RNA, 23 nt, Pseudomonas aeruginosa PA01
cagaacuugcgcaccgcgccggg

SEQ ID NO: 1473212 - RNA, 22 nt, Pseudomonas aeruginosa PA01
cagaagaucagcgcggugagca

SEQ ID NO: 1473213 - RNA, 22 nt, Pseudomonas aeruginosa PA01
cagaagaucgccugcuggccgg

SEQ ID NO: 1473214 - RNA, 15 nt, Pseudomonas aeruginosa PA01
cagaagacgcccagc

SEQ ID NO: 1473215 - RNA, 19 nt, Pseudomonas aeruginosa PA01
cagaagacgcccagcaggg

SEQ ID NO: 1473216 - RNA, 17 nt, Pseudomonas aeruginosa PA01
cagaaaccgaucagcac

SEQ ID NO: 1473217 - RNA, 14 nt, Pseudomonas aeruginosa PA01
cagaacgccgcgca

SEQ ID NO: 1473218 - RNA, 20 nt, Pseudomonas aeruginosa PA01
cagaacgccgcgcaccucga

SEQ ID NO: 1473219 - RNA, 16 nt, Pseudomonas aeruginosa PA01
cagaaagccucaggcg

SEQ ID NO: 1473220 - RNA, 21 nt, Pseudomonas aeruginosa PA01
gauauaggcgacgaucagccc

SEQ ID NO: 1473221 - RNA, 22 nt, Pseudomonas aeruginosa PA01
gauauggccguagccggugccg

SEQ ID NO: 1473222 - RNA, 15 nt, Pseudomonas aeruginosa PA01
gauauggcuggcgca

SEQ ID NO: 1473223 - RNA, 22 nt, Pseudomonas aeruginosa PA01
gauaugggugaugaccccggcg

SEQ ID NO: 1473224 - RNA, 21 nt, Pseudomonas aeruginosa PA01
gauauggaccggcucgucggc

SEQ ID NO: 1473225 - RNA, 22 nt, Pseudomonas aeruginosa PA01
gauauggaccggcucgucggcg

SEQ ID NO: 1473226 - RNA, 14 nt, Pseudomonas aeruginosa PA01
gauaugcgccgcca

SEQ ID NO: 1473227 - RNA, 18 nt, Pseudomonas aeruginosa PA01
gauaugccgcucagcgga

SEQ ID NO: 1473228 - RNA, 12 nt, Pseudomonas aeruginosa PA01
gaucaccugcuu

SEQ ID NO: 1473229 - RNA, 20 nt, Pseudomonas aeruginosa PA01
gaucaccugcuucugguugc

SEQ ID NO: 1473230 - RNA, 15 nt, Pseudomonas aeruginosa PA01
gaucaccuggaucgc

SEQ ID NO: 1473231 - RNA, 17 nt, Pseudomonas aeruginosa PA01
gaucaccuggccgguga

SEQ ID NO: 1473232 - RNA, 23 nt, Pseudomonas aeruginosa PA01
gaucaccucgaaccccuggcgcu

SEQ ID NO: 1473233 - RNA, 13 nt, Pseudomonas aeruginosa PA01
gaucaccggggcc

SEQ ID NO: 1473234 - RNA, 22 nt, Pseudomonas aeruginosa PA01
gaucaccgcguccauccccgcc

SEQ ID NO: 1473235 - RNA, 15 nt, Pseudomonas aeruginosa PA01
gaucaccggcuggcc

SEQ ID NO: 1473236 - RNA, 17 nt, Pseudomonas aeruginosa PA01
gaucaccggcuggcccu

SEQ ID NO: 1473237 - RNA, 17 nt, Pseudomonas aeruginosa PA01
gaucaccgcggcgcuga

SEQ ID NO: 1473238 - RNA, 19 nt, Pseudomonas aeruginosa PA01
gaucaccgcggcgcugaag

SEQ ID NO: 1473239 - RNA, 17 nt, Pseudomonas aeruginosa PA01
gaucagcagcagcgcca

SEQ ID NO: 1473240 - RNA, 19 nt, Pseudomonas aeruginosa PA01
gaucagcagcagcgccaug

SEQ ID NO: 1473241 - RNA, 11 nt, Pseudomonas aeruginosa PA01
gaucagcaccc

SEQ ID NO: 1473242 - RNA, 14 nt, Pseudomonas aeruginosa PA01
gaucagcaccgcca

SEQ ID NO: 1473243 - RNA, 19 nt, Pseudomonas aeruginosa PA01
gaucagcaccgccaccagc

SEQ ID NO: 1473244 - RNA, 21 nt, Pseudomonas aeruginosa PA01
gaucagcaccgccaccagcga

SEQ ID NO: 1473245 - RNA, 16 nt, Pseudomonas aeruginosa PA01
gaucagcaccagcgga

SEQ ID NO: 1473246 - RNA, 20 nt, Pseudomonas aeruginosa PA01
gaucacgucguacucggcgg

SEQ ID NO: 1473247 - RNA, 21 nt, Pseudomonas aeruginosa PA01
gaucacgucguacucggcggg

SEQ ID NO: 1473248 - RNA, 17 nt, Pseudomonas aeruginosa PA01
gaucacucccugcucgc

SEQ ID NO: 1473249 - RNA, 14 nt, Pseudomonas aeruginosa PA01
gaucacucgccgcc

SEQ ID NO: 1473250 - RNA, 15 nt, Pseudomonas aeruginosa PA01
gaucacucgccgccg

SEQ ID NO: 1473251 - RNA, 16 nt, Pseudomonas aeruginosa PA01
gaucacucgccgccgu

SEQ ID NO: 1473252 - RNA, 13 nt, Pseudomonas aeruginosa PA01
gaucagccacggg

SEQ ID NO: 1473253 - RNA, 22 nt, Pseudomonas aeruginosa PA01
gaucagccacgggcgccagcgg

SEQ ID NO: 1473254 - RNA, 16 nt, Pseudomonas aeruginosa PA01
gaucagcccgucggcc

SEQ ID NO: 1473255 - RNA, 17 nt, Pseudomonas aeruginosa PA01
gaucagcccuucgcgcu

SEQ ID NO: 1473256 - RNA, 18 nt, Pseudomonas aeruginosa PA01
gaucagcccuucgcgcuc

SEQ ID NO: 1473257 - RNA, 19 nt, Pseudomonas aeruginosa PA01
gaucagcccuucgcgcucg

SEQ ID NO: 1473258 - RNA, 20 nt, Pseudomonas aeruginosa PA01
gaucagcccuucgcgcucga

SEQ ID NO: 1473259 - RNA, 20 nt, Pseudomonas aeruginosa PA01
gaucagccauuggccgacgc

SEQ ID NO: 1473260 - RNA, 22 nt, Pseudomonas aeruginosa PA01
gaucagccauuggccgacgccg

SEQ ID NO: 1473261 - RNA, 14 nt, Pseudomonas aeruginosa PA01
gaucagccagggca

SEQ ID NO: 1473262 - RNA, 23 nt, Pseudomonas aeruginosa PA01
gaucagccagggcaacgccaggc

SEQ ID NO: 1473263 - RNA, 16 nt, Pseudomonas aeruginosa PA01
gaucagccagccggcg

SEQ ID NO: 1473264 - RNA, 17 nt, Pseudomonas aeruginosa PA01
gaucagccagccggcga

SEQ ID NO: 1473265 - RNA, 17 nt, Pseudomonas aeruginosa PA01
gaucagcccgccggcga

SEQ ID NO: 1473266 - RNA, 16 nt, Pseudomonas aeruginosa PA01
gaucagcccgcugacc

SEQ ID NO: 1473267 - RNA, 22 nt, Pseudomonas aeruginosa PA01
gaucagcccgcugaccgggcgg

SEQ ID NO: 1473268 - RNA, 21 nt, Pseudomonas aeruginosa PA01
gaucagcccgccaacguccuc

SEQ ID NO: 1473269 - RNA, 13 nt, Pseudomonas aeruginosa PA01
gaucagccgcagg

SEQ ID NO: 1473270 - RNA, 15 nt, Pseudomonas aeruginosa PA01
gaucagccgcaggca

SEQ ID NO: 1473271 - RNA, 14 nt, Pseudomonas aeruginosa PA01
gaucagccgcucca

SEQ ID NO: 1473272 - RNA, 21 nt, Pseudomonas aeruginosa PA01
gaucagccgcuccaggaucgc

SEQ ID NO: 1473273 - RNA, 19 nt, Pseudomonas aeruginosa PA01
gaucagcgagcuucgccgc

SEQ ID NO: 1473274 - RNA, 20 nt, Pseudomonas aeruginosa PA01
gaucagcgagcuucgccgcg

SEQ ID NO: 1473275 - RNA, 21 nt, Pseudomonas aeruginosa PA01
gaucagcgagcuucgccgcgc

SEQ ID NO: 1473276 - RNA, 16 nt, Pseudomonas aeruginosa PA01
gaucagccggcgcgcu

SEQ ID NO: 1473277 - RNA, 18 nt, Pseudomonas aeruginosa PA01
gaucagccgggcgugucg

SEQ ID NO: 1473278 - RNA, 13 nt, Pseudomonas aeruginosa PA01
gauagaucaggcc

SEQ ID NO: 1473279 - RNA, 18 nt, Pseudomonas aeruginosa PA01
gauagcgcgcaggcgcua

SEQ ID NO: 1473280 - RNA, 21 nt, Pseudomonas aeruginosa PA01
gauaccucguuucccggcgcg

SEQ ID NO: 1473281 - RNA, 22 nt, Pseudomonas aeruginosa PA01
gauacgcaggaacuggucgauc

SEQ ID NO: 1473282 - RNA, 15 nt, Pseudomonas aeruginosa PA01
gauacgcaucugcuc

SEQ ID NO: 1473283 - RNA, 19 nt, Pseudomonas aeruginosa PA01
gauagagcuucucgucgcc

SEQ ID NO: 1473284 - RNA, 20 nt, Pseudomonas aeruginosa PA01
gauaccggccaucagcacca

SEQ ID NO: 1473285 - RNA, 21 nt, Pseudomonas aeruginosa PA01
gauaccggccaucagcaccag

SEQ ID NO: 1473286 - RNA, 14 nt, Pseudomonas aeruginosa PA01
gauaccagcgccgc

SEQ ID NO: 1473287 - RNA, 15 nt, Pseudomonas aeruginosa PA01
gauaccagcgccgcu

SEQ ID NO: 1473288 - RNA, 16 nt, Pseudomonas aeruginosa PA01
gauaccagcgccgcuc

SEQ ID NO: 1473289 - RNA, 14 nt, Pseudomonas aeruginosa PA01
gauacccaccggcu

SEQ ID NO: 1473290 - RNA, 18 nt, Pseudomonas aeruginosa PA01
gauacccaccggcucgcu

SEQ ID NO: 1473291 - RNA, 22 nt, Pseudomonas aeruginosa PA01
gauacccaggccgucgagggca

SEQ ID NO: 1473292 - RNA, 14 nt, Pseudomonas aeruginosa PA01
gauaccacccgcag

SEQ ID NO: 1473293 - RNA, 14 nt, Pseudomonas aeruginosa PA01
gauacaggcgcagc

SEQ ID NO: 1473294 - RNA, 17 nt, Pseudomonas aeruginosa PA01
gaguuugcccagcgccg

SEQ ID NO: 1473295 - RNA, 12 nt, Pseudomonas aeruginosa PA01
gaguuccgcgca

SEQ ID NO: 1473296 - RNA, 16 nt, Pseudomonas aeruginosa PA01
gaguucgcccgcccca

SEQ ID NO: 1473297 - RNA, 13 nt, Pseudomonas aeruginosa PA01
gaguucgccggcc

SEQ ID NO: 1473298 - RNA, 18 nt, Pseudomonas aeruginosa PA01
gaguucccagaccuggcc

SEQ ID NO: 1473299 - RNA, 19 nt, Pseudomonas aeruginosa PA01
gaguucccagaccuggccg

SEQ ID NO: 1473300 - RNA, 23 nt, Pseudomonas aeruginosa PA01
gaguucccagaccuggccgcugu

SEQ ID NO: 1473301 - RNA, 12 nt, Pseudomonas aeruginosa PA01
gaguggccgcug

SEQ ID NO: 1473302 - RNA, 15 nt, Pseudomonas aeruginosa PA01
gagugcgcagcagcg

SEQ ID NO: 1473303 - RNA, 20 nt, Pseudomonas aeruginosa PA01
gagugcgcccagcagcaggc

SEQ ID NO: 1473304 - RNA, 18 nt, Pseudomonas aeruginosa PA01
gagugcccaggcgcuggc

SEQ ID NO: 1473305 - RNA, 21 nt, Pseudomonas aeruginosa PA01
gagugcccaggcgcuggcgcc

SEQ ID NO: 1473306 - RNA, 20 nt, Pseudomonas aeruginosa PA01
gaguggcgcggcugaucggc

SEQ ID NO: 1473307 - RNA, 21 nt, Pseudomonas aeruginosa PA01
gagguugccgccgaucagcgc

SEQ ID NO: 1473308 - RNA, 20 nt, Pseudomonas aeruginosa PA01
gagguugcgcggcaggacga

SEQ ID NO: 1473309 - RNA, 23 nt, Pseudomonas aeruginosa PA01
gagguucuuccacuugcgccggc

SEQ ID NO: 1473310 - RNA, 20 nt, Pseudomonas aeruginosa PA01
gagguucuugcccagcaacg

SEQ ID NO: 1473311 - RNA, 19 nt, Pseudomonas aeruginosa PA01
gaggugggcgcgccgcagu

SEQ ID NO: 1473312 - RNA, 20 nt, Pseudomonas aeruginosa PA01
gaggucaguucggugccgcc

SEQ ID NO: 1473313 - RNA, 22 nt, Pseudomonas aeruginosa PA01
gaggucaguucggugccgccgg

SEQ ID NO: 1473314 - RNA, 22 nt, Pseudomonas aeruginosa PA01
gaggucgaaagcuucgucgcgc

SEQ ID NO: 1473315 - RNA, 23 nt, Pseudomonas aeruginosa PA01
gaggucgaccagccagucggcgg

SEQ ID NO: 1473316 - RNA, 17 nt, Pseudomonas aeruginosa PA01
gaggucgacggcggccg

SEQ ID NO: 1473317 - RNA, 17 nt, Pseudomonas aeruginosa PA01
gaggucgcacgcagcgc

SEQ ID NO: 1473318 - RNA, 19 nt, Pseudomonas aeruginosa PA01
gaggucgcacgcagcgccg

SEQ ID NO: 1473319 - RNA, 19 nt, Pseudomonas aeruginosa PA01
gagucggcaacgauaccgc

SEQ ID NO: 1473320 - RNA, 16 nt, Pseudomonas aeruginosa PA01
gagucgccggcgaacu

SEQ ID NO: 1473321 - RNA, 14 nt, Pseudomonas aeruginosa PA01
gagucgcucgcgca

SEQ ID NO: 1473322 - RNA, 15 nt, Pseudomonas aeruginosa PA01
gagucgcucgcgcag

SEQ ID NO: 1473323 - RNA, 18 nt, Pseudomonas aeruginosa PA01
gagcagcaccacggcgau

SEQ ID NO: 1473324 - RNA, 14 nt, Pseudomonas aeruginosa PA01
gagcagcaccagca

SEQ ID NO: 1473325 - RNA, 16 nt, Pseudomonas aeruginosa PA01
gagcagcaccagcacc

SEQ ID NO: 1473326 - RNA, 17 nt, Pseudomonas aeruginosa PA01
gagcagcaccagcacca

SEQ ID NO: 1473327 - RNA, 16 nt, Pseudomonas aeruginosa PA01
gagcagcaccaggcug

SEQ ID NO: 1473328 - RNA, 19 nt, Pseudomonas aeruginosa PA01
gaggcauucaucaccagcu

SEQ ID NO: 1473329 - RNA, 16 nt, Pseudomonas aeruginosa PA01
gaggcauucucgcgac

SEQ ID NO: 1473330 - RNA, 22 nt, Pseudomonas aeruginosa PA01
gaggcauucucgcgacccuggc

SEQ ID NO: 1473331 - RNA, 12 nt, Pseudomonas aeruginosa PA01
gagcagagucgc

SEQ ID NO: 1473332 - RNA, 15 nt, Pseudomonas aeruginosa PA01
gaggccgagccgaca

SEQ ID NO: 1473333 - RNA, 16 nt, Pseudomonas aeruginosa PA01
gaggccgagccgacau

SEQ ID NO: 1473334 - RNA, 16 nt, Pseudomonas aeruginosa PA01
gaggccgaccuugucc

SEQ ID NO: 1473335 - RNA, 17 nt, Pseudomonas aeruginosa PA01
gaggccgaccuugucca

SEQ ID NO: 1473336 - RNA, 22 nt, Pseudomonas aeruginosa PA01
gaggccgacgaacagccagagg

SEQ ID NO: 1473337 - RNA, 23 nt, Pseudomonas aeruginosa PA01
gaggccggcaugcagguggcgcu

SEQ ID NO: 1473338 - RNA, 18 nt, Pseudomonas aeruginosa PA01
gaggccggccccaccagc

SEQ ID NO: 1473339 - RNA, 17 nt, Pseudomonas aeruginosa PA01
gaggccgcccagcgcag

SEQ ID NO: 1473340 - RNA, 18 nt, Pseudomonas aeruginosa PA01
gaggccgcccagcgcagc

SEQ ID NO: 1473341 - RNA, 18 nt, Pseudomonas aeruginosa PA01
gaggccgccgcgggcaac

SEQ ID NO: 1473342 - RNA, 19 nt, Pseudomonas aeruginosa PA01
gaggccgcccuggccgagc

SEQ ID NO: 1473343 - RNA, 14 nt, Pseudomonas aeruginosa PA01
gaggcccagcgacu

SEQ ID NO: 1473344 - RNA, 19 nt, Pseudomonas aeruginosa PA01
gaggcccagcgacuccgcc

SEQ ID NO: 1473345 - RNA, 16 nt, Pseudomonas aeruginosa PA01
gaggcccucggcgccg

SEQ ID NO: 1473346 - RNA, 17 nt, Pseudomonas aeruginosa PA01
gaggcccucggcgccga

SEQ ID NO: 1473347 - RNA, 19 nt, Pseudomonas aeruginosa PA01
gaggcccucggcgccgagc

SEQ ID NO: 1473348 - RNA, 22 nt, Pseudomonas aeruginosa PA01
gaggccauccccgaggcgacgc

SEQ ID NO: 1473349 - RNA, 18 nt, Pseudomonas aeruginosa PA01
gaggcccacgggcggccg

SEQ ID NO: 1473350 - RNA, 13 nt, Pseudomonas aeruginosa PA01
gaggccagcaggc

SEQ ID NO: 1473351 - RNA, 15 nt, Pseudomonas aeruginosa PA01
gaggccaggaucguc

SEQ ID NO: 1473352 - RNA, 20 nt, Pseudomonas aeruginosa PA01
gaggccaggaucgucggccc

SEQ ID NO: 1473353 - RNA, 14 nt, Pseudomonas aeruginosa PA01
gaggccaggccgag

SEQ ID NO: 1473354 - RNA, 21 nt, Pseudomonas aeruginosa PA01
gaggccaggccgagcgccagg

SEQ ID NO: 1473355 - RNA, 15 nt, Pseudomonas aeruginosa PA01
gagggcgucccgcug

SEQ ID NO: 1473356 - RNA, 14 nt, Pseudomonas aeruginosa PA01
gagggcgcggcgcc

SEQ ID NO: 1473357 - RNA, 15 nt, Pseudomonas aeruginosa PA01
gagggcgcggcgcca

SEQ ID NO: 1473358 - RNA, 14 nt, Pseudomonas aeruginosa PA01
gagggcggcgaccg

SEQ ID NO: 1473359 - RNA, 16 nt, Pseudomonas aeruginosa PA01
gagggcggcgaccugg

SEQ ID NO: 1473360 - RNA, 21 nt, Pseudomonas aeruginosa PA01
gagggcggcggcucaggccgc

SEQ ID NO: 1473361 - RNA, 23 nt, Pseudomonas aeruginosa PA01
gagggcggcggcucaggccgccg

SEQ ID NO: 1473362 - RNA, 13 nt, Pseudomonas aeruginosa PA01
gagggcgccaggu

SEQ ID NO: 1473363 - RNA, 16 nt, Pseudomonas aeruginosa PA01
gagggcgccaggugca

SEQ ID NO: 1473364 - RNA, 23 nt, Pseudomonas aeruginosa PA01
gagggcgaagaucucgccauggc

SEQ ID NO: 1473365 - RNA, 21 nt, Pseudomonas aeruginosa PA01
gagggcgacguugcgcagggg

SEQ ID NO: 1473366 - RNA, 16 nt, Pseudomonas aeruginosa PA01
gagggccucggcgaag

SEQ ID NO: 1473367 - RNA, 15 nt, Pseudomonas aeruginosa PA01
gagggccgcgcugcu

SEQ ID NO: 1473368 - RNA, 16 nt, Pseudomonas aeruginosa PA01
gagguagcugcgccgc

SEQ ID NO: 1473369 - RNA, 14 nt, Pseudomonas aeruginosa PA01
gagguagagcacgc

SEQ ID NO: 1473370 - RNA, 22 nt, Pseudomonas aeruginosa PA01
gagguagagcacgccgucgcgc

SEQ ID NO: 1473371 - RNA, 22 nt, Pseudomonas aeruginosa PA01
gaggccguaccagucgcccgcu

SEQ ID NO: 1473372 - RNA, 19 nt, Pseudomonas aeruginosa PA01
gaggcgcuccaccagggcc

SEQ ID NO: 1473373 - RNA, 14 nt, Pseudomonas aeruginosa PA01
gaggcgcuggccag

SEQ ID NO: 1473374 - RNA, 15 nt, Pseudomonas aeruginosa PA01
gaggcgcuggccagc

SEQ ID NO: 1473375 - RNA, 18 nt, Pseudomonas aeruginosa PA01
gaggccgucgaaguggac

SEQ ID NO: 1473376 - RNA, 20 nt, Pseudomonas aeruginosa PA01
gaggccgucgaaguggacga

SEQ ID NO: 1473377 - RNA, 22 nt, Pseudomonas aeruginosa PA01
gaggcgcucaacgccucgcggc

SEQ ID NO: 1473378 - RNA, 19 nt, Pseudomonas aeruginosa PA01
gaggcgcuucugcucggcc

SEQ ID NO: 1473379 - RNA, 20 nt, Pseudomonas aeruginosa PA01
gaggcgcuucugcucggccu

SEQ ID NO: 1473380 - RNA, 13 nt, Pseudomonas aeruginosa PA01
gaggcggcgguca

SEQ ID NO: 1473381 - RNA, 14 nt, Pseudomonas aeruginosa PA01
gaggcgggccagca

SEQ ID NO: 1473382 - RNA, 14 nt, Pseudomonas aeruginosa PA01
gagggacugaagag

SEQ ID NO: 1473383 - RNA, 15 nt, Pseudomonas aeruginosa PA01
gagggagcgccuggc

SEQ ID NO: 1473384 - RNA, 16 nt, Pseudomonas aeruginosa PA01
gagggaggaggcgccg

SEQ ID NO: 1473385 - RNA, 19 nt, Pseudomonas aeruginosa PA01
gagggcaggaaccagacgu

SEQ ID NO: 1473386 - RNA, 22 nt, Pseudomonas aeruginosa PA01
gagggcaugaccgauggcgccg

SEQ ID NO: 1473387 - RNA, 14 nt, Pseudomonas aeruginosa PA01
gaggcgggcuggaa

SEQ ID NO: 1473388 - RNA, 16 nt, Pseudomonas aeruginosa PA01
gagggcaaaggcgcgc

SEQ ID NO: 1473389 - RNA, 12 nt, Pseudomonas aeruginosa PA01
gaugaaucgccu

SEQ ID NO: 1473390 - RNA, 16 nt, Pseudomonas aeruginosa PA01
gaugaaggucagcacg

SEQ ID NO: 1473391 - RNA, 19 nt, Pseudomonas aeruginosa PA01
gaugaagaagccauugccg

SEQ ID NO: 1473392 - RNA, 13 nt, Pseudomonas aeruginosa PA01
gaugaagcgccgc

SEQ ID NO: 1473393 - RNA, 14 nt, Pseudomonas aeruginosa PA01
gaugaacgccgcga

SEQ ID NO: 1473394 - RNA, 17 nt, Pseudomonas aeruginosa PA01
gaugaacagugcgcccg

SEQ ID NO: 1473395 - RNA, 22 nt, Pseudomonas aeruginosa PA01
gaugaaauagcucugccgaucc

SEQ ID NO: 1473396 - RNA, 16 nt, Pseudomonas aeruginosa PA01
gaugaacaaccgcuug

SEQ ID NO: 1473397 - RNA, 22 nt, Pseudomonas aeruginosa PA01
gaugaacaagugcucgauggcg

SEQ ID NO: 1473398 - RNA, 20 nt, Pseudomonas aeruginosa PA01
gaucugugcggugccgcgca

SEQ ID NO: 1473399 - RNA, 22 nt, Pseudomonas aeruginosa PA01
gaucugugcggugccgcgcagc

SEQ ID NO: 1473400 - RNA, 18 nt, Pseudomonas aeruginosa PA01
gaucugcaugccguccgg

SEQ ID NO: 1473401 - RNA, 19 nt, Pseudomonas aeruginosa PA01
gaucugccgguaggucacc

SEQ ID NO: 1473402 - RNA, 21 nt, Pseudomonas aeruginosa PA01
gaucuggguuucgucgcggac

SEQ ID NO: 1473403 - RNA, 21 nt, Pseudomonas aeruginosa PA01
gaucugguagaccaccgugcg

SEQ ID NO: 1473404 - RNA, 23 nt, Pseudomonas aeruginosa PA01
gaucugcgaauagacgccgcuga

SEQ ID NO: 1473405 - RNA, 16 nt, Pseudomonas aeruginosa PA01
gaucugcgagcgcaca

SEQ ID NO: 1473406 - RNA, 15 nt, Pseudomonas aeruginosa PA01
gaucugcaccgccca

SEQ ID NO: 1473407 - RNA, 22 nt, Pseudomonas aeruginosa PA01
gaucucuacuaccgccagcgca

SEQ ID NO: 1473408 - RNA, 18 nt, Pseudomonas aeruginosa PA01
gaucucuucccggcucgg

SEQ ID NO: 1473409 - RNA, 23 nt, Pseudomonas aeruginosa PA01
gaucucgcaguacucguguucgg

SEQ ID NO: 1473410 - RNA, 13 nt, Pseudomonas aeruginosa PA01
gaucucgucgccg

SEQ ID NO: 1473411 - RNA, 16 nt, Pseudomonas aeruginosa PA01
gaucucgucgccgacc

SEQ ID NO: 1473412 - RNA, 21 nt, Pseudomonas aeruginosa PA01
gaucucgugcuuggugucggc

SEQ ID NO: 1473413 - RNA, 19 nt, Pseudomonas aeruginosa PA01
gaucucgugggccagcagg

SEQ ID NO: 1473414 - RNA, 20 nt, Pseudomonas aeruginosa PA01
gaucucguucggguagucga

SEQ ID NO: 1473415 - RNA, 18 nt, Pseudomonas aeruginosa PA01
gaucuccuccgccccggc

SEQ ID NO: 1473416 - RNA, 23 nt, Pseudomonas aeruginosa PA01
gaucuccuccgccccggcaagcg

SEQ ID NO: 1473417 - RNA, 18 nt, Pseudomonas aeruginosa PA01
gaucuccuccucggcggc

SEQ ID NO: 1473418 - RNA, 18 nt, Pseudomonas aeruginosa PA01
gaucuccucgacggcggg

SEQ ID NO: 1473419 - RNA, 16 nt, Pseudomonas aeruginosa PA01
gaucuccucgauccgc

SEQ ID NO: 1473420 - RNA, 16 nt, Pseudomonas aeruginosa PA01
gaucuccucgcgcagc

SEQ ID NO: 1473421 - RNA, 20 nt, Pseudomonas aeruginosa PA01
gaucuccucgcgcagcggcu

SEQ ID NO: 1473422 - RNA, 17 nt, Pseudomonas aeruginosa PA01
gaucuccugcugggcgu

SEQ ID NO: 1473423 - RNA, 19 nt, Pseudomonas aeruginosa PA01
gaucucgaagaccagcgga

SEQ ID NO: 1473424 - RNA, 13 nt, Pseudomonas aeruginosa PA01
gaucucccgcgau

SEQ ID NO: 1473425 - RNA, 18 nt, Pseudomonas aeruginosa PA01
gaucuccgccaggcggcc

SEQ ID NO: 1473426 - RNA, 13 nt, Pseudomonas aeruginosa PA01
gaucuccgcgcca

SEQ ID NO: 1473427 - RNA, 19 nt, Pseudomonas aeruginosa PA01
gaucuccgcgccacgcgca

SEQ ID NO: 1473428 - RNA, 13 nt, Pseudomonas aeruginosa PA01
gaucuccgcgccg

SEQ ID NO: 1473429 - RNA, 14 nt, Pseudomonas aeruginosa PA01
gaucuccgcgccgg

SEQ ID NO: 1473430 - RNA, 15 nt, Pseudomonas aeruginosa PA01
gaucguaggcgcgca

SEQ ID NO: 1473431 - RNA, 15 nt, Pseudomonas aeruginosa PA01
gaucgguucccgccc

SEQ ID NO: 1473432 - RNA, 24 nt, Pseudomonas aeruginosa PA01
gaucguccgggcgguacaggcgca

SEQ ID NO: 1473433 - RNA, 12 nt, Pseudomonas aeruginosa PA01
gaucgucggccc

SEQ ID NO: 1473434 - RNA, 14 nt, Pseudomonas aeruginosa PA01
gaucgucgccaagc

SEQ ID NO: 1473435 - RNA, 20 nt, Pseudomonas aeruginosa PA01
gaucgucgagaugcugcggg

SEQ ID NO: 1473436 - RNA, 13 nt, Pseudomonas aeruginosa PA01
gaucggcagcauc

SEQ ID NO: 1473437 - RNA, 18 nt, Pseudomonas aeruginosa PA01
gaucggcagcaucagccg

SEQ ID NO: 1473438 - RNA, 12 nt, Pseudomonas aeruginosa PA01
gaucggcagccg

SEQ ID NO: 1473439 - RNA, 20 nt, Pseudomonas aeruginosa PA01
gaucggcagccguccgccca

SEQ ID NO: 1473440 - RNA, 14 nt, Pseudomonas aeruginosa PA01
gaucggcaccauca

SEQ ID NO: 1473441 - RNA, 14 nt, Pseudomonas aeruginosa PA01
gaucggcaggcugg

SEQ ID NO: 1473442 - RNA, 16 nt, Pseudomonas aeruginosa PA01
gaucggcaggcuggcg

SEQ ID NO: 1473443 - RNA, 17 nt, Pseudomonas aeruginosa PA01
gaucggcaggcuggcgu

SEQ ID NO: 1473444 - RNA, 16 nt, Pseudomonas aeruginosa PA01
gaucggcagggcgccg

SEQ ID NO: 1473445 - RNA, 17 nt, Pseudomonas aeruginosa PA01
gaucggcagggcgccga

SEQ ID NO: 1473446 - RNA, 23 nt, Pseudomonas aeruginosa PA01
gaucggauugaggacgcugggac

SEQ ID NO: 1473447 - RNA, 12 nt, Pseudomonas aeruginosa PA01
gaucgcccuggc

SEQ ID NO: 1473448 - RNA, 19 nt, Pseudomonas aeruginosa PA01
gaucgcccuggcgccagcg

SEQ ID NO: 1473449 - RNA, 20 nt, Pseudomonas aeruginosa PA01
gaucgcccuggcgccagcgu

SEQ ID NO: 1473450 - RNA, 21 nt, Pseudomonas aeruginosa PA01
gaucgccgaaaaauucagcgc

SEQ ID NO: 1473451 - RNA, 16 nt, Pseudomonas aeruginosa PA01
gaucgcggccuucucg

SEQ ID NO: 1473452 - RNA, 21 nt, Pseudomonas aeruginosa PA01
gaucgcggccuucucgucgcc

SEQ ID NO: 1473453 - RNA, 22 nt, Pseudomonas aeruginosa PA01
gaucgcggccuucucgucgccg

SEQ ID NO: 1473454 - RNA, 15 nt, Pseudomonas aeruginosa PA01
gaucgcccgaacgcc

SEQ ID NO: 1473455 - RNA, 18 nt, Pseudomonas aeruginosa PA01
gaucgcccgaacgccgac

SEQ ID NO: 1473456 - RNA, 17 nt, Pseudomonas aeruginosa PA01
gaucgcccgcgccucga

SEQ ID NO: 1473457 - RNA, 15 nt, Pseudomonas aeruginosa PA01
gaucgcccggcgcuc

SEQ ID NO: 1473458 - RNA, 17 nt, Pseudomonas aeruginosa PA01
gaucgcccagcggcugg

SEQ ID NO: 1473459 - RNA, 19 nt, Pseudomonas aeruginosa PA01
gaucgcccagcggcuggcg

SEQ ID NO: 1473460 - RNA, 20 nt, Pseudomonas aeruginosa PA01
gaucgcccagcggcuggcgg

SEQ ID NO: 1473461 - RNA, 17 nt, Pseudomonas aeruginosa PA01
gaucggcauggccgacc

SEQ ID NO: 1473462 - RNA, 19 nt, Pseudomonas aeruginosa PA01
gaucggcauggccgaccgc

SEQ ID NO: 1473463 - RNA, 20 nt, Pseudomonas aeruginosa PA01
gaucggcauggccgaccgcc

SEQ ID NO: 1473464 - RNA, 21 nt, Pseudomonas aeruginosa PA01
gaucggccaacugagcggcgg

SEQ ID NO: 1473465 - RNA, 14 nt, Pseudomonas aeruginosa PA01
gaucggcuccagcu

SEQ ID NO: 1473466 - RNA, 13 nt, Pseudomonas aeruginosa PA01
gaucggcguccgc

SEQ ID NO: 1473467 - RNA, 14 nt, Pseudomonas aeruginosa PA01
gaucggcguccgcg

SEQ ID NO: 1473468 - RNA, 17 nt, Pseudomonas aeruginosa PA01
gaucggcguccgcggcc

SEQ ID NO: 1473469 - RNA, 22 nt, Pseudomonas aeruginosa PA01
gaucggcuugaagugauccagg

SEQ ID NO: 1473470 - RNA, 17 nt, Pseudomonas aeruginosa PA01
gaucggcugcaacgccg

SEQ ID NO: 1473471 - RNA, 20 nt, Pseudomonas aeruginosa PA01
gaucggcugcaacgccggcc

SEQ ID NO: 1473472 - RNA, 18 nt, Pseudomonas aeruginosa PA01
gaucgggcuucggcagca

SEQ ID NO: 1473473 - RNA, 19 nt, Pseudomonas aeruginosa PA01
gaucggggaagggacgucg

SEQ ID NO: 1473474 - RNA, 18 nt, Pseudomonas aeruginosa PA01
gaucggguagagcgcggc

SEQ ID NO: 1473475 - RNA, 19 nt, Pseudomonas aeruginosa PA01
gaucggguagagcgcggcg

SEQ ID NO: 1473476 - RNA, 21 nt, Pseudomonas aeruginosa PA01
gaucggguagagcgcggcgca

SEQ ID NO: 1473477 - RNA, 13 nt, Pseudomonas aeruginosa PA01
gaucgccacgccg

SEQ ID NO: 1473478 - RNA, 15 nt, Pseudomonas aeruginosa PA01
gaucgccacgccggc

SEQ ID NO: 1473479 - RNA, 16 nt, Pseudomonas aeruginosa PA01
gaucgccacgccggcg

SEQ ID NO: 1473480 - RNA, 18 nt, Pseudomonas aeruginosa PA01
gaucgccacgccggcgcu

SEQ ID NO: 1473481 - RNA, 19 nt, Pseudomonas aeruginosa PA01
gaucgccacgccggcgcuc

SEQ ID NO: 1473482 - RNA, 19 nt, Pseudomonas aeruginosa PA01
gaucgcauuguugcggucg

SEQ ID NO: 1473483 - RNA, 14 nt, Pseudomonas aeruginosa PA01
gaucgccagcccgu

SEQ ID NO: 1473484 - RNA, 18 nt, Pseudomonas aeruginosa PA01
gaucgccagcgccagcag

SEQ ID NO: 1473485 - RNA, 13 nt, Pseudomonas aeruginosa PA01
gaucgccagcucg

SEQ ID NO: 1473486 - RNA, 14 nt, Pseudomonas aeruginosa PA01
gaucgccagcucgc

SEQ ID NO: 1473487 - RNA, 19 nt, Pseudomonas aeruginosa PA01
gaucgccagcucgccgcgc

SEQ ID NO: 1473488 - RNA, 20 nt, Pseudomonas aeruginosa PA01
gaucgccagcucgccgcgcu

SEQ ID NO: 1473489 - RNA, 19 nt, Pseudomonas aeruginosa PA01
gaucgauguuuccgacccg

SEQ ID NO: 1473490 - RNA, 18 nt, Pseudomonas aeruginosa PA01
gaucgaucggcuggucgu

SEQ ID NO: 1473491 - RNA, 18 nt, Pseudomonas aeruginosa PA01
gaucgaucucgucggcgg

SEQ ID NO: 1473492 - RNA, 16 nt, Pseudomonas aeruginosa PA01
gaucgaucagcagcac

SEQ ID NO: 1473493 - RNA, 12 nt, Pseudomonas aeruginosa PA01
gaucgaucagca

SEQ ID NO: 1473494 - RNA, 16 nt, Pseudomonas aeruginosa PA01
gaucgagucgccggcg

SEQ ID NO: 1473495 - RNA, 17 nt, Pseudomonas aeruginosa PA01
gaucgagucgccggcga

SEQ ID NO: 1473496 - RNA, 16 nt, Pseudomonas aeruginosa PA01
gaucgaagcccaucga

SEQ ID NO: 1473497 - RNA, 17 nt, Pseudomonas aeruginosa PA01
gaucgaacuggccagca

SEQ ID NO: 1473498 - RNA, 22 nt, Pseudomonas aeruginosa PA01
gaucgaacuggccagcaccagu

SEQ ID NO: 1473499 - RNA, 16 nt, Pseudomonas aeruginosa PA01
gauccugggcgccagc

SEQ ID NO: 1473500 - RNA, 15 nt, Pseudomonas aeruginosa PA01
gauccuggccggcgg

SEQ ID NO: 1473501 - RNA, 16 nt, Pseudomonas aeruginosa PA01
gauccuggccggcggc

SEQ ID NO: 1473502 - RNA, 17 nt, Pseudomonas aeruginosa PA01
gauccuggccggcggcg

SEQ ID NO: 1473503 - RNA, 16 nt, Pseudomonas aeruginosa PA01
gaucgaaaaaaggcgc

SEQ ID NO: 1473504 - RNA, 13 nt, Pseudomonas aeruginosa PA01
gauccagcuggcg

SEQ ID NO: 1473505 - RNA, 19 nt, Pseudomonas aeruginosa PA01
gauccgaccuggggcggcc

SEQ ID NO: 1473506 - RNA, 22 nt, Pseudomonas aeruginosa PA01
gauccgaccuggggcggccuca

SEQ ID NO: 1473507 - RNA, 15 nt, Pseudomonas aeruginosa PA01
gauccagcggcaggu

SEQ ID NO: 1473508 - RNA, 16 nt, Pseudomonas aeruginosa PA01
gauccacuugccgccg

SEQ ID NO: 1473509 - RNA, 19 nt, Pseudomonas aeruginosa PA01
gauccagaagaucagcgcg

SEQ ID NO: 1473510 - RNA, 22 nt, Pseudomonas aeruginosa PA01
gauccagaagaucagcgcggug

SEQ ID NO: 1473511 - RNA, 23 nt, Pseudomonas aeruginosa PA01
gauccagcagucgcggcccuggu

SEQ ID NO: 1473512 - RNA, 17 nt, Pseudomonas aeruginosa PA01
gauccgcgacaguucgc

SEQ ID NO: 1473513 - RNA, 19 nt, Pseudomonas aeruginosa PA01
gauccgcgacaguucgccg

SEQ ID NO: 1473514 - RNA, 23 nt, Pseudomonas aeruginosa PA01
gauccgcccgcaugccagggccu

SEQ ID NO: 1473515 - RNA, 18 nt, Pseudomonas aeruginosa PA01
gauccgccgugaggcgcg

SEQ ID NO: 1473516 - RNA, 23 nt, Pseudomonas aeruginosa PA01
gauccgccgugaggcgcgcgccg

SEQ ID NO: 1473517 - RNA, 18 nt, Pseudomonas aeruginosa PA01
gauccgcggaucguccgg

SEQ ID NO: 1473518 - RNA, 13 nt, Pseudomonas aeruginosa PA01
gauccgcgccugc

SEQ ID NO: 1473519 - RNA, 13 nt, Pseudomonas aeruginosa PA01
gauccgcuccagc

SEQ ID NO: 1473520 - RNA, 16 nt, Pseudomonas aeruginosa PA01
gauccgcuccagcgcc

SEQ ID NO: 1473521 - RNA, 15 nt, Pseudomonas aeruginosa PA01
gauccgcucgauccc

SEQ ID NO: 1473522 - RNA, 20 nt, Pseudomonas aeruginosa PA01
gauccgcguuaccguccgcg

SEQ ID NO: 1473523 - RNA, 20 nt, Pseudomonas aeruginosa PA01
gauccgcguggcgugcucgg

SEQ ID NO: 1473524 - RNA, 16 nt, Pseudomonas aeruginosa PA01
gaucagcgcgcggacc

SEQ ID NO: 1473525 - RNA, 13 nt, Pseudomonas aeruginosa PA01
gaucagcggcggg

SEQ ID NO: 1473526 - RNA, 13 nt, Pseudomonas aeruginosa PA01
gaucagcgggcgg

SEQ ID NO: 1473527 - RNA, 17 nt, Pseudomonas aeruginosa PA01
gaucagcggcccgagca

SEQ ID NO: 1473528 - RNA, 19 nt, Pseudomonas aeruginosa PA01
gaucagcgccucggcgcag

SEQ ID NO: 1473529 - RNA, 16 nt, Pseudomonas aeruginosa PA01
gaucagcuucagcucc

SEQ ID NO: 1473530 - RNA, 16 nt, Pseudomonas aeruginosa PA01
gaucagcuuguggucg

SEQ ID NO: 1473531 - RNA, 22 nt, Pseudomonas aeruginosa PA01
gaucagcuuguggucguggcgg

SEQ ID NO: 1473532 - RNA, 17 nt, Pseudomonas aeruginosa PA01
gaucagcucguugcccg

SEQ ID NO: 1473533 - RNA, 18 nt, Pseudomonas aeruginosa PA01
gaucagcucgaucagccc

SEQ ID NO: 1473534 - RNA, 20 nt, Pseudomonas aeruginosa PA01
gaucaggcgggcuccgccgc

SEQ ID NO: 1473535 - RNA, 22 nt, Pseudomonas aeruginosa PA01
gaucaggcgggcuccgccgccg

SEQ ID NO: 1473536 - RNA, 11 nt, Pseudomonas aeruginosa PA01
gaucaggcgcu

SEQ ID NO: 1473537 - RNA, 14 nt, Pseudomonas aeruginosa PA01
gaucaggccggcgu

SEQ ID NO: 1473538 - RNA, 17 nt, Pseudomonas aeruginosa PA01
gaucaggccggcgucga

SEQ ID NO: 1473539 - RNA, 14 nt, Pseudomonas aeruginosa PA01
gaucaggccgagca

SEQ ID NO: 1473540 - RNA, 17 nt, Pseudomonas aeruginosa PA01
gaucaggccgagcaccg

SEQ ID NO: 1473541 - RNA, 14 nt, Pseudomonas aeruginosa PA01
gaucaggccgaugc

SEQ ID NO: 1473542 - RNA, 16 nt, Pseudomonas aeruginosa PA01
gaucaggccgaugcgc

SEQ ID NO: 1473543 - RNA, 21 nt, Pseudomonas aeruginosa PA01
gaucaggccgaugcgcaacgg

SEQ ID NO: 1473544 - RNA, 17 nt, Pseudomonas aeruginosa PA01
gaucaggaagguccagg

SEQ ID NO: 1473545 - RNA, 23 nt, Pseudomonas aeruginosa PA01
gaucaggcugggguugcggcgcc

SEQ ID NO: 1473546 - RNA, 19 nt, Pseudomonas aeruginosa PA01
gaucaggcuguccacgccg

SEQ ID NO: 1473547 - RNA, 15 nt, Pseudomonas aeruginosa PA01
gaucagggcaccgcc

SEQ ID NO: 1473548 - RNA, 16 nt, Pseudomonas aeruginosa PA01
gaucagggcaccgccg

SEQ ID NO: 1473549 - RNA, 20 nt, Pseudomonas aeruginosa PA01
gaucaggugcaggaacagcc

SEQ ID NO: 1473550 - RNA, 19 nt, Pseudomonas aeruginosa PA01
gaucaguaccggcagcgcc

SEQ ID NO: 1473551 - RNA, 16 nt, Pseudomonas aeruginosa PA01
gaucagguccuggccg

SEQ ID NO: 1473552 - RNA, 22 nt, Pseudomonas aeruginosa PA01
gaucaggcguaggccgucgcug

SEQ ID NO: 1473553 - RNA, 12 nt, Pseudomonas aeruginosa PA01
gaucaggcucga

SEQ ID NO: 1473554 - RNA, 20 nt, Pseudomonas aeruginosa PA01
gaucaggucgccgccgccgg

SEQ ID NO: 1473555 - RNA, 22 nt, Pseudomonas aeruginosa PA01
gaucaggucgccgccgccggga

SEQ ID NO: 1473556 - RNA, 17 nt, Pseudomonas aeruginosa PA01
gaucaggucgccgcuga

SEQ ID NO: 1473557 - RNA, 14 nt, Pseudomonas aeruginosa PA01
gaucaggucgcgcg

SEQ ID NO: 1473558 - RNA, 16 nt, Pseudomonas aeruginosa PA01
gaucaugggggccagc

SEQ ID NO: 1473559 - RNA, 17 nt, Pseudomonas aeruginosa PA01
gaucaugggggccagca

SEQ ID NO: 1473560 - RNA, 23 nt, Pseudomonas aeruginosa PA01
gaucaugggggccagcagggccg

SEQ ID NO: 1473561 - RNA, 23 nt, Pseudomonas aeruginosa PA01
gaucaucuucuggacaccgaugc

SEQ ID NO: 1473562 - RNA, 17 nt, Pseudomonas aeruginosa PA01
gauccacgccuggcccu

SEQ ID NO: 1473563 - RNA, 24 nt, Pseudomonas aeruginosa PA01
gaucauuuuccgggucaugccgcc

SEQ ID NO: 1473564 - RNA, 19 nt, Pseudomonas aeruginosa PA01
gaucagugcaucggccgcc

SEQ ID NO: 1473565 - RNA, 24 nt, Pseudomonas aeruginosa PA01
gaucagugcaucggccgccaggcu

SEQ ID NO: 1473566 - RNA, 19 nt, Pseudomonas aeruginosa PA01
gaucagucgucguccagcg

SEQ ID NO: 1473567 - RNA, 15 nt, Pseudomonas aeruginosa PA01
gaucagucaggaucg

SEQ ID NO: 1473568 - RNA, 19 nt, Pseudomonas aeruginosa PA01
gaucagucaggaucggcgc

SEQ ID NO: 1473569 - RNA, 14 nt, Pseudomonas aeruginosa PA01
gaucaucagcaggg

SEQ ID NO: 1473570 - RNA, 22 nt, Pseudomonas aeruginosa PA01
gaucaucagcagggucagggca

SEQ ID NO: 1473571 - RNA, 17 nt, Pseudomonas aeruginosa PA01
gaucaucguccugccgg

SEQ ID NO: 1473572 - RNA, 22 nt, Pseudomonas aeruginosa PA01
gaucaucugaccuuucaccggu

SEQ ID NO: 1473573 - RNA, 17 nt, Pseudomonas aeruginosa PA01
gaucaucugggccaucg

SEQ ID NO: 1473574 - RNA, 21 nt, Pseudomonas aeruginosa PA01
gaucaucugggccaucgccgg

SEQ ID NO: 1473575 - RNA, 14 nt, Pseudomonas aeruginosa PA01
gaucaucgccagcg

SEQ ID NO: 1473576 - RNA, 16 nt, Pseudomonas aeruginosa PA01
gaucaucggcuggccg

SEQ ID NO: 1473577 - RNA, 20 nt, Pseudomonas aeruginosa PA01
gaucaucggcuggccgaggg

SEQ ID NO: 1473578 - RNA, 14 nt, Pseudomonas aeruginosa PA01
gaucaucggcuggu

SEQ ID NO: 1473579 - RNA, 14 nt, Pseudomonas aeruginosa PA01
gaugccggccucga

SEQ ID NO: 1473580 - RNA, 23 nt, Pseudomonas aeruginosa PA01
gaugccggaaagccuggccggcg

SEQ ID NO: 1473581 - RNA, 20 nt, Pseudomonas aeruginosa PA01
gaugccggccggcagcgagc

SEQ ID NO: 1473582 - RNA, 20 nt, Pseudomonas aeruginosa PA01
gaugccguuguggcaggcgc

SEQ ID NO: 1473583 - RNA, 17 nt, Pseudomonas aeruginosa PA01
gaugccguucaggcgcg

SEQ ID NO: 1473584 - RNA, 17 nt, Pseudomonas aeruginosa PA01
gaugccuucggcggccg

SEQ ID NO: 1473585 - RNA, 18 nt, Pseudomonas aeruginosa PA01
gaugccuucggcggccgg

SEQ ID NO: 1473586 - RNA, 22 nt, Pseudomonas aeruginosa PA01
gaugccuucgggagagcccggg

SEQ ID NO: 1473587 - RNA, 15 nt, Pseudomonas aeruginosa PA01
gaugccgccgccgcc

SEQ ID NO: 1473588 - RNA, 21 nt, Pseudomonas aeruginosa PA01
gaugccgccgccgccccagca

SEQ ID NO: 1473589 - RNA, 22 nt, Pseudomonas aeruginosa PA01
gaugccgccgccgccccagcaa

SEQ ID NO: 1473590 - RNA, 14 nt, Pseudomonas aeruginosa PA01
gaugccgcgucggc

SEQ ID NO: 1473591 - RNA, 22 nt, Pseudomonas aeruginosa PA01
gaugccgccugcgucagcgagg

SEQ ID NO: 1473592 - RNA, 14 nt, Pseudomonas aeruginosa PA01
gaugccgcgagcca

SEQ ID NO: 1473593 - RNA, 13 nt, Pseudomonas aeruginosa PA01
gaugccgcgccgg

SEQ ID NO: 1473594 - RNA, 14 nt, Pseudomonas aeruginosa PA01
gaugccgcgcgccu

SEQ ID NO: 1473595 - RNA, 17 nt, Pseudomonas aeruginosa PA01
gaugccgcgcgccuggc

SEQ ID NO: 1473596 - RNA, 19 nt, Pseudomonas aeruginosa PA01
gaugccgcgcgccuggcug

SEQ ID NO: 1473597 - RNA, 20 nt, Pseudomonas aeruginosa PA01
gaugaccaggguggcggcgg

SEQ ID NO: 1473598 - RNA, 19 nt, Pseudomonas aeruginosa PA01
gaugaccacgucgcgaccg

SEQ ID NO: 1473599 - RNA, 15 nt, Pseudomonas aeruginosa PA01
gaugaccccggcgau

SEQ ID NO: 1473600 - RNA, 19 nt, Pseudomonas aeruginosa PA01
gaugaccgccccggcagcc

SEQ ID NO: 1473601 - RNA, 21 nt, Pseudomonas aeruginosa PA01
gaugcgcgaggucugugccgu

SEQ ID NO: 1473602 - RNA, 14 nt, Pseudomonas aeruginosa PA01
gaugcgcgcggcga

SEQ ID NO: 1473603 - RNA, 15 nt, Pseudomonas aeruginosa PA01
gaugcgcgcggcgag

SEQ ID NO: 1473604 - RNA, 13 nt, Pseudomonas aeruginosa PA01
gaugcgcggcagg

SEQ ID NO: 1473605 - RNA, 16 nt, Pseudomonas aeruginosa PA01
gaugcggcccgccggc

SEQ ID NO: 1473606 - RNA, 17 nt, Pseudomonas aeruginosa PA01
gaugcggcccgccggcg

SEQ ID NO: 1473607 - RNA, 17 nt, Pseudomonas aeruginosa PA01
gaugcgcgucgccgaac

SEQ ID NO: 1473608 - RNA, 15 nt, Pseudomonas aeruginosa PA01
gaugcgccccagcgc

SEQ ID NO: 1473609 - RNA, 16 nt, Pseudomonas aeruginosa PA01
gaugcgccccagcgcc

SEQ ID NO: 1473610 - RNA, 18 nt, Pseudomonas aeruginosa PA01
gaugcgccccagcgccug

SEQ ID NO: 1473611 - RNA, 15 nt, Pseudomonas aeruginosa PA01
gaugcgcccggagcu

SEQ ID NO: 1473612 - RNA, 16 nt, Pseudomonas aeruginosa PA01
gaugcgcccgccgcga

SEQ ID NO: 1473613 - RNA, 23 nt, Pseudomonas aeruginosa PA01
gaugcgcgaauaccgcgcgcgca

SEQ ID NO: 1473614 - RNA, 14 nt, Pseudomonas aeruginosa PA01
gaugcgccgcaggu

SEQ ID NO: 1473615 - RNA, 22 nt, Pseudomonas aeruginosa PA01
gaugcgccgguccuuguccggg

SEQ ID NO: 1473616 - RNA, 17 nt, Pseudomonas aeruginosa PA01
gaugcgccucagcggcc

SEQ ID NO: 1473617 - RNA, 22 nt, Pseudomonas aeruginosa PA01
gaugcggcugugcucgaggaag

SEQ ID NO: 1473618 - RNA, 15 nt, Pseudomonas aeruginosa PA01
gaugcggggcgacca

SEQ ID NO: 1473619 - RNA, 14 nt, Pseudomonas aeruginosa PA01
gaugcuccgcgccu

SEQ ID NO: 1473620 - RNA, 13 nt, Pseudomonas aeruginosa PA01
gaugcucgccugg

SEQ ID NO: 1473621 - RNA, 20 nt, Pseudomonas aeruginosa PA01
gaugcuccagguucggcgcc

SEQ ID NO: 1473622 - RNA, 13 nt, Pseudomonas aeruginosa PA01
gaugcucccgagc

SEQ ID NO: 1473623 - RNA, 14 nt, Pseudomonas aeruginosa PA01
gaugcucccgagca

SEQ ID NO: 1473624 - RNA, 14 nt, Pseudomonas aeruginosa PA01
gaugcucagcgccg

SEQ ID NO: 1473625 - RNA, 16 nt, Pseudomonas aeruginosa PA01
gaugcuaucgcguggc

SEQ ID NO: 1473626 - RNA, 22 nt, Pseudomonas aeruginosa PA01
gaugcguugcucgcaccaggcc

SEQ ID NO: 1473627 - RNA, 16 nt, Pseudomonas aeruginosa PA01
gaugcguuugucgacc

SEQ ID NO: 1473628 - RNA, 16 nt, Pseudomonas aeruginosa PA01
gauggcgccgccgagg

SEQ ID NO: 1473629 - RNA, 13 nt, Pseudomonas aeruginosa PA01
gauggcgccgcga

SEQ ID NO: 1473630 - RNA, 18 nt, Pseudomonas aeruginosa PA01
gauggcgccgcgauggua

SEQ ID NO: 1473631 - RNA, 13 nt, Pseudomonas aeruginosa PA01
gauggcucgcggc

SEQ ID NO: 1473632 - RNA, 18 nt, Pseudomonas aeruginosa PA01
gauggcucgcggcgcucg

SEQ ID NO: 1473633 - RNA, 12 nt, Pseudomonas aeruginosa PA01
gauggcugaccc

SEQ ID NO: 1473634 - RNA, 13 nt, Pseudomonas aeruginosa PA01
gauggcgcggggc

SEQ ID NO: 1473635 - RNA, 18 nt, Pseudomonas aeruginosa PA01
gaugggcgaagccggcgg

SEQ ID NO: 1473636 - RNA, 18 nt, Pseudomonas aeruginosa PA01
gaugggcgagaccgggga

SEQ ID NO: 1473637 - RNA, 16 nt, Pseudomonas aeruginosa PA01
gauggcuucgaggcgg

SEQ ID NO: 1473638 - RNA, 19 nt, Pseudomonas aeruginosa PA01
gaugggcacgaucugcgcc

SEQ ID NO: 1473639 - RNA, 15 nt, Pseudomonas aeruginosa PA01
gauggcuggucaggc

SEQ ID NO: 1473640 - RNA, 18 nt, Pseudomonas aeruginosa PA01
gauggcuggucaggcuga

SEQ ID NO: 1473641 - RNA, 15 nt, Pseudomonas aeruginosa PA01
gauggcugucggcgc

SEQ ID NO: 1473642 - RNA, 22 nt, Pseudomonas aeruginosa PA01
gauggucacgccgaggcugcgg

SEQ ID NO: 1473643 - RNA, 14 nt, Pseudomonas aeruginosa PA01
gauggucaggacgc

SEQ ID NO: 1473644 - RNA, 23 nt, Pseudomonas aeruginosa PA01
gauggucaggccggcgcgauccu

SEQ ID NO: 1473645 - RNA, 12 nt, Pseudomonas aeruginosa PA01
gauggucaggcu

SEQ ID NO: 1473646 - RNA, 16 nt, Pseudomonas aeruginosa PA01
gauggucaacaccagc

SEQ ID NO: 1473647 - RNA, 19 nt, Pseudomonas aeruginosa PA01
gauggucaacaccagcgcc

SEQ ID NO: 1473648 - RNA, 20 nt, Pseudomonas aeruginosa PA01
gauggucaacaccagcgccg

SEQ ID NO: 1473649 - RNA, 23 nt, Pseudomonas aeruginosa PA01
gauggugaucacgucggcgucca

SEQ ID NO: 1473650 - RNA, 18 nt, Pseudomonas aeruginosa PA01
gauggugaacgccaggca

SEQ ID NO: 1473651 - RNA, 15 nt, Pseudomonas aeruginosa PA01
gauggugacguugcg

SEQ ID NO: 1473652 - RNA, 17 nt, Pseudomonas aeruginosa PA01
gauggcgauauggccgu

SEQ ID NO: 1473653 - RNA, 13 nt, Pseudomonas aeruginosa PA01
gauggcgaagccg

SEQ ID NO: 1473654 - RNA, 23 nt, Pseudomonas aeruginosa PA01
gauggcgaagcgcuugcccaggu

SEQ ID NO: 1473655 - RNA, 23 nt, Pseudomonas aeruginosa PA01
gauggcgacguucugcucgcugc

SEQ ID NO: 1473656 - RNA, 15 nt, Pseudomonas aeruginosa PA01
gauggccggcaccag

SEQ ID NO: 1473657 - RNA, 14 nt, Pseudomonas aeruginosa PA01
gauggccggcagca

SEQ ID NO: 1473658 - RNA, 12 nt, Pseudomonas aeruginosa PA01
gauggccggcgc

SEQ ID NO: 1473659 - RNA, 21 nt, Pseudomonas aeruginosa PA01
gauggccguccaggcugccgc

SEQ ID NO: 1473660 - RNA, 22 nt, Pseudomonas aeruginosa PA01
gaugcucggugugaucaccagc

SEQ ID NO: 1473661 - RNA, 22 nt, Pseudomonas aeruginosa PA01
gaugcugaacuguucgaucucg

SEQ ID NO: 1473662 - RNA, 17 nt, Pseudomonas aeruginosa PA01
gauuccugucuccgcac

SEQ ID NO: 1473663 - RNA, 13 nt, Pseudomonas aeruginosa PA01
gauucgacgcagc

SEQ ID NO: 1473664 - RNA, 20 nt, Pseudomonas aeruginosa PA01
gauuccucuauccggcacca

SEQ ID NO: 1473665 - RNA, 22 nt, Pseudomonas aeruginosa PA01
gauucgaaccacugcgccaugc

SEQ ID NO: 1473666 - RNA, 20 nt, Pseudomonas aeruginosa PA01
gauucgccggccaccaggcu

SEQ ID NO: 1473667 - RNA, 14 nt, Pseudomonas aeruginosa PA01
gauucgcggcgaca

SEQ ID NO: 1473668 - RNA, 14 nt, Pseudomonas aeruginosa PA01
gauucggccugccg

SEQ ID NO: 1473669 - RNA, 14 nt, Pseudomonas aeruginosa PA01
gauucugcaggcgc

SEQ ID NO: 1473670 - RNA, 15 nt, Pseudomonas aeruginosa PA01
gauugucgcgaucca

SEQ ID NO: 1473671 - RNA, 16 nt, Pseudomonas aeruginosa PA01
gauugugcagggccgc

SEQ ID NO: 1473672 - RNA, 14 nt, Pseudomonas aeruginosa PA01
gauuguccaccggc

SEQ ID NO: 1473673 - RNA, 22 nt, Pseudomonas aeruginosa PA01
gauguucgccacgcugcugccg

SEQ ID NO: 1473674 - RNA, 23 nt, Pseudomonas aeruginosa PA01
gauguucgccacgcugcugccgg

SEQ ID NO: 1473675 - RNA, 15 nt, Pseudomonas aeruginosa PA01
gauguucgccgccgc

SEQ ID NO: 1473676 - RNA, 13 nt, Pseudomonas aeruginosa PA01
gauguuccaggcc

SEQ ID NO: 1473677 - RNA, 20 nt, Pseudomonas aeruginosa PA01
gauguuccaggcccgccgcg

SEQ ID NO: 1473678 - RNA, 16 nt, Pseudomonas aeruginosa PA01
gauguugacgauggcc

SEQ ID NO: 1473679 - RNA, 18 nt, Pseudomonas aeruginosa PA01
gauguugaacagcgccgg

SEQ ID NO: 1473680 - RNA, 13 nt, Pseudomonas aeruginosa PA01
gauggugcggugg

SEQ ID NO: 1473681 - RNA, 20 nt, Pseudomonas aeruginosa PA01
gauggugcgguggcuggcgu

SEQ ID NO: 1473682 - RNA, 21 nt, Pseudomonas aeruginosa PA01
gauguggccgucgcgccgcgg

SEQ ID NO: 1473683 - RNA, 23 nt, Pseudomonas aeruginosa PA01
gauguggccgucgcgccgcggaa

SEQ ID NO: 1473684 - RNA, 16 nt, Pseudomonas aeruginosa PA01
gaugguggucggcagc

SEQ ID NO: 1473685 - RNA, 23 nt, Pseudomonas aeruginosa PA01
gaugugcaguucgaccuccaggc

SEQ ID NO: 1473686 - RNA, 16 nt, Pseudomonas aeruginosa PA01
gaugugcgcaggcugg

SEQ ID NO: 1473687 - RNA, 23 nt, Pseudomonas aeruginosa PA01
gauuuccgcgcccggcuggccau

SEQ ID NO: 1473688 - RNA, 16 nt, Pseudomonas aeruginosa PA01
gauuuccgcggccggc

SEQ ID NO: 1473689 - RNA, 22 nt, Pseudomonas aeruginosa PA01
gauuucacggcggauaaccgcg

SEQ ID NO: 1473690 - RNA, 14 nt, Pseudomonas aeruginosa PA01
gauuugcccggcga

SEQ ID NO: 1473691 - RNA, 19 nt, Pseudomonas aeruginosa PA01
gauuuccggcuugccgaug

SEQ ID NO: 1473692 - RNA, 18 nt, Pseudomonas aeruginosa PA01
gcaaacccauuucccgca

SEQ ID NO: 1473693 - RNA, 22 nt, Pseudomonas aeruginosa PA01
gcaaagccgcuguacaagcgca

SEQ ID NO: 1473694 - RNA, 16 nt, Pseudomonas aeruginosa PA01
gcaaagcccgcuccgc

SEQ ID NO: 1473695 - RNA, 22 nt, Pseudomonas aeruginosa PA01
gcaaagcccgcuuuccccggcg

SEQ ID NO: 1473696 - RNA, 15 nt, Pseudomonas aeruginosa PA01
gcaaagaggcgcuca

SEQ ID NO: 1473697 - RNA, 16 nt, Pseudomonas aeruginosa PA01
gcaaagaggcgcucaa

SEQ ID NO: 1473698 - RNA, 15 nt, Pseudomonas aeruginosa PA01
gcaaagcggcgacgc

SEQ ID NO: 1473699 - RNA, 17 nt, Pseudomonas aeruginosa PA01
gcaaagcggcgacgcca

SEQ ID NO: 1473700 - RNA, 15 nt, Pseudomonas aeruginosa PA01
gcaaaggcgcgcagg

SEQ ID NO: 1473701 - RNA, 22 nt, Pseudomonas aeruginosa PA01
gcaaaggcgcgcagggccgcgg

SEQ ID NO: 1473702 - RNA, 14 nt, Pseudomonas aeruginosa PA01
gcaaaggcccggcg

SEQ ID NO: 1473703 - RNA, 15 nt, Pseudomonas aeruginosa PA01
gcaaaggcccggcgc

SEQ ID NO: 1473704 - RNA, 21 nt, Pseudomonas aeruginosa PA01
gcaagacgaaagagcccggca

SEQ ID NO: 1473705 - RNA, 14 nt, Pseudomonas aeruginosa PA01
gcaagcaggccgcg

SEQ ID NO: 1473706 - RNA, 15 nt, Pseudomonas aeruginosa PA01
gcaagcaggccgcgg

SEQ ID NO: 1473707 - RNA, 15 nt, Pseudomonas aeruginosa PA01
gcaacucgccgccga

SEQ ID NO: 1473708 - RNA, 18 nt, Pseudomonas aeruginosa PA01
gcaacugaccuggccguc

SEQ ID NO: 1473709 - RNA, 14 nt, Pseudomonas aeruginosa PA01
gcaacucggcgccg

SEQ ID NO: 1473710 - RNA, 17 nt, Pseudomonas aeruginosa PA01
gcaacucggcgccguug

SEQ ID NO: 1473711 - RNA, 15 nt, Pseudomonas aeruginosa PA01
gcaacucggcggcga

SEQ ID NO: 1473712 - RNA, 22 nt, Pseudomonas aeruginosa PA01
gcaacucggcggcgagcgccgc

SEQ ID NO: 1473713 - RNA, 18 nt, Pseudomonas aeruginosa PA01
gcaacucggcgucgcgcu

SEQ ID NO: 1473714 - RNA, 13 nt, Pseudomonas aeruginosa PA01
gcaacugccgccc

SEQ ID NO: 1473715 - RNA, 14 nt, Pseudomonas aeruginosa PA01
gcaacugcacguug

SEQ ID NO: 1473716 - RNA, 17 nt, Pseudomonas aeruginosa PA01
gcaacugcauguugccg

SEQ ID NO: 1473717 - RNA, 18 nt, Pseudomonas aeruginosa PA01
gcaacugccaaccgcgcu

SEQ ID NO: 1473718 - RNA, 19 nt, Pseudomonas aeruginosa PA01
gcaacugccaaccgcgcuc

SEQ ID NO: 1473719 - RNA, 21 nt, Pseudomonas aeruginosa PA01
gcaacugccaaccgcgcucgg

SEQ ID NO: 1473720 - RNA, 13 nt, Pseudomonas aeruginosa PA01
gcaacucgucguc

SEQ ID NO: 1473721 - RNA, 14 nt, Pseudomonas aeruginosa PA01
gcaacugacggcgg

SEQ ID NO: 1473722 - RNA, 20 nt, Pseudomonas aeruginosa PA01
gcaacugacggcggaaggcg

SEQ ID NO: 1473723 - RNA, 15 nt, Pseudomonas aeruginosa PA01
gcaacuggucgccgc

SEQ ID NO: 1473724 - RNA, 18 nt, Pseudomonas aeruginosa PA01
gcaacugcggggcgcuca

SEQ ID NO: 1473725 - RNA, 14 nt, Pseudomonas aeruginosa PA01
gcaacuggcuggcc

SEQ ID NO: 1473726 - RNA, 17 nt, Pseudomonas aeruginosa PA01
gcaacuggcuggccugu

SEQ ID NO: 1473727 - RNA, 13 nt, Pseudomonas aeruginosa PA01
gcaacugcgccag

SEQ ID NO: 1473728 - RNA, 14 nt, Pseudomonas aeruginosa PA01
gcaacugcgccagc

SEQ ID NO: 1473729 - RNA, 15 nt, Pseudomonas aeruginosa PA01
gcaagcugcacggcg

SEQ ID NO: 1473730 - RNA, 20 nt, Pseudomonas aeruginosa PA01
gcaagcugcacggcgacccg

SEQ ID NO: 1473731 - RNA, 17 nt, Pseudomonas aeruginosa PA01
gcaagcgugccccgacu

SEQ ID NO: 1473732 - RNA, 16 nt, Pseudomonas aeruginosa PA01
gcaagcuccccgccgc

SEQ ID NO: 1473733 - RNA, 19 nt, Pseudomonas aeruginosa PA01
gcaagcuccccgccgccag

SEQ ID NO: 1473734 - RNA, 15 nt, Pseudomonas aeruginosa PA01
gcaagcucgacgagc

SEQ ID NO: 1473735 - RNA, 14 nt, Pseudomonas aeruginosa PA01
gcaagcgccggcaa

SEQ ID NO: 1473736 - RNA, 16 nt, Pseudomonas aeruginosa PA01
gcaagcgccggcaaca

SEQ ID NO: 1473737 - RNA, 21 nt, Pseudomonas aeruginosa PA01
gcaagcgccggcaacagcagc

SEQ ID NO: 1473738 - RNA, 15 nt, Pseudomonas aeruginosa PA01
gcaagcggcggcuuc

SEQ ID NO: 1473739 - RNA, 18 nt, Pseudomonas aeruginosa PA01
gcaagccuuccagguagu

SEQ ID NO: 1473740 - RNA, 14 nt, Pseudomonas aeruginosa PA01
gcaagcgcccggcg

SEQ ID NO: 1473741 - RNA, 16 nt, Pseudomonas aeruginosa PA01
gcaagcgcccggcgaa

SEQ ID NO: 1473742 - RNA, 12 nt, Pseudomonas aeruginosa PA01
gcaagccgcagc

SEQ ID NO: 1473743 - RNA, 16 nt, Pseudomonas aeruginosa PA01
gcaagccgcagcgccc

SEQ ID NO: 1473744 - RNA, 17 nt, Pseudomonas aeruginosa PA01
gcaagccgcagcgcccc

SEQ ID NO: 1473745 - RNA, 21 nt, Pseudomonas aeruginosa PA01
gcaaggccaagucggccgccc

SEQ ID NO: 1473746 - RNA, 14 nt, Pseudomonas aeruginosa PA01
gcaaggccagcggc

SEQ ID NO: 1473747 - RNA, 18 nt, Pseudomonas aeruginosa PA01
gcaaggccagcggcaucc

SEQ ID NO: 1473748 - RNA, 18 nt, Pseudomonas aeruginosa PA01
gcaaggccagggcggcgc

SEQ ID NO: 1473749 - RNA, 21 nt, Pseudomonas aeruginosa PA01
gcaaggccagggcggcgccga

SEQ ID NO: 1473750 - RNA, 13 nt, Pseudomonas aeruginosa PA01
gcaagcggauauc

SEQ ID NO: 1473751 - RNA, 16 nt, Pseudomonas aeruginosa PA01
gcaaggcacacgcccg

SEQ ID NO: 1473752 - RNA, 17 nt, Pseudomonas aeruginosa PA01
gcaaggcacacgcccgg

SEQ ID NO: 1473753 - RNA, 19 nt, Pseudomonas aeruginosa PA01
gcaaggcagcguccgaacg

SEQ ID NO: 1473754 - RNA, 12 nt, Pseudomonas aeruginosa PA01
gcaaggaccugc

SEQ ID NO: 1473755 - RNA, 13 nt, Pseudomonas aeruginosa PA01
gcaaggaccugcu

SEQ ID NO: 1473756 - RNA, 21 nt, Pseudomonas aeruginosa PA01
gcaaggaccugcugcccggca

SEQ ID NO: 1473757 - RNA, 15 nt, Pseudomonas aeruginosa PA01
gcaagggcgucgcuu

SEQ ID NO: 1473758 - RNA, 23 nt, Pseudomonas aeruginosa PA01
gcaagggcgucugggacggcagc

SEQ ID NO: 1473759 - RNA, 21 nt, Pseudomonas aeruginosa PA01
gcaagggccugcucagcgucc

SEQ ID NO: 1473760 - RNA, 14 nt, Pseudomonas aeruginosa PA01
gcaagggcacuucg

SEQ ID NO: 1473761 - RNA, 23 nt, Pseudomonas aeruginosa PA01
gcaagggcacuucguccaggccg

SEQ ID NO: 1473762 - RNA, 14 nt, Pseudomonas aeruginosa PA01
gcaaggcuucggcg

SEQ ID NO: 1473763 - RNA, 18 nt, Pseudomonas aeruginosa PA01
gcaaggcuucggcgguca

SEQ ID NO: 1473764 - RNA, 20 nt, Pseudomonas aeruginosa PA01
gcaaggcuucggcggucagg

SEQ ID NO: 1473765 - RNA, 21 nt, Pseudomonas aeruginosa PA01
gcaaggcgucauagcagcgcc

SEQ ID NO: 1473766 - RNA, 15 nt, Pseudomonas aeruginosa PA01
gcaaggcgaucccgg

SEQ ID NO: 1473767 - RNA, 16 nt, Pseudomonas aeruginosa PA01
gcaaggcgaucccggc

SEQ ID NO: 1473768 - RNA, 17 nt, Pseudomonas aeruginosa PA01
gcaaggcgaucccggcg

SEQ ID NO: 1473769 - RNA, 23 nt, Pseudomonas aeruginosa PA01
gcaauugcaggcccggccgccug

SEQ ID NO: 1473770 - RNA, 14 nt, Pseudomonas aeruginosa PA01
gcaaugccagcgcc

SEQ ID NO: 1473771 - RNA, 15 nt, Pseudomonas aeruginosa PA01
gcaaugccagcgcca

SEQ ID NO: 1473772 - RNA, 17 nt, Pseudomonas aeruginosa PA01
gcaaugccagcgccacg

SEQ ID NO: 1473773 - RNA, 15 nt, Pseudomonas aeruginosa PA01
gcaagucggccugca

SEQ ID NO: 1473774 - RNA, 20 nt, Pseudomonas aeruginosa PA01
gcaaguaaugccgaaggcgu

SEQ ID NO: 1473775 - RNA, 17 nt, Pseudomonas aeruginosa PA01
gcaaucagggcugggcg

SEQ ID NO: 1473776 - RNA, 18 nt, Pseudomonas aeruginosa PA01
gcaaucagggcugggcgc

SEQ ID NO: 1473777 - RNA, 18 nt, Pseudomonas aeruginosa PA01
gcaaucaucgcgucgccg

SEQ ID NO: 1473778 - RNA, 19 nt, Pseudomonas aeruginosa PA01
gcaaucaucgcgucgccga

SEQ ID NO: 1473779 - RNA, 21 nt, Pseudomonas aeruginosa PA01
gcaaucaucgcgucgccgaac

SEQ ID NO: 1473780 - RNA, 15 nt, Pseudomonas aeruginosa PA01
gcaauccgccgcucc

SEQ ID NO: 1473781 - RNA, 16 nt, Pseudomonas aeruginosa PA01
gcaauccgaccgggga

SEQ ID NO: 1473782 - RNA, 15 nt, Pseudomonas aeruginosa PA01
gcaauccggcgcugc

SEQ ID NO: 1473783 - RNA, 14 nt, Pseudomonas aeruginosa PA01
gcaaccgcggcggc

SEQ ID NO: 1473784 - RNA, 16 nt, Pseudomonas aeruginosa PA01
gcaaccgcggcggccu

SEQ ID NO: 1473785 - RNA, 18 nt, Pseudomonas aeruginosa PA01
gcaaccgcgauggcguga

SEQ ID NO: 1473786 - RNA, 14 nt, Pseudomonas aeruginosa PA01
gcaaccgcugccgc

SEQ ID NO: 1473787 - RNA, 15 nt, Pseudomonas aeruginosa PA01
gcaaccgcugccgcc

SEQ ID NO: 1473788 - RNA, 16 nt, Pseudomonas aeruginosa PA01
gcaaccgcugccgccg

SEQ ID NO: 1473789 - RNA, 21 nt, Pseudomonas aeruginosa PA01
gcaaccggguaccugcucgcg

SEQ ID NO: 1473790 - RNA, 13 nt, Pseudomonas aeruginosa PA01
gcaaccgcagacu

SEQ ID NO: 1473791 - RNA, 21 nt, Pseudomonas aeruginosa PA01
gcaaccgccgccgcaaccgcc

SEQ ID NO: 1473792 - RNA, 20 nt, Pseudomonas aeruginosa PA01
gcaaccgauauggcuggcgc

SEQ ID NO: 1473793 - RNA, 13 nt, Pseudomonas aeruginosa PA01
gcaacccggccca

SEQ ID NO: 1473794 - RNA, 16 nt, Pseudomonas aeruginosa PA01
gcaacccggcccagcg

SEQ ID NO: 1473795 - RNA, 14 nt, Pseudomonas aeruginosa PA01
gcaacccgccgcug

SEQ ID NO: 1473796 - RNA, 18 nt, Pseudomonas aeruginosa PA01
gcaacccgccgcugauca

SEQ ID NO: 1473797 - RNA, 23 nt, Pseudomonas aeruginosa PA01
gcaacccuuugauggcgcugcca

SEQ ID NO: 1473798 - RNA, 20 nt, Pseudomonas aeruginosa PA01
gcaaccccuucggucgcgcc

SEQ ID NO: 1473799 - RNA, 14 nt, Pseudomonas aeruginosa PA01
gcaacccgcccggc

SEQ ID NO: 1473800 - RNA, 20 nt, Pseudomonas aeruginosa PA01
gcaacccgcccuugcucgcg

SEQ ID NO: 1473801 - RNA, 21 nt, Pseudomonas aeruginosa PA01
gcaacccgcccuugcucgcgg

SEQ ID NO: 1473802 - RNA, 20 nt, Pseudomonas aeruginosa PA01
gcaacccagggcgcugccga

SEQ ID NO: 1473803 - RNA, 18 nt, Pseudomonas aeruginosa PA01
gcaaccagcccuggcgca

SEQ ID NO: 1473804 - RNA, 17 nt, Pseudomonas aeruginosa PA01
gcaacaguugccgcagc

SEQ ID NO: 1473805 - RNA, 22 nt, Pseudomonas aeruginosa PA01
gcaacaguugccgcagcagcgg

SEQ ID NO: 1473806 - RNA, 20 nt, Pseudomonas aeruginosa PA01
gcaacaguggguaggccagg

SEQ ID NO: 1473807 - RNA, 21 nt, Pseudomonas aeruginosa PA01
gcaacaguggguaggccaggc

SEQ ID NO: 1473808 - RNA, 22 nt, Pseudomonas aeruginosa PA01
gcaacaguggguaggccaggca

SEQ ID NO: 1473809 - RNA, 22 nt, Pseudomonas aeruginosa PA01
gcaacauggcgucggcgaucac

SEQ ID NO: 1473810 - RNA, 14 nt, Pseudomonas aeruginosa PA01
gcaacagggcauug

SEQ ID NO: 1473811 - RNA, 16 nt, Pseudomonas aeruginosa PA01
gcaacagcgccgcgcg

SEQ ID NO: 1473812 - RNA, 13 nt, Pseudomonas aeruginosa PA01
gcaacagcccgcg

SEQ ID NO: 1473813 - RNA, 17 nt, Pseudomonas aeruginosa PA01
gcaacagcccgcgccgc

SEQ ID NO: 1473814 - RNA, 14 nt, Pseudomonas aeruginosa PA01
gcaacagcgcggcg

SEQ ID NO: 1473815 - RNA, 17 nt, Pseudomonas aeruginosa PA01
gcaacagcgcggcggug

SEQ ID NO: 1473816 - RNA, 18 nt, Pseudomonas aeruginosa PA01
gcaacagcgcggcggugc

SEQ ID NO: 1473817 - RNA, 20 nt, Pseudomonas aeruginosa PA01
gcaacagaaguugcuggcga

SEQ ID NO: 1473818 - RNA, 24 nt, Pseudomonas aeruginosa PA01
gcaacagcaggagaagcgccucgc

SEQ ID NO: 1473819 - RNA, 15 nt, Pseudomonas aeruginosa PA01
gcaacaccuggcgcu

SEQ ID NO: 1473820 - RNA, 16 nt, Pseudomonas aeruginosa PA01
gcaacaccuggcgcuc

SEQ ID NO: 1473821 - RNA, 20 nt, Pseudomonas aeruginosa PA01
gcaacaccuugcgcaccgcc

SEQ ID NO: 1473822 - RNA, 16 nt, Pseudomonas aeruginosa PA01
gcaacaccaucggccc

SEQ ID NO: 1473823 - RNA, 14 nt, Pseudomonas aeruginosa PA01
gcaacacccaggcc

SEQ ID NO: 1473824 - RNA, 17 nt, Pseudomonas aeruginosa PA01
gcaacacccaggccugg

SEQ ID NO: 1473825 - RNA, 18 nt, Pseudomonas aeruginosa PA01
gcaacaccgcgcagauga

SEQ ID NO: 1473826 - RNA, 18 nt, Pseudomonas aeruginosa PA01
gcaaccgguccucgcccg

SEQ ID NO: 1473827 - RNA, 21 nt, Pseudomonas aeruginosa PA01
gcaaccgguuucccucgagca

SEQ ID NO: 1473828 - RNA, 16 nt, Pseudomonas aeruginosa PA01
gcaacgacgaggccug

SEQ ID NO: 1473829 - RNA, 18 nt, Pseudomonas aeruginosa PA01
gcaacgacgaggccugga

SEQ ID NO: 1473830 - RNA, 20 nt, Pseudomonas aeruginosa PA01
gcaacgaaaaagggcggcca

SEQ ID NO: 1473831 - RNA, 21 nt, Pseudomonas aeruginosa PA01
gcaacgaaaaagggcggccac

SEQ ID NO: 1473832 - RNA, 18 nt, Pseudomonas aeruginosa PA01
gcaacgccagcaggcgca

SEQ ID NO: 1473833 - RNA, 20 nt, Pseudomonas aeruginosa PA01
gcaacgccagcaggcgcagg

SEQ ID NO: 1473834 - RNA, 16 nt, Pseudomonas aeruginosa PA01
gcaacgccagcaggcg

SEQ ID NO: 1473835 - RNA, 12 nt, Pseudomonas aeruginosa PA01
gcaacgccaggc

SEQ ID NO: 1473836 - RNA, 22 nt, Pseudomonas aeruginosa PA01
gcaacgccaggcugucagggcg

SEQ ID NO: 1473837 - RNA, 19 nt, Pseudomonas aeruginosa PA01
gcaacgauaccgccgccgg

SEQ ID NO: 1473838 - RNA, 15 nt, Pseudomonas aeruginosa PA01
gcaacgaucucgcuc

SEQ ID NO: 1473839 - RNA, 18 nt, Pseudomonas aeruginosa PA01
gcaacgaucucgcucucg

SEQ ID NO: 1473840 - RNA, 15 nt, Pseudomonas aeruginosa PA01
gcaacgcccgcgagc

SEQ ID NO: 1473841 - RNA, 21 nt, Pseudomonas aeruginosa PA01
gcaacgcccgcgagccguccu

SEQ ID NO: 1473842 - RNA, 14 nt, Pseudomonas aeruginosa PA01
gcaacgccgacggc

SEQ ID NO: 1473843 - RNA, 19 nt, Pseudomonas aeruginosa PA01
gcaacgccgacggcgugcc

SEQ ID NO: 1473844 - RNA, 14 nt, Pseudomonas aeruginosa PA01
gcaacgccgccccc

SEQ ID NO: 1473845 - RNA, 19 nt, Pseudomonas aeruginosa PA01
gcaacgccgcccccagcgc

SEQ ID NO: 1473846 - RNA, 24 nt, Pseudomonas aeruginosa PA01
gcaacgccgcccccagcgcgccgc

SEQ ID NO: 1473847 - RNA, 21 nt, Pseudomonas aeruginosa PA01
gcaacgccuggugcaggucgc

SEQ ID NO: 1473848 - RNA, 22 nt, Pseudomonas aeruginosa PA01
gcaacgccuggugcaggucgcg

SEQ ID NO: 1473849 - RNA, 14 nt, Pseudomonas aeruginosa PA01
gcaacgccggcagg

SEQ ID NO: 1473850 - RNA, 17 nt, Pseudomonas aeruginosa PA01
gcaacgccggcccgugc

SEQ ID NO: 1473851 - RNA, 12 nt, Pseudomonas aeruginosa PA01
gcaacgccgcca

SEQ ID NO: 1473852 - RNA, 15 nt, Pseudomonas aeruginosa PA01
gcaacgccgccaacu

SEQ ID NO: 1473853 - RNA, 17 nt, Pseudomonas aeruginosa PA01
gcaacggcagcgcuucg

SEQ ID NO: 1473854 - RNA, 12 nt, Pseudomonas aeruginosa PA01
gcaacggcacga

SEQ ID NO: 1473855 - RNA, 12 nt, Pseudomonas aeruginosa PA01
gcaacgcgccca

SEQ ID NO: 1473856 - RNA, 20 nt, Pseudomonas aeruginosa PA01
gcaacggacguuccaccugg

SEQ ID NO: 1473857 - RNA, 22 nt, Pseudomonas aeruginosa PA01
gcaacggacguuccaccuggcg

SEQ ID NO: 1473858 - RNA, 23 nt, Pseudomonas aeruginosa PA01
gcaacggacguuccaccuggcgc

SEQ ID NO: 1473859 - RNA, 21 nt, Pseudomonas aeruginosa PA01
gcaacgcggagcaggcggaga

SEQ ID NO: 1473860 - RNA, 22 nt, Pseudomonas aeruginosa PA01
gcaacgcgguuauccgccgcug

SEQ ID NO: 1473861 - RNA, 18 nt, Pseudomonas aeruginosa PA01
gcaacgguuccaugcgaa

SEQ ID NO: 1473862 - RNA, 15 nt, Pseudomonas aeruginosa PA01
gcaacguccucgcgc

SEQ ID NO: 1473863 - RNA, 18 nt, Pseudomonas aeruginosa PA01
gcaacguccucgcgccgc

SEQ ID NO: 1473864 - RNA, 19 nt, Pseudomonas aeruginosa PA01
gcaacguccucgcgccgcu

SEQ ID NO: 1473865 - RNA, 17 nt, Pseudomonas aeruginosa PA01
gcaacgggacgccaggc

SEQ ID NO: 1473866 - RNA, 18 nt, Pseudomonas aeruginosa PA01
gcaacgggacgccaggcg

SEQ ID NO: 1473867 - RNA, 15 nt, Pseudomonas aeruginosa PA01
gcaccguggcgccau

SEQ ID NO: 1473868 - RNA, 13 nt, Pseudomonas aeruginosa PA01
gcaccguggucag

SEQ ID NO: 1473869 - RNA, 18 nt, Pseudomonas aeruginosa PA01
gcaccuaccaguaguucu

SEQ ID NO: 1473870 - RNA, 22 nt, Pseudomonas aeruginosa PA01
gcaccuacccgagcaacugcuc

SEQ ID NO: 1473871 - RNA, 14 nt, Pseudomonas aeruginosa PA01
gcaccucgaccgcg

SEQ ID NO: 1473872 - RNA, 20 nt, Pseudomonas aeruginosa PA01
gcaccucgaccgcgccggcg

SEQ ID NO: 1473873 - RNA, 21 nt, Pseudomonas aeruginosa PA01
gcaccucgaccgcgccggcga

SEQ ID NO: 1473874 - RNA, 18 nt, Pseudomonas aeruginosa PA01
gcaccucccccagcgggc

SEQ ID NO: 1473875 - RNA, 15 nt, Pseudomonas aeruginosa PA01
gcaccucaugcugcg

SEQ ID NO: 1473876 - RNA, 16 nt, Pseudomonas aeruginosa PA01
gcaccucgauggcggc

SEQ ID NO: 1473877 - RNA, 18 nt, Pseudomonas aeruginosa PA01
gcaccucgauggcggcgg

SEQ ID NO: 1473878 - RNA, 16 nt, Pseudomonas aeruginosa PA01
gcaccgcuugccagcc

SEQ ID NO: 1473879 - RNA, 17 nt, Pseudomonas aeruginosa PA01
gcaccgcuugccagccg

SEQ ID NO: 1473880 - RNA, 18 nt, Pseudomonas aeruginosa PA01
gcaccgcuugccagccgc

SEQ ID NO: 1473881 - RNA, 20 nt, Pseudomonas aeruginosa PA01
gcaccgcuuucaccaggguc

SEQ ID NO: 1473882 - RNA, 21 nt, Pseudomonas aeruginosa PA01
gcaccgcuuucaccagggucg

SEQ ID NO: 1473883 - RNA, 22 nt, Pseudomonas aeruginosa PA01
gcaccggccacucgcagccgcg

SEQ ID NO: 1473884 - RNA, 18 nt, Pseudomonas aeruginosa PA01
gcaccggccucaagcaag

SEQ ID NO: 1473885 - RNA, 14 nt, Pseudomonas aeruginosa PA01
gcaccggccaggcg

SEQ ID NO: 1473886 - RNA, 15 nt, Pseudomonas aeruginosa PA01
gcaccggccaggcgc

SEQ ID NO: 1473887 - RNA, 16 nt, Pseudomonas aeruginosa PA01
gcaccggccaggcgcu

SEQ ID NO: 1473888 - RNA, 18 nt, Pseudomonas aeruginosa PA01
gcaccgugcgcgcggccu

SEQ ID NO: 1473889 - RNA, 19 nt, Pseudomonas aeruginosa PA01
gcaccgugcgcgcggccug

SEQ ID NO: 1473890 - RNA, 14 nt, Pseudomonas aeruginosa PA01
gcaccugcagacgg

SEQ ID NO: 1473891 - RNA, 22 nt, Pseudomonas aeruginosa PA01
gcaccugcagacgguucagcag

SEQ ID NO: 1473892 - RNA, 15 nt, Pseudomonas aeruginosa PA01
gcaccugcucggggc

SEQ ID NO: 1473893 - RNA, 19 nt, Pseudomonas aeruginosa PA01
gcaccuggcgaugcccugg

SEQ ID NO: 1473894 - RNA, 20 nt, Pseudomonas aeruginosa PA01
gcaccuggcgaugcccuggc

SEQ ID NO: 1473895 - RNA, 16 nt, Pseudomonas aeruginosa PA01
gcaccuuggccacgcu

SEQ ID NO: 1473896 - RNA, 14 nt, Pseudomonas aeruginosa PA01
gcaccuuggccaug

SEQ ID NO: 1473897 - RNA, 19 nt, Pseudomonas aeruginosa PA01
gcaccuggcagugcgccgg

SEQ ID NO: 1473898 - RNA, 18 nt, Pseudomonas aeruginosa PA01
gcaccugcgggcugcgug

SEQ ID NO: 1473899 - RNA, 23 nt, Pseudomonas aeruginosa PA01
gcaccuuggcuugcagguagcug

SEQ ID NO: 1473900 - RNA, 17 nt, Pseudomonas aeruginosa PA01
gcaccuugggaucgucg

SEQ ID NO: 1473901 - RNA, 12 nt, Pseudomonas aeruginosa PA01
gcacgaaccguc

SEQ ID NO: 1473902 - RNA, 19 nt, Pseudomonas aeruginosa PA01
gcacgaccacaucggccag

SEQ ID NO: 1473903 - RNA, 17 nt, Pseudomonas aeruginosa PA01
gcacgaauuuccuggcg

SEQ ID NO: 1473904 - RNA, 18 nt, Pseudomonas aeruginosa PA01
gcacgaauuuccuggcgc

SEQ ID NO: 1473905 - RNA, 16 nt, Pseudomonas aeruginosa PA01
gcacgaacccaggcgc

SEQ ID NO: 1473906 - RNA, 19 nt, Pseudomonas aeruginosa PA01
gcacgaacccaggcgcugc

SEQ ID NO: 1473907 - RNA, 18 nt, Pseudomonas aeruginosa PA01
gcacgaaagccaugccca

SEQ ID NO: 1473908 - RNA, 21 nt, Pseudomonas aeruginosa PA01
gcacgaaagccaugcccagac

SEQ ID NO: 1473909 - RNA, 23 nt, Pseudomonas aeruginosa PA01
gcacgaacagggucuucaggccg

SEQ ID NO: 1473910 - RNA, 15 nt, Pseudomonas aeruginosa PA01
gcacaccgcgcgcgc

SEQ ID NO: 1473911 - RNA, 20 nt, Pseudomonas aeruginosa PA01
gcacaccgcgcgcgccugca

SEQ ID NO: 1473912 - RNA, 23 nt, Pseudomonas aeruginosa PA01
gcacaccgcgcgcgccugcaacg

SEQ ID NO: 1473913 - RNA, 20 nt, Pseudomonas aeruginosa PA01
gcacccggaccuuguccagg

SEQ ID NO: 1473914 - RNA, 12 nt, Pseudomonas aeruginosa PA01
gcacccgggcga

SEQ ID NO: 1473915 - RNA, 17 nt, Pseudomonas aeruginosa PA01
gcacccgggcgaccugc

SEQ ID NO: 1473916 - RNA, 19 nt, Pseudomonas aeruginosa PA01
gcacccgggcgaccugcuc

SEQ ID NO: 1473917 - RNA, 14 nt, Pseudomonas aeruginosa PA01
gcacccggcccaug

SEQ ID NO: 1473918 - RNA, 13 nt, Pseudomonas aeruginosa PA01
gcacccgguagcc

SEQ ID NO: 1473919 - RNA, 20 nt, Pseudomonas aeruginosa PA01
gcacccgguugaccccgcgg

SEQ ID NO: 1473920 - RNA, 17 nt, Pseudomonas aeruginosa PA01
gcacccucuuccgcgcu

SEQ ID NO: 1473921 - RNA, 17 nt, Pseudomonas aeruginosa PA01
gcaccgaggcgcgccga

SEQ ID NO: 1473922 - RNA, 19 nt, Pseudomonas aeruginosa PA01
gcaccgcgcagaccaucag

SEQ ID NO: 1473923 - RNA, 12 nt, Pseudomonas aeruginosa PA01
gcaccgcgcagc

SEQ ID NO: 1473924 - RNA, 18 nt, Pseudomonas aeruginosa PA01
gcaccgccugcaacucgu

SEQ ID NO: 1473925 - RNA, 19 nt, Pseudomonas aeruginosa PA01
gcaccgccugcaacucguc

SEQ ID NO: 1473926 - RNA, 14 nt, Pseudomonas aeruginosa PA01
gcaccgccugcagc

SEQ ID NO: 1473927 - RNA, 16 nt, Pseudomonas aeruginosa PA01
gcaccgccugcagcac

SEQ ID NO: 1473928 - RNA, 14 nt, Pseudomonas aeruginosa PA01
gcaccgcgccggcg

SEQ ID NO: 1473929 - RNA, 13 nt, Pseudomonas aeruginosa PA01
gcaccgcgccggg

SEQ ID NO: 1473930 - RNA, 22 nt, Pseudomonas aeruginosa PA01
gcaccgcgcagcgucaccgcgu

SEQ ID NO: 1473931 - RNA, 14 nt, Pseudomonas aeruginosa PA01
gcaccgccuggcgc

SEQ ID NO: 1473932 - RNA, 12 nt, Pseudomonas aeruginosa PA01
gcaccgcgagca

SEQ ID NO: 1473933 - RNA, 18 nt, Pseudomonas aeruginosa PA01
gcaccgcaagggugcuca

SEQ ID NO: 1473934 - RNA, 13 nt, Pseudomonas aeruginosa PA01
gcaccgccaccag

SEQ ID NO: 1473935 - RNA, 14 nt, Pseudomonas aeruginosa PA01
gcaccgccaccagc

SEQ ID NO: 1473936 - RNA, 14 nt, Pseudomonas aeruginosa PA01
gcaccgaucgcccg

SEQ ID NO: 1473937 - RNA, 19 nt, Pseudomonas aeruginosa PA01
gcaccgaucgcccgcgccu

SEQ ID NO: 1473938 - RNA, 20 nt, Pseudomonas aeruginosa PA01
gcacggccgguagucggggc

SEQ ID NO: 1473939 - RNA, 16 nt, Pseudomonas aeruginosa PA01
gcacggccgucacggc

SEQ ID NO: 1473940 - RNA, 17 nt, Pseudomonas aeruginosa PA01
gcacggccgucacggcc

SEQ ID NO: 1473941 - RNA, 21 nt, Pseudomonas aeruginosa PA01
gcacggccgucacggccuccg

SEQ ID NO: 1473942 - RNA, 14 nt, Pseudomonas aeruginosa PA01
gcacggccguccug

SEQ ID NO: 1473943 - RNA, 18 nt, Pseudomonas aeruginosa PA01
gcacggcgacggugccgg

SEQ ID NO: 1473944 - RNA, 18 nt, Pseudomonas aeruginosa PA01
gcacggcgauacccaggc

SEQ ID NO: 1473945 - RNA, 20 nt, Pseudomonas aeruginosa PA01
gcacggcgauacccaggccg

SEQ ID NO: 1473946 - RNA, 21 nt, Pseudomonas aeruginosa PA01
gcacggcgauacccaggccgu

SEQ ID NO: 1473947 - RNA, 13 nt, Pseudomonas aeruginosa PA01
gcacggccucgcg

SEQ ID NO: 1473948 - RNA, 16 nt, Pseudomonas aeruginosa PA01
gcacggccucgcgugc

SEQ ID NO: 1473949 - RNA, 17 nt, Pseudomonas aeruginosa PA01
gcacggccugcaccugc

SEQ ID NO: 1473950 - RNA, 19 nt, Pseudomonas aeruginosa PA01
gcacggcgaacaccgggcc

SEQ ID NO: 1473951 - RNA, 14 nt, Pseudomonas aeruginosa PA01
gcacggggcgccug

SEQ ID NO: 1473952 - RNA, 20 nt, Pseudomonas aeruginosa PA01
gcacggggcgccuguccggg

SEQ ID NO: 1473953 - RNA, 20 nt, Pseudomonas aeruginosa PA01
gcacggcaucgauccgcacc

SEQ ID NO: 1473954 - RNA, 16 nt, Pseudomonas aeruginosa PA01
gcacggcauagccacg

SEQ ID NO: 1473955 - RNA, 17 nt, Pseudomonas aeruginosa PA01
gcacggcauagccacgg

SEQ ID NO: 1473956 - RNA, 18 nt, Pseudomonas aeruginosa PA01
gcacggcauagccacggc

SEQ ID NO: 1473957 - RNA, 22 nt, Pseudomonas aeruginosa PA01
gcacgcugcgccggcgcugcga

SEQ ID NO: 1473958 - RNA, 21 nt, Pseudomonas aeruginosa PA01
gcacgcugcuugcgcaccucc

SEQ ID NO: 1473959 - RNA, 19 nt, Pseudomonas aeruginosa PA01
gcacgcugacgccggcacc

SEQ ID NO: 1473960 - RNA, 12 nt, Pseudomonas aeruginosa PA01
gcacgcucuucu

SEQ ID NO: 1473961 - RNA, 14 nt, Pseudomonas aeruginosa PA01
gcacgcugccgccg

SEQ ID NO: 1473962 - RNA, 15 nt, Pseudomonas aeruginosa PA01
gcacgcugccgccga

SEQ ID NO: 1473963 - RNA, 13 nt, Pseudomonas aeruginosa PA01
gcacgcugccagc

SEQ ID NO: 1473964 - RNA, 17 nt, Pseudomonas aeruginosa PA01
gcacgcugccagcaggc

SEQ ID NO: 1473965 - RNA, 21 nt, Pseudomonas aeruginosa PA01
gcacgcugccagcaggccgag

SEQ ID NO: 1473966 - RNA, 13 nt, Pseudomonas aeruginosa PA01
gcacgccuuccag

SEQ ID NO: 1473967 - RNA, 23 nt, Pseudomonas aeruginosa PA01
gcacgccuuccggguugaaggcg

SEQ ID NO: 1473968 - RNA, 22 nt, Pseudomonas aeruginosa PA01
gcacgccgugcaucaccggcag

SEQ ID NO: 1473969 - RNA, 23 nt, Pseudomonas aeruginosa PA01
gcacgccgugcaucaccggcagc

SEQ ID NO: 1473970 - RNA, 17 nt, Pseudomonas aeruginosa PA01
gcacgccguggaccagg

SEQ ID NO: 1473971 - RNA, 22 nt, Pseudomonas aeruginosa PA01
gcacgcgcaguacgaucagcca

SEQ ID NO: 1473972 - RNA, 11 nt, Pseudomonas aeruginosa PA01
gcacgcgccgg

SEQ ID NO: 1473973 - RNA, 19 nt, Pseudomonas aeruginosa PA01
gcacgcucuggccguucuc

SEQ ID NO: 1473974 - RNA, 18 nt, Pseudomonas aeruginosa PA01
gcacgcugaagaucgcca

SEQ ID NO: 1473975 - RNA, 20 nt, Pseudomonas aeruginosa PA01
gcacgcccugggacaggcgu

SEQ ID NO: 1473976 - RNA, 22 nt, Pseudomonas aeruginosa PA01
gcacgcccugggacaggcgucc

SEQ ID NO: 1473977 - RNA, 12 nt, Pseudomonas aeruginosa PA01
gcacgccgaagu

SEQ ID NO: 1473978 - RNA, 14 nt, Pseudomonas aeruginosa PA01
gcacgcccaggcgc

SEQ ID NO: 1473979 - RNA, 15 nt, Pseudomonas aeruginosa PA01
gcacgcccaggcgcu

SEQ ID NO: 1473980 - RNA, 21 nt, Pseudomonas aeruginosa PA01
gcacgcccaggcgcucggcga

SEQ ID NO: 1473981 - RNA, 22 nt, Pseudomonas aeruginosa PA01
gcacgcccaggcgcucggcgac

SEQ ID NO: 1473982 - RNA, 19 nt, Pseudomonas aeruginosa PA01
gcacgcccaguugcgccgc

SEQ ID NO: 1473983 - RNA, 21 nt, Pseudomonas aeruginosa PA01
gcacgcccaguugcgccgccu

SEQ ID NO: 1473984 - RNA, 22 nt, Pseudomonas aeruginosa PA01
gcacgcccaucgccaccagcag

SEQ ID NO: 1473985 - RNA, 20 nt, Pseudomonas aeruginosa PA01
gcacgccccauccgggcggc

SEQ ID NO: 1473986 - RNA, 21 nt, Pseudomonas aeruginosa PA01
gcacgccccauccgggcggcg

SEQ ID NO: 1473987 - RNA, 13 nt, Pseudomonas aeruginosa PA01
gcacgcccaggcg

SEQ ID NO: 1473988 - RNA, 19 nt, Pseudomonas aeruginosa PA01
gcacuguuccucagccccu

SEQ ID NO: 1473989 - RNA, 17 nt, Pseudomonas aeruginosa PA01
gcacuuccaggcgccaa

SEQ ID NO: 1473990 - RNA, 20 nt, Pseudomonas aeruginosa PA01
gcacuuccugaaggcgcggg

SEQ ID NO: 1473991 - RNA, 21 nt, Pseudomonas aeruginosa PA01
gcacuucguccaggccgccua

SEQ ID NO: 1473992 - RNA, 15 nt, Pseudomonas aeruginosa PA01
gcacuucggcgcgcg

SEQ ID NO: 1473993 - RNA, 16 nt, Pseudomonas aeruginosa PA01
gcacuucggcgcgcgg

SEQ ID NO: 1473994 - RNA, 13 nt, Pseudomonas aeruginosa PA01
gcacugccaggag

SEQ ID NO: 1473995 - RNA, 18 nt, Pseudomonas aeruginosa PA01
gcacugccaggagcacgc

SEQ ID NO: 1473996 - RNA, 20 nt, Pseudomonas aeruginosa PA01
gcacugagcuuaaggcaggu

SEQ ID NO: 1473997 - RNA, 21 nt, Pseudomonas aeruginosa PA01
gcacugagggucagccgcagg

SEQ ID NO: 1473998 - RNA, 13 nt, Pseudomonas aeruginosa PA01
gcacgugcagcgg

SEQ ID NO: 1473999 - RNA, 16 nt, Pseudomonas aeruginosa PA01
gcacgugcagcggcag

SEQ ID NO: 1474000 - RNA, 17 nt, Pseudomonas aeruginosa PA01
gcacgugcagcggcagc

SEQ ID NO: 1474001 - RNA, 22 nt, Pseudomonas aeruginosa PA01
gcacgugcagcggcagcgucuc

SEQ ID NO: 1474002 - RNA, 15 nt, Pseudomonas aeruginosa PA01
gcacgugcagcucgg

SEQ ID NO: 1474003 - RNA, 19 nt, Pseudomonas aeruginosa PA01
gcacggugaaccaggcgcc

SEQ ID NO: 1474004 - RNA, 15 nt, Pseudomonas aeruginosa PA01
gcacggucuuggcgu

SEQ ID NO: 1474005 - RNA, 20 nt, Pseudomonas aeruginosa PA01
gcacggugacacccugccgc

SEQ ID NO: 1474006 - RNA, 15 nt, Pseudomonas aeruginosa PA01
gcacggucugcucgg

SEQ ID NO: 1474007 - RNA, 17 nt, Pseudomonas aeruginosa PA01
gcacguugcugugcugc

SEQ ID NO: 1474008 - RNA, 19 nt, Pseudomonas aeruginosa PA01
gcacguugcugugcugcac

SEQ ID NO: 1474009 - RNA, 22 nt, Pseudomonas aeruginosa PA01
gcacguugcugugcugcaccag

SEQ ID NO: 1474010 - RNA, 23 nt, Pseudomonas aeruginosa PA01
gcacguugcugugcugcaccagc

SEQ ID NO: 1474011 - RNA, 21 nt, Pseudomonas aeruginosa PA01
gcacguugggauagcuuucca

SEQ ID NO: 1474012 - RNA, 16 nt, Pseudomonas aeruginosa PA01
gcacguuguucaccgu

SEQ ID NO: 1474013 - RNA, 22 nt, Pseudomonas aeruginosa PA01
gcacguuguucaccgugauccc

SEQ ID NO: 1474014 - RNA, 11 nt, Pseudomonas aeruginosa PA01
gcacuacgccc

SEQ ID NO: 1474015 - RNA, 13 nt, Pseudomonas aeruginosa PA01
gcacuacgcccau

SEQ ID NO: 1474016 - RNA, 17 nt, Pseudomonas aeruginosa PA01
gcacucauagcucagcu

SEQ ID NO: 1474017 - RNA, 21 nt, Pseudomonas aeruginosa PA01
gcacucauagcucagcuggau

SEQ ID NO: 1474018 - RNA, 19 nt, Pseudomonas aeruginosa PA01
gcagcaacuggucgccgca

SEQ ID NO: 1474019 - RNA, 21 nt, Pseudomonas aeruginosa PA01
gcagcaacuggucgccgcagg

SEQ ID NO: 1474020 - RNA, 14 nt, Pseudomonas aeruginosa PA01
gcagcaacccggcc

SEQ ID NO: 1474021 - RNA, 13 nt, Pseudomonas aeruginosa PA01
gcagaugucgguc

SEQ ID NO: 1474022 - RNA, 23 nt, Pseudomonas aeruginosa PA01
gcagaugucguucuugcgcgguc

SEQ ID NO: 1474023 - RNA, 13 nt, Pseudomonas aeruginosa PA01
gcagcaacagcgc

SEQ ID NO: 1474024 - RNA, 15 nt, Pseudomonas aeruginosa PA01
gcagcaacagcgccg

SEQ ID NO: 1474025 - RNA, 15 nt, Pseudomonas aeruginosa PA01
gcagacuccggcgca

SEQ ID NO: 1474026 - RNA, 16 nt, Pseudomonas aeruginosa PA01
gcagacuccggcgcag

SEQ ID NO: 1474027 - RNA, 20 nt, Pseudomonas aeruginosa PA01
gcagacuccggcgcagccca

SEQ ID NO: 1474028 - RNA, 18 nt, Pseudomonas aeruginosa PA01
gcagacuucgccgugcuc

SEQ ID NO: 1474029 - RNA, 20 nt, Pseudomonas aeruginosa PA01
gcagaugcggggcgaccagc

SEQ ID NO: 1474030 - RNA, 21 nt, Pseudomonas aeruginosa PA01
gcagaugcggggcgaccagca

SEQ ID NO: 1474031 - RNA, 18 nt, Pseudomonas aeruginosa PA01
gcagacgucuuccgggac

SEQ ID NO: 1474032 - RNA, 18 nt, Pseudomonas aeruginosa PA01
gcagagaaaaggccgcuu

SEQ ID NO: 1474033 - RNA, 14 nt, Pseudomonas aeruginosa PA01
gcagauggucgccg

SEQ ID NO: 1474034 - RNA, 13 nt, Pseudomonas aeruginosa PA01
gcagaugcuccag

SEQ ID NO: 1474035 - RNA, 24 nt, Pseudomonas aeruginosa PA01
gcagaugcuccagggagcgcucgc

SEQ ID NO: 1474036 - RNA, 19 nt, Pseudomonas aeruginosa PA01
gcagcaagccgcagcgccc

SEQ ID NO: 1474037 - RNA, 20 nt, Pseudomonas aeruginosa PA01
gcagcaacucgccgccgaca

SEQ ID NO: 1474038 - RNA, 15 nt, Pseudomonas aeruginosa PA01
gcagcacggccucgc

SEQ ID NO: 1474039 - RNA, 14 nt, Pseudomonas aeruginosa PA01
gcagcacggcgacg

SEQ ID NO: 1474040 - RNA, 19 nt, Pseudomonas aeruginosa PA01
gcagcacggcgacgaaggc

SEQ ID NO: 1474041 - RNA, 22 nt, Pseudomonas aeruginosa PA01
gcagcacggcgacgaaggccug

SEQ ID NO: 1474042 - RNA, 23 nt, Pseudomonas aeruginosa PA01
gcagcacggcgacgaaggccugg

SEQ ID NO: 1474043 - RNA, 14 nt, Pseudomonas aeruginosa PA01
gcagcacgaugcac

SEQ ID NO: 1474044 - RNA, 17 nt, Pseudomonas aeruginosa PA01
gcagcacgcugacgccg

SEQ ID NO: 1474045 - RNA, 19 nt, Pseudomonas aeruginosa PA01
gcagcacgcugacgccggc

SEQ ID NO: 1474046 - RNA, 23 nt, Pseudomonas aeruginosa PA01
gcagcagcgguacggucgaggcg

SEQ ID NO: 1474047 - RNA, 14 nt, Pseudomonas aeruginosa PA01
gcagcagcgucgcg

SEQ ID NO: 1474048 - RNA, 14 nt, Pseudomonas aeruginosa PA01
gcagcagcgccuuc

SEQ ID NO: 1474049 - RNA, 22 nt, Pseudomonas aeruginosa PA01
gcagcagcggaucggcggugcc

SEQ ID NO: 1474050 - RNA, 13 nt, Pseudomonas aeruginosa PA01
gcagcagcggcga

SEQ ID NO: 1474051 - RNA, 14 nt, Pseudomonas aeruginosa PA01
gcagcagcgccgcg

SEQ ID NO: 1474052 - RNA, 15 nt, Pseudomonas aeruginosa PA01
gcagcagcgccgcga

SEQ ID NO: 1474053 - RNA, 14 nt, Pseudomonas aeruginosa PA01
gcagcagcgccagg

SEQ ID NO: 1474054 - RNA, 15 nt, Pseudomonas aeruginosa PA01
gcagcagcgccaugc

SEQ ID NO: 1474055 - RNA, 12 nt, Pseudomonas aeruginosa PA01
gcagcagcgcca

SEQ ID NO: 1474056 - RNA, 19 nt, Pseudomonas aeruginosa PA01
gcagcagccaaccgucgcc

SEQ ID NO: 1474057 - RNA, 24 nt, Pseudomonas aeruginosa PA01
gcagcagcgaacgccgcagcucgg

SEQ ID NO: 1474058 - RNA, 16 nt, Pseudomonas aeruginosa PA01
gcagcagcgaccugac

SEQ ID NO: 1474059 - RNA, 13 nt, Pseudomonas aeruginosa PA01
gcagaacacccgg

SEQ ID NO: 1474060 - RNA, 19 nt, Pseudomonas aeruginosa PA01
gcagaaagccccugccgcg

SEQ ID NO: 1474061 - RNA, 14 nt, Pseudomonas aeruginosa PA01
gcacuugcggcagu

SEQ ID NO: 1474062 - RNA, 17 nt, Pseudomonas aeruginosa PA01
gcacuugcggcaguccu

SEQ ID NO: 1474063 - RNA, 22 nt, Pseudomonas aeruginosa PA01
gcagaaggcgcuuucguagggg

SEQ ID NO: 1474064 - RNA, 15 nt, Pseudomonas aeruginosa PA01
gcagaagggcggaga

SEQ ID NO: 1474065 - RNA, 22 nt, Pseudomonas aeruginosa PA01
gcagaacuugcgcaccgcgccg

SEQ ID NO: 1474066 - RNA, 15 nt, Pseudomonas aeruginosa PA01
gcagaacggauagcg

SEQ ID NO: 1474067 - RNA, 14 nt, Pseudomonas aeruginosa PA01
gcagaacgccccgc

SEQ ID NO: 1474068 - RNA, 16 nt, Pseudomonas aeruginosa PA01
gcagaaccgccagcag

SEQ ID NO: 1474069 - RNA, 15 nt, Pseudomonas aeruginosa PA01
gcagaccgacccuca

SEQ ID NO: 1474070 - RNA, 17 nt, Pseudomonas aeruginosa PA01
gcagaccagcgaaccgc

SEQ ID NO: 1474071 - RNA, 19 nt, Pseudomonas aeruginosa PA01
gcagaccagcgaaccgccg

SEQ ID NO: 1474072 - RNA, 23 nt, Pseudomonas aeruginosa PA01
gcagaccagcgaaccgccggccu

SEQ ID NO: 1474073 - RNA, 13 nt, Pseudomonas aeruginosa PA01
gcagaccagcgca

SEQ ID NO: 1474074 - RNA, 21 nt, Pseudomonas aeruginosa PA01
gcagaccagcgcaagcggcgg

SEQ ID NO: 1474075 - RNA, 22 nt, Pseudomonas aeruginosa PA01
gcagaccagcgcaagcggcggc

SEQ ID NO: 1474076 - RNA, 14 nt, Pseudomonas aeruginosa PA01
gcagaccaggccga

SEQ ID NO: 1474077 - RNA, 17 nt, Pseudomonas aeruginosa PA01
gcagaccaggccgagca

SEQ ID NO: 1474078 - RNA, 18 nt, Pseudomonas aeruginosa PA01
gcagacgguucagcagcg

SEQ ID NO: 1474079 - RNA, 22 nt, Pseudomonas aeruginosa PA01
gcagacgguucagcagcggcac

SEQ ID NO: 1474080 - RNA, 13 nt, Pseudomonas aeruginosa PA01
gcagacgucgagg

SEQ ID NO: 1474081 - RNA, 21 nt, Pseudomonas aeruginosa PA01
gcagacggcacgacgccggug

SEQ ID NO: 1474082 - RNA, 22 nt, Pseudomonas aeruginosa PA01
gcagacgauugaccucccgcgc

SEQ ID NO: 1474083 - RNA, 23 nt, Pseudomonas aeruginosa PA01
gcagacgaucuccugcugggcgu

SEQ ID NO: 1474084 - RNA, 18 nt, Pseudomonas aeruginosa PA01
gcagaccuggugggcggc

SEQ ID NO: 1474085 - RNA, 19 nt, Pseudomonas aeruginosa PA01
gcagccgcaggaugccgcc

SEQ ID NO: 1474086 - RNA, 15 nt, Pseudomonas aeruginosa PA01
gcagccgccgcggca

SEQ ID NO: 1474087 - RNA, 13 nt, Pseudomonas aeruginosa PA01
gcagccgcgcucg

SEQ ID NO: 1474088 - RNA, 17 nt, Pseudomonas aeruginosa PA01
gcagccgcucggccgcc

SEQ ID NO: 1474089 - RNA, 19 nt, Pseudomonas aeruginosa PA01
gcagccgcucggccgccag

SEQ ID NO: 1474090 - RNA, 14 nt, Pseudomonas aeruginosa PA01
gcagccgcgcaacc

SEQ ID NO: 1474091 - RNA, 12 nt, Pseudomonas aeruginosa PA01
gcagccggcggc

SEQ ID NO: 1474092 - RNA, 21 nt, Pseudomonas aeruginosa PA01
gcagccuuggcaugaccgagc

SEQ ID NO: 1474093 - RNA, 19 nt, Pseudomonas aeruginosa PA01
gcagccggggcucaggccu

SEQ ID NO: 1474094 - RNA, 13 nt, Pseudomonas aeruginosa PA01
gcagccgggccgc

SEQ ID NO: 1474095 - RNA, 19 nt, Pseudomonas aeruginosa PA01
gcagccggccaugcuggcg

SEQ ID NO: 1474096 - RNA, 21 nt, Pseudomonas aeruginosa PA01
gcagccggcgaacagguagcc

SEQ ID NO: 1474097 - RNA, 15 nt, Pseudomonas aeruginosa PA01
gcagccgcugggcca

SEQ ID NO: 1474098 - RNA, 16 nt, Pseudomonas aeruginosa PA01
gcagccgcugcugcaa

SEQ ID NO: 1474099 - RNA, 20 nt, Pseudomonas aeruginosa PA01
gcagccgcugcugcaaccga

SEQ ID NO: 1474100 - RNA, 12 nt, Pseudomonas aeruginosa PA01
gcagcaggaucc

SEQ ID NO: 1474101 - RNA, 16 nt, Pseudomonas aeruginosa PA01
gcagcaggauccaggu

SEQ ID NO: 1474102 - RNA, 23 nt, Pseudomonas aeruginosa PA01
gcagcaggauccaggugcgcggc

SEQ ID NO: 1474103 - RNA, 16 nt, Pseudomonas aeruginosa PA01
gcagcagcuugccggc

SEQ ID NO: 1474104 - RNA, 21 nt, Pseudomonas aeruginosa PA01
gcagccaugaaaaagccggga

SEQ ID NO: 1474105 - RNA, 22 nt, Pseudomonas aeruginosa PA01
gcagccaucgcauagccggcgc

SEQ ID NO: 1474106 - RNA, 22 nt, Pseudomonas aeruginosa PA01
gcagccauggcuggugcgggug

SEQ ID NO: 1474107 - RNA, 14 nt, Pseudomonas aeruginosa PA01
gcagccauucgccg

SEQ ID NO: 1474108 - RNA, 18 nt, Pseudomonas aeruginosa PA01
gcagccauucgccgcgac

SEQ ID NO: 1474109 - RNA, 13 nt, Pseudomonas aeruginosa PA01
gcagcccagcgcu

SEQ ID NO: 1474110 - RNA, 14 nt, Pseudomonas aeruginosa PA01
gcagcccagccgcu

SEQ ID NO: 1474111 - RNA, 15 nt, Pseudomonas aeruginosa PA01
gcagcccagccgcuc

SEQ ID NO: 1474112 - RNA, 23 nt, Pseudomonas aeruginosa PA01
gcagcccagccgcucgcguccgc

SEQ ID NO: 1474113 - RNA, 19 nt, Pseudomonas aeruginosa PA01
gcagcccaguucgcgcagg

SEQ ID NO: 1474114 - RNA, 23 nt, Pseudomonas aeruginosa PA01
gcagcccuaggcgacccggcauu

SEQ ID NO: 1474115 - RNA, 20 nt, Pseudomonas aeruginosa PA01
gcagcccggucacgccggga

SEQ ID NO: 1474116 - RNA, 21 nt, Pseudomonas aeruginosa PA01
gcagcccgggcaacugccgau

SEQ ID NO: 1474117 - RNA, 17 nt, Pseudomonas aeruginosa PA01
gcagccgaauacccggu

SEQ ID NO: 1474118 - RNA, 13 nt, Pseudomonas aeruginosa PA01
gcagcccuggcgu

SEQ ID NO: 1474119 - RNA, 18 nt, Pseudomonas aeruginosa PA01
gcagcccuggcguggccg

SEQ ID NO: 1474120 - RNA, 23 nt, Pseudomonas aeruginosa PA01
gcagcccuugcaaccgccgccgc

SEQ ID NO: 1474121 - RNA, 17 nt, Pseudomonas aeruginosa PA01
gcagccgauggcgaaca

SEQ ID NO: 1474122 - RNA, 16 nt, Pseudomonas aeruginosa PA01
gcagccgaucgaagaa

SEQ ID NO: 1474123 - RNA, 17 nt, Pseudomonas aeruginosa PA01
gcagccgcaaggccagg

SEQ ID NO: 1474124 - RNA, 20 nt, Pseudomonas aeruginosa PA01
gcagccgcaaggccagggcg

SEQ ID NO: 1474125 - RNA, 21 nt, Pseudomonas aeruginosa PA01
gcagccgcaaggccagggcgg

SEQ ID NO: 1474126 - RNA, 22 nt, Pseudomonas aeruginosa PA01
gcagccgcaaggccagggcggc

SEQ ID NO: 1474127 - RNA, 18 nt, Pseudomonas aeruginosa PA01
gcagcgaagaucuuuucg

SEQ ID NO: 1474128 - RNA, 12 nt, Pseudomonas aeruginosa PA01
gcagcgaacgcc

SEQ ID NO: 1474129 - RNA, 14 nt, Pseudomonas aeruginosa PA01
gcagcgaacgccgc

SEQ ID NO: 1474130 - RNA, 17 nt, Pseudomonas aeruginosa PA01
gcagcgaacgccgcagc

SEQ ID NO: 1474131 - RNA, 22 nt, Pseudomonas aeruginosa PA01
gcagcgaacgggcguugccggc

SEQ ID NO: 1474132 - RNA, 13 nt, Pseudomonas aeruginosa PA01
gcagcgaccacca

SEQ ID NO: 1474133 - RNA, 19 nt, Pseudomonas aeruginosa PA01
gcagcgaccaccaccaggu

SEQ ID NO: 1474134 - RNA, 15 nt, Pseudomonas aeruginosa PA01
gcagcgcaagucggc

SEQ ID NO: 1474135 - RNA, 17 nt, Pseudomonas aeruginosa PA01
gcagcgcaagucggccu

SEQ ID NO: 1474136 - RNA, 20 nt, Pseudomonas aeruginosa PA01
gcagcgcaagucggccugca

SEQ ID NO: 1474137 - RNA, 19 nt, Pseudomonas aeruginosa PA01
gcagcgaugccuccggcuu

SEQ ID NO: 1474138 - RNA, 21 nt, Pseudomonas aeruginosa PA01
gcagcgcacgcuucuccucgg

SEQ ID NO: 1474139 - RNA, 13 nt, Pseudomonas aeruginosa PA01
gcagcgcagccga

SEQ ID NO: 1474140 - RNA, 16 nt, Pseudomonas aeruginosa PA01
gcagcgcaccauccuc

SEQ ID NO: 1474141 - RNA, 22 nt, Pseudomonas aeruginosa PA01
gcagcgccucguggaacagcgc

SEQ ID NO: 1474142 - RNA, 23 nt, Pseudomonas aeruginosa PA01
gcagcgccucguggaacagcgcg

SEQ ID NO: 1474143 - RNA, 15 nt, Pseudomonas aeruginosa PA01
gcagcgccucggcgg

SEQ ID NO: 1474144 - RNA, 16 nt, Pseudomonas aeruginosa PA01
gcagcgccucggcggc

SEQ ID NO: 1474145 - RNA, 23 nt, Pseudomonas aeruginosa PA01
gcagcgccuuuucggcacucagg

SEQ ID NO: 1474146 - RNA, 20 nt, Pseudomonas aeruginosa PA01
gcagcgccuguuccagggcc

SEQ ID NO: 1474147 - RNA, 16 nt, Pseudomonas aeruginosa PA01
gcagcggcgaacccuc

SEQ ID NO: 1474148 - RNA, 14 nt, Pseudomonas aeruginosa PA01
gcagcggcgacacc

SEQ ID NO: 1474149 - RNA, 18 nt, Pseudomonas aeruginosa PA01
gcagcggcgacaccgcca

SEQ ID NO: 1474150 - RNA, 12 nt, Pseudomonas aeruginosa PA01
gcagcggcgccg

SEQ ID NO: 1474151 - RNA, 13 nt, Pseudomonas aeruginosa PA01
gcagcggcgccga

SEQ ID NO: 1474152 - RNA, 15 nt, Pseudomonas aeruginosa PA01
gcagcggcgccgagg

SEQ ID NO: 1474153 - RNA, 18 nt, Pseudomonas aeruginosa PA01
gcagcgcguagaccaccu

SEQ ID NO: 1474154 - RNA, 21 nt, Pseudomonas aeruginosa PA01
gcagcgcgauaucgcaggcca

SEQ ID NO: 1474155 - RNA, 22 nt, Pseudomonas aeruginosa PA01
gcagcgcggucauccgcccugc

SEQ ID NO: 1474156 - RNA, 17 nt, Pseudomonas aeruginosa PA01
gcagcgcggcggcggcc

SEQ ID NO: 1474157 - RNA, 22 nt, Pseudomonas aeruginosa PA01
gcagcgcggcggcggccagcag

SEQ ID NO: 1474158 - RNA, 18 nt, Pseudomonas aeruginosa PA01
gcagcggcucacgcccca

SEQ ID NO: 1474159 - RNA, 13 nt, Pseudomonas aeruginosa PA01
gcagcggcuggcc

SEQ ID NO: 1474160 - RNA, 14 nt, Pseudomonas aeruginosa PA01
gcagcggcuggccg

SEQ ID NO: 1474161 - RNA, 18 nt, Pseudomonas aeruginosa PA01
gcagcggcuggccgucga

SEQ ID NO: 1474162 - RNA, 17 nt, Pseudomonas aeruginosa PA01
gcagcggcuguugccgg

SEQ ID NO: 1474163 - RNA, 20 nt, Pseudomonas aeruginosa PA01
gcagcggcuguugccggaau

SEQ ID NO: 1474164 - RNA, 16 nt, Pseudomonas aeruginosa PA01
gcagcggcgcuuucca

SEQ ID NO: 1474165 - RNA, 18 nt, Pseudomonas aeruginosa PA01
gcagcggcgucugccgcu

SEQ ID NO: 1474166 - RNA, 20 nt, Pseudomonas aeruginosa PA01
gcagcggcggcgccggcagg

SEQ ID NO: 1474167 - RNA, 15 nt, Pseudomonas aeruginosa PA01
gcaggcagcacaugc

SEQ ID NO: 1474168 - RNA, 20 nt, Pseudomonas aeruginosa PA01
gcaggcagcacaugccacgc

SEQ ID NO: 1474169 - RNA, 22 nt, Pseudomonas aeruginosa PA01
gcaggcacgcugccagcaggcc

SEQ ID NO: 1474170 - RNA, 18 nt, Pseudomonas aeruginosa PA01
gcagcgucucggcugccg

SEQ ID NO: 1474171 - RNA, 22 nt, Pseudomonas aeruginosa PA01
gcagcgucucggcugccgccag

SEQ ID NO: 1474172 - RNA, 15 nt, Pseudomonas aeruginosa PA01
gcagcgggccaggcg

SEQ ID NO: 1474173 - RNA, 19 nt, Pseudomonas aeruginosa PA01
gcagcgucgcgucggccug

SEQ ID NO: 1474174 - RNA, 20 nt, Pseudomonas aeruginosa PA01
gcagcgggcguccggcgagc

SEQ ID NO: 1474175 - RNA, 15 nt, Pseudomonas aeruginosa PA01
gcagcgucgccgggc

SEQ ID NO: 1474176 - RNA, 21 nt, Pseudomonas aeruginosa PA01
gcagcgucgccgggcguaacg

SEQ ID NO: 1474177 - RNA, 18 nt, Pseudomonas aeruginosa PA01
gcagcgucgcgcguccag

SEQ ID NO: 1474178 - RNA, 21 nt, Pseudomonas aeruginosa PA01
gcagcgggcugaagugggucg

SEQ ID NO: 1474179 - RNA, 24 nt, Pseudomonas aeruginosa PA01
gcagcgggcugaagugggucgccg

SEQ ID NO: 1474180 - RNA, 16 nt, Pseudomonas aeruginosa PA01
gcaggccgaagcgugg

SEQ ID NO: 1474181 - RNA, 17 nt, Pseudomonas aeruginosa PA01
gcaggccgaaggccagg

SEQ ID NO: 1474182 - RNA, 20 nt, Pseudomonas aeruginosa PA01
gcaggccgaaggccaggacc

SEQ ID NO: 1474183 - RNA, 22 nt, Pseudomonas aeruginosa PA01
gcaggccgaauccgccggcgau

SEQ ID NO: 1474184 - RNA, 13 nt, Pseudomonas aeruginosa PA01
gcaggccgaccuc

SEQ ID NO: 1474185 - RNA, 21 nt, Pseudomonas aeruginosa PA01
gcaggccgaccucggcgguca

SEQ ID NO: 1474186 - RNA, 22 nt, Pseudomonas aeruginosa PA01
gcaggccacgcaccagcucccg

SEQ ID NO: 1474187 - RNA, 12 nt, Pseudomonas aeruginosa PA01
gcaggcccugcc

SEQ ID NO: 1474188 - RNA, 15 nt, Pseudomonas aeruginosa PA01
gcaggccagcgccag

SEQ ID NO: 1474189 - RNA, 16 nt, Pseudomonas aeruginosa PA01
gcaggccagcgccagg

SEQ ID NO: 1474190 - RNA, 17 nt, Pseudomonas aeruginosa PA01
gcaggccagcgccaggg

SEQ ID NO: 1474191 - RNA, 17 nt, Pseudomonas aeruginosa PA01
gcaggccagcgccaggu

SEQ ID NO: 1474192 - RNA, 16 nt, Pseudomonas aeruginosa PA01
gcaggccacggccgcu

SEQ ID NO: 1474193 - RNA, 14 nt, Pseudomonas aeruginosa PA01
gcaggcagugccgg

SEQ ID NO: 1474194 - RNA, 21 nt, Pseudomonas aeruginosa PA01
gcaggcaguggcgccagccag

SEQ ID NO: 1474195 - RNA, 14 nt, Pseudomonas aeruginosa PA01
gcaggcaggucgcu

SEQ ID NO: 1474196 - RNA, 13 nt, Pseudomonas aeruginosa PA01
gcaggcagcgcgc

SEQ ID NO: 1474197 - RNA, 20 nt, Pseudomonas aeruginosa PA01
gcaggcagcgcgcgucgguc

SEQ ID NO: 1474198 - RNA, 21 nt, Pseudomonas aeruginosa PA01
gcaggcaugcggccccggcgc

SEQ ID NO: 1474199 - RNA, 15 nt, Pseudomonas aeruginosa PA01
gcaggccgcuggcga

SEQ ID NO: 1474200 - RNA, 23 nt, Pseudomonas aeruginosa PA01
gcaggccguccuugaguagcugg

SEQ ID NO: 1474201 - RNA, 14 nt, Pseudomonas aeruginosa PA01
gcaggcgcagcagc

SEQ ID NO: 1474202 - RNA, 14 nt, Pseudomonas aeruginosa PA01
gcaggcgcccuggc

SEQ ID NO: 1474203 - RNA, 15 nt, Pseudomonas aeruginosa PA01
gcaggcgcccuggcc

SEQ ID NO: 1474204 - RNA, 17 nt, Pseudomonas aeruginosa PA01
gcaggcgccggccgggc

SEQ ID NO: 1474205 - RNA, 13 nt, Pseudomonas aeruginosa PA01
gcaggcgccggcg

SEQ ID NO: 1474206 - RNA, 15 nt, Pseudomonas aeruginosa PA01
gcaggcgccggcgga

SEQ ID NO: 1474207 - RNA, 18 nt, Pseudomonas aeruginosa PA01
gcaggcgccggcggauca

SEQ ID NO: 1474208 - RNA, 15 nt, Pseudomonas aeruginosa PA01
gcaggcgcaggucgg

SEQ ID NO: 1474209 - RNA, 18 nt, Pseudomonas aeruginosa PA01
gcaggcgcaggucggccu

SEQ ID NO: 1474210 - RNA, 22 nt, Pseudomonas aeruginosa PA01
gcaggcgcguugcuuccaggca

SEQ ID NO: 1474211 - RNA, 16 nt, Pseudomonas aeruginosa PA01
gcaggcgcuauccgcc

SEQ ID NO: 1474212 - RNA, 18 nt, Pseudomonas aeruginosa PA01
gcaggcgcuauccgccgu

SEQ ID NO: 1474213 - RNA, 18 nt, Pseudomonas aeruginosa PA01
gcaggcgcgggcuggcca

SEQ ID NO: 1474214 - RNA, 21 nt, Pseudomonas aeruginosa PA01
gcaggcgcgggcuggccaccg

SEQ ID NO: 1474215 - RNA, 19 nt, Pseudomonas aeruginosa PA01
gcaggcgcauggcguucug

SEQ ID NO: 1474216 - RNA, 17 nt, Pseudomonas aeruginosa PA01
gcaggcgcauguccagc

SEQ ID NO: 1474217 - RNA, 20 nt, Pseudomonas aeruginosa PA01
gcaggcgcauguccagccag

SEQ ID NO: 1474218 - RNA, 19 nt, Pseudomonas aeruginosa PA01
gcaggcgccaaccgggcag

SEQ ID NO: 1474219 - RNA, 21 nt, Pseudomonas aeruginosa PA01
gcaggcgccaaccgggcagca

SEQ ID NO: 1474220 - RNA, 21 nt, Pseudomonas aeruginosa PA01
gcaggccgccgcgugccgccg

SEQ ID NO: 1474221 - RNA, 17 nt, Pseudomonas aeruginosa PA01
gcaggccgaggccggcg

SEQ ID NO: 1474222 - RNA, 12 nt, Pseudomonas aeruginosa PA01
gcaggccgacgg

SEQ ID NO: 1474223 - RNA, 20 nt, Pseudomonas aeruginosa PA01
gcaggccgacggcgcgcugc

SEQ ID NO: 1474224 - RNA, 17 nt, Pseudomonas aeruginosa PA01
gcaggccgacguagccg

SEQ ID NO: 1474225 - RNA, 18 nt, Pseudomonas aeruginosa PA01
gcaggccgagcccgagug

SEQ ID NO: 1474226 - RNA, 17 nt, Pseudomonas aeruginosa PA01
gcaggccgagguuucca

SEQ ID NO: 1474227 - RNA, 22 nt, Pseudomonas aeruginosa PA01
gcaggccgagguuuccaguugc

SEQ ID NO: 1474228 - RNA, 20 nt, Pseudomonas aeruginosa PA01
gcaggccgaucaccagcgcc

SEQ ID NO: 1474229 - RNA, 23 nt, Pseudomonas aeruginosa PA01
gcaggccgaucucgugggccagc

SEQ ID NO: 1474230 - RNA, 13 nt, Pseudomonas aeruginosa PA01
gcaggccgauggc

SEQ ID NO: 1474231 - RNA, 15 nt, Pseudomonas aeruginosa PA01
gcaggccgccgaucc

SEQ ID NO: 1474232 - RNA, 21 nt, Pseudomonas aeruginosa PA01
gcaggccgccgaucccgacgc

SEQ ID NO: 1474233 - RNA, 18 nt, Pseudomonas aeruginosa PA01
gcaggccgggcuggccac

SEQ ID NO: 1474234 - RNA, 20 nt, Pseudomonas aeruginosa PA01
gcaggccgggcuggccaccg

SEQ ID NO: 1474235 - RNA, 19 nt, Pseudomonas aeruginosa PA01
gcaggccggccuccagcgc

SEQ ID NO: 1474236 - RNA, 15 nt, Pseudomonas aeruginosa PA01
gcaggccggcgacca

SEQ ID NO: 1474237 - RNA, 18 nt, Pseudomonas aeruginosa PA01
gcaggccggcgagccagg

SEQ ID NO: 1474238 - RNA, 19 nt, Pseudomonas aeruginosa PA01
gcaggccggcgagccaggu

SEQ ID NO: 1474239 - RNA, 12 nt, Pseudomonas aeruginosa PA01
gcaggccgcggc

SEQ ID NO: 1474240 - RNA, 16 nt, Pseudomonas aeruginosa PA01
gcaggccgccggcggc

SEQ ID NO: 1474241 - RNA, 17 nt, Pseudomonas aeruginosa PA01
gcaggccgccggcggcc

SEQ ID NO: 1474242 - RNA, 14 nt, Pseudomonas aeruginosa PA01
gcaggccgcggccg

SEQ ID NO: 1474243 - RNA, 16 nt, Pseudomonas aeruginosa PA01
gcaggucgaggcgcuc

SEQ ID NO: 1474244 - RNA, 23 nt, Pseudomonas aeruginosa PA01
gcagguccuggguauagaccagc

SEQ ID NO: 1474245 - RNA, 14 nt, Pseudomonas aeruginosa PA01
gcaggucgcggccc

SEQ ID NO: 1474246 - RNA, 16 nt, Pseudomonas aeruginosa PA01
gcaggucgcgacaggu

SEQ ID NO: 1474247 - RNA, 15 nt, Pseudomonas aeruginosa PA01
gcaggucggccucgg

SEQ ID NO: 1474248 - RNA, 18 nt, Pseudomonas aeruginosa PA01
gcaggucggccucggcga

SEQ ID NO: 1474249 - RNA, 13 nt, Pseudomonas aeruginosa PA01
gcaggucgcugcc

SEQ ID NO: 1474250 - RNA, 22 nt, Pseudomonas aeruginosa PA01
gcaggucgcuggcgucgaccgc

SEQ ID NO: 1474251 - RNA, 21 nt, Pseudomonas aeruginosa PA01
gcaggucggcgcgacggccca

SEQ ID NO: 1474252 - RNA, 17 nt, Pseudomonas aeruginosa PA01
gcaggucgugcagcccg

SEQ ID NO: 1474253 - RNA, 14 nt, Pseudomonas aeruginosa PA01
gcaggucguugacg

SEQ ID NO: 1474254 - RNA, 18 nt, Pseudomonas aeruginosa PA01
gcaggucucaccgcccug

SEQ ID NO: 1474255 - RNA, 13 nt, Pseudomonas aeruginosa PA01
gcaggucgucggc

SEQ ID NO: 1474256 - RNA, 15 nt, Pseudomonas aeruginosa PA01
gcaggucgucggcga

SEQ ID NO: 1474257 - RNA, 19 nt, Pseudomonas aeruginosa PA01
gcaggucgucggcgaaagc

SEQ ID NO: 1474258 - RNA, 21 nt, Pseudomonas aeruginosa PA01
gcaggucaugaaggaaaccgg

SEQ ID NO: 1474259 - RNA, 16 nt, Pseudomonas aeruginosa PA01
gcaggucacgcccugc

SEQ ID NO: 1474260 - RNA, 18 nt, Pseudomonas aeruginosa PA01
gcagguaucgcugggcgc

SEQ ID NO: 1474261 - RNA, 22 nt, Pseudomonas aeruginosa PA01
gcagguagucgcucauggcgcc

SEQ ID NO: 1474262 - RNA, 20 nt, Pseudomonas aeruginosa PA01
gcagguaguucuccaggccc

SEQ ID NO: 1474263 - RNA, 24 nt, Pseudomonas aeruginosa PA01
gcagguccgcgccucgcgcaacgc

SEQ ID NO: 1474264 - RNA, 21 nt, Pseudomonas aeruginosa PA01
gcagguccgacggaaauaggc

SEQ ID NO: 1474265 - RNA, 23 nt, Pseudomonas aeruginosa PA01
gcaggguucggggaacagcgcca

SEQ ID NO: 1474266 - RNA, 14 nt, Pseudomonas aeruginosa PA01
gcagguaguccagc

SEQ ID NO: 1474267 - RNA, 17 nt, Pseudomonas aeruginosa PA01
gcagguaguccagccag

SEQ ID NO: 1474268 - RNA, 18 nt, Pseudomonas aeruginosa PA01
gcagguaguccagccagu

SEQ ID NO: 1474269 - RNA, 21 nt, Pseudomonas aeruginosa PA01
gcagguagcagccguccagcu

SEQ ID NO: 1474270 - RNA, 23 nt, Pseudomonas aeruginosa PA01
gcagguagccaggggucaggccg

SEQ ID NO: 1474271 - RNA, 13 nt, Pseudomonas aeruginosa PA01
gcagguagccgcg

SEQ ID NO: 1474272 - RNA, 17 nt, Pseudomonas aeruginosa PA01
gcagguagccgcgccgg

SEQ ID NO: 1474273 - RNA, 16 nt, Pseudomonas aeruginosa PA01
gcagguagccugcggc

SEQ ID NO: 1474274 - RNA, 18 nt, Pseudomonas aeruginosa PA01
gcagguagccugcggcca

SEQ ID NO: 1474275 - RNA, 20 nt, Pseudomonas aeruginosa PA01
gcagguagccugcggccagc

SEQ ID NO: 1474276 - RNA, 15 nt, Pseudomonas aeruginosa PA01
gcagguagcgcugcg

SEQ ID NO: 1474277 - RNA, 19 nt, Pseudomonas aeruginosa PA01
gcagguagcgcugcgcccg

SEQ ID NO: 1474278 - RNA, 23 nt, Pseudomonas aeruginosa PA01
gcagguagcgcugcgcccgcucg

SEQ ID NO: 1474279 - RNA, 18 nt, Pseudomonas aeruginosa PA01
gcagguagcugagcaggc

SEQ ID NO: 1474280 - RNA, 17 nt, Pseudomonas aeruginosa PA01
gcagguagcugcuccag

SEQ ID NO: 1474281 - RNA, 16 nt, Pseudomonas aeruginosa PA01
gcagguacggcgccgc

SEQ ID NO: 1474282 - RNA, 17 nt, Pseudomonas aeruginosa PA01
gcagguacggcgccgcu

SEQ ID NO: 1474283 - RNA, 16 nt, Pseudomonas aeruginosa PA01
gcagguaacccgcggc

SEQ ID NO: 1474284 - RNA, 14 nt, Pseudomonas aeruginosa PA01
gcagguacagcagc

SEQ ID NO: 1474285 - RNA, 17 nt, Pseudomonas aeruginosa PA01
gcagguacucgccggcg

SEQ ID NO: 1474286 - RNA, 19 nt, Pseudomonas aeruginosa PA01
gcagguagaaggugcccag

SEQ ID NO: 1474287 - RNA, 23 nt, Pseudomonas aeruginosa PA01
gcagguagaaggugcccagcggc

SEQ ID NO: 1474288 - RNA, 21 nt, Pseudomonas aeruginosa PA01
gcagguagaccacgcaggcca

SEQ ID NO: 1474289 - RNA, 13 nt, Pseudomonas aeruginosa PA01
gcagguagaccuc

SEQ ID NO: 1474290 - RNA, 14 nt, Pseudomonas aeruginosa PA01
gcagguagacgcag

SEQ ID NO: 1474291 - RNA, 19 nt, Pseudomonas aeruginosa PA01
gcagggcgguacgccgcgc

SEQ ID NO: 1474292 - RNA, 18 nt, Pseudomonas aeruginosa PA01
gcagggcguaggcgucgc

SEQ ID NO: 1474293 - RNA, 22 nt, Pseudomonas aeruginosa PA01
gcagggcguaggcgucgcgaac

SEQ ID NO: 1474294 - RNA, 21 nt, Pseudomonas aeruginosa PA01
gcagggcgucccguuccggcg

SEQ ID NO: 1474295 - RNA, 23 nt, Pseudomonas aeruginosa PA01
gcagggcgucccguuccggcgca

SEQ ID NO: 1474296 - RNA, 14 nt, Pseudomonas aeruginosa PA01
gcagggcgucgccc

SEQ ID NO: 1474297 - RNA, 13 nt, Pseudomonas aeruginosa PA01
gcagggcggcgcc

SEQ ID NO: 1474298 - RNA, 19 nt, Pseudomonas aeruginosa PA01
gcagggcggcgccuggagc

SEQ ID NO: 1474299 - RNA, 18 nt, Pseudomonas aeruginosa PA01
gcagggcggcuuccaggu

SEQ ID NO: 1474300 - RNA, 18 nt, Pseudomonas aeruginosa PA01
gcagggcgcugagcgcgg

SEQ ID NO: 1474301 - RNA, 21 nt, Pseudomonas aeruginosa PA01
gcagggcgcugagcgcgguca

SEQ ID NO: 1474302 - RNA, 13 nt, Pseudomonas aeruginosa PA01
gcagggccuggcc

SEQ ID NO: 1474303 - RNA, 12 nt, Pseudomonas aeruginosa PA01
gcagggugcugu

SEQ ID NO: 1474304 - RNA, 22 nt, Pseudomonas aeruginosa PA01
gcagggugcuguguucgaucuc

SEQ ID NO: 1474305 - RNA, 13 nt, Pseudomonas aeruginosa PA01
gcaggguggccag

SEQ ID NO: 1474306 - RNA, 16 nt, Pseudomonas aeruginosa PA01
gcagggcgucggcgug

SEQ ID NO: 1474307 - RNA, 14 nt, Pseudomonas aeruginosa PA01
gcagggcgucggcg

SEQ ID NO: 1474308 - RNA, 22 nt, Pseudomonas aeruginosa PA01
gcagggcuuccuuggcgggaug

SEQ ID NO: 1474309 - RNA, 20 nt, Pseudomonas aeruginosa PA01
gcagggcuauguauucggcg

SEQ ID NO: 1474310 - RNA, 23 nt, Pseudomonas aeruginosa PA01
gcaggguguugaucaccgcggug

SEQ ID NO: 1474311 - RNA, 14 nt, Pseudomonas aeruginosa PA01
gcaggguggccagg

SEQ ID NO: 1474312 - RNA, 14 nt, Pseudomonas aeruginosa PA01
gcaggguggcgacg

SEQ ID NO: 1474313 - RNA, 16 nt, Pseudomonas aeruginosa PA01
gcaggcugccggacgc

SEQ ID NO: 1474314 - RNA, 16 nt, Pseudomonas aeruginosa PA01
gcaggcugccguugcg

SEQ ID NO: 1474315 - RNA, 19 nt, Pseudomonas aeruginosa PA01
gcaggcugccguugcggcc

SEQ ID NO: 1474316 - RNA, 13 nt, Pseudomonas aeruginosa PA01
gcaggcugccuuc

SEQ ID NO: 1474317 - RNA, 13 nt, Pseudomonas aeruginosa PA01
gcagggccucgcu

SEQ ID NO: 1474318 - RNA, 17 nt, Pseudomonas aeruginosa PA01
gcagggcgaugccgaug

SEQ ID NO: 1474319 - RNA, 16 nt, Pseudomonas aeruginosa PA01
gcagggcgauggccag

SEQ ID NO: 1474320 - RNA, 21 nt, Pseudomonas aeruginosa PA01
gcagggcgauggccagcgcgu

SEQ ID NO: 1474321 - RNA, 16 nt, Pseudomonas aeruginosa PA01
gcagggcgcaaccugg

SEQ ID NO: 1474322 - RNA, 12 nt, Pseudomonas aeruginosa PA01
gcagggcgcccg

SEQ ID NO: 1474323 - RNA, 16 nt, Pseudomonas aeruginosa PA01
gcaggcucucgcgcag

SEQ ID NO: 1474324 - RNA, 17 nt, Pseudomonas aeruginosa PA01
gcaggcucucgcgcagc

SEQ ID NO: 1474325 - RNA, 18 nt, Pseudomonas aeruginosa PA01
gcaggcucucgcgcagca

SEQ ID NO: 1474326 - RNA, 16 nt, Pseudomonas aeruginosa PA01
gcaggcucaucgcccg

SEQ ID NO: 1474327 - RNA, 19 nt, Pseudomonas aeruginosa PA01
gcaggcucaucgcccgccc

SEQ ID NO: 1474328 - RNA, 23 nt, Pseudomonas aeruginosa PA01
gcaggcucagcgcaugcggaagg

SEQ ID NO: 1474329 - RNA, 22 nt, Pseudomonas aeruginosa PA01
gcaggcucacgcguucggcgau

SEQ ID NO: 1474330 - RNA, 24 nt, Pseudomonas aeruginosa PA01
gcaggcucacgcguucggcgaugc

SEQ ID NO: 1474331 - RNA, 15 nt, Pseudomonas aeruginosa PA01
gcaggcguucggcga

SEQ ID NO: 1474332 - RNA, 17 nt, Pseudomonas aeruginosa PA01
gcaggcguucggcgaug

SEQ ID NO: 1474333 - RNA, 19 nt, Pseudomonas aeruginosa PA01
gcaggcguugcagugcgcc

SEQ ID NO: 1474334 - RNA, 21 nt, Pseudomonas aeruginosa PA01
gcaggcguugcagugcgccgc

SEQ ID NO: 1474335 - RNA, 15 nt, Pseudomonas aeruginosa PA01
gcaggcgcugcagcc

SEQ ID NO: 1474336 - RNA, 17 nt, Pseudomonas aeruginosa PA01
gcaggcgcucggcgacg

SEQ ID NO: 1474337 - RNA, 18 nt, Pseudomonas aeruginosa PA01
gcaggcgcucggcgacgc

SEQ ID NO: 1474338 - RNA, 21 nt, Pseudomonas aeruginosa PA01
gcaggcgcucgcgggccgccu

SEQ ID NO: 1474339 - RNA, 15 nt, Pseudomonas aeruginosa PA01
gcaggcggucgccga

SEQ ID NO: 1474340 - RNA, 21 nt, Pseudomonas aeruginosa PA01
gcaggcggucgccgaacagcc

SEQ ID NO: 1474341 - RNA, 14 nt, Pseudomonas aeruginosa PA01
gcaggcggucggaa

SEQ ID NO: 1474342 - RNA, 22 nt, Pseudomonas aeruginosa PA01
gcaggcggucggaaagcagggc

SEQ ID NO: 1474343 - RNA, 21 nt, Pseudomonas aeruginosa PA01
gcaggcggucggccaucuggc

SEQ ID NO: 1474344 - RNA, 13 nt, Pseudomonas aeruginosa PA01
gcaucaccccgca

SEQ ID NO: 1474345 - RNA, 13 nt, Pseudomonas aeruginosa PA01
gcaucaccgcggu

SEQ ID NO: 1474346 - RNA, 22 nt, Pseudomonas aeruginosa PA01
gcaucaccgcgguggaggcggc

SEQ ID NO: 1474347 - RNA, 23 nt, Pseudomonas aeruginosa PA01
gcaucaccgcgguggaggcggcg

SEQ ID NO: 1474348 - RNA, 13 nt, Pseudomonas aeruginosa PA01
gcaucaccaggcu

SEQ ID NO: 1474349 - RNA, 19 nt, Pseudomonas aeruginosa PA01
gcauaggucaugcccaggc

SEQ ID NO: 1474350 - RNA, 20 nt, Pseudomonas aeruginosa PA01
gcauaggucaugcccaggcc

SEQ ID NO: 1474351 - RNA, 21 nt, Pseudomonas aeruginosa PA01
gcauaggucaugcccaggccg

SEQ ID NO: 1474352 - RNA, 14 nt, Pseudomonas aeruginosa PA01
gcauccgccgcugg

SEQ ID NO: 1474353 - RNA, 16 nt, Pseudomonas aeruginosa PA01
gcaucgaaggcgccgg

SEQ ID NO: 1474354 - RNA, 18 nt, Pseudomonas aeruginosa PA01
gcaucgaaggcgccggca

SEQ ID NO: 1474355 - RNA, 15 nt, Pseudomonas aeruginosa PA01
gcaucgaccagggcc

SEQ ID NO: 1474356 - RNA, 16 nt, Pseudomonas aeruginosa PA01
gcaucgaccuugcccu

SEQ ID NO: 1474357 - RNA, 22 nt, Pseudomonas aeruginosa PA01
gcaucccgcccggucucagccg

SEQ ID NO: 1474358 - RNA, 14 nt, Pseudomonas aeruginosa PA01
gcaucgaggccgcc

SEQ ID NO: 1474359 - RNA, 16 nt, Pseudomonas aeruginosa PA01
gcaucgaggccgccca

SEQ ID NO: 1474360 - RNA, 18 nt, Pseudomonas aeruginosa PA01
gcaucgaggccgcccagc

SEQ ID NO: 1474361 - RNA, 18 nt, Pseudomonas aeruginosa PA01
gcaucgaggccggcaugc

SEQ ID NO: 1474362 - RNA, 13 nt, Pseudomonas aeruginosa PA01
gcauccggcaggc

SEQ ID NO: 1474363 - RNA, 22 nt, Pseudomonas aeruginosa PA01
gcaucgacgauguacugcucgg

SEQ ID NO: 1474364 - RNA, 17 nt, Pseudomonas aeruginosa PA01
gcaucgacgccagcggc

SEQ ID NO: 1474365 - RNA, 20 nt, Pseudomonas aeruginosa PA01
gcaucgacgccagcggcgau

SEQ ID NO: 1474366 - RNA, 17 nt, Pseudomonas aeruginosa PA01
gcaucgcaucggcgacc

SEQ ID NO: 1474367 - RNA, 18 nt, Pseudomonas aeruginosa PA01
gcaucgccauggcgcugc

SEQ ID NO: 1474368 - RNA, 12 nt, Pseudomonas aeruginosa PA01
gcaucgccgaca

SEQ ID NO: 1474369 - RNA, 19 nt, Pseudomonas aeruginosa PA01
gcaucgaucuugcccaugu

SEQ ID NO: 1474370 - RNA, 15 nt, Pseudomonas aeruginosa PA01
gcaucgauccgcacc

SEQ ID NO: 1474371 - RNA, 13 nt, Pseudomonas aeruginosa PA01
gcaucgccgccca

SEQ ID NO: 1474372 - RNA, 14 nt, Pseudomonas aeruginosa PA01
gcaucgccggcagc

SEQ ID NO: 1474373 - RNA, 21 nt, Pseudomonas aeruginosa PA01
gcaucgccggcagcgccgcgc

SEQ ID NO: 1474374 - RNA, 18 nt, Pseudomonas aeruginosa PA01
gcaucgccugggccggcg

SEQ ID NO: 1474375 - RNA, 19 nt, Pseudomonas aeruginosa PA01
gcaucgccugggccggcgu

SEQ ID NO: 1474376 - RNA, 22 nt, Pseudomonas aeruginosa PA01
gcaucgcgcacaugccgagcga

SEQ ID NO: 1474377 - RNA, 13 nt, Pseudomonas aeruginosa PA01
gcaucgccggggc

SEQ ID NO: 1474378 - RNA, 20 nt, Pseudomonas aeruginosa PA01
gcaucgcggacaccgcggug

SEQ ID NO: 1474379 - RNA, 14 nt, Pseudomonas aeruginosa PA01
gcaguugccaggag

SEQ ID NO: 1474380 - RNA, 17 nt, Pseudomonas aeruginosa PA01
gcaguugcgggcgcagg

SEQ ID NO: 1474381 - RNA, 14 nt, Pseudomonas aeruginosa PA01
gcaguucgucgcca

SEQ ID NO: 1474382 - RNA, 23 nt, Pseudomonas aeruginosa PA01
gcaguucgucuuccagcggccac

SEQ ID NO: 1474383 - RNA, 12 nt, Pseudomonas aeruginosa PA01
gcauaaccgcuu

SEQ ID NO: 1474384 - RNA, 16 nt, Pseudomonas aeruginosa PA01
gcauaaccgcuugcgg

SEQ ID NO: 1474385 - RNA, 17 nt, Pseudomonas aeruginosa PA01
gcauaaccggaagcgau

SEQ ID NO: 1474386 - RNA, 19 nt, Pseudomonas aeruginosa PA01
gcauagaugccggccucga

SEQ ID NO: 1474387 - RNA, 21 nt, Pseudomonas aeruginosa PA01
gcauagaugccggccucgacg

SEQ ID NO: 1474388 - RNA, 23 nt, Pseudomonas aeruginosa PA01
gcauagcagaugucguucuugcg

SEQ ID NO: 1474389 - RNA, 13 nt, Pseudomonas aeruginosa PA01
gcauagcaggccu

SEQ ID NO: 1474390 - RNA, 16 nt, Pseudomonas aeruginosa PA01
gcauagcaggccugga

SEQ ID NO: 1474391 - RNA, 17 nt, Pseudomonas aeruginosa PA01
gcauagcaggccuggag

SEQ ID NO: 1474392 - RNA, 14 nt, Pseudomonas aeruginosa PA01
gcauagcugaucuc

SEQ ID NO: 1474393 - RNA, 15 nt, Pseudomonas aeruginosa PA01
gcauagccggcgcgc

SEQ ID NO: 1474394 - RNA, 16 nt, Pseudomonas aeruginosa PA01
gcauagccggcgcgcc

SEQ ID NO: 1474395 - RNA, 19 nt, Pseudomonas aeruginosa PA01
gcauagccggcgcgcccgg

SEQ ID NO: 1474396 - RNA, 13 nt, Pseudomonas aeruginosa PA01
gcagguggccgga

SEQ ID NO: 1474397 - RNA, 16 nt, Pseudomonas aeruginosa PA01
gcagguggacggcauu

SEQ ID NO: 1474398 - RNA, 22 nt, Pseudomonas aeruginosa PA01
gcagguggcgcagccguccauc

SEQ ID NO: 1474399 - RNA, 12 nt, Pseudomonas aeruginosa PA01
gcagguggcggg

SEQ ID NO: 1474400 - RNA, 14 nt, Pseudomonas aeruginosa PA01
gcagguggcuggcc

SEQ ID NO: 1474401 - RNA, 19 nt, Pseudomonas aeruginosa PA01
gcagguggucguugcgcgc

SEQ ID NO: 1474402 - RNA, 21 nt, Pseudomonas aeruginosa PA01
gcagguggucguugcgcgcca

SEQ ID NO: 1474403 - RNA, 21 nt, Pseudomonas aeruginosa PA01
gcagguucaccgccucggaga

SEQ ID NO: 1474404 - RNA, 19 nt, Pseudomonas aeruginosa PA01
gcagguucagcaggucgcg

SEQ ID NO: 1474405 - RNA, 21 nt, Pseudomonas aeruginosa PA01
gcagguucaucgccgccaggc

SEQ ID NO: 1474406 - RNA, 22 nt, Pseudomonas aeruginosa PA01
gcagguucaucgccgccaggca

SEQ ID NO: 1474407 - RNA, 23 nt, Pseudomonas aeruginosa PA01
gcagguucaucgccgccaggcag

SEQ ID NO: 1474408 - RNA, 18 nt, Pseudomonas aeruginosa PA01
gcagguguucggcggcgu

SEQ ID NO: 1474409 - RNA, 16 nt, Pseudomonas aeruginosa PA01
gcaggugcccuggcag

SEQ ID NO: 1474410 - RNA, 20 nt, Pseudomonas aeruginosa PA01
gcaggugcccuggcagacgc

SEQ ID NO: 1474411 - RNA, 18 nt, Pseudomonas aeruginosa PA01
gcaggugcaccgcgcugg

SEQ ID NO: 1474412 - RNA, 22 nt, Pseudomonas aeruginosa PA01
gcaggugcaccgcgcuggagac

SEQ ID NO: 1474413 - RNA, 21 nt, Pseudomonas aeruginosa PA01
gcaggucuuccaccgcgucga

SEQ ID NO: 1474414 - RNA, 13 nt, Pseudomonas aeruginosa PA01
gcagugccgggcg

SEQ ID NO: 1474415 - RNA, 18 nt, Pseudomonas aeruginosa PA01
gcagguugaccccgcggc

SEQ ID NO: 1474416 - RNA, 19 nt, Pseudomonas aeruginosa PA01
gcagguugauccugggcgc

SEQ ID NO: 1474417 - RNA, 20 nt, Pseudomonas aeruginosa PA01
gcagguucgaaugcugcccg

SEQ ID NO: 1474418 - RNA, 20 nt, Pseudomonas aeruginosa PA01
gcagugcgcccucgaacggc

SEQ ID NO: 1474419 - RNA, 21 nt, Pseudomonas aeruginosa PA01
gcaguucguccaucgccaggc

SEQ ID NO: 1474420 - RNA, 22 nt, Pseudomonas aeruginosa PA01
gcaguucguccaucgccaggcc

SEQ ID NO: 1474421 - RNA, 23 nt, Pseudomonas aeruginosa PA01
gcaguucguccaucgccaggcca

SEQ ID NO: 1474422 - RNA, 13 nt, Pseudomonas aeruginosa PA01
gcauuucagcgga

SEQ ID NO: 1474423 - RNA, 14 nt, Pseudomonas aeruginosa PA01
gcauugucccugcg

SEQ ID NO: 1474424 - RNA, 18 nt, Pseudomonas aeruginosa PA01
gcauuggccaggccccag

SEQ ID NO: 1474425 - RNA, 16 nt, Pseudomonas aeruginosa PA01
gcauuggugcugcgcg

SEQ ID NO: 1474426 - RNA, 22 nt, Pseudomonas aeruginosa PA01
gccaaagccgcaauccgccgcu

SEQ ID NO: 1474427 - RNA, 22 nt, Pseudomonas aeruginosa PA01
gccaaacccagcgacaacggcg

SEQ ID NO: 1474428 - RNA, 16 nt, Pseudomonas aeruginosa PA01
gccaaccaccggcgca

SEQ ID NO: 1474429 - RNA, 16 nt, Pseudomonas aeruginosa PA01
gccaacccucggaugc

SEQ ID NO: 1474430 - RNA, 22 nt, Pseudomonas aeruginosa PA01
gccaacccucggaugccgcaca

SEQ ID NO: 1474431 - RNA, 18 nt, Pseudomonas aeruginosa PA01
gccaaccgggcagcagcc

SEQ ID NO: 1474432 - RNA, 19 nt, Pseudomonas aeruginosa PA01
gccaaccgcgcucggcggu

SEQ ID NO: 1474433 - RNA, 17 nt, Pseudomonas aeruginosa PA01
gccaaccgucgcccugg

SEQ ID NO: 1474434 - RNA, 18 nt, Pseudomonas aeruginosa PA01
gccaaccgucgcccuggu

SEQ ID NO: 1474435 - RNA, 20 nt, Pseudomonas aeruginosa PA01
gccaaccgucgcccuggugc

SEQ ID NO: 1474436 - RNA, 15 nt, Pseudomonas aeruginosa PA01
gccaacgcccgggcc

SEQ ID NO: 1474437 - RNA, 21 nt, Pseudomonas aeruginosa PA01
gccaacgcccgggccgggggc

SEQ ID NO: 1474438 - RNA, 16 nt, Pseudomonas aeruginosa PA01
gcauucgacccgccga

SEQ ID NO: 1474439 - RNA, 16 nt, Pseudomonas aeruginosa PA01
gcauuccucagcgccg

SEQ ID NO: 1474440 - RNA, 20 nt, Pseudomonas aeruginosa PA01
gcauuccuccagggucgccc

SEQ ID NO: 1474441 - RNA, 23 nt, Pseudomonas aeruginosa PA01
gcauugacacggauauccgggcc

SEQ ID NO: 1474442 - RNA, 19 nt, Pseudomonas aeruginosa PA01
gcauucguccagccgccgc

SEQ ID NO: 1474443 - RNA, 21 nt, Pseudomonas aeruginosa PA01
gcauucguccagccgccgcug

SEQ ID NO: 1474444 - RNA, 12 nt, Pseudomonas aeruginosa PA01
gcauucgucgcc

SEQ ID NO: 1474445 - RNA, 15 nt, Pseudomonas aeruginosa PA01
gcauucgucgccgcu

SEQ ID NO: 1474446 - RNA, 17 nt, Pseudomonas aeruginosa PA01
gcauucgucgccgcugg

SEQ ID NO: 1474447 - RNA, 20 nt, Pseudomonas aeruginosa PA01
gcauugacccgggugccuuc

SEQ ID NO: 1474448 - RNA, 19 nt, Pseudomonas aeruginosa PA01
gcauugcgcuugcgaucga

SEQ ID NO: 1474449 - RNA, 14 nt, Pseudomonas aeruginosa PA01
gcauguccaccgcc

SEQ ID NO: 1474450 - RNA, 16 nt, Pseudomonas aeruginosa PA01
gcauguagcgcgccga

SEQ ID NO: 1474451 - RNA, 21 nt, Pseudomonas aeruginosa PA01
gcaugucgagguugcgcucca

SEQ ID NO: 1474452 - RNA, 23 nt, Pseudomonas aeruginosa PA01
gcauguccucggcgccgucgauc

SEQ ID NO: 1474453 - RNA, 13 nt, Pseudomonas aeruginosa PA01
gcauguucaugcg

SEQ ID NO: 1474454 - RNA, 15 nt, Pseudomonas aeruginosa PA01
gcauguuggcgccuu

SEQ ID NO: 1474455 - RNA, 22 nt, Pseudomonas aeruginosa PA01
gcauguuguuauggccgacccg

SEQ ID NO: 1474456 - RNA, 16 nt, Pseudomonas aeruginosa PA01
gcaugucuucgucgcg

SEQ ID NO: 1474457 - RNA, 17 nt, Pseudomonas aeruginosa PA01
gcaugucuucgucgcgc

SEQ ID NO: 1474458 - RNA, 20 nt, Pseudomonas aeruginosa PA01
gcaugguccguucggcgccc

SEQ ID NO: 1474459 - RNA, 21 nt, Pseudomonas aeruginosa PA01
gcaugguccguucggcgccca

SEQ ID NO: 1474460 - RNA, 22 nt, Pseudomonas aeruginosa PA01
gcaugguccguucggcgcccag

SEQ ID NO: 1474461 - RNA, 20 nt, Pseudomonas aeruginosa PA01
gcaugggucagcgccagcaa

SEQ ID NO: 1474462 - RNA, 19 nt, Pseudomonas aeruginosa PA01
gcaugguguccggcggcga

SEQ ID NO: 1474463 - RNA, 20 nt, Pseudomonas aeruginosa PA01
gcauggucgcgcuguugccg

SEQ ID NO: 1474464 - RNA, 22 nt, Pseudomonas aeruginosa PA01
gcauggucgcgcuguugccgcg

SEQ ID NO: 1474465 - RNA, 15 nt, Pseudomonas aeruginosa PA01
gcauggcuggcgcua

SEQ ID NO: 1474466 - RNA, 21 nt, Pseudomonas aeruginosa PA01
gcauggcuggcgcuaccgcgc

SEQ ID NO: 1474467 - RNA, 17 nt, Pseudomonas aeruginosa PA01
gcauggcuuuccaggcg

SEQ ID NO: 1474468 - RNA, 19 nt, Pseudomonas aeruginosa PA01
gcauggcuuuccaggcgcc

SEQ ID NO: 1474469 - RNA, 20 nt, Pseudomonas aeruginosa PA01
gcauggcuuuccaggcgccg

SEQ ID NO: 1474470 - RNA, 22 nt, Pseudomonas aeruginosa PA01
gcaugggauggcgcgguccgcg

SEQ ID NO: 1474471 - RNA, 20 nt, Pseudomonas aeruginosa PA01
gcaugggcauccugccgccu

SEQ ID NO: 1474472 - RNA, 21 nt, Pseudomonas aeruginosa PA01
gcaugggcauccugccgccug

SEQ ID NO: 1474473 - RNA, 16 nt, Pseudomonas aeruginosa PA01
gcaugggcucgcgcgg

SEQ ID NO: 1474474 - RNA, 19 nt, Pseudomonas aeruginosa PA01
gcaugggcucgcgcggggc

SEQ ID NO: 1474475 - RNA, 17 nt, Pseudomonas aeruginosa PA01
gcaugauggugccgccg

SEQ ID NO: 1474476 - RNA, 18 nt, Pseudomonas aeruginosa PA01
gcaugauggugccgccgg

SEQ ID NO: 1474477 - RNA, 18 nt, Pseudomonas aeruginosa PA01
gcaugaucgccucggcgc

SEQ ID NO: 1474478 - RNA, 15 nt, Pseudomonas aeruginosa PA01
gcaugaugcaggcag

SEQ ID NO: 1474479 - RNA, 18 nt, Pseudomonas aeruginosa PA01
gcaugaugccgaggcggc

SEQ ID NO: 1474480 - RNA, 20 nt, Pseudomonas aeruginosa PA01
gcaugaugccgaggcggccg

SEQ ID NO: 1474481 - RNA, 19 nt, Pseudomonas aeruginosa PA01
gcaugcaccuaccaguagu

SEQ ID NO: 1474482 - RNA, 21 nt, Pseudomonas aeruginosa PA01
gcaugauuucguuggcccaga

SEQ ID NO: 1474483 - RNA, 22 nt, Pseudomonas aeruginosa PA01
gcaugauuucguuggcccagac

SEQ ID NO: 1474484 - RNA, 16 nt, Pseudomonas aeruginosa PA01
gcaugaccuccagggc

SEQ ID NO: 1474485 - RNA, 16 nt, Pseudomonas aeruginosa PA01
gcaugaggcuggccag

SEQ ID NO: 1474486 - RNA, 17 nt, Pseudomonas aeruginosa PA01
gcaugaggggaaucgcc

SEQ ID NO: 1474487 - RNA, 19 nt, Pseudomonas aeruginosa PA01
gcaugaggggaaucgccgu

SEQ ID NO: 1474488 - RNA, 15 nt, Pseudomonas aeruginosa PA01
gcaugacggauccac

SEQ ID NO: 1474489 - RNA, 20 nt, Pseudomonas aeruginosa PA01
gcaugaccuucagcaccugc

SEQ ID NO: 1474490 - RNA, 22 nt, Pseudomonas aeruginosa PA01
gcaugacgauaucggcgccggc

SEQ ID NO: 1474491 - RNA, 14 nt, Pseudomonas aeruginosa PA01
gcaugcagguggcg

SEQ ID NO: 1474492 - RNA, 21 nt, Pseudomonas aeruginosa PA01
gcaugccggccgucgcgcacc

SEQ ID NO: 1474493 - RNA, 18 nt, Pseudomonas aeruginosa PA01
gcaugccgggguccgccg

SEQ ID NO: 1474494 - RNA, 18 nt, Pseudomonas aeruginosa PA01
gcaugccguugggccagg

SEQ ID NO: 1474495 - RNA, 19 nt, Pseudomonas aeruginosa PA01
gcaugccguugggccaggg

SEQ ID NO: 1474496 - RNA, 16 nt, Pseudomonas aeruginosa PA01
gcaugccgugggcgcc

SEQ ID NO: 1474497 - RNA, 18 nt, Pseudomonas aeruginosa PA01
gcaugccgugggcgccgc

SEQ ID NO: 1474498 - RNA, 18 nt, Pseudomonas aeruginosa PA01
gcaugcccugccggcgca

SEQ ID NO: 1474499 - RNA, 17 nt, Pseudomonas aeruginosa PA01
gcaugcccgcgucgcgc

SEQ ID NO: 1474500 - RNA, 20 nt, Pseudomonas aeruginosa PA01
gcaugcccgcgucgcgcgcg

SEQ ID NO: 1474501 - RNA, 15 nt, Pseudomonas aeruginosa PA01
gcaugcccagcgugg

SEQ ID NO: 1474502 - RNA, 22 nt, Pseudomonas aeruginosa PA01
gcaugcccagcguggccagcga

SEQ ID NO: 1474503 - RNA, 13 nt, Pseudomonas aeruginosa PA01
gcaugcccagggc

SEQ ID NO: 1474504 - RNA, 14 nt, Pseudomonas aeruginosa PA01
gcaugcccagggcc

SEQ ID NO: 1474505 - RNA, 17 nt, Pseudomonas aeruginosa PA01
gcaugcccagggccagc

SEQ ID NO: 1474506 - RNA, 19 nt, Pseudomonas aeruginosa PA01
gcaugcccagggccagcag

SEQ ID NO: 1474507 - RNA, 20 nt, Pseudomonas aeruginosa PA01
gcaugcccagggccagcagc

SEQ ID NO: 1474508 - RNA, 20 nt, Pseudomonas aeruginosa PA01
gcaugcuuuugaacaccagc

SEQ ID NO: 1474509 - RNA, 16 nt, Pseudomonas aeruginosa PA01
gcauggccacgcucuc

SEQ ID NO: 1474510 - RNA, 20 nt, Pseudomonas aeruginosa PA01
gcauggccuugccggcaucg

SEQ ID NO: 1474511 - RNA, 15 nt, Pseudomonas aeruginosa PA01
gcauggccggcuacu

SEQ ID NO: 1474512 - RNA, 14 nt, Pseudomonas aeruginosa PA01
gcauggcgaccugg

SEQ ID NO: 1474513 - RNA, 12 nt, Pseudomonas aeruginosa PA01
gcauggcgcucu

SEQ ID NO: 1474514 - RNA, 22 nt, Pseudomonas aeruginosa PA01
gcaugcgcacggucuccgggga

SEQ ID NO: 1474515 - RNA, 14 nt, Pseudomonas aeruginosa PA01
gcaugcgcggcgua

SEQ ID NO: 1474516 - RNA, 17 nt, Pseudomonas aeruginosa PA01
gcaugcguucgccgaaa

SEQ ID NO: 1474517 - RNA, 16 nt, Pseudomonas aeruginosa PA01
gcaugcucagccgcgc

SEQ ID NO: 1474518 - RNA, 17 nt, Pseudomonas aeruginosa PA01
gcaugcucgggcugccg

SEQ ID NO: 1474519 - RNA, 19 nt, Pseudomonas aeruginosa PA01
gcaugcggccccggcgcuc

SEQ ID NO: 1474520 - RNA, 21 nt, Pseudomonas aeruginosa PA01
gcaugcggccccggcgcucgc

SEQ ID NO: 1474521 - RNA, 19 nt, Pseudomonas aeruginosa PA01
gcaucgucgaaacgcuggc

SEQ ID NO: 1474522 - RNA, 21 nt, Pseudomonas aeruginosa PA01
gcaucgucgaaacgcuggcgg

SEQ ID NO: 1474523 - RNA, 15 nt, Pseudomonas aeruginosa PA01
gcaucgucgaagggc

SEQ ID NO: 1474524 - RNA, 20 nt, Pseudomonas aeruginosa PA01
gcaucggugccggcaggccu

SEQ ID NO: 1474525 - RNA, 16 nt, Pseudomonas aeruginosa PA01
gcaucggugaccuggu

SEQ ID NO: 1474526 - RNA, 22 nt, Pseudomonas aeruginosa PA01
gcaucggugaccugguagucgc

SEQ ID NO: 1474527 - RNA, 13 nt, Pseudomonas aeruginosa PA01
gcaucggcgcgcc

SEQ ID NO: 1474528 - RNA, 16 nt, Pseudomonas aeruginosa PA01
gcaucggcgcgccgaa

SEQ ID NO: 1474529 - RNA, 14 nt, Pseudomonas aeruginosa PA01
gcaucggcgccucc

SEQ ID NO: 1474530 - RNA, 23 nt, Pseudomonas aeruginosa PA01
gcaucggccaccuucgcccgcug

SEQ ID NO: 1474531 - RNA, 11 nt, Pseudomonas aeruginosa PA01
gcaucggccac

SEQ ID NO: 1474532 - RNA, 22 nt, Pseudomonas aeruginosa PA01
gcaucggccauucggccuggca

SEQ ID NO: 1474533 - RNA, 12 nt, Pseudomonas aeruginosa PA01
gcaucggccggg

SEQ ID NO: 1474534 - RNA, 14 nt, Pseudomonas aeruginosa PA01
gcaucggccgggau

SEQ ID NO: 1474535 - RNA, 16 nt, Pseudomonas aeruginosa PA01
gcaucggcgccgcgca

SEQ ID NO: 1474536 - RNA, 23 nt, Pseudomonas aeruginosa PA01
gcaucgcgggcgugcuccagcac

SEQ ID NO: 1474537 - RNA, 15 nt, Pseudomonas aeruginosa PA01
gcaucgcucgcaacg

SEQ ID NO: 1474538 - RNA, 19 nt, Pseudomonas aeruginosa PA01
gcaucgcugaccucgagcu

SEQ ID NO: 1474539 - RNA, 16 nt, Pseudomonas aeruginosa PA01
gcaucggagaccacgg

SEQ ID NO: 1474540 - RNA, 15 nt, Pseudomonas aeruginosa PA01
gcaucgugccgcgga

SEQ ID NO: 1474541 - RNA, 19 nt, Pseudomonas aeruginosa PA01
gcaucgugcuucucaccga

SEQ ID NO: 1474542 - RNA, 20 nt, Pseudomonas aeruginosa PA01
gcaucgugcuucucaccgag

SEQ ID NO: 1474543 - RNA, 14 nt, Pseudomonas aeruginosa PA01
gcaucguuggcgcc

SEQ ID NO: 1474544 - RNA, 15 nt, Pseudomonas aeruginosa PA01
gcaucguuggcgccg

SEQ ID NO: 1474545 - RNA, 19 nt, Pseudomonas aeruginosa PA01
gcaucguuggcgccguccu

SEQ ID NO: 1474546 - RNA, 12 nt, Pseudomonas aeruginosa PA01
gcaucucgccgg

SEQ ID NO: 1474547 - RNA, 16 nt, Pseudomonas aeruginosa PA01
gcaucucggccaggcc

SEQ ID NO: 1474548 - RNA, 17 nt, Pseudomonas aeruginosa PA01
gcaucucggccaggccc

SEQ ID NO: 1474549 - RNA, 18 nt, Pseudomonas aeruginosa PA01
gcaucucggccaggcccu

SEQ ID NO: 1474550 - RNA, 13 nt, Pseudomonas aeruginosa PA01
gcaucucgauggu

SEQ ID NO: 1474551 - RNA, 17 nt, Pseudomonas aeruginosa PA01
gcaucuccggcaccgug

SEQ ID NO: 1474552 - RNA, 18 nt, Pseudomonas aeruginosa PA01
gcaucugcugguccuggc

SEQ ID NO: 1474553 - RNA, 19 nt, Pseudomonas aeruginosa PA01
gcaucugcugguccuggcg

SEQ ID NO: 1474554 - RNA, 19 nt, Pseudomonas aeruginosa PA01
gcaucugcgacaugccggu

SEQ ID NO: 1474555 - RNA, 12 nt, Pseudomonas aeruginosa PA01
gcaucugcgccg

SEQ ID NO: 1474556 - RNA, 19 nt, Pseudomonas aeruginosa PA01
gcaucugcgcguagcgguc

SEQ ID NO: 1474557 - RNA, 15 nt, Pseudomonas aeruginosa PA01
gcaucuggcugcgcg

SEQ ID NO: 1474558 - RNA, 18 nt, Pseudomonas aeruginosa PA01
gcaucuggcugcgcgcca

SEQ ID NO: 1474559 - RNA, 18 nt, Pseudomonas aeruginosa PA01
gcaucuggugcgcgucca

SEQ ID NO: 1474560 - RNA, 16 nt, Pseudomonas aeruginosa PA01
gcaucuucaaucgcgc

SEQ ID NO: 1474561 - RNA, 16 nt, Pseudomonas aeruginosa PA01
gcaucuucuucaaccg

SEQ ID NO: 1474562 - RNA, 15 nt, Pseudomonas aeruginosa PA01
gcaugaaaaaacccg

SEQ ID NO: 1474563 - RNA, 16 nt, Pseudomonas aeruginosa PA01
gcaugaaaaagccgcc

SEQ ID NO: 1474564 - RNA, 13 nt, Pseudomonas aeruginosa PA01
gcaugaaggcgcu

SEQ ID NO: 1474565 - RNA, 22 nt, Pseudomonas aeruginosa PA01
gcaugaaggcgcugagcgccuc

SEQ ID NO: 1474566 - RNA, 21 nt, Pseudomonas aeruginosa PA01
gccggaaccuguccgaacagg

SEQ ID NO: 1474567 - RNA, 13 nt, Pseudomonas aeruginosa PA01
gccggaacggcuu

SEQ ID NO: 1474568 - RNA, 14 nt, Pseudomonas aeruginosa PA01
gccggaagcgcucg

SEQ ID NO: 1474569 - RNA, 15 nt, Pseudomonas aeruginosa PA01
gccggaagcgcucgc

SEQ ID NO: 1474570 - RNA, 18 nt, Pseudomonas aeruginosa PA01
gccggaagcgcucgcgcu

SEQ ID NO: 1474571 - RNA, 15 nt, Pseudomonas aeruginosa PA01
gccggaaguggcagc

SEQ ID NO: 1474572 - RNA, 16 nt, Pseudomonas aeruginosa PA01
gccggaagcuucaggc

SEQ ID NO: 1474573 - RNA, 18 nt, Pseudomonas aeruginosa PA01
gccggagacuucagcgca

SEQ ID NO: 1474574 - RNA, 14 nt, Pseudomonas aeruginosa PA01
gccggagagcagca

SEQ ID NO: 1474575 - RNA, 15 nt, Pseudomonas aeruginosa PA01
gccggagagcagcac

SEQ ID NO: 1474576 - RNA, 18 nt, Pseudomonas aeruginosa PA01
gccggagagcagcacggc

SEQ ID NO: 1474577 - RNA, 23 nt, Pseudomonas aeruginosa PA01
gccggagagcagcacggccucgc

SEQ ID NO: 1474578 - RNA, 24 nt, Pseudomonas aeruginosa PA01
gccggaauguugcggcgguggccg

SEQ ID NO: 1474579 - RNA, 17 nt, Pseudomonas aeruginosa PA01
gccggaaugacgagccg

SEQ ID NO: 1474580 - RNA, 18 nt, Pseudomonas aeruginosa PA01
gccggagaugugcgcggu

SEQ ID NO: 1474581 - RNA, 19 nt, Pseudomonas aeruginosa PA01
gccggagaugugcgcggug

SEQ ID NO: 1474582 - RNA, 20 nt, Pseudomonas aeruginosa PA01
gccggagaugugcgcgguga

SEQ ID NO: 1474583 - RNA, 22 nt, Pseudomonas aeruginosa PA01
gccggagagcgaauacaccgag

SEQ ID NO: 1474584 - RNA, 14 nt, Pseudomonas aeruginosa PA01
gccggagcaggcca

SEQ ID NO: 1474585 - RNA, 15 nt, Pseudomonas aeruginosa PA01
gccggagcaggccau

SEQ ID NO: 1474586 - RNA, 12 nt, Pseudomonas aeruginosa PA01
gccgcugcugca

SEQ ID NO: 1474587 - RNA, 13 nt, Pseudomonas aeruginosa PA01
gccgcugcugcaa

SEQ ID NO: 1474588 - RNA, 14 nt, Pseudomonas aeruginosa PA01
gccgcugcugcaac

SEQ ID NO: 1474589 - RNA, 18 nt, Pseudomonas aeruginosa PA01
gccgcugcugcaaccgau

SEQ ID NO: 1474590 - RNA, 14 nt, Pseudomonas aeruginosa PA01
gccgcugcgucguc

SEQ ID NO: 1474591 - RNA, 21 nt, Pseudomonas aeruginosa PA01
gccgcuguggaaguacggcgc

SEQ ID NO: 1474592 - RNA, 15 nt, Pseudomonas aeruginosa PA01
gccgcugcggcucgc

SEQ ID NO: 1474593 - RNA, 17 nt, Pseudomonas aeruginosa PA01
gccgcugcggcucgccg

SEQ ID NO: 1474594 - RNA, 18 nt, Pseudomonas aeruginosa PA01
gccgcugcggcucgccga

SEQ ID NO: 1474595 - RNA, 21 nt, Pseudomonas aeruginosa PA01
gccgcugugugccucugaccg

SEQ ID NO: 1474596 - RNA, 22 nt, Pseudomonas aeruginosa PA01
gccgcugugugccucugaccgc

SEQ ID NO: 1474597 - RNA, 18 nt, Pseudomonas aeruginosa PA01
gccgcugccugucgcagc

SEQ ID NO: 1474598 - RNA, 20 nt, Pseudomonas aeruginosa PA01
gccgcugccguugcaggccc

SEQ ID NO: 1474599 - RNA, 13 nt, Pseudomonas aeruginosa PA01
gccgcugaugcgc

SEQ ID NO: 1474600 - RNA, 16 nt, Pseudomonas aeruginosa PA01
gccgcugaucaguacc

SEQ ID NO: 1474601 - RNA, 15 nt, Pseudomonas aeruginosa PA01
gccgcugcgcgcagu

SEQ ID NO: 1474602 - RNA, 13 nt, Pseudomonas aeruginosa PA01
gccgcugcgcagg

SEQ ID NO: 1474603 - RNA, 14 nt, Pseudomonas aeruginosa PA01
gccgcugcgcaggc

SEQ ID NO: 1474604 - RNA, 18 nt, Pseudomonas aeruginosa PA01
gccgcugcgcaggccgag

SEQ ID NO: 1474605 - RNA, 14 nt, Pseudomonas aeruginosa PA01
gccgcugcgcauca

SEQ ID NO: 1474606 - RNA, 19 nt, Pseudomonas aeruginosa PA01
gccgcugcgcaucaggucg

SEQ ID NO: 1474607 - RNA, 15 nt, Pseudomonas aeruginosa PA01
gccgcuuacccaggu

SEQ ID NO: 1474608 - RNA, 16 nt, Pseudomonas aeruginosa PA01
gccgcuuccgccaggc

SEQ ID NO: 1474609 - RNA, 17 nt, Pseudomonas aeruginosa PA01
gccgcuuccgccaggcg

SEQ ID NO: 1474610 - RNA, 19 nt, Pseudomonas aeruginosa PA01
gccgcuuccgccaggcgca

SEQ ID NO: 1474611 - RNA, 21 nt, Pseudomonas aeruginosa PA01
gccgcuuccgccaggcgcagc

SEQ ID NO: 1474612 - RNA, 15 nt, Pseudomonas aeruginosa PA01
gccgcuuccgccggc

SEQ ID NO: 1474613 - RNA, 16 nt, Pseudomonas aeruginosa PA01
gccgcuuccgccggcg

SEQ ID NO: 1474614 - RNA, 20 nt, Pseudomonas aeruginosa PA01
gccgcuuccggcccggccag

SEQ ID NO: 1474615 - RNA, 14 nt, Pseudomonas aeruginosa PA01
gccgcuucggcugc

SEQ ID NO: 1474616 - RNA, 16 nt, Pseudomonas aeruginosa PA01
gccgcuuucggugaac

SEQ ID NO: 1474617 - RNA, 20 nt, Pseudomonas aeruginosa PA01
gccggaaagcaguucgcccg

SEQ ID NO: 1474618 - RNA, 22 nt, Pseudomonas aeruginosa PA01
gccggaaagcaguucgcccggc

SEQ ID NO: 1474619 - RNA, 16 nt, Pseudomonas aeruginosa PA01
gccggaaagccuggcc

SEQ ID NO: 1474620 - RNA, 21 nt, Pseudomonas aeruginosa PA01
gccggaaagccuggccggcga

SEQ ID NO: 1474621 - RNA, 23 nt, Pseudomonas aeruginosa PA01
gccggaaagccuggccggcgaac

SEQ ID NO: 1474622 - RNA, 19 nt, Pseudomonas aeruginosa PA01
gccgcuucgcgguagacgc

SEQ ID NO: 1474623 - RNA, 18 nt, Pseudomonas aeruginosa PA01
gccggaaaaagcaccgac

SEQ ID NO: 1474624 - RNA, 16 nt, Pseudomonas aeruginosa PA01
gccggaaaacagcgag

SEQ ID NO: 1474625 - RNA, 22 nt, Pseudomonas aeruginosa PA01
gccggaaaacagcgagcccagg

SEQ ID NO: 1474626 - RNA, 13 nt, Pseudomonas aeruginosa PA01
gccggcaacagca

SEQ ID NO: 1474627 - RNA, 16 nt, Pseudomonas aeruginosa PA01
gccggcaacagcagca

SEQ ID NO: 1474628 - RNA, 22 nt, Pseudomonas aeruginosa PA01
gccggcaccgucgagcaccagg

SEQ ID NO: 1474629 - RNA, 14 nt, Pseudomonas aeruginosa PA01
gccggcagcuccgg

SEQ ID NO: 1474630 - RNA, 12 nt, Pseudomonas aeruginosa PA01
gccggcacggca

SEQ ID NO: 1474631 - RNA, 18 nt, Pseudomonas aeruginosa PA01
gccggcacggcaucgauc

SEQ ID NO: 1474632 - RNA, 21 nt, Pseudomonas aeruginosa PA01
gccggcacggcaucgauccgc

SEQ ID NO: 1474633 - RNA, 13 nt, Pseudomonas aeruginosa PA01
gccggaugggcga

SEQ ID NO: 1474634 - RNA, 18 nt, Pseudomonas aeruginosa PA01
gccggaugggcgagcugc

SEQ ID NO: 1474635 - RNA, 14 nt, Pseudomonas aeruginosa PA01
gccggauucgcgca

SEQ ID NO: 1474636 - RNA, 17 nt, Pseudomonas aeruginosa PA01
gccggauucgcgcagca

SEQ ID NO: 1474637 - RNA, 19 nt, Pseudomonas aeruginosa PA01
gccggauucgcgcagcagg

SEQ ID NO: 1474638 - RNA, 21 nt, Pseudomonas aeruginosa PA01
gccggauucgcgcagcaggcg

SEQ ID NO: 1474639 - RNA, 16 nt, Pseudomonas aeruginosa PA01
gccggauuggccgagg

SEQ ID NO: 1474640 - RNA, 19 nt, Pseudomonas aeruginosa PA01
gccggauagaucaggccgg

SEQ ID NO: 1474641 - RNA, 21 nt, Pseudomonas aeruginosa PA01
gccggauagaucaggccggcg

SEQ ID NO: 1474642 - RNA, 22 nt, Pseudomonas aeruginosa PA01
gccggauagaucaggccggcgu

SEQ ID NO: 1474643 - RNA, 18 nt, Pseudomonas aeruginosa PA01
gccggccaggaaggccgc

SEQ ID NO: 1474644 - RNA, 22 nt, Pseudomonas aeruginosa PA01
gccggccaggaaggccgcuucg

SEQ ID NO: 1474645 - RNA, 14 nt, Pseudomonas aeruginosa PA01
gccggccacgcgac

SEQ ID NO: 1474646 - RNA, 15 nt, Pseudomonas aeruginosa PA01
gccggccacgcgacc

SEQ ID NO: 1474647 - RNA, 19 nt, Pseudomonas aeruginosa PA01
gccggccacgcgaccagcg

SEQ ID NO: 1474648 - RNA, 18 nt, Pseudomonas aeruginosa PA01
gccggccaugcuggcgcu

SEQ ID NO: 1474649 - RNA, 16 nt, Pseudomonas aeruginosa PA01
gccggccaugcaggcc

SEQ ID NO: 1474650 - RNA, 17 nt, Pseudomonas aeruginosa PA01
gccggccaugcaggcca

SEQ ID NO: 1474651 - RNA, 16 nt, Pseudomonas aeruginosa PA01
gccggccauccagcca

SEQ ID NO: 1474652 - RNA, 22 nt, Pseudomonas aeruginosa PA01
gccggccauccagccaggcgcu

SEQ ID NO: 1474653 - RNA, 13 nt, Pseudomonas aeruginosa PA01
gccggccaggugg

SEQ ID NO: 1474654 - RNA, 23 nt, Pseudomonas aeruginosa PA01
gccggccagguggucguagcagg

SEQ ID NO: 1474655 - RNA, 19 nt, Pseudomonas aeruginosa PA01
gccggccaggucguugcgc

SEQ ID NO: 1474656 - RNA, 22 nt, Pseudomonas aeruginosa PA01
gccggccaggucguugcgccgg

SEQ ID NO: 1474657 - RNA, 14 nt, Pseudomonas aeruginosa PA01
gccggccagggcga

SEQ ID NO: 1474658 - RNA, 20 nt, Pseudomonas aeruginosa PA01
gccggccagggcgcgguagg

SEQ ID NO: 1474659 - RNA, 14 nt, Pseudomonas aeruginosa PA01
gccggccaggggcu

SEQ ID NO: 1474660 - RNA, 20 nt, Pseudomonas aeruginosa PA01
gccggccaggggcugaacag

SEQ ID NO: 1474661 - RNA, 13 nt, Pseudomonas aeruginosa PA01
gccggccaggguc

SEQ ID NO: 1474662 - RNA, 22 nt, Pseudomonas aeruginosa PA01
gccggccagguagcggcguucg

SEQ ID NO: 1474663 - RNA, 16 nt, Pseudomonas aeruginosa PA01
gccggcagcucggccg

SEQ ID NO: 1474664 - RNA, 15 nt, Pseudomonas aeruginosa PA01
gccggcaggaacgcc

SEQ ID NO: 1474665 - RNA, 14 nt, Pseudomonas aeruginosa PA01
gccggcaggaggau

SEQ ID NO: 1474666 - RNA, 18 nt, Pseudomonas aeruginosa PA01
gccggcagguagaccucg

SEQ ID NO: 1474667 - RNA, 13 nt, Pseudomonas aeruginosa PA01
gccggcaggccga

SEQ ID NO: 1474668 - RNA, 15 nt, Pseudomonas aeruginosa PA01
gccggcaggccgaua

SEQ ID NO: 1474669 - RNA, 15 nt, Pseudomonas aeruginosa PA01
gccggccaaccaccg

SEQ ID NO: 1474670 - RNA, 16 nt, Pseudomonas aeruginosa PA01
gccggccaaccaccgg

SEQ ID NO: 1474671 - RNA, 18 nt, Pseudomonas aeruginosa PA01
gccggccaaccaccggcg

SEQ ID NO: 1474672 - RNA, 19 nt, Pseudomonas aeruginosa PA01
gccggccaaccaccggcgc

SEQ ID NO: 1474673 - RNA, 14 nt, Pseudomonas aeruginosa PA01
gccggcauagccga

SEQ ID NO: 1474674 - RNA, 19 nt, Pseudomonas aeruginosa PA01
gccggcagugugccgcccu

SEQ ID NO: 1474675 - RNA, 17 nt, Pseudomonas aeruginosa PA01
gccggccaccagcagca

SEQ ID NO: 1474676 - RNA, 21 nt, Pseudomonas aeruginosa PA01
gccggccaccagcagcaacgg

SEQ ID NO: 1474677 - RNA, 13 nt, Pseudomonas aeruginosa PA01
gccggccaccagg

SEQ ID NO: 1474678 - RNA, 22 nt, Pseudomonas aeruginosa PA01
gccgcucuucugguaggccagc

SEQ ID NO: 1474679 - RNA, 20 nt, Pseudomonas aeruginosa PA01
gccgcugacggucugccagc

SEQ ID NO: 1474680 - RNA, 14 nt, Pseudomonas aeruginosa PA01
gccgcugaggcucg

SEQ ID NO: 1474681 - RNA, 14 nt, Pseudomonas aeruginosa PA01
gccgcugagcagca

SEQ ID NO: 1474682 - RNA, 15 nt, Pseudomonas aeruginosa PA01
gccgcugaaguccug

SEQ ID NO: 1474683 - RNA, 18 nt, Pseudomonas aeruginosa PA01
gccgcugaaguccuggcc

SEQ ID NO: 1474684 - RNA, 20 nt, Pseudomonas aeruginosa PA01
gccgcugaaguccuggccga

SEQ ID NO: 1474685 - RNA, 22 nt, Pseudomonas aeruginosa PA01
gccgcugaaguccuggccgagc

SEQ ID NO: 1474686 - RNA, 20 nt, Pseudomonas aeruginosa PA01
gccgcugaauaccaccgggc

SEQ ID NO: 1474687 - RNA, 18 nt, Pseudomonas aeruginosa PA01
gccgcucguuggcggcca

SEQ ID NO: 1474688 - RNA, 20 nt, Pseudomonas aeruginosa PA01
gccgcucguuggcggccagc

SEQ ID NO: 1474689 - RNA, 22 nt, Pseudomonas aeruginosa PA01
gccgcucugccagaaggccugc

SEQ ID NO: 1474690 - RNA, 15 nt, Pseudomonas aeruginosa PA01
gccgcucugcccgac

SEQ ID NO: 1474691 - RNA, 17 nt, Pseudomonas aeruginosa PA01
gccgcucugcccgaccg

SEQ ID NO: 1474692 - RNA, 16 nt, Pseudomonas aeruginosa PA01
gccgcucugcuggccg

SEQ ID NO: 1474693 - RNA, 18 nt, Pseudomonas aeruginosa PA01
gccgcucugcuggccgcc

SEQ ID NO: 1474694 - RNA, 17 nt, Pseudomonas aeruginosa PA01
gccgcucuggcugcugg

SEQ ID NO: 1474695 - RNA, 13 nt, Pseudomonas aeruginosa PA01
gccgcucgaugcc

SEQ ID NO: 1474696 - RNA, 18 nt, Pseudomonas aeruginosa PA01
gccgcucgaugcccgcca

SEQ ID NO: 1474697 - RNA, 20 nt, Pseudomonas aeruginosa PA01
gccgcucgaugcccgccagc

SEQ ID NO: 1474698 - RNA, 22 nt, Pseudomonas aeruginosa PA01
gccgcucgagggcgaccgccag

SEQ ID NO: 1474699 - RNA, 16 nt, Pseudomonas aeruginosa PA01
gccgcuccuccucgcu

SEQ ID NO: 1474700 - RNA, 15 nt, Pseudomonas aeruginosa PA01
gccgcuccuggcagg

SEQ ID NO: 1474701 - RNA, 14 nt, Pseudomonas aeruginosa PA01
gccgcuccggcugc

SEQ ID NO: 1474702 - RNA, 14 nt, Pseudomonas aeruginosa PA01
gccgcuccgcgcca

SEQ ID NO: 1474703 - RNA, 18 nt, Pseudomonas aeruginosa PA01
gccgcuccgcgccacgcu

SEQ ID NO: 1474704 - RNA, 16 nt, Pseudomonas aeruginosa PA01
gccgcuccaggaucgc

SEQ ID NO: 1474705 - RNA, 18 nt, Pseudomonas aeruginosa PA01
gccgcuccaggaucgccu

SEQ ID NO: 1474706 - RNA, 17 nt, Pseudomonas aeruginosa PA01
gccgcuagcgguagccg

SEQ ID NO: 1474707 - RNA, 20 nt, Pseudomonas aeruginosa PA01
gccgcuagcgguagccguca

SEQ ID NO: 1474708 - RNA, 13 nt, Pseudomonas aeruginosa PA01
gccgcucauccgc

SEQ ID NO: 1474709 - RNA, 14 nt, Pseudomonas aeruginosa PA01
gccgcucauccgcu

SEQ ID NO: 1474710 - RNA, 16 nt, Pseudomonas aeruginosa PA01
gccgcuacugcgcggg

SEQ ID NO: 1474711 - RNA, 16 nt, Pseudomonas aeruginosa PA01
gccgcuccacacccgg

SEQ ID NO: 1474712 - RNA, 13 nt, Pseudomonas aeruginosa PA01
gccgcuacgcggc

SEQ ID NO: 1474713 - RNA, 17 nt, Pseudomonas aeruginosa PA01
gccgcuagcccugcugc

SEQ ID NO: 1474714 - RNA, 18 nt, Pseudomonas aeruginosa PA01
gccgcuagcccugcugcu

SEQ ID NO: 1474715 - RNA, 23 nt, Pseudomonas aeruginosa PA01
gccgcuagcccugcugcucgcca

SEQ ID NO: 1474716 - RNA, 23 nt, Pseudomonas aeruginosa PA01
gccgcguugucccugucccgccg

SEQ ID NO: 1474717 - RNA, 18 nt, Pseudomonas aeruginosa PA01
gccgcggcggcgugcagg

SEQ ID NO: 1474718 - RNA, 22 nt, Pseudomonas aeruginosa PA01
gccgcggcggcgugcaggccga

SEQ ID NO: 1474719 - RNA, 16 nt, Pseudomonas aeruginosa PA01
gccgcggcguuagccg

SEQ ID NO: 1474720 - RNA, 24 nt, Pseudomonas aeruginosa PA01
gccgcggcguuagccgccugcggc

SEQ ID NO: 1474721 - RNA, 16 nt, Pseudomonas aeruginosa PA01
gccgcggcugaugccg

SEQ ID NO: 1474722 - RNA, 20 nt, Pseudomonas aeruginosa PA01
gccgcggcugaugccgcggu

SEQ ID NO: 1474723 - RNA, 19 nt, Pseudomonas aeruginosa PA01
gccgcggcguugucggcca

SEQ ID NO: 1474724 - RNA, 19 nt, Pseudomonas aeruginosa PA01
gccgcggcuggcaggugcc

SEQ ID NO: 1474725 - RNA, 18 nt, Pseudomonas aeruginosa PA01
gccgcggcuggccauccg

SEQ ID NO: 1474726 - RNA, 14 nt, Pseudomonas aeruginosa PA01
gccgcgggucucga

SEQ ID NO: 1474727 - RNA, 22 nt, Pseudomonas aeruginosa PA01
gccgcgggucucgaucagcgcc

SEQ ID NO: 1474728 - RNA, 17 nt, Pseudomonas aeruginosa PA01
gccgcgggucugcucgg

SEQ ID NO: 1474729 - RNA, 20 nt, Pseudomonas aeruginosa PA01
gccgcgggucugcucggcgc

SEQ ID NO: 1474730 - RNA, 22 nt, Pseudomonas aeruginosa PA01
gccgcggguuccucacggcgca

SEQ ID NO: 1474731 - RNA, 17 nt, Pseudomonas aeruginosa PA01
gccgcgguaggucagcg

SEQ ID NO: 1474732 - RNA, 17 nt, Pseudomonas aeruginosa PA01
gccgcgucgcccaggcc

SEQ ID NO: 1474733 - RNA, 19 nt, Pseudomonas aeruginosa PA01
gccgcgucgcccaggccgc

SEQ ID NO: 1474734 - RNA, 12 nt, Pseudomonas aeruginosa PA01
gccgcgucgccg

SEQ ID NO: 1474735 - RNA, 22 nt, Pseudomonas aeruginosa PA01
gccgcguugcauguccucggcg

SEQ ID NO: 1474736 - RNA, 23 nt, Pseudomonas aeruginosa PA01
gccgcguugcauguccucggcgc

SEQ ID NO: 1474737 - RNA, 13 nt, Pseudomonas aeruginosa PA01
gccgcgucgaagc

SEQ ID NO: 1474738 - RNA, 23 nt, Pseudomonas aeruginosa PA01
gccgcgucgaagcugucggcccg

SEQ ID NO: 1474739 - RNA, 19 nt, Pseudomonas aeruginosa PA01
gccgcgucgaagucgauca

SEQ ID NO: 1474740 - RNA, 23 nt, Pseudomonas aeruginosa PA01
gccgcgucgaagucgaucaccgc

SEQ ID NO: 1474741 - RNA, 18 nt, Pseudomonas aeruginosa PA01
gccgcgucccugcacagg

SEQ ID NO: 1474742 - RNA, 15 nt, Pseudomonas aeruginosa PA01
gccgcggucuucgcg

SEQ ID NO: 1474743 - RNA, 18 nt, Pseudomonas aeruginosa PA01
gccgcggucuucgcguug

SEQ ID NO: 1474744 - RNA, 21 nt, Pseudomonas aeruginosa PA01
gccgcguaguaggcacaggac

SEQ ID NO: 1474745 - RNA, 22 nt, Pseudomonas aeruginosa PA01
gccgcguaguaggcacaggacc

SEQ ID NO: 1474746 - RNA, 24 nt, Pseudomonas aeruginosa PA01
gccgcguaguaggcacaggacccu

SEQ ID NO: 1474747 - RNA, 16 nt, Pseudomonas aeruginosa PA01
gccgcggugcgggccu

SEQ ID NO: 1474748 - RNA, 14 nt, Pseudomonas aeruginosa PA01
gccgcguauggcuu

SEQ ID NO: 1474749 - RNA, 13 nt, Pseudomonas aeruginosa PA01
gccgcgcuuggcc

SEQ ID NO: 1474750 - RNA, 14 nt, Pseudomonas aeruginosa PA01
gccgcgcucggcca

SEQ ID NO: 1474751 - RNA, 16 nt, Pseudomonas aeruginosa PA01
gccgcgcucggccagu

SEQ ID NO: 1474752 - RNA, 19 nt, Pseudomonas aeruginosa PA01
gccgcgcucgcggaaccag

SEQ ID NO: 1474753 - RNA, 15 nt, Pseudomonas aeruginosa PA01
gccgcgcucggauca

SEQ ID NO: 1474754 - RNA, 13 nt, Pseudomonas aeruginosa PA01
gccgcgcucggcc

SEQ ID NO: 1474755 - RNA, 15 nt, Pseudomonas aeruginosa PA01
gccgcgcucgacggu

SEQ ID NO: 1474756 - RNA, 12 nt, Pseudomonas aeruginosa PA01
gccgcggagcac

SEQ ID NO: 1474757 - RNA, 14 nt, Pseudomonas aeruginosa PA01
gccgcggagcaccg

SEQ ID NO: 1474758 - RNA, 19 nt, Pseudomonas aeruginosa PA01
gccgcggagcaccgcgccu

SEQ ID NO: 1474759 - RNA, 19 nt, Pseudomonas aeruginosa PA01
gccgcggaaaacgccgcga

SEQ ID NO: 1474760 - RNA, 16 nt, Pseudomonas aeruginosa PA01
gccgcgcucgguccag

SEQ ID NO: 1474761 - RNA, 20 nt, Pseudomonas aeruginosa PA01
gccgcggaagugcgccgguu

SEQ ID NO: 1474762 - RNA, 17 nt, Pseudomonas aeruginosa PA01
gccgcggauacggcagg

SEQ ID NO: 1474763 - RNA, 21 nt, Pseudomonas aeruginosa PA01
gccgcggauacggcaggggcu

SEQ ID NO: 1474764 - RNA, 12 nt, Pseudomonas aeruginosa PA01
gccgcggaucac

SEQ ID NO: 1474765 - RNA, 22 nt, Pseudomonas aeruginosa PA01
gccgcggaucaccuggccgugc

SEQ ID NO: 1474766 - RNA, 16 nt, Pseudomonas aeruginosa PA01
gccgcggcgaacauca

SEQ ID NO: 1474767 - RNA, 20 nt, Pseudomonas aeruginosa PA01
gccgcggcgaacaucaucca

SEQ ID NO: 1474768 - RNA, 18 nt, Pseudomonas aeruginosa PA01
gccgcggcgaagcgcucg

SEQ ID NO: 1474769 - RNA, 13 nt, Pseudomonas aeruginosa PA01
gccgcggcgacca

SEQ ID NO: 1474770 - RNA, 21 nt, Pseudomonas aeruginosa PA01
gccgcggcgccacgcucaccg

SEQ ID NO: 1474771 - RNA, 12 nt, Pseudomonas aeruginosa PA01
gccgcggcggcg

SEQ ID NO: 1474772 - RNA, 17 nt, Pseudomonas aeruginosa PA01
gccgcggcgaccagcgc

SEQ ID NO: 1474773 - RNA, 16 nt, Pseudomonas aeruginosa PA01
gccgcggcgaccaugu

SEQ ID NO: 1474774 - RNA, 15 nt, Pseudomonas aeruginosa PA01
gccgcggcgcggaga

SEQ ID NO: 1474775 - RNA, 20 nt, Pseudomonas aeruginosa PA01
gccgcggcgcggagagucgg

SEQ ID NO: 1474776 - RNA, 14 nt, Pseudomonas aeruginosa PA01
gccgcgcgggccgg

SEQ ID NO: 1474777 - RNA, 16 nt, Pseudomonas aeruginosa PA01
gccgcgcgggccggcg

SEQ ID NO: 1474778 - RNA, 21 nt, Pseudomonas aeruginosa PA01
gccgcgcgggccggcgauggc

SEQ ID NO: 1474779 - RNA, 22 nt, Pseudomonas aeruginosa PA01
gccgcgcgggccggcgauggcc

SEQ ID NO: 1474780 - RNA, 21 nt, Pseudomonas aeruginosa PA01
gccgcgcggcauagcgcagcc

SEQ ID NO: 1474781 - RNA, 21 nt, Pseudomonas aeruginosa PA01
gccgcgcguggcuucguccag

SEQ ID NO: 1474782 - RNA, 20 nt, Pseudomonas aeruginosa PA01
gccgcgcguaggcuuggucg

SEQ ID NO: 1474783 - RNA, 21 nt, Pseudomonas aeruginosa PA01
gccgcgcggucgagcucggcc

SEQ ID NO: 1474784 - RNA, 13 nt, Pseudomonas aeruginosa PA01
gccgcgcgcgucg

SEQ ID NO: 1474785 - RNA, 17 nt, Pseudomonas aeruginosa PA01
gccgcgauauucgcccu

SEQ ID NO: 1474786 - RNA, 12 nt, Pseudomonas aeruginosa PA01
gccgcgcgcugg

SEQ ID NO: 1474787 - RNA, 14 nt, Pseudomonas aeruginosa PA01
gccgcgcgcuggau

SEQ ID NO: 1474788 - RNA, 22 nt, Pseudomonas aeruginosa PA01
gccggcgcaucgucgaaacgcu

SEQ ID NO: 1474789 - RNA, 14 nt, Pseudomonas aeruginosa PA01
gccggcgccagcag

SEQ ID NO: 1474790 - RNA, 15 nt, Pseudomonas aeruginosa PA01
gccggcgccagcagg

SEQ ID NO: 1474791 - RNA, 17 nt, Pseudomonas aeruginosa PA01
gccggcgcaugcgccgg

SEQ ID NO: 1474792 - RNA, 17 nt, Pseudomonas aeruginosa PA01
gccggcgcagaucgcgg

SEQ ID NO: 1474793 - RNA, 18 nt, Pseudomonas aeruginosa PA01
gccggcgcagaucgcggc

SEQ ID NO: 1474794 - RNA, 14 nt, Pseudomonas aeruginosa PA01
gccggcgauggccc

SEQ ID NO: 1474795 - RNA, 20 nt, Pseudomonas aeruginosa PA01
gccggcgauggcccagauga

SEQ ID NO: 1474796 - RNA, 23 nt, Pseudomonas aeruginosa PA01
gccggcgauggcccagaugauca

SEQ ID NO: 1474797 - RNA, 15 nt, Pseudomonas aeruginosa PA01
gccggcgauggccgc

SEQ ID NO: 1474798 - RNA, 22 nt, Pseudomonas aeruginosa PA01
gccggcgauggccgccugcagg

SEQ ID NO: 1474799 - RNA, 20 nt, Pseudomonas aeruginosa PA01
gccggcgaugcgcaggccgg

SEQ ID NO: 1474800 - RNA, 16 nt, Pseudomonas aeruginosa PA01
gccggcgaugugcggc

SEQ ID NO: 1474801 - RNA, 20 nt, Pseudomonas aeruginosa PA01
gccggcgaugugcggcgugg

SEQ ID NO: 1474802 - RNA, 21 nt, Pseudomonas aeruginosa PA01
gccggcgaugugcggcguggc

SEQ ID NO: 1474803 - RNA, 20 nt, Pseudomonas aeruginosa PA01
gccggcgauguucgcccccu

SEQ ID NO: 1474804 - RNA, 14 nt, Pseudomonas aeruginosa PA01
gccggcgccgcagg

SEQ ID NO: 1474805 - RNA, 20 nt, Pseudomonas aeruginosa PA01
gccggcgccgauuccugggc

SEQ ID NO: 1474806 - RNA, 12 nt, Pseudomonas aeruginosa PA01
gccggcgccgau

SEQ ID NO: 1474807 - RNA, 23 nt, Pseudomonas aeruginosa PA01
gccggcgccgauauugaacgacu

SEQ ID NO: 1474808 - RNA, 14 nt, Pseudomonas aeruginosa PA01
gccggcgccgaugc

SEQ ID NO: 1474809 - RNA, 13 nt, Pseudomonas aeruginosa PA01
gccggcgccgauu

SEQ ID NO: 1474810 - RNA, 11 nt, Pseudomonas aeruginosa PA01
gccggcgcccu

SEQ ID NO: 1474811 - RNA, 15 nt, Pseudomonas aeruginosa PA01
gccggcgcccugggc

SEQ ID NO: 1474812 - RNA, 13 nt, Pseudomonas aeruginosa PA01
gccggcgcccuuc

SEQ ID NO: 1474813 - RNA, 14 nt, Pseudomonas aeruginosa PA01
gccggcgccgccgg

SEQ ID NO: 1474814 - RNA, 14 nt, Pseudomonas aeruginosa PA01
gccggcgccgccga

SEQ ID NO: 1474815 - RNA, 15 nt, Pseudomonas aeruginosa PA01
gccggcgccgccucg

SEQ ID NO: 1474816 - RNA, 16 nt, Pseudomonas aeruginosa PA01
gccggcgccgcggucg

SEQ ID NO: 1474817 - RNA, 13 nt, Pseudomonas aeruginosa PA01
gccggcgaccagc

SEQ ID NO: 1474818 - RNA, 14 nt, Pseudomonas aeruginosa PA01
gccggcgaccagcg

SEQ ID NO: 1474819 - RNA, 17 nt, Pseudomonas aeruginosa PA01
gccggcgaccagcgucg

SEQ ID NO: 1474820 - RNA, 22 nt, Pseudomonas aeruginosa PA01
gccggcgaccagcgucgcgcgu

SEQ ID NO: 1474821 - RNA, 14 nt, Pseudomonas aeruginosa PA01
gccggcgaccagcu

SEQ ID NO: 1474822 - RNA, 13 nt, Pseudomonas aeruginosa PA01
gccggcgacgccg

SEQ ID NO: 1474823 - RNA, 16 nt, Pseudomonas aeruginosa PA01
gccggcgacgccgucc

SEQ ID NO: 1474824 - RNA, 13 nt, Pseudomonas aeruginosa PA01
gccggcgacgacg

SEQ ID NO: 1474825 - RNA, 21 nt, Pseudomonas aeruginosa PA01
gccggcgacgacgaucccggc

SEQ ID NO: 1474826 - RNA, 20 nt, Pseudomonas aeruginosa PA01
gccggcgaccuuguccaggc

SEQ ID NO: 1474827 - RNA, 23 nt, Pseudomonas aeruginosa PA01
gccggcgaccuuguccaggcgcu

SEQ ID NO: 1474828 - RNA, 17 nt, Pseudomonas aeruginosa PA01
gccggcgaccuuguccu

SEQ ID NO: 1474829 - RNA, 20 nt, Pseudomonas aeruginosa PA01
gccggcgaccuuguccugcg

SEQ ID NO: 1474830 - RNA, 23 nt, Pseudomonas aeruginosa PA01
gccggcgaacucguuguacucga

SEQ ID NO: 1474831 - RNA, 16 nt, Pseudomonas aeruginosa PA01
gccggcgaagggcagg

SEQ ID NO: 1474832 - RNA, 18 nt, Pseudomonas aeruginosa PA01
gccggcgaagggcaggcc

SEQ ID NO: 1474833 - RNA, 21 nt, Pseudomonas aeruginosa PA01
gccggcgaagggcaggccgau

SEQ ID NO: 1474834 - RNA, 23 nt, Pseudomonas aeruginosa PA01
gccggcgaagggcaggccgauca

SEQ ID NO: 1474835 - RNA, 19 nt, Pseudomonas aeruginosa PA01
gccggcgaacggcaugcgu

SEQ ID NO: 1474836 - RNA, 12 nt, Pseudomonas aeruginosa PA01
gccggcgaacuc

SEQ ID NO: 1474837 - RNA, 17 nt, Pseudomonas aeruginosa PA01
gccggccuugcuuugcg

SEQ ID NO: 1474838 - RNA, 17 nt, Pseudomonas aeruginosa PA01
gccggcgaacagccagc

SEQ ID NO: 1474839 - RNA, 15 nt, Pseudomonas aeruginosa PA01
gccggcgaaccaggc

SEQ ID NO: 1474840 - RNA, 18 nt, Pseudomonas aeruginosa PA01
gccggcgaaccaggcggc

SEQ ID NO: 1474841 - RNA, 19 nt, Pseudomonas aeruginosa PA01
gccggcgaaccaggcggcc

SEQ ID NO: 1474842 - RNA, 20 nt, Pseudomonas aeruginosa PA01
gccggcgaaccaggcggccg

SEQ ID NO: 1474843 - RNA, 21 nt, Pseudomonas aeruginosa PA01
gccggcgaaccaggcggccga

SEQ ID NO: 1474844 - RNA, 16 nt, Pseudomonas aeruginosa PA01
gccggcgaucuccgcc

SEQ ID NO: 1474845 - RNA, 23 nt, Pseudomonas aeruginosa PA01
gccggcgaucuccgccaggcggc

SEQ ID NO: 1474846 - RNA, 16 nt, Pseudomonas aeruginosa PA01
gccggcgaugcccagg

SEQ ID NO: 1474847 - RNA, 17 nt, Pseudomonas aeruginosa PA01
gccggcgaugcccaggc

SEQ ID NO: 1474848 - RNA, 18 nt, Pseudomonas aeruginosa PA01
gccggcgaugcccaggcc

SEQ ID NO: 1474849 - RNA, 19 nt, Pseudomonas aeruginosa PA01
gccggcgaugcccaggccg

SEQ ID NO: 1474850 - RNA, 20 nt, Pseudomonas aeruginosa PA01
gccggcgaugcccaggccgc

SEQ ID NO: 1474851 - RNA, 21 nt, Pseudomonas aeruginosa PA01
gccggcgaugcccaggccgcc

SEQ ID NO: 1474852 - RNA, 23 nt, Pseudomonas aeruginosa PA01
gccggcgaugcccaggccgccga

SEQ ID NO: 1474853 - RNA, 15 nt, Pseudomonas aeruginosa PA01
gccggcgaucgccag

SEQ ID NO: 1474854 - RNA, 17 nt, Pseudomonas aeruginosa PA01
gccggcgaucgccaggc

SEQ ID NO: 1474855 - RNA, 21 nt, Pseudomonas aeruginosa PA01
gccggcgaucagaacgaugcc

SEQ ID NO: 1474856 - RNA, 15 nt, Pseudomonas aeruginosa PA01
gccggcgaucagcgc

SEQ ID NO: 1474857 - RNA, 21 nt, Pseudomonas aeruginosa PA01
gccggcgaucagcgcuuccag

SEQ ID NO: 1474858 - RNA, 19 nt, Pseudomonas aeruginosa PA01
gccggcgaucagcucgcgg

SEQ ID NO: 1474859 - RNA, 20 nt, Pseudomonas aeruginosa PA01
gccggcgaucagcucgcggu

SEQ ID NO: 1474860 - RNA, 21 nt, Pseudomonas aeruginosa PA01
gccggcgaucagcucgcggua

SEQ ID NO: 1474861 - RNA, 23 nt, Pseudomonas aeruginosa PA01
gccggcgaucagcucgcgguagg

SEQ ID NO: 1474862 - RNA, 17 nt, Pseudomonas aeruginosa PA01
gccggcgagggcggcga

SEQ ID NO: 1474863 - RNA, 22 nt, Pseudomonas aeruginosa PA01
gccggcgagggcggcgaccugg

SEQ ID NO: 1474864 - RNA, 15 nt, Pseudomonas aeruginosa PA01
gccggcgaggaucgc

SEQ ID NO: 1474865 - RNA, 23 nt, Pseudomonas aeruginosa PA01
gccggcgaggaucgcgcuggcca

SEQ ID NO: 1474866 - RNA, 16 nt, Pseudomonas aeruginosa PA01
gccggcgaggcggaaa

SEQ ID NO: 1474867 - RNA, 13 nt, Pseudomonas aeruginosa PA01
gccggcgagccgc

SEQ ID NO: 1474868 - RNA, 16 nt, Pseudomonas aeruginosa PA01
gccggcgagcgccugg

SEQ ID NO: 1474869 - RNA, 17 nt, Pseudomonas aeruginosa PA01
gccggcgagcgccugga

SEQ ID NO: 1474870 - RNA, 21 nt, Pseudomonas aeruginosa PA01
gccggcgacggucagcaggcc

SEQ ID NO: 1474871 - RNA, 17 nt, Pseudomonas aeruginosa PA01
gccggcccgcgcggcaa

SEQ ID NO: 1474872 - RNA, 12 nt, Pseudomonas aeruginosa PA01
gccggccccugg

SEQ ID NO: 1474873 - RNA, 19 nt, Pseudomonas aeruginosa PA01
gccggccccugggccggcu

SEQ ID NO: 1474874 - RNA, 12 nt, Pseudomonas aeruginosa PA01
gccggccgacga

SEQ ID NO: 1474875 - RNA, 20 nt, Pseudomonas aeruginosa PA01
gccggcccgugcccguccua

SEQ ID NO: 1474876 - RNA, 16 nt, Pseudomonas aeruginosa PA01
gccggcccucgcgagc

SEQ ID NO: 1474877 - RNA, 15 nt, Pseudomonas aeruginosa PA01
gccggccgcgucgcc

SEQ ID NO: 1474878 - RNA, 16 nt, Pseudomonas aeruginosa PA01
gccggccgcgucgccc

SEQ ID NO: 1474879 - RNA, 17 nt, Pseudomonas aeruginosa PA01
gccggccgcgucgccca

SEQ ID NO: 1474880 - RNA, 19 nt, Pseudomonas aeruginosa PA01
gccggccgcgucgcccagg

SEQ ID NO: 1474881 - RNA, 21 nt, Pseudomonas aeruginosa PA01
gccggccgcgucgcccaggcc

SEQ ID NO: 1474882 - RNA, 14 nt, Pseudomonas aeruginosa PA01
gccggccgccagca

SEQ ID NO: 1474883 - RNA, 15 nt, Pseudomonas aeruginosa PA01
gccggccgccagcag

SEQ ID NO: 1474884 - RNA, 22 nt, Pseudomonas aeruginosa PA01
gccggccucgcgcaacugcggg

SEQ ID NO: 1474885 - RNA, 16 nt, Pseudomonas aeruginosa PA01
gccggccucuccgaga

SEQ ID NO: 1474886 - RNA, 13 nt, Pseudomonas aeruginosa PA01
gccggccucgacg

SEQ ID NO: 1474887 - RNA, 15 nt, Pseudomonas aeruginosa PA01
gccggccucgacgca

SEQ ID NO: 1474888 - RNA, 17 nt, Pseudomonas aeruginosa PA01
gccggccucgacgcaga

SEQ ID NO: 1474889 - RNA, 20 nt, Pseudomonas aeruginosa PA01
gccggccucgacgcagagcg

SEQ ID NO: 1474890 - RNA, 16 nt, Pseudomonas aeruginosa PA01
gccggccucgaggaac

SEQ ID NO: 1474891 - RNA, 23 nt, Pseudomonas aeruginosa PA01
gccggccucgaggaacaggucga

SEQ ID NO: 1474892 - RNA, 12 nt, Pseudomonas aeruginosa PA01
gccggccucgca

SEQ ID NO: 1474893 - RNA, 21 nt, Pseudomonas aeruginosa PA01
gccggccuggaucucggcggc

SEQ ID NO: 1474894 - RNA, 23 nt, Pseudomonas aeruginosa PA01
gccggccuggaucucggcggcca

SEQ ID NO: 1474895 - RNA, 14 nt, Pseudomonas aeruginosa PA01
gccggccgucgcgc

SEQ ID NO: 1474896 - RNA, 22 nt, Pseudomonas aeruginosa PA01
gccggccgucgcgcaccaccca

SEQ ID NO: 1474897 - RNA, 20 nt, Pseudomonas aeruginosa PA01
gccggccgugcggaggguca

SEQ ID NO: 1474898 - RNA, 21 nt, Pseudomonas aeruginosa PA01
gccggccgugcggagggucag

SEQ ID NO: 1474899 - RNA, 20 nt, Pseudomonas aeruginosa PA01
gccggccgucccagucggcg

SEQ ID NO: 1474900 - RNA, 22 nt, Pseudomonas aeruginosa PA01
gccggccgucccagucggcguc

SEQ ID NO: 1474901 - RNA, 13 nt, Pseudomonas aeruginosa PA01
gccggccuccagc

SEQ ID NO: 1474902 - RNA, 15 nt, Pseudomonas aeruginosa PA01
gccggccuccagcac

SEQ ID NO: 1474903 - RNA, 15 nt, Pseudomonas aeruginosa PA01
gccggccuccagcgc

SEQ ID NO: 1474904 - RNA, 16 nt, Pseudomonas aeruginosa PA01
gccggccuccagcgcc

SEQ ID NO: 1474905 - RNA, 17 nt, Pseudomonas aeruginosa PA01
gccggccuccagcgccu

SEQ ID NO: 1474906 - RNA, 22 nt, Pseudomonas aeruginosa PA01
gccggccuccagcgccucgccg

SEQ ID NO: 1474907 - RNA, 15 nt, Pseudomonas aeruginosa PA01
gccggccgggugacg

SEQ ID NO: 1474908 - RNA, 13 nt, Pseudomonas aeruginosa PA01
gccggccggggcc

SEQ ID NO: 1474909 - RNA, 14 nt, Pseudomonas aeruginosa PA01
gccggccggggccg

SEQ ID NO: 1474910 - RNA, 14 nt, Pseudomonas aeruginosa PA01
gccggccggcagcg

SEQ ID NO: 1474911 - RNA, 15 nt, Pseudomonas aeruginosa PA01
gccggcuacucgugg

SEQ ID NO: 1474912 - RNA, 15 nt, Pseudomonas aeruginosa PA01
gccggcuccuugcgc

SEQ ID NO: 1474913 - RNA, 22 nt, Pseudomonas aeruginosa PA01
gccggcuccuugcgccguugcc

SEQ ID NO: 1474914 - RNA, 23 nt, Pseudomonas aeruginosa PA01
gccggcuccuugcgccguugccg

SEQ ID NO: 1474915 - RNA, 14 nt, Pseudomonas aeruginosa PA01
gccggcucagcgcu

SEQ ID NO: 1474916 - RNA, 21 nt, Pseudomonas aeruginosa PA01
gccggcucagcgcuucggcuc

SEQ ID NO: 1474917 - RNA, 23 nt, Pseudomonas aeruginosa PA01
gccggcuccccuggaaugccggc

SEQ ID NO: 1474918 - RNA, 14 nt, Pseudomonas aeruginosa PA01
gccggcugacgcug

SEQ ID NO: 1474919 - RNA, 15 nt, Pseudomonas aeruginosa PA01
gccggcugacgcugg

SEQ ID NO: 1474920 - RNA, 18 nt, Pseudomonas aeruginosa PA01
gccggcugacgcuggcga

SEQ ID NO: 1474921 - RNA, 14 nt, Pseudomonas aeruginosa PA01
gccggcucggugua

SEQ ID NO: 1474922 - RNA, 18 nt, Pseudomonas aeruginosa PA01
gccggcucgguguaggcg

SEQ ID NO: 1474923 - RNA, 21 nt, Pseudomonas aeruginosa PA01
gccggcucccugcaauggggc

SEQ ID NO: 1474924 - RNA, 15 nt, Pseudomonas aeruginosa PA01
gccggcugccgaaga

SEQ ID NO: 1474925 - RNA, 14 nt, Pseudomonas aeruginosa PA01
gccggcugcgccgc

SEQ ID NO: 1474926 - RNA, 21 nt, Pseudomonas aeruginosa PA01
gccggcugcgccgcguucgcc

SEQ ID NO: 1474927 - RNA, 23 nt, Pseudomonas aeruginosa PA01
gccggcugcgccgcguucgccga

SEQ ID NO: 1474928 - RNA, 20 nt, Pseudomonas aeruginosa PA01
gccgggaagccgcucggcgu

SEQ ID NO: 1474929 - RNA, 16 nt, Pseudomonas aeruginosa PA01
gccggcuugcugcagg

SEQ ID NO: 1474930 - RNA, 19 nt, Pseudomonas aeruginosa PA01
gccggcuugcugcaggugg

SEQ ID NO: 1474931 - RNA, 13 nt, Pseudomonas aeruginosa PA01
gccggcugaugcc

SEQ ID NO: 1474932 - RNA, 14 nt, Pseudomonas aeruginosa PA01
gccggcugaugccc

SEQ ID NO: 1474933 - RNA, 13 nt, Pseudomonas aeruginosa PA01
gccggcugcuccg

SEQ ID NO: 1474934 - RNA, 17 nt, Pseudomonas aeruginosa PA01
gccggcugugcagggca

SEQ ID NO: 1474935 - RNA, 18 nt, Pseudomonas aeruginosa PA01
gccggcugugcagggcag

SEQ ID NO: 1474936 - RNA, 16 nt, Pseudomonas aeruginosa PA01
gccggcuuccucgccc

SEQ ID NO: 1474937 - RNA, 19 nt, Pseudomonas aeruginosa PA01
gccggcuuccucgcccuca

SEQ ID NO: 1474938 - RNA, 16 nt, Pseudomonas aeruginosa PA01
gccggcgugccgaccu

SEQ ID NO: 1474939 - RNA, 14 nt, Pseudomonas aeruginosa PA01
gccggcgucggcga

SEQ ID NO: 1474940 - RNA, 18 nt, Pseudomonas aeruginosa PA01
gccggcguuauccgccga

SEQ ID NO: 1474941 - RNA, 16 nt, Pseudomonas aeruginosa PA01
gccggcuaaccgcgaa

SEQ ID NO: 1474942 - RNA, 19 nt, Pseudomonas aeruginosa PA01
gccggcuaaccgcgaagcg

SEQ ID NO: 1474943 - RNA, 21 nt, Pseudomonas aeruginosa PA01
gccggcguucgacgccuugcc

SEQ ID NO: 1474944 - RNA, 17 nt, Pseudomonas aeruginosa PA01
gccggcguugcgcgccc

SEQ ID NO: 1474945 - RNA, 22 nt, Pseudomonas aeruginosa PA01
gccggcguuggaauaguggauc

SEQ ID NO: 1474946 - RNA, 18 nt, Pseudomonas aeruginosa PA01
gccggcguuggcgucgcu

SEQ ID NO: 1474947 - RNA, 15 nt, Pseudomonas aeruginosa PA01
gccggcguccgccgg

SEQ ID NO: 1474948 - RNA, 12 nt, Pseudomonas aeruginosa PA01
gccggcgcgccc

SEQ ID NO: 1474949 - RNA, 16 nt, Pseudomonas aeruginosa PA01
gccggcgcgcccaggc

SEQ ID NO: 1474950 - RNA, 17 nt, Pseudomonas aeruginosa PA01
gccggcgcgcccaggcc

SEQ ID NO: 1474951 - RNA, 19 nt, Pseudomonas aeruginosa PA01
gccggcgcgcccaggccca

SEQ ID NO: 1474952 - RNA, 18 nt, Pseudomonas aeruginosa PA01
gccggcgcgauccuggcg

SEQ ID NO: 1474953 - RNA, 21 nt, Pseudomonas aeruginosa PA01
gccggcgcgauccuggcggca

SEQ ID NO: 1474954 - RNA, 13 nt, Pseudomonas aeruginosa PA01
gccggcgccuugc

SEQ ID NO: 1474955 - RNA, 18 nt, Pseudomonas aeruginosa PA01
gccggcgccuugcgccag

SEQ ID NO: 1474956 - RNA, 19 nt, Pseudomonas aeruginosa PA01
gccggcgccuugcgccagg

SEQ ID NO: 1474957 - RNA, 21 nt, Pseudomonas aeruginosa PA01
gccggcgccuugcgccaggcc

SEQ ID NO: 1474958 - RNA, 14 nt, Pseudomonas aeruginosa PA01
gccggcgcggcgca

SEQ ID NO: 1474959 - RNA, 16 nt, Pseudomonas aeruginosa PA01
gccggcgcggcgcagc

SEQ ID NO: 1474960 - RNA, 17 nt, Pseudomonas aeruginosa PA01
gccggcgcggacggccu

SEQ ID NO: 1474961 - RNA, 19 nt, Pseudomonas aeruginosa PA01
gccggcgcggacggccugc

SEQ ID NO: 1474962 - RNA, 20 nt, Pseudomonas aeruginosa PA01
gccggcgcgccccugcgccc

SEQ ID NO: 1474963 - RNA, 13 nt, Pseudomonas aeruginosa PA01
gccggcgcgccgu

SEQ ID NO: 1474964 - RNA, 15 nt, Pseudomonas aeruginosa PA01
gccggcgcgcggcgg

SEQ ID NO: 1474965 - RNA, 18 nt, Pseudomonas aeruginosa PA01
gccggcgcgucccugggc

SEQ ID NO: 1474966 - RNA, 22 nt, Pseudomonas aeruginosa PA01
gccggcgcgucccugggcgcag

SEQ ID NO: 1474967 - RNA, 17 nt, Pseudomonas aeruginosa PA01
gccggcgcggucucgcg

SEQ ID NO: 1474968 - RNA, 17 nt, Pseudomonas aeruginosa PA01
gccggcgcgggcggccu

SEQ ID NO: 1474969 - RNA, 21 nt, Pseudomonas aeruginosa PA01
gccggcgcgggcggccucgau

SEQ ID NO: 1474970 - RNA, 21 nt, Pseudomonas aeruginosa PA01
gccggcgcguucacuccacga

SEQ ID NO: 1474971 - RNA, 15 nt, Pseudomonas aeruginosa PA01
gccggcgcguaggug

SEQ ID NO: 1474972 - RNA, 18 nt, Pseudomonas aeruginosa PA01
gccggcgcgucgcugcgc

SEQ ID NO: 1474973 - RNA, 14 nt, Pseudomonas aeruginosa PA01
gccggcgcucggcc

SEQ ID NO: 1474974 - RNA, 16 nt, Pseudomonas aeruginosa PA01
gccggcgcucggccag

SEQ ID NO: 1474975 - RNA, 18 nt, Pseudomonas aeruginosa PA01
gccggcgcucggccaggu

SEQ ID NO: 1474976 - RNA, 21 nt, Pseudomonas aeruginosa PA01
gccggcgcucggccaggucgc

SEQ ID NO: 1474977 - RNA, 12 nt, Pseudomonas aeruginosa PA01
gccggcggauca

SEQ ID NO: 1474978 - RNA, 16 nt, Pseudomonas aeruginosa PA01
gccggcggaucagccc

SEQ ID NO: 1474979 - RNA, 16 nt, Pseudomonas aeruginosa PA01
gccggcgcugucucgc

SEQ ID NO: 1474980 - RNA, 23 nt, Pseudomonas aeruginosa PA01
gccggcgcuucugcgagccgcgc

SEQ ID NO: 1474981 - RNA, 15 nt, Pseudomonas aeruginosa PA01
gccggcggcggacgc

SEQ ID NO: 1474982 - RNA, 18 nt, Pseudomonas aeruginosa PA01
gccggcggcggacgcagg

SEQ ID NO: 1474983 - RNA, 13 nt, Pseudomonas aeruginosa PA01
gccggcggcgcgg

SEQ ID NO: 1474984 - RNA, 13 nt, Pseudomonas aeruginosa PA01
gccggcggcgcgu

SEQ ID NO: 1474985 - RNA, 12 nt, Pseudomonas aeruginosa PA01
gccggcgggcgc

SEQ ID NO: 1474986 - RNA, 16 nt, Pseudomonas aeruginosa PA01
gccggcgggcgcgagg

SEQ ID NO: 1474987 - RNA, 20 nt, Pseudomonas aeruginosa PA01
gccggcgggcgcgaggcgcc

SEQ ID NO: 1474988 - RNA, 11 nt, Pseudomonas aeruginosa PA01
gccggcgggga

SEQ ID NO: 1474989 - RNA, 15 nt, Pseudomonas aeruginosa PA01
gccggcggccugagc

SEQ ID NO: 1474990 - RNA, 17 nt, Pseudomonas aeruginosa PA01
gccggcggccugagccg

SEQ ID NO: 1474991 - RNA, 18 nt, Pseudomonas aeruginosa PA01
gccggcggccugagccgg

SEQ ID NO: 1474992 - RNA, 13 nt, Pseudomonas aeruginosa PA01
gccggcggcgaug

SEQ ID NO: 1474993 - RNA, 15 nt, Pseudomonas aeruginosa PA01
gccggcggcgaugau

SEQ ID NO: 1474994 - RNA, 22 nt, Pseudomonas aeruginosa PA01
gccggcggcgaugaucggcagc

SEQ ID NO: 1474995 - RNA, 14 nt, Pseudomonas aeruginosa PA01
gccggcggccaggg

SEQ ID NO: 1474996 - RNA, 15 nt, Pseudomonas aeruginosa PA01
gccgcaucgcugacc

SEQ ID NO: 1474997 - RNA, 13 nt, Pseudomonas aeruginosa PA01
gccgcauccgcgg

SEQ ID NO: 1474998 - RNA, 19 nt, Pseudomonas aeruginosa PA01
gccgcaguuguuccucgcg

SEQ ID NO: 1474999 - RNA, 21 nt, Pseudomonas aeruginosa PA01
gccgcaguuguuccucgcggc

SEQ ID NO: 1475000 - RNA, 22 nt, Pseudomonas aeruginosa PA01
gccgcaguuguuccucgcggcu

SEQ ID NO: 1475001 - RNA, 12 nt, Pseudomonas aeruginosa PA01
gccgcaggcgcu

SEQ ID NO: 1475002 - RNA, 21 nt, Pseudomonas aeruginosa PA01
gccgcaggcgcuauccgccgu

SEQ ID NO: 1475003 - RNA, 15 nt, Pseudomonas aeruginosa PA01
gccgcaguccagggc

SEQ ID NO: 1475004 - RNA, 16 nt, Pseudomonas aeruginosa PA01
gccgcaguccagggcg

SEQ ID NO: 1475005 - RNA, 17 nt, Pseudomonas aeruginosa PA01
gccgcaguccagggcga

SEQ ID NO: 1475006 - RNA, 17 nt, Pseudomonas aeruginosa PA01
gccgcaguacgaggggc

SEQ ID NO: 1475007 - RNA, 22 nt, Pseudomonas aeruginosa PA01
gccgcaguacgaggggccgccg

SEQ ID NO: 1475008 - RNA, 23 nt, Pseudomonas aeruginosa PA01
gccgcaguacgaggggccgccgu

SEQ ID NO: 1475009 - RNA, 19 nt, Pseudomonas aeruginosa PA01
gccgcaguagaugccgcgu

SEQ ID NO: 1475010 - RNA, 22 nt, Pseudomonas aeruginosa PA01
gccgcaguagaugccgcgucgg

SEQ ID NO: 1475011 - RNA, 16 nt, Pseudomonas aeruginosa PA01
gccgcaggucggcguc

SEQ ID NO: 1475012 - RNA, 17 nt, Pseudomonas aeruginosa PA01
gccgcaggucggcgucu

SEQ ID NO: 1475013 - RNA, 21 nt, Pseudomonas aeruginosa PA01
gccgcaggucuugucgcgggu

SEQ ID NO: 1475014 - RNA, 15 nt, Pseudomonas aeruginosa PA01
gccgcaggugaagcu

SEQ ID NO: 1475015 - RNA, 22 nt, Pseudomonas aeruginosa PA01
gccgcaggaaccgacgcgcagg

SEQ ID NO: 1475016 - RNA, 14 nt, Pseudomonas aeruginosa PA01
gccgcagcucggcc

SEQ ID NO: 1475017 - RNA, 13 nt, Pseudomonas aeruginosa PA01
gccgcaggcagaa

SEQ ID NO: 1475018 - RNA, 18 nt, Pseudomonas aeruginosa PA01
gccgcaggcaguggcgcc

SEQ ID NO: 1475019 - RNA, 21 nt, Pseudomonas aeruginosa PA01
gccgcaggcaguggcgccagc

SEQ ID NO: 1475020 - RNA, 14 nt, Pseudomonas aeruginosa PA01
gccgcaggccgcgg

SEQ ID NO: 1475021 - RNA, 19 nt, Pseudomonas aeruginosa PA01
gccgcaggccgcggccgaa

SEQ ID NO: 1475022 - RNA, 12 nt, Pseudomonas aeruginosa PA01
gccgcaggccgu

SEQ ID NO: 1475023 - RNA, 13 nt, Pseudomonas aeruginosa PA01
gccgcaggcgggc

SEQ ID NO: 1475024 - RNA, 14 nt, Pseudomonas aeruginosa PA01
gccgcaggcgggcg

SEQ ID NO: 1475025 - RNA, 15 nt, Pseudomonas aeruginosa PA01
gccgcaggcgggcgc

SEQ ID NO: 1475026 - RNA, 19 nt, Pseudomonas aeruginosa PA01
gccgcaggcgggcgccauc

SEQ ID NO: 1475027 - RNA, 21 nt, Pseudomonas aeruginosa PA01
gccgcagcggcgucugccgcu

SEQ ID NO: 1475028 - RNA, 22 nt, Pseudomonas aeruginosa PA01
gccgcagcggcgucugccgcuc

SEQ ID NO: 1475029 - RNA, 23 nt, Pseudomonas aeruginosa PA01
gccgcagcggcgucugccgcucg

SEQ ID NO: 1475030 - RNA, 13 nt, Pseudomonas aeruginosa PA01
gccgcaugccggg

SEQ ID NO: 1475031 - RNA, 15 nt, Pseudomonas aeruginosa PA01
gccgcaugccggggu

SEQ ID NO: 1475032 - RNA, 15 nt, Pseudomonas aeruginosa PA01
gccgcauuggccagg

SEQ ID NO: 1475033 - RNA, 16 nt, Pseudomonas aeruginosa PA01
gccgcauuggccaggc

SEQ ID NO: 1475034 - RNA, 17 nt, Pseudomonas aeruginosa PA01
gccgcauuggccaggcc

SEQ ID NO: 1475035 - RNA, 18 nt, Pseudomonas aeruginosa PA01
gccgcauuggccaggccc

SEQ ID NO: 1475036 - RNA, 18 nt, Pseudomonas aeruginosa PA01
gccgccaaccacuccgcc

SEQ ID NO: 1475037 - RNA, 21 nt, Pseudomonas aeruginosa PA01
gccgccaccacgaucaggccc

SEQ ID NO: 1475038 - RNA, 15 nt, Pseudomonas aeruginosa PA01
gccgccaccgccacc

SEQ ID NO: 1475039 - RNA, 19 nt, Pseudomonas aeruginosa PA01
gccgccaccgccaccgccg

SEQ ID NO: 1475040 - RNA, 20 nt, Pseudomonas aeruginosa PA01
gccgccaccgccaccgccgg

SEQ ID NO: 1475041 - RNA, 13 nt, Pseudomonas aeruginosa PA01
gccgccaccgcca

SEQ ID NO: 1475042 - RNA, 14 nt, Pseudomonas aeruginosa PA01
gccgccaccgccac

SEQ ID NO: 1475043 - RNA, 15 nt, Pseudomonas aeruginosa PA01
gccgccaagcccuug

SEQ ID NO: 1475044 - RNA, 15 nt, Pseudomonas aeruginosa PA01
gccgccccguuggcg

SEQ ID NO: 1475045 - RNA, 22 nt, Pseudomonas aeruginosa PA01
gccgccccguuggcgcgggcga

SEQ ID NO: 1475046 - RNA, 16 nt, Pseudomonas aeruginosa PA01
gccgcccgagccgcug

SEQ ID NO: 1475047 - RNA, 17 nt, Pseudomonas aeruginosa PA01
gccgcccgagccgcugc

SEQ ID NO: 1475048 - RNA, 18 nt, Pseudomonas aeruginosa PA01
gccgcccgagccgcugca

SEQ ID NO: 1475049 - RNA, 17 nt, Pseudomonas aeruginosa PA01
gccgcccgaggcgaccu

SEQ ID NO: 1475050 - RNA, 22 nt, Pseudomonas aeruginosa PA01
gccgcccgaggcgaccuuggcc

SEQ ID NO: 1475051 - RNA, 16 nt, Pseudomonas aeruginosa PA01
gccgccccagccucgg

SEQ ID NO: 1475052 - RNA, 20 nt, Pseudomonas aeruginosa PA01
gccgccccagccucggcagg

SEQ ID NO: 1475053 - RNA, 14 nt, Pseudomonas aeruginosa PA01
gccgccccaccacc

SEQ ID NO: 1475054 - RNA, 22 nt, Pseudomonas aeruginosa PA01
gccgccccaccaccaucgccgc

SEQ ID NO: 1475055 - RNA, 23 nt, Pseudomonas aeruginosa PA01
gccgccccaccaccaucgccgcg

SEQ ID NO: 1475056 - RNA, 23 nt, Pseudomonas aeruginosa PA01
gccgccccacgggucgucgcccu

SEQ ID NO: 1475057 - RNA, 19 nt, Pseudomonas aeruginosa PA01
gccgcccccagcgcgccgc

SEQ ID NO: 1475058 - RNA, 22 nt, Pseudomonas aeruginosa PA01
gccgcccccagcgcgccgccga

SEQ ID NO: 1475059 - RNA, 16 nt, Pseudomonas aeruginosa PA01
gccgcccccggcccgg

SEQ ID NO: 1475060 - RNA, 18 nt, Pseudomonas aeruginosa PA01
gccgcccccggcccgggc

SEQ ID NO: 1475061 - RNA, 15 nt, Pseudomonas aeruginosa PA01
gccgcccaguucgcg

SEQ ID NO: 1475062 - RNA, 20 nt, Pseudomonas aeruginosa PA01
gccgccauagagugcccagg

SEQ ID NO: 1475063 - RNA, 21 nt, Pseudomonas aeruginosa PA01
gccgccauagagugcccaggc

SEQ ID NO: 1475064 - RNA, 16 nt, Pseudomonas aeruginosa PA01
gccgccaugcucggcc

SEQ ID NO: 1475065 - RNA, 18 nt, Pseudomonas aeruginosa PA01
gccgccaugcucggccag

SEQ ID NO: 1475066 - RNA, 19 nt, Pseudomonas aeruginosa PA01
gccgccaugcucggccagc

SEQ ID NO: 1475067 - RNA, 15 nt, Pseudomonas aeruginosa PA01
gccgccacgccgaua

SEQ ID NO: 1475068 - RNA, 14 nt, Pseudomonas aeruginosa PA01
gccgccacgugcac

SEQ ID NO: 1475069 - RNA, 17 nt, Pseudomonas aeruginosa PA01
gccgccacgugcacgcc

SEQ ID NO: 1475070 - RNA, 21 nt, Pseudomonas aeruginosa PA01
gccgccacgugcacgccgugc

SEQ ID NO: 1475071 - RNA, 22 nt, Pseudomonas aeruginosa PA01
gccgccacgugcacgccgugca

SEQ ID NO: 1475072 - RNA, 14 nt, Pseudomonas aeruginosa PA01
gccgccagcaacag

SEQ ID NO: 1475073 - RNA, 23 nt, Pseudomonas aeruginosa PA01
gccgccagcaacaguugccgcag

SEQ ID NO: 1475074 - RNA, 22 nt, Pseudomonas aeruginosa PA01
gccgccagaaagccucaggcgc

SEQ ID NO: 1475075 - RNA, 23 nt, Pseudomonas aeruginosa PA01
gccgccaguugcuugaucgccag

SEQ ID NO: 1475076 - RNA, 18 nt, Pseudomonas aeruginosa PA01
gccgccaguucgcgcagg

SEQ ID NO: 1475077 - RNA, 16 nt, Pseudomonas aeruginosa PA01
gccgccaguucggcca

SEQ ID NO: 1475078 - RNA, 16 nt, Pseudomonas aeruginosa PA01
gccgccagucggccug

SEQ ID NO: 1475079 - RNA, 14 nt, Pseudomonas aeruginosa PA01
gccgccaggcgcgu

SEQ ID NO: 1475080 - RNA, 19 nt, Pseudomonas aeruginosa PA01
gccgccaggcgcgucgcgg

SEQ ID NO: 1475081 - RNA, 22 nt, Pseudomonas aeruginosa PA01
gccgccaggcgcgucgcggccu

SEQ ID NO: 1475082 - RNA, 20 nt, Pseudomonas aeruginosa PA01
gccgccaggcgcgucuccag

SEQ ID NO: 1475083 - RNA, 13 nt, Pseudomonas aeruginosa PA01
gccgccaggcgcu

SEQ ID NO: 1475084 - RNA, 18 nt, Pseudomonas aeruginosa PA01
gccgccaggcgcuggcga

SEQ ID NO: 1475085 - RNA, 16 nt, Pseudomonas aeruginosa PA01
gccgccagguccgccu

SEQ ID NO: 1475086 - RNA, 15 nt, Pseudomonas aeruginosa PA01
gccgccagguccgcc

SEQ ID NO: 1475087 - RNA, 14 nt, Pseudomonas aeruginosa PA01
gccgccagggcguc

SEQ ID NO: 1475088 - RNA, 15 nt, Pseudomonas aeruginosa PA01
gccgccagggucagc

SEQ ID NO: 1475089 - RNA, 16 nt, Pseudomonas aeruginosa PA01
gccgccagccagagca

SEQ ID NO: 1475090 - RNA, 17 nt, Pseudomonas aeruginosa PA01
gccgccagccagagcag

SEQ ID NO: 1475091 - RNA, 18 nt, Pseudomonas aeruginosa PA01
gccgccagcaggaucgga

SEQ ID NO: 1475092 - RNA, 14 nt, Pseudomonas aeruginosa PA01
gccgccagcaggcc

SEQ ID NO: 1475093 - RNA, 16 nt, Pseudomonas aeruginosa PA01
gccgccagcaggccga

SEQ ID NO: 1475094 - RNA, 17 nt, Pseudomonas aeruginosa PA01
gccgccagcaggccgaa

SEQ ID NO: 1475095 - RNA, 18 nt, Pseudomonas aeruginosa PA01
gccgccagcaggucggcc

SEQ ID NO: 1475096 - RNA, 20 nt, Pseudomonas aeruginosa PA01
gccgccagcaggucggccug

SEQ ID NO: 1475097 - RNA, 22 nt, Pseudomonas aeruginosa PA01
gccgccaggcaggccgggcugg

SEQ ID NO: 1475098 - RNA, 13 nt, Pseudomonas aeruginosa PA01
gccgccaggcccu

SEQ ID NO: 1475099 - RNA, 17 nt, Pseudomonas aeruginosa PA01
gccgccaggcccugggc

SEQ ID NO: 1475100 - RNA, 22 nt, Pseudomonas aeruginosa PA01
gccgccaggcccugggcggcgg

SEQ ID NO: 1475101 - RNA, 12 nt, Pseudomonas aeruginosa PA01
gccgccaggccu

SEQ ID NO: 1475102 - RNA, 13 nt, Pseudomonas aeruginosa PA01
gccgcccgcgccu

SEQ ID NO: 1475103 - RNA, 14 nt, Pseudomonas aeruginosa PA01
gccgcccgcgccuc

SEQ ID NO: 1475104 - RNA, 19 nt, Pseudomonas aeruginosa PA01
gccgcccgcggaccgggcg

SEQ ID NO: 1475105 - RNA, 18 nt, Pseudomonas aeruginosa PA01
gccgcccuccaucagcgc

SEQ ID NO: 1475106 - RNA, 16 nt, Pseudomonas aeruginosa PA01
gccgcccucgggccgc

SEQ ID NO: 1475107 - RNA, 17 nt, Pseudomonas aeruginosa PA01
gccgcccuggccgagcg

SEQ ID NO: 1475108 - RNA, 15 nt, Pseudomonas aeruginosa PA01
gccgcccuggccgcc

SEQ ID NO: 1475109 - RNA, 16 nt, Pseudomonas aeruginosa PA01
gccgcccugcggcagg

SEQ ID NO: 1475110 - RNA, 17 nt, Pseudomonas aeruginosa PA01
gccgcccugcggcaggc

SEQ ID NO: 1475111 - RNA, 21 nt, Pseudomonas aeruginosa PA01
gccgcccugcggcaggcgcca

SEQ ID NO: 1475112 - RNA, 12 nt, Pseudomonas aeruginosa PA01
gccgcccuugcc

SEQ ID NO: 1475113 - RNA, 23 nt, Pseudomonas aeruginosa PA01
gccgcccucgcaguacagcucgg

SEQ ID NO: 1475114 - RNA, 14 nt, Pseudomonas aeruginosa PA01
gccgcccuggcucu

SEQ ID NO: 1475115 - RNA, 23 nt, Pseudomonas aeruginosa PA01
gccgcccuugucgaugagccagc

SEQ ID NO: 1475116 - RNA, 15 nt, Pseudomonas aeruginosa PA01
gccgccgcagagcca

SEQ ID NO: 1475117 - RNA, 14 nt, Pseudomonas aeruginosa PA01
gccgccgaugcugu

SEQ ID NO: 1475118 - RNA, 21 nt, Pseudomonas aeruginosa PA01
gccgccgaugcuguucagcag

SEQ ID NO: 1475119 - RNA, 14 nt, Pseudomonas aeruginosa PA01
gccgccgaugccga

SEQ ID NO: 1475120 - RNA, 13 nt, Pseudomonas aeruginosa PA01
gccgccgaugccg

SEQ ID NO: 1475121 - RNA, 15 nt, Pseudomonas aeruginosa PA01
gccgccgcaaccgcc

SEQ ID NO: 1475122 - RNA, 13 nt, Pseudomonas aeruginosa PA01
gccgccgcggcca

SEQ ID NO: 1475123 - RNA, 14 nt, Pseudomonas aeruginosa PA01
gccgccgcggcacc

SEQ ID NO: 1475124 - RNA, 18 nt, Pseudomonas aeruginosa PA01
gccgccgcggcaccggcg

SEQ ID NO: 1475125 - RNA, 23 nt, Pseudomonas aeruginosa PA01
gccgccggagggaaugaagaagc

SEQ ID NO: 1475126 - RNA, 15 nt, Pseudomonas aeruginosa PA01
gccgccggaccgucg

SEQ ID NO: 1475127 - RNA, 11 nt, Pseudomonas aeruginosa PA01
gccgccgcgcg

SEQ ID NO: 1475128 - RNA, 13 nt, Pseudomonas aeruginosa PA01
gccgccgcgcugc

SEQ ID NO: 1475129 - RNA, 15 nt, Pseudomonas aeruginosa PA01
gccgccgcgcugcag

SEQ ID NO: 1475130 - RNA, 20 nt, Pseudomonas aeruginosa PA01
gccgccgcgcugcaggcggu

SEQ ID NO: 1475131 - RNA, 14 nt, Pseudomonas aeruginosa PA01
gccgccgcgccggc

SEQ ID NO: 1475132 - RNA, 16 nt, Pseudomonas aeruginosa PA01
gccgccgcgccggcga

SEQ ID NO: 1475133 - RNA, 14 nt, Pseudomonas aeruginosa PA01
gccgccgccuuggc

SEQ ID NO: 1475134 - RNA, 15 nt, Pseudomonas aeruginosa PA01
gccgccgccuuggca

SEQ ID NO: 1475135 - RNA, 13 nt, Pseudomonas aeruginosa PA01
gccgccgcgcagc

SEQ ID NO: 1475136 - RNA, 16 nt, Pseudomonas aeruginosa PA01
gccgccgcgcagcacc

SEQ ID NO: 1475137 - RNA, 14 nt, Pseudomonas aeruginosa PA01
gccgccgcgcccgg

SEQ ID NO: 1475138 - RNA, 15 nt, Pseudomonas aeruginosa PA01
gccgccgcgcccggc

SEQ ID NO: 1475139 - RNA, 16 nt, Pseudomonas aeruginosa PA01
gccgccgcgcccggcg

SEQ ID NO: 1475140 - RNA, 11 nt, Pseudomonas aeruginosa PA01
gccgccggcau

SEQ ID NO: 1475141 - RNA, 13 nt, Pseudomonas aeruginosa PA01
gccgccggccacc

SEQ ID NO: 1475142 - RNA, 16 nt, Pseudomonas aeruginosa PA01
gccgccggcggccagg

SEQ ID NO: 1475143 - RNA, 14 nt, Pseudomonas aeruginosa PA01
gccgccggcggcca

SEQ ID NO: 1475144 - RNA, 19 nt, Pseudomonas aeruginosa PA01
gccgccucgaaggccggca

SEQ ID NO: 1475145 - RNA, 14 nt, Pseudomonas aeruginosa PA01
gccgccucgauggc

SEQ ID NO: 1475146 - RNA, 17 nt, Pseudomonas aeruginosa PA01
gccgccucgauggcggc

SEQ ID NO: 1475147 - RNA, 16 nt, Pseudomonas aeruginosa PA01
gccgccucgcgcaacg

SEQ ID NO: 1475148 - RNA, 19 nt, Pseudomonas aeruginosa PA01
gccgccucgcgcaacgccu

SEQ ID NO: 1475149 - RNA, 15 nt, Pseudomonas aeruginosa PA01
gccgccucgcgccgc

SEQ ID NO: 1475150 - RNA, 14 nt, Pseudomonas aeruginosa PA01
gccgcgaccgggca

SEQ ID NO: 1475151 - RNA, 24 nt, Pseudomonas aeruginosa PA01
gccgcgaccgggcaugccgugggc

SEQ ID NO: 1475152 - RNA, 13 nt, Pseudomonas aeruginosa PA01
gccgccucggcgu

SEQ ID NO: 1475153 - RNA, 22 nt, Pseudomonas aeruginosa PA01
gccgccuauccacgacgucggc

SEQ ID NO: 1475154 - RNA, 20 nt, Pseudomonas aeruginosa PA01
gccgccuauccgugacgucg

SEQ ID NO: 1475155 - RNA, 21 nt, Pseudomonas aeruginosa PA01
gccgccuauccgugacgucgg

SEQ ID NO: 1475156 - RNA, 22 nt, Pseudomonas aeruginosa PA01
gccgccuauccgugacgucggc

SEQ ID NO: 1475157 - RNA, 17 nt, Pseudomonas aeruginosa PA01
gccgccuauggcggaua

SEQ ID NO: 1475158 - RNA, 14 nt, Pseudomonas aeruginosa PA01
gccgcgacggcugc

SEQ ID NO: 1475159 - RNA, 18 nt, Pseudomonas aeruginosa PA01
gccgcgacggcugcuccg

SEQ ID NO: 1475160 - RNA, 17 nt, Pseudomonas aeruginosa PA01
gccgcgacucggcugca

SEQ ID NO: 1475161 - RNA, 18 nt, Pseudomonas aeruginosa PA01
gccgcgacucggcugcaa

SEQ ID NO: 1475162 - RNA, 16 nt, Pseudomonas aeruginosa PA01
gccgcgacgacugcgg

SEQ ID NO: 1475163 - RNA, 12 nt, Pseudomonas aeruginosa PA01
gccgcgaccucg

SEQ ID NO: 1475164 - RNA, 16 nt, Pseudomonas aeruginosa PA01
gccgcgaccucguugc

SEQ ID NO: 1475165 - RNA, 15 nt, Pseudomonas aeruginosa PA01
gccgcgaccugcucg

SEQ ID NO: 1475166 - RNA, 19 nt, Pseudomonas aeruginosa PA01
gccgcgaccugcucgucga

SEQ ID NO: 1475167 - RNA, 22 nt, Pseudomonas aeruginosa PA01
gccgcgaccugcucgucgaugc

SEQ ID NO: 1475168 - RNA, 13 nt, Pseudomonas aeruginosa PA01
gccgcgacgcucc

SEQ ID NO: 1475169 - RNA, 16 nt, Pseudomonas aeruginosa PA01
gccgcgacgcuccagc

SEQ ID NO: 1475170 - RNA, 17 nt, Pseudomonas aeruginosa PA01
gccgcgacgcuccagcg

SEQ ID NO: 1475171 - RNA, 17 nt, Pseudomonas aeruginosa PA01
gccgcgagcgcggccgg

SEQ ID NO: 1475172 - RNA, 20 nt, Pseudomonas aeruginosa PA01
gccgcgagcgcggccggcca

SEQ ID NO: 1475173 - RNA, 21 nt, Pseudomonas aeruginosa PA01
gccgcgagcgcggccggccac

SEQ ID NO: 1475174 - RNA, 20 nt, Pseudomonas aeruginosa PA01
gccgcgagcuuggcccuggc

SEQ ID NO: 1475175 - RNA, 13 nt, Pseudomonas aeruginosa PA01
gccgcgaggacaa

SEQ ID NO: 1475176 - RNA, 23 nt, Pseudomonas aeruginosa PA01
gccgcgagccuucagcacggcgc

SEQ ID NO: 1475177 - RNA, 20 nt, Pseudomonas aeruginosa PA01
gccgcgagcgaaacggcgcu

SEQ ID NO: 1475178 - RNA, 18 nt, Pseudomonas aeruginosa PA01
gccgcgaguccuucggcg

SEQ ID NO: 1475179 - RNA, 16 nt, Pseudomonas aeruginosa PA01
gccgcgagguccggcu

SEQ ID NO: 1475180 - RNA, 13 nt, Pseudomonas aeruginosa PA01
gccgcgaggugga

SEQ ID NO: 1475181 - RNA, 18 nt, Pseudomonas aeruginosa PA01
gccgccgucuccgccgcu

SEQ ID NO: 1475182 - RNA, 20 nt, Pseudomonas aeruginosa PA01
gccgccgucuccgccgcuau

SEQ ID NO: 1475183 - RNA, 17 nt, Pseudomonas aeruginosa PA01
gccgccgucuugccgcu

SEQ ID NO: 1475184 - RNA, 20 nt, Pseudomonas aeruginosa PA01
gccgccgugaucucgaacuc

SEQ ID NO: 1475185 - RNA, 21 nt, Pseudomonas aeruginosa PA01
gccgccgugaucucgaacucg

SEQ ID NO: 1475186 - RNA, 22 nt, Pseudomonas aeruginosa PA01
gccgccgucgacuugccgauca

SEQ ID NO: 1475187 - RNA, 12 nt, Pseudomonas aeruginosa PA01
gccgccguccug

SEQ ID NO: 1475188 - RNA, 14 nt, Pseudomonas aeruginosa PA01
gccgccgucgacac

SEQ ID NO: 1475189 - RNA, 16 nt, Pseudomonas aeruginosa PA01
gccgccguugaugacg

SEQ ID NO: 1475190 - RNA, 18 nt, Pseudomonas aeruginosa PA01
gccgccguugaugacgaa

SEQ ID NO: 1475191 - RNA, 22 nt, Pseudomonas aeruginosa PA01
gccgccguugaugacgaacugc

SEQ ID NO: 1475192 - RNA, 22 nt, Pseudomonas aeruginosa PA01
gccgccguucucauugcgccgc

SEQ ID NO: 1475193 - RNA, 17 nt, Pseudomonas aeruginosa PA01
gccgccgucgcggccau

SEQ ID NO: 1475194 - RNA, 14 nt, Pseudomonas aeruginosa PA01
gccgccgucggacu

SEQ ID NO: 1475195 - RNA, 23 nt, Pseudomonas aeruginosa PA01
gccgccgucggacucgacgucau

SEQ ID NO: 1475196 - RNA, 22 nt, Pseudomonas aeruginosa PA01
gccgccguggcugugcuggcca

SEQ ID NO: 1475197 - RNA, 23 nt, Pseudomonas aeruginosa PA01
gccgccguggcugugcuggccac

SEQ ID NO: 1475198 - RNA, 21 nt, Pseudomonas aeruginosa PA01
gccgccgguucgcaggccagg

SEQ ID NO: 1475199 - RNA, 15 nt, Pseudomonas aeruginosa PA01
gccgccguacaggcc

SEQ ID NO: 1475200 - RNA, 16 nt, Pseudomonas aeruginosa PA01
gccgccguacaggcca

SEQ ID NO: 1475201 - RNA, 17 nt, Pseudomonas aeruginosa PA01
gccgccguacaggccac

SEQ ID NO: 1475202 - RNA, 15 nt, Pseudomonas aeruginosa PA01
gccgccggugaacag

SEQ ID NO: 1475203 - RNA, 18 nt, Pseudomonas aeruginosa PA01
gccgccggugcaccaggc

SEQ ID NO: 1475204 - RNA, 20 nt, Pseudomonas aeruginosa PA01
gccgccggugcaccaggcga

SEQ ID NO: 1475205 - RNA, 21 nt, Pseudomonas aeruginosa PA01
gccgccggugcaccaggcgau

SEQ ID NO: 1475206 - RNA, 23 nt, Pseudomonas aeruginosa PA01
gccgccggugcaccaggcgaugc

SEQ ID NO: 1475207 - RNA, 24 nt, Pseudomonas aeruginosa PA01
gccgccggugcaccaggcgaugcg

SEQ ID NO: 1475208 - RNA, 19 nt, Pseudomonas aeruginosa PA01
gccgauugccagaguugcc

SEQ ID NO: 1475209 - RNA, 20 nt, Pseudomonas aeruginosa PA01
gccgauugccagaguugccu

SEQ ID NO: 1475210 - RNA, 17 nt, Pseudomonas aeruginosa PA01
gccgcaaccgcccgagc

SEQ ID NO: 1475211 - RNA, 23 nt, Pseudomonas aeruginosa PA01
gccgcaacgaaaaagggcggcca

SEQ ID NO: 1475212 - RNA, 15 nt, Pseudomonas aeruginosa PA01
gccgcaaccagcccu

SEQ ID NO: 1475213 - RNA, 17 nt, Pseudomonas aeruginosa PA01
gccgcaaccagcccugg

SEQ ID NO: 1475214 - RNA, 14 nt, Pseudomonas aeruginosa PA01
gccgcaaacccccu

SEQ ID NO: 1475215 - RNA, 20 nt, Pseudomonas aeruginosa PA01
gccgcaaacccccugcgcgg

SEQ ID NO: 1475216 - RNA, 18 nt, Pseudomonas aeruginosa PA01
gccgauugugcagggccg

SEQ ID NO: 1475217 - RNA, 18 nt, Pseudomonas aeruginosa PA01
gccgauuucgaugacgcc

SEQ ID NO: 1475218 - RNA, 15 nt, Pseudomonas aeruginosa PA01
gccgaugcccgggcg

SEQ ID NO: 1475219 - RNA, 13 nt, Pseudomonas aeruginosa PA01
gccgaugccgacc

SEQ ID NO: 1475220 - RNA, 22 nt, Pseudomonas aeruginosa PA01
gccgaugccgaccuugccgguu

SEQ ID NO: 1475221 - RNA, 14 nt, Pseudomonas aeruginosa PA01
gccgaugccggccg

SEQ ID NO: 1475222 - RNA, 15 nt, Pseudomonas aeruginosa PA01
gccgaugccggccgg

SEQ ID NO: 1475223 - RNA, 21 nt, Pseudomonas aeruginosa PA01
gccgaugccggaaagccuggc

SEQ ID NO: 1475224 - RNA, 22 nt, Pseudomonas aeruginosa PA01
gccgaugccggaaagccuggcc

SEQ ID NO: 1475225 - RNA, 16 nt, Pseudomonas aeruginosa PA01
gccgaugcccaggccg

SEQ ID NO: 1475226 - RNA, 17 nt, Pseudomonas aeruginosa PA01
gccgaugcccaggccga

SEQ ID NO: 1475227 - RNA, 14 nt, Pseudomonas aeruginosa PA01
gccgaugccgccga

SEQ ID NO: 1475228 - RNA, 13 nt, Pseudomonas aeruginosa PA01
gccgaugccgggc

SEQ ID NO: 1475229 - RNA, 20 nt, Pseudomonas aeruginosa PA01
gccgcagaccagcgaaccgc

SEQ ID NO: 1475230 - RNA, 17 nt, Pseudomonas aeruginosa PA01
gccgcagacaucgccga

SEQ ID NO: 1475231 - RNA, 17 nt, Pseudomonas aeruginosa PA01
gccgcagaugcuccagg

SEQ ID NO: 1475232 - RNA, 19 nt, Pseudomonas aeruginosa PA01
gccgcagaugcuccaggga

SEQ ID NO: 1475233 - RNA, 14 nt, Pseudomonas aeruginosa PA01
gccgcagagccagc

SEQ ID NO: 1475234 - RNA, 14 nt, Pseudomonas aeruginosa PA01
gccgcacuuccagg

SEQ ID NO: 1475235 - RNA, 19 nt, Pseudomonas aeruginosa PA01
gccgcacuuccaggcgcca

SEQ ID NO: 1475236 - RNA, 18 nt, Pseudomonas aeruginosa PA01
gccgcagcggccagggaa

SEQ ID NO: 1475237 - RNA, 14 nt, Pseudomonas aeruginosa PA01
gccgcagcgccucc

SEQ ID NO: 1475238 - RNA, 20 nt, Pseudomonas aeruginosa PA01
gccgcagcgccucccgggcc

SEQ ID NO: 1475239 - RNA, 14 nt, Pseudomonas aeruginosa PA01
gccgcagcggcaug

SEQ ID NO: 1475240 - RNA, 12 nt, Pseudomonas aeruginosa PA01
gccgcagcgccc

SEQ ID NO: 1475241 - RNA, 22 nt, Pseudomonas aeruginosa PA01
gccgcagcgccccucccagcca

SEQ ID NO: 1475242 - RNA, 22 nt, Pseudomonas aeruginosa PA01
gccgcagcaagucgaacaggcc

SEQ ID NO: 1475243 - RNA, 20 nt, Pseudomonas aeruginosa PA01
gccgcaccacguagccggcg

SEQ ID NO: 1475244 - RNA, 22 nt, Pseudomonas aeruginosa PA01
gccgcaccacguagccggcguc

SEQ ID NO: 1475245 - RNA, 18 nt, Pseudomonas aeruginosa PA01
gccgcacaggcuggccag

SEQ ID NO: 1475246 - RNA, 18 nt, Pseudomonas aeruginosa PA01
gccgcacaguugcgcgcc

SEQ ID NO: 1475247 - RNA, 22 nt, Pseudomonas aeruginosa PA01
gccgcacaguugcgcgccggcg

SEQ ID NO: 1475248 - RNA, 23 nt, Pseudomonas aeruginosa PA01
gccgcacaguugcgcgccggcgg

SEQ ID NO: 1475249 - RNA, 20 nt, Pseudomonas aeruginosa PA01
gccgcaccccauccucgccg

SEQ ID NO: 1475250 - RNA, 11 nt, Pseudomonas aeruginosa PA01
gccgcaccagg

SEQ ID NO: 1475251 - RNA, 14 nt, Pseudomonas aeruginosa PA01
gccgcaccgccucg

SEQ ID NO: 1475252 - RNA, 16 nt, Pseudomonas aeruginosa PA01
gccgauacagcgcgcg

SEQ ID NO: 1475253 - RNA, 13 nt, Pseudomonas aeruginosa PA01
gccgaucuccugg

SEQ ID NO: 1475254 - RNA, 16 nt, Pseudomonas aeruginosa PA01
gccgaucuccuggcgg

SEQ ID NO: 1475255 - RNA, 17 nt, Pseudomonas aeruginosa PA01
gccgaucuccuggcggg

SEQ ID NO: 1475256 - RNA, 18 nt, Pseudomonas aeruginosa PA01
gccgaucucguaggcauc

SEQ ID NO: 1475257 - RNA, 19 nt, Pseudomonas aeruginosa PA01
gccgaucucguaggcaucc

SEQ ID NO: 1475258 - RNA, 21 nt, Pseudomonas aeruginosa PA01
gccgaucucgugggccagcag

SEQ ID NO: 1475259 - RNA, 13 nt, Pseudomonas aeruginosa PA01
gccgaucucguag

SEQ ID NO: 1475260 - RNA, 12 nt, Pseudomonas aeruginosa PA01
gccgaucucgcc

SEQ ID NO: 1475261 - RNA, 19 nt, Pseudomonas aeruginosa PA01
gccgaugaucuccgcgccg

SEQ ID NO: 1475262 - RNA, 13 nt, Pseudomonas aeruginosa PA01
gccgaucugcugg

SEQ ID NO: 1475263 - RNA, 13 nt, Pseudomonas aeruginosa PA01
gccgaucagcgcc

SEQ ID NO: 1475264 - RNA, 12 nt, Pseudomonas aeruginosa PA01
gccgaucagcca

SEQ ID NO: 1475265 - RNA, 13 nt, Pseudomonas aeruginosa PA01
gccgaucagccau

SEQ ID NO: 1475266 - RNA, 22 nt, Pseudomonas aeruginosa PA01
gccgaucagccauuggccgacg

SEQ ID NO: 1475267 - RNA, 13 nt, Pseudomonas aeruginosa PA01
gccgaucaccgcc

SEQ ID NO: 1475268 - RNA, 16 nt, Pseudomonas aeruginosa PA01
gccgaucaccaggauc

SEQ ID NO: 1475269 - RNA, 22 nt, Pseudomonas aeruginosa PA01
gccgaucaccaggaucgccggg

SEQ ID NO: 1475270 - RNA, 23 nt, Pseudomonas aeruginosa PA01
gccgaucaccaggaucgccgggc

SEQ ID NO: 1475271 - RNA, 19 nt, Pseudomonas aeruginosa PA01
gccgaucaccccgcccagu

SEQ ID NO: 1475272 - RNA, 21 nt, Pseudomonas aeruginosa PA01
gccgauacccugggagccgcc

SEQ ID NO: 1475273 - RNA, 22 nt, Pseudomonas aeruginosa PA01
gccgauacccugggagccgccg

SEQ ID NO: 1475274 - RNA, 22 nt, Pseudomonas aeruginosa PA01
gccgaguggccgcugagcagca

SEQ ID NO: 1475275 - RNA, 15 nt, Pseudomonas aeruginosa PA01
gccgaggucggcggc

SEQ ID NO: 1475276 - RNA, 15 nt, Pseudomonas aeruginosa PA01
gccgaggucgcgggc

SEQ ID NO: 1475277 - RNA, 18 nt, Pseudomonas aeruginosa PA01
gccgaggucgcgggccag

SEQ ID NO: 1475278 - RNA, 21 nt, Pseudomonas aeruginosa PA01
gccgaggucgcgggccaggcc

SEQ ID NO: 1475279 - RNA, 18 nt, Pseudomonas aeruginosa PA01
gccgaguucgcgcaggcg

SEQ ID NO: 1475280 - RNA, 23 nt, Pseudomonas aeruginosa PA01
gccgaguucgcgcaggcgcuggc

SEQ ID NO: 1475281 - RNA, 14 nt, Pseudomonas aeruginosa PA01
gccgagggcgcgca

SEQ ID NO: 1475282 - RNA, 18 nt, Pseudomonas aeruginosa PA01
gccgagggcgcgcaguag

SEQ ID NO: 1475283 - RNA, 16 nt, Pseudomonas aeruginosa PA01
gccgagggcgcggcgc

SEQ ID NO: 1475284 - RNA, 17 nt, Pseudomonas aeruginosa PA01
gccgagggcgcggcgcc

SEQ ID NO: 1475285 - RNA, 20 nt, Pseudomonas aeruginosa PA01
gccgagggcgcggcgccagc

SEQ ID NO: 1475286 - RNA, 20 nt, Pseudomonas aeruginosa PA01
gccgagggcuguaaucgccg

SEQ ID NO: 1475287 - RNA, 22 nt, Pseudomonas aeruginosa PA01
gccgagggcuguaaucgccgcu

SEQ ID NO: 1475288 - RNA, 19 nt, Pseudomonas aeruginosa PA01
gccgagggcgaguucggcg

SEQ ID NO: 1475289 - RNA, 13 nt, Pseudomonas aeruginosa PA01
gccgagggcgcca

SEQ ID NO: 1475290 - RNA, 16 nt, Pseudomonas aeruginosa PA01
gccgagggcgccaggu

SEQ ID NO: 1475291 - RNA, 17 nt, Pseudomonas aeruginosa PA01
gccgagggcgccaggug

SEQ ID NO: 1475292 - RNA, 18 nt, Pseudomonas aeruginosa PA01
gccgagggcgccaggugc

SEQ ID NO: 1475293 - RNA, 20 nt, Pseudomonas aeruginosa PA01
gccgagggcgaagacuucga

SEQ ID NO: 1475294 - RNA, 16 nt, Pseudomonas aeruginosa PA01
gccgaggucgaccagc

SEQ ID NO: 1475295 - RNA, 15 nt, Pseudomonas aeruginosa PA01
gccgaggucgaggau

SEQ ID NO: 1475296 - RNA, 22 nt, Pseudomonas aeruginosa PA01
gccgaggucgaggauguaguag

SEQ ID NO: 1475297 - RNA, 13 nt, Pseudomonas aeruginosa PA01
gccgaggucgccg

SEQ ID NO: 1475298 - RNA, 16 nt, Pseudomonas aeruginosa PA01
gccgaggucgccgcca

SEQ ID NO: 1475299 - RNA, 19 nt, Pseudomonas aeruginosa PA01
gccgaggucgccgccagcu

SEQ ID NO: 1475300 - RNA, 20 nt, Pseudomonas aeruginosa PA01
gccgaggucaguucggugcc

SEQ ID NO: 1475301 - RNA, 23 nt, Pseudomonas aeruginosa PA01
gccgaggucaguucggugccgcc

SEQ ID NO: 1475302 - RNA, 13 nt, Pseudomonas aeruginosa PA01
gccgaggacccgg

SEQ ID NO: 1475303 - RNA, 21 nt, Pseudomonas aeruginosa PA01
gccgaggaacuccuccucgcu

SEQ ID NO: 1475304 - RNA, 16 nt, Pseudomonas aeruginosa PA01
gccgaggaacucgcgg

SEQ ID NO: 1475305 - RNA, 20 nt, Pseudomonas aeruginosa PA01
gccgaggaggacgucgcggu

SEQ ID NO: 1475306 - RNA, 18 nt, Pseudomonas aeruginosa PA01
gccgaggaggaugccgau

SEQ ID NO: 1475307 - RNA, 20 nt, Pseudomonas aeruginosa PA01
gccgaggaggaugccgauca

SEQ ID NO: 1475308 - RNA, 13 nt, Pseudomonas aeruginosa PA01
gccgaggaggcca

SEQ ID NO: 1475309 - RNA, 23 nt, Pseudomonas aeruginosa PA01
gccgaggcuuuccagcaggcgcu

SEQ ID NO: 1475310 - RNA, 17 nt, Pseudomonas aeruginosa PA01
gccgagggcaccgacga

SEQ ID NO: 1475311 - RNA, 17 nt, Pseudomonas aeruginosa PA01
gccgaggaugcucgccu

SEQ ID NO: 1475312 - RNA, 19 nt, Pseudomonas aeruginosa PA01
gccgaggaugcucgccugg

SEQ ID NO: 1475313 - RNA, 15 nt, Pseudomonas aeruginosa PA01
gccgagcgcucgccg

SEQ ID NO: 1475314 - RNA, 16 nt, Pseudomonas aeruginosa PA01
gccgagcgcucgccgu

SEQ ID NO: 1475315 - RNA, 18 nt, Pseudomonas aeruginosa PA01
gccgagcgcucgccguca

SEQ ID NO: 1475316 - RNA, 15 nt, Pseudomonas aeruginosa PA01
gccgagcuugaccuu

SEQ ID NO: 1475317 - RNA, 23 nt, Pseudomonas aeruginosa PA01
gccgagcuugaccuugccgccgg

SEQ ID NO: 1475318 - RNA, 16 nt, Pseudomonas aeruginosa PA01
gccgagcgggaagcgu

SEQ ID NO: 1475319 - RNA, 17 nt, Pseudomonas aeruginosa PA01
gccgaggaaggcgcugg

SEQ ID NO: 1475320 - RNA, 18 nt, Pseudomonas aeruginosa PA01
gccgaggaaggcgcuggc

SEQ ID NO: 1475321 - RNA, 20 nt, Pseudomonas aeruginosa PA01
gccgaggaaggcgcuggcgc

SEQ ID NO: 1475322 - RNA, 20 nt, Pseudomonas aeruginosa PA01
gccgaggaagucggcggccg

SEQ ID NO: 1475323 - RNA, 22 nt, Pseudomonas aeruginosa PA01
gccgaggaagucggcggccgcc

SEQ ID NO: 1475324 - RNA, 13 nt, Pseudomonas aeruginosa PA01
gccgacgaacagc

SEQ ID NO: 1475325 - RNA, 15 nt, Pseudomonas aeruginosa PA01
gccgacgaacagcca

SEQ ID NO: 1475326 - RNA, 18 nt, Pseudomonas aeruginosa PA01
gccgacgaacagccagag

SEQ ID NO: 1475327 - RNA, 23 nt, Pseudomonas aeruginosa PA01
gccgaccuuguccacgucguagg

SEQ ID NO: 1475328 - RNA, 16 nt, Pseudomonas aeruginosa PA01
gccgacgccgcggccg

SEQ ID NO: 1475329 - RNA, 19 nt, Pseudomonas aeruginosa PA01
gccgacgccgcggccggcg

SEQ ID NO: 1475330 - RNA, 12 nt, Pseudomonas aeruginosa PA01
gccgacgccgga

SEQ ID NO: 1475331 - RNA, 14 nt, Pseudomonas aeruginosa PA01
gccgacgccggacg

SEQ ID NO: 1475332 - RNA, 15 nt, Pseudomonas aeruginosa PA01
gccgacgccggacga

SEQ ID NO: 1475333 - RNA, 23 nt, Pseudomonas aeruginosa PA01
gccgacgccggacgagcuuuccu

SEQ ID NO: 1475334 - RNA, 13 nt, Pseudomonas aeruginosa PA01
gccgacgcgcugc

SEQ ID NO: 1475335 - RNA, 18 nt, Pseudomonas aeruginosa PA01
gccgacgcugaggaucac

SEQ ID NO: 1475336 - RNA, 15 nt, Pseudomonas aeruginosa PA01
gccgacgcuuccucg

SEQ ID NO: 1475337 - RNA, 19 nt, Pseudomonas aeruginosa PA01
gccgacggacguccuccug

SEQ ID NO: 1475338 - RNA, 13 nt, Pseudomonas aeruginosa PA01
gccgacguagccg

SEQ ID NO: 1475339 - RNA, 16 nt, Pseudomonas aeruginosa PA01
gccgacguagccgcgu

SEQ ID NO: 1475340 - RNA, 19 nt, Pseudomonas aeruginosa PA01
gccgacguagggcaucgcc

SEQ ID NO: 1475341 - RNA, 20 nt, Pseudomonas aeruginosa PA01
gccgacguagggcaucgccg

SEQ ID NO: 1475342 - RNA, 23 nt, Pseudomonas aeruginosa PA01
gccgacguagggcaucgccgaca

SEQ ID NO: 1475343 - RNA, 19 nt, Pseudomonas aeruginosa PA01
gccgacguccaucagcguc

SEQ ID NO: 1475344 - RNA, 23 nt, Pseudomonas aeruginosa PA01
gccgacguccaucagcgucugca

SEQ ID NO: 1475345 - RNA, 22 nt, Pseudomonas aeruginosa PA01
gccgacgucguggauaggcggc

SEQ ID NO: 1475346 - RNA, 12 nt, Pseudomonas aeruginosa PA01
gccgacgugcac

SEQ ID NO: 1475347 - RNA, 17 nt, Pseudomonas aeruginosa PA01
gccgacgugcacccgcu

SEQ ID NO: 1475348 - RNA, 18 nt, Pseudomonas aeruginosa PA01
gccgagaaaguucccgca

SEQ ID NO: 1475349 - RNA, 17 nt, Pseudomonas aeruginosa PA01
gccgagaccgcagccca

SEQ ID NO: 1475350 - RNA, 20 nt, Pseudomonas aeruginosa PA01
gccgagaagguucucggcca

SEQ ID NO: 1475351 - RNA, 23 nt, Pseudomonas aeruginosa PA01
gccgagaagguucucggccacca

SEQ ID NO: 1475352 - RNA, 20 nt, Pseudomonas aeruginosa PA01
gccgagaaucugcccggcca

SEQ ID NO: 1475353 - RNA, 18 nt, Pseudomonas aeruginosa PA01
gccgagaacccggccagg

SEQ ID NO: 1475354 - RNA, 20 nt, Pseudomonas aeruginosa PA01
gccgagaacccggccaggcc

SEQ ID NO: 1475355 - RNA, 22 nt, Pseudomonas aeruginosa PA01
gccgagaacccggccaggcccu

SEQ ID NO: 1475356 - RNA, 17 nt, Pseudomonas aeruginosa PA01
gccgagaacgcggcgaa

SEQ ID NO: 1475357 - RNA, 13 nt, Pseudomonas aeruginosa PA01
gccgagcaggguc

SEQ ID NO: 1475358 - RNA, 18 nt, Pseudomonas aeruginosa PA01
gccgagcagggucacgcc

SEQ ID NO: 1475359 - RNA, 21 nt, Pseudomonas aeruginosa PA01
gccgagcagggucacgccgau

SEQ ID NO: 1475360 - RNA, 22 nt, Pseudomonas aeruginosa PA01
gccgagcagggucacgccgauc

SEQ ID NO: 1475361 - RNA, 15 nt, Pseudomonas aeruginosa PA01
gccgagcaucagcga

SEQ ID NO: 1475362 - RNA, 18 nt, Pseudomonas aeruginosa PA01
gccgagcaucagcgacug

SEQ ID NO: 1475363 - RNA, 19 nt, Pseudomonas aeruginosa PA01
gccgagcaucagcgacugg

SEQ ID NO: 1475364 - RNA, 14 nt, Pseudomonas aeruginosa PA01
gccgagcauccagg

SEQ ID NO: 1475365 - RNA, 23 nt, Pseudomonas aeruginosa PA01
gccgagcaggaagaagccgauca

SEQ ID NO: 1475366 - RNA, 17 nt, Pseudomonas aeruginosa PA01
gccgagcaggaugauca

SEQ ID NO: 1475367 - RNA, 21 nt, Pseudomonas aeruginosa PA01
gccgagcaggccacgcaccag

SEQ ID NO: 1475368 - RNA, 14 nt, Pseudomonas aeruginosa PA01
gccgagcaggccca

SEQ ID NO: 1475369 - RNA, 20 nt, Pseudomonas aeruginosa PA01
gccgagcaggcgcgccaggc

SEQ ID NO: 1475370 - RNA, 13 nt, Pseudomonas aeruginosa PA01
gccgagcccaccg

SEQ ID NO: 1475371 - RNA, 15 nt, Pseudomonas aeruginosa PA01
gccgagcccagcggc

SEQ ID NO: 1475372 - RNA, 18 nt, Pseudomonas aeruginosa PA01
gccgagcccagcggcagg

SEQ ID NO: 1475373 - RNA, 12 nt, Pseudomonas aeruginosa PA01
gccgagccccca

SEQ ID NO: 1475374 - RNA, 23 nt, Pseudomonas aeruginosa PA01
gccgagccccgguuacucgccgg

SEQ ID NO: 1475375 - RNA, 17 nt, Pseudomonas aeruginosa PA01
gccgagcaugcgggcga

SEQ ID NO: 1475376 - RNA, 19 nt, Pseudomonas aeruginosa PA01
gccgagcaugcgggcgauc

SEQ ID NO: 1475377 - RNA, 20 nt, Pseudomonas aeruginosa PA01
gccgagcauguaggcgcacc

SEQ ID NO: 1475378 - RNA, 17 nt, Pseudomonas aeruginosa PA01
gccgagccagccgcgga

SEQ ID NO: 1475379 - RNA, 19 nt, Pseudomonas aeruginosa PA01
gccgagccagccgcggauc

SEQ ID NO: 1475380 - RNA, 13 nt, Pseudomonas aeruginosa PA01
gccgagcgcagcg

SEQ ID NO: 1475381 - RNA, 18 nt, Pseudomonas aeruginosa PA01
gccgagcgcagcgccacc

SEQ ID NO: 1475382 - RNA, 23 nt, Pseudomonas aeruginosa PA01
gccgagccgacauccugucgagg

SEQ ID NO: 1475383 - RNA, 17 nt, Pseudomonas aeruginosa PA01
gccgagcgccagggcca

SEQ ID NO: 1475384 - RNA, 12 nt, Pseudomonas aeruginosa PA01
gccgagcgccgc

SEQ ID NO: 1475385 - RNA, 17 nt, Pseudomonas aeruginosa PA01
gccgagcgccgccaggc

SEQ ID NO: 1475386 - RNA, 18 nt, Pseudomonas aeruginosa PA01
gccgagcgccgccaggca

SEQ ID NO: 1475387 - RNA, 21 nt, Pseudomonas aeruginosa PA01
gccgagcgccgccaggcaggc

SEQ ID NO: 1475388 - RNA, 23 nt, Pseudomonas aeruginosa PA01
gccgagcgccgccaggcaggccg

SEQ ID NO: 1475389 - RNA, 14 nt, Pseudomonas aeruginosa PA01
gccgagcgccgccu

SEQ ID NO: 1475390 - RNA, 15 nt, Pseudomonas aeruginosa PA01
gccgagcgccgccug

SEQ ID NO: 1475391 - RNA, 16 nt, Pseudomonas aeruginosa PA01
gccgagcgccgccugg

SEQ ID NO: 1475392 - RNA, 17 nt, Pseudomonas aeruginosa PA01
gccgagcgccgccuggg

SEQ ID NO: 1475393 - RNA, 19 nt, Pseudomonas aeruginosa PA01
gccgagcgccgccugggcc

SEQ ID NO: 1475394 - RNA, 19 nt, Pseudomonas aeruginosa PA01
gccgagcgccuggcaaccg

SEQ ID NO: 1475395 - RNA, 16 nt, Pseudomonas aeruginosa PA01
gccgagcgcgaucagc

SEQ ID NO: 1475396 - RNA, 17 nt, Pseudomonas aeruginosa PA01
gccgagcgcgaucagcc

SEQ ID NO: 1475397 - RNA, 23 nt, Pseudomonas aeruginosa PA01
gccgagcgcgaucagccgcucca

SEQ ID NO: 1475398 - RNA, 16 nt, Pseudomonas aeruginosa PA01
gccgagcagcaccagg

SEQ ID NO: 1475399 - RNA, 18 nt, Pseudomonas aeruginosa PA01
gccgagcagcaccaggcu

SEQ ID NO: 1475400 - RNA, 23 nt, Pseudomonas aeruginosa PA01
gccgagcagcaccaggcuggcca

SEQ ID NO: 1475401 - RNA, 12 nt, Pseudomonas aeruginosa PA01
gccgagcagcgc

SEQ ID NO: 1475402 - RNA, 14 nt, Pseudomonas aeruginosa PA01
gccgagcagcgcca

SEQ ID NO: 1475403 - RNA, 15 nt, Pseudomonas aeruginosa PA01
gccgagcagcgccag

SEQ ID NO: 1475404 - RNA, 16 nt, Pseudomonas aeruginosa PA01
gccgagcagcgccagc

SEQ ID NO: 1475405 - RNA, 15 nt, Pseudomonas aeruginosa PA01
gccgagcagcggcgc

SEQ ID NO: 1475406 - RNA, 18 nt, Pseudomonas aeruginosa PA01
gccgagcagcggcgcgcc

SEQ ID NO: 1475407 - RNA, 20 nt, Pseudomonas aeruginosa PA01
gccgagacuccggagaaccg

SEQ ID NO: 1475408 - RNA, 14 nt, Pseudomonas aeruginosa PA01
gccgaccagcgccg

SEQ ID NO: 1475409 - RNA, 15 nt, Pseudomonas aeruginosa PA01
gccgaccagcgccga

SEQ ID NO: 1475410 - RNA, 14 nt, Pseudomonas aeruginosa PA01
gccgaccaggccga

SEQ ID NO: 1475411 - RNA, 15 nt, Pseudomonas aeruginosa PA01
gccgaccaggccgau

SEQ ID NO: 1475412 - RNA, 17 nt, Pseudomonas aeruginosa PA01
gccgaccaggccgaucg

SEQ ID NO: 1475413 - RNA, 16 nt, Pseudomonas aeruginosa PA01
gccgaccaggcggccg

SEQ ID NO: 1475414 - RNA, 21 nt, Pseudomonas aeruginosa PA01
gccgaccaggcggccgucggc

SEQ ID NO: 1475415 - RNA, 15 nt, Pseudomonas aeruginosa PA01
gccgaccagguccgc

SEQ ID NO: 1475416 - RNA, 17 nt, Pseudomonas aeruginosa PA01
gccgaccagguccgcca

SEQ ID NO: 1475417 - RNA, 16 nt, Pseudomonas aeruginosa PA01
gccgaccgcaccgcca

SEQ ID NO: 1475418 - RNA, 19 nt, Pseudomonas aeruginosa PA01
gccgaccgcaccgccagcg

SEQ ID NO: 1475419 - RNA, 24 nt, Pseudomonas aeruginosa PA01
gccgaccgcaccgccagcgucgcc

SEQ ID NO: 1475420 - RNA, 14 nt, Pseudomonas aeruginosa PA01
gccgaccagccgca

SEQ ID NO: 1475421 - RNA, 15 nt, Pseudomonas aeruginosa PA01
gccgaccagccgcag

SEQ ID NO: 1475422 - RNA, 16 nt, Pseudomonas aeruginosa PA01
gccgaccagccgcagg

SEQ ID NO: 1475423 - RNA, 16 nt, Pseudomonas aeruginosa PA01
gccgaccagcagggcc

SEQ ID NO: 1475424 - RNA, 17 nt, Pseudomonas aeruginosa PA01
gccgaccagcagggcca

SEQ ID NO: 1475425 - RNA, 13 nt, Pseudomonas aeruginosa PA01
gccgaccagcuuc

SEQ ID NO: 1475426 - RNA, 13 nt, Pseudomonas aeruginosa PA01
gccgacaggucgc

SEQ ID NO: 1475427 - RNA, 16 nt, Pseudomonas aeruginosa PA01
gccgacaggucggccg

SEQ ID NO: 1475428 - RNA, 21 nt, Pseudomonas aeruginosa PA01
gccgaccuucaccaccagcga

SEQ ID NO: 1475429 - RNA, 22 nt, Pseudomonas aeruginosa PA01
gccgaccuucaccaccagcgag

SEQ ID NO: 1475430 - RNA, 20 nt, Pseudomonas aeruginosa PA01
gccgaccuucaucaggcggc

SEQ ID NO: 1475431 - RNA, 15 nt, Pseudomonas aeruginosa PA01
gccgaccuugccggu

SEQ ID NO: 1475432 - RNA, 19 nt, Pseudomonas aeruginosa PA01
gccgaccuugcgucuucgc

SEQ ID NO: 1475433 - RNA, 21 nt, Pseudomonas aeruginosa PA01
gccgaccuugcgucuucgccg

SEQ ID NO: 1475434 - RNA, 13 nt, Pseudomonas aeruginosa PA01
gccgaccgccagg

SEQ ID NO: 1475435 - RNA, 15 nt, Pseudomonas aeruginosa PA01
gccgaccgccaggcc

SEQ ID NO: 1475436 - RNA, 16 nt, Pseudomonas aeruginosa PA01
gccgaccgccaggccg

SEQ ID NO: 1475437 - RNA, 17 nt, Pseudomonas aeruginosa PA01
gccgaccgccaggccga

SEQ ID NO: 1475438 - RNA, 21 nt, Pseudomonas aeruginosa PA01
gccgaccgccaggccgacccg

SEQ ID NO: 1475439 - RNA, 15 nt, Pseudomonas aeruginosa PA01
gccgaccgccaaggu

SEQ ID NO: 1475440 - RNA, 18 nt, Pseudomonas aeruginosa PA01
gccgaccgccaaggucgg

SEQ ID NO: 1475441 - RNA, 20 nt, Pseudomonas aeruginosa PA01
gccgaccgccaaggucgguc

SEQ ID NO: 1475442 - RNA, 17 nt, Pseudomonas aeruginosa PA01
gccgaccgcgcgccugc

SEQ ID NO: 1475443 - RNA, 22 nt, Pseudomonas aeruginosa PA01
gccgaccgcgcgccugcaacgc

SEQ ID NO: 1475444 - RNA, 14 nt, Pseudomonas aeruginosa PA01
gcccucagcggcgg

SEQ ID NO: 1475445 - RNA, 22 nt, Pseudomonas aeruginosa PA01
gcccucagggaagaugcacacc

SEQ ID NO: 1475446 - RNA, 13 nt, Pseudomonas aeruginosa PA01
gcccucagcagcg

SEQ ID NO: 1475447 - RNA, 16 nt, Pseudomonas aeruginosa PA01
gcccucagcagcgccg

SEQ ID NO: 1475448 - RNA, 18 nt, Pseudomonas aeruginosa PA01
gcccucagcagcgccgcc

SEQ ID NO: 1475449 - RNA, 20 nt, Pseudomonas aeruginosa PA01
gcccucagcagcgccgcccu

SEQ ID NO: 1475450 - RNA, 14 nt, Pseudomonas aeruginosa PA01
gccgaauccgccgg

SEQ ID NO: 1475451 - RNA, 18 nt, Pseudomonas aeruginosa PA01
gccgaauccgccggcgau

SEQ ID NO: 1475452 - RNA, 19 nt, Pseudomonas aeruginosa PA01
gccgaauccgccggcgaug

SEQ ID NO: 1475453 - RNA, 17 nt, Pseudomonas aeruginosa PA01
gccgaauccuccagccg

SEQ ID NO: 1475454 - RNA, 23 nt, Pseudomonas aeruginosa PA01
gccgaauccuccagccggcgacg

SEQ ID NO: 1475455 - RNA, 16 nt, Pseudomonas aeruginosa PA01
gcccuacaaugauggc

SEQ ID NO: 1475456 - RNA, 20 nt, Pseudomonas aeruginosa PA01
gcccuacaaugauggcccuu

SEQ ID NO: 1475457 - RNA, 16 nt, Pseudomonas aeruginosa PA01
gcccuacccgacaggc

SEQ ID NO: 1475458 - RNA, 19 nt, Pseudomonas aeruginosa PA01
gcccuaccgcccacccugc

SEQ ID NO: 1475459 - RNA, 15 nt, Pseudomonas aeruginosa PA01
gcccuaccugucccg

SEQ ID NO: 1475460 - RNA, 23 nt, Pseudomonas aeruginosa PA01
gcccuacggaccggugccccgcu

SEQ ID NO: 1475461 - RNA, 20 nt, Pseudomonas aeruginosa PA01
gcccuacgggggcgugucga

SEQ ID NO: 1475462 - RNA, 20 nt, Pseudomonas aeruginosa PA01
gcccuacgcaacccgcccgg

SEQ ID NO: 1475463 - RNA, 15 nt, Pseudomonas aeruginosa PA01
gcccuaggcgacccg

SEQ ID NO: 1475464 - RNA, 18 nt, Pseudomonas aeruginosa PA01
gccgacagcacgauggcg

SEQ ID NO: 1475465 - RNA, 21 nt, Pseudomonas aeruginosa PA01
gccgacagcacgauggcgagg

SEQ ID NO: 1475466 - RNA, 20 nt, Pseudomonas aeruginosa PA01
gccgacacgugugucgacac

SEQ ID NO: 1475467 - RNA, 21 nt, Pseudomonas aeruginosa PA01
gccgacacgugugucgacacc

SEQ ID NO: 1475468 - RNA, 16 nt, Pseudomonas aeruginosa PA01
gccgacagagcggccg

SEQ ID NO: 1475469 - RNA, 20 nt, Pseudomonas aeruginosa PA01
gccgacagagcggccggcgc

SEQ ID NO: 1475470 - RNA, 23 nt, Pseudomonas aeruginosa PA01
gccgacagagcggccggcgcggc

SEQ ID NO: 1475471 - RNA, 14 nt, Pseudomonas aeruginosa PA01
gccgacagcggcug

SEQ ID NO: 1475472 - RNA, 17 nt, Pseudomonas aeruginosa PA01
gccgacagcggcuggcg

SEQ ID NO: 1475473 - RNA, 19 nt, Pseudomonas aeruginosa PA01
gccgacagcggcuggcgcu

SEQ ID NO: 1475474 - RNA, 13 nt, Pseudomonas aeruginosa PA01
gccgacaggccgg

SEQ ID NO: 1475475 - RNA, 17 nt, Pseudomonas aeruginosa PA01
gccgacaggccggugcc

SEQ ID NO: 1475476 - RNA, 20 nt, Pseudomonas aeruginosa PA01
gccgacaggccggugccgcc

SEQ ID NO: 1475477 - RNA, 22 nt, Pseudomonas aeruginosa PA01
gccgacaggccggugccgccgg

SEQ ID NO: 1475478 - RNA, 18 nt, Pseudomonas aeruginosa PA01
gcccucaagucuccagcg

SEQ ID NO: 1475479 - RNA, 16 nt, Pseudomonas aeruginosa PA01
gccgaauauuucccau

SEQ ID NO: 1475480 - RNA, 15 nt, Pseudomonas aeruginosa PA01
gccgaauccaggccg

SEQ ID NO: 1475481 - RNA, 16 nt, Pseudomonas aeruginosa PA01
gccgaauccaggccga

SEQ ID NO: 1475482 - RNA, 19 nt, Pseudomonas aeruginosa PA01
gccgaauugggucugcugg

SEQ ID NO: 1475483 - RNA, 13 nt, Pseudomonas aeruginosa PA01
gccauccagccag

SEQ ID NO: 1475484 - RNA, 16 nt, Pseudomonas aeruginosa PA01
gccaucgcauagccgg

SEQ ID NO: 1475485 - RNA, 21 nt, Pseudomonas aeruginosa PA01
gccauccauaucggccaccga

SEQ ID NO: 1475486 - RNA, 20 nt, Pseudomonas aeruginosa PA01
gccauccagccaggcgcucu

SEQ ID NO: 1475487 - RNA, 13 nt, Pseudomonas aeruginosa PA01
gccauccagcgcc

SEQ ID NO: 1475488 - RNA, 14 nt, Pseudomonas aeruginosa PA01
gccauccagcgccu

SEQ ID NO: 1475489 - RNA, 16 nt, Pseudomonas aeruginosa PA01
gccauccagcgccugg

SEQ ID NO: 1475490 - RNA, 13 nt, Pseudomonas aeruginosa PA01
gccaucagcgcca

SEQ ID NO: 1475491 - RNA, 15 nt, Pseudomonas aeruginosa PA01
gccaucagcgccagg

SEQ ID NO: 1475492 - RNA, 16 nt, Pseudomonas aeruginosa PA01
gccaucagcgccaggg

SEQ ID NO: 1475493 - RNA, 16 nt, Pseudomonas aeruginosa PA01
gccaucagcgccgccu

SEQ ID NO: 1475494 - RNA, 18 nt, Pseudomonas aeruginosa PA01
gccaucagcgccgccucg

SEQ ID NO: 1475495 - RNA, 19 nt, Pseudomonas aeruginosa PA01
gccaucaggccgcggcccu

SEQ ID NO: 1475496 - RNA, 20 nt, Pseudomonas aeruginosa PA01
gccaucaggccgcggcccug

SEQ ID NO: 1475497 - RNA, 13 nt, Pseudomonas aeruginosa PA01
gccaucagggcga

SEQ ID NO: 1475498 - RNA, 19 nt, Pseudomonas aeruginosa PA01
gccaucagugacauccucc

SEQ ID NO: 1475499 - RNA, 17 nt, Pseudomonas aeruginosa PA01
gccaucgccucgccggc

SEQ ID NO: 1475500 - RNA, 18 nt, Pseudomonas aeruginosa PA01
gccaucgccucgccggcc

SEQ ID NO: 1475501 - RNA, 19 nt, Pseudomonas aeruginosa PA01
gccaucgccucgccggcca

SEQ ID NO: 1475502 - RNA, 12 nt, Pseudomonas aeruginosa PA01
gccaucgccggc

SEQ ID NO: 1475503 - RNA, 14 nt, Pseudomonas aeruginosa PA01
gccaucgccggccc

SEQ ID NO: 1475504 - RNA, 13 nt, Pseudomonas aeruginosa PA01
gccaucgccgucu

SEQ ID NO: 1475505 - RNA, 14 nt, Pseudomonas aeruginosa PA01
gccaucuggcugcc

SEQ ID NO: 1475506 - RNA, 17 nt, Pseudomonas aeruginosa PA01
gccaucuggcugccgag

SEQ ID NO: 1475507 - RNA, 15 nt, Pseudomonas aeruginosa PA01
gccaucggccugggg

SEQ ID NO: 1475508 - RNA, 23 nt, Pseudomonas aeruginosa PA01
gccaucggccuggggcucggcuu

SEQ ID NO: 1475509 - RNA, 20 nt, Pseudomonas aeruginosa PA01
gccaucggcgguacgcccuc

SEQ ID NO: 1475510 - RNA, 22 nt, Pseudomonas aeruginosa PA01
gccaucggcgguacgcccucca

SEQ ID NO: 1475511 - RNA, 20 nt, Pseudomonas aeruginosa PA01
gccaucgcuuuccuggccga

SEQ ID NO: 1475512 - RNA, 21 nt, Pseudomonas aeruginosa PA01
gccaucgcuuuccuggccgac

SEQ ID NO: 1475513 - RNA, 14 nt, Pseudomonas aeruginosa PA01
gccaucgcucaccg

SEQ ID NO: 1475514 - RNA, 19 nt, Pseudomonas aeruginosa PA01
gccagucauugcgcuccga

SEQ ID NO: 1475515 - RNA, 14 nt, Pseudomonas aeruginosa PA01
gccaguccacgacg

SEQ ID NO: 1475516 - RNA, 20 nt, Pseudomonas aeruginosa PA01
gccaguccacgacgaacggc

SEQ ID NO: 1475517 - RNA, 13 nt, Pseudomonas aeruginosa PA01
gccagucaucgcg

SEQ ID NO: 1475518 - RNA, 13 nt, Pseudomonas aeruginosa PA01
gccauagcgcgcc

SEQ ID NO: 1475519 - RNA, 14 nt, Pseudomonas aeruginosa PA01
gccauagcgcgccg

SEQ ID NO: 1475520 - RNA, 15 nt, Pseudomonas aeruginosa PA01
gccauagcgcgccgg

SEQ ID NO: 1475521 - RNA, 16 nt, Pseudomonas aeruginosa PA01
gccauagcgcgccggg

SEQ ID NO: 1475522 - RNA, 17 nt, Pseudomonas aeruginosa PA01
gccauagcgcgccgggu

SEQ ID NO: 1475523 - RNA, 14 nt, Pseudomonas aeruginosa PA01
gccauagccgacga

SEQ ID NO: 1475524 - RNA, 14 nt, Pseudomonas aeruginosa PA01
gccaguccggcagc

SEQ ID NO: 1475525 - RNA, 17 nt, Pseudomonas aeruginosa PA01
gccaguccggcagcacg

SEQ ID NO: 1475526 - RNA, 19 nt, Pseudomonas aeruginosa PA01
gccaguccggucagcagca

SEQ ID NO: 1475527 - RNA, 17 nt, Pseudomonas aeruginosa PA01
gccauagagugcccagg

SEQ ID NO: 1475528 - RNA, 21 nt, Pseudomonas aeruginosa PA01
gccauagagugcccaggcgcu

SEQ ID NO: 1475529 - RNA, 16 nt, Pseudomonas aeruginosa PA01
gccaucaccagcggcg

SEQ ID NO: 1475530 - RNA, 21 nt, Pseudomonas aeruginosa PA01
gccaucaccagcggcgagcag

SEQ ID NO: 1475531 - RNA, 22 nt, Pseudomonas aeruginosa PA01
gccaucaccagcggcgagcagg

SEQ ID NO: 1475532 - RNA, 16 nt, Pseudomonas aeruginosa PA01
gccaucaacggauauc

SEQ ID NO: 1475533 - RNA, 12 nt, Pseudomonas aeruginosa PA01
gccaucagcacg

SEQ ID NO: 1475534 - RNA, 17 nt, Pseudomonas aeruginosa PA01
gccaucagcacgaaagc

SEQ ID NO: 1475535 - RNA, 17 nt, Pseudomonas aeruginosa PA01
gccauagugcugggcga

SEQ ID NO: 1475536 - RNA, 20 nt, Pseudomonas aeruginosa PA01
gccauagugcugggcgaccu

SEQ ID NO: 1475537 - RNA, 15 nt, Pseudomonas aeruginosa PA01
gccauauagcgcugu

SEQ ID NO: 1475538 - RNA, 20 nt, Pseudomonas aeruginosa PA01
gccauaggaugccgaggugu

SEQ ID NO: 1475539 - RNA, 15 nt, Pseudomonas aeruginosa PA01
gccauaggccagcac

SEQ ID NO: 1475540 - RNA, 16 nt, Pseudomonas aeruginosa PA01
gccauggucucgcuga

SEQ ID NO: 1475541 - RNA, 23 nt, Pseudomonas aeruginosa PA01
gccaugguuuaccaggaccagcg

SEQ ID NO: 1475542 - RNA, 22 nt, Pseudomonas aeruginosa PA01
gccauguacguaucccagcgcg

SEQ ID NO: 1475543 - RNA, 21 nt, Pseudomonas aeruginosa PA01
gccauucacuuccccucccga

SEQ ID NO: 1475544 - RNA, 17 nt, Pseudomonas aeruginosa PA01
gccauucaggcggauca

SEQ ID NO: 1475545 - RNA, 13 nt, Pseudomonas aeruginosa PA01
gccauucgccgcg

SEQ ID NO: 1475546 - RNA, 14 nt, Pseudomonas aeruginosa PA01
gccauucgccgcga

SEQ ID NO: 1475547 - RNA, 19 nt, Pseudomonas aeruginosa PA01
gccauguuccacaugcgcu

SEQ ID NO: 1475548 - RNA, 15 nt, Pseudomonas aeruginosa PA01
gccauguuggccuug

SEQ ID NO: 1475549 - RNA, 17 nt, Pseudomonas aeruginosa PA01
gccaugacacaccacgc

SEQ ID NO: 1475550 - RNA, 15 nt, Pseudomonas aeruginosa PA01
gccaugaccucggcc

SEQ ID NO: 1475551 - RNA, 16 nt, Pseudomonas aeruginosa PA01
gccaugaccucggcca

SEQ ID NO: 1475552 - RNA, 18 nt, Pseudomonas aeruginosa PA01
gccaugagguuggccacg

SEQ ID NO: 1475553 - RNA, 19 nt, Pseudomonas aeruginosa PA01
gccaugagguuggccacgu

SEQ ID NO: 1475554 - RNA, 17 nt, Pseudomonas aeruginosa PA01
gccaucuuccugugcga

SEQ ID NO: 1475555 - RNA, 12 nt, Pseudomonas aeruginosa PA01
gccaucuucucg

SEQ ID NO: 1475556 - RNA, 16 nt, Pseudomonas aeruginosa PA01
gccaugaaaaagccgg

SEQ ID NO: 1475557 - RNA, 18 nt, Pseudomonas aeruginosa PA01
gccaugaaaaagccggga

SEQ ID NO: 1475558 - RNA, 15 nt, Pseudomonas aeruginosa PA01
gccaugggcacgccg

SEQ ID NO: 1475559 - RNA, 18 nt, Pseudomonas aeruginosa PA01
gccaugggccggccgacg

SEQ ID NO: 1475560 - RNA, 13 nt, Pseudomonas aeruginosa PA01
gccauggcuggug

SEQ ID NO: 1475561 - RNA, 20 nt, Pseudomonas aeruginosa PA01
gccauggcgggucacgccga

SEQ ID NO: 1475562 - RNA, 21 nt, Pseudomonas aeruginosa PA01
gccauggcgggucacgccgaa

SEQ ID NO: 1475563 - RNA, 19 nt, Pseudomonas aeruginosa PA01
gccaugaucaucgccugcu

SEQ ID NO: 1475564 - RNA, 23 nt, Pseudomonas aeruginosa PA01
gccauggcggaucuggaauucgc

SEQ ID NO: 1475565 - RNA, 13 nt, Pseudomonas aeruginosa PA01
gccauucucgcca

SEQ ID NO: 1475566 - RNA, 14 nt, Pseudomonas aeruginosa PA01
gccauucucgccau

SEQ ID NO: 1475567 - RNA, 15 nt, Pseudomonas aeruginosa PA01
gccauucggcgacgg

SEQ ID NO: 1475568 - RNA, 16 nt, Pseudomonas aeruginosa PA01
gccauucggcuuccug

SEQ ID NO: 1475569 - RNA, 17 nt, Pseudomonas aeruginosa PA01
gccauucggcuuccugg

SEQ ID NO: 1475570 - RNA, 15 nt, Pseudomonas aeruginosa PA01
gccauugcagguagu

SEQ ID NO: 1475571 - RNA, 16 nt, Pseudomonas aeruginosa PA01
gccauugaacggaccu

SEQ ID NO: 1475572 - RNA, 14 nt, Pseudomonas aeruginosa PA01
gccauugaaggccg

SEQ ID NO: 1475573 - RNA, 17 nt, Pseudomonas aeruginosa PA01
gccauugaaggccgaca

SEQ ID NO: 1475574 - RNA, 20 nt, Pseudomonas aeruginosa PA01
gccauugcuugagcaguucg

SEQ ID NO: 1475575 - RNA, 14 nt, Pseudomonas aeruginosa PA01
gccauugcccggug

SEQ ID NO: 1475576 - RNA, 14 nt, Pseudomonas aeruginosa PA01
gccauugccgccag

SEQ ID NO: 1475577 - RNA, 16 nt, Pseudomonas aeruginosa PA01
gccauugccgccaggu

SEQ ID NO: 1475578 - RNA, 23 nt, Pseudomonas aeruginosa PA01
gccauugacgaaauacucgucga

SEQ ID NO: 1475579 - RNA, 14 nt, Pseudomonas aeruginosa PA01
gccauuggccaggg

SEQ ID NO: 1475580 - RNA, 16 nt, Pseudomonas aeruginosa PA01
gccauuggccaggguc

SEQ ID NO: 1475581 - RNA, 17 nt, Pseudomonas aeruginosa PA01
gccauuggccaggguca

SEQ ID NO: 1475582 - RNA, 17 nt, Pseudomonas aeruginosa PA01
gccauuggccgacgccg

SEQ ID NO: 1475583 - RNA, 20 nt, Pseudomonas aeruginosa PA01
gccauuggccgacgccgcug

SEQ ID NO: 1475584 - RNA, 17 nt, Pseudomonas aeruginosa PA01
gccauugucggccucga

SEQ ID NO: 1475585 - RNA, 13 nt, Pseudomonas aeruginosa PA01
gccauugugcgcg

SEQ ID NO: 1475586 - RNA, 19 nt, Pseudomonas aeruginosa PA01
gccauugugcgcgcgcaga

SEQ ID NO: 1475587 - RNA, 14 nt, Pseudomonas aeruginosa PA01
gcccaagccgagcg

SEQ ID NO: 1475588 - RNA, 19 nt, Pseudomonas aeruginosa PA01
gccaggucgcgcagggcca

SEQ ID NO: 1475589 - RNA, 18 nt, Pseudomonas aeruginosa PA01
gccaggucgcgacugacc

SEQ ID NO: 1475590 - RNA, 19 nt, Pseudomonas aeruginosa PA01
gccaggucgcgacugacca

SEQ ID NO: 1475591 - RNA, 19 nt, Pseudomonas aeruginosa PA01
gccaggucggagugcucga

SEQ ID NO: 1475592 - RNA, 15 nt, Pseudomonas aeruginosa PA01
gccaggucgcgggug

SEQ ID NO: 1475593 - RNA, 19 nt, Pseudomonas aeruginosa PA01
gccaggucgguccgccgau

SEQ ID NO: 1475594 - RNA, 17 nt, Pseudomonas aeruginosa PA01
gccaggucgucgcgcuu

SEQ ID NO: 1475595 - RNA, 19 nt, Pseudomonas aeruginosa PA01
gccaggucgucgcgcuuga

SEQ ID NO: 1475596 - RNA, 15 nt, Pseudomonas aeruginosa PA01
gccaggucguugcgc

SEQ ID NO: 1475597 - RNA, 17 nt, Pseudomonas aeruginosa PA01
gccaggucguugcgccg

SEQ ID NO: 1475598 - RNA, 22 nt, Pseudomonas aeruginosa PA01
gccaggugcaggaagcgccggg

SEQ ID NO: 1475599 - RNA, 14 nt, Pseudomonas aeruginosa PA01
gccagguggcgggc

SEQ ID NO: 1475600 - RNA, 18 nt, Pseudomonas aeruginosa PA01
gccagguggcgggcaagg

SEQ ID NO: 1475601 - RNA, 14 nt, Pseudomonas aeruginosa PA01
gccagguggucgua

SEQ ID NO: 1475602 - RNA, 14 nt, Pseudomonas aeruginosa PA01
gccaggugcgcugg

SEQ ID NO: 1475603 - RNA, 16 nt, Pseudomonas aeruginosa PA01
gccaggugcgcugguu

SEQ ID NO: 1475604 - RNA, 18 nt, Pseudomonas aeruginosa PA01
gccagguguucggccccg

SEQ ID NO: 1475605 - RNA, 18 nt, Pseudomonas aeruginosa PA01
gccaguaguccuccgcgc

SEQ ID NO: 1475606 - RNA, 22 nt, Pseudomonas aeruginosa PA01
gccaguaguccuccgcgcccag

SEQ ID NO: 1475607 - RNA, 21 nt, Pseudomonas aeruginosa PA01
gccaggucgacgaccuugccc

SEQ ID NO: 1475608 - RNA, 21 nt, Pseudomonas aeruginosa PA01
gccagguccgccugguccagc

SEQ ID NO: 1475609 - RNA, 16 nt, Pseudomonas aeruginosa PA01
gccagguauuccgccc

SEQ ID NO: 1475610 - RNA, 20 nt, Pseudomonas aeruginosa PA01
gccagguauuccgcccauug

SEQ ID NO: 1475611 - RNA, 18 nt, Pseudomonas aeruginosa PA01
gccagguauucgcgcucg

SEQ ID NO: 1475612 - RNA, 22 nt, Pseudomonas aeruginosa PA01
gccagguauucgcgcucggcga

SEQ ID NO: 1475613 - RNA, 15 nt, Pseudomonas aeruginosa PA01
gccagguaggcgacg

SEQ ID NO: 1475614 - RNA, 21 nt, Pseudomonas aeruginosa PA01
gccagguaggggucguugccg

SEQ ID NO: 1475615 - RNA, 18 nt, Pseudomonas aeruginosa PA01
gccagguacggaugccgc

SEQ ID NO: 1475616 - RNA, 22 nt, Pseudomonas aeruginosa PA01
gccagguacggaugccgcgagc

SEQ ID NO: 1475617 - RNA, 22 nt, Pseudomonas aeruginosa PA01
gccaggguccgcuucagcgcgc

SEQ ID NO: 1475618 - RNA, 14 nt, Pseudomonas aeruginosa PA01
gccagggucgccag

SEQ ID NO: 1475619 - RNA, 18 nt, Pseudomonas aeruginosa PA01
gccagggucuugccgacc

SEQ ID NO: 1475620 - RNA, 18 nt, Pseudomonas aeruginosa PA01
gccagguacuggcgaugg

SEQ ID NO: 1475621 - RNA, 19 nt, Pseudomonas aeruginosa PA01
gccagguacuggcgaugga

SEQ ID NO: 1475622 - RNA, 16 nt, Pseudomonas aeruginosa PA01
gccagguacuuggcca

SEQ ID NO: 1475623 - RNA, 15 nt, Pseudomonas aeruginosa PA01
gccagguagccugga

SEQ ID NO: 1475624 - RNA, 16 nt, Pseudomonas aeruginosa PA01
gccagguagccuggau

SEQ ID NO: 1475625 - RNA, 21 nt, Pseudomonas aeruginosa PA01
gccagguagcggaccccggcc

SEQ ID NO: 1475626 - RNA, 22 nt, Pseudomonas aeruginosa PA01
gccagguagcggaccccggccu

SEQ ID NO: 1475627 - RNA, 21 nt, Pseudomonas aeruginosa PA01
gccagguagcggcguucgccg

SEQ ID NO: 1475628 - RNA, 22 nt, Pseudomonas aeruginosa PA01
gccagguagcggcguucgccga

SEQ ID NO: 1475629 - RNA, 16 nt, Pseudomonas aeruginosa PA01
gccaggcguuccagcu

SEQ ID NO: 1475630 - RNA, 22 nt, Pseudomonas aeruginosa PA01
gccaggcguuccagcucggcga

SEQ ID NO: 1475631 - RNA, 13 nt, Pseudomonas aeruginosa PA01
gccaggcucgccg

SEQ ID NO: 1475632 - RNA, 14 nt, Pseudomonas aeruginosa PA01
gccaggcucgccgc

SEQ ID NO: 1475633 - RNA, 15 nt, Pseudomonas aeruginosa PA01
gccaggcucgccgcc

SEQ ID NO: 1475634 - RNA, 20 nt, Pseudomonas aeruginosa PA01
gccaggcucgccgccagcag

SEQ ID NO: 1475635 - RNA, 17 nt, Pseudomonas aeruginosa PA01
gccaggcucgcgaugcu

SEQ ID NO: 1475636 - RNA, 22 nt, Pseudomonas aeruginosa PA01
gccaggcucgguucugcgcacc

SEQ ID NO: 1475637 - RNA, 22 nt, Pseudomonas aeruginosa PA01
gccaggcucuucuucgaaccgc

SEQ ID NO: 1475638 - RNA, 16 nt, Pseudomonas aeruginosa PA01
gccaggcggcucccuu

SEQ ID NO: 1475639 - RNA, 17 nt, Pseudomonas aeruginosa PA01
gccaggcggggauggcg

SEQ ID NO: 1475640 - RNA, 18 nt, Pseudomonas aeruginosa PA01
gccaggcgguccagccag

SEQ ID NO: 1475641 - RNA, 21 nt, Pseudomonas aeruginosa PA01
gccaggcgguuccagacaucc

SEQ ID NO: 1475642 - RNA, 17 nt, Pseudomonas aeruginosa PA01
gccaggcguauucggcg

SEQ ID NO: 1475643 - RNA, 18 nt, Pseudomonas aeruginosa PA01
gccaggcguauucggcga

SEQ ID NO: 1475644 - RNA, 21 nt, Pseudomonas aeruginosa PA01
gccaggcguauucggcgacca

SEQ ID NO: 1475645 - RNA, 23 nt, Pseudomonas aeruginosa PA01
gccaggcguauucggcgaccagc

SEQ ID NO: 1475646 - RNA, 19 nt, Pseudomonas aeruginosa PA01
gccaggcuggcugguaacg

SEQ ID NO: 1475647 - RNA, 23 nt, Pseudomonas aeruginosa PA01
gccaggcuggcugguaacgggcg

SEQ ID NO: 1475648 - RNA, 20 nt, Pseudomonas aeruginosa PA01
gccaggcuggguuggcgcga

SEQ ID NO: 1475649 - RNA, 21 nt, Pseudomonas aeruginosa PA01
gccaggcuggguuggcgcgag

SEQ ID NO: 1475650 - RNA, 22 nt, Pseudomonas aeruginosa PA01
gccaggcuggguuggcgcgaga

SEQ ID NO: 1475651 - RNA, 14 nt, Pseudomonas aeruginosa PA01
gccaggcuggccac

SEQ ID NO: 1475652 - RNA, 13 nt, Pseudomonas aeruginosa PA01
gccaggcuggcca

SEQ ID NO: 1475653 - RNA, 20 nt, Pseudomonas aeruginosa PA01
gccaggcugaccgcgugggc

SEQ ID NO: 1475654 - RNA, 15 nt, Pseudomonas aeruginosa PA01
gccagggcaacgcca

SEQ ID NO: 1475655 - RNA, 18 nt, Pseudomonas aeruginosa PA01
gccagggcagcaggucgc

SEQ ID NO: 1475656 - RNA, 15 nt, Pseudomonas aeruginosa PA01
gccaggcugauccgc

SEQ ID NO: 1475657 - RNA, 20 nt, Pseudomonas aeruginosa PA01
gccaggcuuuccgccgagcg

SEQ ID NO: 1475658 - RNA, 21 nt, Pseudomonas aeruginosa PA01
gccagggaggcgcuggccagc

SEQ ID NO: 1475659 - RNA, 19 nt, Pseudomonas aeruginosa PA01
gccagggagucgcuggcca

SEQ ID NO: 1475660 - RNA, 20 nt, Pseudomonas aeruginosa PA01
gccagggagcaggacgccga

SEQ ID NO: 1475661 - RNA, 18 nt, Pseudomonas aeruginosa PA01
gccaggguaccguugcgc

SEQ ID NO: 1475662 - RNA, 19 nt, Pseudomonas aeruginosa PA01
gccagggucagcucgacag

SEQ ID NO: 1475663 - RNA, 13 nt, Pseudomonas aeruginosa PA01
gccaggggucagg

SEQ ID NO: 1475664 - RNA, 17 nt, Pseudomonas aeruginosa PA01
gccaggggucaggccga

SEQ ID NO: 1475665 - RNA, 15 nt, Pseudomonas aeruginosa PA01
gccagggggccuggc

SEQ ID NO: 1475666 - RNA, 16 nt, Pseudomonas aeruginosa PA01
gccagggggccuggcu

SEQ ID NO: 1475667 - RNA, 19 nt, Pseudomonas aeruginosa PA01
gccagggggccuggcucga

SEQ ID NO: 1475668 - RNA, 18 nt, Pseudomonas aeruginosa PA01
gccaggggcuagucgcgc

SEQ ID NO: 1475669 - RNA, 15 nt, Pseudomonas aeruginosa PA01
gccaggggcugaaca

SEQ ID NO: 1475670 - RNA, 17 nt, Pseudomonas aeruginosa PA01
gccaggggcugaacagc

SEQ ID NO: 1475671 - RNA, 21 nt, Pseudomonas aeruginosa PA01
gccaggggcugaacagcgcca

SEQ ID NO: 1475672 - RNA, 23 nt, Pseudomonas aeruginosa PA01
gccaggggcugaacagcgccacc

SEQ ID NO: 1475673 - RNA, 15 nt, Pseudomonas aeruginosa PA01
gccagggcgucggag

SEQ ID NO: 1475674 - RNA, 19 nt, Pseudomonas aeruginosa PA01
gccaggggagcgccggcgc

SEQ ID NO: 1475675 - RNA, 19 nt, Pseudomonas aeruginosa PA01
gccaggggcacgcuggcga

SEQ ID NO: 1475676 - RNA, 13 nt, Pseudomonas aeruginosa PA01
gccagggcgguga

SEQ ID NO: 1475677 - RNA, 15 nt, Pseudomonas aeruginosa PA01
gccagggcggugagg

SEQ ID NO: 1475678 - RNA, 19 nt, Pseudomonas aeruginosa PA01
gccagggcgaggccgcucu

SEQ ID NO: 1475679 - RNA, 17 nt, Pseudomonas aeruginosa PA01
gccagggcguugcucga

SEQ ID NO: 1475680 - RNA, 18 nt, Pseudomonas aeruginosa PA01
gccagggcguugcucgaa

SEQ ID NO: 1475681 - RNA, 19 nt, Pseudomonas aeruginosa PA01
gccagggcuucccaggcca

SEQ ID NO: 1475682 - RNA, 21 nt, Pseudomonas aeruginosa PA01
gccagggcuucccaggccagc

SEQ ID NO: 1475683 - RNA, 22 nt, Pseudomonas aeruginosa PA01
gccagggcgaacagcgccgcgg

SEQ ID NO: 1475684 - RNA, 16 nt, Pseudomonas aeruginosa PA01
gccagggcggcgccga

SEQ ID NO: 1475685 - RNA, 22 nt, Pseudomonas aeruginosa PA01
gccagggcggcgccgaacaggg

SEQ ID NO: 1475686 - RNA, 13 nt, Pseudomonas aeruginosa PA01
gccagggcggcgg

SEQ ID NO: 1475687 - RNA, 13 nt, Pseudomonas aeruginosa PA01
gccagggcgcggu

SEQ ID NO: 1475688 - RNA, 13 nt, Pseudomonas aeruginosa PA01
gccagggcgcuca

SEQ ID NO: 1475689 - RNA, 21 nt, Pseudomonas aeruginosa PA01
gccagggcaugggucagcgcc

SEQ ID NO: 1475690 - RNA, 13 nt, Pseudomonas aeruginosa PA01
gccagggccgcga

SEQ ID NO: 1475691 - RNA, 15 nt, Pseudomonas aeruginosa PA01
gccagggccgcucga

SEQ ID NO: 1475692 - RNA, 19 nt, Pseudomonas aeruginosa PA01
gccagggcccacagugcca

SEQ ID NO: 1475693 - RNA, 13 nt, Pseudomonas aeruginosa PA01
gccagcucggcga

SEQ ID NO: 1475694 - RNA, 17 nt, Pseudomonas aeruginosa PA01
gccagcucgucgcccuu

SEQ ID NO: 1475695 - RNA, 19 nt, Pseudomonas aeruginosa PA01
gccagcucggccggcaggc

SEQ ID NO: 1475696 - RNA, 13 nt, Pseudomonas aeruginosa PA01
gccagcucggccu

SEQ ID NO: 1475697 - RNA, 16 nt, Pseudomonas aeruginosa PA01
gccagcucgcugucca

SEQ ID NO: 1475698 - RNA, 19 nt, Pseudomonas aeruginosa PA01
gccagcucggacaagggcc

SEQ ID NO: 1475699 - RNA, 16 nt, Pseudomonas aeruginosa PA01
gccagcucgccgcgcu

SEQ ID NO: 1475700 - RNA, 17 nt, Pseudomonas aeruginosa PA01
gccagcucgccggucaa

SEQ ID NO: 1475701 - RNA, 18 nt, Pseudomonas aeruginosa PA01
gccagcucuugcccugcc

SEQ ID NO: 1475702 - RNA, 17 nt, Pseudomonas aeruginosa PA01
gccaggaucggcauggc

SEQ ID NO: 1475703 - RNA, 20 nt, Pseudomonas aeruginosa PA01
gccaggaucggcauggccac

SEQ ID NO: 1475704 - RNA, 14 nt, Pseudomonas aeruginosa PA01
gccaggaucgucgg

SEQ ID NO: 1475705 - RNA, 19 nt, Pseudomonas aeruginosa PA01
gccaggaucgucggcccgc

SEQ ID NO: 1475706 - RNA, 20 nt, Pseudomonas aeruginosa PA01
gccaggaucgucggcccgca

SEQ ID NO: 1475707 - RNA, 22 nt, Pseudomonas aeruginosa PA01
gccaggcccucagcggcggugc

SEQ ID NO: 1475708 - RNA, 17 nt, Pseudomonas aeruginosa PA01
gccaggcaccggaccga

SEQ ID NO: 1475709 - RNA, 18 nt, Pseudomonas aeruginosa PA01
gccaggccccaggccgcc

SEQ ID NO: 1475710 - RNA, 19 nt, Pseudomonas aeruginosa PA01
gccaggccccaggccgccg

SEQ ID NO: 1475711 - RNA, 20 nt, Pseudomonas aeruginosa PA01
gccaggccccagggccggcg

SEQ ID NO: 1475712 - RNA, 14 nt, Pseudomonas aeruginosa PA01
gccaggccacggcc

SEQ ID NO: 1475713 - RNA, 17 nt, Pseudomonas aeruginosa PA01
gccaggccacggccggc

SEQ ID NO: 1475714 - RNA, 22 nt, Pseudomonas aeruginosa PA01
gccaggccacggccggcgaggc

SEQ ID NO: 1475715 - RNA, 18 nt, Pseudomonas aeruginosa PA01
gccaggcccacgcccauc

SEQ ID NO: 1475716 - RNA, 22 nt, Pseudomonas aeruginosa PA01
gccaggauuucuccugcggucg

SEQ ID NO: 1475717 - RNA, 21 nt, Pseudomonas aeruginosa PA01
gccaggcauuccuccaggguc

SEQ ID NO: 1475718 - RNA, 23 nt, Pseudomonas aeruginosa PA01
gccaggcauuccuccagggucgc

SEQ ID NO: 1475719 - RNA, 13 nt, Pseudomonas aeruginosa PA01
gccaggcagacca

SEQ ID NO: 1475720 - RNA, 15 nt, Pseudomonas aeruginosa PA01
gccaggcagaccagg

SEQ ID NO: 1475721 - RNA, 21 nt, Pseudomonas aeruginosa PA01
gccaggcagaccaggccgagc

SEQ ID NO: 1475722 - RNA, 14 nt, Pseudomonas aeruginosa PA01
gccaggcaggccgg

SEQ ID NO: 1475723 - RNA, 15 nt, Pseudomonas aeruginosa PA01
gccaggcaggccggg

SEQ ID NO: 1475724 - RNA, 22 nt, Pseudomonas aeruginosa PA01
gccaggcaggccgggcuggcca

SEQ ID NO: 1475725 - RNA, 13 nt, Pseudomonas aeruginosa PA01
gccaggcaggcgg

SEQ ID NO: 1475726 - RNA, 16 nt, Pseudomonas aeruginosa PA01
gccaggcaggcgguca

SEQ ID NO: 1475727 - RNA, 17 nt, Pseudomonas aeruginosa PA01
gccaggcagucguaggu

SEQ ID NO: 1475728 - RNA, 16 nt, Pseudomonas aeruginosa PA01
gccaggcauccagcac

SEQ ID NO: 1475729 - RNA, 18 nt, Pseudomonas aeruginosa PA01
gccaggcauccagcaccg

SEQ ID NO: 1475730 - RNA, 13 nt, Pseudomonas aeruginosa PA01
gccaggccugggu

SEQ ID NO: 1475731 - RNA, 19 nt, Pseudomonas aeruginosa PA01
gccaggccugggucaccag

SEQ ID NO: 1475732 - RNA, 20 nt, Pseudomonas aeruginosa PA01
gccaggccuuccagaacgcc

SEQ ID NO: 1475733 - RNA, 13 nt, Pseudomonas aeruginosa PA01
gccaggccguucu

SEQ ID NO: 1475734 - RNA, 13 nt, Pseudomonas aeruginosa PA01
gccaggccggagc

SEQ ID NO: 1475735 - RNA, 15 nt, Pseudomonas aeruginosa PA01
gccaggccggagccg

SEQ ID NO: 1475736 - RNA, 15 nt, Pseudomonas aeruginosa PA01
gccaggccggcgcau

SEQ ID NO: 1475737 - RNA, 16 nt, Pseudomonas aeruginosa PA01
gccaggccggcgccuu

SEQ ID NO: 1475738 - RNA, 23 nt, Pseudomonas aeruginosa PA01
gccaggccggcgccuugcgccag

SEQ ID NO: 1475739 - RNA, 13 nt, Pseudomonas aeruginosa PA01
gccaggccggugc

SEQ ID NO: 1475740 - RNA, 19 nt, Pseudomonas aeruginosa PA01
gccaggccguagaccacca

SEQ ID NO: 1475741 - RNA, 22 nt, Pseudomonas aeruginosa PA01
gccaggccguagaccaccagca

SEQ ID NO: 1475742 - RNA, 17 nt, Pseudomonas aeruginosa PA01
gccaggccggcgagggc

SEQ ID NO: 1475743 - RNA, 13 nt, Pseudomonas aeruginosa PA01
gccaggccggcgc

SEQ ID NO: 1475744 - RNA, 14 nt, Pseudomonas aeruginosa PA01
gccaggccgagcaa

SEQ ID NO: 1475745 - RNA, 22 nt, Pseudomonas aeruginosa PA01
gccaggccgagcaauccggcgc

SEQ ID NO: 1475746 - RNA, 13 nt, Pseudomonas aeruginosa PA01
gccaggccgagcg

SEQ ID NO: 1475747 - RNA, 16 nt, Pseudomonas aeruginosa PA01
gccaggccgagcgcca

SEQ ID NO: 1475748 - RNA, 18 nt, Pseudomonas aeruginosa PA01
gccaggccgagcgccagg

SEQ ID NO: 1475749 - RNA, 22 nt, Pseudomonas aeruginosa PA01
gccaggccgagcgcgccgccga

SEQ ID NO: 1475750 - RNA, 18 nt, Pseudomonas aeruginosa PA01
gccaggccgagcgugcgc

SEQ ID NO: 1475751 - RNA, 15 nt, Pseudomonas aeruginosa PA01
gccaggccgaucagc

SEQ ID NO: 1475752 - RNA, 15 nt, Pseudomonas aeruginosa PA01
gccaggcccucggcg

SEQ ID NO: 1475753 - RNA, 19 nt, Pseudomonas aeruginosa PA01
gccaggcccucggcgacca

SEQ ID NO: 1475754 - RNA, 15 nt, Pseudomonas aeruginosa PA01
gccaggccgacccgc

SEQ ID NO: 1475755 - RNA, 15 nt, Pseudomonas aeruginosa PA01
gccaggccgcccagg

SEQ ID NO: 1475756 - RNA, 17 nt, Pseudomonas aeruginosa PA01
gccaggccgcccaggac

SEQ ID NO: 1475757 - RNA, 13 nt, Pseudomonas aeruginosa PA01
gccaggccgccga

SEQ ID NO: 1475758 - RNA, 16 nt, Pseudomonas aeruginosa PA01
gccaggccgccgaaga

SEQ ID NO: 1475759 - RNA, 17 nt, Pseudomonas aeruginosa PA01
gccaggccgcgcagucc

SEQ ID NO: 1475760 - RNA, 23 nt, Pseudomonas aeruginosa PA01
gccaggccgaucagcgccucggc

SEQ ID NO: 1475761 - RNA, 15 nt, Pseudomonas aeruginosa PA01
gccaggcgcaguagg

SEQ ID NO: 1475762 - RNA, 15 nt, Pseudomonas aeruginosa PA01
gccaggcgcagugcc

SEQ ID NO: 1475763 - RNA, 15 nt, Pseudomonas aeruginosa PA01
gccaggcgcaccagc

SEQ ID NO: 1475764 - RNA, 18 nt, Pseudomonas aeruginosa PA01
gccaggcgcaccagcagg

SEQ ID NO: 1475765 - RNA, 23 nt, Pseudomonas aeruginosa PA01
gccaggcgauggugcgcucgcgg

SEQ ID NO: 1475766 - RNA, 13 nt, Pseudomonas aeruginosa PA01
gccaggcgccagg

SEQ ID NO: 1475767 - RNA, 19 nt, Pseudomonas aeruginosa PA01
gccaggccuugugcgccag

SEQ ID NO: 1475768 - RNA, 20 nt, Pseudomonas aeruginosa PA01
gccaggccuugugcgccagc

SEQ ID NO: 1475769 - RNA, 21 nt, Pseudomonas aeruginosa PA01
gccaggccuugugcgccagcu

SEQ ID NO: 1475770 - RNA, 23 nt, Pseudomonas aeruginosa PA01
gccaggccuugugcgccagcucg

SEQ ID NO: 1475771 - RNA, 13 nt, Pseudomonas aeruginosa PA01
gccaggccuugca

SEQ ID NO: 1475772 - RNA, 16 nt, Pseudomonas aeruginosa PA01
gccaggccuugcagca

SEQ ID NO: 1475773 - RNA, 12 nt, Pseudomonas aeruginosa PA01
gccaggccucgg

SEQ ID NO: 1475774 - RNA, 19 nt, Pseudomonas aeruginosa PA01
gccaggccucggcgcgggc

SEQ ID NO: 1475775 - RNA, 17 nt, Pseudomonas aeruginosa PA01
gccaggcgaggaacagc

SEQ ID NO: 1475776 - RNA, 21 nt, Pseudomonas aeruginosa PA01
gccaggcgauccagcggguag

SEQ ID NO: 1475777 - RNA, 21 nt, Pseudomonas aeruginosa PA01
gccaggcgaugaacggcguca

SEQ ID NO: 1475778 - RNA, 22 nt, Pseudomonas aeruginosa PA01
gccaggcgaagcggcuggccgc

SEQ ID NO: 1475779 - RNA, 19 nt, Pseudomonas aeruginosa PA01
gccaggcgaaggcgauccc

SEQ ID NO: 1475780 - RNA, 13 nt, Pseudomonas aeruginosa PA01
gccaggcgcgguu

SEQ ID NO: 1475781 - RNA, 21 nt, Pseudomonas aeruginosa PA01
gccaggcgcgguugccgcugc

SEQ ID NO: 1475782 - RNA, 13 nt, Pseudomonas aeruginosa PA01
gccaggcgcgucg

SEQ ID NO: 1475783 - RNA, 15 nt, Pseudomonas aeruginosa PA01
gccaggcgcgucgcg

SEQ ID NO: 1475784 - RNA, 13 nt, Pseudomonas aeruginosa PA01
gccaggcggccga

SEQ ID NO: 1475785 - RNA, 15 nt, Pseudomonas aeruginosa PA01
gccaggcggccgcug

SEQ ID NO: 1475786 - RNA, 18 nt, Pseudomonas aeruginosa PA01
gccaggcgcugguccagc

SEQ ID NO: 1475787 - RNA, 21 nt, Pseudomonas aeruginosa PA01
gccaggcggaacggcucgcga

SEQ ID NO: 1475788 - RNA, 22 nt, Pseudomonas aeruginosa PA01
gccaggcgcuccuccagcgccg

SEQ ID NO: 1475789 - RNA, 13 nt, Pseudomonas aeruginosa PA01
gccaggcgcucgc

SEQ ID NO: 1475790 - RNA, 17 nt, Pseudomonas aeruginosa PA01
gccaggcgcucucgccg

SEQ ID NO: 1475791 - RNA, 19 nt, Pseudomonas aeruginosa PA01
gccaggcgcucucgccgcc

SEQ ID NO: 1475792 - RNA, 20 nt, Pseudomonas aeruginosa PA01
gccaggcgcucucgccgccu

SEQ ID NO: 1475793 - RNA, 17 nt, Pseudomonas aeruginosa PA01
gccagcggaugcuggcg

SEQ ID NO: 1475794 - RNA, 18 nt, Pseudomonas aeruginosa PA01
gccagcggaugcuggcgg

SEQ ID NO: 1475795 - RNA, 17 nt, Pseudomonas aeruginosa PA01
gccagcgcuuccaccgc

SEQ ID NO: 1475796 - RNA, 22 nt, Pseudomonas aeruginosa PA01
gccagcgcuuccaccgccugcc

SEQ ID NO: 1475797 - RNA, 18 nt, Pseudomonas aeruginosa PA01
gccagcgcuucgcgaucg

SEQ ID NO: 1475798 - RNA, 21 nt, Pseudomonas aeruginosa PA01
gccagcgcuucgcgaucggcg

SEQ ID NO: 1475799 - RNA, 23 nt, Pseudomonas aeruginosa PA01
gccagcgcguagcuuuccgcggc

SEQ ID NO: 1475800 - RNA, 17 nt, Pseudomonas aeruginosa PA01
gccagcgcucgaacgcc

SEQ ID NO: 1475801 - RNA, 20 nt, Pseudomonas aeruginosa PA01
gccagcggcgaucgccuggu

SEQ ID NO: 1475802 - RNA, 23 nt, Pseudomonas aeruginosa PA01
gccagcggcgaucgccuggucga

SEQ ID NO: 1475803 - RNA, 15 nt, Pseudomonas aeruginosa PA01
gccagcggcagaucg

SEQ ID NO: 1475804 - RNA, 18 nt, Pseudomonas aeruginosa PA01
gccagcggcauccgccgc

SEQ ID NO: 1475805 - RNA, 20 nt, Pseudomonas aeruginosa PA01
gccagcggcauccgccgcug

SEQ ID NO: 1475806 - RNA, 18 nt, Pseudomonas aeruginosa PA01
gccagcguccuucggcgc

SEQ ID NO: 1475807 - RNA, 19 nt, Pseudomonas aeruginosa PA01
gccagcguccuucggcgcu

SEQ ID NO: 1475808 - RNA, 21 nt, Pseudomonas aeruginosa PA01
gccagcguccuucggcgcucu

SEQ ID NO: 1475809 - RNA, 13 nt, Pseudomonas aeruginosa PA01
gccagcgucgccg

SEQ ID NO: 1475810 - RNA, 15 nt, Pseudomonas aeruginosa PA01
gccagcgucgccgcc

SEQ ID NO: 1475811 - RNA, 19 nt, Pseudomonas aeruginosa PA01
gccagcgugaagaccuggu

SEQ ID NO: 1475812 - RNA, 21 nt, Pseudomonas aeruginosa PA01
gccagcgguugagcagggcgu

SEQ ID NO: 1475813 - RNA, 17 nt, Pseudomonas aeruginosa PA01
gccagcggcccggcagg

SEQ ID NO: 1475814 - RNA, 12 nt, Pseudomonas aeruginosa PA01
gccagcucgccg

SEQ ID NO: 1475815 - RNA, 14 nt, Pseudomonas aeruginosa PA01
gccagcucgccgaa

SEQ ID NO: 1475816 - RNA, 13 nt, Pseudomonas aeruginosa PA01
gccagcucgccgc

SEQ ID NO: 1475817 - RNA, 13 nt, Pseudomonas aeruginosa PA01
gccagcucgcccg

SEQ ID NO: 1475818 - RNA, 18 nt, Pseudomonas aeruginosa PA01
gccagcucgcccgccucg

SEQ ID NO: 1475819 - RNA, 14 nt, Pseudomonas aeruginosa PA01
gccagcucgaccuu

SEQ ID NO: 1475820 - RNA, 19 nt, Pseudomonas aeruginosa PA01
gccagcucgaccuugcccu

SEQ ID NO: 1475821 - RNA, 16 nt, Pseudomonas aeruginosa PA01
gccagcgccuggcgca

SEQ ID NO: 1475822 - RNA, 19 nt, Pseudomonas aeruginosa PA01
gccagcgccuucgugacca

SEQ ID NO: 1475823 - RNA, 16 nt, Pseudomonas aeruginosa PA01
gccagcgcggugcgcg

SEQ ID NO: 1475824 - RNA, 13 nt, Pseudomonas aeruginosa PA01
gccagcgcggcgc

SEQ ID NO: 1475825 - RNA, 15 nt, Pseudomonas aeruginosa PA01
gccagcgcggcgcgc

SEQ ID NO: 1475826 - RNA, 16 nt, Pseudomonas aeruginosa PA01
gccagcgcggcgcgcu

SEQ ID NO: 1475827 - RNA, 18 nt, Pseudomonas aeruginosa PA01
gccagcgcggcgcgcuga

SEQ ID NO: 1475828 - RNA, 17 nt, Pseudomonas aeruginosa PA01
gccagcgagacgggcga

SEQ ID NO: 1475829 - RNA, 20 nt, Pseudomonas aeruginosa PA01
gccagcgagacgggcgaggc

SEQ ID NO: 1475830 - RNA, 19 nt, Pseudomonas aeruginosa PA01
gccagcgacucgcucgcuu

SEQ ID NO: 1475831 - RNA, 24 nt, Pseudomonas aeruginosa PA01
gccagcgaacccaggccgcgcagc

SEQ ID NO: 1475832 - RNA, 20 nt, Pseudomonas aeruginosa PA01
gccagccuucccggcgcuuc

SEQ ID NO: 1475833 - RNA, 15 nt, Pseudomonas aeruginosa PA01
gccagccuuccucgg

SEQ ID NO: 1475834 - RNA, 16 nt, Pseudomonas aeruginosa PA01
gccagccuuccucggg

SEQ ID NO: 1475835 - RNA, 21 nt, Pseudomonas aeruginosa PA01
gccagcgaccgucgaaccagg

SEQ ID NO: 1475836 - RNA, 20 nt, Pseudomonas aeruginosa PA01
gccagccggcgaagggcagg

SEQ ID NO: 1475837 - RNA, 14 nt, Pseudomonas aeruginosa PA01
gccagccucggcga

SEQ ID NO: 1475838 - RNA, 17 nt, Pseudomonas aeruginosa PA01
gccagccucggcgaagu

SEQ ID NO: 1475839 - RNA, 18 nt, Pseudomonas aeruginosa PA01
gccagccucggcgaaguc

SEQ ID NO: 1475840 - RNA, 16 nt, Pseudomonas aeruginosa PA01
gccagccugcagccag

SEQ ID NO: 1475841 - RNA, 12 nt, Pseudomonas aeruginosa PA01
gccagccuggcc

SEQ ID NO: 1475842 - RNA, 15 nt, Pseudomonas aeruginosa PA01
gccagccuggccagc

SEQ ID NO: 1475843 - RNA, 18 nt, Pseudomonas aeruginosa PA01
gccagccuggccagcgcu

SEQ ID NO: 1475844 - RNA, 20 nt, Pseudomonas aeruginosa PA01
gccagccccaggccgcccuu

SEQ ID NO: 1475845 - RNA, 16 nt, Pseudomonas aeruginosa PA01
gccagccccaggcgcg

SEQ ID NO: 1475846 - RNA, 18 nt, Pseudomonas aeruginosa PA01
gccagccccaggcgcggc

SEQ ID NO: 1475847 - RNA, 17 nt, Pseudomonas aeruginosa PA01
gccagcccagcggcgcg

SEQ ID NO: 1475848 - RNA, 19 nt, Pseudomonas aeruginosa PA01
gccagcccagcggcgcggc

SEQ ID NO: 1475849 - RNA, 21 nt, Pseudomonas aeruginosa PA01
gccagcccagcggcgcggcgu

SEQ ID NO: 1475850 - RNA, 11 nt, Pseudomonas aeruginosa PA01
gccagcccagu

SEQ ID NO: 1475851 - RNA, 12 nt, Pseudomonas aeruginosa PA01
gccagcccagaa

SEQ ID NO: 1475852 - RNA, 13 nt, Pseudomonas aeruginosa PA01
gccagccgcgagu

SEQ ID NO: 1475853 - RNA, 13 nt, Pseudomonas aeruginosa PA01
gccagccgcgcca

SEQ ID NO: 1475854 - RNA, 12 nt, Pseudomonas aeruginosa PA01
gccagccgcgcg

SEQ ID NO: 1475855 - RNA, 20 nt, Pseudomonas aeruginosa PA01
gccagccgcgcgccgcaucg

SEQ ID NO: 1475856 - RNA, 15 nt, Pseudomonas aeruginosa PA01
gccagccgcggauca

SEQ ID NO: 1475857 - RNA, 16 nt, Pseudomonas aeruginosa PA01
gccagccgcggaucac

SEQ ID NO: 1475858 - RNA, 18 nt, Pseudomonas aeruginosa PA01
gccagccgcggaucaccu

SEQ ID NO: 1475859 - RNA, 23 nt, Pseudomonas aeruginosa PA01
gccagccgcggaucaccuggccg

SEQ ID NO: 1475860 - RNA, 14 nt, Pseudomonas aeruginosa PA01
gccagccgccagga

SEQ ID NO: 1475861 - RNA, 16 nt, Pseudomonas aeruginosa PA01
gccagccgccaggacg

SEQ ID NO: 1475862 - RNA, 13 nt, Pseudomonas aeruginosa PA01
gccagccgccauc

SEQ ID NO: 1475863 - RNA, 18 nt, Pseudomonas aeruginosa PA01
gccagccgccaucaccag

SEQ ID NO: 1475864 - RNA, 14 nt, Pseudomonas aeruginosa PA01
gccagccgcccugg

SEQ ID NO: 1475865 - RNA, 19 nt, Pseudomonas aeruginosa PA01
gccagccgcccuggcucug

SEQ ID NO: 1475866 - RNA, 12 nt, Pseudomonas aeruginosa PA01
gccagccgccga

SEQ ID NO: 1475867 - RNA, 17 nt, Pseudomonas aeruginosa PA01
gccagccgccgaagggc

SEQ ID NO: 1475868 - RNA, 21 nt, Pseudomonas aeruginosa PA01
gccagccgccgaagggccgca

SEQ ID NO: 1475869 - RNA, 20 nt, Pseudomonas aeruginosa PA01
gccagcccccucgcccucga

SEQ ID NO: 1475870 - RNA, 11 nt, Pseudomonas aeruginosa PA01
gccagccgcca

SEQ ID NO: 1475871 - RNA, 16 nt, Pseudomonas aeruginosa PA01
gccagccagccgcgcg

SEQ ID NO: 1475872 - RNA, 16 nt, Pseudomonas aeruginosa PA01
gccagccacucccggc

SEQ ID NO: 1475873 - RNA, 14 nt, Pseudomonas aeruginosa PA01
gccagccagcgcgg

SEQ ID NO: 1475874 - RNA, 13 nt, Pseudomonas aeruginosa PA01
gccagccagggca

SEQ ID NO: 1475875 - RNA, 21 nt, Pseudomonas aeruginosa PA01
gccagccagggcagcaggucg

SEQ ID NO: 1475876 - RNA, 23 nt, Pseudomonas aeruginosa PA01
gccagccaacugcuucaggcgcg

SEQ ID NO: 1475877 - RNA, 20 nt, Pseudomonas aeruginosa PA01
gccagcaguggcuccgcgcg

SEQ ID NO: 1475878 - RNA, 21 nt, Pseudomonas aeruginosa PA01
gccagcaguggcuccgcgcgu

SEQ ID NO: 1475879 - RNA, 23 nt, Pseudomonas aeruginosa PA01
gccagcagucguugacggugcug

SEQ ID NO: 1475880 - RNA, 16 nt, Pseudomonas aeruginosa PA01
gccagcagguggucga

SEQ ID NO: 1475881 - RNA, 21 nt, Pseudomonas aeruginosa PA01
gccagcagguggucgaugggc

SEQ ID NO: 1475882 - RNA, 21 nt, Pseudomonas aeruginosa PA01
gccagcaggucgcgcugggcg

SEQ ID NO: 1475883 - RNA, 18 nt, Pseudomonas aeruginosa PA01
gccagcaggucggccugc

SEQ ID NO: 1475884 - RNA, 21 nt, Pseudomonas aeruginosa PA01
gccagcagguagacgcaggug

SEQ ID NO: 1475885 - RNA, 19 nt, Pseudomonas aeruginosa PA01
gccagcaucgcaucggcga

SEQ ID NO: 1475886 - RNA, 20 nt, Pseudomonas aeruginosa PA01
gccagcaucgcaucggcgac

SEQ ID NO: 1475887 - RNA, 21 nt, Pseudomonas aeruginosa PA01
gccagcaucgcaucggcgacc

SEQ ID NO: 1475888 - RNA, 13 nt, Pseudomonas aeruginosa PA01
gccagcaccagca

SEQ ID NO: 1475889 - RNA, 13 nt, Pseudomonas aeruginosa PA01
gccagcaccaccc

SEQ ID NO: 1475890 - RNA, 17 nt, Pseudomonas aeruginosa PA01
gccagcaccacccggcc

SEQ ID NO: 1475891 - RNA, 22 nt, Pseudomonas aeruginosa PA01
gccagcaggcucaugcccagcu

SEQ ID NO: 1475892 - RNA, 15 nt, Pseudomonas aeruginosa PA01
gccagcaggcuggcg

SEQ ID NO: 1475893 - RNA, 16 nt, Pseudomonas aeruginosa PA01
gccagcaggcuggcgg

SEQ ID NO: 1475894 - RNA, 17 nt, Pseudomonas aeruginosa PA01
gccagcaggcuggcggc

SEQ ID NO: 1475895 - RNA, 18 nt, Pseudomonas aeruginosa PA01
gccagcaggcuggcggca

SEQ ID NO: 1475896 - RNA, 13 nt, Pseudomonas aeruginosa PA01
gccagcaggcugu

SEQ ID NO: 1475897 - RNA, 19 nt, Pseudomonas aeruginosa PA01
gccagcagguacagcagcu

SEQ ID NO: 1475898 - RNA, 17 nt, Pseudomonas aeruginosa PA01
gccagcagggccgccga

SEQ ID NO: 1475899 - RNA, 19 nt, Pseudomonas aeruginosa PA01
gccagcagggccgccgagg

SEQ ID NO: 1475900 - RNA, 13 nt, Pseudomonas aeruginosa PA01
gccagcaggcgcg

SEQ ID NO: 1475901 - RNA, 17 nt, Pseudomonas aeruginosa PA01
gccagcaggcgcgggcu

SEQ ID NO: 1475902 - RNA, 22 nt, Pseudomonas aeruginosa PA01
gccagcaggcgcgggcuggcca

SEQ ID NO: 1475903 - RNA, 14 nt, Pseudomonas aeruginosa PA01
gccagcaggcgcuc

SEQ ID NO: 1475904 - RNA, 19 nt, Pseudomonas aeruginosa PA01
gccagcaggcgcucggcga

SEQ ID NO: 1475905 - RNA, 21 nt, Pseudomonas aeruginosa PA01
gccagcaggcgcucggcgacg

SEQ ID NO: 1475906 - RNA, 17 nt, Pseudomonas aeruginosa PA01
gccagcaauacccgccg

SEQ ID NO: 1475907 - RNA, 18 nt, Pseudomonas aeruginosa PA01
gccagcaauacccgccgc

SEQ ID NO: 1475908 - RNA, 20 nt, Pseudomonas aeruginosa PA01
gccagcaauacccgccgcug

SEQ ID NO: 1475909 - RNA, 19 nt, Pseudomonas aeruginosa PA01
gccagcaaugcccgcgccu

SEQ ID NO: 1475910 - RNA, 18 nt, Pseudomonas aeruginosa PA01
gccagaugcgcgucgccg

SEQ ID NO: 1475911 - RNA, 14 nt, Pseudomonas aeruginosa PA01
gccagaccggcagc

SEQ ID NO: 1475912 - RNA, 16 nt, Pseudomonas aeruginosa PA01
gccagaccggcagcgc

SEQ ID NO: 1475913 - RNA, 19 nt, Pseudomonas aeruginosa PA01
gccagaccggcagcgccgc

SEQ ID NO: 1475914 - RNA, 15 nt, Pseudomonas aeruginosa PA01
gccagaccguggcgc

SEQ ID NO: 1475915 - RNA, 17 nt, Pseudomonas aeruginosa PA01
gccagacguccggcagg

SEQ ID NO: 1475916 - RNA, 19 nt, Pseudomonas aeruginosa PA01
gccacuugcgggugcgcag

SEQ ID NO: 1475917 - RNA, 21 nt, Pseudomonas aeruginosa PA01
gccacuugcgggugcgcaggc

SEQ ID NO: 1475918 - RNA, 19 nt, Pseudomonas aeruginosa PA01
gccagaaagccucaggcgc

SEQ ID NO: 1475919 - RNA, 20 nt, Pseudomonas aeruginosa PA01
gccagaaagccucaggcgcu

SEQ ID NO: 1475920 - RNA, 22 nt, Pseudomonas aeruginosa PA01
gccagaaagccucaggcgcugc

SEQ ID NO: 1475921 - RNA, 21 nt, Pseudomonas aeruginosa PA01
gccagacaggccagcucgccc

SEQ ID NO: 1475922 - RNA, 15 nt, Pseudomonas aeruginosa PA01
gccagaaggccugcg

SEQ ID NO: 1475923 - RNA, 16 nt, Pseudomonas aeruginosa PA01
gccagaaggccugcgc

SEQ ID NO: 1475924 - RNA, 17 nt, Pseudomonas aeruginosa PA01
gccagaaggccugcgcu

SEQ ID NO: 1475925 - RNA, 14 nt, Pseudomonas aeruginosa PA01
gccagaagcgcucg

SEQ ID NO: 1475926 - RNA, 15 nt, Pseudomonas aeruginosa PA01
gccagaagcgcucgu

SEQ ID NO: 1475927 - RNA, 13 nt, Pseudomonas aeruginosa PA01
gccagaagcggcc

SEQ ID NO: 1475928 - RNA, 17 nt, Pseudomonas aeruginosa PA01
gccagaagcggccgacc

SEQ ID NO: 1475929 - RNA, 20 nt, Pseudomonas aeruginosa PA01
gccagaagcggccgaccagg

SEQ ID NO: 1475930 - RNA, 16 nt, Pseudomonas aeruginosa PA01
gccacuccagccccgc

SEQ ID NO: 1475931 - RNA, 17 nt, Pseudomonas aeruginosa PA01
gccacuccagccccgcg

SEQ ID NO: 1475932 - RNA, 17 nt, Pseudomonas aeruginosa PA01
gccacuauuccuugcgc

SEQ ID NO: 1475933 - RNA, 19 nt, Pseudomonas aeruginosa PA01
gccacuauuccuugcgcca

SEQ ID NO: 1475934 - RNA, 20 nt, Pseudomonas aeruginosa PA01
gccacuauuccuugcgccau

SEQ ID NO: 1475935 - RNA, 22 nt, Pseudomonas aeruginosa PA01
gccacuauuccuugcgccaugc

SEQ ID NO: 1475936 - RNA, 23 nt, Pseudomonas aeruginosa PA01
gccacuauuccuugcgccaugcg

SEQ ID NO: 1475937 - RNA, 19 nt, Pseudomonas aeruginosa PA01
gccacuaucgccaacgcca

SEQ ID NO: 1475938 - RNA, 16 nt, Pseudomonas aeruginosa PA01
gccacguucugcagga

SEQ ID NO: 1475939 - RNA, 19 nt, Pseudomonas aeruginosa PA01
gccacgugcacgccgugca

SEQ ID NO: 1475940 - RNA, 20 nt, Pseudomonas aeruginosa PA01
gccacgugcacgccgugcau

SEQ ID NO: 1475941 - RNA, 20 nt, Pseudomonas aeruginosa PA01
gccacgugcggggugcgcug

SEQ ID NO: 1475942 - RNA, 14 nt, Pseudomonas aeruginosa PA01
gccacggccagcag

SEQ ID NO: 1475943 - RNA, 16 nt, Pseudomonas aeruginosa PA01
gccacggccagcagga

SEQ ID NO: 1475944 - RNA, 14 nt, Pseudomonas aeruginosa PA01
gccacggccgcugc

SEQ ID NO: 1475945 - RNA, 17 nt, Pseudomonas aeruginosa PA01
gccacggccgcugcgca

SEQ ID NO: 1475946 - RNA, 18 nt, Pseudomonas aeruginosa PA01
gccacggccgcugcgcag

SEQ ID NO: 1475947 - RNA, 14 nt, Pseudomonas aeruginosa PA01
gccacgccggcgcu

SEQ ID NO: 1475948 - RNA, 15 nt, Pseudomonas aeruginosa PA01
gccacgccggcgcuc

SEQ ID NO: 1475949 - RNA, 20 nt, Pseudomonas aeruginosa PA01
gccacgccuucgggcgaugc

SEQ ID NO: 1475950 - RNA, 14 nt, Pseudomonas aeruginosa PA01
gccacgcgaccagc

SEQ ID NO: 1475951 - RNA, 17 nt, Pseudomonas aeruginosa PA01
gccacgcgaccagcgcc

SEQ ID NO: 1475952 - RNA, 18 nt, Pseudomonas aeruginosa PA01
gccacgcgaccagcgcca

SEQ ID NO: 1475953 - RNA, 20 nt, Pseudomonas aeruginosa PA01
gccacgcgaccagcgccagg

SEQ ID NO: 1475954 - RNA, 15 nt, Pseudomonas aeruginosa PA01
gccacgcgagaagcc

SEQ ID NO: 1475955 - RNA, 19 nt, Pseudomonas aeruginosa PA01
gccacgcgagaagccgccc

SEQ ID NO: 1475956 - RNA, 20 nt, Pseudomonas aeruginosa PA01
gccacgcgagaagccgccca

SEQ ID NO: 1475957 - RNA, 19 nt, Pseudomonas aeruginosa PA01
gccacggcgagagcgccga

SEQ ID NO: 1475958 - RNA, 15 nt, Pseudomonas aeruginosa PA01
gccacggccggcgag

SEQ ID NO: 1475959 - RNA, 17 nt, Pseudomonas aeruginosa PA01
gccacggccggcgaggc

SEQ ID NO: 1475960 - RNA, 17 nt, Pseudomonas aeruginosa PA01
gccacguccagcggcau

SEQ ID NO: 1475961 - RNA, 21 nt, Pseudomonas aeruginosa PA01
gccacguccuugguguagccg

SEQ ID NO: 1475962 - RNA, 20 nt, Pseudomonas aeruginosa PA01
gccacgaucauggugaagcc

SEQ ID NO: 1475963 - RNA, 15 nt, Pseudomonas aeruginosa PA01
gccacgcaccaccag

SEQ ID NO: 1475964 - RNA, 16 nt, Pseudomonas aeruginosa PA01
gccacgcaccaccagg

SEQ ID NO: 1475965 - RNA, 14 nt, Pseudomonas aeruginosa PA01
gccacgcaccagcu

SEQ ID NO: 1475966 - RNA, 24 nt, Pseudomonas aeruginosa PA01
gccacgcaccagcucccggcucaa

SEQ ID NO: 1475967 - RNA, 18 nt, Pseudomonas aeruginosa PA01
gccacgcaguucgcgggc

SEQ ID NO: 1475968 - RNA, 17 nt, Pseudomonas aeruginosa PA01
gccacgcaauccucggu

SEQ ID NO: 1475969 - RNA, 19 nt, Pseudomonas aeruginosa PA01
gccacgcaauccucggugc

SEQ ID NO: 1475970 - RNA, 23 nt, Pseudomonas aeruginosa PA01
gccacgacccugcuggccggugc

SEQ ID NO: 1475971 - RNA, 24 nt, Pseudomonas aeruginosa PA01
gccacgacccugcuggccggugcc

SEQ ID NO: 1475972 - RNA, 19 nt, Pseudomonas aeruginosa PA01
gccaacggcguuauccgcc

SEQ ID NO: 1475973 - RNA, 17 nt, Pseudomonas aeruginosa PA01
gccaacguccucgaugc

SEQ ID NO: 1475974 - RNA, 22 nt, Pseudomonas aeruginosa PA01
gccaacguccucgaugcccgcc

SEQ ID NO: 1475975 - RNA, 16 nt, Pseudomonas aeruginosa PA01
gccaacgcgccgucgc

SEQ ID NO: 1475976 - RNA, 14 nt, Pseudomonas aeruginosa PA01
gcccgaauguucca

SEQ ID NO: 1475977 - RNA, 15 nt, Pseudomonas aeruginosa PA01
gcccgaacgccgacc

SEQ ID NO: 1475978 - RNA, 17 nt, Pseudomonas aeruginosa PA01
gcccgaacgccgaccga

SEQ ID NO: 1475979 - RNA, 20 nt, Pseudomonas aeruginosa PA01
gcccgaccccacgccggccg

SEQ ID NO: 1475980 - RNA, 13 nt, Pseudomonas aeruginosa PA01
gcccgagccgcug

SEQ ID NO: 1475981 - RNA, 15 nt, Pseudomonas aeruginosa PA01
gcccgagccggacga

SEQ ID NO: 1475982 - RNA, 14 nt, Pseudomonas aeruginosa PA01
gcccgagcuuugcg

SEQ ID NO: 1475983 - RNA, 18 nt, Pseudomonas aeruginosa PA01
gcccgaggugucgccgcg

SEQ ID NO: 1475984 - RNA, 21 nt, Pseudomonas aeruginosa PA01
gcccgaggcguuauccgccga

SEQ ID NO: 1475985 - RNA, 14 nt, Pseudomonas aeruginosa PA01
gcccgagggcggca

SEQ ID NO: 1475986 - RNA, 17 nt, Pseudomonas aeruginosa PA01
gcccgagggcggcaggg

SEQ ID NO: 1475987 - RNA, 14 nt, Pseudomonas aeruginosa PA01
gcccgagcgacugg

SEQ ID NO: 1475988 - RNA, 22 nt, Pseudomonas aeruginosa PA01
gcccgaggcgaccuuggccagc

SEQ ID NO: 1475989 - RNA, 21 nt, Pseudomonas aeruginosa PA01
gcccgagucccuugcggcaga

SEQ ID NO: 1475990 - RNA, 20 nt, Pseudomonas aeruginosa PA01
gcccgaucgccucgucgagc

SEQ ID NO: 1475991 - RNA, 15 nt, Pseudomonas aeruginosa PA01
gcccgaugccgcgcc

SEQ ID NO: 1475992 - RNA, 20 nt, Pseudomonas aeruginosa PA01
gcccgcagaucuuccccguu

SEQ ID NO: 1475993 - RNA, 17 nt, Pseudomonas aeruginosa PA01
gcccgccaagggcgccg

SEQ ID NO: 1475994 - RNA, 20 nt, Pseudomonas aeruginosa PA01
gcccgccaagggcgccgccg

SEQ ID NO: 1475995 - RNA, 21 nt, Pseudomonas aeruginosa PA01
gcccgccaagggcgccgccga

SEQ ID NO: 1475996 - RNA, 22 nt, Pseudomonas aeruginosa PA01
gcccgccaccgacccucggcga

SEQ ID NO: 1475997 - RNA, 16 nt, Pseudomonas aeruginosa PA01
gcccgccacggcgcgc

SEQ ID NO: 1475998 - RNA, 22 nt, Pseudomonas aeruginosa PA01
gcccgccacggcgcgcuccggc

SEQ ID NO: 1475999 - RNA, 17 nt, Pseudomonas aeruginosa PA01
gcccgccacgcuugucg

SEQ ID NO: 1476000 - RNA, 15 nt, Pseudomonas aeruginosa PA01
gcccgccaccuggcg

SEQ ID NO: 1476001 - RNA, 18 nt, Pseudomonas aeruginosa PA01
gcccgccaccuggcgggc

SEQ ID NO: 1476002 - RNA, 18 nt, Pseudomonas aeruginosa PA01
gcccgccacagaucgcca

SEQ ID NO: 1476003 - RNA, 19 nt, Pseudomonas aeruginosa PA01
gcccgccacagaucgccag

SEQ ID NO: 1476004 - RNA, 15 nt, Pseudomonas aeruginosa PA01
gcccgccccgcacca

SEQ ID NO: 1476005 - RNA, 19 nt, Pseudomonas aeruginosa PA01
gcccgccccgcaccagcca

SEQ ID NO: 1476006 - RNA, 12 nt, Pseudomonas aeruginosa PA01
gcccgccagcag

SEQ ID NO: 1476007 - RNA, 12 nt, Pseudomonas aeruginosa PA01
gcccgaugccgc

SEQ ID NO: 1476008 - RNA, 14 nt, Pseudomonas aeruginosa PA01
gcccgcaccacccg

SEQ ID NO: 1476009 - RNA, 16 nt, Pseudomonas aeruginosa PA01
gcccgcagccacaggc

SEQ ID NO: 1476010 - RNA, 16 nt, Pseudomonas aeruginosa PA01
gcccgcagccagccuc

SEQ ID NO: 1476011 - RNA, 22 nt, Pseudomonas aeruginosa PA01
gcccgcagccagccucagguac

SEQ ID NO: 1476012 - RNA, 14 nt, Pseudomonas aeruginosa PA01
gccccgccggcgcu

SEQ ID NO: 1476013 - RNA, 22 nt, Pseudomonas aeruginosa PA01
gccccgccgggagcggccgugc

SEQ ID NO: 1476014 - RNA, 17 nt, Pseudomonas aeruginosa PA01
gccccgccuaccggggc

SEQ ID NO: 1476015 - RNA, 23 nt, Pseudomonas aeruginosa PA01
gccccgccuaccggggcgcgggc

SEQ ID NO: 1476016 - RNA, 14 nt, Pseudomonas aeruginosa PA01
gccccgcgauugca

SEQ ID NO: 1476017 - RNA, 13 nt, Pseudomonas aeruginosa PA01
gccccgcgaacgc

SEQ ID NO: 1476018 - RNA, 13 nt, Pseudomonas aeruginosa PA01
gcccccuggccgu

SEQ ID NO: 1476019 - RNA, 15 nt, Pseudomonas aeruginosa PA01
gcccccuggccguug

SEQ ID NO: 1476020 - RNA, 13 nt, Pseudomonas aeruginosa PA01
gccccgccgccag

SEQ ID NO: 1476021 - RNA, 14 nt, Pseudomonas aeruginosa PA01
gccccgccgccagg

SEQ ID NO: 1476022 - RNA, 18 nt, Pseudomonas aeruginosa PA01
gccccgaaaaaaaaggcc

SEQ ID NO: 1476023 - RNA, 15 nt, Pseudomonas aeruginosa PA01
gccccgcgguacccg

SEQ ID NO: 1476024 - RNA, 21 nt, Pseudomonas aeruginosa PA01
gccccgcgguacccggcaggg

SEQ ID NO: 1476025 - RNA, 16 nt, Pseudomonas aeruginosa PA01
gccccgcguucgcggg

SEQ ID NO: 1476026 - RNA, 16 nt, Pseudomonas aeruginosa PA01
gccccgcuacccugcc

SEQ ID NO: 1476027 - RNA, 19 nt, Pseudomonas aeruginosa PA01
gccccggcaagcgccggca

SEQ ID NO: 1476028 - RNA, 23 nt, Pseudomonas aeruginosa PA01
gccccggcaagggccugcucagc

SEQ ID NO: 1476029 - RNA, 14 nt, Pseudomonas aeruginosa PA01
gccccggccgcgcc

SEQ ID NO: 1476030 - RNA, 17 nt, Pseudomonas aeruginosa PA01
gccccggccgcgccagc

SEQ ID NO: 1476031 - RNA, 18 nt, Pseudomonas aeruginosa PA01
gccccggcgagcgagcgg

SEQ ID NO: 1476032 - RNA, 15 nt, Pseudomonas aeruginosa PA01
gccccggcccggcgu

SEQ ID NO: 1476033 - RNA, 19 nt, Pseudomonas aeruginosa PA01
gccccggcaucgccggggc

SEQ ID NO: 1476034 - RNA, 15 nt, Pseudomonas aeruginosa PA01
gccccggccagguac

SEQ ID NO: 1476035 - RNA, 22 nt, Pseudomonas aeruginosa PA01
gccccggccagguaccggccag

SEQ ID NO: 1476036 - RNA, 14 nt, Pseudomonas aeruginosa PA01
gccccggcagccac

SEQ ID NO: 1476037 - RNA, 17 nt, Pseudomonas aeruginosa PA01
gccccggcagccaccag

SEQ ID NO: 1476038 - RNA, 16 nt, Pseudomonas aeruginosa PA01
gccccgcuugccgucg

SEQ ID NO: 1476039 - RNA, 23 nt, Pseudomonas aeruginosa PA01
gccccgcuugccgucgaccugcg

SEQ ID NO: 1476040 - RNA, 16 nt, Pseudomonas aeruginosa PA01
gccccgcuauggcggg

SEQ ID NO: 1476041 - RNA, 16 nt, Pseudomonas aeruginosa PA01
gccccgcuucggcggg

SEQ ID NO: 1476042 - RNA, 19 nt, Pseudomonas aeruginosa PA01
gccccgggucgcugcucag

SEQ ID NO: 1476043 - RNA, 19 nt, Pseudomonas aeruginosa PA01
gccccgggucggcacggcc

SEQ ID NO: 1476044 - RNA, 20 nt, Pseudomonas aeruginosa PA01
gccccguuggcgcgggcgaa

SEQ ID NO: 1476045 - RNA, 14 nt, Pseudomonas aeruginosa PA01
gccccggcuuggcg

SEQ ID NO: 1476046 - RNA, 20 nt, Pseudomonas aeruginosa PA01
gccccguuugccgucggcgc

SEQ ID NO: 1476047 - RNA, 21 nt, Pseudomonas aeruginosa PA01
gccccguuugccgucggcgcg

SEQ ID NO: 1476048 - RNA, 21 nt, Pseudomonas aeruginosa PA01
gccccguuuuuccuuguggcg

SEQ ID NO: 1476049 - RNA, 15 nt, Pseudomonas aeruginosa PA01
gccccggcgucggcg

SEQ ID NO: 1476050 - RNA, 20 nt, Pseudomonas aeruginosa PA01
gccccggcgucggcgcgggc

SEQ ID NO: 1476051 - RNA, 15 nt, Pseudomonas aeruginosa PA01
gccccggcggcgauc

SEQ ID NO: 1476052 - RNA, 16 nt, Pseudomonas aeruginosa PA01
gccccggcggcgaucu

SEQ ID NO: 1476053 - RNA, 17 nt, Pseudomonas aeruginosa PA01
gccccuagaccaacugc

SEQ ID NO: 1476054 - RNA, 20 nt, Pseudomonas aeruginosa PA01
gccccuccuucgagccuggc

SEQ ID NO: 1476055 - RNA, 21 nt, Pseudomonas aeruginosa PA01
gccccuccuucgagccuggcc

SEQ ID NO: 1476056 - RNA, 13 nt, Pseudomonas aeruginosa PA01
gccccucgccgug

SEQ ID NO: 1476057 - RNA, 13 nt, Pseudomonas aeruginosa PA01
gccccucggccag

SEQ ID NO: 1476058 - RNA, 17 nt, Pseudomonas aeruginosa PA01
gccccucggccaggacc

SEQ ID NO: 1476059 - RNA, 15 nt, Pseudomonas aeruginosa PA01
gccccucccagccac

SEQ ID NO: 1476060 - RNA, 21 nt, Pseudomonas aeruginosa PA01
gccccucacuccgucuccagc

SEQ ID NO: 1476061 - RNA, 17 nt, Pseudomonas aeruginosa PA01
gccccucacaccaccag

SEQ ID NO: 1476062 - RNA, 19 nt, Pseudomonas aeruginosa PA01
gccccucacaccaccagca

SEQ ID NO: 1476063 - RNA, 16 nt, Pseudomonas aeruginosa PA01
gccccuuggccagcac

SEQ ID NO: 1476064 - RNA, 18 nt, Pseudomonas aeruginosa PA01
gccccaaggggccgcgcu

SEQ ID NO: 1476065 - RNA, 19 nt, Pseudomonas aeruginosa PA01
gccccaccaccaucgccgc

SEQ ID NO: 1476066 - RNA, 22 nt, Pseudomonas aeruginosa PA01
gccccaccaccaucgccgcgga

SEQ ID NO: 1476067 - RNA, 19 nt, Pseudomonas aeruginosa PA01
gcccauguagaccaccagc

SEQ ID NO: 1476068 - RNA, 23 nt, Pseudomonas aeruginosa PA01
gcccauugcccggccaggcgcgg

SEQ ID NO: 1476069 - RNA, 15 nt, Pseudomonas aeruginosa PA01
gcccauugccgggcu

SEQ ID NO: 1476070 - RNA, 13 nt, Pseudomonas aeruginosa PA01
gcccauggcgacg

SEQ ID NO: 1476071 - RNA, 14 nt, Pseudomonas aeruginosa PA01
gcccauggucagcg

SEQ ID NO: 1476072 - RNA, 20 nt, Pseudomonas aeruginosa PA01
gcccaugugcuugaccgccg

SEQ ID NO: 1476073 - RNA, 23 nt, Pseudomonas aeruginosa PA01
gcccaugugcuugaccgccgccu

SEQ ID NO: 1476074 - RNA, 16 nt, Pseudomonas aeruginosa PA01
gcccaguucgccggcc

SEQ ID NO: 1476075 - RNA, 23 nt, Pseudomonas aeruginosa PA01
gcccaguucgccggccagcaccu

SEQ ID NO: 1476076 - RNA, 16 nt, Pseudomonas aeruginosa PA01
gcccaguucgcgcagg

SEQ ID NO: 1476077 - RNA, 15 nt, Pseudomonas aeruginosa PA01
gcccaguucgcgcgg

SEQ ID NO: 1476078 - RNA, 18 nt, Pseudomonas aeruginosa PA01
gcccaguccugggugucg

SEQ ID NO: 1476079 - RNA, 19 nt, Pseudomonas aeruginosa PA01
gcccagugguuccaggagg

SEQ ID NO: 1476080 - RNA, 17 nt, Pseudomonas aeruginosa PA01
gcccagugcccggcaga

SEQ ID NO: 1476081 - RNA, 15 nt, Pseudomonas aeruginosa PA01
gcccccggcccgggc

SEQ ID NO: 1476082 - RNA, 13 nt, Pseudomonas aeruginosa PA01
gcccccggcgccc

SEQ ID NO: 1476083 - RNA, 21 nt, Pseudomonas aeruginosa PA01
gcccccaugaaaaaggcgccc

SEQ ID NO: 1476084 - RNA, 17 nt, Pseudomonas aeruginosa PA01
gcccccauaccgccucg

SEQ ID NO: 1476085 - RNA, 23 nt, Pseudomonas aeruginosa PA01
gcccccaacggaaaaaggcgccu

SEQ ID NO: 1476086 - RNA, 14 nt, Pseudomonas aeruginosa PA01
gcccccacgacgca

SEQ ID NO: 1476087 - RNA, 12 nt, Pseudomonas aeruginosa PA01
gccccaggccgc

SEQ ID NO: 1476088 - RNA, 14 nt, Pseudomonas aeruginosa PA01
gccccaggccgccg

SEQ ID NO: 1476089 - RNA, 18 nt, Pseudomonas aeruginosa PA01
gccccauccgacgccggc

SEQ ID NO: 1476090 - RNA, 18 nt, Pseudomonas aeruginosa PA01
gccccagccucggcaggg

SEQ ID NO: 1476091 - RNA, 18 nt, Pseudomonas aeruginosa PA01
gccccagcgcaucgcgca

SEQ ID NO: 1476092 - RNA, 13 nt, Pseudomonas aeruginosa PA01
gccccagcggucg

SEQ ID NO: 1476093 - RNA, 14 nt, Pseudomonas aeruginosa PA01
gccccaggcacggc

SEQ ID NO: 1476094 - RNA, 19 nt, Pseudomonas aeruginosa PA01
gccccaggaaggagcgaaa

SEQ ID NO: 1476095 - RNA, 20 nt, Pseudomonas aeruginosa PA01
gccccaccgcacugguggcg

SEQ ID NO: 1476096 - RNA, 13 nt, Pseudomonas aeruginosa PA01
gccccaccgccag

SEQ ID NO: 1476097 - RNA, 17 nt, Pseudomonas aeruginosa PA01
gccccagcccagggcga

SEQ ID NO: 1476098 - RNA, 19 nt, Pseudomonas aeruginosa PA01
gccccagcccagggcgauc

SEQ ID NO: 1476099 - RNA, 15 nt, Pseudomonas aeruginosa PA01
gcccaggcgucgcgc

SEQ ID NO: 1476100 - RNA, 17 nt, Pseudomonas aeruginosa PA01
gcccaggcgucgcgcca

SEQ ID NO: 1476101 - RNA, 16 nt, Pseudomonas aeruginosa PA01
gcccagggcguggucg

SEQ ID NO: 1476102 - RNA, 21 nt, Pseudomonas aeruginosa PA01
gcccagggcguggucggcggc

SEQ ID NO: 1476103 - RNA, 17 nt, Pseudomonas aeruginosa PA01
gcccagggcuucgcggu

SEQ ID NO: 1476104 - RNA, 17 nt, Pseudomonas aeruginosa PA01
gcccagggugacgcucu

SEQ ID NO: 1476105 - RNA, 15 nt, Pseudomonas aeruginosa PA01
gcccagggggccggg

SEQ ID NO: 1476106 - RNA, 16 nt, Pseudomonas aeruginosa PA01
gcccagggggccgggc

SEQ ID NO: 1476107 - RNA, 20 nt, Pseudomonas aeruginosa PA01
gcccagggggccgggccgau

SEQ ID NO: 1476108 - RNA, 19 nt, Pseudomonas aeruginosa PA01
gcccaggcgguuguucagc

SEQ ID NO: 1476109 - RNA, 11 nt, Pseudomonas aeruginosa PA01
gcccagggcgg

SEQ ID NO: 1476110 - RNA, 12 nt, Pseudomonas aeruginosa PA01
gcccagggccag

SEQ ID NO: 1476111 - RNA, 13 nt, Pseudomonas aeruginosa PA01
gcccagggccagc

SEQ ID NO: 1476112 - RNA, 19 nt, Pseudomonas aeruginosa PA01
gcccagggccagcggguug

SEQ ID NO: 1476113 - RNA, 17 nt, Pseudomonas aeruginosa PA01
gcccagggcccagagca

SEQ ID NO: 1476114 - RNA, 18 nt, Pseudomonas aeruginosa PA01
gcccaggcugaggucgcg

SEQ ID NO: 1476115 - RNA, 20 nt, Pseudomonas aeruginosa PA01
gcccaggcugaggucgcggg

SEQ ID NO: 1476116 - RNA, 11 nt, Pseudomonas aeruginosa PA01
gcccaggcugc

SEQ ID NO: 1476117 - RNA, 15 nt, Pseudomonas aeruginosa PA01
gcccaggcugccggc

SEQ ID NO: 1476118 - RNA, 17 nt, Pseudomonas aeruginosa PA01
gcccaggcugccggcca

SEQ ID NO: 1476119 - RNA, 20 nt, Pseudomonas aeruginosa PA01
gcccaggcugccggccaggu

SEQ ID NO: 1476120 - RNA, 15 nt, Pseudomonas aeruginosa PA01
gcccaggcuggcggc

SEQ ID NO: 1476121 - RNA, 14 nt, Pseudomonas aeruginosa PA01
gcccaggcgcucgg

SEQ ID NO: 1476122 - RNA, 24 nt, Pseudomonas aeruginosa PA01
gcccaggcgcucggcgaccuugcg

SEQ ID NO: 1476123 - RNA, 18 nt, Pseudomonas aeruginosa PA01
gcccaggcgcucggcggc

SEQ ID NO: 1476124 - RNA, 22 nt, Pseudomonas aeruginosa PA01
gcccaggcgcucggcggcgcgc

SEQ ID NO: 1476125 - RNA, 16 nt, Pseudomonas aeruginosa PA01
gcccaggcgcuggcgc

SEQ ID NO: 1476126 - RNA, 17 nt, Pseudomonas aeruginosa PA01
gcccaggcgcuggcgcc

SEQ ID NO: 1476127 - RNA, 18 nt, Pseudomonas aeruginosa PA01
gcccaggcgcuggcgccg

SEQ ID NO: 1476128 - RNA, 20 nt, Pseudomonas aeruginosa PA01
gcccaggcgcuggcgccgau

SEQ ID NO: 1476129 - RNA, 15 nt, Pseudomonas aeruginosa PA01
gcccagcggaugcgc

SEQ ID NO: 1476130 - RNA, 14 nt, Pseudomonas aeruginosa PA01
gcccagcggcaggg

SEQ ID NO: 1476131 - RNA, 20 nt, Pseudomonas aeruginosa PA01
gcccagcggcagggcggcga

SEQ ID NO: 1476132 - RNA, 21 nt, Pseudomonas aeruginosa PA01
gcccagcggcagggcggcgau

SEQ ID NO: 1476133 - RNA, 16 nt, Pseudomonas aeruginosa PA01
gcccagcggcaggucg

SEQ ID NO: 1476134 - RNA, 16 nt, Pseudomonas aeruginosa PA01
gcccagcggcgccagc

SEQ ID NO: 1476135 - RNA, 17 nt, Pseudomonas aeruginosa PA01
gcccagcggcgccagcu

SEQ ID NO: 1476136 - RNA, 14 nt, Pseudomonas aeruginosa PA01
gcccagcggcgccu

SEQ ID NO: 1476137 - RNA, 16 nt, Pseudomonas aeruginosa PA01
gcccagcggcgccucg

SEQ ID NO: 1476138 - RNA, 13 nt, Pseudomonas aeruginosa PA01
gcccagcggcgcg

SEQ ID NO: 1476139 - RNA, 15 nt, Pseudomonas aeruginosa PA01
gcccagcggcgcggc

SEQ ID NO: 1476140 - RNA, 15 nt, Pseudomonas aeruginosa PA01
gcccagcuucuuggc

SEQ ID NO: 1476141 - RNA, 20 nt, Pseudomonas aeruginosa PA01
gcccaggcagaucgcgccga

SEQ ID NO: 1476142 - RNA, 21 nt, Pseudomonas aeruginosa PA01
gcccaggcagaucgcgccgag

SEQ ID NO: 1476143 - RNA, 22 nt, Pseudomonas aeruginosa PA01
gcccaggcagaucgcgccgagc

SEQ ID NO: 1476144 - RNA, 20 nt, Pseudomonas aeruginosa PA01
gcccaggcagcagagcgcca

SEQ ID NO: 1476145 - RNA, 14 nt, Pseudomonas aeruginosa PA01
gcccaggcaggcga

SEQ ID NO: 1476146 - RNA, 21 nt, Pseudomonas aeruginosa PA01
gcccaggacaacgacagcccc

SEQ ID NO: 1476147 - RNA, 17 nt, Pseudomonas aeruginosa PA01
gcccagcuugauguagg

SEQ ID NO: 1476148 - RNA, 15 nt, Pseudomonas aeruginosa PA01
gcccagcuuggccac

SEQ ID NO: 1476149 - RNA, 19 nt, Pseudomonas aeruginosa PA01
gcccagcuuggccacgucc

SEQ ID NO: 1476150 - RNA, 14 nt, Pseudomonas aeruginosa PA01
gcccagcgccugua

SEQ ID NO: 1476151 - RNA, 17 nt, Pseudomonas aeruginosa PA01
gcccagcgccgccugcu

SEQ ID NO: 1476152 - RNA, 22 nt, Pseudomonas aeruginosa PA01
gcccagcgccgccugcuggcug

SEQ ID NO: 1476153 - RNA, 14 nt, Pseudomonas aeruginosa PA01
gcccagcgccgcca

SEQ ID NO: 1476154 - RNA, 16 nt, Pseudomonas aeruginosa PA01
gcccagcgccgccagc

SEQ ID NO: 1476155 - RNA, 22 nt, Pseudomonas aeruginosa PA01
gcccagcgccgccagcaggucg

SEQ ID NO: 1476156 - RNA, 23 nt, Pseudomonas aeruginosa PA01
gcccagcgccgccagcaggucgg

SEQ ID NO: 1476157 - RNA, 16 nt, Pseudomonas aeruginosa PA01
gcccagcgcggcgccc

SEQ ID NO: 1476158 - RNA, 18 nt, Pseudomonas aeruginosa PA01
gcccagcgcggcgcccca

SEQ ID NO: 1476159 - RNA, 22 nt, Pseudomonas aeruginosa PA01
gcccagcgcggcgccccaggcg

SEQ ID NO: 1476160 - RNA, 14 nt, Pseudomonas aeruginosa PA01
gcccagcgccccgc

SEQ ID NO: 1476161 - RNA, 20 nt, Pseudomonas aeruginosa PA01
gcccagcgccccgccuaccg

SEQ ID NO: 1476162 - RNA, 11 nt, Pseudomonas aeruginosa PA01
gcccagcgccg

SEQ ID NO: 1476163 - RNA, 19 nt, Pseudomonas aeruginosa PA01
gcccagcgcagccugcugg

SEQ ID NO: 1476164 - RNA, 14 nt, Pseudomonas aeruginosa PA01
gcccagcgcaggcc

SEQ ID NO: 1476165 - RNA, 15 nt, Pseudomonas aeruginosa PA01
gcccagcgcaggccg

SEQ ID NO: 1476166 - RNA, 16 nt, Pseudomonas aeruginosa PA01
gcccagcgcaggccga

SEQ ID NO: 1476167 - RNA, 17 nt, Pseudomonas aeruginosa PA01
gcccagcgcaggccgau

SEQ ID NO: 1476168 - RNA, 15 nt, Pseudomonas aeruginosa PA01
gcccaauccgcgccg

SEQ ID NO: 1476169 - RNA, 13 nt, Pseudomonas aeruginosa PA01
gcccaccaccagg

SEQ ID NO: 1476170 - RNA, 15 nt, Pseudomonas aeruginosa PA01
gcccaccaccaggac

SEQ ID NO: 1476171 - RNA, 17 nt, Pseudomonas aeruginosa PA01
gcccaaggccaggucga

SEQ ID NO: 1476172 - RNA, 19 nt, Pseudomonas aeruginosa PA01
gcccaccagcgucgccagg

SEQ ID NO: 1476173 - RNA, 20 nt, Pseudomonas aeruginosa PA01
gcccaccagcgucgccaggc

SEQ ID NO: 1476174 - RNA, 23 nt, Pseudomonas aeruginosa PA01
gcccaccagcgucgccaggccgu

SEQ ID NO: 1476175 - RNA, 19 nt, Pseudomonas aeruginosa PA01
gcccaccagaggcugaccu

SEQ ID NO: 1476176 - RNA, 20 nt, Pseudomonas aeruginosa PA01
gcccggcgcagaacugccgg

SEQ ID NO: 1476177 - RNA, 15 nt, Pseudomonas aeruginosa PA01
gcccggcgccaccgc

SEQ ID NO: 1476178 - RNA, 23 nt, Pseudomonas aeruginosa PA01
gcccggcgccaguucgccgguga

SEQ ID NO: 1476179 - RNA, 13 nt, Pseudomonas aeruginosa PA01
gcccggcgcgacg

SEQ ID NO: 1476180 - RNA, 20 nt, Pseudomonas aeruginosa PA01
gcccggcgcgacgcuccagg

SEQ ID NO: 1476181 - RNA, 12 nt, Pseudomonas aeruginosa PA01
gcccggcggaaa

SEQ ID NO: 1476182 - RNA, 15 nt, Pseudomonas aeruginosa PA01
gcccggcgcuccaac

SEQ ID NO: 1476183 - RNA, 16 nt, Pseudomonas aeruginosa PA01
gcccggcgcggcggcc

SEQ ID NO: 1476184 - RNA, 18 nt, Pseudomonas aeruginosa PA01
gcccggcgcggcggccgc

SEQ ID NO: 1476185 - RNA, 12 nt, Pseudomonas aeruginosa PA01
gcccggcgcggc

SEQ ID NO: 1476186 - RNA, 12 nt, Pseudomonas aeruginosa PA01
gcccggcggcgg

SEQ ID NO: 1476187 - RNA, 23 nt, Pseudomonas aeruginosa PA01
gcccggcggcggcaccgacgccg

SEQ ID NO: 1476188 - RNA, 22 nt, Pseudomonas aeruginosa PA01
gcccggcgggaaacgcgagugg

SEQ ID NO: 1476189 - RNA, 16 nt, Pseudomonas aeruginosa PA01
gcccggcgugagcagg

SEQ ID NO: 1476190 - RNA, 22 nt, Pseudomonas aeruginosa PA01
gcccggcgugggcggucggcga

SEQ ID NO: 1476191 - RNA, 13 nt, Pseudomonas aeruginosa PA01
gcccggcuccaac

SEQ ID NO: 1476192 - RNA, 14 nt, Pseudomonas aeruginosa PA01
gcccggcucgccgc

SEQ ID NO: 1476193 - RNA, 18 nt, Pseudomonas aeruginosa PA01
gcccggcuccagccgggc

SEQ ID NO: 1476194 - RNA, 15 nt, Pseudomonas aeruginosa PA01
gcccggccaggccac

SEQ ID NO: 1476195 - RNA, 18 nt, Pseudomonas aeruginosa PA01
gcccggccaggccacggc

SEQ ID NO: 1476196 - RNA, 20 nt, Pseudomonas aeruginosa PA01
gcccggccaggccacggcgg

SEQ ID NO: 1476197 - RNA, 14 nt, Pseudomonas aeruginosa PA01
gcccggccaggccg

SEQ ID NO: 1476198 - RNA, 15 nt, Pseudomonas aeruginosa PA01
gcccggccaggccgc

SEQ ID NO: 1476199 - RNA, 16 nt, Pseudomonas aeruginosa PA01
gcccggccaggccgcc

SEQ ID NO: 1476200 - RNA, 13 nt, Pseudomonas aeruginosa PA01
gcccggccaggcg

SEQ ID NO: 1476201 - RNA, 16 nt, Pseudomonas aeruginosa PA01
gcccggccaggcgaua

SEQ ID NO: 1476202 - RNA, 14 nt, Pseudomonas aeruginosa PA01
gcccggccaggcgc

SEQ ID NO: 1476203 - RNA, 17 nt, Pseudomonas aeruginosa PA01
gcccggccaggcgcggc

SEQ ID NO: 1476204 - RNA, 21 nt, Pseudomonas aeruginosa PA01
gcccggccagguaggcgacga

SEQ ID NO: 1476205 - RNA, 12 nt, Pseudomonas aeruginosa PA01
gcccggccaucc

SEQ ID NO: 1476206 - RNA, 17 nt, Pseudomonas aeruginosa PA01
gcccggccauccuggcc

SEQ ID NO: 1476207 - RNA, 22 nt, Pseudomonas aeruginosa PA01
gcccggccauccuggccggucg

SEQ ID NO: 1476208 - RNA, 20 nt, Pseudomonas aeruginosa PA01
gcccggccaauggccgggcu

SEQ ID NO: 1476209 - RNA, 13 nt, Pseudomonas aeruginosa PA01
gcccggccgccug

SEQ ID NO: 1476210 - RNA, 15 nt, Pseudomonas aeruginosa PA01
gcccggccgccugcc

SEQ ID NO: 1476211 - RNA, 18 nt, Pseudomonas aeruginosa PA01
gcccggccgccugccuuc

SEQ ID NO: 1476212 - RNA, 13 nt, Pseudomonas aeruginosa PA01
gcccggccgcugc

SEQ ID NO: 1476213 - RNA, 15 nt, Pseudomonas aeruginosa PA01
gcccggccgcugccg

SEQ ID NO: 1476214 - RNA, 17 nt, Pseudomonas aeruginosa PA01
gcccggccgcugccggg

SEQ ID NO: 1476215 - RNA, 18 nt, Pseudomonas aeruginosa PA01
gcccggccgcugccgggc

SEQ ID NO: 1476216 - RNA, 15 nt, Pseudomonas aeruginosa PA01
gcccggccgcuggau

SEQ ID NO: 1476217 - RNA, 16 nt, Pseudomonas aeruginosa PA01
gcccggccgcuggaug

SEQ ID NO: 1476218 - RNA, 19 nt, Pseudomonas aeruginosa PA01
gcccggccgcuggaugccg

SEQ ID NO: 1476219 - RNA, 20 nt, Pseudomonas aeruginosa PA01
gcccggccgcuggaugccga

SEQ ID NO: 1476220 - RNA, 14 nt, Pseudomonas aeruginosa PA01
gcccggccuggugc

SEQ ID NO: 1476221 - RNA, 18 nt, Pseudomonas aeruginosa PA01
gcccggccuucaccgcgc

SEQ ID NO: 1476222 - RNA, 14 nt, Pseudomonas aeruginosa PA01
gcccggccucgccg

SEQ ID NO: 1476223 - RNA, 12 nt, Pseudomonas aeruginosa PA01
gcccggcgagag

SEQ ID NO: 1476224 - RNA, 18 nt, Pseudomonas aeruginosa PA01
gcccggggcucugccggu

SEQ ID NO: 1476225 - RNA, 19 nt, Pseudomonas aeruginosa PA01
gcccggggcucugccggug

SEQ ID NO: 1476226 - RNA, 16 nt, Pseudomonas aeruginosa PA01
gcccggguugccguag

SEQ ID NO: 1476227 - RNA, 18 nt, Pseudomonas aeruginosa PA01
gcccggguugccguagcg

SEQ ID NO: 1476228 - RNA, 15 nt, Pseudomonas aeruginosa PA01
gcccgguauucagcc

SEQ ID NO: 1476229 - RNA, 17 nt, Pseudomonas aeruginosa PA01
gcccgguauucagccag

SEQ ID NO: 1476230 - RNA, 21 nt, Pseudomonas aeruginosa PA01
gcccgguauucagccagagcc

SEQ ID NO: 1476231 - RNA, 19 nt, Pseudomonas aeruginosa PA01
gcccgucaugaccagagcc

SEQ ID NO: 1476232 - RNA, 18 nt, Pseudomonas aeruginosa PA01
gcccgucacuucacgaca

SEQ ID NO: 1476233 - RNA, 17 nt, Pseudomonas aeruginosa PA01
gcccggucaccacccag

SEQ ID NO: 1476234 - RNA, 21 nt, Pseudomonas aeruginosa PA01
gcccggucaccacccagccgc

SEQ ID NO: 1476235 - RNA, 20 nt, Pseudomonas aeruginosa PA01
gcccggucagcuucgccgcc

SEQ ID NO: 1476236 - RNA, 21 nt, Pseudomonas aeruginosa PA01
gcccggucagcuucgccgccc

SEQ ID NO: 1476237 - RNA, 23 nt, Pseudomonas aeruginosa PA01
gcccggucagcuucgccgcccug

SEQ ID NO: 1476238 - RNA, 24 nt, Pseudomonas aeruginosa PA01
gcccggucagcuucgccgcccugg

SEQ ID NO: 1476239 - RNA, 12 nt, Pseudomonas aeruginosa PA01
gcccgucggccu

SEQ ID NO: 1476240 - RNA, 19 nt, Pseudomonas aeruginosa PA01
gcccgucggccucgccgau

SEQ ID NO: 1476241 - RNA, 20 nt, Pseudomonas aeruginosa PA01
gcccgucgaccaucaccagc

SEQ ID NO: 1476242 - RNA, 14 nt, Pseudomonas aeruginosa PA01
gcccgucgcgccgg

SEQ ID NO: 1476243 - RNA, 15 nt, Pseudomonas aeruginosa PA01
gcccgucgcgccggc

SEQ ID NO: 1476244 - RNA, 17 nt, Pseudomonas aeruginosa PA01
gcccgucgcgcgccgga

SEQ ID NO: 1476245 - RNA, 20 nt, Pseudomonas aeruginosa PA01
gcccgucgcgcgccggagcc

SEQ ID NO: 1476246 - RNA, 12 nt, Pseudomonas aeruginosa PA01
gcccgucgucgu

SEQ ID NO: 1476247 - RNA, 23 nt, Pseudomonas aeruginosa PA01
gcccgucgaagaucaccggggcc

SEQ ID NO: 1476248 - RNA, 12 nt, Pseudomonas aeruginosa PA01
gcccgucgaagc

SEQ ID NO: 1476249 - RNA, 17 nt, Pseudomonas aeruginosa PA01
gcccgucgaagccaggc

SEQ ID NO: 1476250 - RNA, 16 nt, Pseudomonas aeruginosa PA01
gcccguccgcgccacg

SEQ ID NO: 1476251 - RNA, 23 nt, Pseudomonas aeruginosa PA01
gcccguccgucccacaggccggc

SEQ ID NO: 1476252 - RNA, 19 nt, Pseudomonas aeruginosa PA01
gcccggcuuuccucggcca

SEQ ID NO: 1476253 - RNA, 20 nt, Pseudomonas aeruginosa PA01
gcccggcuuuccucggccau

SEQ ID NO: 1476254 - RNA, 12 nt, Pseudomonas aeruginosa PA01
gcccgggaucga

SEQ ID NO: 1476255 - RNA, 20 nt, Pseudomonas aeruginosa PA01
gcccgggaucgaugcgcgcc

SEQ ID NO: 1476256 - RNA, 13 nt, Pseudomonas aeruginosa PA01
gcccggcugcaca

SEQ ID NO: 1476257 - RNA, 14 nt, Pseudomonas aeruginosa PA01
gcccggcuggcgua

SEQ ID NO: 1476258 - RNA, 22 nt, Pseudomonas aeruginosa PA01
gcccggcuggcguaccucgcca

SEQ ID NO: 1476259 - RNA, 18 nt, Pseudomonas aeruginosa PA01
gcccggcuucgcggguga

SEQ ID NO: 1476260 - RNA, 16 nt, Pseudomonas aeruginosa PA01
gcccggcuucgcuggu

SEQ ID NO: 1476261 - RNA, 19 nt, Pseudomonas aeruginosa PA01
gcccggcuucgcuggugcu

SEQ ID NO: 1476262 - RNA, 17 nt, Pseudomonas aeruginosa PA01
gcccggcuucggcggcg

SEQ ID NO: 1476263 - RNA, 21 nt, Pseudomonas aeruginosa PA01
gcccggcuucggcggcgcgcu

SEQ ID NO: 1476264 - RNA, 14 nt, Pseudomonas aeruginosa PA01
gcccgggccuggug

SEQ ID NO: 1476265 - RNA, 16 nt, Pseudomonas aeruginosa PA01
gcccgggccuggugca

SEQ ID NO: 1476266 - RNA, 14 nt, Pseudomonas aeruginosa PA01
gcccgggcgccacc

SEQ ID NO: 1476267 - RNA, 15 nt, Pseudomonas aeruginosa PA01
gcccgggcgccaccg

SEQ ID NO: 1476268 - RNA, 14 nt, Pseudomonas aeruginosa PA01
gcccgggcguuggc

SEQ ID NO: 1476269 - RNA, 20 nt, Pseudomonas aeruginosa PA01
gcccggguggauaucgucgg

SEQ ID NO: 1476270 - RNA, 21 nt, Pseudomonas aeruginosa PA01
gcccggguggauaucgucggg

SEQ ID NO: 1476271 - RNA, 21 nt, Pseudomonas aeruginosa PA01
gcccgggucgucggucggcca

SEQ ID NO: 1476272 - RNA, 22 nt, Pseudomonas aeruginosa PA01
gcccgggucgucggucggccag

SEQ ID NO: 1476273 - RNA, 23 nt, Pseudomonas aeruginosa PA01
gcccgggucgucggucggccagg

SEQ ID NO: 1476274 - RNA, 16 nt, Pseudomonas aeruginosa PA01
gcccgggucacgguca

SEQ ID NO: 1476275 - RNA, 22 nt, Pseudomonas aeruginosa PA01
gcccgggucacggucagcucgg

SEQ ID NO: 1476276 - RNA, 14 nt, Pseudomonas aeruginosa PA01
gcccggcaccaccg

SEQ ID NO: 1476277 - RNA, 19 nt, Pseudomonas aeruginosa PA01
gcccggcaccaccggucaa

SEQ ID NO: 1476278 - RNA, 17 nt, Pseudomonas aeruginosa PA01
gcccggcaccaggccga

SEQ ID NO: 1476279 - RNA, 12 nt, Pseudomonas aeruginosa PA01
gcccggcaccgg

SEQ ID NO: 1476280 - RNA, 15 nt, Pseudomonas aeruginosa PA01
gcccggcaccggggu

SEQ ID NO: 1476281 - RNA, 15 nt, Pseudomonas aeruginosa PA01
gcccggcacucgccg

SEQ ID NO: 1476282 - RNA, 15 nt, Pseudomonas aeruginosa PA01
gcccggcacgcucca

SEQ ID NO: 1476283 - RNA, 18 nt, Pseudomonas aeruginosa PA01
gcccggcacgcuccaggg

SEQ ID NO: 1476284 - RNA, 15 nt, Pseudomonas aeruginosa PA01
gcccggcagcgccgg

SEQ ID NO: 1476285 - RNA, 17 nt, Pseudomonas aeruginosa PA01
gcccggcagcgccgggc

SEQ ID NO: 1476286 - RNA, 14 nt, Pseudomonas aeruginosa PA01
gcccggcagcggcu

SEQ ID NO: 1476287 - RNA, 16 nt, Pseudomonas aeruginosa PA01
gcccggcagcggcugg

SEQ ID NO: 1476288 - RNA, 19 nt, Pseudomonas aeruginosa PA01
gcccggcagcggcuggccg

SEQ ID NO: 1476289 - RNA, 21 nt, Pseudomonas aeruginosa PA01
gcccggcagcggcuggccguc

SEQ ID NO: 1476290 - RNA, 20 nt, Pseudomonas aeruginosa PA01
gcccggcaggcagugccggg

SEQ ID NO: 1476291 - RNA, 21 nt, Pseudomonas aeruginosa PA01
gcccggcaggcagugccgggc

SEQ ID NO: 1476292 - RNA, 13 nt, Pseudomonas aeruginosa PA01
gcccggcagcagg

SEQ ID NO: 1476293 - RNA, 14 nt, Pseudomonas aeruginosa PA01
gcccggcagcaggc

SEQ ID NO: 1476294 - RNA, 16 nt, Pseudomonas aeruginosa PA01
gcccggcagcaggccg

SEQ ID NO: 1476295 - RNA, 17 nt, Pseudomonas aeruginosa PA01
gcccggcagcaggccgc

SEQ ID NO: 1476296 - RNA, 18 nt, Pseudomonas aeruginosa PA01
gcccggcagcaggccgcc

SEQ ID NO: 1476297 - RNA, 19 nt, Pseudomonas aeruginosa PA01
gcccggcagcaggccgccg

SEQ ID NO: 1476298 - RNA, 22 nt, Pseudomonas aeruginosa PA01
gcccggcagcucccuugccgcc

SEQ ID NO: 1476299 - RNA, 16 nt, Pseudomonas aeruginosa PA01
gcccggcauaggcgcc

SEQ ID NO: 1476300 - RNA, 18 nt, Pseudomonas aeruginosa PA01
gcccggcauaggcgccag

SEQ ID NO: 1476301 - RNA, 20 nt, Pseudomonas aeruginosa PA01
gcccggcauaggcgccagcc

SEQ ID NO: 1476302 - RNA, 16 nt, Pseudomonas aeruginosa PA01
gcccggcaucugccgg

SEQ ID NO: 1476303 - RNA, 13 nt, Pseudomonas aeruginosa PA01
gcccggcagaucu

SEQ ID NO: 1476304 - RNA, 16 nt, Pseudomonas aeruginosa PA01
gcccggcauucgccgg

SEQ ID NO: 1476305 - RNA, 17 nt, Pseudomonas aeruginosa PA01
gcccggagccaacgccc

SEQ ID NO: 1476306 - RNA, 14 nt, Pseudomonas aeruginosa PA01
gcccggagcgcgag

SEQ ID NO: 1476307 - RNA, 15 nt, Pseudomonas aeruginosa PA01
gcccggagcggcugc

SEQ ID NO: 1476308 - RNA, 18 nt, Pseudomonas aeruginosa PA01
gcccggagcuuugcaggg

SEQ ID NO: 1476309 - RNA, 22 nt, Pseudomonas aeruginosa PA01
gcccggagcuuugcagggcgau

SEQ ID NO: 1476310 - RNA, 21 nt, Pseudomonas aeruginosa PA01
gcccggagaccgugccgccgg

SEQ ID NO: 1476311 - RNA, 22 nt, Pseudomonas aeruginosa PA01
gcccggagaccgugccgccggg

SEQ ID NO: 1476312 - RNA, 20 nt, Pseudomonas aeruginosa PA01
gcccggauuuugggcagcgu

SEQ ID NO: 1476313 - RNA, 17 nt, Pseudomonas aeruginosa PA01
gcccggcaaaugccggg

SEQ ID NO: 1476314 - RNA, 18 nt, Pseudomonas aeruginosa PA01
gcccggcaaaugccgggc

SEQ ID NO: 1476315 - RNA, 19 nt, Pseudomonas aeruginosa PA01
gcccggcaaaugccgggcu

SEQ ID NO: 1476316 - RNA, 13 nt, Pseudomonas aeruginosa PA01
gcccgcucggggc

SEQ ID NO: 1476317 - RNA, 14 nt, Pseudomonas aeruginosa PA01
gcccgcucggggca

SEQ ID NO: 1476318 - RNA, 13 nt, Pseudomonas aeruginosa PA01
gcccgcuccgcau

SEQ ID NO: 1476319 - RNA, 22 nt, Pseudomonas aeruginosa PA01
gcccgcucuugauacccaccgg

SEQ ID NO: 1476320 - RNA, 12 nt, Pseudomonas aeruginosa PA01
gcccgcugaccg

SEQ ID NO: 1476321 - RNA, 15 nt, Pseudomonas aeruginosa PA01
gcccgcugaccgggc

SEQ ID NO: 1476322 - RNA, 18 nt, Pseudomonas aeruginosa PA01
gcccgcugaccgggcgga

SEQ ID NO: 1476323 - RNA, 23 nt, Pseudomonas aeruginosa PA01
gcccgcugaccgggcggaucgcc

SEQ ID NO: 1476324 - RNA, 13 nt, Pseudomonas aeruginosa PA01
gcccgcgucgcgc

SEQ ID NO: 1476325 - RNA, 20 nt, Pseudomonas aeruginosa PA01
gcccgcuuuccccggcggca

SEQ ID NO: 1476326 - RNA, 12 nt, Pseudomonas aeruginosa PA01
gcccgcugggca

SEQ ID NO: 1476327 - RNA, 17 nt, Pseudomonas aeruginosa PA01
gcccgcuugcgccgccu

SEQ ID NO: 1476328 - RNA, 22 nt, Pseudomonas aeruginosa PA01
gcccgcuugcgccgccucgcgc

SEQ ID NO: 1476329 - RNA, 17 nt, Pseudomonas aeruginosa PA01
gcccgcuucgagcgggc

SEQ ID NO: 1476330 - RNA, 18 nt, Pseudomonas aeruginosa PA01
gcccgcuucgagcgggcu

SEQ ID NO: 1476331 - RNA, 15 nt, Pseudomonas aeruginosa PA01
gcccgcuucgccauc

SEQ ID NO: 1476332 - RNA, 24 nt, Pseudomonas aeruginosa PA01
gcccgcugauugcgggccuuggcg

SEQ ID NO: 1476333 - RNA, 15 nt, Pseudomonas aeruginosa PA01
gcccgcugcgcugcc

SEQ ID NO: 1476334 - RNA, 18 nt, Pseudomonas aeruginosa PA01
gcccgcugcgcugccagc

SEQ ID NO: 1476335 - RNA, 19 nt, Pseudomonas aeruginosa PA01
gcccgcugcgcugccagcg

SEQ ID NO: 1476336 - RNA, 16 nt, Pseudomonas aeruginosa PA01
gcccgccuugauggcg

SEQ ID NO: 1476337 - RNA, 15 nt, Pseudomonas aeruginosa PA01
gcccgccuuguucgc

SEQ ID NO: 1476338 - RNA, 23 nt, Pseudomonas aeruginosa PA01
gcccgccuuguucgccagcaccu

SEQ ID NO: 1476339 - RNA, 17 nt, Pseudomonas aeruginosa PA01
gcccgccuuccagcuug

SEQ ID NO: 1476340 - RNA, 17 nt, Pseudomonas aeruginosa PA01
gcccgcccggcaccacc

SEQ ID NO: 1476341 - RNA, 15 nt, Pseudomonas aeruginosa PA01
gcccgcgagccgucc

SEQ ID NO: 1476342 - RNA, 14 nt, Pseudomonas aeruginosa PA01
gcccgcgccgccuc

SEQ ID NO: 1476343 - RNA, 15 nt, Pseudomonas aeruginosa PA01
gcccgcgccgccucg

SEQ ID NO: 1476344 - RNA, 23 nt, Pseudomonas aeruginosa PA01
gcccgcgcauggagacggcccgc

SEQ ID NO: 1476345 - RNA, 15 nt, Pseudomonas aeruginosa PA01
gcccgcggaucgcgc

SEQ ID NO: 1476346 - RNA, 20 nt, Pseudomonas aeruginosa PA01
gcccgcggaucgcgccgucg

SEQ ID NO: 1476347 - RNA, 13 nt, Pseudomonas aeruginosa PA01
gcccgcggcagca

SEQ ID NO: 1476348 - RNA, 14 nt, Pseudomonas aeruginosa PA01
gcccgcggcagcag

SEQ ID NO: 1476349 - RNA, 15 nt, Pseudomonas aeruginosa PA01
gcccgcggcagcagc

SEQ ID NO: 1476350 - RNA, 17 nt, Pseudomonas aeruginosa PA01
gcccgcggcagcagcca

SEQ ID NO: 1476351 - RNA, 18 nt, Pseudomonas aeruginosa PA01
gcccgcggcggcgacgcu

SEQ ID NO: 1476352 - RNA, 22 nt, Pseudomonas aeruginosa PA01
gcccgcggcggcgacgcuggcg

SEQ ID NO: 1476353 - RNA, 12 nt, Pseudomonas aeruginosa PA01
gcccgcgcucgg

SEQ ID NO: 1476354 - RNA, 15 nt, Pseudomonas aeruginosa PA01
gcccgcgcucggccg

SEQ ID NO: 1476355 - RNA, 16 nt, Pseudomonas aeruginosa PA01
gcccgcgcucggccgc

SEQ ID NO: 1476356 - RNA, 17 nt, Pseudomonas aeruginosa PA01
gcccgcgcucggccgcc

SEQ ID NO: 1476357 - RNA, 21 nt, Pseudomonas aeruginosa PA01
gcccgcgcucggccgccuggc

SEQ ID NO: 1476358 - RNA, 22 nt, Pseudomonas aeruginosa PA01
gcccgcgcucggccgccuggcg

SEQ ID NO: 1476359 - RNA, 22 nt, Pseudomonas aeruginosa PA01
gcccgcgccuccaggcgcgccu

SEQ ID NO: 1476360 - RNA, 14 nt, Pseudomonas aeruginosa PA01
gcccgcgccucgcu

SEQ ID NO: 1476361 - RNA, 12 nt, Pseudomonas aeruginosa PA01
gcccgcggcgag

SEQ ID NO: 1476362 - RNA, 23 nt, Pseudomonas aeruginosa PA01
gcccgcggcguuauccgcccuac

SEQ ID NO: 1476363 - RNA, 16 nt, Pseudomonas aeruginosa PA01
gcccgcgggcagcucg

SEQ ID NO: 1476364 - RNA, 14 nt, Pseudomonas aeruginosa PA01
gcccgcgggcgccu

SEQ ID NO: 1476365 - RNA, 23 nt, Pseudomonas aeruginosa PA01
gcccgcgguauucuccagcaggc

SEQ ID NO: 1476366 - RNA, 18 nt, Pseudomonas aeruginosa PA01
gcccgcggucacucggcc

SEQ ID NO: 1476367 - RNA, 22 nt, Pseudomonas aeruginosa PA01
gcccgcggucacucggccucgg

SEQ ID NO: 1476368 - RNA, 18 nt, Pseudomonas aeruginosa PA01
gcccgcgucgcgcgcggc

SEQ ID NO: 1476369 - RNA, 20 nt, Pseudomonas aeruginosa PA01
gcccgcgucgcgcgcggcau

SEQ ID NO: 1476370 - RNA, 22 nt, Pseudomonas aeruginosa PA01
cguccccacucaucucagcaac

SEQ ID NO: 1476371 - RNA, 13 nt, Pseudomonas aeruginosa PA01
cgucccaucgggu

SEQ ID NO: 1476372 - RNA, 23 nt, Pseudomonas aeruginosa PA01
cgucccaugaccgucagccaggc

SEQ ID NO: 1476373 - RNA, 18 nt, Pseudomonas aeruginosa PA01
cgucccagucggcguccg

SEQ ID NO: 1476374 - RNA, 22 nt, Pseudomonas aeruginosa PA01
cguccaucccugcuucgaccag

SEQ ID NO: 1476375 - RNA, 24 nt, Pseudomonas aeruginosa PA01
cguccauccccgccucgaccagcg

SEQ ID NO: 1476376 - RNA, 18 nt, Pseudomonas aeruginosa PA01
cguccccuuccuccucgc

SEQ ID NO: 1476377 - RNA, 20 nt, Pseudomonas aeruginosa PA01
cguccccuuccuccucgccg

SEQ ID NO: 1476378 - RNA, 20 nt, Pseudomonas aeruginosa PA01
cgucccgagcaccggccuca

SEQ ID NO: 1476379 - RNA, 17 nt, Pseudomonas aeruginosa PA01
cgucccgcuccagccgg

SEQ ID NO: 1476380 - RNA, 12 nt, Pseudomonas aeruginosa PA01
cgucccgcugcg

SEQ ID NO: 1476381 - RNA, 13 nt, Pseudomonas aeruginosa PA01
cguccgacagcag

SEQ ID NO: 1476382 - RNA, 15 nt, Pseudomonas aeruginosa PA01
cguccgacagcaggu

SEQ ID NO: 1476383 - RNA, 13 nt, Pseudomonas aeruginosa PA01
cguccgcgaugcg

SEQ ID NO: 1476384 - RNA, 23 nt, Pseudomonas aeruginosa PA01
cguccgcgaugcguuccagggcg

SEQ ID NO: 1476385 - RNA, 15 nt, Pseudomonas aeruginosa PA01
cguccgccucgcuga

SEQ ID NO: 1476386 - RNA, 13 nt, Pseudomonas aeruginosa PA01
cguccgccgccgu

SEQ ID NO: 1476387 - RNA, 14 nt, Pseudomonas aeruginosa PA01
cguccgccaccacg

SEQ ID NO: 1476388 - RNA, 16 nt, Pseudomonas aeruginosa PA01
cguccgccaccacggc

SEQ ID NO: 1476389 - RNA, 17 nt, Pseudomonas aeruginosa PA01
cguccgccaccacggcg

SEQ ID NO: 1476390 - RNA, 18 nt, Pseudomonas aeruginosa PA01
cguccgcggccugcucgg

SEQ ID NO: 1476391 - RNA, 12 nt, Pseudomonas aeruginosa PA01
cguccgccuggg

SEQ ID NO: 1476392 - RNA, 14 nt, Pseudomonas aeruginosa PA01
cguccgcgcaggcg

SEQ ID NO: 1476393 - RNA, 14 nt, Pseudomonas aeruginosa PA01
cguccgcgccgcgc

SEQ ID NO: 1476394 - RNA, 20 nt, Pseudomonas aeruginosa PA01
cguccgcaguucgccccgcc

SEQ ID NO: 1476395 - RNA, 18 nt, Pseudomonas aeruginosa PA01
cguccagugcggcagucg

SEQ ID NO: 1476396 - RNA, 16 nt, Pseudomonas aeruginosa PA01
cguccaguucagggcc

SEQ ID NO: 1476397 - RNA, 23 nt, Pseudomonas aeruginosa PA01
cguccaguuccagggucagcugg

SEQ ID NO: 1476398 - RNA, 14 nt, Pseudomonas aeruginosa PA01
cguccaguagcgcc

SEQ ID NO: 1476399 - RNA, 16 nt, Pseudomonas aeruginosa PA01
cguccaggcgcgaacg

SEQ ID NO: 1476400 - RNA, 12 nt, Pseudomonas aeruginosa PA01
cguccagggcac

SEQ ID NO: 1476401 - RNA, 22 nt, Pseudomonas aeruginosa PA01
cguccaggcugccgccuucgcg

SEQ ID NO: 1476402 - RNA, 13 nt, Pseudomonas aeruginosa PA01
cguccagggcgcu

SEQ ID NO: 1476403 - RNA, 18 nt, Pseudomonas aeruginosa PA01
cguccagggcuucgacau

SEQ ID NO: 1476404 - RNA, 20 nt, Pseudomonas aeruginosa PA01
cguccagggugcugaccuuc

SEQ ID NO: 1476405 - RNA, 14 nt, Pseudomonas aeruginosa PA01
cguccagcgcgccg

SEQ ID NO: 1476406 - RNA, 15 nt, Pseudomonas aeruginosa PA01
cguccaggccgcagg

SEQ ID NO: 1476407 - RNA, 17 nt, Pseudomonas aeruginosa PA01
cguccagcaggacgucg

SEQ ID NO: 1476408 - RNA, 16 nt, Pseudomonas aeruginosa PA01
cguccagcaggcccag

SEQ ID NO: 1476409 - RNA, 12 nt, Pseudomonas aeruginosa PA01
cguccagcgccg

SEQ ID NO: 1476410 - RNA, 20 nt, Pseudomonas aeruginosa PA01
cguccagcgaggcguggaag

SEQ ID NO: 1476411 - RNA, 14 nt, Pseudomonas aeruginosa PA01
cguccagccggcgc

SEQ ID NO: 1476412 - RNA, 15 nt, Pseudomonas aeruginosa PA01
cguccagccggcgcu

SEQ ID NO: 1476413 - RNA, 17 nt, Pseudomonas aeruginosa PA01
cguccagccggcgcuuc

SEQ ID NO: 1476414 - RNA, 18 nt, Pseudomonas aeruginosa PA01
cguccagcucggccauca

SEQ ID NO: 1476415 - RNA, 17 nt, Pseudomonas aeruginosa PA01
cguccagcggcaugccg

SEQ ID NO: 1476416 - RNA, 17 nt, Pseudomonas aeruginosa PA01
cguccagcgggcccaug

SEQ ID NO: 1476417 - RNA, 20 nt, Pseudomonas aeruginosa PA01
cguccagcgggcccauggcg

SEQ ID NO: 1476418 - RNA, 14 nt, Pseudomonas aeruginosa PA01
cgucaugccgccgu

SEQ ID NO: 1476419 - RNA, 14 nt, Pseudomonas aeruginosa PA01
cgucauggcgcacg

SEQ ID NO: 1476420 - RNA, 19 nt, Pseudomonas aeruginosa PA01
cgucaugcacuucgaccag

SEQ ID NO: 1476421 - RNA, 14 nt, Pseudomonas aeruginosa PA01
cguccacggcgcgu

SEQ ID NO: 1476422 - RNA, 18 nt, Pseudomonas aeruginosa PA01
cguccacggcgcgucggc

SEQ ID NO: 1476423 - RNA, 20 nt, Pseudomonas aeruginosa PA01
cguccacguugagcaucacc

SEQ ID NO: 1476424 - RNA, 16 nt, Pseudomonas aeruginosa PA01
cguccacuccggcagc

SEQ ID NO: 1476425 - RNA, 19 nt, Pseudomonas aeruginosa PA01
cguccacuccggcagcacc

SEQ ID NO: 1476426 - RNA, 20 nt, Pseudomonas aeruginosa PA01
cguccacuccggcagcaccc

SEQ ID NO: 1476427 - RNA, 18 nt, Pseudomonas aeruginosa PA01
cguccaccgaguggcgca

SEQ ID NO: 1476428 - RNA, 14 nt, Pseudomonas aeruginosa PA01
cguccaccggcgcc

SEQ ID NO: 1476429 - RNA, 13 nt, Pseudomonas aeruginosa PA01
cguccaccuggcg

SEQ ID NO: 1476430 - RNA, 15 nt, Pseudomonas aeruginosa PA01
cguccaccuggcggc

SEQ ID NO: 1476431 - RNA, 14 nt, Pseudomonas aeruginosa PA01
cguccaccagccag

SEQ ID NO: 1476432 - RNA, 14 nt, Pseudomonas aeruginosa PA01
cgucagccgcggcc

SEQ ID NO: 1476433 - RNA, 15 nt, Pseudomonas aeruginosa PA01
cgucagccgcggccg

SEQ ID NO: 1476434 - RNA, 13 nt, Pseudomonas aeruginosa PA01
cgucagcgaggcg

SEQ ID NO: 1476435 - RNA, 15 nt, Pseudomonas aeruginosa PA01
cgucagcgaggcggg

SEQ ID NO: 1476436 - RNA, 14 nt, Pseudomonas aeruginosa PA01
cgucaggccuugcg

SEQ ID NO: 1476437 - RNA, 19 nt, Pseudomonas aeruginosa PA01
cgucaggccuugcgcggcg

SEQ ID NO: 1476438 - RNA, 22 nt, Pseudomonas aeruginosa PA01
cgucaggccuugcgcggcgccg

SEQ ID NO: 1476439 - RNA, 14 nt, Pseudomonas aeruginosa PA01
cgucaucgagcagu

SEQ ID NO: 1476440 - RNA, 14 nt, Pseudomonas aeruginosa PA01
cgucaucgcugacc

SEQ ID NO: 1476441 - RNA, 14 nt, Pseudomonas aeruginosa PA01
cgucaugaccagag

SEQ ID NO: 1476442 - RNA, 14 nt, Pseudomonas aeruginosa PA01
cgucauccgccaac

SEQ ID NO: 1476443 - RNA, 14 nt, Pseudomonas aeruginosa PA01
cgucgaggucgacg

SEQ ID NO: 1476444 - RNA, 19 nt, Pseudomonas aeruginosa PA01
cgucgagggcaaaggcgcg

SEQ ID NO: 1476445 - RNA, 21 nt, Pseudomonas aeruginosa PA01
cgucgagggcaaaggcgcgca

SEQ ID NO: 1476446 - RNA, 23 nt, Pseudomonas aeruginosa PA01
cgucgauacgcaucugcucgagg

SEQ ID NO: 1476447 - RNA, 15 nt, Pseudomonas aeruginosa PA01
cgucgaucaucugcu

SEQ ID NO: 1476448 - RNA, 21 nt, Pseudomonas aeruginosa PA01
cgucgaucaucugcugcagca

SEQ ID NO: 1476449 - RNA, 23 nt, Pseudomonas aeruginosa PA01
cgucgaucaucugcugcagcauc

SEQ ID NO: 1476450 - RNA, 12 nt, Pseudomonas aeruginosa PA01
cgucgaucaggu

SEQ ID NO: 1476451 - RNA, 21 nt, Pseudomonas aeruginosa PA01
cgucgaucagguaggccggcg

SEQ ID NO: 1476452 - RNA, 18 nt, Pseudomonas aeruginosa PA01
cgucgaucccgaucgcca

SEQ ID NO: 1476453 - RNA, 17 nt, Pseudomonas aeruginosa PA01
cgucgccauucggcgac

SEQ ID NO: 1476454 - RNA, 18 nt, Pseudomonas aeruginosa PA01
cgucgccauucggcgacg

SEQ ID NO: 1476455 - RNA, 21 nt, Pseudomonas aeruginosa PA01
cgucgccauucggcgacgggc

SEQ ID NO: 1476456 - RNA, 16 nt, Pseudomonas aeruginosa PA01
cgucgccaugcggcag

SEQ ID NO: 1476457 - RNA, 19 nt, Pseudomonas aeruginosa PA01
cgucgccaugcggcaggcc

SEQ ID NO: 1476458 - RNA, 23 nt, Pseudomonas aeruginosa PA01
cgucgcccaggccgcuggcggcg

SEQ ID NO: 1476459 - RNA, 17 nt, Pseudomonas aeruginosa PA01
cgucgaugccuucggcg

SEQ ID NO: 1476460 - RNA, 19 nt, Pseudomonas aeruginosa PA01
cgucgaugccuucggcggc

SEQ ID NO: 1476461 - RNA, 20 nt, Pseudomonas aeruginosa PA01
cgucgaugccuucggcggcc

SEQ ID NO: 1476462 - RNA, 23 nt, Pseudomonas aeruginosa PA01
cgucgaugccuucggcggccggg

SEQ ID NO: 1476463 - RNA, 16 nt, Pseudomonas aeruginosa PA01
cgucgaugcgccucag

SEQ ID NO: 1476464 - RNA, 17 nt, Pseudomonas aeruginosa PA01
cgucgaugcguccgcgc

SEQ ID NO: 1476465 - RNA, 18 nt, Pseudomonas aeruginosa PA01
cgucgaugcguccgcgca

SEQ ID NO: 1476466 - RNA, 15 nt, Pseudomonas aeruginosa PA01
cgucgaugcugccgu

SEQ ID NO: 1476467 - RNA, 17 nt, Pseudomonas aeruginosa PA01
cgucgaugcugccguag

SEQ ID NO: 1476468 - RNA, 19 nt, Pseudomonas aeruginosa PA01
cgucgaugcuuucgagcaa

SEQ ID NO: 1476469 - RNA, 13 nt, Pseudomonas aeruginosa PA01
cgucgaugucgcg

SEQ ID NO: 1476470 - RNA, 15 nt, Pseudomonas aeruginosa PA01
cgucgaugucgcggc

SEQ ID NO: 1476471 - RNA, 17 nt, Pseudomonas aeruginosa PA01
cgucgaugucgcggcug

SEQ ID NO: 1476472 - RNA, 15 nt, Pseudomonas aeruginosa PA01
cgucgcgccagcacc

SEQ ID NO: 1476473 - RNA, 14 nt, Pseudomonas aeruginosa PA01
cgucgcgcagcucc

SEQ ID NO: 1476474 - RNA, 15 nt, Pseudomonas aeruginosa PA01
cgucgcgcaggcggg

SEQ ID NO: 1476475 - RNA, 12 nt, Pseudomonas aeruginosa PA01
cgucgcgccggc

SEQ ID NO: 1476476 - RNA, 14 nt, Pseudomonas aeruginosa PA01
cgucgcgccgcgga

SEQ ID NO: 1476477 - RNA, 15 nt, Pseudomonas aeruginosa PA01
cgucgcgccaggcga

SEQ ID NO: 1476478 - RNA, 18 nt, Pseudomonas aeruginosa PA01
cgucgcgccaggcgaaga

SEQ ID NO: 1476479 - RNA, 14 nt, Pseudomonas aeruginosa PA01
cgucgccggcgacg

SEQ ID NO: 1476480 - RNA, 14 nt, Pseudomonas aeruginosa PA01
cgucgccgcugaug

SEQ ID NO: 1476481 - RNA, 12 nt, Pseudomonas aeruginosa PA01
cgucgccgcugg

SEQ ID NO: 1476482 - RNA, 14 nt, Pseudomonas aeruginosa PA01
cgucgcccucggcg

SEQ ID NO: 1476483 - RNA, 15 nt, Pseudomonas aeruginosa PA01
cgucgcccuggccga

SEQ ID NO: 1476484 - RNA, 17 nt, Pseudomonas aeruginosa PA01
cgucgccgaacggcagc

SEQ ID NO: 1476485 - RNA, 21 nt, Pseudomonas aeruginosa PA01
cgucgccgaacuccgagcagg

SEQ ID NO: 1476486 - RNA, 20 nt, Pseudomonas aeruginosa PA01
cgucgaggcugucgcggacc

SEQ ID NO: 1476487 - RNA, 21 nt, Pseudomonas aeruginosa PA01
cgucgagguagaacaggcugc

SEQ ID NO: 1476488 - RNA, 14 nt, Pseudomonas aeruginosa PA01
cgucgagguagucg

SEQ ID NO: 1476489 - RNA, 13 nt, Pseudomonas aeruginosa PA01
cgucgagcagcgc

SEQ ID NO: 1476490 - RNA, 18 nt, Pseudomonas aeruginosa PA01
cgucgagcaucugccggg

SEQ ID NO: 1476491 - RNA, 14 nt, Pseudomonas aeruginosa PA01
cgucgagcaugccg

SEQ ID NO: 1476492 - RNA, 18 nt, Pseudomonas aeruginosa PA01
cgucgagcaugccgagga

SEQ ID NO: 1476493 - RNA, 16 nt, Pseudomonas aeruginosa PA01
cgucgagcugcucggc

SEQ ID NO: 1476494 - RNA, 18 nt, Pseudomonas aeruginosa PA01
cgucgagcugcucggcgg

SEQ ID NO: 1476495 - RNA, 19 nt, Pseudomonas aeruginosa PA01
cgucgagcugcucggcggu

SEQ ID NO: 1476496 - RNA, 15 nt, Pseudomonas aeruginosa PA01
cgucgagccagccca

SEQ ID NO: 1476497 - RNA, 14 nt, Pseudomonas aeruginosa PA01
cgucgagcagcgcg

SEQ ID NO: 1476498 - RNA, 15 nt, Pseudomonas aeruginosa PA01
cgucgagcagcgcgc

SEQ ID NO: 1476499 - RNA, 14 nt, Pseudomonas aeruginosa PA01
cgucgagaugcugc

SEQ ID NO: 1476500 - RNA, 17 nt, Pseudomonas aeruginosa PA01
cgucgagcaccagcagg

SEQ ID NO: 1476501 - RNA, 18 nt, Pseudomonas aeruginosa PA01
cgucgagcaccagcaggu

SEQ ID NO: 1476502 - RNA, 22 nt, Pseudomonas aeruginosa PA01
cgucgacgcagcgcgcgucggc

SEQ ID NO: 1476503 - RNA, 13 nt, Pseudomonas aeruginosa PA01
cgucgacgcccug

SEQ ID NO: 1476504 - RNA, 16 nt, Pseudomonas aeruginosa PA01
cgucgacgcccuggcg

SEQ ID NO: 1476505 - RNA, 17 nt, Pseudomonas aeruginosa PA01
cgucgacgcccugggcg

SEQ ID NO: 1476506 - RNA, 20 nt, Pseudomonas aeruginosa PA01
cgucgacgcccugggcgacg

SEQ ID NO: 1476507 - RNA, 13 nt, Pseudomonas aeruginosa PA01
cgucgacgccgag

SEQ ID NO: 1476508 - RNA, 14 nt, Pseudomonas aeruginosa PA01
cgucgacgccgagc

SEQ ID NO: 1476509 - RNA, 16 nt, Pseudomonas aeruginosa PA01
cgucgacgccgagcug

SEQ ID NO: 1476510 - RNA, 23 nt, Pseudomonas aeruginosa PA01
cgucgaccaugguguuggcggcc

SEQ ID NO: 1476511 - RNA, 17 nt, Pseudomonas aeruginosa PA01
cgucgaccaucaccagc

SEQ ID NO: 1476512 - RNA, 18 nt, Pseudomonas aeruginosa PA01
cgucgaccaucaccagcg

SEQ ID NO: 1476513 - RNA, 19 nt, Pseudomonas aeruginosa PA01
cgucgaccaucaccagcgc

SEQ ID NO: 1476514 - RNA, 18 nt, Pseudomonas aeruginosa PA01
cgucgaccacgaagcugu

SEQ ID NO: 1476515 - RNA, 20 nt, Pseudomonas aeruginosa PA01
cgucgacacugauauccgcu

SEQ ID NO: 1476516 - RNA, 19 nt, Pseudomonas aeruginosa PA01
cgucgacaccgaucaccug

SEQ ID NO: 1476517 - RNA, 23 nt, Pseudomonas aeruginosa PA01
cgucgacaccgaucaccuggccg

SEQ ID NO: 1476518 - RNA, 20 nt, Pseudomonas aeruginosa PA01
cgucgaagccaggcaccgga

SEQ ID NO: 1476519 - RNA, 21 nt, Pseudomonas aeruginosa PA01
cguccgguaugccgaucaugc

SEQ ID NO: 1476520 - RNA, 20 nt, Pseudomonas aeruginosa PA01
cguccgguugcuggcacagg

SEQ ID NO: 1476521 - RNA, 22 nt, Pseudomonas aeruginosa PA01
cguccguaaugcaacccgccgc

SEQ ID NO: 1476522 - RNA, 19 nt, Pseudomonas aeruginosa PA01
cguccgucccacaggccgg

SEQ ID NO: 1476523 - RNA, 21 nt, Pseudomonas aeruginosa PA01
cguccgucccacaggccggcu

SEQ ID NO: 1476524 - RNA, 19 nt, Pseudomonas aeruginosa PA01
cguccucagccucacccug

SEQ ID NO: 1476525 - RNA, 20 nt, Pseudomonas aeruginosa PA01
cguccgggugggucauggcg

SEQ ID NO: 1476526 - RNA, 19 nt, Pseudomonas aeruginosa PA01
cguccgggugccccaggcg

SEQ ID NO: 1476527 - RNA, 22 nt, Pseudomonas aeruginosa PA01
cguccgggugccccaggcgagu

SEQ ID NO: 1476528 - RNA, 23 nt, Pseudomonas aeruginosa PA01
cguauggccccuccaccucgacc

SEQ ID NO: 1476529 - RNA, 14 nt, Pseudomonas aeruginosa PA01
cguagguggcgccg

SEQ ID NO: 1476530 - RNA, 16 nt, Pseudomonas aeruginosa PA01
cguagguggcgccgcc

SEQ ID NO: 1476531 - RNA, 18 nt, Pseudomonas aeruginosa PA01
cguagguggcgccgccgg

SEQ ID NO: 1476532 - RNA, 21 nt, Pseudomonas aeruginosa PA01
cguagguggcgccgccggcga

SEQ ID NO: 1476533 - RNA, 23 nt, Pseudomonas aeruginosa PA01
cguagguggcgccgccggcgaac

SEQ ID NO: 1476534 - RNA, 14 nt, Pseudomonas aeruginosa PA01
cguaggcgucgcga

SEQ ID NO: 1476535 - RNA, 21 nt, Pseudomonas aeruginosa PA01
cguaggcuuggucgggcgccg

SEQ ID NO: 1476536 - RNA, 16 nt, Pseudomonas aeruginosa PA01
cguaggcgcgggcggc

SEQ ID NO: 1476537 - RNA, 22 nt, Pseudomonas aeruginosa PA01
cguagcuguucucuuugaccuu

SEQ ID NO: 1476538 - RNA, 16 nt, Pseudomonas aeruginosa PA01
cguaggcgcgccaagg

SEQ ID NO: 1476539 - RNA, 20 nt, Pseudomonas aeruginosa PA01
cguaggcgcgccaaggccgc

SEQ ID NO: 1476540 - RNA, 20 nt, Pseudomonas aeruginosa PA01
cguagguggauugcagcguc

SEQ ID NO: 1476541 - RNA, 19 nt, Pseudomonas aeruginosa PA01
cguaggucaugcgugcggg

SEQ ID NO: 1476542 - RNA, 22 nt, Pseudomonas aeruginosa PA01
cguagggcgaacaaccgcucgc

SEQ ID NO: 1476543 - RNA, 18 nt, Pseudomonas aeruginosa PA01
cguagggcgaacaacgcc

SEQ ID NO: 1476544 - RNA, 16 nt, Pseudomonas aeruginosa PA01
cguagggcgaagccaa

SEQ ID NO: 1476545 - RNA, 19 nt, Pseudomonas aeruginosa PA01
cguagggcgaauaacgcca

SEQ ID NO: 1476546 - RNA, 20 nt, Pseudomonas aeruginosa PA01
cguagggcgcauaaccgcuc

SEQ ID NO: 1476547 - RNA, 22 nt, Pseudomonas aeruginosa PA01
cguagggcgcauaaccgcuugc

SEQ ID NO: 1476548 - RNA, 13 nt, Pseudomonas aeruginosa PA01
cguauucgccgaa

SEQ ID NO: 1476549 - RNA, 16 nt, Pseudomonas aeruginosa PA01
cguauuccacgucgcc

SEQ ID NO: 1476550 - RNA, 19 nt, Pseudomonas aeruginosa PA01
cguauuccacgucgccgac

SEQ ID NO: 1476551 - RNA, 15 nt, Pseudomonas aeruginosa PA01
cguauuccaggggca

SEQ ID NO: 1476552 - RNA, 15 nt, Pseudomonas aeruginosa PA01
cgucacgcccugccc

SEQ ID NO: 1476553 - RNA, 11 nt, Pseudomonas aeruginosa PA01
cgucacgccga

SEQ ID NO: 1476554 - RNA, 19 nt, Pseudomonas aeruginosa PA01
cgucacgccgaucccggcg

SEQ ID NO: 1476555 - RNA, 23 nt, Pseudomonas aeruginosa PA01
cgucacgccgaucccggcggcga

SEQ ID NO: 1476556 - RNA, 17 nt, Pseudomonas aeruginosa PA01
cgucacggauaggcggc

SEQ ID NO: 1476557 - RNA, 19 nt, Pseudomonas aeruginosa PA01
cgucacggauaggcggcgg

SEQ ID NO: 1476558 - RNA, 13 nt, Pseudomonas aeruginosa PA01
cgucagcaggucu

SEQ ID NO: 1476559 - RNA, 13 nt, Pseudomonas aeruginosa PA01
cgucagccaggcu

SEQ ID NO: 1476560 - RNA, 14 nt, Pseudomonas aeruginosa PA01
cgucagccaggcug

SEQ ID NO: 1476561 - RNA, 18 nt, Pseudomonas aeruginosa PA01
cgucagccaggcuggcug

SEQ ID NO: 1476562 - RNA, 21 nt, Pseudomonas aeruginosa PA01
cgucaacccuugcucccgccg

SEQ ID NO: 1476563 - RNA, 22 nt, Pseudomonas aeruginosa PA01
cgucaacccuugcucccgccgc

SEQ ID NO: 1476564 - RNA, 21 nt, Pseudomonas aeruginosa PA01
cguacgcccagcagcggcagg

SEQ ID NO: 1476565 - RNA, 14 nt, Pseudomonas aeruginosa PA01
cguacgcccgcagc

SEQ ID NO: 1476566 - RNA, 18 nt, Pseudomonas aeruginosa PA01
cguaccuucgagcaggag

SEQ ID NO: 1476567 - RNA, 21 nt, Pseudomonas aeruginosa PA01
cguaccggcuacaggccguag

SEQ ID NO: 1476568 - RNA, 23 nt, Pseudomonas aeruginosa PA01
cguaccggcuacaggccguagcg

SEQ ID NO: 1476569 - RNA, 21 nt, Pseudomonas aeruginosa PA01
cguacuccagcaacggcaucg

SEQ ID NO: 1476570 - RNA, 16 nt, Pseudomonas aeruginosa PA01
cguacuggcgccaggc

SEQ ID NO: 1476571 - RNA, 14 nt, Pseudomonas aeruginosa PA01
cguacggcgccucg

SEQ ID NO: 1476572 - RNA, 23 nt, Pseudomonas aeruginosa PA01
cguacgaaccccgggccgcgcac

SEQ ID NO: 1476573 - RNA, 18 nt, Pseudomonas aeruginosa PA01
cguacucauggccgcagc

SEQ ID NO: 1476574 - RNA, 21 nt, Pseudomonas aeruginosa PA01
cguacguccagggcaccacgg

SEQ ID NO: 1476575 - RNA, 15 nt, Pseudomonas aeruginosa PA01
cguacggucaugccg

SEQ ID NO: 1476576 - RNA, 17 nt, Pseudomonas aeruginosa PA01
cguagcgcgcggcgagc

SEQ ID NO: 1476577 - RNA, 14 nt, Pseudomonas aeruginosa PA01
cguagcgcggcagc

SEQ ID NO: 1476578 - RNA, 17 nt, Pseudomonas aeruginosa PA01
cguagcgcggcagcgcc

SEQ ID NO: 1476579 - RNA, 21 nt, Pseudomonas aeruginosa PA01
cguagcggaagccgucggcga

SEQ ID NO: 1476580 - RNA, 23 nt, Pseudomonas aeruginosa PA01
cguagcggaagccgucggcgauc

SEQ ID NO: 1476581 - RNA, 16 nt, Pseudomonas aeruginosa PA01
cguagcggccucguuc

SEQ ID NO: 1476582 - RNA, 15 nt, Pseudomonas aeruginosa PA01
cguagcgugccgcca

SEQ ID NO: 1476583 - RNA, 17 nt, Pseudomonas aeruginosa PA01
cguagcugggcgaucac

SEQ ID NO: 1476584 - RNA, 18 nt, Pseudomonas aeruginosa PA01
cguagcugggcgaucacg

SEQ ID NO: 1476585 - RNA, 23 nt, Pseudomonas aeruginosa PA01
cguagacugugguguagcgcagg

SEQ ID NO: 1476586 - RNA, 18 nt, Pseudomonas aeruginosa PA01
cguagagauauucccgcg

SEQ ID NO: 1476587 - RNA, 21 nt, Pseudomonas aeruginosa PA01
cguagagauauucccgcgaca

SEQ ID NO: 1476588 - RNA, 15 nt, Pseudomonas aeruginosa PA01
cguagaggcucggcg

SEQ ID NO: 1476589 - RNA, 17 nt, Pseudomonas aeruginosa PA01
cguagaggcucggcggc

SEQ ID NO: 1476590 - RNA, 20 nt, Pseudomonas aeruginosa PA01
cguagaguucgcugcgcgcc

SEQ ID NO: 1476591 - RNA, 21 nt, Pseudomonas aeruginosa PA01
cguagaguucgcugcgcgcca

SEQ ID NO: 1476592 - RNA, 17 nt, Pseudomonas aeruginosa PA01
cguagaugccggugcug

SEQ ID NO: 1476593 - RNA, 14 nt, Pseudomonas aeruginosa PA01
cguagcgcagcggc

SEQ ID NO: 1476594 - RNA, 12 nt, Pseudomonas aeruginosa PA01
cguagcgcaggu

SEQ ID NO: 1476595 - RNA, 13 nt, Pseudomonas aeruginosa PA01
cguagcgcagguc

SEQ ID NO: 1476596 - RNA, 19 nt, Pseudomonas aeruginosa PA01
cguagcgcaguucgccgcc

SEQ ID NO: 1476597 - RNA, 17 nt, Pseudomonas aeruginosa PA01
cguagccgucgaacagc

SEQ ID NO: 1476598 - RNA, 20 nt, Pseudomonas aeruginosa PA01
cguagccgucgaacagcagc

SEQ ID NO: 1476599 - RNA, 17 nt, Pseudomonas aeruginosa PA01
cguagccgucguagcgc

SEQ ID NO: 1476600 - RNA, 20 nt, Pseudomonas aeruginosa PA01
cguagccgucguagcgcagc

SEQ ID NO: 1476601 - RNA, 23 nt, Pseudomonas aeruginosa PA01
cguagccguauucgaagcucggc

SEQ ID NO: 1476602 - RNA, 16 nt, Pseudomonas aeruginosa PA01
cguagccggcgcggcg

SEQ ID NO: 1476603 - RNA, 20 nt, Pseudomonas aeruginosa PA01
cguagccggcgcggcgcagc

SEQ ID NO: 1476604 - RNA, 23 nt, Pseudomonas aeruginosa PA01
cguagccggcgcggcgcagcggc

SEQ ID NO: 1476605 - RNA, 16 nt, Pseudomonas aeruginosa PA01
cgguuggcggaugacg

SEQ ID NO: 1476606 - RNA, 16 nt, Pseudomonas aeruginosa PA01
cguaaagcaagcccgu

SEQ ID NO: 1476607 - RNA, 15 nt, Pseudomonas aeruginosa PA01
cgguuggcgccccag

SEQ ID NO: 1476608 - RNA, 17 nt, Pseudomonas aeruginosa PA01
cgguuggccucggcccg

SEQ ID NO: 1476609 - RNA, 19 nt, Pseudomonas aeruginosa PA01
cgguuggccucggcccggu

SEQ ID NO: 1476610 - RNA, 19 nt, Pseudomonas aeruginosa PA01
cgguuggcuacccgcaggg

SEQ ID NO: 1476611 - RNA, 21 nt, Pseudomonas aeruginosa PA01
cgguugugcgcccguucgauc

SEQ ID NO: 1476612 - RNA, 17 nt, Pseudomonas aeruginosa PA01
cgguugauagcgcggcc

SEQ ID NO: 1476613 - RNA, 16 nt, Pseudomonas aeruginosa PA01
cgguugaugccgacgu

SEQ ID NO: 1476614 - RNA, 17 nt, Pseudomonas aeruginosa PA01
cgguuccagcggccgcg

SEQ ID NO: 1476615 - RNA, 18 nt, Pseudomonas aeruginosa PA01
cgguuccagcggccgcga

SEQ ID NO: 1476616 - RNA, 22 nt, Pseudomonas aeruginosa PA01
cgguucagcgggacagcuugcc

SEQ ID NO: 1476617 - RNA, 17 nt, Pseudomonas aeruginosa PA01
cgguucagcagcggcac

SEQ ID NO: 1476618 - RNA, 16 nt, Pseudomonas aeruginosa PA01
cgguucacaaagccuu

SEQ ID NO: 1476619 - RNA, 20 nt, Pseudomonas aeruginosa PA01
cgguucacaaagccuugacc

SEQ ID NO: 1476620 - RNA, 17 nt, Pseudomonas aeruginosa PA01
cgguugccgcugcggcg

SEQ ID NO: 1476621 - RNA, 19 nt, Pseudomonas aeruginosa PA01
cgguugccaggccggcgca

SEQ ID NO: 1476622 - RNA, 20 nt, Pseudomonas aeruginosa PA01
cgguugccaggccggcgcau

SEQ ID NO: 1476623 - RNA, 12 nt, Pseudomonas aeruginosa PA01
cgguugcgaccg

SEQ ID NO: 1476624 - RNA, 13 nt, Pseudomonas aeruginosa PA01
cgguuggcccgcg

SEQ ID NO: 1476625 - RNA, 16 nt, Pseudomonas aeruginosa PA01
cgguuggcccgcgccg

SEQ ID NO: 1476626 - RNA, 14 nt, Pseudomonas aeruginosa PA01
cgguuggagcggau

SEQ ID NO: 1476627 - RNA, 18 nt, Pseudomonas aeruginosa PA01
cggugacccacuccggca

SEQ ID NO: 1476628 - RNA, 20 nt, Pseudomonas aeruginosa PA01
cggugacccacuccggcagg

SEQ ID NO: 1476629 - RNA, 16 nt, Pseudomonas aeruginosa PA01
cgguggucuucagcac

SEQ ID NO: 1476630 - RNA, 16 nt, Pseudomonas aeruginosa PA01
cggugaagguccgcgc

SEQ ID NO: 1476631 - RNA, 22 nt, Pseudomonas aeruginosa PA01
cggugaagguccgcgccaugcc

SEQ ID NO: 1476632 - RNA, 16 nt, Pseudomonas aeruginosa PA01
cggugaaguagaucgc

SEQ ID NO: 1476633 - RNA, 17 nt, Pseudomonas aeruginosa PA01
cggugaaguagaucgcc

SEQ ID NO: 1476634 - RNA, 19 nt, Pseudomonas aeruginosa PA01
cggugaaguagaucgcccg

SEQ ID NO: 1476635 - RNA, 15 nt, Pseudomonas aeruginosa PA01
cggugaagcgcggcg

SEQ ID NO: 1476636 - RNA, 18 nt, Pseudomonas aeruginosa PA01
cggugaagcgcggcggcg

SEQ ID NO: 1476637 - RNA, 18 nt, Pseudomonas aeruginosa PA01
cggugacauucgacagca

SEQ ID NO: 1476638 - RNA, 21 nt, Pseudomonas aeruginosa PA01
cggugacacccugccgcgccg

SEQ ID NO: 1476639 - RNA, 22 nt, Pseudomonas aeruginosa PA01
cggugacacccugccgcgccgg

SEQ ID NO: 1476640 - RNA, 14 nt, Pseudomonas aeruginosa PA01
cggugaccagcggc

SEQ ID NO: 1476641 - RNA, 15 nt, Pseudomonas aeruginosa PA01
cggugaccagcggca

SEQ ID NO: 1476642 - RNA, 18 nt, Pseudomonas aeruginosa PA01
cgguguagaccaccagca

SEQ ID NO: 1476643 - RNA, 20 nt, Pseudomonas aeruginosa PA01
cgguguagaccaccagcagg

SEQ ID NO: 1476644 - RNA, 16 nt, Pseudomonas aeruginosa PA01
cgguguaucggcggau

SEQ ID NO: 1476645 - RNA, 12 nt, Pseudomonas aeruginosa PA01
cggugucggcca

SEQ ID NO: 1476646 - RNA, 22 nt, Pseudomonas aeruginosa PA01
cgguguaguucaccguccacug

SEQ ID NO: 1476647 - RNA, 20 nt, Pseudomonas aeruginosa PA01
cgguguugccguggucgcgc

SEQ ID NO: 1476648 - RNA, 17 nt, Pseudomonas aeruginosa PA01
cgguguuguggcuggcc

SEQ ID NO: 1476649 - RNA, 23 nt, Pseudomonas aeruginosa PA01
cgguguuguggcuggccucggcg

SEQ ID NO: 1476650 - RNA, 16 nt, Pseudomonas aeruginosa PA01
cggugugaccuucaac

SEQ ID NO: 1476651 - RNA, 13 nt, Pseudomonas aeruginosa PA01
cggugugacggcc

SEQ ID NO: 1476652 - RNA, 17 nt, Pseudomonas aeruginosa PA01
cggugugaucaccagcc

SEQ ID NO: 1476653 - RNA, 17 nt, Pseudomonas aeruginosa PA01
cgugggaaaucaccgcc

SEQ ID NO: 1476654 - RNA, 14 nt, Pseudomonas aeruginosa PA01
cguggcuuggcccu

SEQ ID NO: 1476655 - RNA, 22 nt, Pseudomonas aeruginosa PA01
cguggcuuggcccugcgcgcgc

SEQ ID NO: 1476656 - RNA, 16 nt, Pseudomonas aeruginosa PA01
cgugggaucgccacgc

SEQ ID NO: 1476657 - RNA, 22 nt, Pseudomonas aeruginosa PA01
cgugggaucgccacgccggcgc

SEQ ID NO: 1476658 - RNA, 13 nt, Pseudomonas aeruginosa PA01
cgugggcaacagg

SEQ ID NO: 1476659 - RNA, 18 nt, Pseudomonas aeruginosa PA01
cgugggcaacaggccgau

SEQ ID NO: 1476660 - RNA, 13 nt, Pseudomonas aeruginosa PA01
cguggcucggcgg

SEQ ID NO: 1476661 - RNA, 17 nt, Pseudomonas aeruginosa PA01
cguggcucggcggcagg

SEQ ID NO: 1476662 - RNA, 15 nt, Pseudomonas aeruginosa PA01
cguggcuucguccag

SEQ ID NO: 1476663 - RNA, 20 nt, Pseudomonas aeruginosa PA01
cguggcuucguccagcgagg

SEQ ID NO: 1476664 - RNA, 16 nt, Pseudomonas aeruginosa PA01
cguggcuggcgccgcg

SEQ ID NO: 1476665 - RNA, 15 nt, Pseudomonas aeruginosa PA01
cguggcugugcuggc

SEQ ID NO: 1476666 - RNA, 16 nt, Pseudomonas aeruginosa PA01
cguggcugugcuggcc

SEQ ID NO: 1476667 - RNA, 22 nt, Pseudomonas aeruginosa PA01
cguggcugugcuggccacccuu

SEQ ID NO: 1476668 - RNA, 14 nt, Pseudomonas aeruginosa PA01
cgugggcgccgccg

SEQ ID NO: 1476669 - RNA, 18 nt, Pseudomonas aeruginosa PA01
cgugggcgccgccgguga

SEQ ID NO: 1476670 - RNA, 19 nt, Pseudomonas aeruginosa PA01
cgugggcgccgccggugaa

SEQ ID NO: 1476671 - RNA, 13 nt, Pseudomonas aeruginosa PA01
cgugggcgccggc

SEQ ID NO: 1476672 - RNA, 20 nt, Pseudomonas aeruginosa PA01
cgugggcgccggcgcgcagg

SEQ ID NO: 1476673 - RNA, 18 nt, Pseudomonas aeruginosa PA01
cgugggccugcucggaga

SEQ ID NO: 1476674 - RNA, 15 nt, Pseudomonas aeruginosa PA01
cgugggccgguuccg

SEQ ID NO: 1476675 - RNA, 23 nt, Pseudomonas aeruginosa PA01
cgugggccgguuccgaaucgccu

SEQ ID NO: 1476676 - RNA, 12 nt, Pseudomonas aeruginosa PA01
cgugggccgccg

SEQ ID NO: 1476677 - RNA, 13 nt, Pseudomonas aeruginosa PA01
cgugggccgccga

SEQ ID NO: 1476678 - RNA, 14 nt, Pseudomonas aeruginosa PA01
cgugggccgccgaa

SEQ ID NO: 1476679 - RNA, 17 nt, Pseudomonas aeruginosa PA01
cgugggccagcaggccg

SEQ ID NO: 1476680 - RNA, 15 nt, Pseudomonas aeruginosa PA01
cgugggccagcccag

SEQ ID NO: 1476681 - RNA, 23 nt, Pseudomonas aeruginosa PA01
cgugggccagcccagaacagcaa

SEQ ID NO: 1476682 - RNA, 14 nt, Pseudomonas aeruginosa PA01
cguggcgggccagc

SEQ ID NO: 1476683 - RNA, 16 nt, Pseudomonas aeruginosa PA01
cguggcgggccagcag

SEQ ID NO: 1476684 - RNA, 18 nt, Pseudomonas aeruginosa PA01
cguggcgggccagcaggc

SEQ ID NO: 1476685 - RNA, 17 nt, Pseudomonas aeruginosa PA01
cguggcggaaggucagg

SEQ ID NO: 1476686 - RNA, 21 nt, Pseudomonas aeruginosa PA01
cguggcggacaacccggcgcu

SEQ ID NO: 1476687 - RNA, 14 nt, Pseudomonas aeruginosa PA01
cguggcggccgccg

SEQ ID NO: 1476688 - RNA, 20 nt, Pseudomonas aeruginosa PA01
cguggcggccgccgcgcagc

SEQ ID NO: 1476689 - RNA, 15 nt, Pseudomonas aeruginosa PA01
cguggcggccgccgg

SEQ ID NO: 1476690 - RNA, 16 nt, Pseudomonas aeruginosa PA01
cguggcggccgccggc

SEQ ID NO: 1476691 - RNA, 17 nt, Pseudomonas aeruginosa PA01
cguggcggccgccggcg

SEQ ID NO: 1476692 - RNA, 16 nt, Pseudomonas aeruginosa PA01
cguggcgugcucggcg

SEQ ID NO: 1476693 - RNA, 19 nt, Pseudomonas aeruginosa PA01
cguggcgugcucggcgauc

SEQ ID NO: 1476694 - RNA, 15 nt, Pseudomonas aeruginosa PA01
cguggcucgaucagc

SEQ ID NO: 1476695 - RNA, 18 nt, Pseudomonas aeruginosa PA01
cguggcucgaucagccgg

SEQ ID NO: 1476696 - RNA, 22 nt, Pseudomonas aeruginosa PA01
cguggcucgaucagccggcgcg

SEQ ID NO: 1476697 - RNA, 18 nt, Pseudomonas aeruginosa PA01
cguggcgccggcgcgcuu

SEQ ID NO: 1476698 - RNA, 14 nt, Pseudomonas aeruginosa PA01
cguggcgcgaaucc

SEQ ID NO: 1476699 - RNA, 16 nt, Pseudomonas aeruginosa PA01
cguggcgccggcgcgc

SEQ ID NO: 1476700 - RNA, 19 nt, Pseudomonas aeruginosa PA01
cguggcgcuugagcagcca

SEQ ID NO: 1476701 - RNA, 21 nt, Pseudomonas aeruginosa PA01
cguggcgcuugagcagccagg

SEQ ID NO: 1476702 - RNA, 22 nt, Pseudomonas aeruginosa PA01
cguggcgcuugagcagccaggc

SEQ ID NO: 1476703 - RNA, 18 nt, Pseudomonas aeruginosa PA01
cguggcgaucaggcagcg

SEQ ID NO: 1476704 - RNA, 23 nt, Pseudomonas aeruginosa PA01
cguggcgaucaggcagcgcgcgg

SEQ ID NO: 1476705 - RNA, 18 nt, Pseudomonas aeruginosa PA01
cguggcgaacgcccggcu

SEQ ID NO: 1476706 - RNA, 17 nt, Pseudomonas aeruginosa PA01
cguggccggcgaccagc

SEQ ID NO: 1476707 - RNA, 12 nt, Pseudomonas aeruginosa PA01
cguggccggcgc

SEQ ID NO: 1476708 - RNA, 19 nt, Pseudomonas aeruginosa PA01
cguggccgcccaucgaggu

SEQ ID NO: 1476709 - RNA, 19 nt, Pseudomonas aeruginosa PA01
cguggccgcgggaggccgc

SEQ ID NO: 1476710 - RNA, 19 nt, Pseudomonas aeruginosa PA01
cguggcauucgucgccgcu

SEQ ID NO: 1476711 - RNA, 19 nt, Pseudomonas aeruginosa PA01
cguggccagcgcccaggcc

SEQ ID NO: 1476712 - RNA, 21 nt, Pseudomonas aeruginosa PA01
cguggccauagagccgcuggg

SEQ ID NO: 1476713 - RNA, 23 nt, Pseudomonas aeruginosa PA01
cguggccagcgaacccaggccgc

SEQ ID NO: 1476714 - RNA, 24 nt, Pseudomonas aeruginosa PA01
cguggccagcgaacccaggccgcg

SEQ ID NO: 1476715 - RNA, 17 nt, Pseudomonas aeruginosa PA01
cguggccauggguaucg

SEQ ID NO: 1476716 - RNA, 14 nt, Pseudomonas aeruginosa PA01
cguggcccggcgcg

SEQ ID NO: 1476717 - RNA, 18 nt, Pseudomonas aeruginosa PA01
cguggccgcgaaccgggu

SEQ ID NO: 1476718 - RNA, 21 nt, Pseudomonas aeruginosa PA01
cguggcacguacguccagggc

SEQ ID NO: 1476719 - RNA, 22 nt, Pseudomonas aeruginosa PA01
cguggcaggcgcccggucaggu

SEQ ID NO: 1476720 - RNA, 14 nt, Pseudomonas aeruginosa PA01
cguggugauguccc

SEQ ID NO: 1476721 - RNA, 18 nt, Pseudomonas aeruginosa PA01
cguggugcauccgccgca

SEQ ID NO: 1476722 - RNA, 19 nt, Pseudomonas aeruginosa PA01
cguggugcauccgccgcag

SEQ ID NO: 1476723 - RNA, 20 nt, Pseudomonas aeruginosa PA01
cguggugcauccgccgcaga

SEQ ID NO: 1476724 - RNA, 14 nt, Pseudomonas aeruginosa PA01
cguggugcuaucga

SEQ ID NO: 1476725 - RNA, 18 nt, Pseudomonas aeruginosa PA01
cguggugacgguccgcgc

SEQ ID NO: 1476726 - RNA, 17 nt, Pseudomonas aeruginosa PA01
cgugguccgccagcagg

SEQ ID NO: 1476727 - RNA, 16 nt, Pseudomonas aeruginosa PA01
cguggucgcgcaggcg

SEQ ID NO: 1476728 - RNA, 13 nt, Pseudomonas aeruginosa PA01
cguggucggcggc

SEQ ID NO: 1476729 - RNA, 14 nt, Pseudomonas aeruginosa PA01
cguggucggcggcc

SEQ ID NO: 1476730 - RNA, 17 nt, Pseudomonas aeruginosa PA01
cguggucggcggccucg

SEQ ID NO: 1476731 - RNA, 14 nt, Pseudomonas aeruginosa PA01
cguggucauggcgc

SEQ ID NO: 1476732 - RNA, 17 nt, Pseudomonas aeruginosa PA01
cguggucauggcgcaga

SEQ ID NO: 1476733 - RNA, 18 nt, Pseudomonas aeruginosa PA01
cguggucauggcgcagac

SEQ ID NO: 1476734 - RNA, 16 nt, Pseudomonas aeruginosa PA01
cgugguagucgagccg

SEQ ID NO: 1476735 - RNA, 17 nt, Pseudomonas aeruginosa PA01
cgugggguauuccaggc

SEQ ID NO: 1476736 - RNA, 18 nt, Pseudomonas aeruginosa PA01
cgugggggauuuccucgu

SEQ ID NO: 1476737 - RNA, 20 nt, Pseudomonas aeruginosa PA01
cgugggggggaagggccgga

SEQ ID NO: 1476738 - RNA, 18 nt, Pseudomonas aeruginosa PA01
cguggguccacgccgggc

SEQ ID NO: 1476739 - RNA, 17 nt, Pseudomonas aeruginosa PA01
cgugggugccgggggcg

SEQ ID NO: 1476740 - RNA, 19 nt, Pseudomonas aeruginosa PA01
cguggggaagacggccagg

SEQ ID NO: 1476741 - RNA, 14 nt, Pseudomonas aeruginosa PA01
cguggggcggcgca

SEQ ID NO: 1476742 - RNA, 15 nt, Pseudomonas aeruginosa PA01
cguggggcggcgcag

SEQ ID NO: 1476743 - RNA, 15 nt, Pseudomonas aeruginosa PA01
cgugggcggccggcc

SEQ ID NO: 1476744 - RNA, 16 nt, Pseudomonas aeruginosa PA01
cgugggcggucggcga

SEQ ID NO: 1476745 - RNA, 15 nt, Pseudomonas aeruginosa PA01
cgugggcuucgccgc

SEQ ID NO: 1476746 - RNA, 20 nt, Pseudomonas aeruginosa PA01
cgugggcuucgccgccgcgc

SEQ ID NO: 1476747 - RNA, 13 nt, Pseudomonas aeruginosa PA01
cgugguggccgug

SEQ ID NO: 1476748 - RNA, 12 nt, Pseudomonas aeruginosa PA01
cgugguggcggg

SEQ ID NO: 1476749 - RNA, 23 nt, Pseudomonas aeruginosa PA01
cgugguugaggcgcucguagagc

SEQ ID NO: 1476750 - RNA, 15 nt, Pseudomonas aeruginosa PA01
cguguaccacgcccg

SEQ ID NO: 1476751 - RNA, 18 nt, Pseudomonas aeruginosa PA01
cgugucgaggaaggccag

SEQ ID NO: 1476752 - RNA, 22 nt, Pseudomonas aeruginosa PA01
cgugucgaggaaggccagcagg

SEQ ID NO: 1476753 - RNA, 12 nt, Pseudomonas aeruginosa PA01
cgugucgagggc

SEQ ID NO: 1476754 - RNA, 23 nt, Pseudomonas aeruginosa PA01
cgugucgagggcgaacagcagcg

SEQ ID NO: 1476755 - RNA, 21 nt, Pseudomonas aeruginosa PA01
cgugucgagggcugggcagcg

SEQ ID NO: 1476756 - RNA, 13 nt, Pseudomonas aeruginosa PA01
cguucagcccacc

SEQ ID NO: 1476757 - RNA, 18 nt, Pseudomonas aeruginosa PA01
cguucagcgccucgcggg

SEQ ID NO: 1476758 - RNA, 15 nt, Pseudomonas aeruginosa PA01
cguucacgccuggcg

SEQ ID NO: 1476759 - RNA, 18 nt, Pseudomonas aeruginosa PA01
cguucacguugaccugcg

SEQ ID NO: 1476760 - RNA, 12 nt, Pseudomonas aeruginosa PA01
cguucaggccgg

SEQ ID NO: 1476761 - RNA, 16 nt, Pseudomonas aeruginosa PA01
cguucaggccggcgcc

SEQ ID NO: 1476762 - RNA, 18 nt, Pseudomonas aeruginosa PA01
cguucaggccggcgccgc

SEQ ID NO: 1476763 - RNA, 21 nt, Pseudomonas aeruginosa PA01
cguucaggccggcgccgccga

SEQ ID NO: 1476764 - RNA, 23 nt, Pseudomonas aeruginosa PA01
cguucaggccggcgccgccgaac

SEQ ID NO: 1476765 - RNA, 16 nt, Pseudomonas aeruginosa PA01
cguucagucccgcggc

SEQ ID NO: 1476766 - RNA, 15 nt, Pseudomonas aeruginosa PA01
cguucagggucaggu

SEQ ID NO: 1476767 - RNA, 22 nt, Pseudomonas aeruginosa PA01
cguuccaucgcaggcagcgcgc

SEQ ID NO: 1476768 - RNA, 14 nt, Pseudomonas aeruginosa PA01
cguuccagcgccuc

SEQ ID NO: 1476769 - RNA, 20 nt, Pseudomonas aeruginosa PA01
cguuccagcgccucgggccg

SEQ ID NO: 1476770 - RNA, 13 nt, Pseudomonas aeruginosa PA01
cguuccagcggca

SEQ ID NO: 1476771 - RNA, 15 nt, Pseudomonas aeruginosa PA01
cguuccagcggcacu

SEQ ID NO: 1476772 - RNA, 17 nt, Pseudomonas aeruginosa PA01
cguuccagcggcacuuc

SEQ ID NO: 1476773 - RNA, 12 nt, Pseudomonas aeruginosa PA01
cguuccagcucc

SEQ ID NO: 1476774 - RNA, 15 nt, Pseudomonas aeruginosa PA01
cguuccagcucggcg

SEQ ID NO: 1476775 - RNA, 17 nt, Pseudomonas aeruginosa PA01
cguuccagcucggcgag

SEQ ID NO: 1476776 - RNA, 17 nt, Pseudomonas aeruginosa PA01
cguuccagcucggugcc

SEQ ID NO: 1476777 - RNA, 12 nt, Pseudomonas aeruginosa PA01
cguuccaggcgg

SEQ ID NO: 1476778 - RNA, 18 nt, Pseudomonas aeruginosa PA01
cguuccagggcgaagucg

SEQ ID NO: 1476779 - RNA, 18 nt, Pseudomonas aeruginosa PA01
cguuccacgggucgcagc

SEQ ID NO: 1476780 - RNA, 20 nt, Pseudomonas aeruginosa PA01
cguuccacgggucgcagccg

SEQ ID NO: 1476781 - RNA, 14 nt, Pseudomonas aeruginosa PA01
cguuccagcaccuc

SEQ ID NO: 1476782 - RNA, 19 nt, Pseudomonas aeruginosa PA01
cguuccagcaccucgcggg

SEQ ID NO: 1476783 - RNA, 18 nt, Pseudomonas aeruginosa PA01
cguucaguucugggcggc

SEQ ID NO: 1476784 - RNA, 23 nt, Pseudomonas aeruginosa PA01
cguucaguucugggcggccaggu

SEQ ID NO: 1476785 - RNA, 23 nt, Pseudomonas aeruginosa PA01
cguucagccacggacgcgcaggg

SEQ ID NO: 1476786 - RNA, 16 nt, Pseudomonas aeruginosa PA01
cguucauguagcgcuc

SEQ ID NO: 1476787 - RNA, 16 nt, Pseudomonas aeruginosa PA01
cguucaugucggcucc

SEQ ID NO: 1476788 - RNA, 14 nt, Pseudomonas aeruginosa PA01
cguuccaccaggcg

SEQ ID NO: 1476789 - RNA, 20 nt, Pseudomonas aeruginosa PA01
cguuccaccaggcgucgcac

SEQ ID NO: 1476790 - RNA, 15 nt, Pseudomonas aeruginosa PA01
cguuccaccgccugg

SEQ ID NO: 1476791 - RNA, 14 nt, Pseudomonas aeruginosa PA01
cguuccaccuggcg

SEQ ID NO: 1476792 - RNA, 18 nt, Pseudomonas aeruginosa PA01
cguuccaccuggcgcagg

SEQ ID NO: 1476793 - RNA, 19 nt, Pseudomonas aeruginosa PA01
cguuccaccuggcgcaggu

SEQ ID NO: 1476794 - RNA, 23 nt, Pseudomonas aeruginosa PA01
cguuccaccuggcgcagguagaa

SEQ ID NO: 1476795 - RNA, 21 nt, Pseudomonas aeruginosa PA01
cguuccacgaaaaagcccggc

SEQ ID NO: 1476796 - RNA, 23 nt, Pseudomonas aeruginosa PA01
cguuccacgaaaaagcccggcau

SEQ ID NO: 1476797 - RNA, 18 nt, Pseudomonas aeruginosa PA01
cguucggaucggcccggc

SEQ ID NO: 1476798 - RNA, 14 nt, Pseudomonas aeruginosa PA01
cguucgcuguucuu

SEQ ID NO: 1476799 - RNA, 23 nt, Pseudomonas aeruginosa PA01
cguucggcgaugccgcgccaggc

SEQ ID NO: 1476800 - RNA, 18 nt, Pseudomonas aeruginosa PA01
cguucugcacaugcacca

SEQ ID NO: 1476801 - RNA, 16 nt, Pseudomonas aeruginosa PA01
cguucugcccgccggc

SEQ ID NO: 1476802 - RNA, 19 nt, Pseudomonas aeruginosa PA01
cguucugcccgccggcgcc

SEQ ID NO: 1476803 - RNA, 24 nt, Pseudomonas aeruginosa PA01
cguucugcccgccggcgcccuggg

SEQ ID NO: 1476804 - RNA, 16 nt, Pseudomonas aeruginosa PA01
cguucugccgcagcgc

SEQ ID NO: 1476805 - RNA, 22 nt, Pseudomonas aeruginosa PA01
cguucugcucgcugcccgacgg

SEQ ID NO: 1476806 - RNA, 17 nt, Pseudomonas aeruginosa PA01
cguucugcugcuugcgc

SEQ ID NO: 1476807 - RNA, 18 nt, Pseudomonas aeruginosa PA01
cguucugggucgcgcagg

SEQ ID NO: 1476808 - RNA, 21 nt, Pseudomonas aeruginosa PA01
cguucugggucgcgcagggca

SEQ ID NO: 1476809 - RNA, 23 nt, Pseudomonas aeruginosa PA01
cguucugggucgcgcagggcagc

SEQ ID NO: 1476810 - RNA, 23 nt, Pseudomonas aeruginosa PA01
cguucgcuccagucggggcaggc

SEQ ID NO: 1476811 - RNA, 15 nt, Pseudomonas aeruginosa PA01
cguucgcgggcgccg

SEQ ID NO: 1476812 - RNA, 20 nt, Pseudomonas aeruginosa PA01
cguucgccgaggcggcgcag

SEQ ID NO: 1476813 - RNA, 21 nt, Pseudomonas aeruginosa PA01
cguucgccgaggcggcgcagc

SEQ ID NO: 1476814 - RNA, 14 nt, Pseudomonas aeruginosa PA01
cguucgccgagggc

SEQ ID NO: 1476815 - RNA, 16 nt, Pseudomonas aeruginosa PA01
cguucccagcagcgcc

SEQ ID NO: 1476816 - RNA, 20 nt, Pseudomonas aeruginosa PA01
cguucccagcagcgccucgg

SEQ ID NO: 1476817 - RNA, 19 nt, Pseudomonas aeruginosa PA01
cguucgacgcugcuaggcu

SEQ ID NO: 1476818 - RNA, 18 nt, Pseudomonas aeruginosa PA01
cguucgcccagaccugca

SEQ ID NO: 1476819 - RNA, 22 nt, Pseudomonas aeruginosa PA01
cguucgcccgcggcggcgacgc

SEQ ID NO: 1476820 - RNA, 16 nt, Pseudomonas aeruginosa PA01
cguucgaucuccucgc

SEQ ID NO: 1476821 - RNA, 13 nt, Pseudomonas aeruginosa PA01
cgugugcagcagg

SEQ ID NO: 1476822 - RNA, 22 nt, Pseudomonas aeruginosa PA01
cguguggcgaaacuccagcagg

SEQ ID NO: 1476823 - RNA, 12 nt, Pseudomonas aeruginosa PA01
cgugucgacgac

SEQ ID NO: 1476824 - RNA, 17 nt, Pseudomonas aeruginosa PA01
cguuaaccugccugcgc

SEQ ID NO: 1476825 - RNA, 22 nt, Pseudomonas aeruginosa PA01
cguguugaucgccgcgccgccg

SEQ ID NO: 1476826 - RNA, 14 nt, Pseudomonas aeruginosa PA01
cguguugcagcaga

SEQ ID NO: 1476827 - RNA, 23 nt, Pseudomonas aeruginosa PA01
cguguucgcggcucuggcgcagg

SEQ ID NO: 1476828 - RNA, 14 nt, Pseudomonas aeruginosa PA01
cguguucggccagc

SEQ ID NO: 1476829 - RNA, 21 nt, Pseudomonas aeruginosa PA01
cguguucggccagccggcgcc

SEQ ID NO: 1476830 - RNA, 14 nt, Pseudomonas aeruginosa PA01
cguguucggcggcu

SEQ ID NO: 1476831 - RNA, 14 nt, Pseudomonas aeruginosa PA01
cguuacgccggguu

SEQ ID NO: 1476832 - RNA, 16 nt, Pseudomonas aeruginosa PA01
cguuaccguccgcgcc

SEQ ID NO: 1476833 - RNA, 16 nt, Pseudomonas aeruginosa PA01
cguuauucgcccuacc

SEQ ID NO: 1476834 - RNA, 20 nt, Pseudomonas aeruginosa PA01
cguucaccccgcccuuggcg

SEQ ID NO: 1476835 - RNA, 16 nt, Pseudomonas aeruginosa PA01
cguucaaagcccgccu

SEQ ID NO: 1476836 - RNA, 16 nt, Pseudomonas aeruginosa PA01
cguuauccgccgauac

SEQ ID NO: 1476837 - RNA, 15 nt, Pseudomonas aeruginosa PA01
cguuauccgccgccg

SEQ ID NO: 1476838 - RNA, 16 nt, Pseudomonas aeruginosa PA01
cguuauccgccgccga

SEQ ID NO: 1476839 - RNA, 21 nt, Pseudomonas aeruginosa PA01
cguuauccgccgcucacccug

SEQ ID NO: 1476840 - RNA, 13 nt, Pseudomonas aeruginosa PA01
cguuaucgccggu

SEQ ID NO: 1476841 - RNA, 15 nt, Pseudomonas aeruginosa PA01
cguuagcucagucgg

SEQ ID NO: 1476842 - RNA, 20 nt, Pseudomonas aeruginosa PA01
cguuagcucagucgguagag

SEQ ID NO: 1476843 - RNA, 18 nt, Pseudomonas aeruginosa PA01
cgucucggagugaggccg

SEQ ID NO: 1476844 - RNA, 20 nt, Pseudomonas aeruginosa PA01
cgucucggagugaggccgag

SEQ ID NO: 1476845 - RNA, 20 nt, Pseudomonas aeruginosa PA01
cgucucggugcucaggcggc

SEQ ID NO: 1476846 - RNA, 21 nt, Pseudomonas aeruginosa PA01
cgucucggugcucaggcggcc

SEQ ID NO: 1476847 - RNA, 23 nt, Pseudomonas aeruginosa PA01
cgucucggcgaacgacagcacca

SEQ ID NO: 1476848 - RNA, 18 nt, Pseudomonas aeruginosa PA01
cgucuuauucgacgcucu

SEQ ID NO: 1476849 - RNA, 16 nt, Pseudomonas aeruginosa PA01
cgucuguucggccagg

SEQ ID NO: 1476850 - RNA, 20 nt, Pseudomonas aeruginosa PA01
cgucugugccgaggccgccg

SEQ ID NO: 1476851 - RNA, 21 nt, Pseudomonas aeruginosa PA01
cgucugugccgaggccgccgc

SEQ ID NO: 1476852 - RNA, 14 nt, Pseudomonas aeruginosa PA01
cgugacccgcgcuu

SEQ ID NO: 1476853 - RNA, 11 nt, Pseudomonas aeruginosa PA01
cgugaccagca

SEQ ID NO: 1476854 - RNA, 14 nt, Pseudomonas aeruginosa PA01
cgugaccagcaugg

SEQ ID NO: 1476855 - RNA, 22 nt, Pseudomonas aeruginosa PA01
cgugaccauaggcuugcgccga

SEQ ID NO: 1476856 - RNA, 19 nt, Pseudomonas aeruginosa PA01
cgucuucgaugaaggucag

SEQ ID NO: 1476857 - RNA, 18 nt, Pseudomonas aeruginosa PA01
cgucuucaguaggccagc

SEQ ID NO: 1476858 - RNA, 21 nt, Pseudomonas aeruginosa PA01
cgucuuccggcucgccgcgcu

SEQ ID NO: 1476859 - RNA, 16 nt, Pseudomonas aeruginosa PA01
cgucuuccagcggcca

SEQ ID NO: 1476860 - RNA, 21 nt, Pseudomonas aeruginosa PA01
cgucuuccagcggccacggcg

SEQ ID NO: 1476861 - RNA, 19 nt, Pseudomonas aeruginosa PA01
cgucuuccagggcggcgcg

SEQ ID NO: 1476862 - RNA, 22 nt, Pseudomonas aeruginosa PA01
cgucguuuuguccggcggcugc

SEQ ID NO: 1476863 - RNA, 14 nt, Pseudomonas aeruginosa PA01
cgucguuggccggc

SEQ ID NO: 1476864 - RNA, 16 nt, Pseudomonas aeruginosa PA01
cgucguuggccggcug

SEQ ID NO: 1476865 - RNA, 18 nt, Pseudomonas aeruginosa PA01
cgucguuucauucgucgc

SEQ ID NO: 1476866 - RNA, 17 nt, Pseudomonas aeruginosa PA01
cgucguuucucggcgau

SEQ ID NO: 1476867 - RNA, 18 nt, Pseudomonas aeruginosa PA01
cgucguuucucggcgaug

SEQ ID NO: 1476868 - RNA, 15 nt, Pseudomonas aeruginosa PA01
cgucgugcgccggcc

SEQ ID NO: 1476869 - RNA, 18 nt, Pseudomonas aeruginosa PA01
cgucggggugccgccagu

SEQ ID NO: 1476870 - RNA, 13 nt, Pseudomonas aeruginosa PA01
cgucgggggcgcg

SEQ ID NO: 1476871 - RNA, 21 nt, Pseudomonas aeruginosa PA01
cgucgggcgggaucaggucgc

SEQ ID NO: 1476872 - RNA, 16 nt, Pseudomonas aeruginosa PA01
cgucggcuucgcccau

SEQ ID NO: 1476873 - RNA, 20 nt, Pseudomonas aeruginosa PA01
cgucggcuucgcccauggca

SEQ ID NO: 1476874 - RNA, 14 nt, Pseudomonas aeruginosa PA01
cgucggcugcgcug

SEQ ID NO: 1476875 - RNA, 20 nt, Pseudomonas aeruginosa PA01
cgucggcugcgcugggcgcc

SEQ ID NO: 1476876 - RNA, 15 nt, Pseudomonas aeruginosa PA01
cgucggcuccgcuca

SEQ ID NO: 1476877 - RNA, 19 nt, Pseudomonas aeruginosa PA01
cgucggcucgguuccagcu

SEQ ID NO: 1476878 - RNA, 23 nt, Pseudomonas aeruginosa PA01
cgucggcgugcugggucuccucc

SEQ ID NO: 1476879 - RNA, 21 nt, Pseudomonas aeruginosa PA01
cgucggcguccauggcggcga

SEQ ID NO: 1476880 - RNA, 17 nt, Pseudomonas aeruginosa PA01
cgucggcgucgaggugc

SEQ ID NO: 1476881 - RNA, 18 nt, Pseudomonas aeruginosa PA01
cgucgcgguacagccggu

SEQ ID NO: 1476882 - RNA, 20 nt, Pseudomonas aeruginosa PA01
cgucgcgguacagccgguug

SEQ ID NO: 1476883 - RNA, 16 nt, Pseudomonas aeruginosa PA01
cgucgcgucgcacccg

SEQ ID NO: 1476884 - RNA, 22 nt, Pseudomonas aeruginosa PA01
cgucgcgucggccuggcgcagc

SEQ ID NO: 1476885 - RNA, 19 nt, Pseudomonas aeruginosa PA01
cgucgcggucuuccgccga

SEQ ID NO: 1476886 - RNA, 20 nt, Pseudomonas aeruginosa PA01
cgucgcggucuuccgccgac

SEQ ID NO: 1476887 - RNA, 14 nt, Pseudomonas aeruginosa PA01
cgucguaggccgag

SEQ ID NO: 1476888 - RNA, 21 nt, Pseudomonas aeruginosa PA01
cgucguaggccgagcccaccg

SEQ ID NO: 1476889 - RNA, 21 nt, Pseudomonas aeruginosa PA01
cgucguagcccuucuccgcca

SEQ ID NO: 1476890 - RNA, 13 nt, Pseudomonas aeruginosa PA01
cgucguagcgcag

SEQ ID NO: 1476891 - RNA, 22 nt, Pseudomonas aeruginosa PA01
cgucguagagcgugcggccgau

SEQ ID NO: 1476892 - RNA, 17 nt, Pseudomonas aeruginosa PA01
cgucguaguggccgucg

SEQ ID NO: 1476893 - RNA, 18 nt, Pseudomonas aeruginosa PA01
cgucguaguggccgucga

SEQ ID NO: 1476894 - RNA, 20 nt, Pseudomonas aeruginosa PA01
cgucguaguggccgucgaag

SEQ ID NO: 1476895 - RNA, 17 nt, Pseudomonas aeruginosa PA01
cgucguacucggcgggg

SEQ ID NO: 1476896 - RNA, 15 nt, Pseudomonas aeruginosa PA01
cgucgggucgacccg

SEQ ID NO: 1476897 - RNA, 19 nt, Pseudomonas aeruginosa PA01
cgucgucgcugcgcggguc

SEQ ID NO: 1476898 - RNA, 14 nt, Pseudomonas aeruginosa PA01
cgucgucggcgacc

SEQ ID NO: 1476899 - RNA, 19 nt, Pseudomonas aeruginosa PA01
cgucgucgcggcgccuggc

SEQ ID NO: 1476900 - RNA, 11 nt, Pseudomonas aeruginosa PA01
cgucgucggcg

SEQ ID NO: 1476901 - RNA, 16 nt, Pseudomonas aeruginosa PA01
cgucgucaccucggcg

SEQ ID NO: 1476902 - RNA, 20 nt, Pseudomonas aeruginosa PA01
cgucgucaccucggcgccau

SEQ ID NO: 1476903 - RNA, 14 nt, Pseudomonas aeruginosa PA01
cgucgucgaggcug

SEQ ID NO: 1476904 - RNA, 17 nt, Pseudomonas aeruginosa PA01
cgugagcugggcaggcu

SEQ ID NO: 1476905 - RNA, 16 nt, Pseudomonas aeruginosa PA01
cgugacgucggcggcg

SEQ ID NO: 1476906 - RNA, 17 nt, Pseudomonas aeruginosa PA01
cgugacgucggcggcgg

SEQ ID NO: 1476907 - RNA, 24 nt, Pseudomonas aeruginosa PA01
cgugaccguccagcgcgccgcgca

SEQ ID NO: 1476908 - RNA, 17 nt, Pseudomonas aeruginosa PA01
cgugcaugccgacgagc

SEQ ID NO: 1476909 - RNA, 22 nt, Pseudomonas aeruginosa PA01
cgugcaugccgacgagcagcuc

SEQ ID NO: 1476910 - RNA, 14 nt, Pseudomonas aeruginosa PA01
cgugcauggccggg

SEQ ID NO: 1476911 - RNA, 19 nt, Pseudomonas aeruginosa PA01
cgugcauggccgggccgau

SEQ ID NO: 1476912 - RNA, 17 nt, Pseudomonas aeruginosa PA01
cgugcaccagcaggcga

SEQ ID NO: 1476913 - RNA, 13 nt, Pseudomonas aeruginosa PA01
cgugcaccgaggc

SEQ ID NO: 1476914 - RNA, 21 nt, Pseudomonas aeruginosa PA01
cgugcaccgaggcgcgccgac

SEQ ID NO: 1476915 - RNA, 23 nt, Pseudomonas aeruginosa PA01
cgugcaccgaggcgcgccgacag

SEQ ID NO: 1476916 - RNA, 24 nt, Pseudomonas aeruginosa PA01
cgugcaccgaggcgcgccgacagc

SEQ ID NO: 1476917 - RNA, 16 nt, Pseudomonas aeruginosa PA01
cgugccccgacugucg

SEQ ID NO: 1476918 - RNA, 20 nt, Pseudomonas aeruginosa PA01
cgugcccauccgcucggcga

SEQ ID NO: 1476919 - RNA, 16 nt, Pseudomonas aeruginosa PA01
cgugccccaggccgaa

SEQ ID NO: 1476920 - RNA, 18 nt, Pseudomonas aeruginosa PA01
cgugccaggcgcucgcgc

SEQ ID NO: 1476921 - RNA, 15 nt, Pseudomonas aeruginosa PA01
cgugccaggcggcag

SEQ ID NO: 1476922 - RNA, 16 nt, Pseudomonas aeruginosa PA01
cgugccaggcggcagc

SEQ ID NO: 1476923 - RNA, 13 nt, Pseudomonas aeruginosa PA01
cgugccagcaccu

SEQ ID NO: 1476924 - RNA, 17 nt, Pseudomonas aeruginosa PA01
cgugccaucaggccgcg

SEQ ID NO: 1476925 - RNA, 17 nt, Pseudomonas aeruginosa PA01
cgugcaucaccuugucg

SEQ ID NO: 1476926 - RNA, 13 nt, Pseudomonas aeruginosa PA01
cgugcgcgccgcc

SEQ ID NO: 1476927 - RNA, 15 nt, Pseudomonas aeruginosa PA01
cgugcgcgccgccgg

SEQ ID NO: 1476928 - RNA, 16 nt, Pseudomonas aeruginosa PA01
cgugcgcgccgccggg

SEQ ID NO: 1476929 - RNA, 15 nt, Pseudomonas aeruginosa PA01
cgugcgcgcccucgg

SEQ ID NO: 1476930 - RNA, 23 nt, Pseudomonas aeruginosa PA01
cgugcgccgcgggucaccagcgc

SEQ ID NO: 1476931 - RNA, 14 nt, Pseudomonas aeruginosa PA01
cgugcgccgcucgc

SEQ ID NO: 1476932 - RNA, 17 nt, Pseudomonas aeruginosa PA01
cgugcggaaaccgcggc

SEQ ID NO: 1476933 - RNA, 21 nt, Pseudomonas aeruginosa PA01
cgugcggaaaccgcggccggc

SEQ ID NO: 1476934 - RNA, 22 nt, Pseudomonas aeruginosa PA01
cgugcggagggucaggccgagg

SEQ ID NO: 1476935 - RNA, 21 nt, Pseudomonas aeruginosa PA01
cgugcgcugguaccugccggc

SEQ ID NO: 1476936 - RNA, 16 nt, Pseudomonas aeruginosa PA01
cgugcgcuccgccagg

SEQ ID NO: 1476937 - RNA, 17 nt, Pseudomonas aeruginosa PA01
cgugcgcuccgccaggc

SEQ ID NO: 1476938 - RNA, 20 nt, Pseudomonas aeruginosa PA01
cgugcgcuccgccaggccgc

SEQ ID NO: 1476939 - RNA, 21 nt, Pseudomonas aeruginosa PA01
cgugcgcuccgccaggccgcg

SEQ ID NO: 1476940 - RNA, 23 nt, Pseudomonas aeruginosa PA01
cgugcgcuccgccaggccgcgca

SEQ ID NO: 1476941 - RNA, 14 nt, Pseudomonas aeruginosa PA01
cgugcgcugcgcgu

SEQ ID NO: 1476942 - RNA, 16 nt, Pseudomonas aeruginosa PA01
cgugcgcgcggccugu

SEQ ID NO: 1476943 - RNA, 19 nt, Pseudomonas aeruginosa PA01
cgugccccguggcgggcca

SEQ ID NO: 1476944 - RNA, 22 nt, Pseudomonas aeruginosa PA01
cgugccccguggcgggccagca

SEQ ID NO: 1476945 - RNA, 17 nt, Pseudomonas aeruginosa PA01
cgugcccgccggcgcgc

SEQ ID NO: 1476946 - RNA, 22 nt, Pseudomonas aeruginosa PA01
cgugcccgccggcgcgcccagg

SEQ ID NO: 1476947 - RNA, 22 nt, Pseudomonas aeruginosa PA01
cgugcccgcugcaugugccagg

SEQ ID NO: 1476948 - RNA, 19 nt, Pseudomonas aeruginosa PA01
cgugcgcaugcccgcgucg

SEQ ID NO: 1476949 - RNA, 16 nt, Pseudomonas aeruginosa PA01
cgugccgcaggccgcg

SEQ ID NO: 1476950 - RNA, 17 nt, Pseudomonas aeruginosa PA01
cgugccgcaggccgcgg

SEQ ID NO: 1476951 - RNA, 19 nt, Pseudomonas aeruginosa PA01
cgugccgcaggccgcggcc

SEQ ID NO: 1476952 - RNA, 19 nt, Pseudomonas aeruginosa PA01
cgugccgcaacgaucucgc

SEQ ID NO: 1476953 - RNA, 13 nt, Pseudomonas aeruginosa PA01
cgugcuggacuuc

SEQ ID NO: 1476954 - RNA, 22 nt, Pseudomonas aeruginosa PA01
cgugcucuuuucccgcaccggc

SEQ ID NO: 1476955 - RNA, 14 nt, Pseudomonas aeruginosa PA01
cgugcggcccuugu

SEQ ID NO: 1476956 - RNA, 21 nt, Pseudomonas aeruginosa PA01
cgugcggcccuuguucgcggc

SEQ ID NO: 1476957 - RNA, 23 nt, Pseudomonas aeruginosa PA01
cgugcggcccuuguucgcggcga

SEQ ID NO: 1476958 - RNA, 12 nt, Pseudomonas aeruginosa PA01
cgugcggccugc

SEQ ID NO: 1476959 - RNA, 20 nt, Pseudomonas aeruginosa PA01
cgugcggcacgcugcuugcg

SEQ ID NO: 1476960 - RNA, 17 nt, Pseudomonas aeruginosa PA01
cguggacauacaggcgc

SEQ ID NO: 1476961 - RNA, 13 nt, Pseudomonas aeruginosa PA01
cguggaccaacag

SEQ ID NO: 1476962 - RNA, 20 nt, Pseudomonas aeruginosa PA01
cguggaccaacagccggcgg

SEQ ID NO: 1476963 - RNA, 15 nt, Pseudomonas aeruginosa PA01
cguggauauugugcg

SEQ ID NO: 1476964 - RNA, 14 nt, Pseudomonas aeruginosa PA01
cguggauuucagca

SEQ ID NO: 1476965 - RNA, 22 nt, Pseudomonas aeruginosa PA01
cguggcaaaaaugcccuuggcu

SEQ ID NO: 1476966 - RNA, 19 nt, Pseudomonas aeruginosa PA01
cguggagaggucgccgaca

SEQ ID NO: 1476967 - RNA, 20 nt, Pseudomonas aeruginosa PA01
cguggagaggucgccgacac

SEQ ID NO: 1476968 - RNA, 12 nt, Pseudomonas aeruginosa PA01
cguggaucgcca

SEQ ID NO: 1476969 - RNA, 15 nt, Pseudomonas aeruginosa PA01
cugacauccaccagg

SEQ ID NO: 1476970 - RNA, 18 nt, Pseudomonas aeruginosa PA01
cugacagcuugucgguga

SEQ ID NO: 1476971 - RNA, 15 nt, Pseudomonas aeruginosa PA01
cugaacgcgcccggc

SEQ ID NO: 1476972 - RNA, 20 nt, Pseudomonas aeruginosa PA01
cugaacgcgcccggccaggc

SEQ ID NO: 1476973 - RNA, 16 nt, Pseudomonas aeruginosa PA01
cugaauaccaccgggc

SEQ ID NO: 1476974 - RNA, 17 nt, Pseudomonas aeruginosa PA01
cugaaaaaaggggaugc

SEQ ID NO: 1476975 - RNA, 19 nt, Pseudomonas aeruginosa PA01
cugaaccgcgucaugcucu

SEQ ID NO: 1476976 - RNA, 21 nt, Pseudomonas aeruginosa PA01
cucuugccgcgagcuuggccc

SEQ ID NO: 1476977 - RNA, 20 nt, Pseudomonas aeruginosa PA01
cucugcuucugucccugggc

SEQ ID NO: 1476978 - RNA, 17 nt, Pseudomonas aeruginosa PA01
cucugcauggcaccguc

SEQ ID NO: 1476979 - RNA, 22 nt, Pseudomonas aeruginosa PA01
cucugcgaucagggccucgcca

SEQ ID NO: 1476980 - RNA, 12 nt, Pseudomonas aeruginosa PA01
cucugcucggcc

SEQ ID NO: 1476981 - RNA, 19 nt, Pseudomonas aeruginosa PA01
cucugcucggccagcgcca

SEQ ID NO: 1476982 - RNA, 15 nt, Pseudomonas aeruginosa PA01
cucugcuggccgccc

SEQ ID NO: 1476983 - RNA, 19 nt, Pseudomonas aeruginosa PA01
cucuugaucccggaggcgg

SEQ ID NO: 1476984 - RNA, 14 nt, Pseudomonas aeruginosa PA01
cucugaccgcgccc

SEQ ID NO: 1476985 - RNA, 19 nt, Pseudomonas aeruginosa PA01
cucuaugcaauggggcgcu

SEQ ID NO: 1476986 - RNA, 14 nt, Pseudomonas aeruginosa PA01
cucguugcgccgcu

SEQ ID NO: 1476987 - RNA, 22 nt, Pseudomonas aeruginosa PA01
cucguugcggaaagcgacgccg

SEQ ID NO: 1476988 - RNA, 19 nt, Pseudomonas aeruginosa PA01
cucguugcccggcuugccg

SEQ ID NO: 1476989 - RNA, 18 nt, Pseudomonas aeruginosa PA01
cucguugauuccgccgga

SEQ ID NO: 1476990 - RNA, 17 nt, Pseudomonas aeruginosa PA01
cucguugcacagcgccc

SEQ ID NO: 1476991 - RNA, 13 nt, Pseudomonas aeruginosa PA01
cucuacuaccgcc

SEQ ID NO: 1476992 - RNA, 23 nt, Pseudomonas aeruginosa PA01
cucuaccaggcgguuggcccgcg

SEQ ID NO: 1476993 - RNA, 22 nt, Pseudomonas aeruginosa PA01
cucuaccgagaucaccuugucg

SEQ ID NO: 1476994 - RNA, 22 nt, Pseudomonas aeruginosa PA01
cucguuccgcggagucgccggu

SEQ ID NO: 1476995 - RNA, 22 nt, Pseudomonas aeruginosa PA01
cucguugaccaguacgucacga

SEQ ID NO: 1476996 - RNA, 12 nt, Pseudomonas aeruginosa PA01
cucguucgccca

SEQ ID NO: 1476997 - RNA, 13 nt, Pseudomonas aeruginosa PA01
cucguucgcccag

SEQ ID NO: 1476998 - RNA, 14 nt, Pseudomonas aeruginosa PA01
cucguucgucgccg

SEQ ID NO: 1476999 - RNA, 17 nt, Pseudomonas aeruginosa PA01
cucguucgucgccgacu

SEQ ID NO: 1477000 - RNA, 13 nt, Pseudomonas aeruginosa PA01
cucgucggcgggg

SEQ ID NO: 1477001 - RNA, 21 nt, Pseudomonas aeruginosa PA01
cucgucggcggggcgcaccgc

SEQ ID NO: 1477002 - RNA, 18 nt, Pseudomonas aeruginosa PA01
cucgucguccagcggcuc

SEQ ID NO: 1477003 - RNA, 14 nt, Pseudomonas aeruginosa PA01
cucggccgccuggc

SEQ ID NO: 1477004 - RNA, 14 nt, Pseudomonas aeruginosa PA01
cucggccucgaucu

SEQ ID NO: 1477005 - RNA, 13 nt, Pseudomonas aeruginosa PA01
cucggccucggcg

SEQ ID NO: 1477006 - RNA, 22 nt, Pseudomonas aeruginosa PA01
cucggccucggcgucgcgcagg

SEQ ID NO: 1477007 - RNA, 18 nt, Pseudomonas aeruginosa PA01
cucggccuugagcgccga

SEQ ID NO: 1477008 - RNA, 17 nt, Pseudomonas aeruginosa PA01
cucggccugggcgcagg

SEQ ID NO: 1477009 - RNA, 22 nt, Pseudomonas aeruginosa PA01
cucggccugggcgcaggccgag

SEQ ID NO: 1477010 - RNA, 18 nt, Pseudomonas aeruginosa PA01
cucggccuggugcaccug

SEQ ID NO: 1477011 - RNA, 20 nt, Pseudomonas aeruginosa PA01
cucggccuggugcaccuggc

SEQ ID NO: 1477012 - RNA, 22 nt, Pseudomonas aeruginosa PA01
cucggccuggugcaccuggcga

SEQ ID NO: 1477013 - RNA, 14 nt, Pseudomonas aeruginosa PA01
cucggccugcugcg

SEQ ID NO: 1477014 - RNA, 19 nt, Pseudomonas aeruginosa PA01
cucggccugcugcgccggc

SEQ ID NO: 1477015 - RNA, 14 nt, Pseudomonas aeruginosa PA01
cucggccuggaacc

SEQ ID NO: 1477016 - RNA, 12 nt, Pseudomonas aeruginosa PA01
cucggugcguag

SEQ ID NO: 1477017 - RNA, 13 nt, Pseudomonas aeruginosa PA01
cucggugcguagc

SEQ ID NO: 1477018 - RNA, 16 nt, Pseudomonas aeruginosa PA01
cucggugcucaggcgg

SEQ ID NO: 1477019 - RNA, 17 nt, Pseudomonas aeruginosa PA01
cucggccuugcuggcga

SEQ ID NO: 1477020 - RNA, 17 nt, Pseudomonas aeruginosa PA01
cucggugggcuugccgg

SEQ ID NO: 1477021 - RNA, 18 nt, Pseudomonas aeruginosa PA01
cucggugggcuugccggg

SEQ ID NO: 1477022 - RNA, 14 nt, Pseudomonas aeruginosa PA01
cucgguguagcuga

SEQ ID NO: 1477023 - RNA, 21 nt, Pseudomonas aeruginosa PA01
cucgguguaggcgaucuggcg

SEQ ID NO: 1477024 - RNA, 19 nt, Pseudomonas aeruginosa PA01
cucgguguccaccaccagc

SEQ ID NO: 1477025 - RNA, 22 nt, Pseudomonas aeruginosa PA01
cucgguguccaccaccagcagg

SEQ ID NO: 1477026 - RNA, 23 nt, Pseudomonas aeruginosa PA01
cucgguguccaccaccagcaggc

SEQ ID NO: 1477027 - RNA, 16 nt, Pseudomonas aeruginosa PA01
cucgucgaagcgcagu

SEQ ID NO: 1477028 - RNA, 22 nt, Pseudomonas aeruginosa PA01
cucguccucggggaagcgcggc

SEQ ID NO: 1477029 - RNA, 20 nt, Pseudomonas aeruginosa PA01
cucgucgacgcccuggcgcu

SEQ ID NO: 1477030 - RNA, 17 nt, Pseudomonas aeruginosa PA01
cucgucgagcagcgcgc

SEQ ID NO: 1477031 - RNA, 11 nt, Pseudomonas aeruginosa PA01
cucgucgacgg

SEQ ID NO: 1477032 - RNA, 16 nt, Pseudomonas aeruginosa PA01
cucgucgaggucgagg

SEQ ID NO: 1477033 - RNA, 17 nt, Pseudomonas aeruginosa PA01
cucgucgaggucgaggu

SEQ ID NO: 1477034 - RNA, 22 nt, Pseudomonas aeruginosa PA01
cucgucgaggucgagguccacg

SEQ ID NO: 1477035 - RNA, 19 nt, Pseudomonas aeruginosa PA01
cucgucgagcgcagcgaca

SEQ ID NO: 1477036 - RNA, 22 nt, Pseudomonas aeruginosa PA01
cucgucgagcugcucggcggug

SEQ ID NO: 1477037 - RNA, 21 nt, Pseudomonas aeruginosa PA01
cucguccauguugcggcccag

SEQ ID NO: 1477038 - RNA, 14 nt, Pseudomonas aeruginosa PA01
cucguacaugcgcg

SEQ ID NO: 1477039 - RNA, 17 nt, Pseudomonas aeruginosa PA01
cucguacaugcgcgagu

SEQ ID NO: 1477040 - RNA, 17 nt, Pseudomonas aeruginosa PA01
cucguagaacucgcccu

SEQ ID NO: 1477041 - RNA, 19 nt, Pseudomonas aeruginosa PA01
cucguccaguucagggcca

SEQ ID NO: 1477042 - RNA, 14 nt, Pseudomonas aeruginosa PA01
cucgguucauggac

SEQ ID NO: 1477043 - RNA, 13 nt, Pseudomonas aeruginosa PA01
cucggugguguag

SEQ ID NO: 1477044 - RNA, 17 nt, Pseudomonas aeruginosa PA01
cucggugucggugaugc

SEQ ID NO: 1477045 - RNA, 17 nt, Pseudomonas aeruginosa PA01
cucgguuuccggccagg

SEQ ID NO: 1477046 - RNA, 18 nt, Pseudomonas aeruginosa PA01
cucgguuuccggccaggc

SEQ ID NO: 1477047 - RNA, 16 nt, Pseudomonas aeruginosa PA01
cugaugaugccgcggc

SEQ ID NO: 1477048 - RNA, 16 nt, Pseudomonas aeruginosa PA01
cugaugaaucgccucc

SEQ ID NO: 1477049 - RNA, 23 nt, Pseudomonas aeruginosa PA01
cugaugaaucgccucccuggcga

SEQ ID NO: 1477050 - RNA, 14 nt, Pseudomonas aeruginosa PA01
cugaucgcuccgcu

SEQ ID NO: 1477051 - RNA, 14 nt, Pseudomonas aeruginosa PA01
cugaucggccgcca

SEQ ID NO: 1477052 - RNA, 15 nt, Pseudomonas aeruginosa PA01
cugaucggccgccag

SEQ ID NO: 1477053 - RNA, 18 nt, Pseudomonas aeruginosa PA01
cugaucucgguaucgcuu

SEQ ID NO: 1477054 - RNA, 17 nt, Pseudomonas aeruginosa PA01
cugcaacgccagcaggc

SEQ ID NO: 1477055 - RNA, 17 nt, Pseudomonas aeruginosa PA01
cugcaacgcccgcgagc

SEQ ID NO: 1477056 - RNA, 23 nt, Pseudomonas aeruginosa PA01
cugcaacgcccgcgagccguccu

SEQ ID NO: 1477057 - RNA, 13 nt, Pseudomonas aeruginosa PA01
cugcaacgccgcg

SEQ ID NO: 1477058 - RNA, 14 nt, Pseudomonas aeruginosa PA01
cugcaacgccggcc

SEQ ID NO: 1477059 - RNA, 21 nt, Pseudomonas aeruginosa PA01
cugcaacgccggcccgugccc

SEQ ID NO: 1477060 - RNA, 23 nt, Pseudomonas aeruginosa PA01
cugcaaccgauauggcuggcgca

SEQ ID NO: 1477061 - RNA, 14 nt, Pseudomonas aeruginosa PA01
cugcaacgagagga

SEQ ID NO: 1477062 - RNA, 23 nt, Pseudomonas aeruginosa PA01
cugcaacucggcgucgcgcuugc

SEQ ID NO: 1477063 - RNA, 23 nt, Pseudomonas aeruginosa PA01
cugcaacuggaaggccgcgccga

SEQ ID NO: 1477064 - RNA, 13 nt, Pseudomonas aeruginosa PA01
cugcaacuggccg

SEQ ID NO: 1477065 - RNA, 21 nt, Pseudomonas aeruginosa PA01
cugcacaucaccuucgcccuc

SEQ ID NO: 1477066 - RNA, 17 nt, Pseudomonas aeruginosa PA01
cugcacaugcaccaccu

SEQ ID NO: 1477067 - RNA, 19 nt, Pseudomonas aeruginosa PA01
cugcacaugcaccaccugc

SEQ ID NO: 1477068 - RNA, 16 nt, Pseudomonas aeruginosa PA01
cugcaaaaaagcgcgc

SEQ ID NO: 1477069 - RNA, 22 nt, Pseudomonas aeruginosa PA01
cugcaacagaaguugcuggcga

SEQ ID NO: 1477070 - RNA, 18 nt, Pseudomonas aeruginosa PA01
cugcaacaggacccagcc

SEQ ID NO: 1477071 - RNA, 24 nt, Pseudomonas aeruginosa PA01
cugcaacaguggguaggccaggca

SEQ ID NO: 1477072 - RNA, 17 nt, Pseudomonas aeruginosa PA01
cugcaacauggcgucgg

SEQ ID NO: 1477073 - RNA, 20 nt, Pseudomonas aeruginosa PA01
cugcaacauggcgucggcga

SEQ ID NO: 1477074 - RNA, 18 nt, Pseudomonas aeruginosa PA01
cugcagacgguucagcag

SEQ ID NO: 1477075 - RNA, 21 nt, Pseudomonas aeruginosa PA01
cugcagacgguucagcagcgg

SEQ ID NO: 1477076 - RNA, 22 nt, Pseudomonas aeruginosa PA01
cugcagacgguucagcagcggc

SEQ ID NO: 1477077 - RNA, 23 nt, Pseudomonas aeruginosa PA01
cugcagacgguucagcagcggca

SEQ ID NO: 1477078 - RNA, 16 nt, Pseudomonas aeruginosa PA01
cugcaccgcccagccg

SEQ ID NO: 1477079 - RNA, 13 nt, Pseudomonas aeruginosa PA01
cugcagcaggucg

SEQ ID NO: 1477080 - RNA, 18 nt, Pseudomonas aeruginosa PA01
cugcagcaggaucagcgc

SEQ ID NO: 1477081 - RNA, 23 nt, Pseudomonas aeruginosa PA01
cugcagcaccaccucgccaagcu

SEQ ID NO: 1477082 - RNA, 19 nt, Pseudomonas aeruginosa PA01
cugcagauaaagcuggacc

SEQ ID NO: 1477083 - RNA, 20 nt, Pseudomonas aeruginosa PA01
cugcagauaaagcuggacca

SEQ ID NO: 1477084 - RNA, 19 nt, Pseudomonas aeruginosa PA01
cugcacggauaccacccgc

SEQ ID NO: 1477085 - RNA, 20 nt, Pseudomonas aeruginosa PA01
cugcacggcaacgucgcgga

SEQ ID NO: 1477086 - RNA, 15 nt, Pseudomonas aeruginosa PA01
cugcacccgccgacc

SEQ ID NO: 1477087 - RNA, 17 nt, Pseudomonas aeruginosa PA01
cugcaccaggcucgccc

SEQ ID NO: 1477088 - RNA, 19 nt, Pseudomonas aeruginosa PA01
cugcaccacguucggcgcg

SEQ ID NO: 1477089 - RNA, 18 nt, Pseudomonas aeruginosa PA01
cugcaccacgcaggcgcg

SEQ ID NO: 1477090 - RNA, 16 nt, Pseudomonas aeruginosa PA01
cugcaccagcaggucg

SEQ ID NO: 1477091 - RNA, 18 nt, Pseudomonas aeruginosa PA01
cugcaccagcaggucgag

SEQ ID NO: 1477092 - RNA, 18 nt, Pseudomonas aeruginosa PA01
cugaucgaagcccaucga

SEQ ID NO: 1477093 - RNA, 15 nt, Pseudomonas aeruginosa PA01
cugaucacccgcccg

SEQ ID NO: 1477094 - RNA, 19 nt, Pseudomonas aeruginosa PA01
cugaucaguaccggcagcg

SEQ ID NO: 1477095 - RNA, 21 nt, Pseudomonas aeruginosa PA01
cugaucaguaccggcagcgcc

SEQ ID NO: 1477096 - RNA, 15 nt, Pseudomonas aeruginosa PA01
cugaucaucagcagg

SEQ ID NO: 1477097 - RNA, 16 nt, Pseudomonas aeruginosa PA01
cugaucaucugggcca

SEQ ID NO: 1477098 - RNA, 15 nt, Pseudomonas aeruginosa PA01
cugaucagccgggcg

SEQ ID NO: 1477099 - RNA, 23 nt, Pseudomonas aeruginosa PA01
cugaucagcuucuucagcagcgg

SEQ ID NO: 1477100 - RNA, 21 nt, Pseudomonas aeruginosa PA01
cugaucaggaggaucgccagg

SEQ ID NO: 1477101 - RNA, 15 nt, Pseudomonas aeruginosa PA01
cugaucagcccgcug

SEQ ID NO: 1477102 - RNA, 17 nt, Pseudomonas aeruginosa PA01
cugaucagcccgcugag

SEQ ID NO: 1477103 - RNA, 22 nt, Pseudomonas aeruginosa PA01
cugaucacguagaugccggugc

SEQ ID NO: 1477104 - RNA, 14 nt, Pseudomonas aeruginosa PA01
cugacgucgacgca

SEQ ID NO: 1477105 - RNA, 22 nt, Pseudomonas aeruginosa PA01
cugacgucgacgcagcgcgcgu

SEQ ID NO: 1477106 - RNA, 20 nt, Pseudomonas aeruginosa PA01
cugagccggccggaggggau

SEQ ID NO: 1477107 - RNA, 13 nt, Pseudomonas aeruginosa PA01
cugagcggcggca

SEQ ID NO: 1477108 - RNA, 21 nt, Pseudomonas aeruginosa PA01
cugagcggcggcacgaccaca

SEQ ID NO: 1477109 - RNA, 17 nt, Pseudomonas aeruginosa PA01
cugagcgccaggcgcaa

SEQ ID NO: 1477110 - RNA, 20 nt, Pseudomonas aeruginosa PA01
cugagcgccucgaucgccuc

SEQ ID NO: 1477111 - RNA, 14 nt, Pseudomonas aeruginosa PA01
cugacggcggaagg

SEQ ID NO: 1477112 - RNA, 17 nt, Pseudomonas aeruginosa PA01
cugacggcguggcggau

SEQ ID NO: 1477113 - RNA, 19 nt, Pseudomonas aeruginosa PA01
cugacggcaaggaccugcu

SEQ ID NO: 1477114 - RNA, 16 nt, Pseudomonas aeruginosa PA01
cugacggucugccagc

SEQ ID NO: 1477115 - RNA, 16 nt, Pseudomonas aeruginosa PA01
cugaccgcucccaggc

SEQ ID NO: 1477116 - RNA, 19 nt, Pseudomonas aeruginosa PA01
cugaccgcgugggccggca

SEQ ID NO: 1477117 - RNA, 13 nt, Pseudomonas aeruginosa PA01
cugacgcuggcga

SEQ ID NO: 1477118 - RNA, 15 nt, Pseudomonas aeruginosa PA01
cugaccgggcggauc

SEQ ID NO: 1477119 - RNA, 21 nt, Pseudomonas aeruginosa PA01
cugaccgcgaauggcagcagg

SEQ ID NO: 1477120 - RNA, 23 nt, Pseudomonas aeruginosa PA01
cugaccgcgaauggcagcaggca

SEQ ID NO: 1477121 - RNA, 19 nt, Pseudomonas aeruginosa PA01
cugaccgcgagcgccgccu

SEQ ID NO: 1477122 - RNA, 16 nt, Pseudomonas aeruginosa PA01
cugacccgcuguccgc

SEQ ID NO: 1477123 - RNA, 20 nt, Pseudomonas aeruginosa PA01
cugacccgcuguccgccggc

SEQ ID NO: 1477124 - RNA, 21 nt, Pseudomonas aeruginosa PA01
cugacccgcuguccgccggcc

SEQ ID NO: 1477125 - RNA, 15 nt, Pseudomonas aeruginosa PA01
cugacccgcaccggc

SEQ ID NO: 1477126 - RNA, 13 nt, Pseudomonas aeruginosa PA01
cugacccaggcuu

SEQ ID NO: 1477127 - RNA, 22 nt, Pseudomonas aeruginosa PA01
cugacccaggcuucggcgcgcu

SEQ ID NO: 1477128 - RNA, 20 nt, Pseudomonas aeruginosa PA01
cugaccaucgucgcuuccgg

SEQ ID NO: 1477129 - RNA, 16 nt, Pseudomonas aeruginosa PA01
cugaccacccggugca

SEQ ID NO: 1477130 - RNA, 21 nt, Pseudomonas aeruginosa PA01
cugaccacgcagagcggcagg

SEQ ID NO: 1477131 - RNA, 16 nt, Pseudomonas aeruginosa PA01
cugccuguccgcugcg

SEQ ID NO: 1477132 - RNA, 22 nt, Pseudomonas aeruginosa PA01
cugccuggggacggcaggcccc

SEQ ID NO: 1477133 - RNA, 14 nt, Pseudomonas aeruginosa PA01
cugccuuccagcag

SEQ ID NO: 1477134 - RNA, 18 nt, Pseudomonas aeruginosa PA01
cugccuuccagcaggucg

SEQ ID NO: 1477135 - RNA, 19 nt, Pseudomonas aeruginosa PA01
cugccuucgaagccggcac

SEQ ID NO: 1477136 - RNA, 14 nt, Pseudomonas aeruginosa PA01
cugccucgccgagg

SEQ ID NO: 1477137 - RNA, 23 nt, Pseudomonas aeruginosa PA01
cugccucgguuuccggccaggcg

SEQ ID NO: 1477138 - RNA, 16 nt, Pseudomonas aeruginosa PA01
cugccuggcagguccg

SEQ ID NO: 1477139 - RNA, 15 nt, Pseudomonas aeruginosa PA01
cugccugcgcagggc

SEQ ID NO: 1477140 - RNA, 22 nt, Pseudomonas aeruginosa PA01
cugccguuuuacucgucgccaa

SEQ ID NO: 1477141 - RNA, 15 nt, Pseudomonas aeruginosa PA01
cugccugcaccgggc

SEQ ID NO: 1477142 - RNA, 20 nt, Pseudomonas aeruginosa PA01
cugcgacugacgguggaggc

SEQ ID NO: 1477143 - RNA, 22 nt, Pseudomonas aeruginosa PA01
cugcgacgagccggacggcggc

SEQ ID NO: 1477144 - RNA, 23 nt, Pseudomonas aeruginosa PA01
cugcgacaguucgcggaacuucg

SEQ ID NO: 1477145 - RNA, 17 nt, Pseudomonas aeruginosa PA01
cugcgaccuggcgccga

SEQ ID NO: 1477146 - RNA, 15 nt, Pseudomonas aeruginosa PA01
cugcgaccgugaggc

SEQ ID NO: 1477147 - RNA, 21 nt, Pseudomonas aeruginosa PA01
cugcgaaccgagacccuggcg

SEQ ID NO: 1477148 - RNA, 17 nt, Pseudomonas aeruginosa PA01
cugcgaaucgucgccgg

SEQ ID NO: 1477149 - RNA, 18 nt, Pseudomonas aeruginosa PA01
cugcgaaucgucgccgga

SEQ ID NO: 1477150 - RNA, 19 nt, Pseudomonas aeruginosa PA01
cugcgaauagacgccgcug

SEQ ID NO: 1477151 - RNA, 15 nt, Pseudomonas aeruginosa PA01
cugccguugcggccc

SEQ ID NO: 1477152 - RNA, 16 nt, Pseudomonas aeruginosa PA01
cugccguugcggcccu

SEQ ID NO: 1477153 - RNA, 18 nt, Pseudomonas aeruginosa PA01
cugccguugcggcccuuc

SEQ ID NO: 1477154 - RNA, 16 nt, Pseudomonas aeruginosa PA01
cugccguugcaggccc

SEQ ID NO: 1477155 - RNA, 17 nt, Pseudomonas aeruginosa PA01
cugccguugcaggccca

SEQ ID NO: 1477156 - RNA, 18 nt, Pseudomonas aeruginosa PA01
cugccguugcaggcccag

SEQ ID NO: 1477157 - RNA, 16 nt, Pseudomonas aeruginosa PA01
cugccguucgcccgcg

SEQ ID NO: 1477158 - RNA, 20 nt, Pseudomonas aeruginosa PA01
cugccguucgcccgcggcgg

SEQ ID NO: 1477159 - RNA, 18 nt, Pseudomonas aeruginosa PA01
cugccguucgucaccggc

SEQ ID NO: 1477160 - RNA, 23 nt, Pseudomonas aeruginosa PA01
cugccguucgucaccggcgccac

SEQ ID NO: 1477161 - RNA, 16 nt, Pseudomonas aeruginosa PA01
cugccguauccgcggc

SEQ ID NO: 1477162 - RNA, 17 nt, Pseudomonas aeruginosa PA01
cugccguauccgcggca

SEQ ID NO: 1477163 - RNA, 19 nt, Pseudomonas aeruginosa PA01
cugccguauccgcggcagg

SEQ ID NO: 1477164 - RNA, 20 nt, Pseudomonas aeruginosa PA01
cugccguagugguugcgcac

SEQ ID NO: 1477165 - RNA, 17 nt, Pseudomonas aeruginosa PA01
cugccguacagcccccg

SEQ ID NO: 1477166 - RNA, 20 nt, Pseudomonas aeruginosa PA01
cugccgucacuugaaguccc

SEQ ID NO: 1477167 - RNA, 13 nt, Pseudomonas aeruginosa PA01
cugccgggcgcgc

SEQ ID NO: 1477168 - RNA, 14 nt, Pseudomonas aeruginosa PA01
cugccgggcgcgcu

SEQ ID NO: 1477169 - RNA, 23 nt, Pseudomonas aeruginosa PA01
cugccggcgcagaucgcggcgca

SEQ ID NO: 1477170 - RNA, 21 nt, Pseudomonas aeruginosa PA01
cugccggcuugcugcaggugg

SEQ ID NO: 1477171 - RNA, 22 nt, Pseudomonas aeruginosa PA01
cugccgggcaagcucgacgagc

SEQ ID NO: 1477172 - RNA, 23 nt, Pseudomonas aeruginosa PA01
cugccgggcaagcucgacgagcc

SEQ ID NO: 1477173 - RNA, 20 nt, Pseudomonas aeruginosa PA01
cugccgguaggucaccaggu

SEQ ID NO: 1477174 - RNA, 18 nt, Pseudomonas aeruginosa PA01
cugccgguacgcaccagc

SEQ ID NO: 1477175 - RNA, 20 nt, Pseudomonas aeruginosa PA01
cugccgguaauuggccaggc

SEQ ID NO: 1477176 - RNA, 20 nt, Pseudomonas aeruginosa PA01
cugccggugugccgucaggc

SEQ ID NO: 1477177 - RNA, 15 nt, Pseudomonas aeruginosa PA01
cugccggucggccuu

SEQ ID NO: 1477178 - RNA, 13 nt, Pseudomonas aeruginosa PA01
cugccggucaggc

SEQ ID NO: 1477179 - RNA, 22 nt, Pseudomonas aeruginosa PA01
cugccguagcgcuucaucaggc

SEQ ID NO: 1477180 - RNA, 16 nt, Pseudomonas aeruginosa PA01
cugccgcaccgccucg

SEQ ID NO: 1477181 - RNA, 17 nt, Pseudomonas aeruginosa PA01
cugccgcagaucaucgc

SEQ ID NO: 1477182 - RNA, 14 nt, Pseudomonas aeruginosa PA01
cugccgcagcgccu

SEQ ID NO: 1477183 - RNA, 15 nt, Pseudomonas aeruginosa PA01
cugccgcagcgccuc

SEQ ID NO: 1477184 - RNA, 16 nt, Pseudomonas aeruginosa PA01
cugccgcagcgccucc

SEQ ID NO: 1477185 - RNA, 23 nt, Pseudomonas aeruginosa PA01
cugccgcagcgccucccgggccu

SEQ ID NO: 1477186 - RNA, 16 nt, Pseudomonas aeruginosa PA01
cugccgcaggcgggcg

SEQ ID NO: 1477187 - RNA, 19 nt, Pseudomonas aeruginosa PA01
cugccgcaggcgggcgcca

SEQ ID NO: 1477188 - RNA, 20 nt, Pseudomonas aeruginosa PA01
cugccgcaggcgggcgccau

SEQ ID NO: 1477189 - RNA, 21 nt, Pseudomonas aeruginosa PA01
cugccgcaguagaugccgcgu

SEQ ID NO: 1477190 - RNA, 13 nt, Pseudomonas aeruginosa PA01
cugccgaucagcc

SEQ ID NO: 1477191 - RNA, 22 nt, Pseudomonas aeruginosa PA01
cugccgaucagccauuggccga

SEQ ID NO: 1477192 - RNA, 23 nt, Pseudomonas aeruginosa PA01
cugccgaucagccauuggccgac

SEQ ID NO: 1477193 - RNA, 14 nt, Pseudomonas aeruginosa PA01
cugccgaucgccgc

SEQ ID NO: 1477194 - RNA, 15 nt, Pseudomonas aeruginosa PA01
cugccgaucgccgcg

SEQ ID NO: 1477195 - RNA, 16 nt, Pseudomonas aeruginosa PA01
cugccgaucgccgcgc

SEQ ID NO: 1477196 - RNA, 21 nt, Pseudomonas aeruginosa PA01
cugccgaggcugaucugccgg

SEQ ID NO: 1477197 - RNA, 19 nt, Pseudomonas aeruginosa PA01
cugccgaggguguagagga

SEQ ID NO: 1477198 - RNA, 16 nt, Pseudomonas aeruginosa PA01
cugccgaggaacucgc

SEQ ID NO: 1477199 - RNA, 19 nt, Pseudomonas aeruginosa PA01
cugccgaggaacucgcggu

SEQ ID NO: 1477200 - RNA, 22 nt, Pseudomonas aeruginosa PA01
cugccgagcagggucacgccga

SEQ ID NO: 1477201 - RNA, 16 nt, Pseudomonas aeruginosa PA01
cugccgagcaggugca

SEQ ID NO: 1477202 - RNA, 23 nt, Pseudomonas aeruginosa PA01
cugccgacggcggcggcggaccu

SEQ ID NO: 1477203 - RNA, 22 nt, Pseudomonas aeruginosa PA01
cugccgaagggaaacaccaggc

SEQ ID NO: 1477204 - RNA, 23 nt, Pseudomonas aeruginosa PA01
cugccgaagggaaacaccaggcc

SEQ ID NO: 1477205 - RNA, 15 nt, Pseudomonas aeruginosa PA01
cugccgaacagcagg

SEQ ID NO: 1477206 - RNA, 18 nt, Pseudomonas aeruginosa PA01
cugccgaagaucgacagg

SEQ ID NO: 1477207 - RNA, 22 nt, Pseudomonas aeruginosa PA01
cugccgaagaucgacaggccgc

SEQ ID NO: 1477208 - RNA, 19 nt, Pseudomonas aeruginosa PA01
cugccgaagcccgauccgu

SEQ ID NO: 1477209 - RNA, 21 nt, Pseudomonas aeruginosa PA01
cugccgaagccuucgucgaug

SEQ ID NO: 1477210 - RNA, 22 nt, Pseudomonas aeruginosa PA01
cugccgaagccuucgucgauga

SEQ ID NO: 1477211 - RNA, 19 nt, Pseudomonas aeruginosa PA01
cugcccggcaucgugccgc

SEQ ID NO: 1477212 - RNA, 16 nt, Pseudomonas aeruginosa PA01
cugcccuggcgcgcgc

SEQ ID NO: 1477213 - RNA, 20 nt, Pseudomonas aeruginosa PA01
cugcccgguggggcgggcga

SEQ ID NO: 1477214 - RNA, 22 nt, Pseudomonas aeruginosa PA01
cugcccgguggggcgggcgaag

SEQ ID NO: 1477215 - RNA, 20 nt, Pseudomonas aeruginosa PA01
cugcccguggcgcggacggg

SEQ ID NO: 1477216 - RNA, 15 nt, Pseudomonas aeruginosa PA01
cugcccuccugcucg

SEQ ID NO: 1477217 - RNA, 19 nt, Pseudomonas aeruginosa PA01
cugcccucgaccagguccg

SEQ ID NO: 1477218 - RNA, 14 nt, Pseudomonas aeruginosa PA01
cugccgcccggcca

SEQ ID NO: 1477219 - RNA, 16 nt, Pseudomonas aeruginosa PA01
cugccgcccggccagg

SEQ ID NO: 1477220 - RNA, 14 nt, Pseudomonas aeruginosa PA01
cugccgcccggucu

SEQ ID NO: 1477221 - RNA, 15 nt, Pseudomonas aeruginosa PA01
cugccgcccucgggc

SEQ ID NO: 1477222 - RNA, 13 nt, Pseudomonas aeruginosa PA01
cugccgcccuucg

SEQ ID NO: 1477223 - RNA, 20 nt, Pseudomonas aeruginosa PA01
cugccgccgcagagccagcc

SEQ ID NO: 1477224 - RNA, 12 nt, Pseudomonas aeruginosa PA01
cugccgccagcu

SEQ ID NO: 1477225 - RNA, 16 nt, Pseudomonas aeruginosa PA01
cugccgccgccgucga

SEQ ID NO: 1477226 - RNA, 15 nt, Pseudomonas aeruginosa PA01
cugccgccgcgcagg

SEQ ID NO: 1477227 - RNA, 19 nt, Pseudomonas aeruginosa PA01
cugccgccgcgcccggcgc

SEQ ID NO: 1477228 - RNA, 22 nt, Pseudomonas aeruginosa PA01
cugccgccgcgcccggcgccag

SEQ ID NO: 1477229 - RNA, 13 nt, Pseudomonas aeruginosa PA01
cugccgccgcgcu

SEQ ID NO: 1477230 - RNA, 21 nt, Pseudomonas aeruginosa PA01
cugccgccgcgcugcaggcgg

SEQ ID NO: 1477231 - RNA, 19 nt, Pseudomonas aeruginosa PA01
cugccgcuaucgcuggcgc

SEQ ID NO: 1477232 - RNA, 20 nt, Pseudomonas aeruginosa PA01
cugccgcuaucgcuggcgca

SEQ ID NO: 1477233 - RNA, 22 nt, Pseudomonas aeruginosa PA01
cugccgcuaucgcuggcgcagc

SEQ ID NO: 1477234 - RNA, 14 nt, Pseudomonas aeruginosa PA01
cugccgcgacagga

SEQ ID NO: 1477235 - RNA, 20 nt, Pseudomonas aeruginosa PA01
cugccgcgacaggauggaca

SEQ ID NO: 1477236 - RNA, 19 nt, Pseudomonas aeruginosa PA01
cugccgccgucuccgccgc

SEQ ID NO: 1477237 - RNA, 13 nt, Pseudomonas aeruginosa PA01
cugccgcuggcgg

SEQ ID NO: 1477238 - RNA, 23 nt, Pseudomonas aeruginosa PA01
cugccgcuggcggccuucggcgu

SEQ ID NO: 1477239 - RNA, 17 nt, Pseudomonas aeruginosa PA01
cugccgcucguuggcgg

SEQ ID NO: 1477240 - RNA, 16 nt, Pseudomonas aeruginosa PA01
cugccgcucuggcugc

SEQ ID NO: 1477241 - RNA, 19 nt, Pseudomonas aeruginosa PA01
cugccgcucuggcugcugg

SEQ ID NO: 1477242 - RNA, 13 nt, Pseudomonas aeruginosa PA01
cugccgcgccgga

SEQ ID NO: 1477243 - RNA, 14 nt, Pseudomonas aeruginosa PA01
cugccggacgcgau

SEQ ID NO: 1477244 - RNA, 14 nt, Pseudomonas aeruginosa PA01
cugccggcacgcuc

SEQ ID NO: 1477245 - RNA, 18 nt, Pseudomonas aeruginosa PA01
cugccggcacgcucaggc

SEQ ID NO: 1477246 - RNA, 20 nt, Pseudomonas aeruginosa PA01
cugccggccagggucgccag

SEQ ID NO: 1477247 - RNA, 17 nt, Pseudomonas aeruginosa PA01
cugcagccuggcgucgc

SEQ ID NO: 1477248 - RNA, 20 nt, Pseudomonas aeruginosa PA01
cugcagccagcuucagccga

SEQ ID NO: 1477249 - RNA, 21 nt, Pseudomonas aeruginosa PA01
cugcagccagcuucagccgac

SEQ ID NO: 1477250 - RNA, 20 nt, Pseudomonas aeruginosa PA01
cugcagcgacuccagccagg

SEQ ID NO: 1477251 - RNA, 21 nt, Pseudomonas aeruginosa PA01
cugcagcgacuccagccaggc

SEQ ID NO: 1477252 - RNA, 23 nt, Pseudomonas aeruginosa PA01
cugcagcgacuccagccaggcga

SEQ ID NO: 1477253 - RNA, 13 nt, Pseudomonas aeruginosa PA01
cugcagcgcccca

SEQ ID NO: 1477254 - RNA, 14 nt, Pseudomonas aeruginosa PA01
cugcagcgccccag

SEQ ID NO: 1477255 - RNA, 20 nt, Pseudomonas aeruginosa PA01
cugcagcgccccagcaccuc

SEQ ID NO: 1477256 - RNA, 11 nt, Pseudomonas aeruginosa PA01
cugcagcgccu

SEQ ID NO: 1477257 - RNA, 20 nt, Pseudomonas aeruginosa PA01
cugcagcgccucguggaaca

SEQ ID NO: 1477258 - RNA, 15 nt, Pseudomonas aeruginosa PA01
cugcaggacccgcga

SEQ ID NO: 1477259 - RNA, 16 nt, Pseudomonas aeruginosa PA01
cugcaggacgaagucg

SEQ ID NO: 1477260 - RNA, 21 nt, Pseudomonas aeruginosa PA01
cugcaggacgaagucgccggc

SEQ ID NO: 1477261 - RNA, 22 nt, Pseudomonas aeruginosa PA01
cugcaggacgaagucgccggca

SEQ ID NO: 1477262 - RNA, 14 nt, Pseudomonas aeruginosa PA01
cugcagcucggccu

SEQ ID NO: 1477263 - RNA, 18 nt, Pseudomonas aeruginosa PA01
cugcagcuugugggcaug

SEQ ID NO: 1477264 - RNA, 23 nt, Pseudomonas aeruginosa PA01
cugcagcuugugggcaugcucgg

SEQ ID NO: 1477265 - RNA, 11 nt, Pseudomonas aeruginosa PA01
cugcaggccgu

SEQ ID NO: 1477266 - RNA, 15 nt, Pseudomonas aeruginosa PA01
cugcaggccgugcca

SEQ ID NO: 1477267 - RNA, 19 nt, Pseudomonas aeruginosa PA01
cugcagguuguccagggca

SEQ ID NO: 1477268 - RNA, 19 nt, Pseudomonas aeruginosa PA01
cugcaggcgguagcgccgc

SEQ ID NO: 1477269 - RNA, 14 nt, Pseudomonas aeruginosa PA01
cugcagcuugcgcg

SEQ ID NO: 1477270 - RNA, 14 nt, Pseudomonas aeruginosa PA01
cugcaggaucgaga

SEQ ID NO: 1477271 - RNA, 16 nt, Pseudomonas aeruginosa PA01
cugcagggcggcgcug

SEQ ID NO: 1477272 - RNA, 13 nt, Pseudomonas aeruginosa PA01
cugcagggccagg

SEQ ID NO: 1477273 - RNA, 16 nt, Pseudomonas aeruginosa PA01
cugcagggcaucgcgc

SEQ ID NO: 1477274 - RNA, 17 nt, Pseudomonas aeruginosa PA01
cugcagggcaucgcgca

SEQ ID NO: 1477275 - RNA, 18 nt, Pseudomonas aeruginosa PA01
cugcagggcaucgcgcau

SEQ ID NO: 1477276 - RNA, 14 nt, Pseudomonas aeruginosa PA01
cugcaucaccaggc

SEQ ID NO: 1477277 - RNA, 22 nt, Pseudomonas aeruginosa PA01
cugcaucaccaggcugccgccg

SEQ ID NO: 1477278 - RNA, 17 nt, Pseudomonas aeruginosa PA01
cugcagguaggcggugg

SEQ ID NO: 1477279 - RNA, 16 nt, Pseudomonas aeruginosa PA01
cugcaugccggccguc

SEQ ID NO: 1477280 - RNA, 24 nt, Pseudomonas aeruginosa PA01
cugcaugccggccgucgcgcacca

SEQ ID NO: 1477281 - RNA, 22 nt, Pseudomonas aeruginosa PA01
cugcaugccguccggguggguc

SEQ ID NO: 1477282 - RNA, 22 nt, Pseudomonas aeruginosa PA01
cugcaugaaaaagcccggccgc

SEQ ID NO: 1477283 - RNA, 18 nt, Pseudomonas aeruginosa PA01
cugcaugagugucgccau

SEQ ID NO: 1477284 - RNA, 14 nt, Pseudomonas aeruginosa PA01
cugcaucggcgcgc

SEQ ID NO: 1477285 - RNA, 17 nt, Pseudomonas aeruginosa PA01
cugcaucggcgcgccga

SEQ ID NO: 1477286 - RNA, 16 nt, Pseudomonas aeruginosa PA01
cugcaucggcucggca

SEQ ID NO: 1477287 - RNA, 20 nt, Pseudomonas aeruginosa PA01
cugcaucggcucggcaagcg

SEQ ID NO: 1477288 - RNA, 13 nt, Pseudomonas aeruginosa PA01
cugccacccggcg

SEQ ID NO: 1477289 - RNA, 22 nt, Pseudomonas aeruginosa PA01
cugccacccggcgcccggcgca

SEQ ID NO: 1477290 - RNA, 16 nt, Pseudomonas aeruginosa PA01
cugccacccggcucgg

SEQ ID NO: 1477291 - RNA, 21 nt, Pseudomonas aeruginosa PA01
cugccaccgagggcaggaacc

SEQ ID NO: 1477292 - RNA, 17 nt, Pseudomonas aeruginosa PA01
cugccaaccgcgcucgg

SEQ ID NO: 1477293 - RNA, 22 nt, Pseudomonas aeruginosa PA01
cugcauguccgcaggcaggucg

SEQ ID NO: 1477294 - RNA, 20 nt, Pseudomonas aeruginosa PA01
cugcauggggauggucgaga

SEQ ID NO: 1477295 - RNA, 20 nt, Pseudomonas aeruginosa PA01
cugcccagugggccaccggc

SEQ ID NO: 1477296 - RNA, 15 nt, Pseudomonas aeruginosa PA01
cugcccaucgccucc

SEQ ID NO: 1477297 - RNA, 14 nt, Pseudomonas aeruginosa PA01
cugcccaggcugag

SEQ ID NO: 1477298 - RNA, 19 nt, Pseudomonas aeruginosa PA01
cugcccagggcccagagca

SEQ ID NO: 1477299 - RNA, 23 nt, Pseudomonas aeruginosa PA01
cugcccagggcccagagcagcac

SEQ ID NO: 1477300 - RNA, 14 nt, Pseudomonas aeruginosa PA01
cugccccgccggcg

SEQ ID NO: 1477301 - RNA, 13 nt, Pseudomonas aeruginosa PA01
cugccccacaggc

SEQ ID NO: 1477302 - RNA, 22 nt, Pseudomonas aeruginosa PA01
cugccccacaggcccugcagcg

SEQ ID NO: 1477303 - RNA, 13 nt, Pseudomonas aeruginosa PA01
cugccccagcauc

SEQ ID NO: 1477304 - RNA, 15 nt, Pseudomonas aeruginosa PA01
cugccccagcaucgc

SEQ ID NO: 1477305 - RNA, 19 nt, Pseudomonas aeruginosa PA01
cugccccagcaucgccggc

SEQ ID NO: 1477306 - RNA, 22 nt, Pseudomonas aeruginosa PA01
cugccccagcaucgccggcagc

SEQ ID NO: 1477307 - RNA, 20 nt, Pseudomonas aeruginosa PA01
cugcccgacggcuugaucac

SEQ ID NO: 1477308 - RNA, 17 nt, Pseudomonas aeruginosa PA01
cugccccucguggcgcg

SEQ ID NO: 1477309 - RNA, 13 nt, Pseudomonas aeruginosa PA01
cugcccgaccggg

SEQ ID NO: 1477310 - RNA, 12 nt, Pseudomonas aeruginosa PA01
cugccccggcuu

SEQ ID NO: 1477311 - RNA, 17 nt, Pseudomonas aeruginosa PA01
cugccccggcuuggcgg

SEQ ID NO: 1477312 - RNA, 12 nt, Pseudomonas aeruginosa PA01
cugccccgggcg

SEQ ID NO: 1477313 - RNA, 13 nt, Pseudomonas aeruginosa PA01
cugccccgggcgc

SEQ ID NO: 1477314 - RNA, 16 nt, Pseudomonas aeruginosa PA01
cugccccgggcgccgg

SEQ ID NO: 1477315 - RNA, 19 nt, Pseudomonas aeruginosa PA01
cugccccgggcgccggguc

SEQ ID NO: 1477316 - RNA, 22 nt, Pseudomonas aeruginosa PA01
cugccccgugcaccgaggcgcg

SEQ ID NO: 1477317 - RNA, 20 nt, Pseudomonas aeruginosa PA01
cugccccucacaccaccagc

SEQ ID NO: 1477318 - RNA, 12 nt, Pseudomonas aeruginosa PA01
cugcccgccggc

SEQ ID NO: 1477319 - RNA, 14 nt, Pseudomonas aeruginosa PA01
cugcccgccggcgc

SEQ ID NO: 1477320 - RNA, 15 nt, Pseudomonas aeruginosa PA01
cugcccgccggcgcc

SEQ ID NO: 1477321 - RNA, 13 nt, Pseudomonas aeruginosa PA01
cugcccgcgccuc

SEQ ID NO: 1477322 - RNA, 23 nt, Pseudomonas aeruginosa PA01
cugcccgggguuggcgcugacca

SEQ ID NO: 1477323 - RNA, 21 nt, Pseudomonas aeruginosa PA01
cugcccggcucguucaugucg

SEQ ID NO: 1477324 - RNA, 19 nt, Pseudomonas aeruginosa PA01
cugcccggcgcgacgcucc

SEQ ID NO: 1477325 - RNA, 20 nt, Pseudomonas aeruginosa PA01
cugcccggcauaggcgccag

SEQ ID NO: 1477326 - RNA, 14 nt, Pseudomonas aeruginosa PA01
cugccauggcggcg

SEQ ID NO: 1477327 - RNA, 16 nt, Pseudomonas aeruginosa PA01
cugcccaccaccagga

SEQ ID NO: 1477328 - RNA, 20 nt, Pseudomonas aeruginosa PA01
cugcccaagggccugggcgc

SEQ ID NO: 1477329 - RNA, 13 nt, Pseudomonas aeruginosa PA01
cugcccagcgccg

SEQ ID NO: 1477330 - RNA, 16 nt, Pseudomonas aeruginosa PA01
cugcccagcgccgcca

SEQ ID NO: 1477331 - RNA, 21 nt, Pseudomonas aeruginosa PA01
cugcccagcgccgccagcagg

SEQ ID NO: 1477332 - RNA, 21 nt, Pseudomonas aeruginosa PA01
cugccaguauuuggcgucgua

SEQ ID NO: 1477333 - RNA, 15 nt, Pseudomonas aeruginosa PA01
cugccaguggcggcg

SEQ ID NO: 1477334 - RNA, 16 nt, Pseudomonas aeruginosa PA01
cugccagaccguggcg

SEQ ID NO: 1477335 - RNA, 21 nt, Pseudomonas aeruginosa PA01
cugccagaccguggcgcuacg

SEQ ID NO: 1477336 - RNA, 14 nt, Pseudomonas aeruginosa PA01
cugccagaaggccu

SEQ ID NO: 1477337 - RNA, 15 nt, Pseudomonas aeruginosa PA01
cugccagaaggccug

SEQ ID NO: 1477338 - RNA, 16 nt, Pseudomonas aeruginosa PA01
cugccagaaggccugc

SEQ ID NO: 1477339 - RNA, 19 nt, Pseudomonas aeruginosa PA01
cugccagaaggccugcgcu

SEQ ID NO: 1477340 - RNA, 19 nt, Pseudomonas aeruginosa PA01
cugccagaaaacccagcga

SEQ ID NO: 1477341 - RNA, 12 nt, Pseudomonas aeruginosa PA01
cugccagcgcgu

SEQ ID NO: 1477342 - RNA, 22 nt, Pseudomonas aeruginosa PA01
cugccagcgcgucggcacgccg

SEQ ID NO: 1477343 - RNA, 23 nt, Pseudomonas aeruginosa PA01
cugccagcgcgucggcacgccga

SEQ ID NO: 1477344 - RNA, 14 nt, Pseudomonas aeruginosa PA01
cugccagcgccgcc

SEQ ID NO: 1477345 - RNA, 18 nt, Pseudomonas aeruginosa PA01
cugccagcaggccgagcc

SEQ ID NO: 1477346 - RNA, 14 nt, Pseudomonas aeruginosa PA01
cugccagcucuggc

SEQ ID NO: 1477347 - RNA, 17 nt, Pseudomonas aeruginosa PA01
cugccagcucuggccgu

SEQ ID NO: 1477348 - RNA, 13 nt, Pseudomonas aeruginosa PA01
cucggcaaucgcg

SEQ ID NO: 1477349 - RNA, 19 nt, Pseudomonas aeruginosa PA01
cucggcacgcagcagcuuc

SEQ ID NO: 1477350 - RNA, 16 nt, Pseudomonas aeruginosa PA01
cucggcacgcguggcg

SEQ ID NO: 1477351 - RNA, 21 nt, Pseudomonas aeruginosa PA01
cucggcagcgcuacgcaggcc

SEQ ID NO: 1477352 - RNA, 23 nt, Pseudomonas aeruginosa PA01
cucggcagcgcuacgcaggcccu

SEQ ID NO: 1477353 - RNA, 18 nt, Pseudomonas aeruginosa PA01
cucggcagcgcuggcgau

SEQ ID NO: 1477354 - RNA, 13 nt, Pseudomonas aeruginosa PA01
cucggaucaggcg

SEQ ID NO: 1477355 - RNA, 14 nt, Pseudomonas aeruginosa PA01
cucggaucaggcgg

SEQ ID NO: 1477356 - RNA, 16 nt, Pseudomonas aeruginosa PA01
cucgcugcccgacggc

SEQ ID NO: 1477357 - RNA, 14 nt, Pseudomonas aeruginosa PA01
cucgcugccgccgc

SEQ ID NO: 1477358 - RNA, 15 nt, Pseudomonas aeruginosa PA01
cucgcugccggcgcg

SEQ ID NO: 1477359 - RNA, 20 nt, Pseudomonas aeruginosa PA01
cucgcugccuaccgucacgc

SEQ ID NO: 1477360 - RNA, 18 nt, Pseudomonas aeruginosa PA01
cucgcugccuggggacgg

SEQ ID NO: 1477361 - RNA, 16 nt, Pseudomonas aeruginosa PA01
cucgcugggcgccggc

SEQ ID NO: 1477362 - RNA, 20 nt, Pseudomonas aeruginosa PA01
cucgcugggcgccggcaggc

SEQ ID NO: 1477363 - RNA, 13 nt, Pseudomonas aeruginosa PA01
cucggagugaggc

SEQ ID NO: 1477364 - RNA, 13 nt, Pseudomonas aeruginosa PA01
cucgcugcgcaga

SEQ ID NO: 1477365 - RNA, 16 nt, Pseudomonas aeruginosa PA01
cucgcugcgcagaugc

SEQ ID NO: 1477366 - RNA, 23 nt, Pseudomonas aeruginosa PA01
cucgcugcgggcguagcgcggca

SEQ ID NO: 1477367 - RNA, 22 nt, Pseudomonas aeruginosa PA01
cucgcugcgugcguugcgcggc

SEQ ID NO: 1477368 - RNA, 13 nt, Pseudomonas aeruginosa PA01
cucggccggcagg

SEQ ID NO: 1477369 - RNA, 14 nt, Pseudomonas aeruginosa PA01
cucggccgccagca

SEQ ID NO: 1477370 - RNA, 13 nt, Pseudomonas aeruginosa PA01
cucggccgccagg

SEQ ID NO: 1477371 - RNA, 14 nt, Pseudomonas aeruginosa PA01
cucggccgccaggc

SEQ ID NO: 1477372 - RNA, 18 nt, Pseudomonas aeruginosa PA01
cucggccgccaggcgcgu

SEQ ID NO: 1477373 - RNA, 20 nt, Pseudomonas aeruginosa PA01
cucggccauaccuccagcca

SEQ ID NO: 1477374 - RNA, 23 nt, Pseudomonas aeruginosa PA01
cucggccauaccuccagccagca

SEQ ID NO: 1477375 - RNA, 18 nt, Pseudomonas aeruginosa PA01
cucggccaggucgcgacu

SEQ ID NO: 1477376 - RNA, 21 nt, Pseudomonas aeruginosa PA01
cucggcccggagccaacgccc

SEQ ID NO: 1477377 - RNA, 17 nt, Pseudomonas aeruginosa PA01
cucggcccuggcggcga

SEQ ID NO: 1477378 - RNA, 18 nt, Pseudomonas aeruginosa PA01
cucggcccuggcggcgaa

SEQ ID NO: 1477379 - RNA, 15 nt, Pseudomonas aeruginosa PA01
cucggccgacaggcu

SEQ ID NO: 1477380 - RNA, 16 nt, Pseudomonas aeruginosa PA01
cucggccaugccggcc

SEQ ID NO: 1477381 - RNA, 17 nt, Pseudomonas aeruginosa PA01
cucggccaugccggcca

SEQ ID NO: 1477382 - RNA, 19 nt, Pseudomonas aeruginosa PA01
cucggccaugccggccagg

SEQ ID NO: 1477383 - RNA, 23 nt, Pseudomonas aeruginosa PA01
cucggccaugccggccaggaagg

SEQ ID NO: 1477384 - RNA, 20 nt, Pseudomonas aeruginosa PA01
cucggccauggucucgcuga

SEQ ID NO: 1477385 - RNA, 22 nt, Pseudomonas aeruginosa PA01
cucggccagguacuuggccacg

SEQ ID NO: 1477386 - RNA, 20 nt, Pseudomonas aeruginosa PA01
cucggccagguauucgcgcu

SEQ ID NO: 1477387 - RNA, 21 nt, Pseudomonas aeruginosa PA01
cucggccaggaccagggcggg

SEQ ID NO: 1477388 - RNA, 14 nt, Pseudomonas aeruginosa PA01
cucggccaggcauu

SEQ ID NO: 1477389 - RNA, 18 nt, Pseudomonas aeruginosa PA01
cucggcagggcgcccgcc

SEQ ID NO: 1477390 - RNA, 19 nt, Pseudomonas aeruginosa PA01
cucggcauccucgccccgc

SEQ ID NO: 1477391 - RNA, 22 nt, Pseudomonas aeruginosa PA01
cucggcauccucgccccgccgg

SEQ ID NO: 1477392 - RNA, 19 nt, Pseudomonas aeruginosa PA01
cucggccaggcccuugagg

SEQ ID NO: 1477393 - RNA, 15 nt, Pseudomonas aeruginosa PA01
cucggccaggcgcca

SEQ ID NO: 1477394 - RNA, 13 nt, Pseudomonas aeruginosa PA01
cucggccaggcgg

SEQ ID NO: 1477395 - RNA, 21 nt, Pseudomonas aeruginosa PA01
cucggccaggcgguuccagac

SEQ ID NO: 1477396 - RNA, 16 nt, Pseudomonas aeruginosa PA01
cucgccuucguccaug

SEQ ID NO: 1477397 - RNA, 22 nt, Pseudomonas aeruginosa PA01
cucgccugguaggcggcgacga

SEQ ID NO: 1477398 - RNA, 18 nt, Pseudomonas aeruginosa PA01
cucgcgacccuggccgcg

SEQ ID NO: 1477399 - RNA, 18 nt, Pseudomonas aeruginosa PA01
cucgcgacacgugcccca

SEQ ID NO: 1477400 - RNA, 22 nt, Pseudomonas aeruginosa PA01
cucgcgaugcugugcagggagg

SEQ ID NO: 1477401 - RNA, 18 nt, Pseudomonas aeruginosa PA01
cucgcgcaagcgcccggc

SEQ ID NO: 1477402 - RNA, 19 nt, Pseudomonas aeruginosa PA01
cucgcgcaacgccuugcca

SEQ ID NO: 1477403 - RNA, 21 nt, Pseudomonas aeruginosa PA01
cucgcgcaacugcggggcgcu

SEQ ID NO: 1477404 - RNA, 21 nt, Pseudomonas aeruginosa PA01
cucgcgacugccgucggcgcc

SEQ ID NO: 1477405 - RNA, 15 nt, Pseudomonas aeruginosa PA01
cucgcgagcuggcgc

SEQ ID NO: 1477406 - RNA, 23 nt, Pseudomonas aeruginosa PA01
cucgccggcgaucuccgccaggc

SEQ ID NO: 1477407 - RNA, 12 nt, Pseudomonas aeruginosa PA01
cucgccggccug

SEQ ID NO: 1477408 - RNA, 20 nt, Pseudomonas aeruginosa PA01
cucgccucgggccaugagca

SEQ ID NO: 1477409 - RNA, 14 nt, Pseudomonas aeruginosa PA01
cucgccucccggcu

SEQ ID NO: 1477410 - RNA, 20 nt, Pseudomonas aeruginosa PA01
cucgccucccggcucgccga

SEQ ID NO: 1477411 - RNA, 22 nt, Pseudomonas aeruginosa PA01
cucgccuccgggcggaggcgag

SEQ ID NO: 1477412 - RNA, 14 nt, Pseudomonas aeruginosa PA01
cucgccucgcgcca

SEQ ID NO: 1477413 - RNA, 19 nt, Pseudomonas aeruginosa PA01
cucgcgggcgacgugggcc

SEQ ID NO: 1477414 - RNA, 16 nt, Pseudomonas aeruginosa PA01
cucgcggcgcggcggg

SEQ ID NO: 1477415 - RNA, 13 nt, Pseudomonas aeruginosa PA01
cucgcggcgcucg

SEQ ID NO: 1477416 - RNA, 18 nt, Pseudomonas aeruginosa PA01
cucgcggcguaggccucg

SEQ ID NO: 1477417 - RNA, 14 nt, Pseudomonas aeruginosa PA01
cucgcggcuggccg

SEQ ID NO: 1477418 - RNA, 15 nt, Pseudomonas aeruginosa PA01
cucgcggcggcaggc

SEQ ID NO: 1477419 - RNA, 20 nt, Pseudomonas aeruginosa PA01
cucgcgggucaccaccggga

SEQ ID NO: 1477420 - RNA, 22 nt, Pseudomonas aeruginosa PA01
cucgcgggucaccaccgggaug

SEQ ID NO: 1477421 - RNA, 15 nt, Pseudomonas aeruginosa PA01
cucgcgggucugcgc

SEQ ID NO: 1477422 - RNA, 16 nt, Pseudomonas aeruginosa PA01
cucgcgggucugcgcc

SEQ ID NO: 1477423 - RNA, 23 nt, Pseudomonas aeruginosa PA01
cucgcugacuuccaucagcucca

SEQ ID NO: 1477424 - RNA, 15 nt, Pseudomonas aeruginosa PA01
cucgcugagcaccgg

SEQ ID NO: 1477425 - RNA, 19 nt, Pseudomonas aeruginosa PA01
cucgcugaguuugcccagc

SEQ ID NO: 1477426 - RNA, 21 nt, Pseudomonas aeruginosa PA01
cucgcugaaauccaccagcac

SEQ ID NO: 1477427 - RNA, 16 nt, Pseudomonas aeruginosa PA01
cucgcugacccaggcu

SEQ ID NO: 1477428 - RNA, 22 nt, Pseudomonas aeruginosa PA01
cucgcugacccaggcuucggcg

SEQ ID NO: 1477429 - RNA, 23 nt, Pseudomonas aeruginosa PA01
cucgcugacccaggcuucggcgc

SEQ ID NO: 1477430 - RNA, 22 nt, Pseudomonas aeruginosa PA01
cucgcccagggcguggucggcg

SEQ ID NO: 1477431 - RNA, 17 nt, Pseudomonas aeruginosa PA01
cucgcccaguaccgcca

SEQ ID NO: 1477432 - RNA, 19 nt, Pseudomonas aeruginosa PA01
cucgccccggcggcgaucu

SEQ ID NO: 1477433 - RNA, 18 nt, Pseudomonas aeruginosa PA01
cucgcccgaccccacgcc

SEQ ID NO: 1477434 - RNA, 22 nt, Pseudomonas aeruginosa PA01
cucgcccgaccccacgccggcc

SEQ ID NO: 1477435 - RNA, 17 nt, Pseudomonas aeruginosa PA01
cucgcccaugcgcggcg

SEQ ID NO: 1477436 - RNA, 14 nt, Pseudomonas aeruginosa PA01
cucgccccgccggg

SEQ ID NO: 1477437 - RNA, 15 nt, Pseudomonas aeruginosa PA01
cucgccccgccggga

SEQ ID NO: 1477438 - RNA, 21 nt, Pseudomonas aeruginosa PA01
cucgcccugcuuggccagcgc

SEQ ID NO: 1477439 - RNA, 23 nt, Pseudomonas aeruginosa PA01
cucgcccgucacuucacgacagg

SEQ ID NO: 1477440 - RNA, 22 nt, Pseudomonas aeruginosa PA01
cucgcccucucccuucaggagg

SEQ ID NO: 1477441 - RNA, 13 nt, Pseudomonas aeruginosa PA01
cucgcccgccucg

SEQ ID NO: 1477442 - RNA, 17 nt, Pseudomonas aeruginosa PA01
cucgcccuugcgccgcg

SEQ ID NO: 1477443 - RNA, 21 nt, Pseudomonas aeruginosa PA01
cucgcccuugggaccgggcau

SEQ ID NO: 1477444 - RNA, 17 nt, Pseudomonas aeruginosa PA01
cucgccgaacaggaucu

SEQ ID NO: 1477445 - RNA, 20 nt, Pseudomonas aeruginosa PA01
cucgcccuugaccagucccg

SEQ ID NO: 1477446 - RNA, 14 nt, Pseudomonas aeruginosa PA01
cucgccgaccgcca

SEQ ID NO: 1477447 - RNA, 12 nt, Pseudomonas aeruginosa PA01
cucgccgaccag

SEQ ID NO: 1477448 - RNA, 20 nt, Pseudomonas aeruginosa PA01
cucgccgaaggugcaggccg

SEQ ID NO: 1477449 - RNA, 13 nt, Pseudomonas aeruginosa PA01
cucgccgccagca

SEQ ID NO: 1477450 - RNA, 15 nt, Pseudomonas aeruginosa PA01
cucgccgccagcagg

SEQ ID NO: 1477451 - RNA, 16 nt, Pseudomonas aeruginosa PA01
cucgccgacggcuucg

SEQ ID NO: 1477452 - RNA, 17 nt, Pseudomonas aeruginosa PA01
cucgccgacuuccaggc

SEQ ID NO: 1477453 - RNA, 11 nt, Pseudomonas aeruginosa PA01
cucgccgccga

SEQ ID NO: 1477454 - RNA, 16 nt, Pseudomonas aeruginosa PA01
cucgccgaucuccucc

SEQ ID NO: 1477455 - RNA, 13 nt, Pseudomonas aeruginosa PA01
cucgccgccgagc

SEQ ID NO: 1477456 - RNA, 12 nt, Pseudomonas aeruginosa PA01
cucgccgccggc

SEQ ID NO: 1477457 - RNA, 13 nt, Pseudomonas aeruginosa PA01
cucgccgccggcg

SEQ ID NO: 1477458 - RNA, 16 nt, Pseudomonas aeruginosa PA01
cucgccgccggcgagg

SEQ ID NO: 1477459 - RNA, 21 nt, Pseudomonas aeruginosa PA01
cucgccgccgggcgcgcgccu

SEQ ID NO: 1477460 - RNA, 18 nt, Pseudomonas aeruginosa PA01
cucgccgccuucggcagg

SEQ ID NO: 1477461 - RNA, 14 nt, Pseudomonas aeruginosa PA01
cucgccgcgcacgu

SEQ ID NO: 1477462 - RNA, 18 nt, Pseudomonas aeruginosa PA01
cucgccgcgcacgucgag

SEQ ID NO: 1477463 - RNA, 15 nt, Pseudomonas aeruginosa PA01
cucgccgcuccgcgc

SEQ ID NO: 1477464 - RNA, 17 nt, Pseudomonas aeruginosa PA01
cucgccgcuccgcgcca

SEQ ID NO: 1477465 - RNA, 18 nt, Pseudomonas aeruginosa PA01
cucgccgcuccgcgccac

SEQ ID NO: 1477466 - RNA, 20 nt, Pseudomonas aeruginosa PA01
cucgccgcugaaguccuggc

SEQ ID NO: 1477467 - RNA, 22 nt, Pseudomonas aeruginosa PA01
cucgccgcugaaguccuggccg

SEQ ID NO: 1477468 - RNA, 18 nt, Pseudomonas aeruginosa PA01
cucgccggcacuguuccu

SEQ ID NO: 1477469 - RNA, 16 nt, Pseudomonas aeruginosa PA01
cucgccgcgcucgcgc

SEQ ID NO: 1477470 - RNA, 17 nt, Pseudomonas aeruginosa PA01
cucgccgcgcucgcgca

SEQ ID NO: 1477471 - RNA, 14 nt, Pseudomonas aeruginosa PA01
cucgccgcgcugca

SEQ ID NO: 1477472 - RNA, 13 nt, Pseudomonas aeruginosa PA01
cucgccggccagu

SEQ ID NO: 1477473 - RNA, 13 nt, Pseudomonas aeruginosa PA01
cucgaggccgagc

SEQ ID NO: 1477474 - RNA, 21 nt, Pseudomonas aeruginosa PA01
cucgaggaacaggucgacggc

SEQ ID NO: 1477475 - RNA, 13 nt, Pseudomonas aeruginosa PA01
cucgagccggcug

SEQ ID NO: 1477476 - RNA, 12 nt, Pseudomonas aeruginosa PA01
cucgagccguuc

SEQ ID NO: 1477477 - RNA, 17 nt, Pseudomonas aeruginosa PA01
cucgcagagcgccagcc

SEQ ID NO: 1477478 - RNA, 12 nt, Pseudomonas aeruginosa PA01
cucgcagcaggc

SEQ ID NO: 1477479 - RNA, 20 nt, Pseudomonas aeruginosa PA01
cucgcagcaggcguucggcg

SEQ ID NO: 1477480 - RNA, 17 nt, Pseudomonas aeruginosa PA01
cucgcagccgcgcucgg

SEQ ID NO: 1477481 - RNA, 20 nt, Pseudomonas aeruginosa PA01
cucgcagccgcgcucggcca

SEQ ID NO: 1477482 - RNA, 17 nt, Pseudomonas aeruginosa PA01
cucgcagccggcggcga

SEQ ID NO: 1477483 - RNA, 15 nt, Pseudomonas aeruginosa PA01
cucgcagccgguggu

SEQ ID NO: 1477484 - RNA, 19 nt, Pseudomonas aeruginosa PA01
cucgagggcgaccgccagg

SEQ ID NO: 1477485 - RNA, 19 nt, Pseudomonas aeruginosa PA01
cucgcaaguuacgcgcagc

SEQ ID NO: 1477486 - RNA, 21 nt, Pseudomonas aeruginosa PA01
cucgccagaugacgauggccg

SEQ ID NO: 1477487 - RNA, 15 nt, Pseudomonas aeruginosa PA01
cucgccagcgcgcgc

SEQ ID NO: 1477488 - RNA, 15 nt, Pseudomonas aeruginosa PA01
cucgccagcccggca

SEQ ID NO: 1477489 - RNA, 14 nt, Pseudomonas aeruginosa PA01
cucgcccagcaggc

SEQ ID NO: 1477490 - RNA, 17 nt, Pseudomonas aeruginosa PA01
cucgcccagcaggcgcg

SEQ ID NO: 1477491 - RNA, 20 nt, Pseudomonas aeruginosa PA01
cucgcccagcaggcgcgccc

SEQ ID NO: 1477492 - RNA, 21 nt, Pseudomonas aeruginosa PA01
cucgcccagcaggcgcgcccu

SEQ ID NO: 1477493 - RNA, 19 nt, Pseudomonas aeruginosa PA01
cucgccauucucgccauga

SEQ ID NO: 1477494 - RNA, 16 nt, Pseudomonas aeruginosa PA01
cucgccaucggccugg

SEQ ID NO: 1477495 - RNA, 19 nt, Pseudomonas aeruginosa PA01
cucgccaugacacaccacg

SEQ ID NO: 1477496 - RNA, 22 nt, Pseudomonas aeruginosa PA01
cucgccacugauaccgcuggcc

SEQ ID NO: 1477497 - RNA, 16 nt, Pseudomonas aeruginosa PA01
cucgccaagcuggcga

SEQ ID NO: 1477498 - RNA, 21 nt, Pseudomonas aeruginosa PA01
cucgccaagcuggcgaucgac

SEQ ID NO: 1477499 - RNA, 19 nt, Pseudomonas aeruginosa PA01
cucgccaccccgcuccgcu

SEQ ID NO: 1477500 - RNA, 14 nt, Pseudomonas aeruginosa PA01
cuccgaggccacca

SEQ ID NO: 1477501 - RNA, 22 nt, Pseudomonas aeruginosa PA01
cuccgagggaggaggcgccggg

SEQ ID NO: 1477502 - RNA, 17 nt, Pseudomonas aeruginosa PA01
cuccgagggccgcgccg

SEQ ID NO: 1477503 - RNA, 18 nt, Pseudomonas aeruginosa PA01
cuccgagggccgcgccga

SEQ ID NO: 1477504 - RNA, 19 nt, Pseudomonas aeruginosa PA01
cuccgagggccgcgccgac

SEQ ID NO: 1477505 - RNA, 22 nt, Pseudomonas aeruginosa PA01
cuccgagggccgcgccgaccca

SEQ ID NO: 1477506 - RNA, 21 nt, Pseudomonas aeruginosa PA01
cuccgacuggugggcacgagu

SEQ ID NO: 1477507 - RNA, 17 nt, Pseudomonas aeruginosa PA01
cuccgacuccugcaaca

SEQ ID NO: 1477508 - RNA, 20 nt, Pseudomonas aeruginosa PA01
cuccgaugaagcaggcggag

SEQ ID NO: 1477509 - RNA, 19 nt, Pseudomonas aeruginosa PA01
cuccgaguccugcugcgac

SEQ ID NO: 1477510 - RNA, 21 nt, Pseudomonas aeruginosa PA01
cuccgauggcgcuggaacagc

SEQ ID NO: 1477511 - RNA, 23 nt, Pseudomonas aeruginosa PA01
cuccgauggcgcuggaacagcgg

SEQ ID NO: 1477512 - RNA, 19 nt, Pseudomonas aeruginosa PA01
cuccgaagggaacccgcgg

SEQ ID NO: 1477513 - RNA, 14 nt, Pseudomonas aeruginosa PA01
cuccgaccagguag

SEQ ID NO: 1477514 - RNA, 19 nt, Pseudomonas aeruginosa PA01
cuccgacgaucucaucgcc

SEQ ID NO: 1477515 - RNA, 19 nt, Pseudomonas aeruginosa PA01
cucccuggcggauaucgcg

SEQ ID NO: 1477516 - RNA, 23 nt, Pseudomonas aeruginosa PA01
cucccuggcggauaucgcgccgc

SEQ ID NO: 1477517 - RNA, 18 nt, Pseudomonas aeruginosa PA01
cucccgggccagcuccgc

SEQ ID NO: 1477518 - RNA, 15 nt, Pseudomonas aeruginosa PA01
cucccugcucgcgca

SEQ ID NO: 1477519 - RNA, 15 nt, Pseudomonas aeruginosa PA01
cucccuugccgccgg

SEQ ID NO: 1477520 - RNA, 22 nt, Pseudomonas aeruginosa PA01
cuccgccggggguguugaaagc

SEQ ID NO: 1477521 - RNA, 21 nt, Pseudomonas aeruginosa PA01
cuccgccggcguugcgcgccc

SEQ ID NO: 1477522 - RNA, 21 nt, Pseudomonas aeruginosa PA01
cuccgccuggcggauaucgcg

SEQ ID NO: 1477523 - RNA, 20 nt, Pseudomonas aeruginosa PA01
cuccgccgcgccucgucgcg

SEQ ID NO: 1477524 - RNA, 22 nt, Pseudomonas aeruginosa PA01
cuccgccgcgugcgcgcccucg

SEQ ID NO: 1477525 - RNA, 21 nt, Pseudomonas aeruginosa PA01
cuccgccgcuaucgccgccgc

SEQ ID NO: 1477526 - RNA, 22 nt, Pseudomonas aeruginosa PA01
cuccgccgcuaucgccgccgca

SEQ ID NO: 1477527 - RNA, 15 nt, Pseudomonas aeruginosa PA01
cuccgccgcuuccgc

SEQ ID NO: 1477528 - RNA, 22 nt, Pseudomonas aeruginosa PA01
cuccgccccggcaagcgccggc

SEQ ID NO: 1477529 - RNA, 13 nt, Pseudomonas aeruginosa PA01
cuccgccaggucg

SEQ ID NO: 1477530 - RNA, 23 nt, Pseudomonas aeruginosa PA01
cuccgccaggucgauccccaacc

SEQ ID NO: 1477531 - RNA, 19 nt, Pseudomonas aeruginosa PA01
cuccgcccaguucuucgcc

SEQ ID NO: 1477532 - RNA, 21 nt, Pseudomonas aeruginosa PA01
cuccgcccaguucuucgccgc

SEQ ID NO: 1477533 - RNA, 22 nt, Pseudomonas aeruginosa PA01
cuccgcccaguucuucgccgcc

SEQ ID NO: 1477534 - RNA, 18 nt, Pseudomonas aeruginosa PA01
cuccgccagcaccacccg

SEQ ID NO: 1477535 - RNA, 20 nt, Pseudomonas aeruginosa PA01
cuccgccagcaccacccggc

SEQ ID NO: 1477536 - RNA, 22 nt, Pseudomonas aeruginosa PA01
cuccgccagcaccacccggccg

SEQ ID NO: 1477537 - RNA, 22 nt, Pseudomonas aeruginosa PA01
cuccgccagccagccgcgcgcc

SEQ ID NO: 1477538 - RNA, 16 nt, Pseudomonas aeruginosa PA01
cuccgccagcguuucg

SEQ ID NO: 1477539 - RNA, 13 nt, Pseudomonas aeruginosa PA01
cuccgccaggccg

SEQ ID NO: 1477540 - RNA, 19 nt, Pseudomonas aeruginosa PA01
cuccgccaggcgcuccagg

SEQ ID NO: 1477541 - RNA, 13 nt, Pseudomonas aeruginosa PA01
cuccgccaggcgg

SEQ ID NO: 1477542 - RNA, 14 nt, Pseudomonas aeruginosa PA01
cuccgcuuccgccc

SEQ ID NO: 1477543 - RNA, 14 nt, Pseudomonas aeruginosa PA01
cuccggaacgccug

SEQ ID NO: 1477544 - RNA, 14 nt, Pseudomonas aeruginosa PA01
cuccggauggcuga

SEQ ID NO: 1477545 - RNA, 21 nt, Pseudomonas aeruginosa PA01
cuccggauggcugacccgcug

SEQ ID NO: 1477546 - RNA, 12 nt, Pseudomonas aeruginosa PA01
cuccggacgccg

SEQ ID NO: 1477547 - RNA, 15 nt, Pseudomonas aeruginosa PA01
cuccggacugccgau

SEQ ID NO: 1477548 - RNA, 16 nt, Pseudomonas aeruginosa PA01
cuccggacugccgaug

SEQ ID NO: 1477549 - RNA, 18 nt, Pseudomonas aeruginosa PA01
cuccggagaaccggcgga

SEQ ID NO: 1477550 - RNA, 23 nt, Pseudomonas aeruginosa PA01
cuccgcuggauggcauuggugcu

SEQ ID NO: 1477551 - RNA, 15 nt, Pseudomonas aeruginosa PA01
cuccgcucugcuggc

SEQ ID NO: 1477552 - RNA, 17 nt, Pseudomonas aeruginosa PA01
cuccgcucugcuggcca

SEQ ID NO: 1477553 - RNA, 21 nt, Pseudomonas aeruginosa PA01
cuccgcucugcuggccacccu

SEQ ID NO: 1477554 - RNA, 17 nt, Pseudomonas aeruginosa PA01
cuccgccugcacgucgg

SEQ ID NO: 1477555 - RNA, 19 nt, Pseudomonas aeruginosa PA01
cuccgcgccgggcuggccg

SEQ ID NO: 1477556 - RNA, 22 nt, Pseudomonas aeruginosa PA01
cuccgcgauguccccggccagc

SEQ ID NO: 1477557 - RNA, 15 nt, Pseudomonas aeruginosa PA01
cuccgcggagaggau

SEQ ID NO: 1477558 - RNA, 14 nt, Pseudomonas aeruginosa PA01
cuccgcggccggcu

SEQ ID NO: 1477559 - RNA, 19 nt, Pseudomonas aeruginosa PA01
cuccgcggccggcuucagc

SEQ ID NO: 1477560 - RNA, 17 nt, Pseudomonas aeruginosa PA01
cuccggcacgcugccgc

SEQ ID NO: 1477561 - RNA, 13 nt, Pseudomonas aeruginosa PA01
cuccggcagcguc

SEQ ID NO: 1477562 - RNA, 18 nt, Pseudomonas aeruginosa PA01
cuccggcgcagcccagcc

SEQ ID NO: 1477563 - RNA, 14 nt, Pseudomonas aeruginosa PA01
cuccggcgccaggc

SEQ ID NO: 1477564 - RNA, 17 nt, Pseudomonas aeruginosa PA01
cuccggcgccaggcccu

SEQ ID NO: 1477565 - RNA, 16 nt, Pseudomonas aeruginosa PA01
cuccggcgccaggccg

SEQ ID NO: 1477566 - RNA, 17 nt, Pseudomonas aeruginosa PA01
cuccggcgccaggccgg

SEQ ID NO: 1477567 - RNA, 21 nt, Pseudomonas aeruginosa PA01
cuccggcgccaggccggagcc

SEQ ID NO: 1477568 - RNA, 14 nt, Pseudomonas aeruginosa PA01
cuccggcgccgagg

SEQ ID NO: 1477569 - RNA, 13 nt, Pseudomonas aeruginosa PA01
cuccggcgccggg

SEQ ID NO: 1477570 - RNA, 16 nt, Pseudomonas aeruginosa PA01
cuccggcgcguuggcu

SEQ ID NO: 1477571 - RNA, 19 nt, Pseudomonas aeruginosa PA01
cuccggcgcguuggcuggc

SEQ ID NO: 1477572 - RNA, 21 nt, Pseudomonas aeruginosa PA01
cuccggcgcguuggcuggcgg

SEQ ID NO: 1477573 - RNA, 14 nt, Pseudomonas aeruginosa PA01
cuccuugcgccguu

SEQ ID NO: 1477574 - RNA, 23 nt, Pseudomonas aeruginosa PA01
cuccuugaaggcuuccuggaagc

SEQ ID NO: 1477575 - RNA, 15 nt, Pseudomonas aeruginosa PA01
cuccuguugcuggcc

SEQ ID NO: 1477576 - RNA, 18 nt, Pseudomonas aeruginosa PA01
cuccuguugcuggccggu

SEQ ID NO: 1477577 - RNA, 22 nt, Pseudomonas aeruginosa PA01
cuccugguagaacuccuugccg

SEQ ID NO: 1477578 - RNA, 17 nt, Pseudomonas aeruginosa PA01
cuccucggccugggcgc

SEQ ID NO: 1477579 - RNA, 19 nt, Pseudomonas aeruginosa PA01
cuccucggccuugcuggcg

SEQ ID NO: 1477580 - RNA, 14 nt, Pseudomonas aeruginosa PA01
cuccuggugcggca

SEQ ID NO: 1477581 - RNA, 16 nt, Pseudomonas aeruginosa PA01
cuccuggugcggcacc

SEQ ID NO: 1477582 - RNA, 17 nt, Pseudomonas aeruginosa PA01
cuccuuuggcgucgaug

SEQ ID NO: 1477583 - RNA, 14 nt, Pseudomonas aeruginosa PA01
cucgaaagccgccg

SEQ ID NO: 1477584 - RNA, 19 nt, Pseudomonas aeruginosa PA01
cucgaaagccgccgccgcg

SEQ ID NO: 1477585 - RNA, 20 nt, Pseudomonas aeruginosa PA01
cuccuuucggaacagcgccu

SEQ ID NO: 1477586 - RNA, 17 nt, Pseudomonas aeruginosa PA01
cucgaacaccggcgagc

SEQ ID NO: 1477587 - RNA, 18 nt, Pseudomonas aeruginosa PA01
cucgaacaccggcgagca

SEQ ID NO: 1477588 - RNA, 14 nt, Pseudomonas aeruginosa PA01
cucgaacagcagca

SEQ ID NO: 1477589 - RNA, 21 nt, Pseudomonas aeruginosa PA01
cuccuccucgcucugcgccgc

SEQ ID NO: 1477590 - RNA, 16 nt, Pseudomonas aeruginosa PA01
cuccucccgccccucc

SEQ ID NO: 1477591 - RNA, 14 nt, Pseudomonas aeruginosa PA01
cuccuccgggaaga

SEQ ID NO: 1477592 - RNA, 13 nt, Pseudomonas aeruginosa PA01
cuccucgacggcg

SEQ ID NO: 1477593 - RNA, 19 nt, Pseudomonas aeruginosa PA01
cuccucgauaaacggcgcu

SEQ ID NO: 1477594 - RNA, 13 nt, Pseudomonas aeruginosa PA01
cuccucgauccgc

SEQ ID NO: 1477595 - RNA, 22 nt, Pseudomonas aeruginosa PA01
cuccucgaugaaacgcagggcc

SEQ ID NO: 1477596 - RNA, 19 nt, Pseudomonas aeruginosa PA01
cuccucggcagcgcuggcg

SEQ ID NO: 1477597 - RNA, 23 nt, Pseudomonas aeruginosa PA01
cuccucggcagcgcuggcgauca

SEQ ID NO: 1477598 - RNA, 13 nt, Pseudomonas aeruginosa PA01
cuccucgccgccg

SEQ ID NO: 1477599 - RNA, 16 nt, Pseudomonas aeruginosa PA01
cuccucgccgccgacc

SEQ ID NO: 1477600 - RNA, 23 nt, Pseudomonas aeruginosa PA01
cuccuccagcaggaccuggccgu

SEQ ID NO: 1477601 - RNA, 16 nt, Pseudomonas aeruginosa PA01
cuccgggcggcuguag

SEQ ID NO: 1477602 - RNA, 17 nt, Pseudomonas aeruginosa PA01
cuccgggcguaacggcu

SEQ ID NO: 1477603 - RNA, 20 nt, Pseudomonas aeruginosa PA01
cuccgggagcaucuggcccg

SEQ ID NO: 1477604 - RNA, 13 nt, Pseudomonas aeruginosa PA01
cuccgggccgagg

SEQ ID NO: 1477605 - RNA, 23 nt, Pseudomonas aeruginosa PA01
cuccgggccgagggcugagacgc

SEQ ID NO: 1477606 - RNA, 18 nt, Pseudomonas aeruginosa PA01
cuccgggcagaccagcag

SEQ ID NO: 1477607 - RNA, 20 nt, Pseudomonas aeruginosa PA01
cuccgggcagaccagcagcg

SEQ ID NO: 1477608 - RNA, 14 nt, Pseudomonas aeruginosa PA01
cuccgggaacagcc

SEQ ID NO: 1477609 - RNA, 20 nt, Pseudomonas aeruginosa PA01
cuccggcucgcugacgccau

SEQ ID NO: 1477610 - RNA, 14 nt, Pseudomonas aeruginosa PA01
cucgaccucggccg

SEQ ID NO: 1477611 - RNA, 16 nt, Pseudomonas aeruginosa PA01
cucgaccucggccgca

SEQ ID NO: 1477612 - RNA, 16 nt, Pseudomonas aeruginosa PA01
cucgaagcuccagcgu

SEQ ID NO: 1477613 - RNA, 16 nt, Pseudomonas aeruginosa PA01
cucgaagcucuucgcc

SEQ ID NO: 1477614 - RNA, 16 nt, Pseudomonas aeruginosa PA01
cucgacgaaggcgcgc

SEQ ID NO: 1477615 - RNA, 17 nt, Pseudomonas aeruginosa PA01
cucgacgaaggcgcgcu

SEQ ID NO: 1477616 - RNA, 13 nt, Pseudomonas aeruginosa PA01
cucgaccuugccg

SEQ ID NO: 1477617 - RNA, 19 nt, Pseudomonas aeruginosa PA01
cucgacgaaauaaugcggc

SEQ ID NO: 1477618 - RNA, 22 nt, Pseudomonas aeruginosa PA01
cucgacgaaauaaugcggcgcg

SEQ ID NO: 1477619 - RNA, 15 nt, Pseudomonas aeruginosa PA01
cucgaacggcggauc

SEQ ID NO: 1477620 - RNA, 20 nt, Pseudomonas aeruginosa PA01
cucgaacggcggaucgauca

SEQ ID NO: 1477621 - RNA, 17 nt, Pseudomonas aeruginosa PA01
cucgaacaacuggacga

SEQ ID NO: 1477622 - RNA, 20 nt, Pseudomonas aeruginosa PA01
cucgaaccccuggcgcucga

SEQ ID NO: 1477623 - RNA, 16 nt, Pseudomonas aeruginosa PA01
cucgaagagcuggcgg

SEQ ID NO: 1477624 - RNA, 21 nt, Pseudomonas aeruginosa PA01
cucgaagcagagggcguccug

SEQ ID NO: 1477625 - RNA, 16 nt, Pseudomonas aeruginosa PA01
cucgaagcccagcgcc

SEQ ID NO: 1477626 - RNA, 17 nt, Pseudomonas aeruginosa PA01
cucgaaggccagcucgu

SEQ ID NO: 1477627 - RNA, 19 nt, Pseudomonas aeruginosa PA01
cucgaaggccagcucgucg

SEQ ID NO: 1477628 - RNA, 16 nt, Pseudomonas aeruginosa PA01
cucgaagcgcgccugc

SEQ ID NO: 1477629 - RNA, 17 nt, Pseudomonas aeruginosa PA01
cucgaagcgcgccugcu

SEQ ID NO: 1477630 - RNA, 14 nt, Pseudomonas aeruginosa PA01
cucgaagcgcuugc

SEQ ID NO: 1477631 - RNA, 23 nt, Pseudomonas aeruginosa PA01
cucgaagcggaucucgucgccga

SEQ ID NO: 1477632 - RNA, 13 nt, Pseudomonas aeruginosa PA01
cucgacggcgauc

SEQ ID NO: 1477633 - RNA, 16 nt, Pseudomonas aeruginosa PA01
cucgacgggcgcuucc

SEQ ID NO: 1477634 - RNA, 13 nt, Pseudomonas aeruginosa PA01
cucgacggucagc

SEQ ID NO: 1477635 - RNA, 19 nt, Pseudomonas aeruginosa PA01
cucgacgcugcccagcccg

SEQ ID NO: 1477636 - RNA, 16 nt, Pseudomonas aeruginosa PA01
cucgacggcaccagcg

SEQ ID NO: 1477637 - RNA, 18 nt, Pseudomonas aeruginosa PA01
cucgacgagccgcgacgc

SEQ ID NO: 1477638 - RNA, 23 nt, Pseudomonas aeruginosa PA01
cucgacgaucaggugcaggaaca

SEQ ID NO: 1477639 - RNA, 18 nt, Pseudomonas aeruginosa PA01
cucgacgaucugucgaua

SEQ ID NO: 1477640 - RNA, 22 nt, Pseudomonas aeruginosa PA01
cucgacgauauccacgccgucg

SEQ ID NO: 1477641 - RNA, 23 nt, Pseudomonas aeruginosa PA01
cucgacgauauccacgccgucgc

SEQ ID NO: 1477642 - RNA, 16 nt, Pseudomonas aeruginosa PA01
cuagaccaacugcgcc

SEQ ID NO: 1477643 - RNA, 14 nt, Pseudomonas aeruginosa PA01
cuagcccucgaccu

SEQ ID NO: 1477644 - RNA, 15 nt, Pseudomonas aeruginosa PA01
cuagcccucgaccug

SEQ ID NO: 1477645 - RNA, 20 nt, Pseudomonas aeruginosa PA01
cuagcgaaggcuccgcugcu

SEQ ID NO: 1477646 - RNA, 13 nt, Pseudomonas aeruginosa PA01
cuagcgcaggcgg

SEQ ID NO: 1477647 - RNA, 21 nt, Pseudomonas aeruginosa PA01
cuagcgcauggcgaccuggug

SEQ ID NO: 1477648 - RNA, 23 nt, Pseudomonas aeruginosa PA01
cuagcgcauggcgaccugguggc

SEQ ID NO: 1477649 - RNA, 17 nt, Pseudomonas aeruginosa PA01
cuagcgccccggccgcg

SEQ ID NO: 1477650 - RNA, 20 nt, Pseudomonas aeruginosa PA01
cuauccacgacgucggcggc

SEQ ID NO: 1477651 - RNA, 13 nt, Pseudomonas aeruginosa PA01
cuaucaggugagg

SEQ ID NO: 1477652 - RNA, 21 nt, Pseudomonas aeruginosa PA01
cuaugcgccguuacgccgggu

SEQ ID NO: 1477653 - RNA, 14 nt, Pseudomonas aeruginosa PA01
cuaugggacgaccu

SEQ ID NO: 1477654 - RNA, 14 nt, Pseudomonas aeruginosa PA01
cucaacgaccgccc

SEQ ID NO: 1477655 - RNA, 16 nt, Pseudomonas aeruginosa PA01
cucaacggcgugccgg

SEQ ID NO: 1477656 - RNA, 17 nt, Pseudomonas aeruginosa PA01
cucaacugguuggccgc

SEQ ID NO: 1477657 - RNA, 17 nt, Pseudomonas aeruginosa PA01
cucaacgccucgcggcu

SEQ ID NO: 1477658 - RNA, 14 nt, Pseudomonas aeruginosa PA01
cuacccgcgcuucu

SEQ ID NO: 1477659 - RNA, 22 nt, Pseudomonas aeruginosa PA01
cuacccucaggggugcagcccu

SEQ ID NO: 1477660 - RNA, 22 nt, Pseudomonas aeruginosa PA01
cuacccugccccagcaucgccg

SEQ ID NO: 1477661 - RNA, 17 nt, Pseudomonas aeruginosa PA01
cguugagggucagcgac

SEQ ID NO: 1477662 - RNA, 16 nt, Pseudomonas aeruginosa PA01
cuacagcccccccagc

SEQ ID NO: 1477663 - RNA, 13 nt, Pseudomonas aeruginosa PA01
cuacaggaccuuc

SEQ ID NO: 1477664 - RNA, 18 nt, Pseudomonas aeruginosa PA01
cguucugcaggacgaagu

SEQ ID NO: 1477665 - RNA, 21 nt, Pseudomonas aeruginosa PA01
cguucuucacccgcagcggca

SEQ ID NO: 1477666 - RNA, 20 nt, Pseudomonas aeruginosa PA01
cguucuuccccugcaugccg

SEQ ID NO: 1477667 - RNA, 16 nt, Pseudomonas aeruginosa PA01
cguugaacucggcgcc

SEQ ID NO: 1477668 - RNA, 17 nt, Pseudomonas aeruginosa PA01
cguugaaagucugcacc

SEQ ID NO: 1477669 - RNA, 21 nt, Pseudomonas aeruginosa PA01
cguugacugccugcagguagc

SEQ ID NO: 1477670 - RNA, 17 nt, Pseudomonas aeruginosa PA01
cguugagcaucaccgcg

SEQ ID NO: 1477671 - RNA, 18 nt, Pseudomonas aeruginosa PA01
cguugagcaucaccgcgg

SEQ ID NO: 1477672 - RNA, 14 nt, Pseudomonas aeruginosa PA01
cguugagcaccgga

SEQ ID NO: 1477673 - RNA, 20 nt, Pseudomonas aeruginosa PA01
cguugagcaccucgaccugg

SEQ ID NO: 1477674 - RNA, 15 nt, Pseudomonas aeruginosa PA01
cguugagggccuuga

SEQ ID NO: 1477675 - RNA, 19 nt, Pseudomonas aeruginosa PA01
cguugagggccuugagcac

SEQ ID NO: 1477676 - RNA, 12 nt, Pseudomonas aeruginosa PA01
cuaccggcgccg

SEQ ID NO: 1477677 - RNA, 14 nt, Pseudomonas aeruginosa PA01
cuacguuccagggc

SEQ ID NO: 1477678 - RNA, 17 nt, Pseudomonas aeruginosa PA01
cuacuaccgccagcgca

SEQ ID NO: 1477679 - RNA, 12 nt, Pseudomonas aeruginosa PA01
cuaccggcaagg

SEQ ID NO: 1477680 - RNA, 19 nt, Pseudomonas aeruginosa PA01
cuaccgccgagggcgccag

SEQ ID NO: 1477681 - RNA, 15 nt, Pseudomonas aeruginosa PA01
cuaccgcaucgccac

SEQ ID NO: 1477682 - RNA, 14 nt, Pseudomonas aeruginosa PA01
cuaccgcccacccu

SEQ ID NO: 1477683 - RNA, 20 nt, Pseudomonas aeruginosa PA01
cuaccgcccacccugcgcga

SEQ ID NO: 1477684 - RNA, 20 nt, Pseudomonas aeruginosa PA01
cuaccgcugggacggcggcu

SEQ ID NO: 1477685 - RNA, 16 nt, Pseudomonas aeruginosa PA01
cuaccgcgcauggcgg

SEQ ID NO: 1477686 - RNA, 18 nt, Pseudomonas aeruginosa PA01
cuacuccaggggucggca

SEQ ID NO: 1477687 - RNA, 22 nt, Pseudomonas aeruginosa PA01
cuacugggcguggcggccgccg

SEQ ID NO: 1477688 - RNA, 17 nt, Pseudomonas aeruginosa PA01
cuacuucccugccggcg

SEQ ID NO: 1477689 - RNA, 14 nt, Pseudomonas aeruginosa PA01
cuacuucucgacga

SEQ ID NO: 1477690 - RNA, 20 nt, Pseudomonas aeruginosa PA01
cucccaacuggucuugccga

SEQ ID NO: 1477691 - RNA, 17 nt, Pseudomonas aeruginosa PA01
cucccaccgcgcggcac

SEQ ID NO: 1477692 - RNA, 14 nt, Pseudomonas aeruginosa PA01
cucccggcugguca

SEQ ID NO: 1477693 - RNA, 21 nt, Pseudomonas aeruginosa PA01
cucccggccuggugacccgga

SEQ ID NO: 1477694 - RNA, 17 nt, Pseudomonas aeruginosa PA01
cucccguaccagcgcga

SEQ ID NO: 1477695 - RNA, 17 nt, Pseudomonas aeruginosa PA01
cucccguccagcgcuug

SEQ ID NO: 1477696 - RNA, 17 nt, Pseudomonas aeruginosa PA01
cucccuaucuccgccgg

SEQ ID NO: 1477697 - RNA, 18 nt, Pseudomonas aeruginosa PA01
cucccuaucuccgccggg

SEQ ID NO: 1477698 - RNA, 23 nt, Pseudomonas aeruginosa PA01
cuccaggcgaaggucgaaggcgc

SEQ ID NO: 1477699 - RNA, 17 nt, Pseudomonas aeruginosa PA01
cuccaggcgcgccgugc

SEQ ID NO: 1477700 - RNA, 14 nt, Pseudomonas aeruginosa PA01
cuccaggcgcgccu

SEQ ID NO: 1477701 - RNA, 23 nt, Pseudomonas aeruginosa PA01
cuccaggcggcgguagccgaggc

SEQ ID NO: 1477702 - RNA, 17 nt, Pseudomonas aeruginosa PA01
cuccaggcucuucagca

SEQ ID NO: 1477703 - RNA, 21 nt, Pseudomonas aeruginosa PA01
cuccaggcugugggcgacuuc

SEQ ID NO: 1477704 - RNA, 20 nt, Pseudomonas aeruginosa PA01
cuccagggagcgcucgcgca

SEQ ID NO: 1477705 - RNA, 18 nt, Pseudomonas aeruginosa PA01
cuccagggcauccucgcg

SEQ ID NO: 1477706 - RNA, 20 nt, Pseudomonas aeruginosa PA01
cuccagggcauccucgcggu

SEQ ID NO: 1477707 - RNA, 18 nt, Pseudomonas aeruginosa PA01
cuccagcuugucgucggc

SEQ ID NO: 1477708 - RNA, 12 nt, Pseudomonas aeruginosa PA01
cuccaggccgaa

SEQ ID NO: 1477709 - RNA, 18 nt, Pseudomonas aeruginosa PA01
cuccaggccgaagccgcc

SEQ ID NO: 1477710 - RNA, 14 nt, Pseudomonas aeruginosa PA01
cuccaggccgccgg

SEQ ID NO: 1477711 - RNA, 16 nt, Pseudomonas aeruginosa PA01
cuccaggccgccggcg

SEQ ID NO: 1477712 - RNA, 17 nt, Pseudomonas aeruginosa PA01
cuccaggccgccggcga

SEQ ID NO: 1477713 - RNA, 19 nt, Pseudomonas aeruginosa PA01
cuccaggccgccggcgacc

SEQ ID NO: 1477714 - RNA, 14 nt, Pseudomonas aeruginosa PA01
cuccaggaccggca

SEQ ID NO: 1477715 - RNA, 23 nt, Pseudomonas aeruginosa PA01
cuccaggaaccaggggucgacgc

SEQ ID NO: 1477716 - RNA, 19 nt, Pseudomonas aeruginosa PA01
cuccaggucgaacagcggc

SEQ ID NO: 1477717 - RNA, 20 nt, Pseudomonas aeruginosa PA01
cuccaggucgaacagcggcu

SEQ ID NO: 1477718 - RNA, 21 nt, Pseudomonas aeruginosa PA01
cuccaggucgaacagcggcug

SEQ ID NO: 1477719 - RNA, 22 nt, Pseudomonas aeruginosa PA01
cuccagggcugccaccgagggc

SEQ ID NO: 1477720 - RNA, 17 nt, Pseudomonas aeruginosa PA01
cuccaggggucggcauc

SEQ ID NO: 1477721 - RNA, 18 nt, Pseudomonas aeruginosa PA01
cuccaggggucggcaucg

SEQ ID NO: 1477722 - RNA, 19 nt, Pseudomonas aeruginosa PA01
cuccagggugccgaccaac

SEQ ID NO: 1477723 - RNA, 18 nt, Pseudomonas aeruginosa PA01
cuccaugcgggagagcgc

SEQ ID NO: 1477724 - RNA, 17 nt, Pseudomonas aeruginosa PA01
cuccauuagcgucgcgc

SEQ ID NO: 1477725 - RNA, 23 nt, Pseudomonas aeruginosa PA01
cuccagcugcgccugcagcucgg

SEQ ID NO: 1477726 - RNA, 19 nt, Pseudomonas aeruginosa PA01
cuccagcucgacccgcccg

SEQ ID NO: 1477727 - RNA, 13 nt, Pseudomonas aeruginosa PA01
cuccagcggcggg

SEQ ID NO: 1477728 - RNA, 23 nt, Pseudomonas aeruginosa PA01
cuccagcgggaaggucggcagca

SEQ ID NO: 1477729 - RNA, 14 nt, Pseudomonas aeruginosa PA01
cuccagcgcccagg

SEQ ID NO: 1477730 - RNA, 14 nt, Pseudomonas aeruginosa PA01
cuccagcggaaucg

SEQ ID NO: 1477731 - RNA, 17 nt, Pseudomonas aeruginosa PA01
cuccagcggcagcucgg

SEQ ID NO: 1477732 - RNA, 20 nt, Pseudomonas aeruginosa PA01
cuccagcggcagcucggcga

SEQ ID NO: 1477733 - RNA, 21 nt, Pseudomonas aeruginosa PA01
cuccagcggcagcucggcgac

SEQ ID NO: 1477734 - RNA, 23 nt, Pseudomonas aeruginosa PA01
cuccagcgccucgaccagaucgg

SEQ ID NO: 1477735 - RNA, 16 nt, Pseudomonas aeruginosa PA01
cuccagcgccucgccg

SEQ ID NO: 1477736 - RNA, 17 nt, Pseudomonas aeruginosa PA01
cuccagcgccucgccga

SEQ ID NO: 1477737 - RNA, 14 nt, Pseudomonas aeruginosa PA01
cuccagcgccgccu

SEQ ID NO: 1477738 - RNA, 14 nt, Pseudomonas aeruginosa PA01
cuccagcgccgcau

SEQ ID NO: 1477739 - RNA, 20 nt, Pseudomonas aeruginosa PA01
cuccagccccacuggaagaa

SEQ ID NO: 1477740 - RNA, 19 nt, Pseudomonas aeruginosa PA01
cuccagccccgcgauugca

SEQ ID NO: 1477741 - RNA, 22 nt, Pseudomonas aeruginosa PA01
cuccagcgaauggacaggcgcc

SEQ ID NO: 1477742 - RNA, 14 nt, Pseudomonas aeruginosa PA01
cuccagccgcugca

SEQ ID NO: 1477743 - RNA, 14 nt, Pseudomonas aeruginosa PA01
cuccagccggcgac

SEQ ID NO: 1477744 - RNA, 13 nt, Pseudomonas aeruginosa PA01
cuccagccgggcu

SEQ ID NO: 1477745 - RNA, 21 nt, Pseudomonas aeruginosa PA01
cuccagccgggcuccgccgcg

SEQ ID NO: 1477746 - RNA, 16 nt, Pseudomonas aeruginosa PA01
cuccagcaccgccugg

SEQ ID NO: 1477747 - RNA, 21 nt, Pseudomonas aeruginosa PA01
cuccagcagggccagcgccug

SEQ ID NO: 1477748 - RNA, 19 nt, Pseudomonas aeruginosa PA01
cuccagcaggaccuggccg

SEQ ID NO: 1477749 - RNA, 20 nt, Pseudomonas aeruginosa PA01
cuccagcaggaccuggccgu

SEQ ID NO: 1477750 - RNA, 22 nt, Pseudomonas aeruginosa PA01
cuccagcaggcucuuggucgcg

SEQ ID NO: 1477751 - RNA, 22 nt, Pseudomonas aeruginosa PA01
cuccagcagucgcacagccagg

SEQ ID NO: 1477752 - RNA, 21 nt, Pseudomonas aeruginosa PA01
cuccagcaguucgucgccacg

SEQ ID NO: 1477753 - RNA, 15 nt, Pseudomonas aeruginosa PA01
cucauggcgccgcca

SEQ ID NO: 1477754 - RNA, 22 nt, Pseudomonas aeruginosa PA01
cucaugcgcguguugcgccgca

SEQ ID NO: 1477755 - RNA, 14 nt, Pseudomonas aeruginosa PA01
cucaugcugcgcgg

SEQ ID NO: 1477756 - RNA, 19 nt, Pseudomonas aeruginosa PA01
cucauggaacugcagggca

SEQ ID NO: 1477757 - RNA, 19 nt, Pseudomonas aeruginosa PA01
cucauggagcaacagcguc

SEQ ID NO: 1477758 - RNA, 14 nt, Pseudomonas aeruginosa PA01
cucauggccgcagc

SEQ ID NO: 1477759 - RNA, 18 nt, Pseudomonas aeruginosa PA01
cucauggccgcagcggcu

SEQ ID NO: 1477760 - RNA, 23 nt, Pseudomonas aeruginosa PA01
cucauucaucucgccgucggcgg

SEQ ID NO: 1477761 - RNA, 19 nt, Pseudomonas aeruginosa PA01
cucauucggccagcgcggc

SEQ ID NO: 1477762 - RNA, 16 nt, Pseudomonas aeruginosa PA01
cucacgcguucggcga

SEQ ID NO: 1477763 - RNA, 17 nt, Pseudomonas aeruginosa PA01
cucacgcucgacauugc

SEQ ID NO: 1477764 - RNA, 16 nt, Pseudomonas aeruginosa PA01
cucaccaaugccagug

SEQ ID NO: 1477765 - RNA, 13 nt, Pseudomonas aeruginosa PA01
cucacgccccagc

SEQ ID NO: 1477766 - RNA, 13 nt, Pseudomonas aeruginosa PA01
cucacaccaccag

SEQ ID NO: 1477767 - RNA, 24 nt, Pseudomonas aeruginosa PA01
cucagccguggcacccaggccacg

SEQ ID NO: 1477768 - RNA, 15 nt, Pseudomonas aeruginosa PA01
cucagccucacccug

SEQ ID NO: 1477769 - RNA, 23 nt, Pseudomonas aeruginosa PA01
cucagccucacccugcugggcgg

SEQ ID NO: 1477770 - RNA, 16 nt, Pseudomonas aeruginosa PA01
cucagcgccggccagg

SEQ ID NO: 1477771 - RNA, 21 nt, Pseudomonas aeruginosa PA01
cucagcgccgguagcggcgca

SEQ ID NO: 1477772 - RNA, 11 nt, Pseudomonas aeruginosa PA01
cucagcgcgac

SEQ ID NO: 1477773 - RNA, 16 nt, Pseudomonas aeruginosa PA01
cucagcgcgcucggcc

SEQ ID NO: 1477774 - RNA, 19 nt, Pseudomonas aeruginosa PA01
cucagcggaacauuuccuu

SEQ ID NO: 1477775 - RNA, 22 nt, Pseudomonas aeruginosa PA01
cucagcggaacuugcgccgacc

SEQ ID NO: 1477776 - RNA, 18 nt, Pseudomonas aeruginosa PA01
cucagcgcggcggcggcc

SEQ ID NO: 1477777 - RNA, 20 nt, Pseudomonas aeruginosa PA01
cucagcgcggcggcggccgc

SEQ ID NO: 1477778 - RNA, 22 nt, Pseudomonas aeruginosa PA01
cucagcgcggcggcggccgcau

SEQ ID NO: 1477779 - RNA, 20 nt, Pseudomonas aeruginosa PA01
cucacggguguuucggccgc

SEQ ID NO: 1477780 - RNA, 18 nt, Pseudomonas aeruginosa PA01
cucacgugaccguccagc

SEQ ID NO: 1477781 - RNA, 14 nt, Pseudomonas aeruginosa PA01
cucagccgcgccgg

SEQ ID NO: 1477782 - RNA, 17 nt, Pseudomonas aeruginosa PA01
cucagccgcuggcgucg

SEQ ID NO: 1477783 - RNA, 12 nt, Pseudomonas aeruginosa PA01
cucaucaggcug

SEQ ID NO: 1477784 - RNA, 16 nt, Pseudomonas aeruginosa PA01
cucaggucgucgagga

SEQ ID NO: 1477785 - RNA, 17 nt, Pseudomonas aeruginosa PA01
cucaguaccugcaaggc

SEQ ID NO: 1477786 - RNA, 24 nt, Pseudomonas aeruginosa PA01
cucaguauuucucgacuuccgccu

SEQ ID NO: 1477787 - RNA, 20 nt, Pseudomonas aeruginosa PA01
cucagucgaccgucgccacg

SEQ ID NO: 1477788 - RNA, 12 nt, Pseudomonas aeruginosa PA01
cucagucgaggu

SEQ ID NO: 1477789 - RNA, 14 nt, Pseudomonas aeruginosa PA01
cucagggccgcgcc

SEQ ID NO: 1477790 - RNA, 22 nt, Pseudomonas aeruginosa PA01
cucagggaauggaugcgcggca

SEQ ID NO: 1477791 - RNA, 19 nt, Pseudomonas aeruginosa PA01
cucagggacaccccgucuc

SEQ ID NO: 1477792 - RNA, 21 nt, Pseudomonas aeruginosa PA01
cucagcggcccagcgccccgc

SEQ ID NO: 1477793 - RNA, 15 nt, Pseudomonas aeruginosa PA01
cucagcggcuggcga

SEQ ID NO: 1477794 - RNA, 16 nt, Pseudomonas aeruginosa PA01
cucaggcgcugcgcgg

SEQ ID NO: 1477795 - RNA, 15 nt, Pseudomonas aeruginosa PA01
cucaggcgcugcugg

SEQ ID NO: 1477796 - RNA, 18 nt, Pseudomonas aeruginosa PA01
cucaggcgcugcuggugg

SEQ ID NO: 1477797 - RNA, 16 nt, Pseudomonas aeruginosa PA01
cucaggcgucccgcuc

SEQ ID NO: 1477798 - RNA, 14 nt, Pseudomonas aeruginosa PA01
cucaugccuugucg

SEQ ID NO: 1477799 - RNA, 14 nt, Pseudomonas aeruginosa PA01
cucaugcaggccga

SEQ ID NO: 1477800 - RNA, 18 nt, Pseudomonas aeruginosa PA01
cucaugagauccgccagc

SEQ ID NO: 1477801 - RNA, 14 nt, Pseudomonas aeruginosa PA01
cucaucgcccgccc

SEQ ID NO: 1477802 - RNA, 15 nt, Pseudomonas aeruginosa PA01
cucauccgcgaggca

SEQ ID NO: 1477803 - RNA, 15 nt, Pseudomonas aeruginosa PA01
cucauccucgccgcu

SEQ ID NO: 1477804 - RNA, 20 nt, Pseudomonas aeruginosa PA01
cucauccucgccgcuggcgc

SEQ ID NO: 1477805 - RNA, 18 nt, Pseudomonas aeruginosa PA01
gacagcaggucgugcugg

SEQ ID NO: 1477806 - RNA, 14 nt, Pseudomonas aeruginosa PA01
gacagcagguggcu

SEQ ID NO: 1477807 - RNA, 13 nt, Pseudomonas aeruginosa PA01
gacagcagcgcca

SEQ ID NO: 1477808 - RNA, 19 nt, Pseudomonas aeruginosa PA01
gacagcagggucgcgccgu

SEQ ID NO: 1477809 - RNA, 15 nt, Pseudomonas aeruginosa PA01
gacagcaggcugccg

SEQ ID NO: 1477810 - RNA, 14 nt, Pseudomonas aeruginosa PA01
gacaccgccagcac

SEQ ID NO: 1477811 - RNA, 15 nt, Pseudomonas aeruginosa PA01
gacaccgccagcacc

SEQ ID NO: 1477812 - RNA, 19 nt, Pseudomonas aeruginosa PA01
gacaccgccagcaccuggc

SEQ ID NO: 1477813 - RNA, 19 nt, Pseudomonas aeruginosa PA01
gacaccgaucaccuggccg

SEQ ID NO: 1477814 - RNA, 15 nt, Pseudomonas aeruginosa PA01
gacaccgaugccgaa

SEQ ID NO: 1477815 - RNA, 18 nt, Pseudomonas aeruginosa PA01
gacagcaccacgccgcug

SEQ ID NO: 1477816 - RNA, 19 nt, Pseudomonas aeruginosa PA01
gacagcaccacgccgcugg

SEQ ID NO: 1477817 - RNA, 22 nt, Pseudomonas aeruginosa PA01
gacagcaccacgccgcuggcgu

SEQ ID NO: 1477818 - RNA, 16 nt, Pseudomonas aeruginosa PA01
gacacauggucggcca

SEQ ID NO: 1477819 - RNA, 22 nt, Pseudomonas aeruginosa PA01
gacacauggucggccaggucgc

SEQ ID NO: 1477820 - RNA, 23 nt, Pseudomonas aeruginosa PA01
gacaccccgaaacgguccaccag

SEQ ID NO: 1477821 - RNA, 16 nt, Pseudomonas aeruginosa PA01
gacaccccggucaggc

SEQ ID NO: 1477822 - RNA, 19 nt, Pseudomonas aeruginosa PA01
gacaccccggucaggccga

SEQ ID NO: 1477823 - RNA, 16 nt, Pseudomonas aeruginosa PA01
gacacccugccgcgcc

SEQ ID NO: 1477824 - RNA, 17 nt, Pseudomonas aeruginosa PA01
gacacccugccgcgccg

SEQ ID NO: 1477825 - RNA, 18 nt, Pseudomonas aeruginosa PA01
gacacccugccgcgccgg

SEQ ID NO: 1477826 - RNA, 15 nt, Pseudomonas aeruginosa PA01
gacacccugcugcug

SEQ ID NO: 1477827 - RNA, 19 nt, Pseudomonas aeruginosa PA01
gacacccugcugcugcuca

SEQ ID NO: 1477828 - RNA, 16 nt, Pseudomonas aeruginosa PA01
gacaggccgaccagca

SEQ ID NO: 1477829 - RNA, 17 nt, Pseudomonas aeruginosa PA01
gacaggccgaccagcag

SEQ ID NO: 1477830 - RNA, 21 nt, Pseudomonas aeruginosa PA01
gacaggccgaccagcagggcc

SEQ ID NO: 1477831 - RNA, 14 nt, Pseudomonas aeruginosa PA01
gacagccucaagcc

SEQ ID NO: 1477832 - RNA, 16 nt, Pseudomonas aeruginosa PA01
gacaggcagccggcca

SEQ ID NO: 1477833 - RNA, 18 nt, Pseudomonas aeruginosa PA01
gacaggcagcgccgccca

SEQ ID NO: 1477834 - RNA, 17 nt, Pseudomonas aeruginosa PA01
gacaggcauuccgggca

SEQ ID NO: 1477835 - RNA, 15 nt, Pseudomonas aeruginosa PA01
gacaggccacccgcc

SEQ ID NO: 1477836 - RNA, 23 nt, Pseudomonas aeruginosa PA01
gacaggccacccgccucgucgcc

SEQ ID NO: 1477837 - RNA, 17 nt, Pseudomonas aeruginosa PA01
gacaggccagcucgccc

SEQ ID NO: 1477838 - RNA, 12 nt, Pseudomonas aeruginosa PA01
gacagcgaaugc

SEQ ID NO: 1477839 - RNA, 22 nt, Pseudomonas aeruginosa PA01
gacagcgaaugcuugccggcgc

SEQ ID NO: 1477840 - RNA, 23 nt, Pseudomonas aeruginosa PA01
gacagcgaaugcuugccggcgcc

SEQ ID NO: 1477841 - RNA, 23 nt, Pseudomonas aeruginosa PA01
gacagcaucugcugguccuggcg

SEQ ID NO: 1477842 - RNA, 23 nt, Pseudomonas aeruginosa PA01
gacagcauggccuugccggcauc

SEQ ID NO: 1477843 - RNA, 16 nt, Pseudomonas aeruginosa PA01
gacagccugggcggcu

SEQ ID NO: 1477844 - RNA, 17 nt, Pseudomonas aeruginosa PA01
gacagccuucgagccac

SEQ ID NO: 1477845 - RNA, 14 nt, Pseudomonas aeruginosa PA01
gacagggccaggcc

SEQ ID NO: 1477846 - RNA, 16 nt, Pseudomonas aeruginosa PA01
gacagggccaggccga

SEQ ID NO: 1477847 - RNA, 18 nt, Pseudomonas aeruginosa PA01
gacagggccaggccgagc

SEQ ID NO: 1477848 - RNA, 21 nt, Pseudomonas aeruginosa PA01
gacaggucggccggcagcucc

SEQ ID NO: 1477849 - RNA, 19 nt, Pseudomonas aeruginosa PA01
gacaggucggcgaaauccu

SEQ ID NO: 1477850 - RNA, 18 nt, Pseudomonas aeruginosa PA01
gacaggucgcggaagugc

SEQ ID NO: 1477851 - RNA, 17 nt, Pseudomonas aeruginosa PA01
gacaggcuggaggcugg

SEQ ID NO: 1477852 - RNA, 13 nt, Pseudomonas aeruginosa PA01
gacaggcuggugc

SEQ ID NO: 1477853 - RNA, 19 nt, Pseudomonas aeruginosa PA01
gacaggcgccccugguccu

SEQ ID NO: 1477854 - RNA, 20 nt, Pseudomonas aeruginosa PA01
gacaggcgucccuggagcag

SEQ ID NO: 1477855 - RNA, 13 nt, Pseudomonas aeruginosa PA01
gacaggccggugc

SEQ ID NO: 1477856 - RNA, 19 nt, Pseudomonas aeruginosa PA01
gacaggccggugccgccgg

SEQ ID NO: 1477857 - RNA, 22 nt, Pseudomonas aeruginosa PA01
gacaggccggugccgccggcca

SEQ ID NO: 1477858 - RNA, 16 nt, Pseudomonas aeruginosa PA01
gacaggccuccagcaa

SEQ ID NO: 1477859 - RNA, 13 nt, Pseudomonas aeruginosa PA01
gacaggcgaucga

SEQ ID NO: 1477860 - RNA, 22 nt, Pseudomonas aeruginosa PA01
gaccacucgcgagauggcgucg

SEQ ID NO: 1477861 - RNA, 13 nt, Pseudomonas aeruginosa PA01
gaccacgucgcga

SEQ ID NO: 1477862 - RNA, 21 nt, Pseudomonas aeruginosa PA01
gaccacggugaucaggcgcuu

SEQ ID NO: 1477863 - RNA, 21 nt, Pseudomonas aeruginosa PA01
gaccagaacgaaaaaggcgcg

SEQ ID NO: 1477864 - RNA, 22 nt, Pseudomonas aeruginosa PA01
gaccagaacgaaaaaggcgcgc

SEQ ID NO: 1477865 - RNA, 13 nt, Pseudomonas aeruginosa PA01
gaccacuuccagg

SEQ ID NO: 1477866 - RNA, 22 nt, Pseudomonas aeruginosa PA01
gaccacuuccagguagcccacc

SEQ ID NO: 1477867 - RNA, 19 nt, Pseudomonas aeruginosa PA01
gaccagaucggcauggccg

SEQ ID NO: 1477868 - RNA, 14 nt, Pseudomonas aeruginosa PA01
gaccagaucggcgc

SEQ ID NO: 1477869 - RNA, 16 nt, Pseudomonas aeruginosa PA01
gaccagaucggcgcgc

SEQ ID NO: 1477870 - RNA, 19 nt, Pseudomonas aeruginosa PA01
gaccagaucggcgcgcagg

SEQ ID NO: 1477871 - RNA, 23 nt, Pseudomonas aeruginosa PA01
gaccagaucggcgcgcagggcca

SEQ ID NO: 1477872 - RNA, 13 nt, Pseudomonas aeruginosa PA01
gaccagagccgcc

SEQ ID NO: 1477873 - RNA, 16 nt, Pseudomonas aeruginosa PA01
gaccagaggcugaccc

SEQ ID NO: 1477874 - RNA, 23 nt, Pseudomonas aeruginosa PA01
gaccacgcagagcggcaggccgc

SEQ ID NO: 1477875 - RNA, 14 nt, Pseudomonas aeruginosa PA01
gaccacgcaggcca

SEQ ID NO: 1477876 - RNA, 16 nt, Pseudomonas aeruginosa PA01
gaccacgcaggccagc

SEQ ID NO: 1477877 - RNA, 20 nt, Pseudomonas aeruginosa PA01
gaccacgcaggccagcgcca

SEQ ID NO: 1477878 - RNA, 21 nt, Pseudomonas aeruginosa PA01
gaccacgcaggccagcgccag

SEQ ID NO: 1477879 - RNA, 13 nt, Pseudomonas aeruginosa PA01
gaccacgcccugc

SEQ ID NO: 1477880 - RNA, 17 nt, Pseudomonas aeruginosa PA01
gaccacgcccugcgcca

SEQ ID NO: 1477881 - RNA, 19 nt, Pseudomonas aeruginosa PA01
gaccacgcccugcgccagc

SEQ ID NO: 1477882 - RNA, 21 nt, Pseudomonas aeruginosa PA01
gaccacgcccugcgccagcau

SEQ ID NO: 1477883 - RNA, 19 nt, Pseudomonas aeruginosa PA01
gaccacguaguaggcgcgg

SEQ ID NO: 1477884 - RNA, 22 nt, Pseudomonas aeruginosa PA01
gaccacguaguaggcgcgggug

SEQ ID NO: 1477885 - RNA, 15 nt, Pseudomonas aeruginosa PA01
gaccacgcuggucac

SEQ ID NO: 1477886 - RNA, 17 nt, Pseudomonas aeruginosa PA01
gaccacgcucaggucgg

SEQ ID NO: 1477887 - RNA, 19 nt, Pseudomonas aeruginosa PA01
gaccacacaugcaggucgu

SEQ ID NO: 1477888 - RNA, 17 nt, Pseudomonas aeruginosa PA01
gaccaccaccaggucgg

SEQ ID NO: 1477889 - RNA, 20 nt, Pseudomonas aeruginosa PA01
gaccaccaccaggucggcgc

SEQ ID NO: 1477890 - RNA, 23 nt, Pseudomonas aeruginosa PA01
gaccaccaccaggucggcgcgcg

SEQ ID NO: 1477891 - RNA, 18 nt, Pseudomonas aeruginosa PA01
gaccaccacgucgaugcc

SEQ ID NO: 1477892 - RNA, 20 nt, Pseudomonas aeruginosa PA01
gaccaccgcguggugcugca

SEQ ID NO: 1477893 - RNA, 14 nt, Pseudomonas aeruginosa PA01
gaccaccagcagga

SEQ ID NO: 1477894 - RNA, 14 nt, Pseudomonas aeruginosa PA01
gaccaccagcagca

SEQ ID NO: 1477895 - RNA, 16 nt, Pseudomonas aeruginosa PA01
gaccaccagcagcagc

SEQ ID NO: 1477896 - RNA, 19 nt, Pseudomonas aeruginosa PA01
gaccaccgugcgcaccucg

SEQ ID NO: 1477897 - RNA, 20 nt, Pseudomonas aeruginosa PA01
gaccaccguggcgccggcgc

SEQ ID NO: 1477898 - RNA, 21 nt, Pseudomonas aeruginosa PA01
gaccaccguggcgccggcgcg

SEQ ID NO: 1477899 - RNA, 23 nt, Pseudomonas aeruginosa PA01
gaccaccguggcgccggcgcgcu

SEQ ID NO: 1477900 - RNA, 17 nt, Pseudomonas aeruginosa PA01
gaccaccuucaggcugc

SEQ ID NO: 1477901 - RNA, 14 nt, Pseudomonas aeruginosa PA01
gaccaccucggcgu

SEQ ID NO: 1477902 - RNA, 19 nt, Pseudomonas aeruginosa PA01
gacaucggagugcaugccg

SEQ ID NO: 1477903 - RNA, 23 nt, Pseudomonas aeruginosa PA01
gacaucggagugcaugccgggga

SEQ ID NO: 1477904 - RNA, 15 nt, Pseudomonas aeruginosa PA01
gacauccuccaccgu

SEQ ID NO: 1477905 - RNA, 17 nt, Pseudomonas aeruginosa PA01
gacauccucccugcccg

SEQ ID NO: 1477906 - RNA, 17 nt, Pseudomonas aeruginosa PA01
gacaucgccgagggcga

SEQ ID NO: 1477907 - RNA, 20 nt, Pseudomonas aeruginosa PA01
gacaucgacgcccucggcga

SEQ ID NO: 1477908 - RNA, 16 nt, Pseudomonas aeruginosa PA01
gacauccugucgaggc

SEQ ID NO: 1477909 - RNA, 21 nt, Pseudomonas aeruginosa PA01
gacauccugucgaggccucgu

SEQ ID NO: 1477910 - RNA, 15 nt, Pseudomonas aeruginosa PA01
gacagucccaggcca

SEQ ID NO: 1477911 - RNA, 15 nt, Pseudomonas aeruginosa PA01
gacagguuggcgccg

SEQ ID NO: 1477912 - RNA, 16 nt, Pseudomonas aeruginosa PA01
gacagguucaggucga

SEQ ID NO: 1477913 - RNA, 17 nt, Pseudomonas aeruginosa PA01
gaaucuggccgaugccg

SEQ ID NO: 1477914 - RNA, 14 nt, Pseudomonas aeruginosa PA01
gaaucugcccggcc

SEQ ID NO: 1477915 - RNA, 15 nt, Pseudomonas aeruginosa PA01
gaaucugcgccaggu

SEQ ID NO: 1477916 - RNA, 22 nt, Pseudomonas aeruginosa PA01
gaaugaaaaagggaugccggcg

SEQ ID NO: 1477917 - RNA, 23 nt, Pseudomonas aeruginosa PA01
gaaugaaaaagggaugccggcgg

SEQ ID NO: 1477918 - RNA, 18 nt, Pseudomonas aeruginosa PA01
gaauccggucggacuccg

SEQ ID NO: 1477919 - RNA, 18 nt, Pseudomonas aeruginosa PA01
gaauccuccagccggcga

SEQ ID NO: 1477920 - RNA, 20 nt, Pseudomonas aeruginosa PA01
gaauccuccagccggcgacg

SEQ ID NO: 1477921 - RNA, 17 nt, Pseudomonas aeruginosa PA01
gaauccuccgccagcgu

SEQ ID NO: 1477922 - RNA, 17 nt, Pseudomonas aeruginosa PA01
gaauccgcggcccugcu

SEQ ID NO: 1477923 - RNA, 20 nt, Pseudomonas aeruginosa PA01
gaauccgcggcccugcucgc

SEQ ID NO: 1477924 - RNA, 19 nt, Pseudomonas aeruginosa PA01
gaaucccuuggcugcucgc

SEQ ID NO: 1477925 - RNA, 15 nt, Pseudomonas aeruginosa PA01
gaauccaggccgacg

SEQ ID NO: 1477926 - RNA, 22 nt, Pseudomonas aeruginosa PA01
gaauccccaguagcgcuucgcg

SEQ ID NO: 1477927 - RNA, 20 nt, Pseudomonas aeruginosa PA01
gaauacugcacgcccaggcg

SEQ ID NO: 1477928 - RNA, 17 nt, Pseudomonas aeruginosa PA01
gaacuggaagccugcca

SEQ ID NO: 1477929 - RNA, 20 nt, Pseudomonas aeruginosa PA01
gaaucacgcugcucgcagcc

SEQ ID NO: 1477930 - RNA, 19 nt, Pseudomonas aeruginosa PA01
gaacucggcgcugccggcc

SEQ ID NO: 1477931 - RNA, 14 nt, Pseudomonas aeruginosa PA01
gaacugaccaccag

SEQ ID NO: 1477932 - RNA, 15 nt, Pseudomonas aeruginosa PA01
gaacugcacgcccau

SEQ ID NO: 1477933 - RNA, 18 nt, Pseudomonas aeruginosa PA01
gaacugcagggcgucgcc

SEQ ID NO: 1477934 - RNA, 22 nt, Pseudomonas aeruginosa PA01
gaacugcccgcaggggcugccg

SEQ ID NO: 1477935 - RNA, 18 nt, Pseudomonas aeruginosa PA01
gaacugcucggcguccag

SEQ ID NO: 1477936 - RNA, 16 nt, Pseudomonas aeruginosa PA01
gaacugccgggccagc

SEQ ID NO: 1477937 - RNA, 17 nt, Pseudomonas aeruginosa PA01
gaacugcgguccggcga

SEQ ID NO: 1477938 - RNA, 19 nt, Pseudomonas aeruginosa PA01
gaacugcgguccggcgaag

SEQ ID NO: 1477939 - RNA, 13 nt, Pseudomonas aeruginosa PA01
gaaugcuugccgg

SEQ ID NO: 1477940 - RNA, 16 nt, Pseudomonas aeruginosa PA01
gaauggcgccggccag

SEQ ID NO: 1477941 - RNA, 12 nt, Pseudomonas aeruginosa PA01
gaauguccggcg

SEQ ID NO: 1477942 - RNA, 15 nt, Pseudomonas aeruginosa PA01
gaauguccggcgacc

SEQ ID NO: 1477943 - RNA, 22 nt, Pseudomonas aeruginosa PA01
gaauggcguggcuuggcccugc

SEQ ID NO: 1477944 - RNA, 18 nt, Pseudomonas aeruginosa PA01
gaauggcggauagccgca

SEQ ID NO: 1477945 - RNA, 18 nt, Pseudomonas aeruginosa PA01
gacaacgaaaagagccgc

SEQ ID NO: 1477946 - RNA, 17 nt, Pseudomonas aeruginosa PA01
gaauuucacgccgaagg

SEQ ID NO: 1477947 - RNA, 14 nt, Pseudomonas aeruginosa PA01
gacaaucagcggcg

SEQ ID NO: 1477948 - RNA, 14 nt, Pseudomonas aeruginosa PA01
gacacagacgcagc

SEQ ID NO: 1477949 - RNA, 20 nt, Pseudomonas aeruginosa PA01
gacaaggcugaggccgacga

SEQ ID NO: 1477950 - RNA, 19 nt, Pseudomonas aeruginosa PA01
gacaaggagacucagcgcg

SEQ ID NO: 1477951 - RNA, 20 nt, Pseudomonas aeruginosa PA01
gacaaggagacucagcgcga

SEQ ID NO: 1477952 - RNA, 20 nt, Pseudomonas aeruginosa PA01
gacaaggagcgcgagcggca

SEQ ID NO: 1477953 - RNA, 19 nt, Pseudomonas aeruginosa PA01
gacaagcgucgccggccgc

SEQ ID NO: 1477954 - RNA, 22 nt, Pseudomonas aeruginosa PA01
gacaagcauucagcgcgccccg

SEQ ID NO: 1477955 - RNA, 17 nt, Pseudomonas aeruginosa PA01
gacaagccuccagcgcc

SEQ ID NO: 1477956 - RNA, 21 nt, Pseudomonas aeruginosa PA01
gacaagccuccagcgccgccu

SEQ ID NO: 1477957 - RNA, 14 nt, Pseudomonas aeruginosa PA01
gacaagguuugcgc

SEQ ID NO: 1477958 - RNA, 15 nt, Pseudomonas aeruginosa PA01
gaccuugucgauggu

SEQ ID NO: 1477959 - RNA, 17 nt, Pseudomonas aeruginosa PA01
gaccuugucgccgguga

SEQ ID NO: 1477960 - RNA, 20 nt, Pseudomonas aeruginosa PA01
gacgaaacgguagcccgcgg

SEQ ID NO: 1477961 - RNA, 15 nt, Pseudomonas aeruginosa PA01
gacgaaagaagccgc

SEQ ID NO: 1477962 - RNA, 21 nt, Pseudomonas aeruginosa PA01
gacgaaagaagccgcacuucc

SEQ ID NO: 1477963 - RNA, 22 nt, Pseudomonas aeruginosa PA01
gacgaaagacgcugcgaccugg

SEQ ID NO: 1477964 - RNA, 15 nt, Pseudomonas aeruginosa PA01
gacgaaagagcccgg

SEQ ID NO: 1477965 - RNA, 17 nt, Pseudomonas aeruginosa PA01
gacgaaaggccgcgccg

SEQ ID NO: 1477966 - RNA, 18 nt, Pseudomonas aeruginosa PA01
gacgaaaggccgcgccgg

SEQ ID NO: 1477967 - RNA, 19 nt, Pseudomonas aeruginosa PA01
gacgaaauaaugcggcgcg

SEQ ID NO: 1477968 - RNA, 20 nt, Pseudomonas aeruginosa PA01
gacgaaauaaugcggcgcga

SEQ ID NO: 1477969 - RNA, 21 nt, Pseudomonas aeruginosa PA01
gacgaaauaaugcggcgcgau

SEQ ID NO: 1477970 - RNA, 23 nt, Pseudomonas aeruginosa PA01
gacgaaauaaugcggcgcgaugc

SEQ ID NO: 1477971 - RNA, 13 nt, Pseudomonas aeruginosa PA01
gacgaagucgccg

SEQ ID NO: 1477972 - RNA, 15 nt, Pseudomonas aeruginosa PA01
gacgaagucgccggc

SEQ ID NO: 1477973 - RNA, 18 nt, Pseudomonas aeruginosa PA01
gacgaagucgccggcauc

SEQ ID NO: 1477974 - RNA, 15 nt, Pseudomonas aeruginosa PA01
gacgaaggcggcagc

SEQ ID NO: 1477975 - RNA, 16 nt, Pseudomonas aeruginosa PA01
gacgaaggcggcagcg

SEQ ID NO: 1477976 - RNA, 19 nt, Pseudomonas aeruginosa PA01
gacgaaggcggcagcggug

SEQ ID NO: 1477977 - RNA, 20 nt, Pseudomonas aeruginosa PA01
gacgaaggcuggagcgcugc

SEQ ID NO: 1477978 - RNA, 19 nt, Pseudomonas aeruginosa PA01
gacgaaggucggcggcagc

SEQ ID NO: 1477979 - RNA, 23 nt, Pseudomonas aeruginosa PA01
gacgaaggucggcggcagcugcg

SEQ ID NO: 1477980 - RNA, 14 nt, Pseudomonas aeruginosa PA01
gacgaagcgccggc

SEQ ID NO: 1477981 - RNA, 19 nt, Pseudomonas aeruginosa PA01
gacgaagcgccggcggccu

SEQ ID NO: 1477982 - RNA, 21 nt, Pseudomonas aeruginosa PA01
gacgaagcgccggcggccugc

SEQ ID NO: 1477983 - RNA, 14 nt, Pseudomonas aeruginosa PA01
gacgaacaucgcca

SEQ ID NO: 1477984 - RNA, 15 nt, Pseudomonas aeruginosa PA01
gacgaacaucgccag

SEQ ID NO: 1477985 - RNA, 16 nt, Pseudomonas aeruginosa PA01
gacgaacaucgccagc

SEQ ID NO: 1477986 - RNA, 19 nt, Pseudomonas aeruginosa PA01
gacgaacaucgccagcgcc

SEQ ID NO: 1477987 - RNA, 20 nt, Pseudomonas aeruginosa PA01
gacgaacaucgccagcgcca

SEQ ID NO: 1477988 - RNA, 14 nt, Pseudomonas aeruginosa PA01
gaccuucuguccgu

SEQ ID NO: 1477989 - RNA, 17 nt, Pseudomonas aeruginosa PA01
gaccuugaacucgcccg

SEQ ID NO: 1477990 - RNA, 23 nt, Pseudomonas aeruginosa PA01
gaccuugcuggugcccugggcgg

SEQ ID NO: 1477991 - RNA, 14 nt, Pseudomonas aeruginosa PA01
gaccuugcucuucu

SEQ ID NO: 1477992 - RNA, 21 nt, Pseudomonas aeruginosa PA01
gaccuugccgguuaucgaggc

SEQ ID NO: 1477993 - RNA, 14 nt, Pseudomonas aeruginosa PA01
gaccuugccgcgaa

SEQ ID NO: 1477994 - RNA, 17 nt, Pseudomonas aeruginosa PA01
gaccuugacgaagccgg

SEQ ID NO: 1477995 - RNA, 23 nt, Pseudomonas aeruginosa PA01
gaccuugcccuugaagcgcuucu

SEQ ID NO: 1477996 - RNA, 22 nt, Pseudomonas aeruginosa PA01
gaccuggggcggccucaggccu

SEQ ID NO: 1477997 - RNA, 20 nt, Pseudomonas aeruginosa PA01
gaccuggguaccgacggucg

SEQ ID NO: 1477998 - RNA, 22 nt, Pseudomonas aeruginosa PA01
gaccuggcugaggcguuccagu

SEQ ID NO: 1477999 - RNA, 22 nt, Pseudomonas aeruginosa PA01
gaccugggaacccuugcgcagg

SEQ ID NO: 1478000 - RNA, 13 nt, Pseudomonas aeruginosa PA01
gaccuggccguug

SEQ ID NO: 1478001 - RNA, 15 nt, Pseudomonas aeruginosa PA01
gaccuggccguuggc

SEQ ID NO: 1478002 - RNA, 16 nt, Pseudomonas aeruginosa PA01
gaccuggccggcgacc

SEQ ID NO: 1478003 - RNA, 16 nt, Pseudomonas aeruginosa PA01
gaccucggcggucagg

SEQ ID NO: 1478004 - RNA, 22 nt, Pseudomonas aeruginosa PA01
gaccucgggcgagaaucgccga

SEQ ID NO: 1478005 - RNA, 20 nt, Pseudomonas aeruginosa PA01
gaccugcucgucgaugcugc

SEQ ID NO: 1478006 - RNA, 22 nt, Pseudomonas aeruginosa PA01
gaccugcucgucgaugcugccg

SEQ ID NO: 1478007 - RNA, 19 nt, Pseudomonas aeruginosa PA01
gaccugcugggccagcgcc

SEQ ID NO: 1478008 - RNA, 20 nt, Pseudomonas aeruginosa PA01
gaccuggccgcguucgccga

SEQ ID NO: 1478009 - RNA, 13 nt, Pseudomonas aeruginosa PA01
gaccuggccgcug

SEQ ID NO: 1478010 - RNA, 14 nt, Pseudomonas aeruginosa PA01
gaccugcucgcgca

SEQ ID NO: 1478011 - RNA, 17 nt, Pseudomonas aeruginosa PA01
gaccugcucgcgcaccg

SEQ ID NO: 1478012 - RNA, 21 nt, Pseudomonas aeruginosa PA01
gaccugcucgcgcaccgcggc

SEQ ID NO: 1478013 - RNA, 23 nt, Pseudomonas aeruginosa PA01
gaccugcucgcgcaccgcggcca

SEQ ID NO: 1478014 - RNA, 14 nt, Pseudomonas aeruginosa PA01
gaccugcugcccgg

SEQ ID NO: 1478015 - RNA, 12 nt, Pseudomonas aeruginosa PA01
gaccgugccgcc

SEQ ID NO: 1478016 - RNA, 13 nt, Pseudomonas aeruginosa PA01
gaccgugccgccg

SEQ ID NO: 1478017 - RNA, 14 nt, Pseudomonas aeruginosa PA01
gaccgugccgccgg

SEQ ID NO: 1478018 - RNA, 15 nt, Pseudomonas aeruginosa PA01
gaccgugccgccggg

SEQ ID NO: 1478019 - RNA, 14 nt, Pseudomonas aeruginosa PA01
gaccgugaggcgca

SEQ ID NO: 1478020 - RNA, 17 nt, Pseudomonas aeruginosa PA01
gaccgugaugcccagcg

SEQ ID NO: 1478021 - RNA, 21 nt, Pseudomonas aeruginosa PA01
gaccgugaugcccagcggcgc

SEQ ID NO: 1478022 - RNA, 16 nt, Pseudomonas aeruginosa PA01
gaccucggccgcaucg

SEQ ID NO: 1478023 - RNA, 16 nt, Pseudomonas aeruginosa PA01
gaccucggccagccag

SEQ ID NO: 1478024 - RNA, 21 nt, Pseudomonas aeruginosa PA01
gaccucggccagccagggcag

SEQ ID NO: 1478025 - RNA, 22 nt, Pseudomonas aeruginosa PA01
gaccguggcgcuacgcucgccg

SEQ ID NO: 1478026 - RNA, 14 nt, Pseudomonas aeruginosa PA01
gaccguggugacgg

SEQ ID NO: 1478027 - RNA, 14 nt, Pseudomonas aeruginosa PA01
gaccgugcgggucg

SEQ ID NO: 1478028 - RNA, 22 nt, Pseudomonas aeruginosa PA01
gaccgugcgggucgaggccgaa

SEQ ID NO: 1478029 - RNA, 17 nt, Pseudomonas aeruginosa PA01
gaccggguccugcagau

SEQ ID NO: 1478030 - RNA, 19 nt, Pseudomonas aeruginosa PA01
gaccggguccugcagauaa

SEQ ID NO: 1478031 - RNA, 17 nt, Pseudomonas aeruginosa PA01
gaccgguaacuggccag

SEQ ID NO: 1478032 - RNA, 16 nt, Pseudomonas aeruginosa PA01
gaccgguagccaugau

SEQ ID NO: 1478033 - RNA, 23 nt, Pseudomonas aeruginosa PA01
gaccgguuaauggcgcuccaggg

SEQ ID NO: 1478034 - RNA, 21 nt, Pseudomonas aeruginosa PA01
gaccgguuccagcggccgcga

SEQ ID NO: 1478035 - RNA, 12 nt, Pseudomonas aeruginosa PA01
gaccggucaggc

SEQ ID NO: 1478036 - RNA, 18 nt, Pseudomonas aeruginosa PA01
gaccggcuccagggcgaa

SEQ ID NO: 1478037 - RNA, 14 nt, Pseudomonas aeruginosa PA01
gaccggcucgucgg

SEQ ID NO: 1478038 - RNA, 12 nt, Pseudomonas aeruginosa PA01
gaccggcugcuu

SEQ ID NO: 1478039 - RNA, 21 nt, Pseudomonas aeruginosa PA01
gaccgggcauuuccucgauga

SEQ ID NO: 1478040 - RNA, 23 nt, Pseudomonas aeruginosa PA01
gaccgggcauuuccucgaugagc

SEQ ID NO: 1478041 - RNA, 12 nt, Pseudomonas aeruginosa PA01
gaccgggcgccu

SEQ ID NO: 1478042 - RNA, 15 nt, Pseudomonas aeruginosa PA01
gaccgggcggcaggc

SEQ ID NO: 1478043 - RNA, 17 nt, Pseudomonas aeruginosa PA01
gaccgggcggcaggcgc

SEQ ID NO: 1478044 - RNA, 18 nt, Pseudomonas aeruginosa PA01
gaccgggcggcaggcgcc

SEQ ID NO: 1478045 - RNA, 16 nt, Pseudomonas aeruginosa PA01
gaccgggcggcgcggc

SEQ ID NO: 1478046 - RNA, 20 nt, Pseudomonas aeruginosa PA01
gaccgggcggcgcggcgcaa

SEQ ID NO: 1478047 - RNA, 19 nt, Pseudomonas aeruginosa PA01
gaccgggcgggucuggcgg

SEQ ID NO: 1478048 - RNA, 12 nt, Pseudomonas aeruginosa PA01
gaccggccggcu

SEQ ID NO: 1478049 - RNA, 22 nt, Pseudomonas aeruginosa PA01
gaccggcgccccugcggcgccg

SEQ ID NO: 1478050 - RNA, 12 nt, Pseudomonas aeruginosa PA01
gaccggcgcgcc

SEQ ID NO: 1478051 - RNA, 21 nt, Pseudomonas aeruginosa PA01
gaccgcagaaccagacgcucg

SEQ ID NO: 1478052 - RNA, 13 nt, Pseudomonas aeruginosa PA01
gaccgcagccggc

SEQ ID NO: 1478053 - RNA, 15 nt, Pseudomonas aeruginosa PA01
gaccgcagccggcga

SEQ ID NO: 1478054 - RNA, 21 nt, Pseudomonas aeruginosa PA01
gaccgcaucguuggcgccguc

SEQ ID NO: 1478055 - RNA, 15 nt, Pseudomonas aeruginosa PA01
gaccgcaccuggugg

SEQ ID NO: 1478056 - RNA, 14 nt, Pseudomonas aeruginosa PA01
gaccgauggcgccg

SEQ ID NO: 1478057 - RNA, 15 nt, Pseudomonas aeruginosa PA01
gaccgauggcgccgc

SEQ ID NO: 1478058 - RNA, 16 nt, Pseudomonas aeruginosa PA01
gaccgaucaugcccuu

SEQ ID NO: 1478059 - RNA, 21 nt, Pseudomonas aeruginosa PA01
gaccgauccagcagucgcggc

SEQ ID NO: 1478060 - RNA, 17 nt, Pseudomonas aeruginosa PA01
gaccagccgcaggcugc

SEQ ID NO: 1478061 - RNA, 18 nt, Pseudomonas aeruginosa PA01
gaccagccgcaggcugcc

SEQ ID NO: 1478062 - RNA, 16 nt, Pseudomonas aeruginosa PA01
gaccagcccggcggcg

SEQ ID NO: 1478063 - RNA, 17 nt, Pseudomonas aeruginosa PA01
gaccagcccggcggcgg

SEQ ID NO: 1478064 - RNA, 13 nt, Pseudomonas aeruginosa PA01
gaccagcccguug

SEQ ID NO: 1478065 - RNA, 16 nt, Pseudomonas aeruginosa PA01
gaccagcccguugcgg

SEQ ID NO: 1478066 - RNA, 14 nt, Pseudomonas aeruginosa PA01
gaccagcccuggcg

SEQ ID NO: 1478067 - RNA, 16 nt, Pseudomonas aeruginosa PA01
gaccagcccuggcgcg

SEQ ID NO: 1478068 - RNA, 14 nt, Pseudomonas aeruginosa PA01
gaccagcgccgcca

SEQ ID NO: 1478069 - RNA, 13 nt, Pseudomonas aeruginosa PA01
gaccagcgccgcg

SEQ ID NO: 1478070 - RNA, 15 nt, Pseudomonas aeruginosa PA01
gaccagcgccgcggc

SEQ ID NO: 1478071 - RNA, 19 nt, Pseudomonas aeruginosa PA01
gaccagcgccgcggcgacc

SEQ ID NO: 1478072 - RNA, 23 nt, Pseudomonas aeruginosa PA01
gaccagcgccgcggcgaccagcg

SEQ ID NO: 1478073 - RNA, 18 nt, Pseudomonas aeruginosa PA01
gaccagcgcaagcggcgg

SEQ ID NO: 1478074 - RNA, 19 nt, Pseudomonas aeruginosa PA01
gaccagcgcaagcggcggc

SEQ ID NO: 1478075 - RNA, 18 nt, Pseudomonas aeruginosa PA01
gaccagcgcaucggcgcc

SEQ ID NO: 1478076 - RNA, 20 nt, Pseudomonas aeruginosa PA01
gaccagcgcaucggcgccuc

SEQ ID NO: 1478077 - RNA, 21 nt, Pseudomonas aeruginosa PA01
gaccagcgcaucggcgccucc

SEQ ID NO: 1478078 - RNA, 16 nt, Pseudomonas aeruginosa PA01
gaccagcgccaggcgc

SEQ ID NO: 1478079 - RNA, 19 nt, Pseudomonas aeruginosa PA01
gaccagcgccaggcgcggu

SEQ ID NO: 1478080 - RNA, 22 nt, Pseudomonas aeruginosa PA01
gaccagcgccaggcgcgguugc

SEQ ID NO: 1478081 - RNA, 22 nt, Pseudomonas aeruginosa PA01
gaccagcacggcgaauucgucg

SEQ ID NO: 1478082 - RNA, 23 nt, Pseudomonas aeruginosa PA01
gaccagcacggcgaauucgucgc

SEQ ID NO: 1478083 - RNA, 14 nt, Pseudomonas aeruginosa PA01
gaccagcagcggca

SEQ ID NO: 1478084 - RNA, 16 nt, Pseudomonas aeruginosa PA01
gaccagcagcggcagc

SEQ ID NO: 1478085 - RNA, 15 nt, Pseudomonas aeruginosa PA01
gaccagcccgcgcga

SEQ ID NO: 1478086 - RNA, 19 nt, Pseudomonas aeruginosa PA01
gaccagcauggcgggccau

SEQ ID NO: 1478087 - RNA, 21 nt, Pseudomonas aeruginosa PA01
gaccagcauggcgggccauug

SEQ ID NO: 1478088 - RNA, 22 nt, Pseudomonas aeruginosa PA01
gaccagcauguuguuauggccg

SEQ ID NO: 1478089 - RNA, 22 nt, Pseudomonas aeruginosa PA01
gaccagcagggccagcagcgcu

SEQ ID NO: 1478090 - RNA, 16 nt, Pseudomonas aeruginosa PA01
gaccagcgaaccgccg

SEQ ID NO: 1478091 - RNA, 12 nt, Pseudomonas aeruginosa PA01
gaccagccgggg

SEQ ID NO: 1478092 - RNA, 13 nt, Pseudomonas aeruginosa PA01
gaccagcgccugc

SEQ ID NO: 1478093 - RNA, 20 nt, Pseudomonas aeruginosa PA01
gaccagcgcgucgaccaccg

SEQ ID NO: 1478094 - RNA, 16 nt, Pseudomonas aeruginosa PA01
gaccagcggcaccgag

SEQ ID NO: 1478095 - RNA, 18 nt, Pseudomonas aeruginosa PA01
gaccagcgcgcucuucgc

SEQ ID NO: 1478096 - RNA, 16 nt, Pseudomonas aeruginosa PA01
gaccagcggcccggcg

SEQ ID NO: 1478097 - RNA, 22 nt, Pseudomonas aeruginosa PA01
gaccagcgucgcgcgugccccg

SEQ ID NO: 1478098 - RNA, 13 nt, Pseudomonas aeruginosa PA01
gaccaggcggccg

SEQ ID NO: 1478099 - RNA, 22 nt, Pseudomonas aeruginosa PA01
gaccaggcggccggugccuucg

SEQ ID NO: 1478100 - RNA, 16 nt, Pseudomonas aeruginosa PA01
gaccaggcggccgucg

SEQ ID NO: 1478101 - RNA, 21 nt, Pseudomonas aeruginosa PA01
gaccaggccguaggcgauggc

SEQ ID NO: 1478102 - RNA, 19 nt, Pseudomonas aeruginosa PA01
gaccaggccgaucgccucg

SEQ ID NO: 1478103 - RNA, 16 nt, Pseudomonas aeruginosa PA01
gaccagggcauccagg

SEQ ID NO: 1478104 - RNA, 17 nt, Pseudomonas aeruginosa PA01
gaccaggcugaucagcc

SEQ ID NO: 1478105 - RNA, 18 nt, Pseudomonas aeruginosa PA01
gaccaggcugaucagccc

SEQ ID NO: 1478106 - RNA, 20 nt, Pseudomonas aeruginosa PA01
gaccaggcugaucagcccgc

SEQ ID NO: 1478107 - RNA, 14 nt, Pseudomonas aeruginosa PA01
gaccagggcgccgg

SEQ ID NO: 1478108 - RNA, 18 nt, Pseudomonas aeruginosa PA01
gaccagggcgggccgcuc

SEQ ID NO: 1478109 - RNA, 24 nt, Pseudomonas aeruginosa PA01
gaccagggcgggccgcucgcgcgg

SEQ ID NO: 1478110 - RNA, 19 nt, Pseudomonas aeruginosa PA01
gaccagcuuguggccgguc

SEQ ID NO: 1478111 - RNA, 20 nt, Pseudomonas aeruginosa PA01
gaccaggaauuccuggccgg

SEQ ID NO: 1478112 - RNA, 23 nt, Pseudomonas aeruginosa PA01
gaccaggaauuccuggccgguga

SEQ ID NO: 1478113 - RNA, 18 nt, Pseudomonas aeruginosa PA01
gaccaggacagcacgcuc

SEQ ID NO: 1478114 - RNA, 18 nt, Pseudomonas aeruginosa PA01
gaccaggaucgaccccgc

SEQ ID NO: 1478115 - RNA, 19 nt, Pseudomonas aeruginosa PA01
gaccagcucgaagccgccg

SEQ ID NO: 1478116 - RNA, 20 nt, Pseudomonas aeruginosa PA01
gaccagcucgaagccgccgu

SEQ ID NO: 1478117 - RNA, 14 nt, Pseudomonas aeruginosa PA01
gaccagcucggcgg

SEQ ID NO: 1478118 - RNA, 18 nt, Pseudomonas aeruginosa PA01
gaccagcucggcgggacg

SEQ ID NO: 1478119 - RNA, 21 nt, Pseudomonas aeruginosa PA01
gaccagcuucaaccguggcuc

SEQ ID NO: 1478120 - RNA, 14 nt, Pseudomonas aeruginosa PA01
gaccaggaaggccg

SEQ ID NO: 1478121 - RNA, 15 nt, Pseudomonas aeruginosa PA01
gaccaggaaggccgg

SEQ ID NO: 1478122 - RNA, 17 nt, Pseudomonas aeruginosa PA01
gaccaggaaggccgggc

SEQ ID NO: 1478123 - RNA, 18 nt, Pseudomonas aeruginosa PA01
gaccaggaaggccgggcc

SEQ ID NO: 1478124 - RNA, 22 nt, Pseudomonas aeruginosa PA01
gaccaggaaggccgggcccugg

SEQ ID NO: 1478125 - RNA, 14 nt, Pseudomonas aeruginosa PA01
gaccaggguggcgg

SEQ ID NO: 1478126 - RNA, 18 nt, Pseudomonas aeruginosa PA01
gaccaggguggcggcggc

SEQ ID NO: 1478127 - RNA, 13 nt, Pseudomonas aeruginosa PA01
gaccagggccggg

SEQ ID NO: 1478128 - RNA, 15 nt, Pseudomonas aeruginosa PA01
gaccagguccgccac

SEQ ID NO: 1478129 - RNA, 20 nt, Pseudomonas aeruginosa PA01
gaccagguccggcagcgccu

SEQ ID NO: 1478130 - RNA, 21 nt, Pseudomonas aeruginosa PA01
gaccaggucgaguuuccggug

SEQ ID NO: 1478131 - RNA, 17 nt, Pseudomonas aeruginosa PA01
gaccagguagagcagcc

SEQ ID NO: 1478132 - RNA, 22 nt, Pseudomonas aeruginosa PA01
gaccaggucgccaugcccgucg

SEQ ID NO: 1478133 - RNA, 20 nt, Pseudomonas aeruginosa PA01
gaccaggguacgacugacga

SEQ ID NO: 1478134 - RNA, 15 nt, Pseudomonas aeruginosa PA01
gaccagucggccguu

SEQ ID NO: 1478135 - RNA, 17 nt, Pseudomonas aeruginosa PA01
gaccagucggccguugc

SEQ ID NO: 1478136 - RNA, 22 nt, Pseudomonas aeruginosa PA01
gaccagucggccguugcgggcg

SEQ ID NO: 1478137 - RNA, 22 nt, Pseudomonas aeruginosa PA01
gaccagucguugaagacgcuca

SEQ ID NO: 1478138 - RNA, 23 nt, Pseudomonas aeruginosa PA01
gaccaguugcccgagugccggcg

SEQ ID NO: 1478139 - RNA, 18 nt, Pseudomonas aeruginosa PA01
gaccaguucgccgccgcg

SEQ ID NO: 1478140 - RNA, 16 nt, Pseudomonas aeruginosa PA01
gacccgcccgccgucc

SEQ ID NO: 1478141 - RNA, 21 nt, Pseudomonas aeruginosa PA01
gacccgcccgccguccuccag

SEQ ID NO: 1478142 - RNA, 18 nt, Pseudomonas aeruginosa PA01
gacccgggccuccuggcg

SEQ ID NO: 1478143 - RNA, 19 nt, Pseudomonas aeruginosa PA01
gacccgggccuccuggcgg

SEQ ID NO: 1478144 - RNA, 17 nt, Pseudomonas aeruginosa PA01
gaccgacacguucaggc

SEQ ID NO: 1478145 - RNA, 21 nt, Pseudomonas aeruginosa PA01
gaccgauauaggggaugccuu

SEQ ID NO: 1478146 - RNA, 18 nt, Pseudomonas aeruginosa PA01
gaccgacgcucgcggcau

SEQ ID NO: 1478147 - RNA, 21 nt, Pseudomonas aeruginosa PA01
gaccgagauucugcaggcgcu

SEQ ID NO: 1478148 - RNA, 21 nt, Pseudomonas aeruginosa PA01
gaccgagauuggccgccugcu

SEQ ID NO: 1478149 - RNA, 13 nt, Pseudomonas aeruginosa PA01
gaccgagcagcgg

SEQ ID NO: 1478150 - RNA, 15 nt, Pseudomonas aeruginosa PA01
gaccgagcagcggac

SEQ ID NO: 1478151 - RNA, 17 nt, Pseudomonas aeruginosa PA01
gaccgagcaugcgcggc

SEQ ID NO: 1478152 - RNA, 18 nt, Pseudomonas aeruginosa PA01
gaccgagcaugcgcggca

SEQ ID NO: 1478153 - RNA, 21 nt, Pseudomonas aeruginosa PA01
gaccgacguugagaaggcgcc

SEQ ID NO: 1478154 - RNA, 16 nt, Pseudomonas aeruginosa PA01
gaccgagaccgacgcu

SEQ ID NO: 1478155 - RNA, 23 nt, Pseudomonas aeruginosa PA01
gaccgagaccgacgcucgcggca

SEQ ID NO: 1478156 - RNA, 14 nt, Pseudomonas aeruginosa PA01
gaccgaagccgcgc

SEQ ID NO: 1478157 - RNA, 18 nt, Pseudomonas aeruginosa PA01
gaccccggugugcgcugc

SEQ ID NO: 1478158 - RNA, 14 nt, Pseudomonas aeruginosa PA01
gacccgaaggucgc

SEQ ID NO: 1478159 - RNA, 16 nt, Pseudomonas aeruginosa PA01
gacccgaaggucgccg

SEQ ID NO: 1478160 - RNA, 19 nt, Pseudomonas aeruginosa PA01
gacccgaaggucgccgucc

SEQ ID NO: 1478161 - RNA, 12 nt, Pseudomonas aeruginosa PA01
gacccgccagcg

SEQ ID NO: 1478162 - RNA, 16 nt, Pseudomonas aeruginosa PA01
gacccgccagcggcau

SEQ ID NO: 1478163 - RNA, 16 nt, Pseudomonas aeruginosa PA01
gacccgcacggcgacg

SEQ ID NO: 1478164 - RNA, 19 nt, Pseudomonas aeruginosa PA01
gacccgcacuuuaccccga

SEQ ID NO: 1478165 - RNA, 15 nt, Pseudomonas aeruginosa PA01
gacccgcaccggcau

SEQ ID NO: 1478166 - RNA, 18 nt, Pseudomonas aeruginosa PA01
gacccgcaccuggaccgg

SEQ ID NO: 1478167 - RNA, 17 nt, Pseudomonas aeruginosa PA01
gaccccggccuccaggc

SEQ ID NO: 1478168 - RNA, 12 nt, Pseudomonas aeruginosa PA01
gaccccggccug

SEQ ID NO: 1478169 - RNA, 23 nt, Pseudomonas aeruginosa PA01
gaccccggcgaucuucagguagg

SEQ ID NO: 1478170 - RNA, 17 nt, Pseudomonas aeruginosa PA01
gaccccggcgaugcugc

SEQ ID NO: 1478171 - RNA, 21 nt, Pseudomonas aeruginosa PA01
gaccccggcgaugcugcugau

SEQ ID NO: 1478172 - RNA, 16 nt, Pseudomonas aeruginosa PA01
gaccccggcggcgcgu

SEQ ID NO: 1478173 - RNA, 14 nt, Pseudomonas aeruginosa PA01
gaccccgcggccga

SEQ ID NO: 1478174 - RNA, 18 nt, Pseudomonas aeruginosa PA01
gaccccggaaagguucac

SEQ ID NO: 1478175 - RNA, 17 nt, Pseudomonas aeruginosa PA01
gaccaucuuuuccugcu

SEQ ID NO: 1478176 - RNA, 14 nt, Pseudomonas aeruginosa PA01
gaccaguucagcgc

SEQ ID NO: 1478177 - RNA, 15 nt, Pseudomonas aeruginosa PA01
gaccaucaccagcgc

SEQ ID NO: 1478178 - RNA, 18 nt, Pseudomonas aeruginosa PA01
gaccaucaccagcgccgu

SEQ ID NO: 1478179 - RNA, 14 nt, Pseudomonas aeruginosa PA01
gaccaucgccggcg

SEQ ID NO: 1478180 - RNA, 15 nt, Pseudomonas aeruginosa PA01
gaccaucgccggcga

SEQ ID NO: 1478181 - RNA, 12 nt, Pseudomonas aeruginosa PA01
gaccaucggcac

SEQ ID NO: 1478182 - RNA, 18 nt, Pseudomonas aeruginosa PA01
gacggauaacggcagccg

SEQ ID NO: 1478183 - RNA, 16 nt, Pseudomonas aeruginosa PA01
gacggaaacgacaggc

SEQ ID NO: 1478184 - RNA, 18 nt, Pseudomonas aeruginosa PA01
gacggaacgucggccugg

SEQ ID NO: 1478185 - RNA, 18 nt, Pseudomonas aeruginosa PA01
gacggagagcagcagcuc

SEQ ID NO: 1478186 - RNA, 17 nt, Pseudomonas aeruginosa PA01
gacgcugucguggacgc

SEQ ID NO: 1478187 - RNA, 22 nt, Pseudomonas aeruginosa PA01
gacgcugcuaggcuggaagccg

SEQ ID NO: 1478188 - RNA, 16 nt, Pseudomonas aeruginosa PA01
gacgcugcucaccagg

SEQ ID NO: 1478189 - RNA, 17 nt, Pseudomonas aeruginosa PA01
gacgcugcucaccaggu

SEQ ID NO: 1478190 - RNA, 15 nt, Pseudomonas aeruginosa PA01
gacgcugcgaccugg

SEQ ID NO: 1478191 - RNA, 18 nt, Pseudomonas aeruginosa PA01
gacgcugcgaccuggcgc

SEQ ID NO: 1478192 - RNA, 17 nt, Pseudomonas aeruginosa PA01
gacgcuggcgaucaugc

SEQ ID NO: 1478193 - RNA, 13 nt, Pseudomonas aeruginosa PA01
gacgcugggcugg

SEQ ID NO: 1478194 - RNA, 15 nt, Pseudomonas aeruginosa PA01
gacgcuggucaggcu

SEQ ID NO: 1478195 - RNA, 13 nt, Pseudomonas aeruginosa PA01
gacgcugggacgg

SEQ ID NO: 1478196 - RNA, 15 nt, Pseudomonas aeruginosa PA01
gacgcugggacggcu

SEQ ID NO: 1478197 - RNA, 17 nt, Pseudomonas aeruginosa PA01
gacgcugggacggcugc

SEQ ID NO: 1478198 - RNA, 18 nt, Pseudomonas aeruginosa PA01
gacgcugggacggcugcc

SEQ ID NO: 1478199 - RNA, 16 nt, Pseudomonas aeruginosa PA01
gacgcucugcucggcc

SEQ ID NO: 1478200 - RNA, 21 nt, Pseudomonas aeruginosa PA01
gacgcucugcucggccagcgc

SEQ ID NO: 1478201 - RNA, 22 nt, Pseudomonas aeruginosa PA01
gacgcucugcucggccagcgcc

SEQ ID NO: 1478202 - RNA, 20 nt, Pseudomonas aeruginosa PA01
gacgcucuucaccucgauga

SEQ ID NO: 1478203 - RNA, 14 nt, Pseudomonas aeruginosa PA01
gacgcugaggauca

SEQ ID NO: 1478204 - RNA, 19 nt, Pseudomonas aeruginosa PA01
gacgcugcaccgcggcgcg

SEQ ID NO: 1478205 - RNA, 14 nt, Pseudomonas aeruginosa PA01
gacgcugcaugcgg

SEQ ID NO: 1478206 - RNA, 18 nt, Pseudomonas aeruginosa PA01
gacgcugaugccggcgaa

SEQ ID NO: 1478207 - RNA, 21 nt, Pseudomonas aeruginosa PA01
gacgccguccaccagccagcu

SEQ ID NO: 1478208 - RNA, 22 nt, Pseudomonas aeruginosa PA01
gacgccguagcgcaguucgccg

SEQ ID NO: 1478209 - RNA, 14 nt, Pseudomonas aeruginosa PA01
gacgcgcagcgccg

SEQ ID NO: 1478210 - RNA, 17 nt, Pseudomonas aeruginosa PA01
gacgcgcagcgccgccg

SEQ ID NO: 1478211 - RNA, 17 nt, Pseudomonas aeruginosa PA01
gacgcgcagcggcgccg

SEQ ID NO: 1478212 - RNA, 20 nt, Pseudomonas aeruginosa PA01
gacgcgcagcggcgccgagg

SEQ ID NO: 1478213 - RNA, 14 nt, Pseudomonas aeruginosa PA01
gacgcgcaggccgg

SEQ ID NO: 1478214 - RNA, 13 nt, Pseudomonas aeruginosa PA01
gacgcgcagcggc

SEQ ID NO: 1478215 - RNA, 14 nt, Pseudomonas aeruginosa PA01
gacgcgggcccagc

SEQ ID NO: 1478216 - RNA, 23 nt, Pseudomonas aeruginosa PA01
gacgcgggacuuguacucgccgg

SEQ ID NO: 1478217 - RNA, 14 nt, Pseudomonas aeruginosa PA01
gacgcgcaugucga

SEQ ID NO: 1478218 - RNA, 20 nt, Pseudomonas aeruginosa PA01
gacgcgcaugucgagguugc

SEQ ID NO: 1478219 - RNA, 12 nt, Pseudomonas aeruginosa PA01
gacgcgcaggcc

SEQ ID NO: 1478220 - RNA, 15 nt, Pseudomonas aeruginosa PA01
gacgcgcaugcaggg

SEQ ID NO: 1478221 - RNA, 17 nt, Pseudomonas aeruginosa PA01
gacgcgcaugcagggcg

SEQ ID NO: 1478222 - RNA, 20 nt, Pseudomonas aeruginosa PA01
gacgcgcaugcagggcgucc

SEQ ID NO: 1478223 - RNA, 17 nt, Pseudomonas aeruginosa PA01
gacgcgcagggucaggc

SEQ ID NO: 1478224 - RNA, 19 nt, Pseudomonas aeruginosa PA01
gacgcgcagggucaggccc

SEQ ID NO: 1478225 - RNA, 23 nt, Pseudomonas aeruginosa PA01
gacgcuccaggugcacggccagg

SEQ ID NO: 1478226 - RNA, 15 nt, Pseudomonas aeruginosa PA01
gacgcuccugcgccg

SEQ ID NO: 1478227 - RNA, 16 nt, Pseudomonas aeruginosa PA01
gacgcuccugcgccgg

SEQ ID NO: 1478228 - RNA, 17 nt, Pseudomonas aeruginosa PA01
gacgcuccugcgccggc

SEQ ID NO: 1478229 - RNA, 15 nt, Pseudomonas aeruginosa PA01
gacgcucggccagcg

SEQ ID NO: 1478230 - RNA, 16 nt, Pseudomonas aeruginosa PA01
gacgcaggcaggucau

SEQ ID NO: 1478231 - RNA, 14 nt, Pseudomonas aeruginosa PA01
gacgcaggccgacc

SEQ ID NO: 1478232 - RNA, 17 nt, Pseudomonas aeruginosa PA01
gacgcaggccgaccucg

SEQ ID NO: 1478233 - RNA, 18 nt, Pseudomonas aeruginosa PA01
gacgcagggcggcgccug

SEQ ID NO: 1478234 - RNA, 19 nt, Pseudomonas aeruginosa PA01
gacgcagggcggcgccugg

SEQ ID NO: 1478235 - RNA, 23 nt, Pseudomonas aeruginosa PA01
gacgcagggcgguacgccgcgcu

SEQ ID NO: 1478236 - RNA, 23 nt, Pseudomonas aeruginosa PA01
gacgcaggguucggggaacagcg

SEQ ID NO: 1478237 - RNA, 14 nt, Pseudomonas aeruginosa PA01
gacgcaggacgucg

SEQ ID NO: 1478238 - RNA, 16 nt, Pseudomonas aeruginosa PA01
gacgcagcgcgcgccg

SEQ ID NO: 1478239 - RNA, 17 nt, Pseudomonas aeruginosa PA01
gacgcagcgcgcgccga

SEQ ID NO: 1478240 - RNA, 21 nt, Pseudomonas aeruginosa PA01
gacgcagcgcgcgccgagcaa

SEQ ID NO: 1478241 - RNA, 17 nt, Pseudomonas aeruginosa PA01
gacgcagcgggucgauc

SEQ ID NO: 1478242 - RNA, 13 nt, Pseudomonas aeruginosa PA01
gacgcagccgggc

SEQ ID NO: 1478243 - RNA, 16 nt, Pseudomonas aeruginosa PA01
gacgcagccgggccgc

SEQ ID NO: 1478244 - RNA, 22 nt, Pseudomonas aeruginosa PA01
gacgcagccgggccgcagcgca

SEQ ID NO: 1478245 - RNA, 21 nt, Pseudomonas aeruginosa PA01
gacgcagccguuggccagcag

SEQ ID NO: 1478246 - RNA, 14 nt, Pseudomonas aeruginosa PA01
gacgaaggccuggu

SEQ ID NO: 1478247 - RNA, 24 nt, Pseudomonas aeruginosa PA01
gacgaagugaccgcgcgccauggc

SEQ ID NO: 1478248 - RNA, 20 nt, Pseudomonas aeruginosa PA01
gacgaagugauggaagagcg

SEQ ID NO: 1478249 - RNA, 18 nt, Pseudomonas aeruginosa PA01
gacgaaguugagcaccgg

SEQ ID NO: 1478250 - RNA, 20 nt, Pseudomonas aeruginosa PA01
gacgaaguugagcaccggca

SEQ ID NO: 1478251 - RNA, 17 nt, Pseudomonas aeruginosa PA01
gacgaaguuggcggccg

SEQ ID NO: 1478252 - RNA, 18 nt, Pseudomonas aeruginosa PA01
gacgaaguuggcggccga

SEQ ID NO: 1478253 - RNA, 20 nt, Pseudomonas aeruginosa PA01
gacgaaugcccgugcgcugc

SEQ ID NO: 1478254 - RNA, 17 nt, Pseudomonas aeruginosa PA01
gacgcagcacggcggcu

SEQ ID NO: 1478255 - RNA, 18 nt, Pseudomonas aeruginosa PA01
gacgcagcacggcggcua

SEQ ID NO: 1478256 - RNA, 22 nt, Pseudomonas aeruginosa PA01
gacgcccauguagaccaccagc

SEQ ID NO: 1478257 - RNA, 12 nt, Pseudomonas aeruginosa PA01
gacgcccagcag

SEQ ID NO: 1478258 - RNA, 15 nt, Pseudomonas aeruginosa PA01
gacgcccagcagggc

SEQ ID NO: 1478259 - RNA, 16 nt, Pseudomonas aeruginosa PA01
gacgcccagcagggcc

SEQ ID NO: 1478260 - RNA, 14 nt, Pseudomonas aeruginosa PA01
gacgccauucaggc

SEQ ID NO: 1478261 - RNA, 17 nt, Pseudomonas aeruginosa PA01
gacgccauucaggcgga

SEQ ID NO: 1478262 - RNA, 13 nt, Pseudomonas aeruginosa PA01
gacgccauggcgc

SEQ ID NO: 1478263 - RNA, 16 nt, Pseudomonas aeruginosa PA01
gacgccauggcgcuuc

SEQ ID NO: 1478264 - RNA, 22 nt, Pseudomonas aeruginosa PA01
gacgccauggguggaacccgcu

SEQ ID NO: 1478265 - RNA, 16 nt, Pseudomonas aeruginosa PA01
gacgcaucgacggggc

SEQ ID NO: 1478266 - RNA, 16 nt, Pseudomonas aeruginosa PA01
gacgcaguuccgcggc

SEQ ID NO: 1478267 - RNA, 14 nt, Pseudomonas aeruginosa PA01
gacgcaugcgcggc

SEQ ID NO: 1478268 - RNA, 14 nt, Pseudomonas aeruginosa PA01
gacgccauccuucg

SEQ ID NO: 1478269 - RNA, 22 nt, Pseudomonas aeruginosa PA01
gacgccauccuucggcgugauc

SEQ ID NO: 1478270 - RNA, 19 nt, Pseudomonas aeruginosa PA01
gacgccagcucggccggca

SEQ ID NO: 1478271 - RNA, 13 nt, Pseudomonas aeruginosa PA01
gacgccggcgacg

SEQ ID NO: 1478272 - RNA, 17 nt, Pseudomonas aeruginosa PA01
gacgccggucucggcga

SEQ ID NO: 1478273 - RNA, 18 nt, Pseudomonas aeruginosa PA01
gacgccggugccaggacc

SEQ ID NO: 1478274 - RNA, 13 nt, Pseudomonas aeruginosa PA01
gacgccgggcugg

SEQ ID NO: 1478275 - RNA, 16 nt, Pseudomonas aeruginosa PA01
gacgccggacgcacca

SEQ ID NO: 1478276 - RNA, 12 nt, Pseudomonas aeruginosa PA01
gacgccgagcug

SEQ ID NO: 1478277 - RNA, 19 nt, Pseudomonas aeruginosa PA01
gacgccgagccagccgcgg

SEQ ID NO: 1478278 - RNA, 21 nt, Pseudomonas aeruginosa PA01
gacgccgaggagacgcggcau

SEQ ID NO: 1478279 - RNA, 22 nt, Pseudomonas aeruginosa PA01
gacgccgaggagacgcggcaug

SEQ ID NO: 1478280 - RNA, 14 nt, Pseudomonas aeruginosa PA01
gacgcccgcuugcg

SEQ ID NO: 1478281 - RNA, 16 nt, Pseudomonas aeruginosa PA01
gacgcccgcuugcgcc

SEQ ID NO: 1478282 - RNA, 18 nt, Pseudomonas aeruginosa PA01
gacgcccgcuugcgccgc

SEQ ID NO: 1478283 - RNA, 14 nt, Pseudomonas aeruginosa PA01
gacgcccucggcga

SEQ ID NO: 1478284 - RNA, 15 nt, Pseudomonas aeruginosa PA01
gacgcccucggcgac

SEQ ID NO: 1478285 - RNA, 13 nt, Pseudomonas aeruginosa PA01
gacgcccuccagc

SEQ ID NO: 1478286 - RNA, 22 nt, Pseudomonas aeruginosa PA01
gacgcccuccagcaccgccugg

SEQ ID NO: 1478287 - RNA, 23 nt, Pseudomonas aeruginosa PA01
gacgcccuccagcaccgccuggc

SEQ ID NO: 1478288 - RNA, 20 nt, Pseudomonas aeruginosa PA01
gacgccgagcagcaccaggc

SEQ ID NO: 1478289 - RNA, 20 nt, Pseudomonas aeruginosa PA01
gacgccgaaggacaggccgu

SEQ ID NO: 1478290 - RNA, 14 nt, Pseudomonas aeruginosa PA01
gacgccgaaacgcc

SEQ ID NO: 1478291 - RNA, 16 nt, Pseudomonas aeruginosa PA01
gacgcccucggcgacg

SEQ ID NO: 1478292 - RNA, 14 nt, Pseudomonas aeruginosa PA01
gacgcccuggcgcu

SEQ ID NO: 1478293 - RNA, 14 nt, Pseudomonas aeruginosa PA01
gacgcccugggcga

SEQ ID NO: 1478294 - RNA, 18 nt, Pseudomonas aeruginosa PA01
gacgcccuguucggcggg

SEQ ID NO: 1478295 - RNA, 16 nt, Pseudomonas aeruginosa PA01
gacggcaaggaccugc

SEQ ID NO: 1478296 - RNA, 19 nt, Pseudomonas aeruginosa PA01
gacggcaccagcgcgucga

SEQ ID NO: 1478297 - RNA, 19 nt, Pseudomonas aeruginosa PA01
gacggauacgccagguugc

SEQ ID NO: 1478298 - RNA, 13 nt, Pseudomonas aeruginosa PA01
gacggcggcgacc

SEQ ID NO: 1478299 - RNA, 17 nt, Pseudomonas aeruginosa PA01
gacggcggcgaccccga

SEQ ID NO: 1478300 - RNA, 21 nt, Pseudomonas aeruginosa PA01
gacggcggccgccaucgcccg

SEQ ID NO: 1478301 - RNA, 20 nt, Pseudomonas aeruginosa PA01
gacggcacggggcgccuguc

SEQ ID NO: 1478302 - RNA, 15 nt, Pseudomonas aeruginosa PA01
gacggcggaaggcgg

SEQ ID NO: 1478303 - RNA, 18 nt, Pseudomonas aeruginosa PA01
gacggcggaaggcggcga

SEQ ID NO: 1478304 - RNA, 21 nt, Pseudomonas aeruginosa PA01
gacggcggacugcucgccgcc

SEQ ID NO: 1478305 - RNA, 12 nt, Pseudomonas aeruginosa PA01
gacggcucgcgc

SEQ ID NO: 1478306 - RNA, 17 nt, Pseudomonas aeruginosa PA01
gacggcucgcgcagcgg

SEQ ID NO: 1478307 - RNA, 19 nt, Pseudomonas aeruginosa PA01
gacggcucgcgcagcggcg

SEQ ID NO: 1478308 - RNA, 12 nt, Pseudomonas aeruginosa PA01
gacggcggcugg

SEQ ID NO: 1478309 - RNA, 19 nt, Pseudomonas aeruginosa PA01
gacggcgggagcggccuga

SEQ ID NO: 1478310 - RNA, 21 nt, Pseudomonas aeruginosa PA01
gacggcgggagcggccugagc

SEQ ID NO: 1478311 - RNA, 17 nt, Pseudomonas aeruginosa PA01
gacggcgugcagguagc

SEQ ID NO: 1478312 - RNA, 16 nt, Pseudomonas aeruginosa PA01
gacgguucagcagcgg

SEQ ID NO: 1478313 - RNA, 22 nt, Pseudomonas aeruginosa PA01
gacgguucagcagcggcacccg

SEQ ID NO: 1478314 - RNA, 19 nt, Pseudomonas aeruginosa PA01
gacgguccgcgccacgcag

SEQ ID NO: 1478315 - RNA, 14 nt, Pseudomonas aeruginosa PA01
gacggucggcaggu

SEQ ID NO: 1478316 - RNA, 12 nt, Pseudomonas aeruginosa PA01
gacggcuccgga

SEQ ID NO: 1478317 - RNA, 21 nt, Pseudomonas aeruginosa PA01
gacgguaccagggaagcgcgc

SEQ ID NO: 1478318 - RNA, 21 nt, Pseudomonas aeruginosa PA01
gacggucagcggacaaccgcc

SEQ ID NO: 1478319 - RNA, 14 nt, Pseudomonas aeruginosa PA01
gacggucaggccga

SEQ ID NO: 1478320 - RNA, 16 nt, Pseudomonas aeruginosa PA01
gacggucagcaggccc

SEQ ID NO: 1478321 - RNA, 23 nt, Pseudomonas aeruginosa PA01
gacggguuugugccguuccagcg

SEQ ID NO: 1478322 - RNA, 15 nt, Pseudomonas aeruginosa PA01
gacguaccgccugcc

SEQ ID NO: 1478323 - RNA, 15 nt, Pseudomonas aeruginosa PA01
gacgucgccgaugcg

SEQ ID NO: 1478324 - RNA, 16 nt, Pseudomonas aeruginosa PA01
gacgucgccgaugcgg

SEQ ID NO: 1478325 - RNA, 15 nt, Pseudomonas aeruginosa PA01
gacgucgccccagcc

SEQ ID NO: 1478326 - RNA, 17 nt, Pseudomonas aeruginosa PA01
gacgucgccccagccuu

SEQ ID NO: 1478327 - RNA, 12 nt, Pseudomonas aeruginosa PA01
gacgguucgcga

SEQ ID NO: 1478328 - RNA, 13 nt, Pseudomonas aeruginosa PA01
gacguacagcggg

SEQ ID NO: 1478329 - RNA, 20 nt, Pseudomonas aeruginosa PA01
gacguacagcgggucggcga

SEQ ID NO: 1478330 - RNA, 13 nt, Pseudomonas aeruginosa PA01
gacgucggcggcg

SEQ ID NO: 1478331 - RNA, 17 nt, Pseudomonas aeruginosa PA01
gacgugaagccccuggc

SEQ ID NO: 1478332 - RNA, 23 nt, Pseudomonas aeruginosa PA01
gacgugaagccccuggcgcuggg

SEQ ID NO: 1478333 - RNA, 20 nt, Pseudomonas aeruginosa PA01
gacgucuuccgggaccggcu

SEQ ID NO: 1478334 - RNA, 13 nt, Pseudomonas aeruginosa PA01
gacguugcgcagg

SEQ ID NO: 1478335 - RNA, 17 nt, Pseudomonas aeruginosa PA01
gacguugcugcccuggc

SEQ ID NO: 1478336 - RNA, 16 nt, Pseudomonas aeruginosa PA01
gacguucugcccgccg

SEQ ID NO: 1478337 - RNA, 18 nt, Pseudomonas aeruginosa PA01
gacguucugcccgccggc

SEQ ID NO: 1478338 - RNA, 20 nt, Pseudomonas aeruginosa PA01
gacguucugcccgccggcgc

SEQ ID NO: 1478339 - RNA, 18 nt, Pseudomonas aeruginosa PA01
gacguuccgcgauagcuc

SEQ ID NO: 1478340 - RNA, 19 nt, Pseudomonas aeruginosa PA01
gacguugagaaggcgccug

SEQ ID NO: 1478341 - RNA, 13 nt, Pseudomonas aeruginosa PA01
gacguuccaccug

SEQ ID NO: 1478342 - RNA, 16 nt, Pseudomonas aeruginosa PA01
gacguuccaccuggcg

SEQ ID NO: 1478343 - RNA, 20 nt, Pseudomonas aeruginosa PA01
gacguuccaccuggcgcagg

SEQ ID NO: 1478344 - RNA, 20 nt, Pseudomonas aeruginosa PA01
gacgugggaaaucaccgcca

SEQ ID NO: 1478345 - RNA, 18 nt, Pseudomonas aeruginosa PA01
gacgugcugguagagccg

SEQ ID NO: 1478346 - RNA, 17 nt, Pseudomonas aeruginosa PA01
gagauucugcaggcgcu

SEQ ID NO: 1478347 - RNA, 20 nt, Pseudomonas aeruginosa PA01
gagauguacaggaugggcga

SEQ ID NO: 1478348 - RNA, 22 nt, Pseudomonas aeruginosa PA01
gagauguacaggaugggcgaag

SEQ ID NO: 1478349 - RNA, 19 nt, Pseudomonas aeruginosa PA01
gagauguccaucagccgcg

SEQ ID NO: 1478350 - RNA, 13 nt, Pseudomonas aeruginosa PA01
gagcaacacaugc

SEQ ID NO: 1478351 - RNA, 21 nt, Pseudomonas aeruginosa PA01
gagcaaugaaaaaggcgaucg

SEQ ID NO: 1478352 - RNA, 19 nt, Pseudomonas aeruginosa PA01
gagcaacucggcggcgagc

SEQ ID NO: 1478353 - RNA, 20 nt, Pseudomonas aeruginosa PA01
gagcaacucggcggcgagcg

SEQ ID NO: 1478354 - RNA, 15 nt, Pseudomonas aeruginosa PA01
gagcaaccgcgaugg

SEQ ID NO: 1478355 - RNA, 14 nt, Pseudomonas aeruginosa PA01
gagcaacagcagga

SEQ ID NO: 1478356 - RNA, 23 nt, Pseudomonas aeruginosa PA01
gagcaacagcaggagaagcgccu

SEQ ID NO: 1478357 - RNA, 14 nt, Pseudomonas aeruginosa PA01
gagaucggcggcgc

SEQ ID NO: 1478358 - RNA, 13 nt, Pseudomonas aeruginosa PA01
gagaucgccgcgc

SEQ ID NO: 1478359 - RNA, 14 nt, Pseudomonas aeruginosa PA01
gagaucgccgcgcc

SEQ ID NO: 1478360 - RNA, 16 nt, Pseudomonas aeruginosa PA01
gagaucgccgcgccgu

SEQ ID NO: 1478361 - RNA, 17 nt, Pseudomonas aeruginosa PA01
gagaucgcccagcggcu

SEQ ID NO: 1478362 - RNA, 15 nt, Pseudomonas aeruginosa PA01
gagauccgccagcag

SEQ ID NO: 1478363 - RNA, 21 nt, Pseudomonas aeruginosa PA01
gagauccgccagcagacggca

SEQ ID NO: 1478364 - RNA, 13 nt, Pseudomonas aeruginosa PA01
gagaugaagcgcc

SEQ ID NO: 1478365 - RNA, 15 nt, Pseudomonas aeruginosa PA01
gagaucuucaggccg

SEQ ID NO: 1478366 - RNA, 19 nt, Pseudomonas aeruginosa PA01
gagaucuucaggccgaagc

SEQ ID NO: 1478367 - RNA, 20 nt, Pseudomonas aeruginosa PA01
gagaucggucaccgugguca

SEQ ID NO: 1478368 - RNA, 23 nt, Pseudomonas aeruginosa PA01
gagcaccaccacucgcgagcugg

SEQ ID NO: 1478369 - RNA, 21 nt, Pseudomonas aeruginosa PA01
gagcaccagcaggucggcgcg

SEQ ID NO: 1478370 - RNA, 17 nt, Pseudomonas aeruginosa PA01
gagcacccgggcgaccu

SEQ ID NO: 1478371 - RNA, 19 nt, Pseudomonas aeruginosa PA01
gagcacccgggcgaccugc

SEQ ID NO: 1478372 - RNA, 18 nt, Pseudomonas aeruginosa PA01
gagcaccaugcagcggca

SEQ ID NO: 1478373 - RNA, 22 nt, Pseudomonas aeruginosa PA01
gagcaccaugcagcggcauggu

SEQ ID NO: 1478374 - RNA, 19 nt, Pseudomonas aeruginosa PA01
gagcaccaugccgaugaca

SEQ ID NO: 1478375 - RNA, 17 nt, Pseudomonas aeruginosa PA01
gagcaccgcgcagacca

SEQ ID NO: 1478376 - RNA, 15 nt, Pseudomonas aeruginosa PA01
gagcaccgcgccuuc

SEQ ID NO: 1478377 - RNA, 19 nt, Pseudomonas aeruginosa PA01
gagcaccgggacgaagcgg

SEQ ID NO: 1478378 - RNA, 23 nt, Pseudomonas aeruginosa PA01
gagcacuucccaggugcccugga

SEQ ID NO: 1478379 - RNA, 14 nt, Pseudomonas aeruginosa PA01
gagcacggcgcugg

SEQ ID NO: 1478380 - RNA, 18 nt, Pseudomonas aeruginosa PA01
gagcacggcgcuggucuc

SEQ ID NO: 1478381 - RNA, 20 nt, Pseudomonas aeruginosa PA01
gagcaccucgaccugguagc

SEQ ID NO: 1478382 - RNA, 12 nt, Pseudomonas aeruginosa PA01
gagcacgaaagc

SEQ ID NO: 1478383 - RNA, 19 nt, Pseudomonas aeruginosa PA01
gagcacgccgcgaccgaag

SEQ ID NO: 1478384 - RNA, 13 nt, Pseudomonas aeruginosa PA01
gagcacgccgugc

SEQ ID NO: 1478385 - RNA, 16 nt, Pseudomonas aeruginosa PA01
gagagcguccggcagg

SEQ ID NO: 1478386 - RNA, 22 nt, Pseudomonas aeruginosa PA01
gagagcugcaaggcuucggcgg

SEQ ID NO: 1478387 - RNA, 15 nt, Pseudomonas aeruginosa PA01
gagagcuguccggcg

SEQ ID NO: 1478388 - RNA, 14 nt, Pseudomonas aeruginosa PA01
gagaggugggccgu

SEQ ID NO: 1478389 - RNA, 22 nt, Pseudomonas aeruginosa PA01
gagagggagcgccuggcgucga

SEQ ID NO: 1478390 - RNA, 20 nt, Pseudomonas aeruginosa PA01
gagaggggcuacuucgccgg

SEQ ID NO: 1478391 - RNA, 14 nt, Pseudomonas aeruginosa PA01
gagaggguggucgc

SEQ ID NO: 1478392 - RNA, 20 nt, Pseudomonas aeruginosa PA01
gagaggucgccgacacgugu

SEQ ID NO: 1478393 - RNA, 14 nt, Pseudomonas aeruginosa PA01
gagauacgcuccgg

SEQ ID NO: 1478394 - RNA, 18 nt, Pseudomonas aeruginosa PA01
gagaucaccuugucguug

SEQ ID NO: 1478395 - RNA, 22 nt, Pseudomonas aeruginosa PA01
gagagcccgggcgcaacccugc

SEQ ID NO: 1478396 - RNA, 14 nt, Pseudomonas aeruginosa PA01
gagagaauccgccg

SEQ ID NO: 1478397 - RNA, 16 nt, Pseudomonas aeruginosa PA01
gagagacugaacucgg

SEQ ID NO: 1478398 - RNA, 17 nt, Pseudomonas aeruginosa PA01
gagagacccgccagcgg

SEQ ID NO: 1478399 - RNA, 22 nt, Pseudomonas aeruginosa PA01
gagacuugaugucgaugggcga

SEQ ID NO: 1478400 - RNA, 18 nt, Pseudomonas aeruginosa PA01
gagacguugacgaucgcc

SEQ ID NO: 1478401 - RNA, 19 nt, Pseudomonas aeruginosa PA01
gagacguugacgaucgccc

SEQ ID NO: 1478402 - RNA, 14 nt, Pseudomonas aeruginosa PA01
gagacuaccgaucg

SEQ ID NO: 1478403 - RNA, 16 nt, Pseudomonas aeruginosa PA01
gagacgauggcgacgu

SEQ ID NO: 1478404 - RNA, 16 nt, Pseudomonas aeruginosa PA01
gagacgcugccguucg

SEQ ID NO: 1478405 - RNA, 20 nt, Pseudomonas aeruginosa PA01
gagacgcgggcccagcggua

SEQ ID NO: 1478406 - RNA, 13 nt, Pseudomonas aeruginosa PA01
gagacgggcgagg

SEQ ID NO: 1478407 - RNA, 16 nt, Pseudomonas aeruginosa PA01
gagaagccagccaggu

SEQ ID NO: 1478408 - RNA, 21 nt, Pseudomonas aeruginosa PA01
gagaacuugccggcgccaucg

SEQ ID NO: 1478409 - RNA, 16 nt, Pseudomonas aeruginosa PA01
gagaagcagaacgccc

SEQ ID NO: 1478410 - RNA, 22 nt, Pseudomonas aeruginosa PA01
gagaagccgcccacgggcggcu

SEQ ID NO: 1478411 - RNA, 14 nt, Pseudomonas aeruginosa PA01
gagaagcgccucgc

SEQ ID NO: 1478412 - RNA, 16 nt, Pseudomonas aeruginosa PA01
gagaagcgccucgccu

SEQ ID NO: 1478413 - RNA, 18 nt, Pseudomonas aeruginosa PA01
gagaagguucucggccac

SEQ ID NO: 1478414 - RNA, 22 nt, Pseudomonas aeruginosa PA01
gagaaggcguagaaacgcgccu

SEQ ID NO: 1478415 - RNA, 16 nt, Pseudomonas aeruginosa PA01
gagaaggcugccgggc

SEQ ID NO: 1478416 - RNA, 18 nt, Pseudomonas aeruginosa PA01
gagaaucugcccggccau

SEQ ID NO: 1478417 - RNA, 19 nt, Pseudomonas aeruginosa PA01
gagaccucgcccaucgcca

SEQ ID NO: 1478418 - RNA, 23 nt, Pseudomonas aeruginosa PA01
gagaccucgcccaucgccagggu

SEQ ID NO: 1478419 - RNA, 21 nt, Pseudomonas aeruginosa PA01
gagaccuuccugccagcgcgu

SEQ ID NO: 1478420 - RNA, 13 nt, Pseudomonas aeruginosa PA01
gagacgaucagca

SEQ ID NO: 1478421 - RNA, 13 nt, Pseudomonas aeruginosa PA01
gagacgccagccg

SEQ ID NO: 1478422 - RNA, 19 nt, Pseudomonas aeruginosa PA01
gagacgccagccgcccugg

SEQ ID NO: 1478423 - RNA, 20 nt, Pseudomonas aeruginosa PA01
gagacgccagccgcccuggc

SEQ ID NO: 1478424 - RNA, 14 nt, Pseudomonas aeruginosa PA01
gagacgccgcccca

SEQ ID NO: 1478425 - RNA, 14 nt, Pseudomonas aeruginosa PA01
gagacauccggcca

SEQ ID NO: 1478426 - RNA, 15 nt, Pseudomonas aeruginosa PA01
gagacauccggccau

SEQ ID NO: 1478427 - RNA, 22 nt, Pseudomonas aeruginosa PA01
gagaccacggugaucaggcgcu

SEQ ID NO: 1478428 - RNA, 14 nt, Pseudomonas aeruginosa PA01
gagacccuggcgcu

SEQ ID NO: 1478429 - RNA, 22 nt, Pseudomonas aeruginosa PA01
gagacccuggcgcugucgcccg

SEQ ID NO: 1478430 - RNA, 19 nt, Pseudomonas aeruginosa PA01
gagaccgacgcucgcggca

SEQ ID NO: 1478431 - RNA, 17 nt, Pseudomonas aeruginosa PA01
gagaccgauccagcagu

SEQ ID NO: 1478432 - RNA, 22 nt, Pseudomonas aeruginosa PA01
gacucuccgcgccgcggcggcg

SEQ ID NO: 1478433 - RNA, 16 nt, Pseudomonas aeruginosa PA01
gacugcacgcagacgu

SEQ ID NO: 1478434 - RNA, 13 nt, Pseudomonas aeruginosa PA01
gacugagccgcug

SEQ ID NO: 1478435 - RNA, 14 nt, Pseudomonas aeruginosa PA01
gacugagccgcugg

SEQ ID NO: 1478436 - RNA, 22 nt, Pseudomonas aeruginosa PA01
gacugagcuaauccggcggcgc

SEQ ID NO: 1478437 - RNA, 18 nt, Pseudomonas aeruginosa PA01
gacucgaugcgcagcuug

SEQ ID NO: 1478438 - RNA, 15 nt, Pseudomonas aeruginosa PA01
gacucgcugccggcg

SEQ ID NO: 1478439 - RNA, 16 nt, Pseudomonas aeruginosa PA01
gacucgcugccggcgc

SEQ ID NO: 1478440 - RNA, 15 nt, Pseudomonas aeruginosa PA01
gacucgcugggcgcc

SEQ ID NO: 1478441 - RNA, 18 nt, Pseudomonas aeruginosa PA01
gacucgcugggcgccggc

SEQ ID NO: 1478442 - RNA, 21 nt, Pseudomonas aeruginosa PA01
gacucgcugggcgccggcagg

SEQ ID NO: 1478443 - RNA, 17 nt, Pseudomonas aeruginosa PA01
gacucgccaucggccug

SEQ ID NO: 1478444 - RNA, 22 nt, Pseudomonas aeruginosa PA01
gacucgccaucggccuggggcu

SEQ ID NO: 1478445 - RNA, 18 nt, Pseudomonas aeruginosa PA01
gacucgcgaucgaucggc

SEQ ID NO: 1478446 - RNA, 21 nt, Pseudomonas aeruginosa PA01
gacucgcgaucgaucggcugg

SEQ ID NO: 1478447 - RNA, 17 nt, Pseudomonas aeruginosa PA01
gacucgcuaucaggcau

SEQ ID NO: 1478448 - RNA, 20 nt, Pseudomonas aeruginosa PA01
gacucggggcgccuccagcg

SEQ ID NO: 1478449 - RNA, 16 nt, Pseudomonas aeruginosa PA01
gacucggugcguagcg

SEQ ID NO: 1478450 - RNA, 23 nt, Pseudomonas aeruginosa PA01
gacucggugcguagcgacaggcc

SEQ ID NO: 1478451 - RNA, 15 nt, Pseudomonas aeruginosa PA01
gacucuccaggucgg

SEQ ID NO: 1478452 - RNA, 21 nt, Pseudomonas aeruginosa PA01
gacucguugcacgcaggccgc

SEQ ID NO: 1478453 - RNA, 16 nt, Pseudomonas aeruginosa PA01
gacuaccagguucugc

SEQ ID NO: 1478454 - RNA, 18 nt, Pseudomonas aeruginosa PA01
gacuaccgaucggcugcc

SEQ ID NO: 1478455 - RNA, 17 nt, Pseudomonas aeruginosa PA01
gacucagcgcgacaggc

SEQ ID NO: 1478456 - RNA, 20 nt, Pseudomonas aeruginosa PA01
gacucagcgcgacaggcugg

SEQ ID NO: 1478457 - RNA, 15 nt, Pseudomonas aeruginosa PA01
gacucacccgcugcg

SEQ ID NO: 1478458 - RNA, 16 nt, Pseudomonas aeruginosa PA01
gacuccagccaggcga

SEQ ID NO: 1478459 - RNA, 16 nt, Pseudomonas aeruginosa PA01
gacucgaagcucuucg

SEQ ID NO: 1478460 - RNA, 23 nt, Pseudomonas aeruginosa PA01
gacuccggaggcgcacaggcgga

SEQ ID NO: 1478461 - RNA, 18 nt, Pseudomonas aeruginosa PA01
gacugguaggacagggcc

SEQ ID NO: 1478462 - RNA, 20 nt, Pseudomonas aeruginosa PA01
gacugguaggacagggccag

SEQ ID NO: 1478463 - RNA, 18 nt, Pseudomonas aeruginosa PA01
gacugguccugcggcggc

SEQ ID NO: 1478464 - RNA, 19 nt, Pseudomonas aeruginosa PA01
gacugucgcggggcuugcg

SEQ ID NO: 1478465 - RNA, 20 nt, Pseudomonas aeruginosa PA01
gacugguugaccugcagcgc

SEQ ID NO: 1478466 - RNA, 21 nt, Pseudomonas aeruginosa PA01
gacugguugaccugcagcgcc

SEQ ID NO: 1478467 - RNA, 15 nt, Pseudomonas aeruginosa PA01
gacugccaacuggcg

SEQ ID NO: 1478468 - RNA, 22 nt, Pseudomonas aeruginosa PA01
gacugccaggguaccguugcgc

SEQ ID NO: 1478469 - RNA, 15 nt, Pseudomonas aeruginosa PA01
gacugcccagcgccg

SEQ ID NO: 1478470 - RNA, 19 nt, Pseudomonas aeruginosa PA01
gacugcccagcgccgccag

SEQ ID NO: 1478471 - RNA, 21 nt, Pseudomonas aeruginosa PA01
gacugcccagcgccgccagca

SEQ ID NO: 1478472 - RNA, 15 nt, Pseudomonas aeruginosa PA01
gacugccgucggcgc

SEQ ID NO: 1478473 - RNA, 14 nt, Pseudomonas aeruginosa PA01
gacugcgcuggccg

SEQ ID NO: 1478474 - RNA, 16 nt, Pseudomonas aeruginosa PA01
gacugcgaggcggugc

SEQ ID NO: 1478475 - RNA, 22 nt, Pseudomonas aeruginosa PA01
gacugccugcagguagcgcugc

SEQ ID NO: 1478476 - RNA, 19 nt, Pseudomonas aeruginosa PA01
gacugcgguuuuccugccc

SEQ ID NO: 1478477 - RNA, 18 nt, Pseudomonas aeruginosa PA01
gacugcugcugcggggcc

SEQ ID NO: 1478478 - RNA, 12 nt, Pseudomonas aeruginosa PA01
gacugcucgccg

SEQ ID NO: 1478479 - RNA, 16 nt, Pseudomonas aeruginosa PA01
gacugcucgccgccgg

SEQ ID NO: 1478480 - RNA, 16 nt, Pseudomonas aeruginosa PA01
gagaacagcagcggca

SEQ ID NO: 1478481 - RNA, 22 nt, Pseudomonas aeruginosa PA01
gagaaccaguacuugaacagca

SEQ ID NO: 1478482 - RNA, 14 nt, Pseudomonas aeruginosa PA01
gacuuggcagucgc

SEQ ID NO: 1478483 - RNA, 20 nt, Pseudomonas aeruginosa PA01
gacuuggcagucgccgccag

SEQ ID NO: 1478484 - RNA, 20 nt, Pseudomonas aeruginosa PA01
gacuucggucucguccggcg

SEQ ID NO: 1478485 - RNA, 23 nt, Pseudomonas aeruginosa PA01
gacuugccgaucaugggggccag

SEQ ID NO: 1478486 - RNA, 18 nt, Pseudomonas aeruginosa PA01
gacuugaugucgaugggc

SEQ ID NO: 1478487 - RNA, 18 nt, Pseudomonas aeruginosa PA01
gacuucgcaccagccggc

SEQ ID NO: 1478488 - RNA, 21 nt, Pseudomonas aeruginosa PA01
gacuucgcaccagccggccgc

SEQ ID NO: 1478489 - RNA, 15 nt, Pseudomonas aeruginosa PA01
gacuucgcauuccac

SEQ ID NO: 1478490 - RNA, 22 nt, Pseudomonas aeruginosa PA01
gacuucgcauuccaccuuggca

SEQ ID NO: 1478491 - RNA, 12 nt, Pseudomonas aeruginosa PA01
gacuucagcgca

SEQ ID NO: 1478492 - RNA, 13 nt, Pseudomonas aeruginosa PA01
cuguucagcagga

SEQ ID NO: 1478493 - RNA, 14 nt, Pseudomonas aeruginosa PA01
cuguucagcgggug

SEQ ID NO: 1478494 - RNA, 21 nt, Pseudomonas aeruginosa PA01
cuguucacaaaggcgucgauc

SEQ ID NO: 1478495 - RNA, 15 nt, Pseudomonas aeruginosa PA01
cugugcggcagcagg

SEQ ID NO: 1478496 - RNA, 17 nt, Pseudomonas aeruginosa PA01
cugugcggcagcaggcu

SEQ ID NO: 1478497 - RNA, 12 nt, Pseudomonas aeruginosa PA01
cugugcggcgau

SEQ ID NO: 1478498 - RNA, 20 nt, Pseudomonas aeruginosa PA01
cuguucgcgcgccucgcggc

SEQ ID NO: 1478499 - RNA, 23 nt, Pseudomonas aeruginosa PA01
cuguucgcccaaggccaggucga

SEQ ID NO: 1478500 - RNA, 18 nt, Pseudomonas aeruginosa PA01
cuguuccucggcggcggu

SEQ ID NO: 1478501 - RNA, 15 nt, Pseudomonas aeruginosa PA01
cuguuccgggcccag

SEQ ID NO: 1478502 - RNA, 21 nt, Pseudomonas aeruginosa PA01
cugucgggggcugcgcaucgc

SEQ ID NO: 1478503 - RNA, 14 nt, Pseudomonas aeruginosa PA01
cugucggcucgcgc

SEQ ID NO: 1478504 - RNA, 18 nt, Pseudomonas aeruginosa PA01
cugucggcucgcgccggc

SEQ ID NO: 1478505 - RNA, 19 nt, Pseudomonas aeruginosa PA01
cugucggcucgcgccggcg

SEQ ID NO: 1478506 - RNA, 22 nt, Pseudomonas aeruginosa PA01
cugucggcucgcgccggcgcgu

SEQ ID NO: 1478507 - RNA, 22 nt, Pseudomonas aeruginosa PA01
cugucggagagggagcgccugg

SEQ ID NO: 1478508 - RNA, 17 nt, Pseudomonas aeruginosa PA01
cugucggccagccccug

SEQ ID NO: 1478509 - RNA, 17 nt, Pseudomonas aeruginosa PA01
cugucggccaucgccgu

SEQ ID NO: 1478510 - RNA, 13 nt, Pseudomonas aeruginosa PA01
cugucggcccgcg

SEQ ID NO: 1478511 - RNA, 21 nt, Pseudomonas aeruginosa PA01
cugucgcguucccacucgcga

SEQ ID NO: 1478512 - RNA, 22 nt, Pseudomonas aeruginosa PA01
cugucgcguucccacucgcgac

SEQ ID NO: 1478513 - RNA, 17 nt, Pseudomonas aeruginosa PA01
cugucgcucagcgggcc

SEQ ID NO: 1478514 - RNA, 22 nt, Pseudomonas aeruginosa PA01
cugucgcucagcgggccgaucc

SEQ ID NO: 1478515 - RNA, 21 nt, Pseudomonas aeruginosa PA01
cugugccauuccugggccccg

SEQ ID NO: 1478516 - RNA, 20 nt, Pseudomonas aeruginosa PA01
cugugcaggaaggcgacgau

SEQ ID NO: 1478517 - RNA, 16 nt, Pseudomonas aeruginosa PA01
cugugcagggaggcau

SEQ ID NO: 1478518 - RNA, 20 nt, Pseudomonas aeruginosa PA01
cugugcagggucagucgagc

SEQ ID NO: 1478519 - RNA, 14 nt, Pseudomonas aeruginosa PA01
cugugcgccaggcc

SEQ ID NO: 1478520 - RNA, 16 nt, Pseudomonas aeruginosa PA01
cugugcgccaggccgg

SEQ ID NO: 1478521 - RNA, 19 nt, Pseudomonas aeruginosa PA01
cugugcgccaggccggugc

SEQ ID NO: 1478522 - RNA, 19 nt, Pseudomonas aeruginosa PA01
cugugccgaggccgccgcg

SEQ ID NO: 1478523 - RNA, 20 nt, Pseudomonas aeruginosa PA01
cuguuugcggcgcaggcgga

SEQ ID NO: 1478524 - RNA, 17 nt, Pseudomonas aeruginosa PA01
cuguuuuccauggcgag

SEQ ID NO: 1478525 - RNA, 19 nt, Pseudomonas aeruginosa PA01
cuguucgucuggcgccugg

SEQ ID NO: 1478526 - RNA, 21 nt, Pseudomonas aeruginosa PA01
cuguucgucccgagcaccggc

SEQ ID NO: 1478527 - RNA, 22 nt, Pseudomonas aeruginosa PA01
cuguucggcgggaucgacgccg

SEQ ID NO: 1478528 - RNA, 17 nt, Pseudomonas aeruginosa PA01
cuguugcuccaaccagu

SEQ ID NO: 1478529 - RNA, 14 nt, Pseudomonas aeruginosa PA01
cuguuucugcugug

SEQ ID NO: 1478530 - RNA, 22 nt, Pseudomonas aeruginosa PA01
cuguugccggcaaacgccgcca

SEQ ID NO: 1478531 - RNA, 22 nt, Pseudomonas aeruginosa PA01
cuguugccguucugugcggcga

SEQ ID NO: 1478532 - RNA, 17 nt, Pseudomonas aeruginosa PA01
cuguugcagagcggcca

SEQ ID NO: 1478533 - RNA, 19 nt, Pseudomonas aeruginosa PA01
cuguugcagagcggccagg

SEQ ID NO: 1478534 - RNA, 21 nt, Pseudomonas aeruginosa PA01
cugucgcggacccgcgccggc

SEQ ID NO: 1478535 - RNA, 16 nt, Pseudomonas aeruginosa PA01
cugucgcccucgcgga

SEQ ID NO: 1478536 - RNA, 18 nt, Pseudomonas aeruginosa PA01
cugucgcccgggcgccac

SEQ ID NO: 1478537 - RNA, 13 nt, Pseudomonas aeruginosa PA01
cuguccgccgccg

SEQ ID NO: 1478538 - RNA, 21 nt, Pseudomonas aeruginosa PA01
cuguccgaacagggcgaaggc

SEQ ID NO: 1478539 - RNA, 23 nt, Pseudomonas aeruginosa PA01
cugucccggacgacgaaagaagc

SEQ ID NO: 1478540 - RNA, 22 nt, Pseudomonas aeruginosa PA01
cugucccaucacggccccgaga

SEQ ID NO: 1478541 - RNA, 12 nt, Pseudomonas aeruginosa PA01
cugucccagcga

SEQ ID NO: 1478542 - RNA, 14 nt, Pseudomonas aeruginosa PA01
cugucccagcgagu

SEQ ID NO: 1478543 - RNA, 22 nt, Pseudomonas aeruginosa PA01
cugucccagcgaguagucgcgg

SEQ ID NO: 1478544 - RNA, 20 nt, Pseudomonas aeruginosa PA01
cuguccccucacggcgcgag

SEQ ID NO: 1478545 - RNA, 17 nt, Pseudomonas aeruginosa PA01
cugucccgccgcgccgc

SEQ ID NO: 1478546 - RNA, 22 nt, Pseudomonas aeruginosa PA01
cugucccgccgcgccgcucagg

SEQ ID NO: 1478547 - RNA, 17 nt, Pseudomonas aeruginosa PA01
cuguccaucucgccgcg

SEQ ID NO: 1478548 - RNA, 22 nt, Pseudomonas aeruginosa PA01
cuguccaucucgccgcgcacgu

SEQ ID NO: 1478549 - RNA, 19 nt, Pseudomonas aeruginosa PA01
cuguagcgcuccuguucgu

SEQ ID NO: 1478550 - RNA, 13 nt, Pseudomonas aeruginosa PA01
cuguagccggcga

SEQ ID NO: 1478551 - RNA, 21 nt, Pseudomonas aeruginosa PA01
cuguagccggcgaugugcggc

SEQ ID NO: 1478552 - RNA, 14 nt, Pseudomonas aeruginosa PA01
cuguagccggcgcc

SEQ ID NO: 1478553 - RNA, 14 nt, Pseudomonas aeruginosa PA01
cuguagccucccgc

SEQ ID NO: 1478554 - RNA, 18 nt, Pseudomonas aeruginosa PA01
cuguccaccgguggcgac

SEQ ID NO: 1478555 - RNA, 16 nt, Pseudomonas aeruginosa PA01
cuguaguaggcggugg

SEQ ID NO: 1478556 - RNA, 16 nt, Pseudomonas aeruginosa PA01
cuguaggugcccggcg

SEQ ID NO: 1478557 - RNA, 22 nt, Pseudomonas aeruginosa PA01
cuguagggcgaauaacgccaca

SEQ ID NO: 1478558 - RNA, 19 nt, Pseudomonas aeruginosa PA01
cuguagggucgcagcaggc

SEQ ID NO: 1478559 - RNA, 16 nt, Pseudomonas aeruginosa PA01
cuguagcggcucgccg

SEQ ID NO: 1478560 - RNA, 18 nt, Pseudomonas aeruginosa PA01
cuguaggcgagcagcggc

SEQ ID NO: 1478561 - RNA, 15 nt, Pseudomonas aeruginosa PA01
cuguaggacucgaua

SEQ ID NO: 1478562 - RNA, 22 nt, Pseudomonas aeruginosa PA01
cuguagcguuccgggcagcggc

SEQ ID NO: 1478563 - RNA, 23 nt, Pseudomonas aeruginosa PA01
cuguagccacggcgagagcgccg

SEQ ID NO: 1478564 - RNA, 24 nt, Pseudomonas aeruginosa PA01
cuguagccacggcgagagcgccga

SEQ ID NO: 1478565 - RNA, 14 nt, Pseudomonas aeruginosa PA01
cugguuggccgccu

SEQ ID NO: 1478566 - RNA, 21 nt, Pseudomonas aeruginosa PA01
cugguuggccgccuggcgcau

SEQ ID NO: 1478567 - RNA, 21 nt, Pseudomonas aeruginosa PA01
cugguugaccugcagcgccuc

SEQ ID NO: 1478568 - RNA, 16 nt, Pseudomonas aeruginosa PA01
cugguugccagcagcg

SEQ ID NO: 1478569 - RNA, 16 nt, Pseudomonas aeruginosa PA01
cugguucguccgcgcg

SEQ ID NO: 1478570 - RNA, 18 nt, Pseudomonas aeruginosa PA01
cugguucguccgcgcgau

SEQ ID NO: 1478571 - RNA, 15 nt, Pseudomonas aeruginosa PA01
cuguacagcaggagc

SEQ ID NO: 1478572 - RNA, 17 nt, Pseudomonas aeruginosa PA01
cuguacagcaggagcgc

SEQ ID NO: 1478573 - RNA, 19 nt, Pseudomonas aeruginosa PA01
cuguacagcucaccccagg

SEQ ID NO: 1478574 - RNA, 15 nt, Pseudomonas aeruginosa PA01
cuguaccgcucccca

SEQ ID NO: 1478575 - RNA, 23 nt, Pseudomonas aeruginosa PA01
cuguaccgcuccccacucggcca

SEQ ID NO: 1478576 - RNA, 16 nt, Pseudomonas aeruginosa PA01
cuuccaucagcuccac

SEQ ID NO: 1478577 - RNA, 16 nt, Pseudomonas aeruginosa PA01
cuuccgucgucaccuc

SEQ ID NO: 1478578 - RNA, 16 nt, Pseudomonas aeruginosa PA01
cuuccuccaucgccuc

SEQ ID NO: 1478579 - RNA, 19 nt, Pseudomonas aeruginosa PA01
cuuccucgcccucauggcu

SEQ ID NO: 1478580 - RNA, 14 nt, Pseudomonas aeruginosa PA01
cuuccuccucgccg

SEQ ID NO: 1478581 - RNA, 14 nt, Pseudomonas aeruginosa PA01
cuuccugggcuucg

SEQ ID NO: 1478582 - RNA, 13 nt, Pseudomonas aeruginosa PA01
cuuccuggcgccg

SEQ ID NO: 1478583 - RNA, 20 nt, Pseudomonas aeruginosa PA01
cuuccugggaugccgggccg

SEQ ID NO: 1478584 - RNA, 12 nt, Pseudomonas aeruginosa PA01
cuuccuggccgg

SEQ ID NO: 1478585 - RNA, 15 nt, Pseudomonas aeruginosa PA01
cuuccucguggggcc

SEQ ID NO: 1478586 - RNA, 21 nt, Pseudomonas aeruginosa PA01
cuuccucggcgaccaccgcga

SEQ ID NO: 1478587 - RNA, 15 nt, Pseudomonas aeruginosa PA01
cuuccucggugucgg

SEQ ID NO: 1478588 - RNA, 20 nt, Pseudomonas aeruginosa PA01
cuuccucggugucggccaac

SEQ ID NO: 1478589 - RNA, 18 nt, Pseudomonas aeruginosa PA01
cuuccugcacgcugcgcc

SEQ ID NO: 1478590 - RNA, 18 nt, Pseudomonas aeruginosa PA01
cuuccugccagcgcgucg

SEQ ID NO: 1478591 - RNA, 20 nt, Pseudomonas aeruginosa PA01
cuucgcaaagcgagcgcccg

SEQ ID NO: 1478592 - RNA, 18 nt, Pseudomonas aeruginosa PA01
cuucgauugucuccagga

SEQ ID NO: 1478593 - RNA, 18 nt, Pseudomonas aeruginosa PA01
cuucgcaccagccggccg

SEQ ID NO: 1478594 - RNA, 20 nt, Pseudomonas aeruginosa PA01
cuucgcaccagccggccgcg

SEQ ID NO: 1478595 - RNA, 21 nt, Pseudomonas aeruginosa PA01
cuucgcaccagccggccgcgu

SEQ ID NO: 1478596 - RNA, 13 nt, Pseudomonas aeruginosa PA01
cuucgccgucgag

SEQ ID NO: 1478597 - RNA, 14 nt, Pseudomonas aeruginosa PA01
cuucgccgucgagc

SEQ ID NO: 1478598 - RNA, 20 nt, Pseudomonas aeruginosa PA01
cuucgccgucgagccagccc

SEQ ID NO: 1478599 - RNA, 21 nt, Pseudomonas aeruginosa PA01
cuucgccgucgagccagccca

SEQ ID NO: 1478600 - RNA, 16 nt, Pseudomonas aeruginosa PA01
cuucgcaacggccguu

SEQ ID NO: 1478601 - RNA, 12 nt, Pseudomonas aeruginosa PA01
cuucgccuggcg

SEQ ID NO: 1478602 - RNA, 14 nt, Pseudomonas aeruginosa PA01
cuucgccuggcgcg

SEQ ID NO: 1478603 - RNA, 18 nt, Pseudomonas aeruginosa PA01
cuucgccuggcgcgacga

SEQ ID NO: 1478604 - RNA, 14 nt, Pseudomonas aeruginosa PA01
cuucgaugcgccgc

SEQ ID NO: 1478605 - RNA, 20 nt, Pseudomonas aeruginosa PA01
cuuccugugcgaggcuggcc

SEQ ID NO: 1478606 - RNA, 16 nt, Pseudomonas aeruginosa PA01
cuuccuugaccacggc

SEQ ID NO: 1478607 - RNA, 19 nt, Pseudomonas aeruginosa PA01
cuuccuugaccacggcgag

SEQ ID NO: 1478608 - RNA, 20 nt, Pseudomonas aeruginosa PA01
cuucgaggcgggcgucggcg

SEQ ID NO: 1478609 - RNA, 20 nt, Pseudomonas aeruginosa PA01
cuucgaguagguccaggcgu

SEQ ID NO: 1478610 - RNA, 14 nt, Pseudomonas aeruginosa PA01
cuucggcggccggg

SEQ ID NO: 1478611 - RNA, 18 nt, Pseudomonas aeruginosa PA01
cuucggcggcgccgguga

SEQ ID NO: 1478612 - RNA, 15 nt, Pseudomonas aeruginosa PA01
cuucggcggcgcgcu

SEQ ID NO: 1478613 - RNA, 14 nt, Pseudomonas aeruginosa PA01
cuucggcggcuucg

SEQ ID NO: 1478614 - RNA, 16 nt, Pseudomonas aeruginosa PA01
cuucggcgguggggcc

SEQ ID NO: 1478615 - RNA, 13 nt, Pseudomonas aeruginosa PA01
cuucggcgcgccg

SEQ ID NO: 1478616 - RNA, 18 nt, Pseudomonas aeruginosa PA01
cuucggcgugcauggccg

SEQ ID NO: 1478617 - RNA, 17 nt, Pseudomonas aeruginosa PA01
cuucggcgcgccgguga

SEQ ID NO: 1478618 - RNA, 14 nt, Pseudomonas aeruginosa PA01
cuucggcgcgcggc

SEQ ID NO: 1478619 - RNA, 21 nt, Pseudomonas aeruginosa PA01
cuucggcgcgcggcagcacca

SEQ ID NO: 1478620 - RNA, 22 nt, Pseudomonas aeruginosa PA01
cuucggcgcgcggcagcaccag

SEQ ID NO: 1478621 - RNA, 14 nt, Pseudomonas aeruginosa PA01
cuucggcgcgcugg

SEQ ID NO: 1478622 - RNA, 14 nt, Pseudomonas aeruginosa PA01
cuucggcgcggugc

SEQ ID NO: 1478623 - RNA, 16 nt, Pseudomonas aeruginosa PA01
cuucggcgcggugccg

SEQ ID NO: 1478624 - RNA, 16 nt, Pseudomonas aeruginosa PA01
cuucggcaggaccucg

SEQ ID NO: 1478625 - RNA, 19 nt, Pseudomonas aeruginosa PA01
cuucggcaggaccucgggc

SEQ ID NO: 1478626 - RNA, 13 nt, Pseudomonas aeruginosa PA01
cuucggcaccccu

SEQ ID NO: 1478627 - RNA, 14 nt, Pseudomonas aeruginosa PA01
cuucggagcgaggc

SEQ ID NO: 1478628 - RNA, 18 nt, Pseudomonas aeruginosa PA01
cuucgccuucggcgugca

SEQ ID NO: 1478629 - RNA, 20 nt, Pseudomonas aeruginosa PA01
cuucgccuugcccuggccgg

SEQ ID NO: 1478630 - RNA, 22 nt, Pseudomonas aeruginosa PA01
cuucgcgcgggguggccgugca

SEQ ID NO: 1478631 - RNA, 17 nt, Pseudomonas aeruginosa PA01
cuucgcgcucgacgaug

SEQ ID NO: 1478632 - RNA, 23 nt, Pseudomonas aeruginosa PA01
cuucgcggaucucaggaccuucc

SEQ ID NO: 1478633 - RNA, 16 nt, Pseudomonas aeruginosa PA01
cuucgcggcggcgcgu

SEQ ID NO: 1478634 - RNA, 15 nt, Pseudomonas aeruginosa PA01
cuucgcgcagcucgg

SEQ ID NO: 1478635 - RNA, 12 nt, Pseudomonas aeruginosa PA01
cuucgcgcagga

SEQ ID NO: 1478636 - RNA, 14 nt, Pseudomonas aeruginosa PA01
cuucgcgugccaga

SEQ ID NO: 1478637 - RNA, 13 nt, Pseudomonas aeruginosa PA01
cuucgcgugggcc

SEQ ID NO: 1478638 - RNA, 16 nt, Pseudomonas aeruginosa PA01
cuucgcgugggccagg

SEQ ID NO: 1478639 - RNA, 18 nt, Pseudomonas aeruginosa PA01
cuucgcgugggccaggga

SEQ ID NO: 1478640 - RNA, 17 nt, Pseudomonas aeruginosa PA01
cuucgcgggugaccugg

SEQ ID NO: 1478641 - RNA, 21 nt, Pseudomonas aeruginosa PA01
cuucgcgggugaccuggccgc

SEQ ID NO: 1478642 - RNA, 20 nt, Pseudomonas aeruginosa PA01
cuucgcgggccaggccgagc

SEQ ID NO: 1478643 - RNA, 22 nt, Pseudomonas aeruginosa PA01
cuucgcugagaccgauccagca

SEQ ID NO: 1478644 - RNA, 20 nt, Pseudomonas aeruginosa PA01
cuucagauacuccagcagcg

SEQ ID NO: 1478645 - RNA, 14 nt, Pseudomonas aeruginosa PA01
cuucagcagcgggc

SEQ ID NO: 1478646 - RNA, 16 nt, Pseudomonas aeruginosa PA01
cuucagccagaccggc

SEQ ID NO: 1478647 - RNA, 17 nt, Pseudomonas aeruginosa PA01
cuucagccagaccggca

SEQ ID NO: 1478648 - RNA, 22 nt, Pseudomonas aeruginosa PA01
cuucagccagaccggcagcgcc

SEQ ID NO: 1478649 - RNA, 22 nt, Pseudomonas aeruginosa PA01
cuucagcacauagcugccgaau

SEQ ID NO: 1478650 - RNA, 18 nt, Pseudomonas aeruginosa PA01
cuucagcaccugcgccga

SEQ ID NO: 1478651 - RNA, 17 nt, Pseudomonas aeruginosa PA01
cuucagcacgcguccga

SEQ ID NO: 1478652 - RNA, 18 nt, Pseudomonas aeruginosa PA01
cuucagcacuucggcgcg

SEQ ID NO: 1478653 - RNA, 19 nt, Pseudomonas aeruginosa PA01
cuucagcagcaugucgccg

SEQ ID NO: 1478654 - RNA, 20 nt, Pseudomonas aeruginosa PA01
cuucagcagcaugucgccgg

SEQ ID NO: 1478655 - RNA, 22 nt, Pseudomonas aeruginosa PA01
cuucagccgaccguccgccugc

SEQ ID NO: 1478656 - RNA, 22 nt, Pseudomonas aeruginosa PA01
cuucagccccagcacgccgagc

SEQ ID NO: 1478657 - RNA, 23 nt, Pseudomonas aeruginosa PA01
cuucagccccagcacgccgagca

SEQ ID NO: 1478658 - RNA, 16 nt, Pseudomonas aeruginosa PA01
cuucagcgccagcagg

SEQ ID NO: 1478659 - RNA, 16 nt, Pseudomonas aeruginosa PA01
cuucagcgccaggccg

SEQ ID NO: 1478660 - RNA, 17 nt, Pseudomonas aeruginosa PA01
cuucagcgccaggccga

SEQ ID NO: 1478661 - RNA, 15 nt, Pseudomonas aeruginosa PA01
cuucagcgccgccag

SEQ ID NO: 1478662 - RNA, 13 nt, Pseudomonas aeruginosa PA01
cuucagcgccggg

SEQ ID NO: 1478663 - RNA, 16 nt, Pseudomonas aeruginosa PA01
cuucagcgccuccagc

SEQ ID NO: 1478664 - RNA, 15 nt, Pseudomonas aeruginosa PA01
cuucacgacaggcgg

SEQ ID NO: 1478665 - RNA, 15 nt, Pseudomonas aeruginosa PA01
cuucaccggcggaug

SEQ ID NO: 1478666 - RNA, 14 nt, Pseudomonas aeruginosa PA01
cuucaccgcgccgc

SEQ ID NO: 1478667 - RNA, 19 nt, Pseudomonas aeruginosa PA01
cuucaccguucccagcagc

SEQ ID NO: 1478668 - RNA, 21 nt, Pseudomonas aeruginosa PA01
cuucagggugacgucgaaacc

SEQ ID NO: 1478669 - RNA, 22 nt, Pseudomonas aeruginosa PA01
cuucagguagcucaucggcgac

SEQ ID NO: 1478670 - RNA, 19 nt, Pseudomonas aeruginosa PA01
cuucaguucguugggccgg

SEQ ID NO: 1478671 - RNA, 12 nt, Pseudomonas aeruginosa PA01
cuucaucaccuu

SEQ ID NO: 1478672 - RNA, 12 nt, Pseudomonas aeruginosa PA01
cuucaggccgaa

SEQ ID NO: 1478673 - RNA, 20 nt, Pseudomonas aeruginosa PA01
cuucaggccgaguccgcgcg

SEQ ID NO: 1478674 - RNA, 13 nt, Pseudomonas aeruginosa PA01
cuucaggccggcg

SEQ ID NO: 1478675 - RNA, 14 nt, Pseudomonas aeruginosa PA01
cuucaggccggcgc

SEQ ID NO: 1478676 - RNA, 15 nt, Pseudomonas aeruginosa PA01
cuucaggccggcgcc

SEQ ID NO: 1478677 - RNA, 18 nt, Pseudomonas aeruginosa PA01
cuucaggccggcgccgau

SEQ ID NO: 1478678 - RNA, 19 nt, Pseudomonas aeruginosa PA01
cuucaggcgcgcggccagc

SEQ ID NO: 1478679 - RNA, 20 nt, Pseudomonas aeruginosa PA01
cuucaggcgcgcggccagcg

SEQ ID NO: 1478680 - RNA, 12 nt, Pseudomonas aeruginosa PA01
cuucaggcgugg

SEQ ID NO: 1478681 - RNA, 17 nt, Pseudomonas aeruginosa PA01
cuucaggcgugggccag

SEQ ID NO: 1478682 - RNA, 14 nt, Pseudomonas aeruginosa PA01
cuucaggcucggcc

SEQ ID NO: 1478683 - RNA, 17 nt, Pseudomonas aeruginosa PA01
cuucaggcugcgcgcau

SEQ ID NO: 1478684 - RNA, 18 nt, Pseudomonas aeruginosa PA01
cuucagcucgaggccagg

SEQ ID NO: 1478685 - RNA, 20 nt, Pseudomonas aeruginosa PA01
cuucaucuccugcuggacga

SEQ ID NO: 1478686 - RNA, 23 nt, Pseudomonas aeruginosa PA01
cuucaugaacacauagaccagca

SEQ ID NO: 1478687 - RNA, 15 nt, Pseudomonas aeruginosa PA01
cuucaucggcccggc

SEQ ID NO: 1478688 - RNA, 15 nt, Pseudomonas aeruginosa PA01
cuucauccugcgcgc

SEQ ID NO: 1478689 - RNA, 15 nt, Pseudomonas aeruginosa PA01
cuucaucaggcggca

SEQ ID NO: 1478690 - RNA, 11 nt, Pseudomonas aeruginosa PA01
cuuccaggcgc

SEQ ID NO: 1478691 - RNA, 14 nt, Pseudomonas aeruginosa PA01
cuuccagcuugcgc

SEQ ID NO: 1478692 - RNA, 18 nt, Pseudomonas aeruginosa PA01
cuuccagcuugcgccaga

SEQ ID NO: 1478693 - RNA, 21 nt, Pseudomonas aeruginosa PA01
cuuccaggcuguagccggcga

SEQ ID NO: 1478694 - RNA, 15 nt, Pseudomonas aeruginosa PA01
cuuccagggcggcgc

SEQ ID NO: 1478695 - RNA, 16 nt, Pseudomonas aeruginosa PA01
cuuccagggcggcgcg

SEQ ID NO: 1478696 - RNA, 16 nt, Pseudomonas aeruginosa PA01
cuuccagcucucgcug

SEQ ID NO: 1478697 - RNA, 15 nt, Pseudomonas aeruginosa PA01
cuuccagcggccacg

SEQ ID NO: 1478698 - RNA, 22 nt, Pseudomonas aeruginosa PA01
cuuccagcgggcggaucagcuc

SEQ ID NO: 1478699 - RNA, 13 nt, Pseudomonas aeruginosa PA01
cuuccaucaccgc

SEQ ID NO: 1478700 - RNA, 14 nt, Pseudomonas aeruginosa PA01
cuuccaucaccgcg

SEQ ID NO: 1478701 - RNA, 15 nt, Pseudomonas aeruginosa PA01
cuuccaucaccgcgu

SEQ ID NO: 1478702 - RNA, 16 nt, Pseudomonas aeruginosa PA01
cuuccaguuggccggg

SEQ ID NO: 1478703 - RNA, 16 nt, Pseudomonas aeruginosa PA01
cuuccaggcgcaggcg

SEQ ID NO: 1478704 - RNA, 14 nt, Pseudomonas aeruginosa PA01
cuggccaccagcac

SEQ ID NO: 1478705 - RNA, 15 nt, Pseudomonas aeruginosa PA01
cuggccaccgccagg

SEQ ID NO: 1478706 - RNA, 16 nt, Pseudomonas aeruginosa PA01
cuggccaccgccagga

SEQ ID NO: 1478707 - RNA, 17 nt, Pseudomonas aeruginosa PA01
cuggccaccgccaggac

SEQ ID NO: 1478708 - RNA, 13 nt, Pseudomonas aeruginosa PA01
cuggccaccgcgg

SEQ ID NO: 1478709 - RNA, 14 nt, Pseudomonas aeruginosa PA01
cuggccaccgcggc

SEQ ID NO: 1478710 - RNA, 22 nt, Pseudomonas aeruginosa PA01
cuggccaccgggaucagcggcg

SEQ ID NO: 1478711 - RNA, 17 nt, Pseudomonas aeruginosa PA01
cuggccagaaggucggg

SEQ ID NO: 1478712 - RNA, 20 nt, Pseudomonas aeruginosa PA01
cuggccagaauuccagcagg

SEQ ID NO: 1478713 - RNA, 22 nt, Pseudomonas aeruginosa PA01
cuggccacccuugcgcccggcu

SEQ ID NO: 1478714 - RNA, 21 nt, Pseudomonas aeruginosa PA01
cuggccacccuuguggccgau

SEQ ID NO: 1478715 - RNA, 17 nt, Pseudomonas aeruginosa PA01
cuggccacguccagcgg

SEQ ID NO: 1478716 - RNA, 19 nt, Pseudomonas aeruginosa PA01
cuggccacguccagcggca

SEQ ID NO: 1478717 - RNA, 20 nt, Pseudomonas aeruginosa PA01
cuggccacguccagcggcau

SEQ ID NO: 1478718 - RNA, 12 nt, Pseudomonas aeruginosa PA01
cuggcaggucgu

SEQ ID NO: 1478719 - RNA, 17 nt, Pseudomonas aeruginosa PA01
cuggcaggcucaccgcg

SEQ ID NO: 1478720 - RNA, 20 nt, Pseudomonas aeruginosa PA01
cuggcaggcucaccgcguaa

SEQ ID NO: 1478721 - RNA, 19 nt, Pseudomonas aeruginosa PA01
cuggcagggcgcguccagc

SEQ ID NO: 1478722 - RNA, 19 nt, Pseudomonas aeruginosa PA01
cuggaugcagccgauggcg

SEQ ID NO: 1478723 - RNA, 21 nt, Pseudomonas aeruginosa PA01
cuggaugcagccgauggcgaa

SEQ ID NO: 1478724 - RNA, 14 nt, Pseudomonas aeruginosa PA01
cuggaugcagccgg

SEQ ID NO: 1478725 - RNA, 17 nt, Pseudomonas aeruginosa PA01
cuggaugcagccggggc

SEQ ID NO: 1478726 - RNA, 18 nt, Pseudomonas aeruginosa PA01
cuggaugaaacgggcgau

SEQ ID NO: 1478727 - RNA, 19 nt, Pseudomonas aeruginosa PA01
cuggaucucggcggccagg

SEQ ID NO: 1478728 - RNA, 23 nt, Pseudomonas aeruginosa PA01
cuggaucucggcggccaggcggc

SEQ ID NO: 1478729 - RNA, 19 nt, Pseudomonas aeruginosa PA01
cuggaucgaucucgucggc

SEQ ID NO: 1478730 - RNA, 21 nt, Pseudomonas aeruginosa PA01
cuggaucgaucucgucggcgg

SEQ ID NO: 1478731 - RNA, 14 nt, Pseudomonas aeruginosa PA01
cuggaucgccaggc

SEQ ID NO: 1478732 - RNA, 17 nt, Pseudomonas aeruginosa PA01
cuggaucgccuugcgcg

SEQ ID NO: 1478733 - RNA, 13 nt, Pseudomonas aeruginosa PA01
cuggaucggcagc

SEQ ID NO: 1478734 - RNA, 14 nt, Pseudomonas aeruginosa PA01
cuggaucggcaggc

SEQ ID NO: 1478735 - RNA, 19 nt, Pseudomonas aeruginosa PA01
cuggaucggcaggcuggcg

SEQ ID NO: 1478736 - RNA, 16 nt, Pseudomonas aeruginosa PA01
cuggaugcuccgcgcc

SEQ ID NO: 1478737 - RNA, 18 nt, Pseudomonas aeruginosa PA01
cuggaugcuccgcgccuc

SEQ ID NO: 1478738 - RNA, 18 nt, Pseudomonas aeruginosa PA01
cuggauggucacgccgag

SEQ ID NO: 1478739 - RNA, 18 nt, Pseudomonas aeruginosa PA01
cuggacggcggacugcuc

SEQ ID NO: 1478740 - RNA, 22 nt, Pseudomonas aeruginosa PA01
cuggacggcggacugcucgccg

SEQ ID NO: 1478741 - RNA, 23 nt, Pseudomonas aeruginosa PA01
cuggacggcggacugcucgccgc

SEQ ID NO: 1478742 - RNA, 17 nt, Pseudomonas aeruginosa PA01
cuggagaaacucgcggg

SEQ ID NO: 1478743 - RNA, 18 nt, Pseudomonas aeruginosa PA01
cuggagaaacucgcgggc

SEQ ID NO: 1478744 - RNA, 16 nt, Pseudomonas aeruginosa PA01
cuggagaaauccggcu

SEQ ID NO: 1478745 - RNA, 20 nt, Pseudomonas aeruginosa PA01
cuggagaaauccggcuggcg

SEQ ID NO: 1478746 - RNA, 22 nt, Pseudomonas aeruginosa PA01
cuggagaaauccggcuggcgcc

SEQ ID NO: 1478747 - RNA, 15 nt, Pseudomonas aeruginosa PA01
cugcgagcaccaugc

SEQ ID NO: 1478748 - RNA, 18 nt, Pseudomonas aeruginosa PA01
cugcgagcaccaugccga

SEQ ID NO: 1478749 - RNA, 14 nt, Pseudomonas aeruginosa PA01
cugcgagcaggucc

SEQ ID NO: 1478750 - RNA, 22 nt, Pseudomonas aeruginosa PA01
cugcgagcgcuucauccugcgc

SEQ ID NO: 1478751 - RNA, 17 nt, Pseudomonas aeruginosa PA01
cugcgagacgggcgacg

SEQ ID NO: 1478752 - RNA, 13 nt, Pseudomonas aeruginosa PA01
cugcgaggcggug

SEQ ID NO: 1478753 - RNA, 20 nt, Pseudomonas aeruginosa PA01
cugcgaguaguagcguuccu

SEQ ID NO: 1478754 - RNA, 16 nt, Pseudomonas aeruginosa PA01
cuggacgaaccgauca

SEQ ID NO: 1478755 - RNA, 16 nt, Pseudomonas aeruginosa PA01
cuggacgacgcuggcc

SEQ ID NO: 1478756 - RNA, 18 nt, Pseudomonas aeruginosa PA01
cuggacgacgcuggccug

SEQ ID NO: 1478757 - RNA, 20 nt, Pseudomonas aeruginosa PA01
cuggaguaucgcccuggccu

SEQ ID NO: 1478758 - RNA, 14 nt, Pseudomonas aeruginosa PA01
cuggagcugcgcgc

SEQ ID NO: 1478759 - RNA, 18 nt, Pseudomonas aeruginosa PA01
cuggagcagaaccgccag

SEQ ID NO: 1478760 - RNA, 20 nt, Pseudomonas aeruginosa PA01
cuggagcagaaccgccagca

SEQ ID NO: 1478761 - RNA, 15 nt, Pseudomonas aeruginosa PA01
cuggagcagcagcgc

SEQ ID NO: 1478762 - RNA, 17 nt, Pseudomonas aeruginosa PA01
cuggagcagcagcgccg

SEQ ID NO: 1478763 - RNA, 19 nt, Pseudomonas aeruginosa PA01
cuggagcagcagcgccgcg

SEQ ID NO: 1478764 - RNA, 15 nt, Pseudomonas aeruginosa PA01
cuggagcagggcgau

SEQ ID NO: 1478765 - RNA, 17 nt, Pseudomonas aeruginosa PA01
cuggaucagcgccucga

SEQ ID NO: 1478766 - RNA, 21 nt, Pseudomonas aeruginosa PA01
cuggauccucgccucgcgcca

SEQ ID NO: 1478767 - RNA, 16 nt, Pseudomonas aeruginosa PA01
cuggaucaccgcggcg

SEQ ID NO: 1478768 - RNA, 16 nt, Pseudomonas aeruginosa PA01
cuggaguugugccagc

SEQ ID NO: 1478769 - RNA, 20 nt, Pseudomonas aeruginosa PA01
cuggauacgcuuggccaggu

SEQ ID NO: 1478770 - RNA, 12 nt, Pseudomonas aeruginosa PA01
cuggcgccgaug

SEQ ID NO: 1478771 - RNA, 13 nt, Pseudomonas aeruginosa PA01
cuggcgccgaugc

SEQ ID NO: 1478772 - RNA, 15 nt, Pseudomonas aeruginosa PA01
cuggcgccgcuggcg

SEQ ID NO: 1478773 - RNA, 18 nt, Pseudomonas aeruginosa PA01
cuggcgccgcuggcgugg

SEQ ID NO: 1478774 - RNA, 14 nt, Pseudomonas aeruginosa PA01
cuggcgccggugca

SEQ ID NO: 1478775 - RNA, 20 nt, Pseudomonas aeruginosa PA01
cuggcgcgagaagccagcca

SEQ ID NO: 1478776 - RNA, 16 nt, Pseudomonas aeruginosa PA01
cuggcgcgauccgcgc

SEQ ID NO: 1478777 - RNA, 17 nt, Pseudomonas aeruginosa PA01
cuggcgcgauccgcgcg

SEQ ID NO: 1478778 - RNA, 19 nt, Pseudomonas aeruginosa PA01
cuggcgcgauccgcgcggc

SEQ ID NO: 1478779 - RNA, 20 nt, Pseudomonas aeruginosa PA01
cuggcgcgauccgcgcggca

SEQ ID NO: 1478780 - RNA, 20 nt, Pseudomonas aeruginosa PA01
cuggcgcgaucggggcagaa

SEQ ID NO: 1478781 - RNA, 12 nt, Pseudomonas aeruginosa PA01
cuggcgccuggc

SEQ ID NO: 1478782 - RNA, 14 nt, Pseudomonas aeruginosa PA01
cuggcgccuggccu

SEQ ID NO: 1478783 - RNA, 16 nt, Pseudomonas aeruginosa PA01
cuggcgccuggccugg

SEQ ID NO: 1478784 - RNA, 20 nt, Pseudomonas aeruginosa PA01
cuggcgccuggccuggaacu

SEQ ID NO: 1478785 - RNA, 14 nt, Pseudomonas aeruginosa PA01
cuggcgccaggccg

SEQ ID NO: 1478786 - RNA, 22 nt, Pseudomonas aeruginosa PA01
cuggcgcauccgcccgaucgcc

SEQ ID NO: 1478787 - RNA, 17 nt, Pseudomonas aeruginosa PA01
cuggcgcauggcgcucu

SEQ ID NO: 1478788 - RNA, 14 nt, Pseudomonas aeruginosa PA01
cuggcgcagcagca

SEQ ID NO: 1478789 - RNA, 16 nt, Pseudomonas aeruginosa PA01
cuggcgcagcagcagg

SEQ ID NO: 1478790 - RNA, 17 nt, Pseudomonas aeruginosa PA01
cuggcgcagccaggcga

SEQ ID NO: 1478791 - RNA, 18 nt, Pseudomonas aeruginosa PA01
cuggcgcagccaggcgau

SEQ ID NO: 1478792 - RNA, 20 nt, Pseudomonas aeruginosa PA01
cuggcgcagccaggcgaugg

SEQ ID NO: 1478793 - RNA, 15 nt, Pseudomonas aeruginosa PA01
cuggcgcagccguuc

SEQ ID NO: 1478794 - RNA, 14 nt, Pseudomonas aeruginosa PA01
cuggcgcagcggca

SEQ ID NO: 1478795 - RNA, 15 nt, Pseudomonas aeruginosa PA01
cuggcgcagcggcag

SEQ ID NO: 1478796 - RNA, 17 nt, Pseudomonas aeruginosa PA01
cuggcgcagcggcagcg

SEQ ID NO: 1478797 - RNA, 20 nt, Pseudomonas aeruginosa PA01
cuggcgcagcggcagcgcca

SEQ ID NO: 1478798 - RNA, 18 nt, Pseudomonas aeruginosa PA01
cuggcgaucucggcgcgg

SEQ ID NO: 1478799 - RNA, 19 nt, Pseudomonas aeruginosa PA01
cuggcgaucucggcgcggg

SEQ ID NO: 1478800 - RNA, 21 nt, Pseudomonas aeruginosa PA01
cuggcgaucucggcgcgggca

SEQ ID NO: 1478801 - RNA, 16 nt, Pseudomonas aeruginosa PA01
cuggcgaugcccuggc

SEQ ID NO: 1478802 - RNA, 21 nt, Pseudomonas aeruginosa PA01
cuggcgaugcccuggccgcug

SEQ ID NO: 1478803 - RNA, 16 nt, Pseudomonas aeruginosa PA01
cuggcgaucaccaggg

SEQ ID NO: 1478804 - RNA, 16 nt, Pseudomonas aeruginosa PA01
cuggcgagaauggcga

SEQ ID NO: 1478805 - RNA, 23 nt, Pseudomonas aeruginosa PA01
cuggcgacgucccuuccccgauc

SEQ ID NO: 1478806 - RNA, 22 nt, Pseudomonas aeruginosa PA01
cuggcgaguggcgaagccagca

SEQ ID NO: 1478807 - RNA, 15 nt, Pseudomonas aeruginosa PA01
cuggcgagcgucgag

SEQ ID NO: 1478808 - RNA, 23 nt, Pseudomonas aeruginosa PA01
cuggcgaggaacacccagaagcc

SEQ ID NO: 1478809 - RNA, 16 nt, Pseudomonas aeruginosa PA01
cuggcgaggacgccgg

SEQ ID NO: 1478810 - RNA, 20 nt, Pseudomonas aeruginosa PA01
cuggcgaggacgccgggcug

SEQ ID NO: 1478811 - RNA, 16 nt, Pseudomonas aeruginosa PA01
cuggcgaggcugcgau

SEQ ID NO: 1478812 - RNA, 21 nt, Pseudomonas aeruginosa PA01
cuggcgcacggccugcaccug

SEQ ID NO: 1478813 - RNA, 20 nt, Pseudomonas aeruginosa PA01
cuggcgcacacggucgagac

SEQ ID NO: 1478814 - RNA, 18 nt, Pseudomonas aeruginosa PA01
cuggcgcaauacaccgcu

SEQ ID NO: 1478815 - RNA, 14 nt, Pseudomonas aeruginosa PA01
cuggcgcagacagg

SEQ ID NO: 1478816 - RNA, 13 nt, Pseudomonas aeruginosa PA01
cuggcgcagcagc

SEQ ID NO: 1478817 - RNA, 22 nt, Pseudomonas aeruginosa PA01
cuggccuuguacagggcgcgga

SEQ ID NO: 1478818 - RNA, 11 nt, Pseudomonas aeruginosa PA01
cuggcgaccgg

SEQ ID NO: 1478819 - RNA, 21 nt, Pseudomonas aeruginosa PA01
cuggcgaauuuccugcuggcg

SEQ ID NO: 1478820 - RNA, 23 nt, Pseudomonas aeruginosa PA01
cuggcgaauuuccugcuggcgag

SEQ ID NO: 1478821 - RNA, 23 nt, Pseudomonas aeruginosa PA01
cuggcgaauauccucgucgaucc

SEQ ID NO: 1478822 - RNA, 15 nt, Pseudomonas aeruginosa PA01
cuggcgaaugccuuc

SEQ ID NO: 1478823 - RNA, 16 nt, Pseudomonas aeruginosa PA01
cuggcgaaugccuucg

SEQ ID NO: 1478824 - RNA, 18 nt, Pseudomonas aeruginosa PA01
cuggccuuggccacgacc

SEQ ID NO: 1478825 - RNA, 14 nt, Pseudomonas aeruginosa PA01
cuggccuuggccau

SEQ ID NO: 1478826 - RNA, 16 nt, Pseudomonas aeruginosa PA01
cuggccuuggccaugc

SEQ ID NO: 1478827 - RNA, 23 nt, Pseudomonas aeruginosa PA01
cuggcgaacgaugguggucggca

SEQ ID NO: 1478828 - RNA, 12 nt, Pseudomonas aeruginosa PA01
cuggccugccga

SEQ ID NO: 1478829 - RNA, 15 nt, Pseudomonas aeruginosa PA01
cuggccugccgaugg

SEQ ID NO: 1478830 - RNA, 20 nt, Pseudomonas aeruginosa PA01
cuggccugggguagccggcc

SEQ ID NO: 1478831 - RNA, 22 nt, Pseudomonas aeruginosa PA01
cuggccugggguagccggccga

SEQ ID NO: 1478832 - RNA, 14 nt, Pseudomonas aeruginosa PA01
cuggccuggccacc

SEQ ID NO: 1478833 - RNA, 24 nt, Pseudomonas aeruginosa PA01
cuggccgaaauugaccagguacgg

SEQ ID NO: 1478834 - RNA, 16 nt, Pseudomonas aeruginosa PA01
cuggccugcagguccg

SEQ ID NO: 1478835 - RNA, 18 nt, Pseudomonas aeruginosa PA01
cuggccuggaacuggucg

SEQ ID NO: 1478836 - RNA, 19 nt, Pseudomonas aeruginosa PA01
cuggccuggaacuggucgg

SEQ ID NO: 1478837 - RNA, 21 nt, Pseudomonas aeruginosa PA01
cuggccuggaacuggucgggg

SEQ ID NO: 1478838 - RNA, 12 nt, Pseudomonas aeruginosa PA01
cuggccuggcca

SEQ ID NO: 1478839 - RNA, 17 nt, Pseudomonas aeruginosa PA01
cuggccgacccgcagcg

SEQ ID NO: 1478840 - RNA, 20 nt, Pseudomonas aeruginosa PA01
cuggccgacccgcagcggcg

SEQ ID NO: 1478841 - RNA, 21 nt, Pseudomonas aeruginosa PA01
cuggccgacccgcagcggcgc

SEQ ID NO: 1478842 - RNA, 22 nt, Pseudomonas aeruginosa PA01
cuggccgacccgcagcggcgcu

SEQ ID NO: 1478843 - RNA, 20 nt, Pseudomonas aeruginosa PA01
cuggccagcaccagucccug

SEQ ID NO: 1478844 - RNA, 12 nt, Pseudomonas aeruginosa PA01
cuggccagcagg

SEQ ID NO: 1478845 - RNA, 13 nt, Pseudomonas aeruginosa PA01
cuggccagcaggc

SEQ ID NO: 1478846 - RNA, 15 nt, Pseudomonas aeruginosa PA01
cuggccagcaggcug

SEQ ID NO: 1478847 - RNA, 19 nt, Pseudomonas aeruginosa PA01
cuggccagcaggcuggcgg

SEQ ID NO: 1478848 - RNA, 24 nt, Pseudomonas aeruginosa PA01
cuggccagcgcuuccaccgccugc

SEQ ID NO: 1478849 - RNA, 20 nt, Pseudomonas aeruginosa PA01
cuggccagcccugguaggug

SEQ ID NO: 1478850 - RNA, 19 nt, Pseudomonas aeruginosa PA01
cuggccgaauaggcgaucu

SEQ ID NO: 1478851 - RNA, 20 nt, Pseudomonas aeruginosa PA01
cuggccgaccaguaccaggc

SEQ ID NO: 1478852 - RNA, 16 nt, Pseudomonas aeruginosa PA01
cuggcccuccauccag

SEQ ID NO: 1478853 - RNA, 17 nt, Pseudomonas aeruginosa PA01
cuggcccucucucgccu

SEQ ID NO: 1478854 - RNA, 18 nt, Pseudomonas aeruginosa PA01
cuggcccugcaucgcgac

SEQ ID NO: 1478855 - RNA, 15 nt, Pseudomonas aeruginosa PA01
cuggcccuggcgcag

SEQ ID NO: 1478856 - RNA, 19 nt, Pseudomonas aeruginosa PA01
cuggcccuggcgcaggcgg

SEQ ID NO: 1478857 - RNA, 22 nt, Pseudomonas aeruginosa PA01
cuggcccuggcgcaggcggcgc

SEQ ID NO: 1478858 - RNA, 18 nt, Pseudomonas aeruginosa PA01
cugggcauggcuggcgcu

SEQ ID NO: 1478859 - RNA, 14 nt, Pseudomonas aeruginosa PA01
cugggccaccuggc

SEQ ID NO: 1478860 - RNA, 16 nt, Pseudomonas aeruginosa PA01
cugggccaucgccggc

SEQ ID NO: 1478861 - RNA, 19 nt, Pseudomonas aeruginosa PA01
cugggccaucgccggcccg

SEQ ID NO: 1478862 - RNA, 16 nt, Pseudomonas aeruginosa PA01
cugggccaugaccucg

SEQ ID NO: 1478863 - RNA, 22 nt, Pseudomonas aeruginosa PA01
cugggccaugaccucggccagc

SEQ ID NO: 1478864 - RNA, 14 nt, Pseudomonas aeruginosa PA01
cugggccgaaggcc

SEQ ID NO: 1478865 - RNA, 18 nt, Pseudomonas aeruginosa PA01
cugggccgaaggccaggc

SEQ ID NO: 1478866 - RNA, 13 nt, Pseudomonas aeruginosa PA01
cugggccccggcc

SEQ ID NO: 1478867 - RNA, 14 nt, Pseudomonas aeruginosa PA01
cugggccccggcca

SEQ ID NO: 1478868 - RNA, 17 nt, Pseudomonas aeruginosa PA01
cugggccccggccggca

SEQ ID NO: 1478869 - RNA, 20 nt, Pseudomonas aeruginosa PA01
cugggccccggccggcagga

SEQ ID NO: 1478870 - RNA, 17 nt, Pseudomonas aeruginosa PA01
cugggcgugcuuggcga

SEQ ID NO: 1478871 - RNA, 16 nt, Pseudomonas aeruginosa PA01
cugggcugcgggguga

SEQ ID NO: 1478872 - RNA, 21 nt, Pseudomonas aeruginosa PA01
cugggcguacaggccccaggc

SEQ ID NO: 1478873 - RNA, 19 nt, Pseudomonas aeruginosa PA01
cugggcgucgaacaccggc

SEQ ID NO: 1478874 - RNA, 19 nt, Pseudomonas aeruginosa PA01
cugggcguggcggccgccg

SEQ ID NO: 1478875 - RNA, 21 nt, Pseudomonas aeruginosa PA01
cugggcguggcggccgccggc

SEQ ID NO: 1478876 - RNA, 16 nt, Pseudomonas aeruginosa PA01
cugggcguuggccagc

SEQ ID NO: 1478877 - RNA, 19 nt, Pseudomonas aeruginosa PA01
cugggcguuggccagcgcc

SEQ ID NO: 1478878 - RNA, 20 nt, Pseudomonas aeruginosa PA01
cugggcguuggccagcgcca

SEQ ID NO: 1478879 - RNA, 21 nt, Pseudomonas aeruginosa PA01
cugggcguuggccagcgccac

SEQ ID NO: 1478880 - RNA, 23 nt, Pseudomonas aeruginosa PA01
cugggcguuggccagcgccacca

SEQ ID NO: 1478881 - RNA, 23 nt, Pseudomonas aeruginosa PA01
cugggcuacaucgucugcgcggc

SEQ ID NO: 1478882 - RNA, 15 nt, Pseudomonas aeruginosa PA01
cuggggaacugggcg

SEQ ID NO: 1478883 - RNA, 18 nt, Pseudomonas aeruginosa PA01
cuggggauggccggcgcg

SEQ ID NO: 1478884 - RNA, 13 nt, Pseudomonas aeruginosa PA01
cugggugcggugg

SEQ ID NO: 1478885 - RNA, 17 nt, Pseudomonas aeruginosa PA01
cugggugcggugggcga

SEQ ID NO: 1478886 - RNA, 13 nt, Pseudomonas aeruginosa PA01
cugggugaccagc

SEQ ID NO: 1478887 - RNA, 14 nt, Pseudomonas aeruginosa PA01
cugggugaccagca

SEQ ID NO: 1478888 - RNA, 16 nt, Pseudomonas aeruginosa PA01
cugggugaccagcagg

SEQ ID NO: 1478889 - RNA, 17 nt, Pseudomonas aeruginosa PA01
cuggguggaggcccaga

SEQ ID NO: 1478890 - RNA, 17 nt, Pseudomonas aeruginosa PA01
cuggggcaugggcgcgg

SEQ ID NO: 1478891 - RNA, 14 nt, Pseudomonas aeruginosa PA01
cugggugcuuuccu

SEQ ID NO: 1478892 - RNA, 16 nt, Pseudomonas aeruginosa PA01
cuggguggucugcacg

SEQ ID NO: 1478893 - RNA, 17 nt, Pseudomonas aeruginosa PA01
cugggugucgaccuccg

SEQ ID NO: 1478894 - RNA, 21 nt, Pseudomonas aeruginosa PA01
cugggugucgaccuccgccgc

SEQ ID NO: 1478895 - RNA, 23 nt, Pseudomonas aeruginosa PA01
cuggguguugucggucagguacg

SEQ ID NO: 1478896 - RNA, 15 nt, Pseudomonas aeruginosa PA01
cuggguuggcgcgag

SEQ ID NO: 1478897 - RNA, 15 nt, Pseudomonas aeruginosa PA01
cuggguugccaggua

SEQ ID NO: 1478898 - RNA, 19 nt, Pseudomonas aeruginosa PA01
cuggguugccgcgccgaug

SEQ ID NO: 1478899 - RNA, 17 nt, Pseudomonas aeruginosa PA01
cuggcgguagcccggca

SEQ ID NO: 1478900 - RNA, 17 nt, Pseudomonas aeruginosa PA01
cuggcgggugaucuuga

SEQ ID NO: 1478901 - RNA, 14 nt, Pseudomonas aeruginosa PA01
cuggcggucgccgc

SEQ ID NO: 1478902 - RNA, 15 nt, Pseudomonas aeruginosa PA01
cuggcggucgccgcc

SEQ ID NO: 1478903 - RNA, 18 nt, Pseudomonas aeruginosa PA01
cuggcggucgccgccggc

SEQ ID NO: 1478904 - RNA, 19 nt, Pseudomonas aeruginosa PA01
cuggcggucgccgccggcg

SEQ ID NO: 1478905 - RNA, 22 nt, Pseudomonas aeruginosa PA01
cuggcgguugaugccgacgucg

SEQ ID NO: 1478906 - RNA, 16 nt, Pseudomonas aeruginosa PA01
cuggcgcgccuccugc

SEQ ID NO: 1478907 - RNA, 20 nt, Pseudomonas aeruginosa PA01
cuggcggcugagcuguuuca

SEQ ID NO: 1478908 - RNA, 18 nt, Pseudomonas aeruginosa PA01
cuggcggggucgcgccgg

SEQ ID NO: 1478909 - RNA, 23 nt, Pseudomonas aeruginosa PA01
cuggcggggucgcgccgguggcg

SEQ ID NO: 1478910 - RNA, 14 nt, Pseudomonas aeruginosa PA01
cuggcggcucggcu

SEQ ID NO: 1478911 - RNA, 17 nt, Pseudomonas aeruginosa PA01
cuggcgcgcugcggcag

SEQ ID NO: 1478912 - RNA, 20 nt, Pseudomonas aeruginosa PA01
cugggaauggcgaugccgag

SEQ ID NO: 1478913 - RNA, 14 nt, Pseudomonas aeruginosa PA01
cugggcagcgccgc

SEQ ID NO: 1478914 - RNA, 15 nt, Pseudomonas aeruginosa PA01
cugggcagcgccgcc

SEQ ID NO: 1478915 - RNA, 21 nt, Pseudomonas aeruginosa PA01
cugggcagcacgcuggcgucg

SEQ ID NO: 1478916 - RNA, 20 nt, Pseudomonas aeruginosa PA01
cugggcaccaguggcgccgc

SEQ ID NO: 1478917 - RNA, 21 nt, Pseudomonas aeruginosa PA01
cugggcaccaguggcgccgcc

SEQ ID NO: 1478918 - RNA, 23 nt, Pseudomonas aeruginosa PA01
cuggcuuuccagggccuggcgca

SEQ ID NO: 1478919 - RNA, 19 nt, Pseudomonas aeruginosa PA01
cugggaacccuugcgcagg

SEQ ID NO: 1478920 - RNA, 16 nt, Pseudomonas aeruginosa PA01
cuggucguucucgcgc

SEQ ID NO: 1478921 - RNA, 15 nt, Pseudomonas aeruginosa PA01
cuggucguugcgcgc

SEQ ID NO: 1478922 - RNA, 16 nt, Pseudomonas aeruginosa PA01
cuggucguugcgcgca

SEQ ID NO: 1478923 - RNA, 17 nt, Pseudomonas aeruginosa PA01
cuggucguugcgcgcau

SEQ ID NO: 1478924 - RNA, 15 nt, Pseudomonas aeruginosa PA01
cuggucggcuuccgc

SEQ ID NO: 1478925 - RNA, 18 nt, Pseudomonas aeruginosa PA01
cuggucggggccggcgau

SEQ ID NO: 1478926 - RNA, 14 nt, Pseudomonas aeruginosa PA01
cuggucggggcgca

SEQ ID NO: 1478927 - RNA, 16 nt, Pseudomonas aeruginosa PA01
cuggucguaggcgcgg

SEQ ID NO: 1478928 - RNA, 18 nt, Pseudomonas aeruginosa PA01
cuggucguaggcgcgggc

SEQ ID NO: 1478929 - RNA, 21 nt, Pseudomonas aeruginosa PA01
cuggucggcggucucgaacgc

SEQ ID NO: 1478930 - RNA, 14 nt, Pseudomonas aeruginosa PA01
cuggucggcgcggc

SEQ ID NO: 1478931 - RNA, 15 nt, Pseudomonas aeruginosa PA01
cuggucggcgcggcg

SEQ ID NO: 1478932 - RNA, 23 nt, Pseudomonas aeruginosa PA01
cuggucggcgcggcgcuccaggc

SEQ ID NO: 1478933 - RNA, 23 nt, Pseudomonas aeruginosa PA01
cugguagaacuccuugccguggc

SEQ ID NO: 1478934 - RNA, 19 nt, Pseudomonas aeruginosa PA01
cuggucgcguuccagcucc

SEQ ID NO: 1478935 - RNA, 16 nt, Pseudomonas aeruginosa PA01
cuggucgcuccagccc

SEQ ID NO: 1478936 - RNA, 17 nt, Pseudomonas aeruginosa PA01
cuggucgcggcugcgcg

SEQ ID NO: 1478937 - RNA, 20 nt, Pseudomonas aeruginosa PA01
cuggucgcggcugcgcgccg

SEQ ID NO: 1478938 - RNA, 14 nt, Pseudomonas aeruginosa PA01
cuggucgcgcgcgg

SEQ ID NO: 1478939 - RNA, 15 nt, Pseudomonas aeruginosa PA01
cuggucgcgcgcggc

SEQ ID NO: 1478940 - RNA, 16 nt, Pseudomonas aeruginosa PA01
cuggucgcgcgcggcc

SEQ ID NO: 1478941 - RNA, 23 nt, Pseudomonas aeruginosa PA01
cuggucgagcuuguuggccagca

SEQ ID NO: 1478942 - RNA, 22 nt, Pseudomonas aeruginosa PA01
cuggucgccgaaguacucgugu

SEQ ID NO: 1478943 - RNA, 16 nt, Pseudomonas aeruginosa PA01
cuggucgccgcagguc

SEQ ID NO: 1478944 - RNA, 16 nt, Pseudomonas aeruginosa PA01
cuggucgauccgcgcc

SEQ ID NO: 1478945 - RNA, 18 nt, Pseudomonas aeruginosa PA01
cuggucgaucucgucgaa

SEQ ID NO: 1478946 - RNA, 15 nt, Pseudomonas aeruginosa PA01
cuggucgcagccgcg

SEQ ID NO: 1478947 - RNA, 17 nt, Pseudomonas aeruginosa PA01
cugguagcugcugccgg

SEQ ID NO: 1478948 - RNA, 20 nt, Pseudomonas aeruginosa PA01
cugguaggacagggccaggc

SEQ ID NO: 1478949 - RNA, 22 nt, Pseudomonas aeruginosa PA01
cugguaggacagggccaggccg

SEQ ID NO: 1478950 - RNA, 20 nt, Pseudomonas aeruginosa PA01
cugguaggagccgucgccgg

SEQ ID NO: 1478951 - RNA, 21 nt, Pseudomonas aeruginosa PA01
cugguagcgggccaucagguc

SEQ ID NO: 1478952 - RNA, 17 nt, Pseudomonas aeruginosa PA01
cugguagcuaccgucgg

SEQ ID NO: 1478953 - RNA, 22 nt, Pseudomonas aeruginosa PA01
cugguagcuaccgucggccugc

SEQ ID NO: 1478954 - RNA, 20 nt, Pseudomonas aeruginosa PA01
cugguagcagagggucgcca

SEQ ID NO: 1478955 - RNA, 15 nt, Pseudomonas aeruginosa PA01
cugguaccugccggc

SEQ ID NO: 1478956 - RNA, 18 nt, Pseudomonas aeruginosa PA01
cugguacagcacccaggc

SEQ ID NO: 1478957 - RNA, 16 nt, Pseudomonas aeruginosa PA01
cugguaacgggcgaac

SEQ ID NO: 1478958 - RNA, 19 nt, Pseudomonas aeruginosa PA01
cugguaacgggcgaacccg

SEQ ID NO: 1478959 - RNA, 16 nt, Pseudomonas aeruginosa PA01
cuggugccgaucagcc

SEQ ID NO: 1478960 - RNA, 17 nt, Pseudomonas aeruginosa PA01
cuggugccgaucagccc

SEQ ID NO: 1478961 - RNA, 16 nt, Pseudomonas aeruginosa PA01
cuggugcgcguccauc

SEQ ID NO: 1478962 - RNA, 14 nt, Pseudomonas aeruginosa PA01
cuggugcacggcga

SEQ ID NO: 1478963 - RNA, 19 nt, Pseudomonas aeruginosa PA01
cuggugcaggucgcgcggc

SEQ ID NO: 1478964 - RNA, 20 nt, Pseudomonas aeruginosa PA01
cuggugcaggucgcgcggcg

SEQ ID NO: 1478965 - RNA, 22 nt, Pseudomonas aeruginosa PA01
cuggugcaggucgcgcggcgcc

SEQ ID NO: 1478966 - RNA, 20 nt, Pseudomonas aeruginosa PA01
cuggugaugucgcggcaggc

SEQ ID NO: 1478967 - RNA, 16 nt, Pseudomonas aeruginosa PA01
cuggugaucgaccaca

SEQ ID NO: 1478968 - RNA, 14 nt, Pseudomonas aeruginosa PA01
cuggugcaccuggc

SEQ ID NO: 1478969 - RNA, 15 nt, Pseudomonas aeruginosa PA01
cuggugcaccuggcg

SEQ ID NO: 1478970 - RNA, 19 nt, Pseudomonas aeruginosa PA01
cuggugcaccuggcgaugc

SEQ ID NO: 1478971 - RNA, 21 nt, Pseudomonas aeruginosa PA01
cuggugcaccuggcgaugccc

SEQ ID NO: 1478972 - RNA, 19 nt, Pseudomonas aeruginosa PA01
cugguggugaucagcggcc

SEQ ID NO: 1478973 - RNA, 16 nt, Pseudomonas aeruginosa PA01
cugguggucaccgcca

SEQ ID NO: 1478974 - RNA, 18 nt, Pseudomonas aeruginosa PA01
cugguggucaccgccagc

SEQ ID NO: 1478975 - RNA, 21 nt, Pseudomonas aeruginosa PA01
cugguggucaccgccagcggg

SEQ ID NO: 1478976 - RNA, 16 nt, Pseudomonas aeruginosa PA01
cuggugggcggcggcu

SEQ ID NO: 1478977 - RNA, 14 nt, Pseudomonas aeruginosa PA01
cugguggcgccggc

SEQ ID NO: 1478978 - RNA, 15 nt, Pseudomonas aeruginosa PA01
cugguggcgaacagc

SEQ ID NO: 1478979 - RNA, 16 nt, Pseudomonas aeruginosa PA01
cugguggcgaacagca

SEQ ID NO: 1478980 - RNA, 19 nt, Pseudomonas aeruginosa PA01
cugguggcgaacagcaccu

SEQ ID NO: 1478981 - RNA, 19 nt, Pseudomonas aeruginosa PA01
cugguggcccugggcggcg

SEQ ID NO: 1478982 - RNA, 20 nt, Pseudomonas aeruginosa PA01
cugguggcccugggcggcga

SEQ ID NO: 1478983 - RNA, 23 nt, Pseudomonas aeruginosa PA01
cugguggcccugggcggcgaccu

SEQ ID NO: 1478984 - RNA, 13 nt, Pseudomonas aeruginosa PA01
cugguggacgguc

SEQ ID NO: 1478985 - RNA, 13 nt, Pseudomonas aeruginosa PA01
cugguggacgucg

SEQ ID NO: 1478986 - RNA, 18 nt, Pseudomonas aeruginosa PA01
cugguggacgucgucggc

SEQ ID NO: 1478987 - RNA, 19 nt, Pseudomonas aeruginosa PA01
cugguggacgucgucggcg

SEQ ID NO: 1478988 - RNA, 21 nt, Pseudomonas aeruginosa PA01
cugguggauguucgccgccac

SEQ ID NO: 1478989 - RNA, 18 nt, Pseudomonas aeruginosa PA01
cugguggaacagccgcag

SEQ ID NO: 1478990 - RNA, 23 nt, Pseudomonas aeruginosa PA01
cugguggaacagccgcagcggca

SEQ ID NO: 1478991 - RNA, 20 nt, Pseudomonas aeruginosa PA01
cugguggacacccugcugcu

SEQ ID NO: 1478992 - RNA, 14 nt, Pseudomonas aeruginosa PA01
cuggugcggcacca

SEQ ID NO: 1478993 - RNA, 18 nt, Pseudomonas aeruginosa PA01
cuggugcggcaccagcca

SEQ ID NO: 1478994 - RNA, 16 nt, Pseudomonas aeruginosa PA01
cuggugcggccgauga

SEQ ID NO: 1478995 - RNA, 16 nt, Pseudomonas aeruginosa PA01
gaacggcccgcucuug

SEQ ID NO: 1478996 - RNA, 23 nt, Pseudomonas aeruginosa PA01
gaacggcagcuggauccgugcca

SEQ ID NO: 1478997 - RNA, 22 nt, Pseudomonas aeruginosa PA01
gaacggcagguggucguugcgc

SEQ ID NO: 1478998 - RNA, 21 nt, Pseudomonas aeruginosa PA01
gaacggaccugagaucagcgc

SEQ ID NO: 1478999 - RNA, 16 nt, Pseudomonas aeruginosa PA01
gaacggaucgcucucg

SEQ ID NO: 1479000 - RNA, 15 nt, Pseudomonas aeruginosa PA01
gaacggaacggaccu

SEQ ID NO: 1479001 - RNA, 14 nt, Pseudomonas aeruginosa PA01
gaacuccgccagca

SEQ ID NO: 1479002 - RNA, 16 nt, Pseudomonas aeruginosa PA01
gaacuccgccagcacc

SEQ ID NO: 1479003 - RNA, 16 nt, Pseudomonas aeruginosa PA01
gaacuccgccagcuug

SEQ ID NO: 1479004 - RNA, 23 nt, Pseudomonas aeruginosa PA01
gaacuccgccagcuuguccgccg

SEQ ID NO: 1479005 - RNA, 20 nt, Pseudomonas aeruginosa PA01
gaacucgacgcgccaggugc

SEQ ID NO: 1479006 - RNA, 15 nt, Pseudomonas aeruginosa PA01
gaacucgaucagcgc

SEQ ID NO: 1479007 - RNA, 18 nt, Pseudomonas aeruginosa PA01
gaacucgaucagcgcggc

SEQ ID NO: 1479008 - RNA, 17 nt, Pseudomonas aeruginosa PA01
gaacuccaucucgcggc

SEQ ID NO: 1479009 - RNA, 19 nt, Pseudomonas aeruginosa PA01
gaacuccaucucgcggcgg

SEQ ID NO: 1479010 - RNA, 17 nt, Pseudomonas aeruginosa PA01
gaacucaugcaggccga

SEQ ID NO: 1479011 - RNA, 21 nt, Pseudomonas aeruginosa PA01
gaacuagcccucgaccuggcu

SEQ ID NO: 1479012 - RNA, 20 nt, Pseudomonas aeruginosa PA01
gaacgcccgcggcagcagcc

SEQ ID NO: 1479013 - RNA, 21 nt, Pseudomonas aeruginosa PA01
gaacgcccgcggcagcagcca

SEQ ID NO: 1479014 - RNA, 12 nt, Pseudomonas aeruginosa PA01
gaacgccgcagc

SEQ ID NO: 1479015 - RNA, 19 nt, Pseudomonas aeruginosa PA01
gaacgcccugacccgcacc

SEQ ID NO: 1479016 - RNA, 20 nt, Pseudomonas aeruginosa PA01
gaacgccgacaggccggugc

SEQ ID NO: 1479017 - RNA, 18 nt, Pseudomonas aeruginosa PA01
gaacgccgaccgacuggc

SEQ ID NO: 1479018 - RNA, 17 nt, Pseudomonas aeruginosa PA01
gaacgaaaaaggcgcgc

SEQ ID NO: 1479019 - RNA, 21 nt, Pseudomonas aeruginosa PA01
gaacgaaagaaggggagccga

SEQ ID NO: 1479020 - RNA, 14 nt, Pseudomonas aeruginosa PA01
gaaccugaccaucg

SEQ ID NO: 1479021 - RNA, 19 nt, Pseudomonas aeruginosa PA01
gaaccugaccaucgucgcu

SEQ ID NO: 1479022 - RNA, 15 nt, Pseudomonas aeruginosa PA01
gaacgcgcccggcca

SEQ ID NO: 1479023 - RNA, 18 nt, Pseudomonas aeruginosa PA01
gaacgcgcccggccaggc

SEQ ID NO: 1479024 - RNA, 14 nt, Pseudomonas aeruginosa PA01
gaacgcgcgccuga

SEQ ID NO: 1479025 - RNA, 22 nt, Pseudomonas aeruginosa PA01
gaacgccuugguguagccgagc

SEQ ID NO: 1479026 - RNA, 12 nt, Pseudomonas aeruginosa PA01
gaacgccgcgca

SEQ ID NO: 1479027 - RNA, 23 nt, Pseudomonas aeruginosa PA01
gaacgccgccacgccgauaccgg

SEQ ID NO: 1479028 - RNA, 23 nt, Pseudomonas aeruginosa PA01
gaacgccgcccgucgcgccggcc

SEQ ID NO: 1479029 - RNA, 18 nt, Pseudomonas aeruginosa PA01
gaacgccucgcagagcgc

SEQ ID NO: 1479030 - RNA, 20 nt, Pseudomonas aeruginosa PA01
gaacgccucgcagagcgcca

SEQ ID NO: 1479031 - RNA, 14 nt, Pseudomonas aeruginosa PA01
gaacgccucgccaa

SEQ ID NO: 1479032 - RNA, 21 nt, Pseudomonas aeruginosa PA01
gaaccgaagguacugccgcua

SEQ ID NO: 1479033 - RNA, 15 nt, Pseudomonas aeruginosa PA01
gaaccgcggcgcccu

SEQ ID NO: 1479034 - RNA, 23 nt, Pseudomonas aeruginosa PA01
gaaccgggucgucagcaggucuc

SEQ ID NO: 1479035 - RNA, 15 nt, Pseudomonas aeruginosa PA01
gaaccguggcggccg

SEQ ID NO: 1479036 - RNA, 18 nt, Pseudomonas aeruginosa PA01
gaaccguggcggccgccg

SEQ ID NO: 1479037 - RNA, 15 nt, Pseudomonas aeruginosa PA01
gaaccguccgcagcg

SEQ ID NO: 1479038 - RNA, 22 nt, Pseudomonas aeruginosa PA01
gaaccaggcaauggccggcggg

SEQ ID NO: 1479039 - RNA, 17 nt, Pseudomonas aeruginosa PA01
gaaccagcucagcucca

SEQ ID NO: 1479040 - RNA, 15 nt, Pseudomonas aeruginosa PA01
gaaccagcagcaggu

SEQ ID NO: 1479041 - RNA, 12 nt, Pseudomonas aeruginosa PA01
gaaccaggcgcc

SEQ ID NO: 1479042 - RNA, 14 nt, Pseudomonas aeruginosa PA01
gaaccaggcgccga

SEQ ID NO: 1479043 - RNA, 18 nt, Pseudomonas aeruginosa PA01
gaaccaguccagcacggu

SEQ ID NO: 1479044 - RNA, 16 nt, Pseudomonas aeruginosa PA01
gaaccaggggucgacg

SEQ ID NO: 1479045 - RNA, 18 nt, Pseudomonas aeruginosa PA01
gaaccacaccaggucgcc

SEQ ID NO: 1479046 - RNA, 19 nt, Pseudomonas aeruginosa PA01
gaaccacaccaggucgccg

SEQ ID NO: 1479047 - RNA, 20 nt, Pseudomonas aeruginosa PA01
gaaccacaccaggucgccgc

SEQ ID NO: 1479048 - RNA, 22 nt, Pseudomonas aeruginosa PA01
gaaccacgacgaagcgccggcg

SEQ ID NO: 1479049 - RNA, 18 nt, Pseudomonas aeruginosa PA01
gaaccacugcgccaugcc

SEQ ID NO: 1479050 - RNA, 19 nt, Pseudomonas aeruginosa PA01
gaaccagacgcucggccag

SEQ ID NO: 1479051 - RNA, 19 nt, Pseudomonas aeruginosa PA01
gaaccagacguugcgcauc

SEQ ID NO: 1479052 - RNA, 15 nt, Pseudomonas aeruginosa PA01
gaacccgcggcgcgc

SEQ ID NO: 1479053 - RNA, 19 nt, Pseudomonas aeruginosa PA01
gaacccagacagcccucca

SEQ ID NO: 1479054 - RNA, 17 nt, Pseudomonas aeruginosa PA01
gaacccaggccgcgcag

SEQ ID NO: 1479055 - RNA, 18 nt, Pseudomonas aeruginosa PA01
gaaccagugcaccgccgg

SEQ ID NO: 1479056 - RNA, 17 nt, Pseudomonas aeruginosa PA01
gaaccauugcggcccgc

SEQ ID NO: 1479057 - RNA, 20 nt, Pseudomonas aeruginosa PA01
gaacaggaucuccucggcca

SEQ ID NO: 1479058 - RNA, 16 nt, Pseudomonas aeruginosa PA01
gaacagcuugccgcug

SEQ ID NO: 1479059 - RNA, 21 nt, Pseudomonas aeruginosa PA01
gaacagcuugccgcugcgcau

SEQ ID NO: 1479060 - RNA, 22 nt, Pseudomonas aeruginosa PA01
gaacagcuggcgcgucgcugcc

SEQ ID NO: 1479061 - RNA, 11 nt, Pseudomonas aeruginosa PA01
gaacagcgccu

SEQ ID NO: 1479062 - RNA, 23 nt, Pseudomonas aeruginosa PA01
gaacagcggcuggcccucggcgu

SEQ ID NO: 1479063 - RNA, 22 nt, Pseudomonas aeruginosa PA01
gaacagcgggucgcggcuggcc

SEQ ID NO: 1479064 - RNA, 16 nt, Pseudomonas aeruginosa PA01
gaacagcgccaccagc

SEQ ID NO: 1479065 - RNA, 17 nt, Pseudomonas aeruginosa PA01
gaacagcgccagcggca

SEQ ID NO: 1479066 - RNA, 14 nt, Pseudomonas aeruginosa PA01
gaacagcgccgcgg

SEQ ID NO: 1479067 - RNA, 18 nt, Pseudomonas aeruginosa PA01
gaacagcgccgcggcugg

SEQ ID NO: 1479068 - RNA, 19 nt, Pseudomonas aeruginosa PA01
gaacagcgccgcggcuggc

SEQ ID NO: 1479069 - RNA, 20 nt, Pseudomonas aeruginosa PA01
gaacagcgagaccucgccca

SEQ ID NO: 1479070 - RNA, 19 nt, Pseudomonas aeruginosa PA01
gaacagcgagaggggcgcu

SEQ ID NO: 1479071 - RNA, 21 nt, Pseudomonas aeruginosa PA01
gaacagcgagaggggcgcucg

SEQ ID NO: 1479072 - RNA, 22 nt, Pseudomonas aeruginosa PA01
gaacagcgagaggggcgcucgu

SEQ ID NO: 1479073 - RNA, 22 nt, Pseudomonas aeruginosa PA01
gaacacgucguugggccccacc

SEQ ID NO: 1479074 - RNA, 21 nt, Pseudomonas aeruginosa PA01
gaacagaggaaggcgccggca

SEQ ID NO: 1479075 - RNA, 17 nt, Pseudomonas aeruginosa PA01
gaacagcaaagcgcagg

SEQ ID NO: 1479076 - RNA, 16 nt, Pseudomonas aeruginosa PA01
gaacagcaacaccgcg

SEQ ID NO: 1479077 - RNA, 11 nt, Pseudomonas aeruginosa PA01
gaacagcaccu

SEQ ID NO: 1479078 - RNA, 12 nt, Pseudomonas aeruginosa PA01
gaacagcagcgg

SEQ ID NO: 1479079 - RNA, 20 nt, Pseudomonas aeruginosa PA01
gaacagcagcggcaccagca

SEQ ID NO: 1479080 - RNA, 16 nt, Pseudomonas aeruginosa PA01
gaacagcagccaggcg

SEQ ID NO: 1479081 - RNA, 21 nt, Pseudomonas aeruginosa PA01
gaacagcagcgguaggcgcgu

SEQ ID NO: 1479082 - RNA, 19 nt, Pseudomonas aeruginosa PA01
gaacagcaggaugccgcug

SEQ ID NO: 1479083 - RNA, 13 nt, Pseudomonas aeruginosa PA01
gaacagcccgucg

SEQ ID NO: 1479084 - RNA, 21 nt, Pseudomonas aeruginosa PA01
gaacagcccgucgcgcgccgg

SEQ ID NO: 1479085 - RNA, 19 nt, Pseudomonas aeruginosa PA01
gaacagccagaggucgagc

SEQ ID NO: 1479086 - RNA, 22 nt, Pseudomonas aeruginosa PA01
gaacagccagaggucgagcugg

SEQ ID NO: 1479087 - RNA, 17 nt, Pseudomonas aeruginosa PA01
gaacagccgcagcggca

SEQ ID NO: 1479088 - RNA, 13 nt, Pseudomonas aeruginosa PA01
gaacaugaagccg

SEQ ID NO: 1479089 - RNA, 15 nt, Pseudomonas aeruginosa PA01
gaacaucgcccggcg

SEQ ID NO: 1479090 - RNA, 21 nt, Pseudomonas aeruginosa PA01
gaacaucgccugcuuggcggc

SEQ ID NO: 1479091 - RNA, 17 nt, Pseudomonas aeruginosa PA01
gaacaucggcgcuccgc

SEQ ID NO: 1479092 - RNA, 18 nt, Pseudomonas aeruginosa PA01
gaacaucggcgcuccgcc

SEQ ID NO: 1479093 - RNA, 14 nt, Pseudomonas aeruginosa PA01
gaacaucgccagcg

SEQ ID NO: 1479094 - RNA, 15 nt, Pseudomonas aeruginosa PA01
gaacaucgccagcgc

SEQ ID NO: 1479095 - RNA, 20 nt, Pseudomonas aeruginosa PA01
gaacauccgcggccccggcg

SEQ ID NO: 1479096 - RNA, 16 nt, Pseudomonas aeruginosa PA01
gaacaucagcagcagg

SEQ ID NO: 1479097 - RNA, 22 nt, Pseudomonas aeruginosa PA01
gaacaguucgaugggccgguac

SEQ ID NO: 1479098 - RNA, 14 nt, Pseudomonas aeruginosa PA01
gaacaguucggcga

SEQ ID NO: 1479099 - RNA, 15 nt, Pseudomonas aeruginosa PA01
gaacagugcgcccgu

SEQ ID NO: 1479100 - RNA, 15 nt, Pseudomonas aeruginosa PA01
gaacaggcuggcguc

SEQ ID NO: 1479101 - RNA, 21 nt, Pseudomonas aeruginosa PA01
gaacaggcuggcgucgacgcc

SEQ ID NO: 1479102 - RNA, 18 nt, Pseudomonas aeruginosa PA01
gaacagggcgagcagggc

SEQ ID NO: 1479103 - RNA, 16 nt, Pseudomonas aeruginosa PA01
gaacagguagccccgg

SEQ ID NO: 1479104 - RNA, 20 nt, Pseudomonas aeruginosa PA01
gaacagguggcuuuccagca

SEQ ID NO: 1479105 - RNA, 12 nt, Pseudomonas aeruginosa PA01
gaacagguucgg

SEQ ID NO: 1479106 - RNA, 15 nt, Pseudomonas aeruginosa PA01
gaacaggucgacgcc

SEQ ID NO: 1479107 - RNA, 15 nt, Pseudomonas aeruginosa PA01
gaacaccggcgagca

SEQ ID NO: 1479108 - RNA, 19 nt, Pseudomonas aeruginosa PA01
gaacaccucuucgccaucc

SEQ ID NO: 1479109 - RNA, 15 nt, Pseudomonas aeruginosa PA01
gaacaccaggcgcca

SEQ ID NO: 1479110 - RNA, 13 nt, Pseudomonas aeruginosa PA01
gaacaccgccugg

SEQ ID NO: 1479111 - RNA, 23 nt, Pseudomonas aeruginosa PA01
gaacaaucccagcucgccgaaga

SEQ ID NO: 1479112 - RNA, 14 nt, Pseudomonas aeruginosa PA01
gaacaagcccuggu

SEQ ID NO: 1479113 - RNA, 15 nt, Pseudomonas aeruginosa PA01
gaacacacgaauggc

SEQ ID NO: 1479114 - RNA, 16 nt, Pseudomonas aeruginosa PA01
gaacacacccugcgca

SEQ ID NO: 1479115 - RNA, 13 nt, Pseudomonas aeruginosa PA01
gaacaccacccgg

SEQ ID NO: 1479116 - RNA, 22 nt, Pseudomonas aeruginosa PA01
gaacacaucgaccaggucgcca

SEQ ID NO: 1479117 - RNA, 24 nt, Pseudomonas aeruginosa PA01
gaacacauagaccagcagcgagca

SEQ ID NO: 1479118 - RNA, 16 nt, Pseudomonas aeruginosa PA01
gaacaaccgcuugcgg

SEQ ID NO: 1479119 - RNA, 22 nt, Pseudomonas aeruginosa PA01
gaaaugguggaccagcgccgcc

SEQ ID NO: 1479120 - RNA, 13 nt, Pseudomonas aeruginosa PA01
gaaaugcaggccg

SEQ ID NO: 1479121 - RNA, 14 nt, Pseudomonas aeruginosa PA01
gaaauggcggacga

SEQ ID NO: 1479122 - RNA, 19 nt, Pseudomonas aeruginosa PA01
gaaaucgguugccgcgcca

SEQ ID NO: 1479123 - RNA, 14 nt, Pseudomonas aeruginosa PA01
gaaaucgguugcga

SEQ ID NO: 1479124 - RNA, 17 nt, Pseudomonas aeruginosa PA01
gaaaucggcguccuggu

SEQ ID NO: 1479125 - RNA, 18 nt, Pseudomonas aeruginosa PA01
gaaauccuccggacgccg

SEQ ID NO: 1479126 - RNA, 22 nt, Pseudomonas aeruginosa PA01
gaaauccuccggacgccgaacg

SEQ ID NO: 1479127 - RNA, 18 nt, Pseudomonas aeruginosa PA01
gaaauccggcuggcgccg

SEQ ID NO: 1479128 - RNA, 15 nt, Pseudomonas aeruginosa PA01
gaaauccggugccuu

SEQ ID NO: 1479129 - RNA, 15 nt, Pseudomonas aeruginosa PA01
gaaauccgccgcgca

SEQ ID NO: 1479130 - RNA, 18 nt, Pseudomonas aeruginosa PA01
gaaauccaccuugccgcg

SEQ ID NO: 1479131 - RNA, 19 nt, Pseudomonas aeruginosa PA01
cuuggucgggcgccgcgcc

SEQ ID NO: 1479132 - RNA, 16 nt, Pseudomonas aeruginosa PA01
cuuggucucgaucagc

SEQ ID NO: 1479133 - RNA, 20 nt, Pseudomonas aeruginosa PA01
cuuggugaugaagucggcgu

SEQ ID NO: 1479134 - RNA, 14 nt, Pseudomonas aeruginosa PA01
cuuggucaggccga

SEQ ID NO: 1479135 - RNA, 14 nt, Pseudomonas aeruginosa PA01
cuuggucaggucga

SEQ ID NO: 1479136 - RNA, 17 nt, Pseudomonas aeruginosa PA01
cuuggucaggucgacgc

SEQ ID NO: 1479137 - RNA, 16 nt, Pseudomonas aeruginosa PA01
cuuggccagcagcauc

SEQ ID NO: 1479138 - RNA, 14 nt, Pseudomonas aeruginosa PA01
cuuggccagcaggc

SEQ ID NO: 1479139 - RNA, 16 nt, Pseudomonas aeruginosa PA01
cuuggccagcaggccg

SEQ ID NO: 1479140 - RNA, 18 nt, Pseudomonas aeruginosa PA01
cuuggccagcaggccgag

SEQ ID NO: 1479141 - RNA, 14 nt, Pseudomonas aeruginosa PA01
cuuggccagccgcg

SEQ ID NO: 1479142 - RNA, 19 nt, Pseudomonas aeruginosa PA01
cuuggccagccgcgcggca

SEQ ID NO: 1479143 - RNA, 15 nt, Pseudomonas aeruginosa PA01
cuuggccagcgcggc

SEQ ID NO: 1479144 - RNA, 14 nt, Pseudomonas aeruginosa PA01
cuuggccaggcgcu

SEQ ID NO: 1479145 - RNA, 23 nt, Pseudomonas aeruginosa PA01
cuuggcccggcguuucgccgggc

SEQ ID NO: 1479146 - RNA, 16 nt, Pseudomonas aeruginosa PA01
cuuggcccgguuggcc

SEQ ID NO: 1479147 - RNA, 21 nt, Pseudomonas aeruginosa PA01
cuuggcccgguuggccaggac

SEQ ID NO: 1479148 - RNA, 14 nt, Pseudomonas aeruginosa PA01
cuuggcccuggccu

SEQ ID NO: 1479149 - RNA, 15 nt, Pseudomonas aeruginosa PA01
cuuggcccuggccuu

SEQ ID NO: 1479150 - RNA, 15 nt, Pseudomonas aeruginosa PA01
cuugucguggcgggc

SEQ ID NO: 1479151 - RNA, 14 nt, Pseudomonas aeruginosa PA01
cuuguggccggucu

SEQ ID NO: 1479152 - RNA, 20 nt, Pseudomonas aeruginosa PA01
cuugugcgaauguccggcga

SEQ ID NO: 1479153 - RNA, 19 nt, Pseudomonas aeruginosa PA01
cuugugggcaugcucggcc

SEQ ID NO: 1479154 - RNA, 18 nt, Pseudomonas aeruginosa PA01
cuugucgcgggucugcga

SEQ ID NO: 1479155 - RNA, 23 nt, Pseudomonas aeruginosa PA01
cuugucgcgguugccgaagcgcu

SEQ ID NO: 1479156 - RNA, 17 nt, Pseudomonas aeruginosa PA01
cuugucgcugaccggcc

SEQ ID NO: 1479157 - RNA, 14 nt, Pseudomonas aeruginosa PA01
cuugucggccgacg

SEQ ID NO: 1479158 - RNA, 15 nt, Pseudomonas aeruginosa PA01
cuugguguagccgag

SEQ ID NO: 1479159 - RNA, 19 nt, Pseudomonas aeruginosa PA01
cuugguguagccgagcacg

SEQ ID NO: 1479160 - RNA, 15 nt, Pseudomonas aeruginosa PA01
cuuggugucggccgc

SEQ ID NO: 1479161 - RNA, 19 nt, Pseudomonas aeruginosa PA01
cuuguucaggguggcgacc

SEQ ID NO: 1479162 - RNA, 21 nt, Pseudomonas aeruginosa PA01
cuuguucaggguggcgaccgc

SEQ ID NO: 1479163 - RNA, 12 nt, Pseudomonas aeruginosa PA01
cuugcccggcgc

SEQ ID NO: 1479164 - RNA, 22 nt, Pseudomonas aeruginosa PA01
cuugccgaccuucaucaggcgg

SEQ ID NO: 1479165 - RNA, 14 nt, Pseudomonas aeruginosa PA01
cuugccgacgccgc

SEQ ID NO: 1479166 - RNA, 18 nt, Pseudomonas aeruginosa PA01
cuugccgacgccgcggcc

SEQ ID NO: 1479167 - RNA, 22 nt, Pseudomonas aeruginosa PA01
cuugccgaggaagucggcggcc

SEQ ID NO: 1479168 - RNA, 13 nt, Pseudomonas aeruginosa PA01
cuugcccugggcg

SEQ ID NO: 1479169 - RNA, 14 nt, Pseudomonas aeruginosa PA01
cuugcccucgcgcc

SEQ ID NO: 1479170 - RNA, 16 nt, Pseudomonas aeruginosa PA01
cuugcccucggcgccc

SEQ ID NO: 1479171 - RNA, 18 nt, Pseudomonas aeruginosa PA01
cuugcccugcucgucgcu

SEQ ID NO: 1479172 - RNA, 20 nt, Pseudomonas aeruginosa PA01
cuugccgacaagccuccagc

SEQ ID NO: 1479173 - RNA, 16 nt, Pseudomonas aeruginosa PA01
cuugccguuggcgucg

SEQ ID NO: 1479174 - RNA, 18 nt, Pseudomonas aeruginosa PA01
cuugccguuggcgucgcg

SEQ ID NO: 1479175 - RNA, 18 nt, Pseudomonas aeruginosa PA01
cuugccgucgguguccgc

SEQ ID NO: 1479176 - RNA, 13 nt, Pseudomonas aeruginosa PA01
cuugcgaucgagg

SEQ ID NO: 1479177 - RNA, 17 nt, Pseudomonas aeruginosa PA01
cuugccuuccugggcgu

SEQ ID NO: 1479178 - RNA, 21 nt, Pseudomonas aeruginosa PA01
cuugccugucuacucgacgcu

SEQ ID NO: 1479179 - RNA, 19 nt, Pseudomonas aeruginosa PA01
cuugccuuccaccgggaag

SEQ ID NO: 1479180 - RNA, 13 nt, Pseudomonas aeruginosa PA01
cuucuaccuggcg

SEQ ID NO: 1479181 - RNA, 21 nt, Pseudomonas aeruginosa PA01
cuugccauccuccagcacuac

SEQ ID NO: 1479182 - RNA, 14 nt, Pseudomonas aeruginosa PA01
cuugccccaggugc

SEQ ID NO: 1479183 - RNA, 18 nt, Pseudomonas aeruginosa PA01
cuucgugggccugcucgg

SEQ ID NO: 1479184 - RNA, 16 nt, Pseudomonas aeruginosa PA01
cuucgugccacaggcc

SEQ ID NO: 1479185 - RNA, 21 nt, Pseudomonas aeruginosa PA01
cuucguuuucaggcgacgccg

SEQ ID NO: 1479186 - RNA, 23 nt, Pseudomonas aeruginosa PA01
cuucguaggugaagcccaggcgc

SEQ ID NO: 1479187 - RNA, 18 nt, Pseudomonas aeruginosa PA01
cuucggcuccagcaccag

SEQ ID NO: 1479188 - RNA, 15 nt, Pseudomonas aeruginosa PA01
cuucggcuucaacgc

SEQ ID NO: 1479189 - RNA, 20 nt, Pseudomonas aeruginosa PA01
cuucguccagcgaggcgugg

SEQ ID NO: 1479190 - RNA, 15 nt, Pseudomonas aeruginosa PA01
cuucgucccaugacc

SEQ ID NO: 1479191 - RNA, 23 nt, Pseudomonas aeruginosa PA01
cuucguccugcugcuggccuucg

SEQ ID NO: 1479192 - RNA, 14 nt, Pseudomonas aeruginosa PA01
cuucgucgcgcagg

SEQ ID NO: 1479193 - RNA, 15 nt, Pseudomonas aeruginosa PA01
cuucgucgcgcuuca

SEQ ID NO: 1479194 - RNA, 14 nt, Pseudomonas aeruginosa PA01
cuugcuggcgcgau

SEQ ID NO: 1479195 - RNA, 22 nt, Pseudomonas aeruginosa PA01
cuugcuguugccgcugcaggcc

SEQ ID NO: 1479196 - RNA, 21 nt, Pseudomonas aeruginosa PA01
cuuggccacgacccugcuggc

SEQ ID NO: 1479197 - RNA, 14 nt, Pseudomonas aeruginosa PA01
cuuggccacgcugc

SEQ ID NO: 1479198 - RNA, 22 nt, Pseudomonas aeruginosa PA01
cuugcugccggcguccuugccg

SEQ ID NO: 1479199 - RNA, 14 nt, Pseudomonas aeruginosa PA01
cuugcucgacccgg

SEQ ID NO: 1479200 - RNA, 18 nt, Pseudomonas aeruginosa PA01
cuugcugccauggcggcg

SEQ ID NO: 1479201 - RNA, 17 nt, Pseudomonas aeruginosa PA01
cuugcugaagcccaggc

SEQ ID NO: 1479202 - RNA, 17 nt, Pseudomonas aeruginosa PA01
cuugcucaggucguagg

SEQ ID NO: 1479203 - RNA, 18 nt, Pseudomonas aeruginosa PA01
cuugcucaggucgucgag

SEQ ID NO: 1479204 - RNA, 16 nt, Pseudomonas aeruginosa PA01
cuugcggaacccgcgc

SEQ ID NO: 1479205 - RNA, 23 nt, Pseudomonas aeruginosa PA01
cuugcggaacccgcgcaguuccu

SEQ ID NO: 1479206 - RNA, 18 nt, Pseudomonas aeruginosa PA01
cuugcgcagggcggcgag

SEQ ID NO: 1479207 - RNA, 21 nt, Pseudomonas aeruginosa PA01
cuugcgcaccagggccaggag

SEQ ID NO: 1479208 - RNA, 16 nt, Pseudomonas aeruginosa PA01
cuugcgccagagcagg

SEQ ID NO: 1479209 - RNA, 18 nt, Pseudomonas aeruginosa PA01
cuugcgccagagcaggcg

SEQ ID NO: 1479210 - RNA, 14 nt, Pseudomonas aeruginosa PA01
cuugcgccaggccc

SEQ ID NO: 1479211 - RNA, 14 nt, Pseudomonas aeruginosa PA01
cuugcgcccggcgc

SEQ ID NO: 1479212 - RNA, 16 nt, Pseudomonas aeruginosa PA01
cuugcgcccggcgcga

SEQ ID NO: 1479213 - RNA, 17 nt, Pseudomonas aeruginosa PA01
cuugcgcccggcgcgac

SEQ ID NO: 1479214 - RNA, 14 nt, Pseudomonas aeruginosa PA01
cuugcgcccggcuu

SEQ ID NO: 1479215 - RNA, 16 nt, Pseudomonas aeruginosa PA01
cuugcgcccggcuucg

SEQ ID NO: 1479216 - RNA, 16 nt, Pseudomonas aeruginosa PA01
cuugcgccgaccgcgc

SEQ ID NO: 1479217 - RNA, 19 nt, Pseudomonas aeruginosa PA01
cuugcgcucgagccggcug

SEQ ID NO: 1479218 - RNA, 13 nt, Pseudomonas aeruginosa PA01
cuugcgcgccagg

SEQ ID NO: 1479219 - RNA, 16 nt, Pseudomonas aeruginosa PA01
cuugcgcuguuccgcc

SEQ ID NO: 1479220 - RNA, 18 nt, Pseudomonas aeruginosa PA01
cuugcgcuguuccgccgu

SEQ ID NO: 1479221 - RNA, 17 nt, Pseudomonas aeruginosa PA01
cuugcgcuugccggccg

SEQ ID NO: 1479222 - RNA, 15 nt, Pseudomonas aeruginosa PA01
cuugcgcucuggcgc

SEQ ID NO: 1479223 - RNA, 16 nt, Pseudomonas aeruginosa PA01
cuugcgcuggccggca

SEQ ID NO: 1479224 - RNA, 15 nt, Pseudomonas aeruginosa PA01
cuugcgcgccgccgc

SEQ ID NO: 1479225 - RNA, 13 nt, Pseudomonas aeruginosa PA01
cuugcgcgcggcg

SEQ ID NO: 1479226 - RNA, 16 nt, Pseudomonas aeruginosa PA01
cuugcgcgcggcgucg

SEQ ID NO: 1479227 - RNA, 14 nt, Pseudomonas aeruginosa PA01
cuugcgcgccacca

SEQ ID NO: 1479228 - RNA, 14 nt, Pseudomonas aeruginosa PA01
gaaauacagcaccc

SEQ ID NO: 1479229 - RNA, 20 nt, Pseudomonas aeruginosa PA01
gaaauagucgcgggccuggg

SEQ ID NO: 1479230 - RNA, 14 nt, Pseudomonas aeruginosa PA01
gaaauagccggcga

SEQ ID NO: 1479231 - RNA, 21 nt, Pseudomonas aeruginosa PA01
gaaauagccggcgaugccgcc

SEQ ID NO: 1479232 - RNA, 18 nt, Pseudomonas aeruginosa PA01
gaaaucaggaaggucucg

SEQ ID NO: 1479233 - RNA, 14 nt, Pseudomonas aeruginosa PA01
gaaagccuggccgg

SEQ ID NO: 1479234 - RNA, 16 nt, Pseudomonas aeruginosa PA01
gaaagccuggccggcg

SEQ ID NO: 1479235 - RNA, 16 nt, Pseudomonas aeruginosa PA01
gaaagccucaggcgcu

SEQ ID NO: 1479236 - RNA, 17 nt, Pseudomonas aeruginosa PA01
gaaagccucaggcgcug

SEQ ID NO: 1479237 - RNA, 17 nt, Pseudomonas aeruginosa PA01
gaaagccuccagcagcu

SEQ ID NO: 1479238 - RNA, 15 nt, Pseudomonas aeruginosa PA01
gaaagcgucagcgcg

SEQ ID NO: 1479239 - RNA, 18 nt, Pseudomonas aeruginosa PA01
gaaagcgucagcgcgcca

SEQ ID NO: 1479240 - RNA, 20 nt, Pseudomonas aeruginosa PA01
gaaagacgcugcgaccuggc

SEQ ID NO: 1479241 - RNA, 20 nt, Pseudomonas aeruginosa PA01
gaaagaaacgguggaggcgu

SEQ ID NO: 1479242 - RNA, 12 nt, Pseudomonas aeruginosa PA01
gaaagccagcaa

SEQ ID NO: 1479243 - RNA, 14 nt, Pseudomonas aeruginosa PA01
gaaagcaucguugu

SEQ ID NO: 1479244 - RNA, 19 nt, Pseudomonas aeruginosa PA01
gaaagcagaaagccccugc

SEQ ID NO: 1479245 - RNA, 22 nt, Pseudomonas aeruginosa PA01
gaaacucaucaggcugccgagc

SEQ ID NO: 1479246 - RNA, 23 nt, Pseudomonas aeruginosa PA01
gaaacucaucaggcugccgagca

SEQ ID NO: 1479247 - RNA, 21 nt, Pseudomonas aeruginosa PA01
gaaacgguuggccucggcccg

SEQ ID NO: 1479248 - RNA, 13 nt, Pseudomonas aeruginosa PA01
gaaacguccggcg

SEQ ID NO: 1479249 - RNA, 17 nt, Pseudomonas aeruginosa PA01
gaaacaccaggccgaug

SEQ ID NO: 1479250 - RNA, 16 nt, Pseudomonas aeruginosa PA01
gaaacucgcgggcgcg

SEQ ID NO: 1479251 - RNA, 15 nt, Pseudomonas aeruginosa PA01
cuuuuucaugcgugc

SEQ ID NO: 1479252 - RNA, 15 nt, Pseudomonas aeruginosa PA01
cuuuuucauggcugg

SEQ ID NO: 1479253 - RNA, 18 nt, Pseudomonas aeruginosa PA01
gaaaacccugggaauggc

SEQ ID NO: 1479254 - RNA, 20 nt, Pseudomonas aeruginosa PA01
gaaaacccugggaauggcgg

SEQ ID NO: 1479255 - RNA, 16 nt, Pseudomonas aeruginosa PA01
cuuuuuuaugcgcagc

SEQ ID NO: 1479256 - RNA, 23 nt, Pseudomonas aeruginosa PA01
gaaaagcccgccaccuggcgggc

SEQ ID NO: 1479257 - RNA, 21 nt, Pseudomonas aeruginosa PA01
gaaaauggaacagucgcgcgg

SEQ ID NO: 1479258 - RNA, 21 nt, Pseudomonas aeruginosa PA01
gaaaagaaggcggauggcguu

SEQ ID NO: 1479259 - RNA, 22 nt, Pseudomonas aeruginosa PA01
gaaaacgccgcgaagcccagcg

SEQ ID NO: 1479260 - RNA, 15 nt, Pseudomonas aeruginosa PA01
cuuuugcaaucggcg

SEQ ID NO: 1479261 - RNA, 16 nt, Pseudomonas aeruginosa PA01
cuuuugcaaucggcga

SEQ ID NO: 1479262 - RNA, 13 nt, Pseudomonas aeruginosa PA01
cuuuuccggcgcc

SEQ ID NO: 1479263 - RNA, 22 nt, Pseudomonas aeruginosa PA01
cuuuucugccacccggcgcccg

SEQ ID NO: 1479264 - RNA, 22 nt, Pseudomonas aeruginosa PA01
cuuuuccuccagggugccgacc

SEQ ID NO: 1479265 - RNA, 14 nt, Pseudomonas aeruginosa PA01
cuuuuccucgaccc

SEQ ID NO: 1479266 - RNA, 19 nt, Pseudomonas aeruginosa PA01
cuuuuccucgaucaggccu

SEQ ID NO: 1479267 - RNA, 18 nt, Pseudomonas aeruginosa PA01
cuuuucaauuccgccgcg

SEQ ID NO: 1479268 - RNA, 23 nt, Pseudomonas aeruginosa PA01
cuuuucaauuccgccgcggcaau

SEQ ID NO: 1479269 - RNA, 19 nt, Pseudomonas aeruginosa PA01
cuuuucccgcaccggcgcg

SEQ ID NO: 1479270 - RNA, 15 nt, Pseudomonas aeruginosa PA01
cgacauacuccgccg

SEQ ID NO: 1479271 - RNA, 16 nt, Pseudomonas aeruginosa PA01
cgacauacuccgccgc

SEQ ID NO: 1479272 - RNA, 18 nt, Pseudomonas aeruginosa PA01
cgacauacuccgccgcuu

SEQ ID NO: 1479273 - RNA, 14 nt, Pseudomonas aeruginosa PA01
cgacaugccccgcc

SEQ ID NO: 1479274 - RNA, 15 nt, Pseudomonas aeruginosa PA01
cgacaugccccgccg

SEQ ID NO: 1479275 - RNA, 18 nt, Pseudomonas aeruginosa PA01
cgacauagccggcgaacc

SEQ ID NO: 1479276 - RNA, 18 nt, Pseudomonas aeruginosa PA01
cgacauagcgcagcaccg

SEQ ID NO: 1479277 - RNA, 18 nt, Pseudomonas aeruginosa PA01
cgacauagcggcugcugu

SEQ ID NO: 1479278 - RNA, 16 nt, Pseudomonas aeruginosa PA01
cgacaugcaggccggc

SEQ ID NO: 1479279 - RNA, 23 nt, Pseudomonas aeruginosa PA01
cgacaugcaggccggccuccagc

SEQ ID NO: 1479280 - RNA, 17 nt, Pseudomonas aeruginosa PA01
cgacagucagaacacac

SEQ ID NO: 1479281 - RNA, 19 nt, Pseudomonas aeruginosa PA01
cgacagucccaggccaacc

SEQ ID NO: 1479282 - RNA, 14 nt, Pseudomonas aeruginosa PA01
cgacaggccgccgu

SEQ ID NO: 1479283 - RNA, 19 nt, Pseudomonas aeruginosa PA01
cgacaggccggugccgccg

SEQ ID NO: 1479284 - RNA, 20 nt, Pseudomonas aeruginosa PA01
cgacaggccggugccgccgg

SEQ ID NO: 1479285 - RNA, 14 nt, Pseudomonas aeruginosa PA01
cgacaugggccgcg

SEQ ID NO: 1479286 - RNA, 16 nt, Pseudomonas aeruginosa PA01
cgacaugggccgcgca

SEQ ID NO: 1479287 - RNA, 20 nt, Pseudomonas aeruginosa PA01
cgacaugccgguucccgcag

SEQ ID NO: 1479288 - RNA, 21 nt, Pseudomonas aeruginosa PA01
cgacaugccgguucccgcagc

SEQ ID NO: 1479289 - RNA, 23 nt, Pseudomonas aeruginosa PA01
cgacaugccgguucccgcagcga

SEQ ID NO: 1479290 - RNA, 13 nt, Pseudomonas aeruginosa PA01
cgacauggaucac

SEQ ID NO: 1479291 - RNA, 16 nt, Pseudomonas aeruginosa PA01
cgacauggaucaccgc

SEQ ID NO: 1479292 - RNA, 17 nt, Pseudomonas aeruginosa PA01
cgacauggaucaccgcc

SEQ ID NO: 1479293 - RNA, 15 nt, Pseudomonas aeruginosa PA01
cgaccaacagggcgu

SEQ ID NO: 1479294 - RNA, 14 nt, Pseudomonas aeruginosa PA01
cgacauugcugccg

SEQ ID NO: 1479295 - RNA, 20 nt, Pseudomonas aeruginosa PA01
cgacauugcugccgaggccg

SEQ ID NO: 1479296 - RNA, 15 nt, Pseudomonas aeruginosa PA01
cgaccacgacccggg

SEQ ID NO: 1479297 - RNA, 18 nt, Pseudomonas aeruginosa PA01
cgaccaccgcgaauccgc

SEQ ID NO: 1479298 - RNA, 12 nt, Pseudomonas aeruginosa PA01
cgaccaccgcga

SEQ ID NO: 1479299 - RNA, 14 nt, Pseudomonas aeruginosa PA01
cgaccaccgccggg

SEQ ID NO: 1479300 - RNA, 15 nt, Pseudomonas aeruginosa PA01
cgaccaccgccggga

SEQ ID NO: 1479301 - RNA, 18 nt, Pseudomonas aeruginosa PA01
cgaccaccuucaggcugc

SEQ ID NO: 1479302 - RNA, 19 nt, Pseudomonas aeruginosa PA01
cgaccacguaguaggcgcg

SEQ ID NO: 1479303 - RNA, 18 nt, Pseudomonas aeruginosa PA01
cgaccacggccuucggca

SEQ ID NO: 1479304 - RNA, 19 nt, Pseudomonas aeruginosa PA01
cgaccacggccuucggcag

SEQ ID NO: 1479305 - RNA, 21 nt, Pseudomonas aeruginosa PA01
cgaccacacaugcaggucgug

SEQ ID NO: 1479306 - RNA, 15 nt, Pseudomonas aeruginosa PA01
cgaccacaugggcga

SEQ ID NO: 1479307 - RNA, 16 nt, Pseudomonas aeruginosa PA01
cgaccacaucggccag

SEQ ID NO: 1479308 - RNA, 14 nt, Pseudomonas aeruginosa PA01
cgaccaccaccagg

SEQ ID NO: 1479309 - RNA, 23 nt, Pseudomonas aeruginosa PA01
cgaccaccaccaggucggcgcgc

SEQ ID NO: 1479310 - RNA, 16 nt, Pseudomonas aeruginosa PA01
cgaccaccaucaccgc

SEQ ID NO: 1479311 - RNA, 17 nt, Pseudomonas aeruginosa PA01
cgaccaccaucaccgcc

SEQ ID NO: 1479312 - RNA, 22 nt, Pseudomonas aeruginosa PA01
cgaccacccggcgguccgccgc

SEQ ID NO: 1479313 - RNA, 19 nt, Pseudomonas aeruginosa PA01
cgaccaguugcucgcuccg

SEQ ID NO: 1479314 - RNA, 21 nt, Pseudomonas aeruginosa PA01
cgaccaguugcucgcuccgag

SEQ ID NO: 1479315 - RNA, 18 nt, Pseudomonas aeruginosa PA01
cgaccaggucgcuggcac

SEQ ID NO: 1479316 - RNA, 16 nt, Pseudomonas aeruginosa PA01
cgaccaguaccaggcg

SEQ ID NO: 1479317 - RNA, 14 nt, Pseudomonas aeruginosa PA01
cgaccagggccggg

SEQ ID NO: 1479318 - RNA, 16 nt, Pseudomonas aeruginosa PA01
cgaccagguccgccac

SEQ ID NO: 1479319 - RNA, 15 nt, Pseudomonas aeruginosa PA01
cgaccagguccggag

SEQ ID NO: 1479320 - RNA, 18 nt, Pseudomonas aeruginosa PA01
cgaccagguccggcagcg

SEQ ID NO: 1479321 - RNA, 19 nt, Pseudomonas aeruginosa PA01
cgaccagguccggcagcgc

SEQ ID NO: 1479322 - RNA, 21 nt, Pseudomonas aeruginosa PA01
cgaccagguccggcagcgccu

SEQ ID NO: 1479323 - RNA, 19 nt, Pseudomonas aeruginosa PA01
cgaccaggcguuccaccag

SEQ ID NO: 1479324 - RNA, 14 nt, Pseudomonas aeruginosa PA01
cgaccagggcaucc

SEQ ID NO: 1479325 - RNA, 22 nt, Pseudomonas aeruginosa PA01
cgaccagggcauccagggucgc

SEQ ID NO: 1479326 - RNA, 13 nt, Pseudomonas aeruginosa PA01
cgaccaucggcgg

SEQ ID NO: 1479327 - RNA, 21 nt, Pseudomonas aeruginosa PA01
cgaccaucggcggcggcccgc

SEQ ID NO: 1479328 - RNA, 15 nt, Pseudomonas aeruginosa PA01
cgaccauccagccug

SEQ ID NO: 1479329 - RNA, 16 nt, Pseudomonas aeruginosa PA01
cgaccaucaccagcgc

SEQ ID NO: 1479330 - RNA, 18 nt, Pseudomonas aeruginosa PA01
cgaccaucaccagcgccg

SEQ ID NO: 1479331 - RNA, 20 nt, Pseudomonas aeruginosa PA01
cgaccaucauccgcguggcg

SEQ ID NO: 1479332 - RNA, 21 nt, Pseudomonas aeruginosa PA01
cgaccaucauccgcguggcga

SEQ ID NO: 1479333 - RNA, 15 nt, Pseudomonas aeruginosa PA01
cgacccagaccugcc

SEQ ID NO: 1479334 - RNA, 16 nt, Pseudomonas aeruginosa PA01
cgacccagaccugccg

SEQ ID NO: 1479335 - RNA, 17 nt, Pseudomonas aeruginosa PA01
cgacccagaccugccgc

SEQ ID NO: 1479336 - RNA, 13 nt, Pseudomonas aeruginosa PA01
cgacccagccgca

SEQ ID NO: 1479337 - RNA, 17 nt, Pseudomonas aeruginosa PA01
cgacccagccgcacgcc

SEQ ID NO: 1479338 - RNA, 18 nt, Pseudomonas aeruginosa PA01
cgacccagccgcacgccc

SEQ ID NO: 1479339 - RNA, 15 nt, Pseudomonas aeruginosa PA01
cgacccaggcccagc

SEQ ID NO: 1479340 - RNA, 13 nt, Pseudomonas aeruginosa PA01
cgacccaggccga

SEQ ID NO: 1479341 - RNA, 17 nt, Pseudomonas aeruginosa PA01
cgacccaggccgacagc

SEQ ID NO: 1479342 - RNA, 21 nt, Pseudomonas aeruginosa PA01
cgacccaggccgacagcggcu

SEQ ID NO: 1479343 - RNA, 14 nt, Pseudomonas aeruginosa PA01
cgaccauguucacc

SEQ ID NO: 1479344 - RNA, 17 nt, Pseudomonas aeruginosa PA01
cgaccauguucaccagc

SEQ ID NO: 1479345 - RNA, 22 nt, Pseudomonas aeruginosa PA01
cgaccauguucaccagcgcugc

SEQ ID NO: 1479346 - RNA, 20 nt, Pseudomonas aeruginosa PA01
cgaccaugccguagaucagg

SEQ ID NO: 1479347 - RNA, 23 nt, Pseudomonas aeruginosa PA01
cgaccauucaugggcgcacuccg

SEQ ID NO: 1479348 - RNA, 12 nt, Pseudomonas aeruginosa PA01
cgaccagccggg

SEQ ID NO: 1479349 - RNA, 20 nt, Pseudomonas aeruginosa PA01
cgaccagccgcaggcugccg

SEQ ID NO: 1479350 - RNA, 13 nt, Pseudomonas aeruginosa PA01
cgaccagcagggc

SEQ ID NO: 1479351 - RNA, 16 nt, Pseudomonas aeruginosa PA01
cgaccagcagggccag

SEQ ID NO: 1479352 - RNA, 20 nt, Pseudomonas aeruginosa PA01
cgaccagcagggccagcagc

SEQ ID NO: 1479353 - RNA, 14 nt, Pseudomonas aeruginosa PA01
cgaccagcagcggc

SEQ ID NO: 1479354 - RNA, 15 nt, Pseudomonas aeruginosa PA01
cgaccagcagcggcu

SEQ ID NO: 1479355 - RNA, 16 nt, Pseudomonas aeruginosa PA01
cgaccagaucggcaug

SEQ ID NO: 1479356 - RNA, 20 nt, Pseudomonas aeruginosa PA01
cgaccagaucggcauggccg

SEQ ID NO: 1479357 - RNA, 14 nt, Pseudomonas aeruginosa PA01
cgaccagacgcagc

SEQ ID NO: 1479358 - RNA, 20 nt, Pseudomonas aeruginosa PA01
cgaccagaaggucuugccca

SEQ ID NO: 1479359 - RNA, 19 nt, Pseudomonas aeruginosa PA01
cgaccacuuccagguagcc

SEQ ID NO: 1479360 - RNA, 15 nt, Pseudomonas aeruginosa PA01
cgaccacuucggcgg

SEQ ID NO: 1479361 - RNA, 16 nt, Pseudomonas aeruginosa PA01
cgaccacuucggcggu

SEQ ID NO: 1479362 - RNA, 23 nt, Pseudomonas aeruginosa PA01
cgaccacuucggcgguggggccg

SEQ ID NO: 1479363 - RNA, 14 nt, Pseudomonas aeruginosa PA01
cgaccacuuuccac

SEQ ID NO: 1479364 - RNA, 20 nt, Pseudomonas aeruginosa PA01
cgaccaggaauuccuggccg

SEQ ID NO: 1479365 - RNA, 21 nt, Pseudomonas aeruginosa PA01
cgaccaggaauuccuggccgg

SEQ ID NO: 1479366 - RNA, 23 nt, Pseudomonas aeruginosa PA01
cgaccaggaauuccuggccggug

SEQ ID NO: 1479367 - RNA, 19 nt, Pseudomonas aeruginosa PA01
cgaccaggacagcacgcuc

SEQ ID NO: 1479368 - RNA, 22 nt, Pseudomonas aeruginosa PA01
cgaccaggacagcacgcucagg

SEQ ID NO: 1479369 - RNA, 15 nt, Pseudomonas aeruginosa PA01
cgaccagcgucgcgc

SEQ ID NO: 1479370 - RNA, 23 nt, Pseudomonas aeruginosa PA01
cgaccagcgucgcgcgugccccg

SEQ ID NO: 1479371 - RNA, 16 nt, Pseudomonas aeruginosa PA01
cgaccagcuucaaccg

SEQ ID NO: 1479372 - RNA, 21 nt, Pseudomonas aeruginosa PA01
cgaccagcucgaagccgccgu

SEQ ID NO: 1479373 - RNA, 15 nt, Pseudomonas aeruginosa PA01
cgaccagcgccgcgg

SEQ ID NO: 1479374 - RNA, 18 nt, Pseudomonas aeruginosa PA01
cgaccagcgccgcggcga

SEQ ID NO: 1479375 - RNA, 20 nt, Pseudomonas aeruginosa PA01
cgaccagcgccgcggcgacc

SEQ ID NO: 1479376 - RNA, 13 nt, Pseudomonas aeruginosa PA01
cgaccagcgccga

SEQ ID NO: 1479377 - RNA, 14 nt, Pseudomonas aeruginosa PA01
cgaccagcgccagg

SEQ ID NO: 1479378 - RNA, 17 nt, Pseudomonas aeruginosa PA01
cgaccagcgccaggcgc

SEQ ID NO: 1479379 - RNA, 18 nt, Pseudomonas aeruginosa PA01
cgaccagcgccaggcgcg

SEQ ID NO: 1479380 - RNA, 11 nt, Pseudomonas aeruginosa PA01
cgaccagcgcc

SEQ ID NO: 1479381 - RNA, 15 nt, Pseudomonas aeruginosa PA01
cgaaugcccggcagc

SEQ ID NO: 1479382 - RNA, 16 nt, Pseudomonas aeruginosa PA01
cgaaugcccggcagcg

SEQ ID NO: 1479383 - RNA, 17 nt, Pseudomonas aeruginosa PA01
cgaaugcccggcagcgc

SEQ ID NO: 1479384 - RNA, 15 nt, Pseudomonas aeruginosa PA01
cgaaucuucggcgcg

SEQ ID NO: 1479385 - RNA, 18 nt, Pseudomonas aeruginosa PA01
cgaaucuucggcgcgccg

SEQ ID NO: 1479386 - RNA, 19 nt, Pseudomonas aeruginosa PA01
cgaaucuucggcgcgccgg

SEQ ID NO: 1479387 - RNA, 13 nt, Pseudomonas aeruginosa PA01
cgaaucggcgcac

SEQ ID NO: 1479388 - RNA, 17 nt, Pseudomonas aeruginosa PA01
cgaaucgucgccggagg

SEQ ID NO: 1479389 - RNA, 22 nt, Pseudomonas aeruginosa PA01
cgaaucgaugcuguaguugacg

SEQ ID NO: 1479390 - RNA, 20 nt, Pseudomonas aeruginosa PA01
cgaauccggucggacuccgc

SEQ ID NO: 1479391 - RNA, 21 nt, Pseudomonas aeruginosa PA01
cgaauccggucggacuccgcc

SEQ ID NO: 1479392 - RNA, 14 nt, Pseudomonas aeruginosa PA01
cgaauccuccagcc

SEQ ID NO: 1479393 - RNA, 18 nt, Pseudomonas aeruginosa PA01
cgaauccuccagccggcg

SEQ ID NO: 1479394 - RNA, 19 nt, Pseudomonas aeruginosa PA01
cgaagucgccgucguccgg

SEQ ID NO: 1479395 - RNA, 21 nt, Pseudomonas aeruginosa PA01
cgaagucggcgagccggcgca

SEQ ID NO: 1479396 - RNA, 13 nt, Pseudomonas aeruginosa PA01
cgaagucggcgcg

SEQ ID NO: 1479397 - RNA, 17 nt, Pseudomonas aeruginosa PA01
cgaagucgcccgccggc

SEQ ID NO: 1479398 - RNA, 14 nt, Pseudomonas aeruginosa PA01
cgaagucgccggca

SEQ ID NO: 1479399 - RNA, 17 nt, Pseudomonas aeruginosa PA01
cgaagucgccggcaucg

SEQ ID NO: 1479400 - RNA, 20 nt, Pseudomonas aeruginosa PA01
cgaagucguuguacuggccg

SEQ ID NO: 1479401 - RNA, 17 nt, Pseudomonas aeruginosa PA01
cgaagugaccgcgcgcc

SEQ ID NO: 1479402 - RNA, 23 nt, Pseudomonas aeruginosa PA01
cgaagugauggaagagcgccgcg

SEQ ID NO: 1479403 - RNA, 23 nt, Pseudomonas aeruginosa PA01
cgaagugaucuggcauaccgcgu

SEQ ID NO: 1479404 - RNA, 13 nt, Pseudomonas aeruginosa PA01
cgaagugcgcugc

SEQ ID NO: 1479405 - RNA, 17 nt, Pseudomonas aeruginosa PA01
cgaaguguuacagcagg

SEQ ID NO: 1479406 - RNA, 17 nt, Pseudomonas aeruginosa PA01
cgaaguucuccagcaag

SEQ ID NO: 1479407 - RNA, 19 nt, Pseudomonas aeruginosa PA01
cgaaguucuccagcaagcc

SEQ ID NO: 1479408 - RNA, 20 nt, Pseudomonas aeruginosa PA01
cgaaguucuccagcaagccg

SEQ ID NO: 1479409 - RNA, 16 nt, Pseudomonas aeruginosa PA01
cgaaguugccgccgcu

SEQ ID NO: 1479410 - RNA, 20 nt, Pseudomonas aeruginosa PA01
cgaaguugccgccgcuggcc

SEQ ID NO: 1479411 - RNA, 22 nt, Pseudomonas aeruginosa PA01
cgaaguugccgccgcuggccug

SEQ ID NO: 1479412 - RNA, 16 nt, Pseudomonas aeruginosa PA01
cgaagauccgcuccag

SEQ ID NO: 1479413 - RNA, 21 nt, Pseudomonas aeruginosa PA01
cgaagaucgacaggccgccgu

SEQ ID NO: 1479414 - RNA, 15 nt, Pseudomonas aeruginosa PA01
cgaagcaauaccggu

SEQ ID NO: 1479415 - RNA, 19 nt, Pseudomonas aeruginosa PA01
cgaagcaauaccgguuggc

SEQ ID NO: 1479416 - RNA, 14 nt, Pseudomonas aeruginosa PA01
cgaagcccagcgcc

SEQ ID NO: 1479417 - RNA, 16 nt, Pseudomonas aeruginosa PA01
cgaagcccagcgccgc

SEQ ID NO: 1479418 - RNA, 19 nt, Pseudomonas aeruginosa PA01
cgaagggaaacaccaggcc

SEQ ID NO: 1479419 - RNA, 17 nt, Pseudomonas aeruginosa PA01
cgaagccaggaagcggc

SEQ ID NO: 1479420 - RNA, 17 nt, Pseudomonas aeruginosa PA01
cgaagccaggcaccgga

SEQ ID NO: 1479421 - RNA, 19 nt, Pseudomonas aeruginosa PA01
cgaagggaacccgcggcgc

SEQ ID NO: 1479422 - RNA, 17 nt, Pseudomonas aeruginosa PA01
cgaagggcacgccgcuc

SEQ ID NO: 1479423 - RNA, 18 nt, Pseudomonas aeruginosa PA01
cgaagggcaggccgauca

SEQ ID NO: 1479424 - RNA, 20 nt, Pseudomonas aeruginosa PA01
cgaagggcaggccgaucauc

SEQ ID NO: 1479425 - RNA, 19 nt, Pseudomonas aeruginosa PA01
cgaaguagcgacggaagcc

SEQ ID NO: 1479426 - RNA, 17 nt, Pseudomonas aeruginosa PA01
cgaaguccggguugagc

SEQ ID NO: 1479427 - RNA, 17 nt, Pseudomonas aeruginosa PA01
cgaaguccugcaacagg

SEQ ID NO: 1479428 - RNA, 20 nt, Pseudomonas aeruginosa PA01
cgaaguccugcaacagggca

SEQ ID NO: 1479429 - RNA, 18 nt, Pseudomonas aeruginosa PA01
cgaaguccugcaggaucg

SEQ ID NO: 1479430 - RNA, 11 nt, Pseudomonas aeruginosa PA01
cgaaguccacu

SEQ ID NO: 1479431 - RNA, 20 nt, Pseudomonas aeruginosa PA01
cgaaguccacugucucgccg

SEQ ID NO: 1479432 - RNA, 14 nt, Pseudomonas aeruginosa PA01
cgaaggucgaaggc

SEQ ID NO: 1479433 - RNA, 14 nt, Pseudomonas aeruginosa PA01
cgaaggucgccguc

SEQ ID NO: 1479434 - RNA, 17 nt, Pseudomonas aeruginosa PA01
cgaaggucggcggcagc

SEQ ID NO: 1479435 - RNA, 22 nt, Pseudomonas aeruginosa PA01
cgaaggguuggccgcagcagcg

SEQ ID NO: 1479436 - RNA, 13 nt, Pseudomonas aeruginosa PA01
cgaaggucagccc

SEQ ID NO: 1479437 - RNA, 21 nt, Pseudomonas aeruginosa PA01
cgaagggcucagcccaggcgc

SEQ ID NO: 1479438 - RNA, 15 nt, Pseudomonas aeruginosa PA01
cgaagggcgcuucgg

SEQ ID NO: 1479439 - RNA, 18 nt, Pseudomonas aeruginosa PA01
cgaagggcgcuucggcgg

SEQ ID NO: 1479440 - RNA, 23 nt, Pseudomonas aeruginosa PA01
cgaagggcgcuucggcggauaac

SEQ ID NO: 1479441 - RNA, 14 nt, Pseudomonas aeruginosa PA01
cgaaggugcaggcc

SEQ ID NO: 1479442 - RNA, 15 nt, Pseudomonas aeruginosa PA01
cgaaggucugcccgu

SEQ ID NO: 1479443 - RNA, 15 nt, Pseudomonas aeruginosa PA01
cgacagcggcuggcg

SEQ ID NO: 1479444 - RNA, 18 nt, Pseudomonas aeruginosa PA01
cgacagcggcuggcgcuu

SEQ ID NO: 1479445 - RNA, 15 nt, Pseudomonas aeruginosa PA01
cgacagcgacucuuc

SEQ ID NO: 1479446 - RNA, 23 nt, Pseudomonas aeruginosa PA01
cgacagcgaaugcuugccggcgc

SEQ ID NO: 1479447 - RNA, 20 nt, Pseudomonas aeruginosa PA01
cgacaggcccuugaacaggc

SEQ ID NO: 1479448 - RNA, 14 nt, Pseudomonas aeruginosa PA01
cgacaggccgacca

SEQ ID NO: 1479449 - RNA, 22 nt, Pseudomonas aeruginosa PA01
cgacaggccgaccagcagggcc

SEQ ID NO: 1479450 - RNA, 13 nt, Pseudomonas aeruginosa PA01
cgacaggcagcgc

SEQ ID NO: 1479451 - RNA, 14 nt, Pseudomonas aeruginosa PA01
cgacaggcagcgcc

SEQ ID NO: 1479452 - RNA, 18 nt, Pseudomonas aeruginosa PA01
cgacaggcagcgccgccc

SEQ ID NO: 1479453 - RNA, 19 nt, Pseudomonas aeruginosa PA01
cgacagcgucguaguggcg

SEQ ID NO: 1479454 - RNA, 19 nt, Pseudomonas aeruginosa PA01
cgacagcucguggcuggcg

SEQ ID NO: 1479455 - RNA, 21 nt, Pseudomonas aeruginosa PA01
cgacagcucguggcuggcgcc

SEQ ID NO: 1479456 - RNA, 20 nt, Pseudomonas aeruginosa PA01
cgacaccugcaacgcccgcg

SEQ ID NO: 1479457 - RNA, 23 nt, Pseudomonas aeruginosa PA01
cgacaccugcaacgcccgcgagc

SEQ ID NO: 1479458 - RNA, 16 nt, Pseudomonas aeruginosa PA01
cgacagccccggcccg

SEQ ID NO: 1479459 - RNA, 17 nt, Pseudomonas aeruginosa PA01
cgacagccccggcccgg

SEQ ID NO: 1479460 - RNA, 21 nt, Pseudomonas aeruginosa PA01
cgacagccccggcccggucag

SEQ ID NO: 1479461 - RNA, 22 nt, Pseudomonas aeruginosa PA01
cgaaugguucaucuucgcgcgg

SEQ ID NO: 1479462 - RNA, 19 nt, Pseudomonas aeruginosa PA01
cgaaugcuugccggcgccu

SEQ ID NO: 1479463 - RNA, 15 nt, Pseudomonas aeruginosa PA01
cgaauggacaggcgc

SEQ ID NO: 1479464 - RNA, 15 nt, Pseudomonas aeruginosa PA01
cgacaccccggucag

SEQ ID NO: 1479465 - RNA, 20 nt, Pseudomonas aeruginosa PA01
cgacaccccggucaggccga

SEQ ID NO: 1479466 - RNA, 15 nt, Pseudomonas aeruginosa PA01
cgacacccgcgccgc

SEQ ID NO: 1479467 - RNA, 18 nt, Pseudomonas aeruginosa PA01
cgacacccgcgccgccgc

SEQ ID NO: 1479468 - RNA, 19 nt, Pseudomonas aeruginosa PA01
cgacacccgcgccgccgcg

SEQ ID NO: 1479469 - RNA, 16 nt, Pseudomonas aeruginosa PA01
cgacaccaugcuccgc

SEQ ID NO: 1479470 - RNA, 13 nt, Pseudomonas aeruginosa PA01
cgacaccccgaag

SEQ ID NO: 1479471 - RNA, 16 nt, Pseudomonas aeruginosa PA01
cgacaccgccagcacc

SEQ ID NO: 1479472 - RNA, 23 nt, Pseudomonas aeruginosa PA01
ccuucgacgguucgcgaacgguc

SEQ ID NO: 1479473 - RNA, 23 nt, Pseudomonas aeruginosa PA01
ccuuccgucgucaccucggcgcc

SEQ ID NO: 1479474 - RNA, 13 nt, Pseudomonas aeruginosa PA01
ccuucccggcgcu

SEQ ID NO: 1479475 - RNA, 14 nt, Pseudomonas aeruginosa PA01
ccuuccugggcgug

SEQ ID NO: 1479476 - RNA, 14 nt, Pseudomonas aeruginosa PA01
ccuucgaagccggc

SEQ ID NO: 1479477 - RNA, 15 nt, Pseudomonas aeruginosa PA01
ccuucgaagccggca

SEQ ID NO: 1479478 - RNA, 16 nt, Pseudomonas aeruginosa PA01
ccuucgaagccggcac

SEQ ID NO: 1479479 - RNA, 18 nt, Pseudomonas aeruginosa PA01
ccuuccuugaccacggcg

SEQ ID NO: 1479480 - RNA, 18 nt, Pseudomonas aeruginosa PA01
ccuuccagcaggucgagg

SEQ ID NO: 1479481 - RNA, 15 nt, Pseudomonas aeruginosa PA01
ccuuccagaacgccg

SEQ ID NO: 1479482 - RNA, 17 nt, Pseudomonas aeruginosa PA01
ccuuccagaacgccgcg

SEQ ID NO: 1479483 - RNA, 20 nt, Pseudomonas aeruginosa PA01
ccuuccagcccuucgacguc

SEQ ID NO: 1479484 - RNA, 13 nt, Pseudomonas aeruginosa PA01
ccuuccagccgcc

SEQ ID NO: 1479485 - RNA, 12 nt, Pseudomonas aeruginosa PA01
ccuuccaggcgu

SEQ ID NO: 1479486 - RNA, 22 nt, Pseudomonas aeruginosa PA01
ccuucaaaggaaucuucggcgc

SEQ ID NO: 1479487 - RNA, 16 nt, Pseudomonas aeruginosa PA01
ccugugccuuggcucc

SEQ ID NO: 1479488 - RNA, 15 nt, Pseudomonas aeruginosa PA01
ccuguugcuggccgg

SEQ ID NO: 1479489 - RNA, 23 nt, Pseudomonas aeruginosa PA01
ccuguucggcgcugaccucgaug

SEQ ID NO: 1479490 - RNA, 22 nt, Pseudomonas aeruginosa PA01
ccuuagacccacugaagacccg

SEQ ID NO: 1479491 - RNA, 18 nt, Pseudomonas aeruginosa PA01
ccuggccagcgucgccug

SEQ ID NO: 1479492 - RNA, 21 nt, Pseudomonas aeruginosa PA01
ccuggccagcgucgccugcca

SEQ ID NO: 1479493 - RNA, 14 nt, Pseudomonas aeruginosa PA01
ccuggccaggcgcu

SEQ ID NO: 1479494 - RNA, 19 nt, Pseudomonas aeruginosa PA01
ccuggcauggcuuuccagg

SEQ ID NO: 1479495 - RNA, 16 nt, Pseudomonas aeruginosa PA01
ccuggccacgcccggu

SEQ ID NO: 1479496 - RNA, 17 nt, Pseudomonas aeruginosa PA01
ccuggauggugcccggg

SEQ ID NO: 1479497 - RNA, 17 nt, Pseudomonas aeruginosa PA01
ccuggaugcuccgcgcc

SEQ ID NO: 1479498 - RNA, 17 nt, Pseudomonas aeruginosa PA01
ccuggcagacgcugcuc

SEQ ID NO: 1479499 - RNA, 18 nt, Pseudomonas aeruginosa PA01
ccuggcaggcucaccgcg

SEQ ID NO: 1479500 - RNA, 22 nt, Pseudomonas aeruginosa PA01
ccuggcagguaucgcugggcgc

SEQ ID NO: 1479501 - RNA, 23 nt, Pseudomonas aeruginosa PA01
ccuggcagguaucgcugggcgcc

SEQ ID NO: 1479502 - RNA, 16 nt, Pseudomonas aeruginosa PA01
ccugucgcuccggcag

SEQ ID NO: 1479503 - RNA, 17 nt, Pseudomonas aeruginosa PA01
ccugucggcucgcgccg

SEQ ID NO: 1479504 - RNA, 20 nt, Pseudomonas aeruginosa PA01
ccugucggcucgcgccggcg

SEQ ID NO: 1479505 - RNA, 18 nt, Pseudomonas aeruginosa PA01
ccugugcugcgcgccgca

SEQ ID NO: 1479506 - RNA, 18 nt, Pseudomonas aeruginosa PA01
ccuguggcguuauucgcc

SEQ ID NO: 1479507 - RNA, 16 nt, Pseudomonas aeruginosa PA01
ccuguucgcgcccguc

SEQ ID NO: 1479508 - RNA, 16 nt, Pseudomonas aeruginosa PA01
ccuugaacucgcccgg

SEQ ID NO: 1479509 - RNA, 17 nt, Pseudomonas aeruginosa PA01
ccuugaacucgcccggc

SEQ ID NO: 1479510 - RNA, 18 nt, Pseudomonas aeruginosa PA01
ccuugaacucgcccggcu

SEQ ID NO: 1479511 - RNA, 13 nt, Pseudomonas aeruginosa PA01
ccuugccgcgacc

SEQ ID NO: 1479512 - RNA, 14 nt, Pseudomonas aeruginosa PA01
ccuugcgcaccagg

SEQ ID NO: 1479513 - RNA, 12 nt, Pseudomonas aeruginosa PA01
ccuugcgcaccg

SEQ ID NO: 1479514 - RNA, 23 nt, Pseudomonas aeruginosa PA01
ccuugcgcagcaacgcgacgauc

SEQ ID NO: 1479515 - RNA, 16 nt, Pseudomonas aeruginosa PA01
ccuugccguaguggcg

SEQ ID NO: 1479516 - RNA, 21 nt, Pseudomonas aeruginosa PA01
ccuugccguugcucacgccga

SEQ ID NO: 1479517 - RNA, 18 nt, Pseudomonas aeruginosa PA01
ccuugcgaaaagcccgcc

SEQ ID NO: 1479518 - RNA, 18 nt, Pseudomonas aeruginosa PA01
ccuucgagaaacugcagg

SEQ ID NO: 1479519 - RNA, 19 nt, Pseudomonas aeruginosa PA01
ccuucucgucgccgcccgg

SEQ ID NO: 1479520 - RNA, 13 nt, Pseudomonas aeruginosa PA01
ccuuggcggcgcc

SEQ ID NO: 1479521 - RNA, 13 nt, Pseudomonas aeruginosa PA01
ccuuggcgcgacu

SEQ ID NO: 1479522 - RNA, 15 nt, Pseudomonas aeruginosa PA01
ccuugggaucggcga

SEQ ID NO: 1479523 - RNA, 19 nt, Pseudomonas aeruginosa PA01
ccuugggaucggcgaucag

SEQ ID NO: 1479524 - RNA, 17 nt, Pseudomonas aeruginosa PA01
ccuuggcuuccuggcgc

SEQ ID NO: 1479525 - RNA, 15 nt, Pseudomonas aeruginosa PA01
ccuugcgcggcgccg

SEQ ID NO: 1479526 - RNA, 19 nt, Pseudomonas aeruginosa PA01
ccuugcgcuguuccgccgu

SEQ ID NO: 1479527 - RNA, 12 nt, Pseudomonas aeruginosa PA01
ccuugcgccagg

SEQ ID NO: 1479528 - RNA, 19 nt, Pseudomonas aeruginosa PA01
ccuugcgccaggcccggcg

SEQ ID NO: 1479529 - RNA, 21 nt, Pseudomonas aeruginosa PA01
ccuugcgccaggcccggcgcu

SEQ ID NO: 1479530 - RNA, 23 nt, Pseudomonas aeruginosa PA01
ccuugcgccaggcccggcgcugc

SEQ ID NO: 1479531 - RNA, 23 nt, Pseudomonas aeruginosa PA01
ccuugcgaccagguccggagggc

SEQ ID NO: 1479532 - RNA, 11 nt, Pseudomonas aeruginosa PA01
ccuugcgcagg

SEQ ID NO: 1479533 - RNA, 21 nt, Pseudomonas aeruginosa PA01
ccuugcgcagguacucgccgg

SEQ ID NO: 1479534 - RNA, 16 nt, Pseudomonas aeruginosa PA01
ccuuggccagcgcggc

SEQ ID NO: 1479535 - RNA, 12 nt, Pseudomonas aeruginosa PA01
ccuugcggcgcc

SEQ ID NO: 1479536 - RNA, 13 nt, Pseudomonas aeruginosa PA01
ccuugcggcagac

SEQ ID NO: 1479537 - RNA, 17 nt, Pseudomonas aeruginosa PA01
ccuugcggcagacgugc

SEQ ID NO: 1479538 - RNA, 20 nt, Pseudomonas aeruginosa PA01
ccuugcggcagacgugcugg

SEQ ID NO: 1479539 - RNA, 15 nt, Pseudomonas aeruginosa PA01
ccuugcggcccgccu

SEQ ID NO: 1479540 - RNA, 18 nt, Pseudomonas aeruginosa PA01
ccuuggucaggccgacca

SEQ ID NO: 1479541 - RNA, 13 nt, Pseudomonas aeruginosa PA01
ccuuguucggcug

SEQ ID NO: 1479542 - RNA, 21 nt, Pseudomonas aeruginosa PA01
ccuugucguuguagaacacgg

SEQ ID NO: 1479543 - RNA, 15 nt, Pseudomonas aeruginosa PA01
ccuugugcgccagcu

SEQ ID NO: 1479544 - RNA, 20 nt, Pseudomonas aeruginosa PA01
ccuugucgcugaccggccgc

SEQ ID NO: 1479545 - RNA, 15 nt, Pseudomonas aeruginosa PA01
ccuuggugccgaccu

SEQ ID NO: 1479546 - RNA, 15 nt, Pseudomonas aeruginosa PA01
ccuuguccaggcgcu

SEQ ID NO: 1479547 - RNA, 12 nt, Pseudomonas aeruginosa PA01
ccuuguccgggu

SEQ ID NO: 1479548 - RNA, 24 nt, Pseudomonas aeruginosa PA01
ccuugucgaugagccagccugcag

SEQ ID NO: 1479549 - RNA, 16 nt, Pseudomonas aeruginosa PA01
ccuugucgcaccagcc

SEQ ID NO: 1479550 - RNA, 15 nt, Pseudomonas aeruginosa PA01
ccuugucgcagcggc

SEQ ID NO: 1479551 - RNA, 16 nt, Pseudomonas aeruginosa PA01
ccuugucgcagcggcc

SEQ ID NO: 1479552 - RNA, 13 nt, Pseudomonas aeruginosa PA01
ccuugucgccgcu

SEQ ID NO: 1479553 - RNA, 14 nt, Pseudomonas aeruginosa PA01
ccuugucgccgcug

SEQ ID NO: 1479554 - RNA, 15 nt, Pseudomonas aeruginosa PA01
ccuugucgccgcugg

SEQ ID NO: 1479555 - RNA, 17 nt, Pseudomonas aeruginosa PA01
cgaaacgguagcccgcg

SEQ ID NO: 1479556 - RNA, 23 nt, Pseudomonas aeruginosa PA01
ccuuuuucauucuccagccgcac

SEQ ID NO: 1479557 - RNA, 15 nt, Pseudomonas aeruginosa PA01
cgaaacguccggcgu

SEQ ID NO: 1479558 - RNA, 15 nt, Pseudomonas aeruginosa PA01
cgaaacucaucaggc

SEQ ID NO: 1479559 - RNA, 21 nt, Pseudomonas aeruginosa PA01
cgaaacucaucaggcugccga

SEQ ID NO: 1479560 - RNA, 22 nt, Pseudomonas aeruginosa PA01
cgaaacucaucaggcugccgag

SEQ ID NO: 1479561 - RNA, 15 nt, Pseudomonas aeruginosa PA01
cgaaacuccagcagg

SEQ ID NO: 1479562 - RNA, 19 nt, Pseudomonas aeruginosa PA01
ccuuguucaggguggcgac

SEQ ID NO: 1479563 - RNA, 19 nt, Pseudomonas aeruginosa PA01
ccuuuucggcggccaggcg

SEQ ID NO: 1479564 - RNA, 18 nt, Pseudomonas aeruginosa PA01
ccuuuucuuuggcgacga

SEQ ID NO: 1479565 - RNA, 16 nt, Pseudomonas aeruginosa PA01
cgaacacgucggcgcg

SEQ ID NO: 1479566 - RNA, 14 nt, Pseudomonas aeruginosa PA01
cgaacagcaacacc

SEQ ID NO: 1479567 - RNA, 20 nt, Pseudomonas aeruginosa PA01
cgaacagcaacaccgcgcag

SEQ ID NO: 1479568 - RNA, 18 nt, Pseudomonas aeruginosa PA01
cgaacaccgggccgccgg

SEQ ID NO: 1479569 - RNA, 19 nt, Pseudomonas aeruginosa PA01
cgaacaccgggccgccggc

SEQ ID NO: 1479570 - RNA, 21 nt, Pseudomonas aeruginosa PA01
cgaacaccgggccgccggcga

SEQ ID NO: 1479571 - RNA, 20 nt, Pseudomonas aeruginosa PA01
cgaaagacgcugcgaccugg

SEQ ID NO: 1479572 - RNA, 13 nt, Pseudomonas aeruginosa PA01
cgaaagccgccgc

SEQ ID NO: 1479573 - RNA, 19 nt, Pseudomonas aeruginosa PA01
cgaaagccgccgccgcgcc

SEQ ID NO: 1479574 - RNA, 19 nt, Pseudomonas aeruginosa PA01
cgaacagggucuucaggcc

SEQ ID NO: 1479575 - RNA, 23 nt, Pseudomonas aeruginosa PA01
cgaacaggguggugucguugcgc

SEQ ID NO: 1479576 - RNA, 20 nt, Pseudomonas aeruginosa PA01
cgaacaggcgacgguaccag

SEQ ID NO: 1479577 - RNA, 15 nt, Pseudomonas aeruginosa PA01
cgaacagcuugccgu

SEQ ID NO: 1479578 - RNA, 15 nt, Pseudomonas aeruginosa PA01
cgaacaggcagcggg

SEQ ID NO: 1479579 - RNA, 18 nt, Pseudomonas aeruginosa PA01
cgaacagcuccuccagcc

SEQ ID NO: 1479580 - RNA, 22 nt, Pseudomonas aeruginosa PA01
cgaacagcuccuccagccgcgg

SEQ ID NO: 1479581 - RNA, 14 nt, Pseudomonas aeruginosa PA01
cgaacagcgcuucc

SEQ ID NO: 1479582 - RNA, 20 nt, Pseudomonas aeruginosa PA01
cgaacagccagcgguugagc

SEQ ID NO: 1479583 - RNA, 17 nt, Pseudomonas aeruginosa PA01
cgaacagcgagucgucg

SEQ ID NO: 1479584 - RNA, 17 nt, Pseudomonas aeruginosa PA01
cgaacagcaccuuggcc

SEQ ID NO: 1479585 - RNA, 15 nt, Pseudomonas aeruginosa PA01
cgaacagcacccagg

SEQ ID NO: 1479586 - RNA, 16 nt, Pseudomonas aeruginosa PA01
cgaacagcagcaagcc

SEQ ID NO: 1479587 - RNA, 18 nt, Pseudomonas aeruginosa PA01
cgaacagcagggaggcgc

SEQ ID NO: 1479588 - RNA, 17 nt, Pseudomonas aeruginosa PA01
cgaacagcagcgguagg

SEQ ID NO: 1479589 - RNA, 21 nt, Pseudomonas aeruginosa PA01
cgaacagcagcucgccgcuac

SEQ ID NO: 1479590 - RNA, 19 nt, Pseudomonas aeruginosa PA01
cgaaccacgaagaacggcg

SEQ ID NO: 1479591 - RNA, 15 nt, Pseudomonas aeruginosa PA01
cgaaccacucggcgc

SEQ ID NO: 1479592 - RNA, 16 nt, Pseudomonas aeruginosa PA01
cgaaccacugcgccau

SEQ ID NO: 1479593 - RNA, 17 nt, Pseudomonas aeruginosa PA01
cgaaccacugcgccaug

SEQ ID NO: 1479594 - RNA, 15 nt, Pseudomonas aeruginosa PA01
cgaaccagugcaccg

SEQ ID NO: 1479595 - RNA, 21 nt, Pseudomonas aeruginosa PA01
cgaaccaggcaauggccggcg

SEQ ID NO: 1479596 - RNA, 13 nt, Pseudomonas aeruginosa PA01
cgaaccaguccag

SEQ ID NO: 1479597 - RNA, 16 nt, Pseudomonas aeruginosa PA01
cgaaccaguccagcac

SEQ ID NO: 1479598 - RNA, 16 nt, Pseudomonas aeruginosa PA01
cgaaccaggcggccga

SEQ ID NO: 1479599 - RNA, 18 nt, Pseudomonas aeruginosa PA01
cgaaccagggacgcccgg

SEQ ID NO: 1479600 - RNA, 16 nt, Pseudomonas aeruginosa PA01
cgaaccagcucagcuc

SEQ ID NO: 1479601 - RNA, 22 nt, Pseudomonas aeruginosa PA01
cgaaccagcucagcuccaggcc

SEQ ID NO: 1479602 - RNA, 16 nt, Pseudomonas aeruginosa PA01
cgaacccaggcgcugc

SEQ ID NO: 1479603 - RNA, 18 nt, Pseudomonas aeruginosa PA01
cgaaccccgggccgcgca

SEQ ID NO: 1479604 - RNA, 20 nt, Pseudomonas aeruginosa PA01
cgaaccccuggcgcucgaag

SEQ ID NO: 1479605 - RNA, 22 nt, Pseudomonas aeruginosa PA01
cgaaccccaugaaaaaggccgg

SEQ ID NO: 1479606 - RNA, 17 nt, Pseudomonas aeruginosa PA01
cgaacaugagcgauccc

SEQ ID NO: 1479607 - RNA, 15 nt, Pseudomonas aeruginosa PA01
cgaacaucgccagcg

SEQ ID NO: 1479608 - RNA, 17 nt, Pseudomonas aeruginosa PA01
cgaacaugaagccgcgc

SEQ ID NO: 1479609 - RNA, 22 nt, Pseudomonas aeruginosa PA01
cgaacaucauccacagcgugca

SEQ ID NO: 1479610 - RNA, 15 nt, Pseudomonas aeruginosa PA01
cgaacaguucggcgg

SEQ ID NO: 1479611 - RNA, 16 nt, Pseudomonas aeruginosa PA01
cgaacaguucggcggu

SEQ ID NO: 1479612 - RNA, 20 nt, Pseudomonas aeruginosa PA01
cgaacaggcugugcgccagg

SEQ ID NO: 1479613 - RNA, 22 nt, Pseudomonas aeruginosa PA01
cgaacagggccaucagggcgaa

SEQ ID NO: 1479614 - RNA, 18 nt, Pseudomonas aeruginosa PA01
cgaacagguggcuuucca

SEQ ID NO: 1479615 - RNA, 18 nt, Pseudomonas aeruginosa PA01
cgaacggcgugagggucg

SEQ ID NO: 1479616 - RNA, 22 nt, Pseudomonas aeruginosa PA01
cgaacggcgugagggucgcgcc

SEQ ID NO: 1479617 - RNA, 20 nt, Pseudomonas aeruginosa PA01
cgaacggcguuggcacgacg

SEQ ID NO: 1479618 - RNA, 16 nt, Pseudomonas aeruginosa PA01
cgaacggcuggucggc

SEQ ID NO: 1479619 - RNA, 21 nt, Pseudomonas aeruginosa PA01
cgaacgggcguugccggcauu

SEQ ID NO: 1479620 - RNA, 16 nt, Pseudomonas aeruginosa PA01
cgaacggcggaucgau

SEQ ID NO: 1479621 - RNA, 18 nt, Pseudomonas aeruginosa PA01
cgaacggcggaucgauca

SEQ ID NO: 1479622 - RNA, 19 nt, Pseudomonas aeruginosa PA01
cgaacggcggaucgaucag

SEQ ID NO: 1479623 - RNA, 14 nt, Pseudomonas aeruginosa PA01
cgaacugcacccgc

SEQ ID NO: 1479624 - RNA, 16 nt, Pseudomonas aeruginosa PA01
cgaacugcacccgccg

SEQ ID NO: 1479625 - RNA, 13 nt, Pseudomonas aeruginosa PA01
cgaacugcacgcc

SEQ ID NO: 1479626 - RNA, 14 nt, Pseudomonas aeruginosa PA01
cgaacuggccaccg

SEQ ID NO: 1479627 - RNA, 17 nt, Pseudomonas aeruginosa PA01
cgaacuggccagcacca

SEQ ID NO: 1479628 - RNA, 20 nt, Pseudomonas aeruginosa PA01
cgaacugcagggcgucgccg

SEQ ID NO: 1479629 - RNA, 18 nt, Pseudomonas aeruginosa PA01
cgaacugcauggccuugu

SEQ ID NO: 1479630 - RNA, 22 nt, Pseudomonas aeruginosa PA01
cgaagaccuugaacucgcccgg

SEQ ID NO: 1479631 - RNA, 16 nt, Pseudomonas aeruginosa PA01
cgaagaacacgcccca

SEQ ID NO: 1479632 - RNA, 18 nt, Pseudomonas aeruginosa PA01
cgaacuucaggccggcgc

SEQ ID NO: 1479633 - RNA, 18 nt, Pseudomonas aeruginosa PA01
cgaagaaaaggcccggcg

SEQ ID NO: 1479634 - RNA, 16 nt, Pseudomonas aeruginosa PA01
cgaagaaagccccugc

SEQ ID NO: 1479635 - RNA, 17 nt, Pseudomonas aeruginosa PA01
cgaagagcuggcggccg

SEQ ID NO: 1479636 - RNA, 21 nt, Pseudomonas aeruginosa PA01
cgaagagcaccuugucgcuga

SEQ ID NO: 1479637 - RNA, 17 nt, Pseudomonas aeruginosa PA01
cgaagaggcccucggcg

SEQ ID NO: 1479638 - RNA, 22 nt, Pseudomonas aeruginosa PA01
cgaagaggcccucggcgccgag

SEQ ID NO: 1479639 - RNA, 20 nt, Pseudomonas aeruginosa PA01
cgaagauacccagcgggcaa

SEQ ID NO: 1479640 - RNA, 18 nt, Pseudomonas aeruginosa PA01
cgaagaucaccggggccu

SEQ ID NO: 1479641 - RNA, 12 nt, Pseudomonas aeruginosa PA01
cgaacggcaucu

SEQ ID NO: 1479642 - RNA, 12 nt, Pseudomonas aeruginosa PA01
cgaacgccaggc

SEQ ID NO: 1479643 - RNA, 20 nt, Pseudomonas aeruginosa PA01
cgaacgccaggcaggcgguc

SEQ ID NO: 1479644 - RNA, 22 nt, Pseudomonas aeruginosa PA01
cgaacgccgcccgucgcgccgg

SEQ ID NO: 1479645 - RNA, 14 nt, Pseudomonas aeruginosa PA01
cgaacgccgcagcu

SEQ ID NO: 1479646 - RNA, 18 nt, Pseudomonas aeruginosa PA01
cgaacgccgcagcucggc

SEQ ID NO: 1479647 - RNA, 22 nt, Pseudomonas aeruginosa PA01
cgaacgaggcgaggguggcgcc

SEQ ID NO: 1479648 - RNA, 18 nt, Pseudomonas aeruginosa PA01
cgaacgaggcucggucgc

SEQ ID NO: 1479649 - RNA, 20 nt, Pseudomonas aeruginosa PA01
cgaacgagaagccgaucagg

SEQ ID NO: 1479650 - RNA, 12 nt, Pseudomonas aeruginosa PA01
cgaacgacagca

SEQ ID NO: 1479651 - RNA, 14 nt, Pseudomonas aeruginosa PA01
cgaacgacagcacc

SEQ ID NO: 1479652 - RNA, 19 nt, Pseudomonas aeruginosa PA01
cgaaccggaaaagaagccg

SEQ ID NO: 1479653 - RNA, 22 nt, Pseudomonas aeruginosa PA01
cgaaccgccggccucgcugccg

SEQ ID NO: 1479654 - RNA, 20 nt, Pseudomonas aeruginosa PA01
cgaaccgagacccuggcgcu

SEQ ID NO: 1479655 - RNA, 21 nt, Pseudomonas aeruginosa PA01
cgagacuugaucgcacggcgg

SEQ ID NO: 1479656 - RNA, 19 nt, Pseudomonas aeruginosa PA01
cgagagcggcgccaggcgu

SEQ ID NO: 1479657 - RNA, 12 nt, Pseudomonas aeruginosa PA01
cgagagcgcugc

SEQ ID NO: 1479658 - RNA, 16 nt, Pseudomonas aeruginosa PA01
cgagagcgcugccgca

SEQ ID NO: 1479659 - RNA, 20 nt, Pseudomonas aeruginosa PA01
cgagagcuguccggcgcuga

SEQ ID NO: 1479660 - RNA, 21 nt, Pseudomonas aeruginosa PA01
cgagaggaagucgcuucaccg

SEQ ID NO: 1479661 - RNA, 17 nt, Pseudomonas aeruginosa PA01
cgagagcgccgaccagc

SEQ ID NO: 1479662 - RNA, 16 nt, Pseudomonas aeruginosa PA01
cgagaggguggucgcg

SEQ ID NO: 1479663 - RNA, 22 nt, Pseudomonas aeruginosa PA01
cgacugcaugaccuccagggcc

SEQ ID NO: 1479664 - RNA, 16 nt, Pseudomonas aeruginosa PA01
cgacugcaugaugccg

SEQ ID NO: 1479665 - RNA, 14 nt, Pseudomonas aeruginosa PA01
cgacugccgucggc

SEQ ID NO: 1479666 - RNA, 20 nt, Pseudomonas aeruginosa PA01
cgacugccgucggcgcccuu

SEQ ID NO: 1479667 - RNA, 19 nt, Pseudomonas aeruginosa PA01
cgacugcggcagcuuggcg

SEQ ID NO: 1479668 - RNA, 21 nt, Pseudomonas aeruginosa PA01
cgagacgugaagccccuggcg

SEQ ID NO: 1479669 - RNA, 17 nt, Pseudomonas aeruginosa PA01
cgagacuaccgaucggc

SEQ ID NO: 1479670 - RNA, 15 nt, Pseudomonas aeruginosa PA01
cgacucuccgcgccg

SEQ ID NO: 1479671 - RNA, 18 nt, Pseudomonas aeruginosa PA01
cgacucuccgcgccgcgg

SEQ ID NO: 1479672 - RNA, 19 nt, Pseudomonas aeruginosa PA01
cgacucgucgccccacagc

SEQ ID NO: 1479673 - RNA, 16 nt, Pseudomonas aeruginosa PA01
cgacucguugcacgca

SEQ ID NO: 1479674 - RNA, 22 nt, Pseudomonas aeruginosa PA01
cgacucguugcacgcaggccgc

SEQ ID NO: 1479675 - RNA, 20 nt, Pseudomonas aeruginosa PA01
cgacugcacgcagacgucga

SEQ ID NO: 1479676 - RNA, 16 nt, Pseudomonas aeruginosa PA01
cgacugcaacuggccg

SEQ ID NO: 1479677 - RNA, 18 nt, Pseudomonas aeruginosa PA01
cgacugcaacuggccgag

SEQ ID NO: 1479678 - RNA, 18 nt, Pseudomonas aeruginosa PA01
cgacugacgguggaggcg

SEQ ID NO: 1479679 - RNA, 18 nt, Pseudomonas aeruginosa PA01
cgagcaauccggcgcugc

SEQ ID NO: 1479680 - RNA, 20 nt, Pseudomonas aeruginosa PA01
cgagcaauccggcgcugccg

SEQ ID NO: 1479681 - RNA, 22 nt, Pseudomonas aeruginosa PA01
cgagcacggcgaacaccgggcc

SEQ ID NO: 1479682 - RNA, 22 nt, Pseudomonas aeruginosa PA01
cgagaugcucgcgcagcgacuc

SEQ ID NO: 1479683 - RNA, 24 nt, Pseudomonas aeruginosa PA01
cgagaugcugcgggcgccgccgcu

SEQ ID NO: 1479684 - RNA, 17 nt, Pseudomonas aeruginosa PA01
cgagauucugcaggcgc

SEQ ID NO: 1479685 - RNA, 18 nt, Pseudomonas aeruginosa PA01
cgagauuggccgccugcu

SEQ ID NO: 1479686 - RNA, 14 nt, Pseudomonas aeruginosa PA01
cgagcaacggcagc

SEQ ID NO: 1479687 - RNA, 20 nt, Pseudomonas aeruginosa PA01
cgagcaagccuuccagguag

SEQ ID NO: 1479688 - RNA, 21 nt, Pseudomonas aeruginosa PA01
cgagcaagccuuccagguagu

SEQ ID NO: 1479689 - RNA, 16 nt, Pseudomonas aeruginosa PA01
cgagcaacucggcggc

SEQ ID NO: 1479690 - RNA, 21 nt, Pseudomonas aeruginosa PA01
cgagcaggaagaagccgauca

SEQ ID NO: 1479691 - RNA, 14 nt, Pseudomonas aeruginosa PA01
cgagcaggcacccg

SEQ ID NO: 1479692 - RNA, 16 nt, Pseudomonas aeruginosa PA01
cgagcagcucguucgc

SEQ ID NO: 1479693 - RNA, 20 nt, Pseudomonas aeruginosa PA01
cgagcaggccgaggaggacg

SEQ ID NO: 1479694 - RNA, 19 nt, Pseudomonas aeruginosa PA01
cgagcaggccuugcagggc

SEQ ID NO: 1479695 - RNA, 20 nt, Pseudomonas aeruginosa PA01
cgagcaggcgcgccaggccc

SEQ ID NO: 1479696 - RNA, 21 nt, Pseudomonas aeruginosa PA01
cgagcagggagaaccaggcgg

SEQ ID NO: 1479697 - RNA, 23 nt, Pseudomonas aeruginosa PA01
cgagcagggaggagggcgagguc

SEQ ID NO: 1479698 - RNA, 15 nt, Pseudomonas aeruginosa PA01
cgagcagggcacagc

SEQ ID NO: 1479699 - RNA, 14 nt, Pseudomonas aeruginosa PA01
cgagcagcucgccg

SEQ ID NO: 1479700 - RNA, 15 nt, Pseudomonas aeruginosa PA01
cgagcagcucgccgg

SEQ ID NO: 1479701 - RNA, 16 nt, Pseudomonas aeruginosa PA01
cgagcagcucgccggc

SEQ ID NO: 1479702 - RNA, 17 nt, Pseudomonas aeruginosa PA01
cgagcagcucgccggcg

SEQ ID NO: 1479703 - RNA, 21 nt, Pseudomonas aeruginosa PA01
cgagcagcucgccggcguccu

SEQ ID NO: 1479704 - RNA, 19 nt, Pseudomonas aeruginosa PA01
cgagcagcggacgcagcgg

SEQ ID NO: 1479705 - RNA, 15 nt, Pseudomonas aeruginosa PA01
cgagcagcggcacgc

SEQ ID NO: 1479706 - RNA, 17 nt, Pseudomonas aeruginosa PA01
cgagcagcggcacgcuc

SEQ ID NO: 1479707 - RNA, 13 nt, Pseudomonas aeruginosa PA01
cgagcagcggcgc

SEQ ID NO: 1479708 - RNA, 15 nt, Pseudomonas aeruginosa PA01
cgagcagcggcgcca

SEQ ID NO: 1479709 - RNA, 20 nt, Pseudomonas aeruginosa PA01
cgagcagcggcgccaacucg

SEQ ID NO: 1479710 - RNA, 14 nt, Pseudomonas aeruginosa PA01
cgagcagcggcgcg

SEQ ID NO: 1479711 - RNA, 20 nt, Pseudomonas aeruginosa PA01
cgagcagcggcgcgccaugc

SEQ ID NO: 1479712 - RNA, 20 nt, Pseudomonas aeruginosa PA01
cgagcaucagcaauuccgca

SEQ ID NO: 1479713 - RNA, 23 nt, Pseudomonas aeruginosa PA01
cgagcaucugccgggcgcgcugg

SEQ ID NO: 1479714 - RNA, 15 nt, Pseudomonas aeruginosa PA01
cgagcaugcgggcga

SEQ ID NO: 1479715 - RNA, 19 nt, Pseudomonas aeruginosa PA01
cgagcaugcucacugcgag

SEQ ID NO: 1479716 - RNA, 15 nt, Pseudomonas aeruginosa PA01
cgagcaugucgcuga

SEQ ID NO: 1479717 - RNA, 17 nt, Pseudomonas aeruginosa PA01
cgagcauuccucagcgc

SEQ ID NO: 1479718 - RNA, 20 nt, Pseudomonas aeruginosa PA01
cgagcauuccucagcgccgg

SEQ ID NO: 1479719 - RNA, 14 nt, Pseudomonas aeruginosa PA01
cgagcccggccggg

SEQ ID NO: 1479720 - RNA, 15 nt, Pseudomonas aeruginosa PA01
cgagcccccggcgcc

SEQ ID NO: 1479721 - RNA, 15 nt, Pseudomonas aeruginosa PA01
cgagccguuccaggc

SEQ ID NO: 1479722 - RNA, 21 nt, Pseudomonas aeruginosa PA01
cgagccguuccaggcggggcg

SEQ ID NO: 1479723 - RNA, 13 nt, Pseudomonas aeruginosa PA01
cgagccuggccag

SEQ ID NO: 1479724 - RNA, 14 nt, Pseudomonas aeruginosa PA01
cgagccuggccagg

SEQ ID NO: 1479725 - RNA, 17 nt, Pseudomonas aeruginosa PA01
cgagccuggccaggcgc

SEQ ID NO: 1479726 - RNA, 19 nt, Pseudomonas aeruginosa PA01
cgagccuggccaggcgcuc

SEQ ID NO: 1479727 - RNA, 20 nt, Pseudomonas aeruginosa PA01
cgagccuggccaggcgcucc

SEQ ID NO: 1479728 - RNA, 16 nt, Pseudomonas aeruginosa PA01
cgagccuucagcacgg

SEQ ID NO: 1479729 - RNA, 16 nt, Pseudomonas aeruginosa PA01
cgagccguccugcggc

SEQ ID NO: 1479730 - RNA, 18 nt, Pseudomonas aeruginosa PA01
cgagccguccugcggccg

SEQ ID NO: 1479731 - RNA, 19 nt, Pseudomonas aeruginosa PA01
cgagccguccugcggccgc

SEQ ID NO: 1479732 - RNA, 20 nt, Pseudomonas aeruginosa PA01
cgagccguccugcggccgca

SEQ ID NO: 1479733 - RNA, 17 nt, Pseudomonas aeruginosa PA01
cgagcgaaaucggcagg

SEQ ID NO: 1479734 - RNA, 19 nt, Pseudomonas aeruginosa PA01
cgagcgacggugauagagc

SEQ ID NO: 1479735 - RNA, 12 nt, Pseudomonas aeruginosa PA01
cgagcgacugga

SEQ ID NO: 1479736 - RNA, 15 nt, Pseudomonas aeruginosa PA01
cgagcgagcggcaga

SEQ ID NO: 1479737 - RNA, 12 nt, Pseudomonas aeruginosa PA01
cgagccgagcag

SEQ ID NO: 1479738 - RNA, 16 nt, Pseudomonas aeruginosa PA01
cgagccgagcaggcca

SEQ ID NO: 1479739 - RNA, 13 nt, Pseudomonas aeruginosa PA01
cgagccgagcaug

SEQ ID NO: 1479740 - RNA, 18 nt, Pseudomonas aeruginosa PA01
cgagcaugaugcaggcag

SEQ ID NO: 1479741 - RNA, 16 nt, Pseudomonas aeruginosa PA01
cgagcccuggucgaca

SEQ ID NO: 1479742 - RNA, 16 nt, Pseudomonas aeruginosa PA01
cgagcugaccaccagg

SEQ ID NO: 1479743 - RNA, 20 nt, Pseudomonas aeruginosa PA01
cgagcugaccaccagggcga

SEQ ID NO: 1479744 - RNA, 17 nt, Pseudomonas aeruginosa PA01
cgagcugaucgcgcaga

SEQ ID NO: 1479745 - RNA, 20 nt, Pseudomonas aeruginosa PA01
cgagcugccccucguggcgc

SEQ ID NO: 1479746 - RNA, 22 nt, Pseudomonas aeruginosa PA01
cgagcugccccucguggcgcga

SEQ ID NO: 1479747 - RNA, 14 nt, Pseudomonas aeruginosa PA01
cgagcugccgcacc

SEQ ID NO: 1479748 - RNA, 17 nt, Pseudomonas aeruginosa PA01
cgagcugccgcaccgcc

SEQ ID NO: 1479749 - RNA, 21 nt, Pseudomonas aeruginosa PA01
cgagcugccgcaccgccucga

SEQ ID NO: 1479750 - RNA, 23 nt, Pseudomonas aeruginosa PA01
cgagcugccgcaccgccucgauc

SEQ ID NO: 1479751 - RNA, 17 nt, Pseudomonas aeruginosa PA01
cgagcugcucgauggcg

SEQ ID NO: 1479752 - RNA, 19 nt, Pseudomonas aeruginosa PA01
cgagcugccgggcgagcug

SEQ ID NO: 1479753 - RNA, 16 nt, Pseudomonas aeruginosa PA01
cgagcuggcgcaggcc

SEQ ID NO: 1479754 - RNA, 19 nt, Pseudomonas aeruginosa PA01
cgagcuggcgcaggccuuc

SEQ ID NO: 1479755 - RNA, 16 nt, Pseudomonas aeruginosa PA01
cgagcugggcguugcc

SEQ ID NO: 1479756 - RNA, 18 nt, Pseudomonas aeruginosa PA01
cgagcugggucacuccgc

SEQ ID NO: 1479757 - RNA, 19 nt, Pseudomonas aeruginosa PA01
cgagcuuggccacuccggg

SEQ ID NO: 1479758 - RNA, 18 nt, Pseudomonas aeruginosa PA01
cgagcuuggcccuggccu

SEQ ID NO: 1479759 - RNA, 20 nt, Pseudomonas aeruginosa PA01
cgagcuuggcccuggccuug

SEQ ID NO: 1479760 - RNA, 15 nt, Pseudomonas aeruginosa PA01
cgagcuugcaauccg

SEQ ID NO: 1479761 - RNA, 14 nt, Pseudomonas aeruginosa PA01
cgagcuugccgagg

SEQ ID NO: 1479762 - RNA, 21 nt, Pseudomonas aeruginosa PA01
cgagcuguccaucucgccgcg

SEQ ID NO: 1479763 - RNA, 21 nt, Pseudomonas aeruginosa PA01
cgagcugauugagggucagcu

SEQ ID NO: 1479764 - RNA, 14 nt, Pseudomonas aeruginosa PA01
cgagcgcggccggc

SEQ ID NO: 1479765 - RNA, 15 nt, Pseudomonas aeruginosa PA01
cgagcgcggccggcc

SEQ ID NO: 1479766 - RNA, 19 nt, Pseudomonas aeruginosa PA01
cgagcgcggccggccacgc

SEQ ID NO: 1479767 - RNA, 22 nt, Pseudomonas aeruginosa PA01
cgagcguuucgcggaaggcguc

SEQ ID NO: 1479768 - RNA, 14 nt, Pseudomonas aeruginosa PA01
cgagcguucggauc

SEQ ID NO: 1479769 - RNA, 21 nt, Pseudomonas aeruginosa PA01
cgagcguucggaucggcccgg

SEQ ID NO: 1479770 - RNA, 17 nt, Pseudomonas aeruginosa PA01
cgagcgucgagucgcgc

SEQ ID NO: 1479771 - RNA, 18 nt, Pseudomonas aeruginosa PA01
cgagcgugcgcaugcccg

SEQ ID NO: 1479772 - RNA, 17 nt, Pseudomonas aeruginosa PA01
cgagcgcuccaccgcgc

SEQ ID NO: 1479773 - RNA, 13 nt, Pseudomonas aeruginosa PA01
cgagcguccgccg

SEQ ID NO: 1479774 - RNA, 16 nt, Pseudomonas aeruginosa PA01
cgagcguccgccgccg

SEQ ID NO: 1479775 - RNA, 14 nt, Pseudomonas aeruginosa PA01
cgaggccggcgaag

SEQ ID NO: 1479776 - RNA, 15 nt, Pseudomonas aeruginosa PA01
cgaggccggcgauca

SEQ ID NO: 1479777 - RNA, 12 nt, Pseudomonas aeruginosa PA01
cgaggccgccca

SEQ ID NO: 1479778 - RNA, 16 nt, Pseudomonas aeruginosa PA01
cgaggccgcccagcgc

SEQ ID NO: 1479779 - RNA, 17 nt, Pseudomonas aeruginosa PA01
cgaggccgcccagcgca

SEQ ID NO: 1479780 - RNA, 20 nt, Pseudomonas aeruginosa PA01
cgaggccgcccagcgcagcc

SEQ ID NO: 1479781 - RNA, 21 nt, Pseudomonas aeruginosa PA01
cgaggccgcggagcaccgcgc

SEQ ID NO: 1479782 - RNA, 22 nt, Pseudomonas aeruginosa PA01
cgaggccgcggagcaccgcgcc

SEQ ID NO: 1479783 - RNA, 14 nt, Pseudomonas aeruginosa PA01
cgaggcgacccggg

SEQ ID NO: 1479784 - RNA, 20 nt, Pseudomonas aeruginosa PA01
cgaggcgaguaccaccgugc

SEQ ID NO: 1479785 - RNA, 22 nt, Pseudomonas aeruginosa PA01
cgaggcgauguugacgauggcg

SEQ ID NO: 1479786 - RNA, 16 nt, Pseudomonas aeruginosa PA01
cgaggcgaucgccgcg

SEQ ID NO: 1479787 - RNA, 19 nt, Pseudomonas aeruginosa PA01
cgaggcgaucgccgcggcg

SEQ ID NO: 1479788 - RNA, 16 nt, Pseudomonas aeruginosa PA01
cgaggcgcccgccggc

SEQ ID NO: 1479789 - RNA, 13 nt, Pseudomonas aeruginosa PA01
cgaggcgccgacc

SEQ ID NO: 1479790 - RNA, 13 nt, Pseudomonas aeruginosa PA01
cgaggcgcgccga

SEQ ID NO: 1479791 - RNA, 15 nt, Pseudomonas aeruginosa PA01
cgaggcgcgccgaca

SEQ ID NO: 1479792 - RNA, 12 nt, Pseudomonas aeruginosa PA01
cgaggcgcgccu

SEQ ID NO: 1479793 - RNA, 21 nt, Pseudomonas aeruginosa PA01
cgaggccaggaucgucggccc

SEQ ID NO: 1479794 - RNA, 22 nt, Pseudomonas aeruginosa PA01
cgaggccaggaucgucggcccg

SEQ ID NO: 1479795 - RNA, 13 nt, Pseudomonas aeruginosa PA01
cgaggccaggccg

SEQ ID NO: 1479796 - RNA, 15 nt, Pseudomonas aeruginosa PA01
cgaggccaggccgag

SEQ ID NO: 1479797 - RNA, 22 nt, Pseudomonas aeruginosa PA01
cgaggccaggccgagcgccagg

SEQ ID NO: 1479798 - RNA, 23 nt, Pseudomonas aeruginosa PA01
cgaggccaggccgagcgccaggg

SEQ ID NO: 1479799 - RNA, 13 nt, Pseudomonas aeruginosa PA01
cgaggccagcagg

SEQ ID NO: 1479800 - RNA, 14 nt, Pseudomonas aeruginosa PA01
cgaggccagcaggc

SEQ ID NO: 1479801 - RNA, 20 nt, Pseudomonas aeruginosa PA01
cgaggccauccccgaggcga

SEQ ID NO: 1479802 - RNA, 12 nt, Pseudomonas aeruginosa PA01
cgaggcccgcgc

SEQ ID NO: 1479803 - RNA, 15 nt, Pseudomonas aeruginosa PA01
cgaggcccgcgccgc

SEQ ID NO: 1479804 - RNA, 20 nt, Pseudomonas aeruginosa PA01
cgaggcccgcgccgccggua

SEQ ID NO: 1479805 - RNA, 19 nt, Pseudomonas aeruginosa PA01
cgaggccgagccggcaucc

SEQ ID NO: 1479806 - RNA, 14 nt, Pseudomonas aeruginosa PA01
cgaggcccucggcg

SEQ ID NO: 1479807 - RNA, 15 nt, Pseudomonas aeruginosa PA01
cgaggcccucggcgg

SEQ ID NO: 1479808 - RNA, 23 nt, Pseudomonas aeruginosa PA01
cgaggccgaaauggcgguggccg

SEQ ID NO: 1479809 - RNA, 14 nt, Pseudomonas aeruginosa PA01
cgaggcaaucugcc

SEQ ID NO: 1479810 - RNA, 21 nt, Pseudomonas aeruginosa PA01
cgaggcauucucgcgacccug

SEQ ID NO: 1479811 - RNA, 16 nt, Pseudomonas aeruginosa PA01
cgaggacccggcggaa

SEQ ID NO: 1479812 - RNA, 23 nt, Pseudomonas aeruginosa PA01
cgaggacgaucagcucuuccagg

SEQ ID NO: 1479813 - RNA, 15 nt, Pseudomonas aeruginosa PA01
cgaggacgccgccgg

SEQ ID NO: 1479814 - RNA, 17 nt, Pseudomonas aeruginosa PA01
cgaggaauuccggcagc

SEQ ID NO: 1479815 - RNA, 20 nt, Pseudomonas aeruginosa PA01
cgaggaagucggcggccgcc

SEQ ID NO: 1479816 - RNA, 15 nt, Pseudomonas aeruginosa PA01
cgaggaagccgaccg

SEQ ID NO: 1479817 - RNA, 18 nt, Pseudomonas aeruginosa PA01
cgaggaacauccgcggcc

SEQ ID NO: 1479818 - RNA, 12 nt, Pseudomonas aeruginosa PA01
cgaggaaggcgc

SEQ ID NO: 1479819 - RNA, 19 nt, Pseudomonas aeruginosa PA01
cgaggaaggcgcgcaccag

SEQ ID NO: 1479820 - RNA, 15 nt, Pseudomonas aeruginosa PA01
cgaggaaggcgcugg

SEQ ID NO: 1479821 - RNA, 19 nt, Pseudomonas aeruginosa PA01
cgaggaaggcgcuggcgcu

SEQ ID NO: 1479822 - RNA, 16 nt, Pseudomonas aeruginosa PA01
cgaggaaggccagcag

SEQ ID NO: 1479823 - RNA, 17 nt, Pseudomonas aeruginosa PA01
cgaggaaggccagcagg

SEQ ID NO: 1479824 - RNA, 20 nt, Pseudomonas aeruginosa PA01
cgaggaaggccagcaggguc

SEQ ID NO: 1479825 - RNA, 18 nt, Pseudomonas aeruginosa PA01
cgaggaaggccaggucgc

SEQ ID NO: 1479826 - RNA, 23 nt, Pseudomonas aeruginosa PA01
cgaggaacuccuccucgcuccag

SEQ ID NO: 1479827 - RNA, 19 nt, Pseudomonas aeruginosa PA01
cgaggaaaaggaucgccgc

SEQ ID NO: 1479828 - RNA, 20 nt, Pseudomonas aeruginosa PA01
cgaggaaaaggaucgccgcg

SEQ ID NO: 1479829 - RNA, 17 nt, Pseudomonas aeruginosa PA01
cgaggaacgccgacagg

SEQ ID NO: 1479830 - RNA, 20 nt, Pseudomonas aeruginosa PA01
cgaggaacgccgacaggccg

SEQ ID NO: 1479831 - RNA, 15 nt, Pseudomonas aeruginosa PA01
cgagcuuugcgcagc

SEQ ID NO: 1479832 - RNA, 22 nt, Pseudomonas aeruginosa PA01
cgaggaaaugauguugcgccag

SEQ ID NO: 1479833 - RNA, 15 nt, Pseudomonas aeruginosa PA01
cgaggaacacccaga

SEQ ID NO: 1479834 - RNA, 23 nt, Pseudomonas aeruginosa PA01
cgaggaacacccagaagccgacc

SEQ ID NO: 1479835 - RNA, 15 nt, Pseudomonas aeruginosa PA01
cgaggaacaggucga

SEQ ID NO: 1479836 - RNA, 20 nt, Pseudomonas aeruginosa PA01
cgaggacgugcaccaucgca

SEQ ID NO: 1479837 - RNA, 23 nt, Pseudomonas aeruginosa PA01
cgaggacuuucuugaccauggug

SEQ ID NO: 1479838 - RNA, 16 nt, Pseudomonas aeruginosa PA01
cgaggagacgcggcau

SEQ ID NO: 1479839 - RNA, 17 nt, Pseudomonas aeruginosa PA01
cgaggaggacgauggaa

SEQ ID NO: 1479840 - RNA, 17 nt, Pseudomonas aeruginosa PA01
cgaggaggacgucgcgg

SEQ ID NO: 1479841 - RNA, 20 nt, Pseudomonas aeruginosa PA01
cgaggaggaucucgcgcccc

SEQ ID NO: 1479842 - RNA, 23 nt, Pseudomonas aeruginosa PA01
cgaggaggaugccgaucaccgcc

SEQ ID NO: 1479843 - RNA, 16 nt, Pseudomonas aeruginosa PA01
cgaggauagcguccag

SEQ ID NO: 1479844 - RNA, 20 nt, Pseudomonas aeruginosa PA01
cgaggaucacgcagcaggcg

SEQ ID NO: 1479845 - RNA, 21 nt, Pseudomonas aeruginosa PA01
cgaggaucacgcagcaggcga

SEQ ID NO: 1479846 - RNA, 19 nt, Pseudomonas aeruginosa PA01
cgaggauaccgcacggccg

SEQ ID NO: 1479847 - RNA, 22 nt, Pseudomonas aeruginosa PA01
cgaggauaccgcacggccguca

SEQ ID NO: 1479848 - RNA, 14 nt, Pseudomonas aeruginosa PA01
cgaggaucgccagc

SEQ ID NO: 1479849 - RNA, 23 nt, Pseudomonas aeruginosa PA01
cgaggaucuguuucaacucccag

SEQ ID NO: 1479850 - RNA, 14 nt, Pseudomonas aeruginosa PA01
cgaggaucggcacg

SEQ ID NO: 1479851 - RNA, 15 nt, Pseudomonas aeruginosa PA01
cgaggaugcucgccu

SEQ ID NO: 1479852 - RNA, 23 nt, Pseudomonas aeruginosa PA01
cgaggauggccguccucgucgag

SEQ ID NO: 1479853 - RNA, 16 nt, Pseudomonas aeruginosa PA01
cgaggaugaucagggc

SEQ ID NO: 1479854 - RNA, 14 nt, Pseudomonas aeruginosa PA01
cgaggaugaucggc

SEQ ID NO: 1479855 - RNA, 15 nt, Pseudomonas aeruginosa PA01
cgaggaugaucggcu

SEQ ID NO: 1479856 - RNA, 15 nt, Pseudomonas aeruginosa PA01
cgaggaugucggcga

SEQ ID NO: 1479857 - RNA, 17 nt, Pseudomonas aeruginosa PA01
cgaggaugucggcgaac

SEQ ID NO: 1479858 - RNA, 21 nt, Pseudomonas aeruginosa PA01
cgaggauggucaggccggcgc

SEQ ID NO: 1479859 - RNA, 17 nt, Pseudomonas aeruginosa PA01
cgaggaucuugcgcccg

SEQ ID NO: 1479860 - RNA, 22 nt, Pseudomonas aeruginosa PA01
cgaggaucuugcgcccggcgcg

SEQ ID NO: 1479861 - RNA, 18 nt, Pseudomonas aeruginosa PA01
cgaggauuuccgcgcccg

SEQ ID NO: 1479862 - RNA, 15 nt, Pseudomonas aeruginosa PA01
cgacgucggcggcgg

SEQ ID NO: 1479863 - RNA, 16 nt, Pseudomonas aeruginosa PA01
cgacgucggcggcgga

SEQ ID NO: 1479864 - RNA, 13 nt, Pseudomonas aeruginosa PA01
cgacuccgccagu

SEQ ID NO: 1479865 - RNA, 16 nt, Pseudomonas aeruginosa PA01
cgacucgcugggcgcc

SEQ ID NO: 1479866 - RNA, 20 nt, Pseudomonas aeruginosa PA01
cgacucgcugggcgccggca

SEQ ID NO: 1479867 - RNA, 22 nt, Pseudomonas aeruginosa PA01
cgacucgcugggcgccggcagg

SEQ ID NO: 1479868 - RNA, 19 nt, Pseudomonas aeruginosa PA01
cgacucggcugcaacgccg

SEQ ID NO: 1479869 - RNA, 20 nt, Pseudomonas aeruginosa PA01
cgacucggcugcaacgccgc

SEQ ID NO: 1479870 - RNA, 23 nt, Pseudomonas aeruginosa PA01
cgacucgguaaagcccagguacu

SEQ ID NO: 1479871 - RNA, 13 nt, Pseudomonas aeruginosa PA01
cgacucgcgaucg

SEQ ID NO: 1479872 - RNA, 15 nt, Pseudomonas aeruginosa PA01
cgacucgcccuuggg

SEQ ID NO: 1479873 - RNA, 18 nt, Pseudomonas aeruginosa PA01
cgacucgaugcgcagcuu

SEQ ID NO: 1479874 - RNA, 16 nt, Pseudomonas aeruginosa PA01
cgacucgauggcgcgg

SEQ ID NO: 1479875 - RNA, 14 nt, Pseudomonas aeruginosa PA01
cgacucgagcacca

SEQ ID NO: 1479876 - RNA, 18 nt, Pseudomonas aeruginosa PA01
cgacucgagcaccaccac

SEQ ID NO: 1479877 - RNA, 20 nt, Pseudomonas aeruginosa PA01
cgacggcgggagcggccuga

SEQ ID NO: 1479878 - RNA, 23 nt, Pseudomonas aeruginosa PA01
cgacggcucgaacgaguggggcg

SEQ ID NO: 1479879 - RNA, 12 nt, Pseudomonas aeruginosa PA01
cgacggcggccg

SEQ ID NO: 1479880 - RNA, 23 nt, Pseudomonas aeruginosa PA01
cgacgucacggauaggcggcgga

SEQ ID NO: 1479881 - RNA, 16 nt, Pseudomonas aeruginosa PA01
cgacgucauaggccuu

SEQ ID NO: 1479882 - RNA, 18 nt, Pseudomonas aeruginosa PA01
cgacgucauaggccuugg

SEQ ID NO: 1479883 - RNA, 22 nt, Pseudomonas aeruginosa PA01
cgacguccacugcguccugguc

SEQ ID NO: 1479884 - RNA, 13 nt, Pseudomonas aeruginosa PA01
cgacggcaggugg

SEQ ID NO: 1479885 - RNA, 23 nt, Pseudomonas aeruginosa PA01
cgacggcauuccugguccagcca

SEQ ID NO: 1479886 - RNA, 13 nt, Pseudomonas aeruginosa PA01
cgacggcccacgg

SEQ ID NO: 1479887 - RNA, 16 nt, Pseudomonas aeruginosa PA01
cgacggcccacggcga

SEQ ID NO: 1479888 - RNA, 17 nt, Pseudomonas aeruginosa PA01
cgacggcccuccggcgc

SEQ ID NO: 1479889 - RNA, 12 nt, Pseudomonas aeruginosa PA01
cgacggcccuga

SEQ ID NO: 1479890 - RNA, 17 nt, Pseudomonas aeruginosa PA01
cgacggcgcaagggcgc

SEQ ID NO: 1479891 - RNA, 21 nt, Pseudomonas aeruginosa PA01
cgacggcgcaagggcgccgcc

SEQ ID NO: 1479892 - RNA, 22 nt, Pseudomonas aeruginosa PA01
cgacggcgcaagggcgccgccg

SEQ ID NO: 1479893 - RNA, 13 nt, Pseudomonas aeruginosa PA01
cgacgcgccaggu

SEQ ID NO: 1479894 - RNA, 19 nt, Pseudomonas aeruginosa PA01
cgacgcggauaccgagggu

SEQ ID NO: 1479895 - RNA, 15 nt, Pseudomonas aeruginosa PA01
cgacgcgcuggacca

SEQ ID NO: 1479896 - RNA, 21 nt, Pseudomonas aeruginosa PA01
cgacgcgcuggaccauggccg

SEQ ID NO: 1479897 - RNA, 22 nt, Pseudomonas aeruginosa PA01
cgacgcgcuggaccauggccgg

SEQ ID NO: 1479898 - RNA, 14 nt, Pseudomonas aeruginosa PA01
cgacgcuggccugc

SEQ ID NO: 1479899 - RNA, 18 nt, Pseudomonas aeruginosa PA01
cgacgcuggccugccgau

SEQ ID NO: 1479900 - RNA, 21 nt, Pseudomonas aeruginosa PA01
cgacgcuggccugccgauggg

SEQ ID NO: 1479901 - RNA, 16 nt, Pseudomonas aeruginosa PA01
cgacgcugcccagccc

SEQ ID NO: 1479902 - RNA, 19 nt, Pseudomonas aeruginosa PA01
cgacgcugcccagcccgcc

SEQ ID NO: 1479903 - RNA, 16 nt, Pseudomonas aeruginosa PA01
cgacgcugaugccggc

SEQ ID NO: 1479904 - RNA, 18 nt, Pseudomonas aeruginosa PA01
cgacgcugaugccggcga

SEQ ID NO: 1479905 - RNA, 17 nt, Pseudomonas aeruginosa PA01
cgacgcuuccucgcucg

SEQ ID NO: 1479906 - RNA, 15 nt, Pseudomonas aeruginosa PA01
cgacggaaggugcgg

SEQ ID NO: 1479907 - RNA, 17 nt, Pseudomonas aeruginosa PA01
cgacggaaauaggcguc

SEQ ID NO: 1479908 - RNA, 20 nt, Pseudomonas aeruginosa PA01
cgacggaaauaggcgucguc

SEQ ID NO: 1479909 - RNA, 14 nt, Pseudomonas aeruginosa PA01
cgacggaagcccuc

SEQ ID NO: 1479910 - RNA, 14 nt, Pseudomonas aeruginosa PA01
cgacggcaccagcg

SEQ ID NO: 1479911 - RNA, 16 nt, Pseudomonas aeruginosa PA01
cgacggcaccagcgcg

SEQ ID NO: 1479912 - RNA, 14 nt, Pseudomonas aeruginosa PA01
cgacgccgcuggaa

SEQ ID NO: 1479913 - RNA, 14 nt, Pseudomonas aeruginosa PA01
cgacgccgcuggcg

SEQ ID NO: 1479914 - RNA, 15 nt, Pseudomonas aeruginosa PA01
cgacgccgcuggcgg

SEQ ID NO: 1479915 - RNA, 16 nt, Pseudomonas aeruginosa PA01
cgacgccgcuggcggc

SEQ ID NO: 1479916 - RNA, 19 nt, Pseudomonas aeruginosa PA01
cgacgccgcuggcggcgcu

SEQ ID NO: 1479917 - RNA, 15 nt, Pseudomonas aeruginosa PA01
cgacgccgcggccgg

SEQ ID NO: 1479918 - RNA, 17 nt, Pseudomonas aeruginosa PA01
cgacgccgcggccggcg

SEQ ID NO: 1479919 - RNA, 21 nt, Pseudomonas aeruginosa PA01
cgacgccgcggccggcgaccu

SEQ ID NO: 1479920 - RNA, 19 nt, Pseudomonas aeruginosa PA01
cgacgcccgcagccagccu

SEQ ID NO: 1479921 - RNA, 21 nt, Pseudomonas aeruginosa PA01
cgacgcccgcuugcgccgccu

SEQ ID NO: 1479922 - RNA, 15 nt, Pseudomonas aeruginosa PA01
cgacgcccuggcgcu

SEQ ID NO: 1479923 - RNA, 19 nt, Pseudomonas aeruginosa PA01
cgacgcccuugcggcgcgg

SEQ ID NO: 1479924 - RNA, 20 nt, Pseudomonas aeruginosa PA01
cgacgcccuugcggcgcggc

SEQ ID NO: 1479925 - RNA, 21 nt, Pseudomonas aeruginosa PA01
cgacgcccuugcggcgcggcc

SEQ ID NO: 1479926 - RNA, 22 nt, Pseudomonas aeruginosa PA01
cgacgcccuugcggcgcggccc

SEQ ID NO: 1479927 - RNA, 16 nt, Pseudomonas aeruginosa PA01
cgacgcccuccagcac

SEQ ID NO: 1479928 - RNA, 17 nt, Pseudomonas aeruginosa PA01
cgacgcccuccagcacc

SEQ ID NO: 1479929 - RNA, 19 nt, Pseudomonas aeruginosa PA01
cgacgcccuccagcaccgc

SEQ ID NO: 1479930 - RNA, 22 nt, Pseudomonas aeruginosa PA01
cgacgcccuccagcaccgccug

SEQ ID NO: 1479931 - RNA, 12 nt, Pseudomonas aeruginosa PA01
cgacgcccucgg

SEQ ID NO: 1479932 - RNA, 15 nt, Pseudomonas aeruginosa PA01
cgacgcccucggcga

SEQ ID NO: 1479933 - RNA, 18 nt, Pseudomonas aeruginosa PA01
cgacgcccucggcgacga

SEQ ID NO: 1479934 - RNA, 23 nt, Pseudomonas aeruginosa PA01
cgacgcccucggcgacgaggacg

SEQ ID NO: 1479935 - RNA, 21 nt, Pseudomonas aeruginosa PA01
cgacgccggacgcaccagcag

SEQ ID NO: 1479936 - RNA, 18 nt, Pseudomonas aeruginosa PA01
cgacgccggugccaggac

SEQ ID NO: 1479937 - RNA, 23 nt, Pseudomonas aeruginosa PA01
cgacgcccauguagaccaccagc

SEQ ID NO: 1479938 - RNA, 13 nt, Pseudomonas aeruginosa PA01
cgacgccaccagc

SEQ ID NO: 1479939 - RNA, 13 nt, Pseudomonas aeruginosa PA01
cgacgccacccgc

SEQ ID NO: 1479940 - RNA, 17 nt, Pseudomonas aeruginosa PA01
cgacgcagggcggcgcc

SEQ ID NO: 1479941 - RNA, 20 nt, Pseudomonas aeruginosa PA01
cgacgcagggcggcgccugg

SEQ ID NO: 1479942 - RNA, 14 nt, Pseudomonas aeruginosa PA01
cgacgcaucgacgg

SEQ ID NO: 1479943 - RNA, 22 nt, Pseudomonas aeruginosa PA01
cgacgcacaccgucgaaccagc

SEQ ID NO: 1479944 - RNA, 18 nt, Pseudomonas aeruginosa PA01
cgacgcagagcgccauga

SEQ ID NO: 1479945 - RNA, 14 nt, Pseudomonas aeruginosa PA01
cgacgcagcacggc

SEQ ID NO: 1479946 - RNA, 16 nt, Pseudomonas aeruginosa PA01
cgacgcagcacggcgg

SEQ ID NO: 1479947 - RNA, 17 nt, Pseudomonas aeruginosa PA01
cgacgcagccgggccgc

SEQ ID NO: 1479948 - RNA, 20 nt, Pseudomonas aeruginosa PA01
cgacgcagccgggccgcagc

SEQ ID NO: 1479949 - RNA, 22 nt, Pseudomonas aeruginosa PA01
cgacgcagccgggccgcagcgc

SEQ ID NO: 1479950 - RNA, 15 nt, Pseudomonas aeruginosa PA01
cgacgcagcgcgcgc

SEQ ID NO: 1479951 - RNA, 20 nt, Pseudomonas aeruginosa PA01
cgacgcagcgcgcgccgagc

SEQ ID NO: 1479952 - RNA, 18 nt, Pseudomonas aeruginosa PA01
cgacgauguucgaggcgc

SEQ ID NO: 1479953 - RNA, 21 nt, Pseudomonas aeruginosa PA01
cgacgauguucgaggcgccga

SEQ ID NO: 1479954 - RNA, 23 nt, Pseudomonas aeruginosa PA01
cgacgauguucgaggcgccgacc

SEQ ID NO: 1479955 - RNA, 22 nt, Pseudomonas aeruginosa PA01
cgacgagguugcucugggcaug

SEQ ID NO: 1479956 - RNA, 20 nt, Pseudomonas aeruginosa PA01
cgacgacgaaaggccgcgcc

SEQ ID NO: 1479957 - RNA, 19 nt, Pseudomonas aeruginosa PA01
cgacgagccggacggcggc

SEQ ID NO: 1479958 - RNA, 21 nt, Pseudomonas aeruginosa PA01
cgacgagccggacggcggcgu

SEQ ID NO: 1479959 - RNA, 19 nt, Pseudomonas aeruginosa PA01
cgacgaggaacgccucgca

SEQ ID NO: 1479960 - RNA, 13 nt, Pseudomonas aeruginosa PA01
cgacgaggccugg

SEQ ID NO: 1479961 - RNA, 17 nt, Pseudomonas aeruginosa PA01
cgacgaggcgcggcgga

SEQ ID NO: 1479962 - RNA, 14 nt, Pseudomonas aeruginosa PA01
cgaccugcccgcug

SEQ ID NO: 1479963 - RNA, 14 nt, Pseudomonas aeruginosa PA01
cgaccugcucgucg

SEQ ID NO: 1479964 - RNA, 15 nt, Pseudomonas aeruginosa PA01
cgaccugcucgcgca

SEQ ID NO: 1479965 - RNA, 16 nt, Pseudomonas aeruginosa PA01
cgaccugcucgcgcac

SEQ ID NO: 1479966 - RNA, 18 nt, Pseudomonas aeruginosa PA01
cgaccugcucgcgcaccg

SEQ ID NO: 1479967 - RNA, 23 nt, Pseudomonas aeruginosa PA01
cgaccugcucgcgcaccgcggcc

SEQ ID NO: 1479968 - RNA, 16 nt, Pseudomonas aeruginosa PA01
cgaccugcggggcgga

SEQ ID NO: 1479969 - RNA, 21 nt, Pseudomonas aeruginosa PA01
cgaccugcggguuggucggca

SEQ ID NO: 1479970 - RNA, 23 nt, Pseudomonas aeruginosa PA01
cgaccugcggguuggucggcacc

SEQ ID NO: 1479971 - RNA, 17 nt, Pseudomonas aeruginosa PA01
cgacgaacucgacgcgc

SEQ ID NO: 1479972 - RNA, 19 nt, Pseudomonas aeruginosa PA01
cgacgaacucgacgcgcca

SEQ ID NO: 1479973 - RNA, 20 nt, Pseudomonas aeruginosa PA01
cgacgaacucgacgcgccag

SEQ ID NO: 1479974 - RNA, 17 nt, Pseudomonas aeruginosa PA01
cgacgaacaggaagcgc

SEQ ID NO: 1479975 - RNA, 14 nt, Pseudomonas aeruginosa PA01
cgacgaagacgcuc

SEQ ID NO: 1479976 - RNA, 19 nt, Pseudomonas aeruginosa PA01
cgacgaagacgcugcgcac

SEQ ID NO: 1479977 - RNA, 13 nt, Pseudomonas aeruginosa PA01
cgaccucggcggu

SEQ ID NO: 1479978 - RNA, 18 nt, Pseudomonas aeruginosa PA01
cgaccucguugcaggcac

SEQ ID NO: 1479979 - RNA, 19 nt, Pseudomonas aeruginosa PA01
cgaccucguugcaggcacg

SEQ ID NO: 1479980 - RNA, 15 nt, Pseudomonas aeruginosa PA01
cgaccucgcgggcga

SEQ ID NO: 1479981 - RNA, 14 nt, Pseudomonas aeruginosa PA01
cgaccucggccgca

SEQ ID NO: 1479982 - RNA, 14 nt, Pseudomonas aeruginosa PA01
cgaccucggccgcc

SEQ ID NO: 1479983 - RNA, 15 nt, Pseudomonas aeruginosa PA01
cgaccucggccgcca

SEQ ID NO: 1479984 - RNA, 18 nt, Pseudomonas aeruginosa PA01
cgaccucggccgccaggg

SEQ ID NO: 1479985 - RNA, 16 nt, Pseudomonas aeruginosa PA01
cgaccuccgccgcuuc

SEQ ID NO: 1479986 - RNA, 16 nt, Pseudomonas aeruginosa PA01
cgaccuccaggccgaa

SEQ ID NO: 1479987 - RNA, 17 nt, Pseudomonas aeruginosa PA01
cgaccccacgccggccg

SEQ ID NO: 1479988 - RNA, 20 nt, Pseudomonas aeruginosa PA01
cgaccccacgccggccggcu

SEQ ID NO: 1479989 - RNA, 13 nt, Pseudomonas aeruginosa PA01
cgaccccgccggg

SEQ ID NO: 1479990 - RNA, 17 nt, Pseudomonas aeruginosa PA01
cgccauauuucgaaggg

SEQ ID NO: 1479991 - RNA, 21 nt, Pseudomonas aeruginosa PA01
cgccaucaacggauauccccg

SEQ ID NO: 1479992 - RNA, 18 nt, Pseudomonas aeruginosa PA01
cgccaucaccagcggcga

SEQ ID NO: 1479993 - RNA, 20 nt, Pseudomonas aeruginosa PA01
cgccaucaccagcggcgagc

SEQ ID NO: 1479994 - RNA, 22 nt, Pseudomonas aeruginosa PA01
cgccaucaccagcggcgagcag

SEQ ID NO: 1479995 - RNA, 16 nt, Pseudomonas aeruginosa PA01
cgccaucaguuccucg

SEQ ID NO: 1479996 - RNA, 17 nt, Pseudomonas aeruginosa PA01
cgccaucaguuccucgc

SEQ ID NO: 1479997 - RNA, 18 nt, Pseudomonas aeruginosa PA01
cgccaucaguuccucgcg

SEQ ID NO: 1479998 - RNA, 15 nt, Pseudomonas aeruginosa PA01
cgccaucagcgacca

SEQ ID NO: 1479999 - RNA, 14 nt, Pseudomonas aeruginosa PA01
cgccaucagcacga

SEQ ID NO: 1480000 - RNA, 13 nt, Pseudomonas aeruginosa PA01
cgccauaggcggc

SEQ ID NO: 1480001 - RNA, 14 nt, Pseudomonas aeruginosa PA01
cgccauaggcggcg

SEQ ID NO: 1480002 - RNA, 18 nt, Pseudomonas aeruginosa PA01
cgccauaggcggcgcaga

SEQ ID NO: 1480003 - RNA, 14 nt, Pseudomonas aeruginosa PA01
cgccauagggcacc

SEQ ID NO: 1480004 - RNA, 17 nt, Pseudomonas aeruginosa PA01
cgccauagggcacccgg

SEQ ID NO: 1480005 - RNA, 15 nt, Pseudomonas aeruginosa PA01
cgccauauagcgcug

SEQ ID NO: 1480006 - RNA, 19 nt, Pseudomonas aeruginosa PA01
cgccaguuggacgcggccu

SEQ ID NO: 1480007 - RNA, 19 nt, Pseudomonas aeruginosa PA01
cgccaguucucgcagcagg

SEQ ID NO: 1480008 - RNA, 20 nt, Pseudomonas aeruginosa PA01
cgccaguucucgcagcaggc

SEQ ID NO: 1480009 - RNA, 18 nt, Pseudomonas aeruginosa PA01
cgccaucggucgcgcccc

SEQ ID NO: 1480010 - RNA, 20 nt, Pseudomonas aeruginosa PA01
cgccaucggucgcgccccca

SEQ ID NO: 1480011 - RNA, 17 nt, Pseudomonas aeruginosa PA01
cgccaucuccucgcuga

SEQ ID NO: 1480012 - RNA, 16 nt, Pseudomonas aeruginosa PA01
cgccaucgcucaccgg

SEQ ID NO: 1480013 - RNA, 23 nt, Pseudomonas aeruginosa PA01
cgccaucgcuuuccuggccgacc

SEQ ID NO: 1480014 - RNA, 15 nt, Pseudomonas aeruginosa PA01
cgccaucggcgguac

SEQ ID NO: 1480015 - RNA, 17 nt, Pseudomonas aeruginosa PA01
cgccaugacccgcggca

SEQ ID NO: 1480016 - RNA, 19 nt, Pseudomonas aeruginosa PA01
cgccaugacccgcggcagg

SEQ ID NO: 1480017 - RNA, 22 nt, Pseudomonas aeruginosa PA01
cgccaugacccgcggcaggucc

SEQ ID NO: 1480018 - RNA, 18 nt, Pseudomonas aeruginosa PA01
cgccaugcaagaacgccg

SEQ ID NO: 1480019 - RNA, 18 nt, Pseudomonas aeruginosa PA01
cgccaucgccucgccggc

SEQ ID NO: 1480020 - RNA, 19 nt, Pseudomonas aeruginosa PA01
cgccaucgccucgccggcc

SEQ ID NO: 1480021 - RNA, 15 nt, Pseudomonas aeruginosa PA01
cgccauccuucggcg

SEQ ID NO: 1480022 - RNA, 15 nt, Pseudomonas aeruginosa PA01
cgccaucgaccagga

SEQ ID NO: 1480023 - RNA, 21 nt, Pseudomonas aeruginosa PA01
cgccaucgauggucacuggcg

SEQ ID NO: 1480024 - RNA, 23 nt, Pseudomonas aeruginosa PA01
cgccaucgauggucacuggcgag

SEQ ID NO: 1480025 - RNA, 16 nt, Pseudomonas aeruginosa PA01
cgccaucgauggucag

SEQ ID NO: 1480026 - RNA, 19 nt, Pseudomonas aeruginosa PA01
cgccaucgauggucaggcu

SEQ ID NO: 1480027 - RNA, 20 nt, Pseudomonas aeruginosa PA01
cgccaucgauggucaggcug

SEQ ID NO: 1480028 - RNA, 16 nt, Pseudomonas aeruginosa PA01
cgccaucgaucagcag

SEQ ID NO: 1480029 - RNA, 19 nt, Pseudomonas aeruginosa PA01
cgccaucgaucagcagcgc

SEQ ID NO: 1480030 - RNA, 20 nt, Pseudomonas aeruginosa PA01
cgccaucgaucagcagcgcc

SEQ ID NO: 1480031 - RNA, 21 nt, Pseudomonas aeruginosa PA01
cgccaucgaucagcagcgcca

SEQ ID NO: 1480032 - RNA, 13 nt, Pseudomonas aeruginosa PA01
cgccauccgccuu

SEQ ID NO: 1480033 - RNA, 15 nt, Pseudomonas aeruginosa PA01
cgccauccuccagcg

SEQ ID NO: 1480034 - RNA, 16 nt, Pseudomonas aeruginosa PA01
cgccauccuccagcgc

SEQ ID NO: 1480035 - RNA, 17 nt, Pseudomonas aeruginosa PA01
cgccauccuccagcgcc

SEQ ID NO: 1480036 - RNA, 18 nt, Pseudomonas aeruginosa PA01
cgccauccuccagcgccg

SEQ ID NO: 1480037 - RNA, 21 nt, Pseudomonas aeruginosa PA01
cgccauccuccagcgccgcau

SEQ ID NO: 1480038 - RNA, 15 nt, Pseudomonas aeruginosa PA01
cgccauccuccgagg

SEQ ID NO: 1480039 - RNA, 17 nt, Pseudomonas aeruginosa PA01
cgccaguuccgugucga

SEQ ID NO: 1480040 - RNA, 20 nt, Pseudomonas aeruginosa PA01
cgccaguuccgugucgaggg

SEQ ID NO: 1480041 - RNA, 22 nt, Pseudomonas aeruginosa PA01
cgccaguuccgugucgagggcg

SEQ ID NO: 1480042 - RNA, 22 nt, Pseudomonas aeruginosa PA01
cgccaguucggccaucagcacg

SEQ ID NO: 1480043 - RNA, 15 nt, Pseudomonas aeruginosa PA01
cgccaguucgcgcag

SEQ ID NO: 1480044 - RNA, 17 nt, Pseudomonas aeruginosa PA01
cgccaguucgcgcaggu

SEQ ID NO: 1480045 - RNA, 16 nt, Pseudomonas aeruginosa PA01
cgccaguuccggcaac

SEQ ID NO: 1480046 - RNA, 21 nt, Pseudomonas aeruginosa PA01
cgccaguuccggggucagcgc

SEQ ID NO: 1480047 - RNA, 22 nt, Pseudomonas aeruginosa PA01
cgccaguuccggggucagcgcc

SEQ ID NO: 1480048 - RNA, 14 nt, Pseudomonas aeruginosa PA01
cgccaguucgccgg

SEQ ID NO: 1480049 - RNA, 15 nt, Pseudomonas aeruginosa PA01
cgccaguucgccggu

SEQ ID NO: 1480050 - RNA, 17 nt, Pseudomonas aeruginosa PA01
cgccaguucgccgguga

SEQ ID NO: 1480051 - RNA, 19 nt, Pseudomonas aeruginosa PA01
cgccaguucgccggugacg

SEQ ID NO: 1480052 - RNA, 14 nt, Pseudomonas aeruginosa PA01
cgccagucggccug

SEQ ID NO: 1480053 - RNA, 15 nt, Pseudomonas aeruginosa PA01
cgccagucggccugg

SEQ ID NO: 1480054 - RNA, 19 nt, Pseudomonas aeruginosa PA01
cgccagugcagccguugcc

SEQ ID NO: 1480055 - RNA, 15 nt, Pseudomonas aeruginosa PA01
cgccagugcaugcgu

SEQ ID NO: 1480056 - RNA, 21 nt, Pseudomonas aeruginosa PA01
cgccagugcaugcguucgccg

SEQ ID NO: 1480057 - RNA, 20 nt, Pseudomonas aeruginosa PA01
cgccagugccugcaccacgc

SEQ ID NO: 1480058 - RNA, 23 nt, Pseudomonas aeruginosa PA01
cgccagguucaauccuuccgucg

SEQ ID NO: 1480059 - RNA, 21 nt, Pseudomonas aeruginosa PA01
cgccagguggaagcgcgcguc

SEQ ID NO: 1480060 - RNA, 18 nt, Pseudomonas aeruginosa PA01
cgccagguugcgcaacca

SEQ ID NO: 1480061 - RNA, 23 nt, Pseudomonas aeruginosa PA01
cgccagguugcgcaaccagcgcu

SEQ ID NO: 1480062 - RNA, 22 nt, Pseudomonas aeruginosa PA01
cgccagguugcguuccaacugg

SEQ ID NO: 1480063 - RNA, 21 nt, Pseudomonas aeruginosa PA01
cgccagguuggccuggcccgg

SEQ ID NO: 1480064 - RNA, 23 nt, Pseudomonas aeruginosa PA01
cgccagguuggccuggcccggcg

SEQ ID NO: 1480065 - RNA, 13 nt, Pseudomonas aeruginosa PA01
cgccaggugcagg

SEQ ID NO: 1480066 - RNA, 20 nt, Pseudomonas aeruginosa PA01
cgccaggugcaggaagcgcc

SEQ ID NO: 1480067 - RNA, 18 nt, Pseudomonas aeruginosa PA01
cgccagguguacaucggg

SEQ ID NO: 1480068 - RNA, 19 nt, Pseudomonas aeruginosa PA01
cgccagguguacaucggga

SEQ ID NO: 1480069 - RNA, 22 nt, Pseudomonas aeruginosa PA01
cgccagggucagcucgacagcg

SEQ ID NO: 1480070 - RNA, 14 nt, Pseudomonas aeruginosa PA01
cgccaggucgaucc

SEQ ID NO: 1480071 - RNA, 15 nt, Pseudomonas aeruginosa PA01
cgccaggucgauccc

SEQ ID NO: 1480072 - RNA, 16 nt, Pseudomonas aeruginosa PA01
cgccaguacuccgagg

SEQ ID NO: 1480073 - RNA, 20 nt, Pseudomonas aeruginosa PA01
cgccaguacuccgagggccg

SEQ ID NO: 1480074 - RNA, 15 nt, Pseudomonas aeruginosa PA01
cgccagucauugcgc

SEQ ID NO: 1480075 - RNA, 17 nt, Pseudomonas aeruginosa PA01
cgccaguccacgacgaa

SEQ ID NO: 1480076 - RNA, 14 nt, Pseudomonas aeruginosa PA01
cgccagguagccug

SEQ ID NO: 1480077 - RNA, 23 nt, Pseudomonas aeruginosa PA01
cgccagguagccuggauacgggc

SEQ ID NO: 1480078 - RNA, 15 nt, Pseudomonas aeruginosa PA01
cgccagguaguccag

SEQ ID NO: 1480079 - RNA, 19 nt, Pseudomonas aeruginosa PA01
cgccagguagugccgcccu

SEQ ID NO: 1480080 - RNA, 20 nt, Pseudomonas aeruginosa PA01
cgccagguagugccgcccuu

SEQ ID NO: 1480081 - RNA, 22 nt, Pseudomonas aeruginosa PA01
cgccagguagugccgcccuugc

SEQ ID NO: 1480082 - RNA, 17 nt, Pseudomonas aeruginosa PA01
cgccagggggaucgcga

SEQ ID NO: 1480083 - RNA, 18 nt, Pseudomonas aeruginosa PA01
cgccagggggaucgcgaa

SEQ ID NO: 1480084 - RNA, 20 nt, Pseudomonas aeruginosa PA01
cgccagggggaucgcgaaga

SEQ ID NO: 1480085 - RNA, 21 nt, Pseudomonas aeruginosa PA01
cgccagggggaucgcgaagaa

SEQ ID NO: 1480086 - RNA, 19 nt, Pseudomonas aeruginosa PA01
cgccaggguguuguucgcc

SEQ ID NO: 1480087 - RNA, 22 nt, Pseudomonas aeruginosa PA01
cgccaggguguuguucgccagc

SEQ ID NO: 1480088 - RNA, 18 nt, Pseudomonas aeruginosa PA01
cgccagggucuugccgac

SEQ ID NO: 1480089 - RNA, 22 nt, Pseudomonas aeruginosa PA01
cgccagggucuugccgaccuuc

SEQ ID NO: 1480090 - RNA, 19 nt, Pseudomonas aeruginosa PA01
cgccagggcccacagugcc

SEQ ID NO: 1480091 - RNA, 18 nt, Pseudomonas aeruginosa PA01
cgccaggcuuuccgccga

SEQ ID NO: 1480092 - RNA, 20 nt, Pseudomonas aeruginosa PA01
cgccaggcuuuccgccgagc

SEQ ID NO: 1480093 - RNA, 20 nt, Pseudomonas aeruginosa PA01
cgccagggacgcgcagcggc

SEQ ID NO: 1480094 - RNA, 18 nt, Pseudomonas aeruginosa PA01
cgccagggagcaggacgc

SEQ ID NO: 1480095 - RNA, 15 nt, Pseudomonas aeruginosa PA01
cgccagggaggcgau

SEQ ID NO: 1480096 - RNA, 21 nt, Pseudomonas aeruginosa PA01
cgccaggcuggguuggcgcga

SEQ ID NO: 1480097 - RNA, 19 nt, Pseudomonas aeruginosa PA01
cgccaggcugucagggcgc

SEQ ID NO: 1480098 - RNA, 22 nt, Pseudomonas aeruginosa PA01
cgccaggcuggccacgaacagg

SEQ ID NO: 1480099 - RNA, 14 nt, Pseudomonas aeruginosa PA01
cgccaggcugaucc

SEQ ID NO: 1480100 - RNA, 16 nt, Pseudomonas aeruginosa PA01
cgccaggcugauccgc

SEQ ID NO: 1480101 - RNA, 16 nt, Pseudomonas aeruginosa PA01
cgccaggccggagccg

SEQ ID NO: 1480102 - RNA, 14 nt, Pseudomonas aeruginosa PA01
cgccaggccggcga

SEQ ID NO: 1480103 - RNA, 12 nt, Pseudomonas aeruginosa PA01
cgccaggccgau

SEQ ID NO: 1480104 - RNA, 16 nt, Pseudomonas aeruginosa PA01
cgccaggccgaucagc

SEQ ID NO: 1480105 - RNA, 19 nt, Pseudomonas aeruginosa PA01
cgccaggccgccgaagaac

SEQ ID NO: 1480106 - RNA, 12 nt, Pseudomonas aeruginosa PA01
cgccaggccgcg

SEQ ID NO: 1480107 - RNA, 19 nt, Pseudomonas aeruginosa PA01
cgccaggccgcgcaguccc

SEQ ID NO: 1480108 - RNA, 22 nt, Pseudomonas aeruginosa PA01
cgccaggccauugaaggccgac

SEQ ID NO: 1480109 - RNA, 20 nt, Pseudomonas aeruginosa PA01
cgccaggccggugcagaaga

SEQ ID NO: 1480110 - RNA, 22 nt, Pseudomonas aeruginosa PA01
cgccaggccguagaccaccagc

SEQ ID NO: 1480111 - RNA, 23 nt, Pseudomonas aeruginosa PA01
cgccaggccguagaccaccagca

SEQ ID NO: 1480112 - RNA, 15 nt, Pseudomonas aeruginosa PA01
cgccaggccucggcg

SEQ ID NO: 1480113 - RNA, 19 nt, Pseudomonas aeruginosa PA01
cgccaggccucggcgcggg

SEQ ID NO: 1480114 - RNA, 18 nt, Pseudomonas aeruginosa PA01
cgccaggccuugcagcaa

SEQ ID NO: 1480115 - RNA, 13 nt, Pseudomonas aeruginosa PA01
cgccaggcgcaag

SEQ ID NO: 1480116 - RNA, 17 nt, Pseudomonas aeruginosa PA01
cgccaggcgcagccagc

SEQ ID NO: 1480117 - RNA, 18 nt, Pseudomonas aeruginosa PA01
cgccaggcgcagccagca

SEQ ID NO: 1480118 - RNA, 13 nt, Pseudomonas aeruginosa PA01
cgccaggcgccga

SEQ ID NO: 1480119 - RNA, 15 nt, Pseudomonas aeruginosa PA01
cgccaggcgccgauc

SEQ ID NO: 1480120 - RNA, 17 nt, Pseudomonas aeruginosa PA01
cgccaggcggccgaaga

SEQ ID NO: 1480121 - RNA, 14 nt, Pseudomonas aeruginosa PA01
cgccaggcggccgc

SEQ ID NO: 1480122 - RNA, 16 nt, Pseudomonas aeruginosa PA01
cgccaggcggccgcug

SEQ ID NO: 1480123 - RNA, 19 nt, Pseudomonas aeruginosa PA01
cgccaggcggccgcuggcg

SEQ ID NO: 1480124 - RNA, 20 nt, Pseudomonas aeruginosa PA01
cgccaggcgucccguuccgc

SEQ ID NO: 1480125 - RNA, 14 nt, Pseudomonas aeruginosa PA01
cgccaggcgugcag

SEQ ID NO: 1480126 - RNA, 14 nt, Pseudomonas aeruginosa PA01
cgccaggcguucca

SEQ ID NO: 1480127 - RNA, 19 nt, Pseudomonas aeruginosa PA01
cgccaggcguuccagcucg

SEQ ID NO: 1480128 - RNA, 20 nt, Pseudomonas aeruginosa PA01
cgccaggcguuccagcucgg

SEQ ID NO: 1480129 - RNA, 17 nt, Pseudomonas aeruginosa PA01
cgccaggcggaacggcu

SEQ ID NO: 1480130 - RNA, 15 nt, Pseudomonas aeruginosa PA01
cgccaggcgcgucgc

SEQ ID NO: 1480131 - RNA, 22 nt, Pseudomonas aeruginosa PA01
cgccaggcgcgucuccagcucg

SEQ ID NO: 1480132 - RNA, 23 nt, Pseudomonas aeruginosa PA01
cgccaggcgcgucuccagcucgg

SEQ ID NO: 1480133 - RNA, 13 nt, Pseudomonas aeruginosa PA01
cgccaggcgaucc

SEQ ID NO: 1480134 - RNA, 16 nt, Pseudomonas aeruginosa PA01
cgccaggcgauccagc

SEQ ID NO: 1480135 - RNA, 13 nt, Pseudomonas aeruginosa PA01
cgccacgcugcug

SEQ ID NO: 1480136 - RNA, 18 nt, Pseudomonas aeruginosa PA01
cgccacgcugcugccggc

SEQ ID NO: 1480137 - RNA, 14 nt, Pseudomonas aeruginosa PA01
cgccacgcucaccg

SEQ ID NO: 1480138 - RNA, 15 nt, Pseudomonas aeruginosa PA01
cgccacgcucaccgg

SEQ ID NO: 1480139 - RNA, 22 nt, Pseudomonas aeruginosa PA01
cgccacgcgagaagccgcccac

SEQ ID NO: 1480140 - RNA, 21 nt, Pseudomonas aeruginosa PA01
cgccaccugagcgacguggca

SEQ ID NO: 1480141 - RNA, 12 nt, Pseudomonas aeruginosa PA01
cgccaccuggcg

SEQ ID NO: 1480142 - RNA, 23 nt, Pseudomonas aeruginosa PA01
cgccaccugguucaucgagcggc

SEQ ID NO: 1480143 - RNA, 19 nt, Pseudomonas aeruginosa PA01
cgccaccuguuccacgaga

SEQ ID NO: 1480144 - RNA, 14 nt, Pseudomonas aeruginosa PA01
cgccaacguccucg

SEQ ID NO: 1480145 - RNA, 18 nt, Pseudomonas aeruginosa PA01
cgccaagggcgccgccga

SEQ ID NO: 1480146 - RNA, 13 nt, Pseudomonas aeruginosa PA01
cgccaauccgggc

SEQ ID NO: 1480147 - RNA, 13 nt, Pseudomonas aeruginosa PA01
cgccacggccagc

SEQ ID NO: 1480148 - RNA, 16 nt, Pseudomonas aeruginosa PA01
cgccacuaccaccacc

SEQ ID NO: 1480149 - RNA, 13 nt, Pseudomonas aeruginosa PA01
cgccacgugcacg

SEQ ID NO: 1480150 - RNA, 15 nt, Pseudomonas aeruginosa PA01
cgccacgugcacgcc

SEQ ID NO: 1480151 - RNA, 19 nt, Pseudomonas aeruginosa PA01
cgccacgugcacgccgugc

SEQ ID NO: 1480152 - RNA, 15 nt, Pseudomonas aeruginosa PA01
cgccacucggcgugc

SEQ ID NO: 1480153 - RNA, 17 nt, Pseudomonas aeruginosa PA01
cgccacucggcgugccg

SEQ ID NO: 1480154 - RNA, 20 nt, Pseudomonas aeruginosa PA01
cgccacugauaccgcuggcc

SEQ ID NO: 1480155 - RNA, 15 nt, Pseudomonas aeruginosa PA01
cgccagacaggccag

SEQ ID NO: 1480156 - RNA, 17 nt, Pseudomonas aeruginosa PA01
cgccagacaggccagcu

SEQ ID NO: 1480157 - RNA, 16 nt, Pseudomonas aeruginosa PA01
cgccagcaacccgccc

SEQ ID NO: 1480158 - RNA, 13 nt, Pseudomonas aeruginosa PA01
cgccagcaacggc

SEQ ID NO: 1480159 - RNA, 14 nt, Pseudomonas aeruginosa PA01
cgccagcaacggcu

SEQ ID NO: 1480160 - RNA, 17 nt, Pseudomonas aeruginosa PA01
cgccagcaacggcuccu

SEQ ID NO: 1480161 - RNA, 20 nt, Pseudomonas aeruginosa PA01
cgccagcaauugccgcugca

SEQ ID NO: 1480162 - RNA, 22 nt, Pseudomonas aeruginosa PA01
cgccagcaccacccggccgcgc

SEQ ID NO: 1480163 - RNA, 18 nt, Pseudomonas aeruginosa PA01
cgccagaagcggccgacc

SEQ ID NO: 1480164 - RNA, 16 nt, Pseudomonas aeruginosa PA01
cgccagagaucgccca

SEQ ID NO: 1480165 - RNA, 15 nt, Pseudomonas aeruginosa PA01
cgccagccucggcga

SEQ ID NO: 1480166 - RNA, 11 nt, Pseudomonas aeruginosa PA01
cgccagccggc

SEQ ID NO: 1480167 - RNA, 15 nt, Pseudomonas aeruginosa PA01
cgccagcgcggcgcu

SEQ ID NO: 1480168 - RNA, 20 nt, Pseudomonas aeruginosa PA01
cgccagcuaccggcaggguc

SEQ ID NO: 1480169 - RNA, 20 nt, Pseudomonas aeruginosa PA01
cgccagcguugcaggucgau

SEQ ID NO: 1480170 - RNA, 19 nt, Pseudomonas aeruginosa PA01
cgccagcguuucgaagccg

SEQ ID NO: 1480171 - RNA, 16 nt, Pseudomonas aeruginosa PA01
cgccagcuccagcgcc

SEQ ID NO: 1480172 - RNA, 19 nt, Pseudomonas aeruginosa PA01
cgccagcuccagcgcccag

SEQ ID NO: 1480173 - RNA, 21 nt, Pseudomonas aeruginosa PA01
cgccagcuccagcgcccaggu

SEQ ID NO: 1480174 - RNA, 12 nt, Pseudomonas aeruginosa PA01
cgccaggcccgg

SEQ ID NO: 1480175 - RNA, 16 nt, Pseudomonas aeruginosa PA01
cgccaggcccggcgcu

SEQ ID NO: 1480176 - RNA, 18 nt, Pseudomonas aeruginosa PA01
cgccaggcccggcgcugc

SEQ ID NO: 1480177 - RNA, 12 nt, Pseudomonas aeruginosa PA01
cgccaggcccuc

SEQ ID NO: 1480178 - RNA, 19 nt, Pseudomonas aeruginosa PA01
cgccaggcccucggcgacc

SEQ ID NO: 1480179 - RNA, 16 nt, Pseudomonas aeruginosa PA01
cgccaggcccugggcg

SEQ ID NO: 1480180 - RNA, 18 nt, Pseudomonas aeruginosa PA01
cgccaggcccugggcggc

SEQ ID NO: 1480181 - RNA, 20 nt, Pseudomonas aeruginosa PA01
cgccaggcccugggcggcgg

SEQ ID NO: 1480182 - RNA, 21 nt, Pseudomonas aeruginosa PA01
cgccaggcccugggcggcggg

SEQ ID NO: 1480183 - RNA, 16 nt, Pseudomonas aeruginosa PA01
cgccaggccgacccgc

SEQ ID NO: 1480184 - RNA, 15 nt, Pseudomonas aeruginosa PA01
cgccagcucggccug

SEQ ID NO: 1480185 - RNA, 14 nt, Pseudomonas aeruginosa PA01
cgccagcucggccu

SEQ ID NO: 1480186 - RNA, 15 nt, Pseudomonas aeruginosa PA01
cgccagcucggccgg

SEQ ID NO: 1480187 - RNA, 22 nt, Pseudomonas aeruginosa PA01
cgccagcucggccggcaggcug

SEQ ID NO: 1480188 - RNA, 11 nt, Pseudomonas aeruginosa PA01
cgccagcucgg

SEQ ID NO: 1480189 - RNA, 16 nt, Pseudomonas aeruginosa PA01
cgccagcucgcugucc

SEQ ID NO: 1480190 - RNA, 17 nt, Pseudomonas aeruginosa PA01
cgccagcucgcugucca

SEQ ID NO: 1480191 - RNA, 23 nt, Pseudomonas aeruginosa PA01
cgccagcucgcuguccagcacca

SEQ ID NO: 1480192 - RNA, 15 nt, Pseudomonas aeruginosa PA01
cgccagcucgaacag

SEQ ID NO: 1480193 - RNA, 19 nt, Pseudomonas aeruginosa PA01
cgccagcucgaacagcacc

SEQ ID NO: 1480194 - RNA, 23 nt, Pseudomonas aeruginosa PA01
cgccagcucgaacagcaccgagc

SEQ ID NO: 1480195 - RNA, 24 nt, Pseudomonas aeruginosa PA01
cgccagcucgaacagcaccgagca

SEQ ID NO: 1480196 - RNA, 13 nt, Pseudomonas aeruginosa PA01
cgccagcucgccg

SEQ ID NO: 1480197 - RNA, 15 nt, Pseudomonas aeruginosa PA01
cgccagcucgccgcg

SEQ ID NO: 1480198 - RNA, 17 nt, Pseudomonas aeruginosa PA01
cgccagcucgccgcgcu

SEQ ID NO: 1480199 - RNA, 15 nt, Pseudomonas aeruginosa PA01
cgccagccgccagga

SEQ ID NO: 1480200 - RNA, 13 nt, Pseudomonas aeruginosa PA01
cgccagccgcccu

SEQ ID NO: 1480201 - RNA, 15 nt, Pseudomonas aeruginosa PA01
cgccagccagcgcgg

SEQ ID NO: 1480202 - RNA, 16 nt, Pseudomonas aeruginosa PA01
cgccagccagcgcggc

SEQ ID NO: 1480203 - RNA, 18 nt, Pseudomonas aeruginosa PA01
cgccagccagcgcggcuc

SEQ ID NO: 1480204 - RNA, 23 nt, Pseudomonas aeruginosa PA01
cgccagcaucgcaucggcgaccu

SEQ ID NO: 1480205 - RNA, 20 nt, Pseudomonas aeruginosa PA01
cgccagccacucccggcccu

SEQ ID NO: 1480206 - RNA, 16 nt, Pseudomonas aeruginosa PA01
cgccagccagccgcgc

SEQ ID NO: 1480207 - RNA, 18 nt, Pseudomonas aeruginosa PA01
cgccagccagccgcgcgc

SEQ ID NO: 1480208 - RNA, 22 nt, Pseudomonas aeruginosa PA01
cgccagccagccgcgcgccgca

SEQ ID NO: 1480209 - RNA, 20 nt, Pseudomonas aeruginosa PA01
cgccagccagagcagcgucg

SEQ ID NO: 1480210 - RNA, 17 nt, Pseudomonas aeruginosa PA01
cgccagccagcccggcg

SEQ ID NO: 1480211 - RNA, 14 nt, Pseudomonas aeruginosa PA01
cgccagcacggcgc

SEQ ID NO: 1480212 - RNA, 12 nt, Pseudomonas aeruginosa PA01
cgccagcagguc

SEQ ID NO: 1480213 - RNA, 14 nt, Pseudomonas aeruginosa PA01
cgccagcaggucgc

SEQ ID NO: 1480214 - RNA, 22 nt, Pseudomonas aeruginosa PA01
cgccagcaggucgcgcugggcg

SEQ ID NO: 1480215 - RNA, 22 nt, Pseudomonas aeruginosa PA01
cgccagcaggucggccugcugc

SEQ ID NO: 1480216 - RNA, 21 nt, Pseudomonas aeruginosa PA01
cgccagcaguugcaacagcgc

SEQ ID NO: 1480217 - RNA, 18 nt, Pseudomonas aeruginosa PA01
cgccagcagacggcacga

SEQ ID NO: 1480218 - RNA, 21 nt, Pseudomonas aeruginosa PA01
cgccagcagacggcacgacgc

SEQ ID NO: 1480219 - RNA, 20 nt, Pseudomonas aeruginosa PA01
cgccagcacccagucuucgc

SEQ ID NO: 1480220 - RNA, 15 nt, Pseudomonas aeruginosa PA01
cgccagcaccagcag

SEQ ID NO: 1480221 - RNA, 20 nt, Pseudomonas aeruginosa PA01
cgccagcaccucguaggccg

SEQ ID NO: 1480222 - RNA, 22 nt, Pseudomonas aeruginosa PA01
cgccagcaccucguaggccgac

SEQ ID NO: 1480223 - RNA, 23 nt, Pseudomonas aeruginosa PA01
cgccagcaccucguaggccgacu

SEQ ID NO: 1480224 - RNA, 24 nt, Pseudomonas aeruginosa PA01
cgccagcaccucguaggccgacuc

SEQ ID NO: 1480225 - RNA, 16 nt, Pseudomonas aeruginosa PA01
cgccagcaccuggcag

SEQ ID NO: 1480226 - RNA, 20 nt, Pseudomonas aeruginosa PA01
cgccagcaccuggcagugcg

SEQ ID NO: 1480227 - RNA, 15 nt, Pseudomonas aeruginosa PA01
cgccagcaccguggu

SEQ ID NO: 1480228 - RNA, 21 nt, Pseudomonas aeruginosa PA01
cgccaaacccagcgacaacgg

SEQ ID NO: 1480229 - RNA, 18 nt, Pseudomonas aeruginosa PA01
cgccaaaaaaagccccgg

SEQ ID NO: 1480230 - RNA, 18 nt, Pseudomonas aeruginosa PA01
cgccaaccgggcagcagc

SEQ ID NO: 1480231 - RNA, 22 nt, Pseudomonas aeruginosa PA01
cgccaaccacuccgccacccgc

SEQ ID NO: 1480232 - RNA, 20 nt, Pseudomonas aeruginosa PA01
cgccaacggcguuauccgcc

SEQ ID NO: 1480233 - RNA, 21 nt, Pseudomonas aeruginosa PA01
cgccaacggcguuauccgccg

SEQ ID NO: 1480234 - RNA, 12 nt, Pseudomonas aeruginosa PA01
cgccaacgcgcc

SEQ ID NO: 1480235 - RNA, 21 nt, Pseudomonas aeruginosa PA01
cgccaacgcgccgucgcgacc

SEQ ID NO: 1480236 - RNA, 15 nt, Pseudomonas aeruginosa PA01
cgccaacgccaccgc

SEQ ID NO: 1480237 - RNA, 17 nt, Pseudomonas aeruginosa PA01
cgccaacgccaccgcgc

SEQ ID NO: 1480238 - RNA, 22 nt, Pseudomonas aeruginosa PA01
cgcaucaggccaaagccgcaau

SEQ ID NO: 1480239 - RNA, 20 nt, Pseudomonas aeruginosa PA01
cgcaucagcgccgguucguu

SEQ ID NO: 1480240 - RNA, 15 nt, Pseudomonas aeruginosa PA01
cgcaugcgcagcgcg

SEQ ID NO: 1480241 - RNA, 13 nt, Pseudomonas aeruginosa PA01
cgcaugcgccggc

SEQ ID NO: 1480242 - RNA, 12 nt, Pseudomonas aeruginosa PA01
cgcaugcgcggc

SEQ ID NO: 1480243 - RNA, 14 nt, Pseudomonas aeruginosa PA01
cgcaugccagggcc

SEQ ID NO: 1480244 - RNA, 14 nt, Pseudomonas aeruginosa PA01
cgcaugcagggcgu

SEQ ID NO: 1480245 - RNA, 20 nt, Pseudomonas aeruginosa PA01
cgcauccgcccgaucgccuc

SEQ ID NO: 1480246 - RNA, 12 nt, Pseudomonas aeruginosa PA01
cgcaugaucgcc

SEQ ID NO: 1480247 - RNA, 14 nt, Pseudomonas aeruginosa PA01
cgcaugaucgccuc

SEQ ID NO: 1480248 - RNA, 15 nt, Pseudomonas aeruginosa PA01
cgcaugaucgccucg

SEQ ID NO: 1480249 - RNA, 13 nt, Pseudomonas aeruginosa PA01
cgcaguugccagg

SEQ ID NO: 1480250 - RNA, 22 nt, Pseudomonas aeruginosa PA01
cgcaguucguccaucgccaggc

SEQ ID NO: 1480251 - RNA, 15 nt, Pseudomonas aeruginosa PA01
cgcaguucgucgccc

SEQ ID NO: 1480252 - RNA, 22 nt, Pseudomonas aeruginosa PA01
cgcaguucgucuuccagcggcc

SEQ ID NO: 1480253 - RNA, 14 nt, Pseudomonas aeruginosa PA01
cgcaguucgccccg

SEQ ID NO: 1480254 - RNA, 19 nt, Pseudomonas aeruginosa PA01
cgcaguucgccccgccgcc

SEQ ID NO: 1480255 - RNA, 20 nt, Pseudomonas aeruginosa PA01
cgcaguucgccccgccgcca

SEQ ID NO: 1480256 - RNA, 14 nt, Pseudomonas aeruginosa PA01
cgcaguucgccgcc

SEQ ID NO: 1480257 - RNA, 14 nt, Pseudomonas aeruginosa PA01
cgcaguucgcgggc

SEQ ID NO: 1480258 - RNA, 22 nt, Pseudomonas aeruginosa PA01
cgcaguucgcgggccgcggcga

SEQ ID NO: 1480259 - RNA, 20 nt, Pseudomonas aeruginosa PA01
cgcaguuccuugggcaucga

SEQ ID NO: 1480260 - RNA, 22 nt, Pseudomonas aeruginosa PA01
cgcaguuccuugggcaucgaga

SEQ ID NO: 1480261 - RNA, 12 nt, Pseudomonas aeruginosa PA01
cgcauaggcggc

SEQ ID NO: 1480262 - RNA, 22 nt, Pseudomonas aeruginosa PA01
cgcauaggaggcgcuuucccgc

SEQ ID NO: 1480263 - RNA, 22 nt, Pseudomonas aeruginosa PA01
cgcauagcugaucucggcgacu

SEQ ID NO: 1480264 - RNA, 19 nt, Pseudomonas aeruginosa PA01
cgcauagcaggccuggagc

SEQ ID NO: 1480265 - RNA, 17 nt, Pseudomonas aeruginosa PA01
cgcauagccaccgccga

SEQ ID NO: 1480266 - RNA, 20 nt, Pseudomonas aeruginosa PA01
cgcauagccaccgccgacau

SEQ ID NO: 1480267 - RNA, 21 nt, Pseudomonas aeruginosa PA01
cgcauagccaccgccgacauc

SEQ ID NO: 1480268 - RNA, 16 nt, Pseudomonas aeruginosa PA01
cgcauagccggcgcgc

SEQ ID NO: 1480269 - RNA, 22 nt, Pseudomonas aeruginosa PA01
cgcauagccggcgcgcccggcg

SEQ ID NO: 1480270 - RNA, 22 nt, Pseudomonas aeruginosa PA01
cgcauaggugggaacgaaacgc

SEQ ID NO: 1480271 - RNA, 22 nt, Pseudomonas aeruginosa PA01
cgcaucaccccgcaaccgcaga

SEQ ID NO: 1480272 - RNA, 13 nt, Pseudomonas aeruginosa PA01
cgcagggccgcgg

SEQ ID NO: 1480273 - RNA, 17 nt, Pseudomonas aeruginosa PA01
cgcagggccgcggcguu

SEQ ID NO: 1480274 - RNA, 22 nt, Pseudomonas aeruginosa PA01
cgcagggccucuucgcaacggc

SEQ ID NO: 1480275 - RNA, 14 nt, Pseudomonas aeruginosa PA01
cgcagggcggcgag

SEQ ID NO: 1480276 - RNA, 15 nt, Pseudomonas aeruginosa PA01
cgcagggcggcgccu

SEQ ID NO: 1480277 - RNA, 23 nt, Pseudomonas aeruginosa PA01
cgcagggcggcgccuggagcaga

SEQ ID NO: 1480278 - RNA, 18 nt, Pseudomonas aeruginosa PA01
cgcagggcgucgaaggcg

SEQ ID NO: 1480279 - RNA, 22 nt, Pseudomonas aeruginosa PA01
cgcagggcguucuucacccgca

SEQ ID NO: 1480280 - RNA, 14 nt, Pseudomonas aeruginosa PA01
cgcagggcucgugc

SEQ ID NO: 1480281 - RNA, 21 nt, Pseudomonas aeruginosa PA01
cgcagggucaggcccuugagg

SEQ ID NO: 1480282 - RNA, 20 nt, Pseudomonas aeruginosa PA01
cgcagggcuuccuuggcggg

SEQ ID NO: 1480283 - RNA, 14 nt, Pseudomonas aeruginosa PA01
cgcaggggcaccgg

SEQ ID NO: 1480284 - RNA, 16 nt, Pseudomonas aeruginosa PA01
cgcaggggcaccggcg

SEQ ID NO: 1480285 - RNA, 20 nt, Pseudomonas aeruginosa PA01
cgcaggggcaccggcggauu

SEQ ID NO: 1480286 - RNA, 15 nt, Pseudomonas aeruginosa PA01
cgcaggggcgcgccg

SEQ ID NO: 1480287 - RNA, 16 nt, Pseudomonas aeruginosa PA01
cgcaggggcgcgccgg

SEQ ID NO: 1480288 - RNA, 19 nt, Pseudomonas aeruginosa PA01
cgcaggggcgcgccggcuu

SEQ ID NO: 1480289 - RNA, 23 nt, Pseudomonas aeruginosa PA01
cgcaggguucggggaacagcgcc

SEQ ID NO: 1480290 - RNA, 14 nt, Pseudomonas aeruginosa PA01
cgcaguagaagcag

SEQ ID NO: 1480291 - RNA, 19 nt, Pseudomonas aeruginosa PA01
cgcaguagaagcaguagua

SEQ ID NO: 1480292 - RNA, 18 nt, Pseudomonas aeruginosa PA01
cgcaguagaugccgcguc

SEQ ID NO: 1480293 - RNA, 17 nt, Pseudomonas aeruginosa PA01
cgcagguagcggcgaag

SEQ ID NO: 1480294 - RNA, 17 nt, Pseudomonas aeruginosa PA01
cgcagguacucgccggc

SEQ ID NO: 1480295 - RNA, 19 nt, Pseudomonas aeruginosa PA01
cgcagguacucgccggcga

SEQ ID NO: 1480296 - RNA, 21 nt, Pseudomonas aeruginosa PA01
cgcagguacucgccggcgauc

SEQ ID NO: 1480297 - RNA, 19 nt, Pseudomonas aeruginosa PA01
cgcagguaacccgcggcga

SEQ ID NO: 1480298 - RNA, 22 nt, Pseudomonas aeruginosa PA01
cgcagguaacccgcggcgaggu

SEQ ID NO: 1480299 - RNA, 23 nt, Pseudomonas aeruginosa PA01
cgcagggucgcguuggcgugcuc

SEQ ID NO: 1480300 - RNA, 22 nt, Pseudomonas aeruginosa PA01
cgcagggugagcauggcguuga

SEQ ID NO: 1480301 - RNA, 16 nt, Pseudomonas aeruginosa PA01
cgcagggugcccucgu

SEQ ID NO: 1480302 - RNA, 17 nt, Pseudomonas aeruginosa PA01
cgcaguagcucgccgag

SEQ ID NO: 1480303 - RNA, 18 nt, Pseudomonas aeruginosa PA01
cgcaguagcucgccgagg

SEQ ID NO: 1480304 - RNA, 15 nt, Pseudomonas aeruginosa PA01
cgcaguaggccuggu

SEQ ID NO: 1480305 - RNA, 17 nt, Pseudomonas aeruginosa PA01
cgcaguaggcgcugccg

SEQ ID NO: 1480306 - RNA, 23 nt, Pseudomonas aeruginosa PA01
cgcaguccgguagcgcgccugcu

SEQ ID NO: 1480307 - RNA, 16 nt, Pseudomonas aeruginosa PA01
cgcagucccgcgcggc

SEQ ID NO: 1480308 - RNA, 17 nt, Pseudomonas aeruginosa PA01
cgcagucccgcgcggcc

SEQ ID NO: 1480309 - RNA, 14 nt, Pseudomonas aeruginosa PA01
cgcagugucgcgaa

SEQ ID NO: 1480310 - RNA, 23 nt, Pseudomonas aeruginosa PA01
cgcagugucgcgaacucggcgcc

SEQ ID NO: 1480311 - RNA, 13 nt, Pseudomonas aeruginosa PA01
cgcagccgcgcaa

SEQ ID NO: 1480312 - RNA, 21 nt, Pseudomonas aeruginosa PA01
cgcagccgcgcaaccguucca

SEQ ID NO: 1480313 - RNA, 12 nt, Pseudomonas aeruginosa PA01
cgcagccgcgcu

SEQ ID NO: 1480314 - RNA, 15 nt, Pseudomonas aeruginosa PA01
cgcagccgcgcucgg

SEQ ID NO: 1480315 - RNA, 20 nt, Pseudomonas aeruginosa PA01
cgcagccgcgcucggccagu

SEQ ID NO: 1480316 - RNA, 15 nt, Pseudomonas aeruginosa PA01
cgcagccgcgugcgc

SEQ ID NO: 1480317 - RNA, 21 nt, Pseudomonas aeruginosa PA01
cgcagccgcgugcgcgccgcc

SEQ ID NO: 1480318 - RNA, 23 nt, Pseudomonas aeruginosa PA01
cgcagccgcgugcgcgccgccgg

SEQ ID NO: 1480319 - RNA, 12 nt, Pseudomonas aeruginosa PA01
cgcagccgcugg

SEQ ID NO: 1480320 - RNA, 14 nt, Pseudomonas aeruginosa PA01
cgcagcgcgggggc

SEQ ID NO: 1480321 - RNA, 18 nt, Pseudomonas aeruginosa PA01
cgcagccgcucggccgcc

SEQ ID NO: 1480322 - RNA, 11 nt, Pseudomonas aeruginosa PA01
cgcagccgcug

SEQ ID NO: 1480323 - RNA, 16 nt, Pseudomonas aeruginosa PA01
cgcagcgcgcgucggc

SEQ ID NO: 1480324 - RNA, 13 nt, Pseudomonas aeruginosa PA01
cgcagccggcgaa

SEQ ID NO: 1480325 - RNA, 12 nt, Pseudomonas aeruginosa PA01
cgcagcgcgcgc

SEQ ID NO: 1480326 - RNA, 15 nt, Pseudomonas aeruginosa PA01
cgcagcgcgcgccga

SEQ ID NO: 1480327 - RNA, 17 nt, Pseudomonas aeruginosa PA01
cgcagcgcgcgccgagc

SEQ ID NO: 1480328 - RNA, 14 nt, Pseudomonas aeruginosa PA01
cgcagcggcaugcc

SEQ ID NO: 1480329 - RNA, 16 nt, Pseudomonas aeruginosa PA01
cgcagcggcaugcccu

SEQ ID NO: 1480330 - RNA, 13 nt, Pseudomonas aeruginosa PA01
cgcagcggccccg

SEQ ID NO: 1480331 - RNA, 11 nt, Pseudomonas aeruginosa PA01
cgcagcggcag

SEQ ID NO: 1480332 - RNA, 17 nt, Pseudomonas aeruginosa PA01
cgcagcggcagcgccag

SEQ ID NO: 1480333 - RNA, 16 nt, Pseudomonas aeruginosa PA01
cgcagcggcagcggcu

SEQ ID NO: 1480334 - RNA, 17 nt, Pseudomonas aeruginosa PA01
cgcagcggcagcggcuc

SEQ ID NO: 1480335 - RNA, 14 nt, Pseudomonas aeruginosa PA01
cgcagcggcaggcc

SEQ ID NO: 1480336 - RNA, 13 nt, Pseudomonas aeruginosa PA01
cgcagcggcgucu

SEQ ID NO: 1480337 - RNA, 14 nt, Pseudomonas aeruginosa PA01
cgcagcggcgaacc

SEQ ID NO: 1480338 - RNA, 16 nt, Pseudomonas aeruginosa PA01
cgcagcggcgccgagg

SEQ ID NO: 1480339 - RNA, 13 nt, Pseudomonas aeruginosa PA01
cgcagcgucaccg

SEQ ID NO: 1480340 - RNA, 15 nt, Pseudomonas aeruginosa PA01
cgcagcgucaccgcg

SEQ ID NO: 1480341 - RNA, 21 nt, Pseudomonas aeruginosa PA01
cgcagcgucaccgcgucggga

SEQ ID NO: 1480342 - RNA, 16 nt, Pseudomonas aeruginosa PA01
cgcagcguccugcccu

SEQ ID NO: 1480343 - RNA, 20 nt, Pseudomonas aeruginosa PA01
cgcagcucugcgaucagggc

SEQ ID NO: 1480344 - RNA, 18 nt, Pseudomonas aeruginosa PA01
cgcagcugguaggagccg

SEQ ID NO: 1480345 - RNA, 20 nt, Pseudomonas aeruginosa PA01
cgcagcuucugcagggcggc

SEQ ID NO: 1480346 - RNA, 21 nt, Pseudomonas aeruginosa PA01
cgcagcuucugcagggcggcu

SEQ ID NO: 1480347 - RNA, 21 nt, Pseudomonas aeruginosa PA01
cgcagcuugcucgaugccauc

SEQ ID NO: 1480348 - RNA, 19 nt, Pseudomonas aeruginosa PA01
cgcagcuccucggcguggc

SEQ ID NO: 1480349 - RNA, 14 nt, Pseudomonas aeruginosa PA01
cgcagcucggugag

SEQ ID NO: 1480350 - RNA, 18 nt, Pseudomonas aeruginosa PA01
cgcagcucggugagcagg

SEQ ID NO: 1480351 - RNA, 22 nt, Pseudomonas aeruginosa PA01
cgcagcucggugagcaggcgcc

SEQ ID NO: 1480352 - RNA, 12 nt, Pseudomonas aeruginosa PA01
cgcagcguucca

SEQ ID NO: 1480353 - RNA, 14 nt, Pseudomonas aeruginosa PA01
cgcagcuccagcgg

SEQ ID NO: 1480354 - RNA, 15 nt, Pseudomonas aeruginosa PA01
cgcagcuccggcagc

SEQ ID NO: 1480355 - RNA, 17 nt, Pseudomonas aeruginosa PA01
cgcagcuccggcagcag

SEQ ID NO: 1480356 - RNA, 18 nt, Pseudomonas aeruginosa PA01
cgcagcuccggcagcagg

SEQ ID NO: 1480357 - RNA, 19 nt, Pseudomonas aeruginosa PA01
cgcaggaaaccccucggcu

SEQ ID NO: 1480358 - RNA, 20 nt, Pseudomonas aeruginosa PA01
cgcaggaaaccccucggcua

SEQ ID NO: 1480359 - RNA, 21 nt, Pseudomonas aeruginosa PA01
cgcaggaacagcuccuccagc

SEQ ID NO: 1480360 - RNA, 21 nt, Pseudomonas aeruginosa PA01
cgcaggaacuggucgauccgc

SEQ ID NO: 1480361 - RNA, 17 nt, Pseudomonas aeruginosa PA01
cgcaggaaccgacgcgc

SEQ ID NO: 1480362 - RNA, 18 nt, Pseudomonas aeruginosa PA01
cgcaggaaccgacgcgca

SEQ ID NO: 1480363 - RNA, 21 nt, Pseudomonas aeruginosa PA01
cgcaggaaccgacgcgcagga

SEQ ID NO: 1480364 - RNA, 17 nt, Pseudomonas aeruginosa PA01
cgcaggaagaaggcguc

SEQ ID NO: 1480365 - RNA, 19 nt, Pseudomonas aeruginosa PA01
cgcaggaagaaggcgucca

SEQ ID NO: 1480366 - RNA, 20 nt, Pseudomonas aeruginosa PA01
cgcaggaagcugcgcucgga

SEQ ID NO: 1480367 - RNA, 15 nt, Pseudomonas aeruginosa PA01
cgcaggccugguagg

SEQ ID NO: 1480368 - RNA, 13 nt, Pseudomonas aeruginosa PA01
cgcaggccuucga

SEQ ID NO: 1480369 - RNA, 19 nt, Pseudomonas aeruginosa PA01
cgcaggcgaacugccgacg

SEQ ID NO: 1480370 - RNA, 23 nt, Pseudomonas aeruginosa PA01
cgcaggcgaacugccgacggcgg

SEQ ID NO: 1480371 - RNA, 15 nt, Pseudomonas aeruginosa PA01
cgcaggaccacgcug

SEQ ID NO: 1480372 - RNA, 12 nt, Pseudomonas aeruginosa PA01
cgcaggaccaga

SEQ ID NO: 1480373 - RNA, 19 nt, Pseudomonas aeruginosa PA01
cgcaggaccgccauggcgc

SEQ ID NO: 1480374 - RNA, 18 nt, Pseudomonas aeruginosa PA01
cgcaggcgaugaucagcc

SEQ ID NO: 1480375 - RNA, 14 nt, Pseudomonas aeruginosa PA01
cgcaggcgaugccg

SEQ ID NO: 1480376 - RNA, 17 nt, Pseudomonas aeruginosa PA01
cgcaggcgaugccgacg

SEQ ID NO: 1480377 - RNA, 13 nt, Pseudomonas aeruginosa PA01
cgcaggcgaggau

SEQ ID NO: 1480378 - RNA, 21 nt, Pseudomonas aeruginosa PA01
cgcaggcgaggauggccgucc

SEQ ID NO: 1480379 - RNA, 15 nt, Pseudomonas aeruginosa PA01
cgcaggcgcuggcgg

SEQ ID NO: 1480380 - RNA, 18 nt, Pseudomonas aeruginosa PA01
cgcaggcgcuucagcgcc

SEQ ID NO: 1480381 - RNA, 21 nt, Pseudomonas aeruginosa PA01
cgcaggcggaaauacggcucc

SEQ ID NO: 1480382 - RNA, 15 nt, Pseudomonas aeruginosa PA01
cgcaggcggaucgcc

SEQ ID NO: 1480383 - RNA, 19 nt, Pseudomonas aeruginosa PA01
cgcaggcggaucgcccggc

SEQ ID NO: 1480384 - RNA, 22 nt, Pseudomonas aeruginosa PA01
cgcaggcggaucgcccggcgcu

SEQ ID NO: 1480385 - RNA, 15 nt, Pseudomonas aeruginosa PA01
cgcaggcgcucgcgg

SEQ ID NO: 1480386 - RNA, 17 nt, Pseudomonas aeruginosa PA01
cgcaggcgcuauccgcc

SEQ ID NO: 1480387 - RNA, 12 nt, Pseudomonas aeruginosa PA01
cgcaccgccagc

SEQ ID NO: 1480388 - RNA, 13 nt, Pseudomonas aeruginosa PA01
cgcaccgccagca

SEQ ID NO: 1480389 - RNA, 13 nt, Pseudomonas aeruginosa PA01
cgcaccgccaagg

SEQ ID NO: 1480390 - RNA, 17 nt, Pseudomonas aeruginosa PA01
cgcaccgccagcgucgc

SEQ ID NO: 1480391 - RNA, 20 nt, Pseudomonas aeruginosa PA01
cgcaccgccagcgucgccgc

SEQ ID NO: 1480392 - RNA, 21 nt, Pseudomonas aeruginosa PA01
cgcagaaggcgcuuucguagg

SEQ ID NO: 1480393 - RNA, 22 nt, Pseudomonas aeruginosa PA01
cgcagaaggcgcuuucguaggg

SEQ ID NO: 1480394 - RNA, 15 nt, Pseudomonas aeruginosa PA01
cgcaccgccucgugc

SEQ ID NO: 1480395 - RNA, 23 nt, Pseudomonas aeruginosa PA01
cgcaccgccucgugcagcaagcc

SEQ ID NO: 1480396 - RNA, 18 nt, Pseudomonas aeruginosa PA01
cgcaccgccugcagcacc

SEQ ID NO: 1480397 - RNA, 16 nt, Pseudomonas aeruginosa PA01
cgcagacaggccucca

SEQ ID NO: 1480398 - RNA, 18 nt, Pseudomonas aeruginosa PA01
cgcagacaggccuccagc

SEQ ID NO: 1480399 - RNA, 17 nt, Pseudomonas aeruginosa PA01
cgcagacaucgccgagg

SEQ ID NO: 1480400 - RNA, 19 nt, Pseudomonas aeruginosa PA01
cgcagacaucgccgagggc

SEQ ID NO: 1480401 - RNA, 12 nt, Pseudomonas aeruginosa PA01
cgcagaccagcg

SEQ ID NO: 1480402 - RNA, 22 nt, Pseudomonas aeruginosa PA01
cgcagaccagcgaaccgccggc

SEQ ID NO: 1480403 - RNA, 23 nt, Pseudomonas aeruginosa PA01
cgcagaccagcgaaccgccggcc

SEQ ID NO: 1480404 - RNA, 16 nt, Pseudomonas aeruginosa PA01
cgcagacuccggcgca

SEQ ID NO: 1480405 - RNA, 16 nt, Pseudomonas aeruginosa PA01
cgcagacgggugcuga

SEQ ID NO: 1480406 - RNA, 19 nt, Pseudomonas aeruginosa PA01
cgcagacgucuuccgggac

SEQ ID NO: 1480407 - RNA, 21 nt, Pseudomonas aeruginosa PA01
cgcagacguggcauucgucgc

SEQ ID NO: 1480408 - RNA, 22 nt, Pseudomonas aeruginosa PA01
cgcagacguggcauucgucgcc

SEQ ID NO: 1480409 - RNA, 16 nt, Pseudomonas aeruginosa PA01
cgcagagggcgaugcc

SEQ ID NO: 1480410 - RNA, 21 nt, Pseudomonas aeruginosa PA01
cgcagagcggugaaaccggca

SEQ ID NO: 1480411 - RNA, 13 nt, Pseudomonas aeruginosa PA01
cgcagagaucggc

SEQ ID NO: 1480412 - RNA, 15 nt, Pseudomonas aeruginosa PA01
cgcagagaucggcgg

SEQ ID NO: 1480413 - RNA, 18 nt, Pseudomonas aeruginosa PA01
cgcagagaucggcggcgc

SEQ ID NO: 1480414 - RNA, 17 nt, Pseudomonas aeruginosa PA01
cgcagagcaucacccgc

SEQ ID NO: 1480415 - RNA, 22 nt, Pseudomonas aeruginosa PA01
cgcagagccagccgcagcccgg

SEQ ID NO: 1480416 - RNA, 16 nt, Pseudomonas aeruginosa PA01
cgcagagcgccagcca

SEQ ID NO: 1480417 - RNA, 19 nt, Pseudomonas aeruginosa PA01
cgcagagcgccaugacccg

SEQ ID NO: 1480418 - RNA, 17 nt, Pseudomonas aeruginosa PA01
cgcagagcggcaggccg

SEQ ID NO: 1480419 - RNA, 22 nt, Pseudomonas aeruginosa PA01
cgcagagcggcaggccgccgau

SEQ ID NO: 1480420 - RNA, 20 nt, Pseudomonas aeruginosa PA01
cgcagaucgcggcgcaggcu

SEQ ID NO: 1480421 - RNA, 15 nt, Pseudomonas aeruginosa PA01
cgcagaucgccgcgu

SEQ ID NO: 1480422 - RNA, 19 nt, Pseudomonas aeruginosa PA01
cgcagcaggcguucggcga

SEQ ID NO: 1480423 - RNA, 22 nt, Pseudomonas aeruginosa PA01
cgcagcagguagugcggcgggc

SEQ ID NO: 1480424 - RNA, 13 nt, Pseudomonas aeruginosa PA01
cgcagcagggcgu

SEQ ID NO: 1480425 - RNA, 14 nt, Pseudomonas aeruginosa PA01
cgcagcagggcguc

SEQ ID NO: 1480426 - RNA, 15 nt, Pseudomonas aeruginosa PA01
cgcagcaacuggucg

SEQ ID NO: 1480427 - RNA, 19 nt, Pseudomonas aeruginosa PA01
cgcagcaacuguccgacca

SEQ ID NO: 1480428 - RNA, 19 nt, Pseudomonas aeruginosa PA01
cgcagaugucggucaugcc

SEQ ID NO: 1480429 - RNA, 15 nt, Pseudomonas aeruginosa PA01
cgcagcaacgcgacg

SEQ ID NO: 1480430 - RNA, 17 nt, Pseudomonas aeruginosa PA01
cgcagcaacgcgacgau

SEQ ID NO: 1480431 - RNA, 20 nt, Pseudomonas aeruginosa PA01
cgcagcaacggcgcaucguc

SEQ ID NO: 1480432 - RNA, 19 nt, Pseudomonas aeruginosa PA01
cgcagaugcggggcgacca

SEQ ID NO: 1480433 - RNA, 21 nt, Pseudomonas aeruginosa PA01
cgcagaugcggggcgaccagc

SEQ ID NO: 1480434 - RNA, 16 nt, Pseudomonas aeruginosa PA01
cgcagaugaucgccac

SEQ ID NO: 1480435 - RNA, 17 nt, Pseudomonas aeruginosa PA01
cgcagaugaucgccacc

SEQ ID NO: 1480436 - RNA, 18 nt, Pseudomonas aeruginosa PA01
cgcagaugaucgccaccg

SEQ ID NO: 1480437 - RNA, 22 nt, Pseudomonas aeruginosa PA01
cgcagcccuugcaaccgccgcc

SEQ ID NO: 1480438 - RNA, 23 nt, Pseudomonas aeruginosa PA01
cgcagccgaauacccgguugccg

SEQ ID NO: 1480439 - RNA, 16 nt, Pseudomonas aeruginosa PA01
cgcagccgcaaggcca

SEQ ID NO: 1480440 - RNA, 23 nt, Pseudomonas aeruginosa PA01
cgcagccgcaaggccagggcggc

SEQ ID NO: 1480441 - RNA, 14 nt, Pseudomonas aeruginosa PA01
cgcagcccagccgc

SEQ ID NO: 1480442 - RNA, 22 nt, Pseudomonas aeruginosa PA01
cgcagcccagccgcucgcgucc

SEQ ID NO: 1480443 - RNA, 17 nt, Pseudomonas aeruginosa PA01
cgcagccauucgccgcg

SEQ ID NO: 1480444 - RNA, 18 nt, Pseudomonas aeruginosa PA01
cgcagccauucgccgcga

SEQ ID NO: 1480445 - RNA, 21 nt, Pseudomonas aeruginosa PA01
cgcagccauucgccgcgacgc

SEQ ID NO: 1480446 - RNA, 24 nt, Pseudomonas aeruginosa PA01
cgcagccauucgccgcgacgcucc

SEQ ID NO: 1480447 - RNA, 19 nt, Pseudomonas aeruginosa PA01
cgcagcaucuucucggcga

SEQ ID NO: 1480448 - RNA, 21 nt, Pseudomonas aeruginosa PA01
cgcagcaucuucucggcgauu

SEQ ID NO: 1480449 - RNA, 17 nt, Pseudomonas aeruginosa PA01
cgcaccccauccucgcc

SEQ ID NO: 1480450 - RNA, 18 nt, Pseudomonas aeruginosa PA01
cgcaccccauccucgccg

SEQ ID NO: 1480451 - RNA, 19 nt, Pseudomonas aeruginosa PA01
cgcaccccauccucgccgg

SEQ ID NO: 1480452 - RNA, 13 nt, Pseudomonas aeruginosa PA01
cgcaccauccucg

SEQ ID NO: 1480453 - RNA, 15 nt, Pseudomonas aeruginosa PA01
cgcaccauccgccgc

SEQ ID NO: 1480454 - RNA, 14 nt, Pseudomonas aeruginosa PA01
cgcaccagggucgg

SEQ ID NO: 1480455 - RNA, 17 nt, Pseudomonas aeruginosa PA01
cgcaccagggucgggcc

SEQ ID NO: 1480456 - RNA, 19 nt, Pseudomonas aeruginosa PA01
cgcaccagggucgggccgc

SEQ ID NO: 1480457 - RNA, 16 nt, Pseudomonas aeruginosa PA01
cgcacccgggcaacug

SEQ ID NO: 1480458 - RNA, 22 nt, Pseudomonas aeruginosa PA01
cgcacccgcgacucgagcacca

SEQ ID NO: 1480459 - RNA, 14 nt, Pseudomonas aeruginosa PA01
cgcaccgacgccgc

SEQ ID NO: 1480460 - RNA, 21 nt, Pseudomonas aeruginosa PA01
cgcaccgacgccgccugcgcc

SEQ ID NO: 1480461 - RNA, 14 nt, Pseudomonas aeruginosa PA01
cgcaccagcggguc

SEQ ID NO: 1480462 - RNA, 21 nt, Pseudomonas aeruginosa PA01
cgcaccagcgguacguagcgc

SEQ ID NO: 1480463 - RNA, 21 nt, Pseudomonas aeruginosa PA01
cgcaccaggccaggcugcgcu

SEQ ID NO: 1480464 - RNA, 20 nt, Pseudomonas aeruginosa PA01
cgcaccaggccagguggucg

SEQ ID NO: 1480465 - RNA, 13 nt, Pseudomonas aeruginosa PA01
cgcaccagccggc

SEQ ID NO: 1480466 - RNA, 15 nt, Pseudomonas aeruginosa PA01
cgcaccagccggccg

SEQ ID NO: 1480467 - RNA, 18 nt, Pseudomonas aeruginosa PA01
cgcaccagccggccgcgu

SEQ ID NO: 1480468 - RNA, 21 nt, Pseudomonas aeruginosa PA01
cgcaccaccuggcagguaucg

SEQ ID NO: 1480469 - RNA, 21 nt, Pseudomonas aeruginosa PA01
cgcaccagcacuuccggcgcg

SEQ ID NO: 1480470 - RNA, 13 nt, Pseudomonas aeruginosa PA01
cgcaccacccauc

SEQ ID NO: 1480471 - RNA, 12 nt, Pseudomonas aeruginosa PA01
cgcaccacccgc

SEQ ID NO: 1480472 - RNA, 14 nt, Pseudomonas aeruginosa PA01
cgcacaucacccgg

SEQ ID NO: 1480473 - RNA, 22 nt, Pseudomonas aeruginosa PA01
cgcacaucacccgguucucgcc

SEQ ID NO: 1480474 - RNA, 17 nt, Pseudomonas aeruginosa PA01
cgcacaggcuggccaga

SEQ ID NO: 1480475 - RNA, 13 nt, Pseudomonas aeruginosa PA01
cgcaaugccgcgu

SEQ ID NO: 1480476 - RNA, 17 nt, Pseudomonas aeruginosa PA01
cgcaauggcgcagccgc

SEQ ID NO: 1480477 - RNA, 19 nt, Pseudomonas aeruginosa PA01
cgcacaaaaaagcccgcca

SEQ ID NO: 1480478 - RNA, 20 nt, Pseudomonas aeruginosa PA01
cgcacaaaaaagcccgccag

SEQ ID NO: 1480479 - RNA, 12 nt, Pseudomonas aeruginosa PA01
cgcacaccgcgc

SEQ ID NO: 1480480 - RNA, 20 nt, Pseudomonas aeruginosa PA01
cgcacaacgccuuccuuguc

SEQ ID NO: 1480481 - RNA, 21 nt, Pseudomonas aeruginosa PA01
cgcacaacgccuuccuugucg

SEQ ID NO: 1480482 - RNA, 15 nt, Pseudomonas aeruginosa PA01
cgcaauccgccgcuc

SEQ ID NO: 1480483 - RNA, 15 nt, Pseudomonas aeruginosa PA01
cgcaauccucggugc

SEQ ID NO: 1480484 - RNA, 16 nt, Pseudomonas aeruginosa PA01
cgcaauagugcagcuc

SEQ ID NO: 1480485 - RNA, 17 nt, Pseudomonas aeruginosa PA01
cgcaauagugcagcucc

SEQ ID NO: 1480486 - RNA, 15 nt, Pseudomonas aeruginosa PA01
cgcaacugccggucg

SEQ ID NO: 1480487 - RNA, 19 nt, Pseudomonas aeruginosa PA01
cgcaacugccggucggccu

SEQ ID NO: 1480488 - RNA, 12 nt, Pseudomonas aeruginosa PA01
cgcaaggccagg

SEQ ID NO: 1480489 - RNA, 16 nt, Pseudomonas aeruginosa PA01
cgcaaggccagggcgg

SEQ ID NO: 1480490 - RNA, 21 nt, Pseudomonas aeruginosa PA01
cgcaagugcccugggcgaaca

SEQ ID NO: 1480491 - RNA, 12 nt, Pseudomonas aeruginosa PA01
cgcaagucggcc

SEQ ID NO: 1480492 - RNA, 15 nt, Pseudomonas aeruginosa PA01
cgcaagucggccugc

SEQ ID NO: 1480493 - RNA, 18 nt, Pseudomonas aeruginosa PA01
cgcaaguuacgcgcagcg

SEQ ID NO: 1480494 - RNA, 16 nt, Pseudomonas aeruginosa PA01
cgcaaguaccgccggc

SEQ ID NO: 1480495 - RNA, 18 nt, Pseudomonas aeruginosa PA01
cgcaaguaccgccggcag

SEQ ID NO: 1480496 - RNA, 19 nt, Pseudomonas aeruginosa PA01
cgcaaguaccgccggcagu

SEQ ID NO: 1480497 - RNA, 19 nt, Pseudomonas aeruginosa PA01
cgcaaggugcgggccgucg

SEQ ID NO: 1480498 - RNA, 20 nt, Pseudomonas aeruginosa PA01
cgcaaggugcgggccgucgu

SEQ ID NO: 1480499 - RNA, 22 nt, Pseudomonas aeruginosa PA01
cgcaaccccuucggucgcgccc

SEQ ID NO: 1480500 - RNA, 18 nt, Pseudomonas aeruginosa PA01
cgcaacccgcccggcuca

SEQ ID NO: 1480501 - RNA, 13 nt, Pseudomonas aeruginosa PA01
cgcaaccagcccu

SEQ ID NO: 1480502 - RNA, 21 nt, Pseudomonas aeruginosa PA01
cgcaaccagcccuggcgcaga

SEQ ID NO: 1480503 - RNA, 14 nt, Pseudomonas aeruginosa PA01
cgcaaccgcugccg

SEQ ID NO: 1480504 - RNA, 16 nt, Pseudomonas aeruginosa PA01
cgcaaccgguccucgc

SEQ ID NO: 1480505 - RNA, 20 nt, Pseudomonas aeruginosa PA01
cgcaaccguuccagcgccuc

SEQ ID NO: 1480506 - RNA, 15 nt, Pseudomonas aeruginosa PA01
cgcaacgggcggcgg

SEQ ID NO: 1480507 - RNA, 19 nt, Pseudomonas aeruginosa PA01
cgcaaaccggcagcaucuc

SEQ ID NO: 1480508 - RNA, 16 nt, Pseudomonas aeruginosa PA01
cgcaaacccccugcgc

SEQ ID NO: 1480509 - RNA, 13 nt, Pseudomonas aeruginosa PA01
cgauuguccaccg

SEQ ID NO: 1480510 - RNA, 23 nt, Pseudomonas aeruginosa PA01
cgaugucgcggcugaaggccgaa

SEQ ID NO: 1480511 - RNA, 13 nt, Pseudomonas aeruginosa PA01
cgaugucgcgggc

SEQ ID NO: 1480512 - RNA, 18 nt, Pseudomonas aeruginosa PA01
cgaugucguagccgcgcg

SEQ ID NO: 1480513 - RNA, 20 nt, Pseudomonas aeruginosa PA01
cgaugucguagccgcgcgcc

SEQ ID NO: 1480514 - RNA, 19 nt, Pseudomonas aeruginosa PA01
cgaugucguggucgccguc

SEQ ID NO: 1480515 - RNA, 21 nt, Pseudomonas aeruginosa PA01
cgaugucguggucgccgucca

SEQ ID NO: 1480516 - RNA, 18 nt, Pseudomonas aeruginosa PA01
cgauucgccggccaccag

SEQ ID NO: 1480517 - RNA, 13 nt, Pseudomonas aeruginosa PA01
cgauucgccgggc

SEQ ID NO: 1480518 - RNA, 22 nt, Pseudomonas aeruginosa PA01
cgauucgacgcagcgcgcgccg

SEQ ID NO: 1480519 - RNA, 21 nt, Pseudomonas aeruginosa PA01
cgauuggagaugcucaggcgc

SEQ ID NO: 1480520 - RNA, 18 nt, Pseudomonas aeruginosa PA01
cgaugguccccggccccg

SEQ ID NO: 1480521 - RNA, 13 nt, Pseudomonas aeruginosa PA01
cgauggucgccgc

SEQ ID NO: 1480522 - RNA, 15 nt, Pseudomonas aeruginosa PA01
cgauggcguguucau

SEQ ID NO: 1480523 - RNA, 19 nt, Pseudomonas aeruginosa PA01
cgauggcguuauucgcccu

SEQ ID NO: 1480524 - RNA, 18 nt, Pseudomonas aeruginosa PA01
cgaugguauggcggucgg

SEQ ID NO: 1480525 - RNA, 22 nt, Pseudomonas aeruginosa PA01
cgaugguauggcggucggccag

SEQ ID NO: 1480526 - RNA, 22 nt, Pseudomonas aeruginosa PA01
cgauggcgugaaguagccgccg

SEQ ID NO: 1480527 - RNA, 12 nt, Pseudomonas aeruginosa PA01
cgauggccgccg

SEQ ID NO: 1480528 - RNA, 12 nt, Pseudomonas aeruginosa PA01
cgauggcggccg

SEQ ID NO: 1480529 - RNA, 14 nt, Pseudomonas aeruginosa PA01
cgauggcggccgcc

SEQ ID NO: 1480530 - RNA, 15 nt, Pseudomonas aeruginosa PA01
cgauggcggccgcca

SEQ ID NO: 1480531 - RNA, 18 nt, Pseudomonas aeruginosa PA01
cgauggcggccugguagu

SEQ ID NO: 1480532 - RNA, 13 nt, Pseudomonas aeruginosa PA01
cgauggcggcggc

SEQ ID NO: 1480533 - RNA, 21 nt, Pseudomonas aeruginosa PA01
cgauggcguagaggcucggcg

SEQ ID NO: 1480534 - RNA, 19 nt, Pseudomonas aeruginosa PA01
cgauggucacuggcgaggc

SEQ ID NO: 1480535 - RNA, 19 nt, Pseudomonas aeruginosa PA01
cgauggugauacgcaggaa

SEQ ID NO: 1480536 - RNA, 20 nt, Pseudomonas aeruginosa PA01
cgauggugaucacgucggcg

SEQ ID NO: 1480537 - RNA, 20 nt, Pseudomonas aeruginosa PA01
cgauguccccggccagcagc

SEQ ID NO: 1480538 - RNA, 22 nt, Pseudomonas aeruginosa PA01
cgauguccccggccagcagcgc

SEQ ID NO: 1480539 - RNA, 20 nt, Pseudomonas aeruginosa PA01
cgauguccuggaucggcagc

SEQ ID NO: 1480540 - RNA, 22 nt, Pseudomonas aeruginosa PA01
cgauguccugggccaccuggcu

SEQ ID NO: 1480541 - RNA, 22 nt, Pseudomonas aeruginosa PA01
cgaugucgaacaacccgccagc

SEQ ID NO: 1480542 - RNA, 15 nt, Pseudomonas aeruginosa PA01
cgauguccgggaugc

SEQ ID NO: 1480543 - RNA, 18 nt, Pseudomonas aeruginosa PA01
cgauggcccagaugauca

SEQ ID NO: 1480544 - RNA, 19 nt, Pseudomonas aeruginosa PA01
cgauggccccggcgauccg

SEQ ID NO: 1480545 - RNA, 21 nt, Pseudomonas aeruginosa PA01
cgauggcccguuccaccgccu

SEQ ID NO: 1480546 - RNA, 17 nt, Pseudomonas aeruginosa PA01
cgauggccgccagcagg

SEQ ID NO: 1480547 - RNA, 19 nt, Pseudomonas aeruginosa PA01
cgauggccgccagcaggcc

SEQ ID NO: 1480548 - RNA, 20 nt, Pseudomonas aeruginosa PA01
cgauggccgccagcaggccg

SEQ ID NO: 1480549 - RNA, 22 nt, Pseudomonas aeruginosa PA01
cgauggccgccagcaggccgaa

SEQ ID NO: 1480550 - RNA, 13 nt, Pseudomonas aeruginosa PA01
cgauggccgccgc

SEQ ID NO: 1480551 - RNA, 15 nt, Pseudomonas aeruginosa PA01
cgauggccgccgccg

SEQ ID NO: 1480552 - RNA, 20 nt, Pseudomonas aeruginosa PA01
cgauggccgccgccgccguc

SEQ ID NO: 1480553 - RNA, 17 nt, Pseudomonas aeruginosa PA01
cgauggccggcaccagc

SEQ ID NO: 1480554 - RNA, 14 nt, Pseudomonas aeruginosa PA01
cgauggccggcagc

SEQ ID NO: 1480555 - RNA, 17 nt, Pseudomonas aeruginosa PA01
cgauggccggcagcagc

SEQ ID NO: 1480556 - RNA, 19 nt, Pseudomonas aeruginosa PA01
cgauggccggcagcagcgc

SEQ ID NO: 1480557 - RNA, 21 nt, Pseudomonas aeruginosa PA01
cgauggccggcagcagcgcca

SEQ ID NO: 1480558 - RNA, 16 nt, Pseudomonas aeruginosa PA01
cgaugcuggcaacggc

SEQ ID NO: 1480559 - RNA, 20 nt, Pseudomonas aeruginosa PA01
cgaugcugucagcgcccggc

SEQ ID NO: 1480560 - RNA, 23 nt, Pseudomonas aeruginosa PA01
cgauggccagggggccuggcucg

SEQ ID NO: 1480561 - RNA, 13 nt, Pseudomonas aeruginosa PA01
cgauggccagccc

SEQ ID NO: 1480562 - RNA, 15 nt, Pseudomonas aeruginosa PA01
cgauggccagcgcgu

SEQ ID NO: 1480563 - RNA, 19 nt, Pseudomonas aeruginosa PA01
cgaugcugaucacccgccc

SEQ ID NO: 1480564 - RNA, 21 nt, Pseudomonas aeruginosa PA01
cgaugcugaucacccgcccgc

SEQ ID NO: 1480565 - RNA, 23 nt, Pseudomonas aeruginosa PA01
cgaugcugaucacccgcccgccg

SEQ ID NO: 1480566 - RNA, 21 nt, Pseudomonas aeruginosa PA01
cgaugcugaaccuguugcuca

SEQ ID NO: 1480567 - RNA, 20 nt, Pseudomonas aeruginosa PA01
cgaugcugcugaucaggagg

SEQ ID NO: 1480568 - RNA, 22 nt, Pseudomonas aeruginosa PA01
cgaugcugcugaucaggaggau

SEQ ID NO: 1480569 - RNA, 20 nt, Pseudomonas aeruginosa PA01
cgaugccccauccgacgccg

SEQ ID NO: 1480570 - RNA, 21 nt, Pseudomonas aeruginosa PA01
cgaugccccauccgacgccgg

SEQ ID NO: 1480571 - RNA, 13 nt, Pseudomonas aeruginosa PA01
cgaugcccaggcc

SEQ ID NO: 1480572 - RNA, 16 nt, Pseudomonas aeruginosa PA01
cgaugcccaggccgau

SEQ ID NO: 1480573 - RNA, 12 nt, Pseudomonas aeruginosa PA01
cgaugcccgccu

SEQ ID NO: 1480574 - RNA, 16 nt, Pseudomonas aeruginosa PA01
cgaugcccgccagcag

SEQ ID NO: 1480575 - RNA, 17 nt, Pseudomonas aeruginosa PA01
cgaugcccgccagcagg

SEQ ID NO: 1480576 - RNA, 18 nt, Pseudomonas aeruginosa PA01
cgaugcccucgcggcggc

SEQ ID NO: 1480577 - RNA, 22 nt, Pseudomonas aeruginosa PA01
cgaugcccucgcggcggcaggc

SEQ ID NO: 1480578 - RNA, 19 nt, Pseudomonas aeruginosa PA01
cgaugcccuggccgcugcc

SEQ ID NO: 1480579 - RNA, 18 nt, Pseudomonas aeruginosa PA01
cgaugcguccgcgcaggc

SEQ ID NO: 1480580 - RNA, 13 nt, Pseudomonas aeruginosa PA01
cgaugcucagcgc

SEQ ID NO: 1480581 - RNA, 14 nt, Pseudomonas aeruginosa PA01
cgaugcucagcgcc

SEQ ID NO: 1480582 - RNA, 17 nt, Pseudomonas aeruginosa PA01
cgaugcucagcgccggc

SEQ ID NO: 1480583 - RNA, 19 nt, Pseudomonas aeruginosa PA01
cgaugcucagcgccggcca

SEQ ID NO: 1480584 - RNA, 15 nt, Pseudomonas aeruginosa PA01
cgaugcucgcgccag

SEQ ID NO: 1480585 - RNA, 18 nt, Pseudomonas aeruginosa PA01
cgaugcucgcgccagccc

SEQ ID NO: 1480586 - RNA, 23 nt, Pseudomonas aeruginosa PA01
cgaugcucggugugaucaccagc

SEQ ID NO: 1480587 - RNA, 16 nt, Pseudomonas aeruginosa PA01
cgaugcguuccagggc

SEQ ID NO: 1480588 - RNA, 15 nt, Pseudomonas aeruginosa PA01
cgauaggccuugccu

SEQ ID NO: 1480589 - RNA, 16 nt, Pseudomonas aeruginosa PA01
cgauaggcgcgcaacg

SEQ ID NO: 1480590 - RNA, 21 nt, Pseudomonas aeruginosa PA01
cgauagcguccaggugcggcu

SEQ ID NO: 1480591 - RNA, 16 nt, Pseudomonas aeruginosa PA01
cgauaucccgccgccg

SEQ ID NO: 1480592 - RNA, 17 nt, Pseudomonas aeruginosa PA01
cgauaucccgccgccgc

SEQ ID NO: 1480593 - RNA, 15 nt, Pseudomonas aeruginosa PA01
cgauauccguagccg

SEQ ID NO: 1480594 - RNA, 22 nt, Pseudomonas aeruginosa PA01
cgauaucgcaggccaggcccca

SEQ ID NO: 1480595 - RNA, 17 nt, Pseudomonas aeruginosa PA01
cgaucaacgcggccagc

SEQ ID NO: 1480596 - RNA, 12 nt, Pseudomonas aeruginosa PA01
cgauaucggcgc

SEQ ID NO: 1480597 - RNA, 13 nt, Pseudomonas aeruginosa PA01
cgauaucggcgcc

SEQ ID NO: 1480598 - RNA, 15 nt, Pseudomonas aeruginosa PA01
cgauaacaccaggag

SEQ ID NO: 1480599 - RNA, 20 nt, Pseudomonas aeruginosa PA01
cgauaaccgcguugcgguua

SEQ ID NO: 1480600 - RNA, 18 nt, Pseudomonas aeruginosa PA01
cgaggcggauuugccgcc

SEQ ID NO: 1480601 - RNA, 20 nt, Pseudomonas aeruginosa PA01
cgaggcggauuugccgccga

SEQ ID NO: 1480602 - RNA, 20 nt, Pseudomonas aeruginosa PA01
cgaggcgucgaaacgggcgc

SEQ ID NO: 1480603 - RNA, 16 nt, Pseudomonas aeruginosa PA01
cgaggcgucgaucauc

SEQ ID NO: 1480604 - RNA, 11 nt, Pseudomonas aeruginosa PA01
cgaggcgucgg

SEQ ID NO: 1480605 - RNA, 12 nt, Pseudomonas aeruginosa PA01
cgaggcgucggc

SEQ ID NO: 1480606 - RNA, 22 nt, Pseudomonas aeruginosa PA01
cgaggcguuccaggugguggcg

SEQ ID NO: 1480607 - RNA, 15 nt, Pseudomonas aeruginosa PA01
cgaggcguucgucga

SEQ ID NO: 1480608 - RNA, 23 nt, Pseudomonas aeruginosa PA01
cgaggcguaccggcuacaggccg

SEQ ID NO: 1480609 - RNA, 17 nt, Pseudomonas aeruginosa PA01
cgaggcggugcagcgga

SEQ ID NO: 1480610 - RNA, 12 nt, Pseudomonas aeruginosa PA01
cgaggcgggcgc

SEQ ID NO: 1480611 - RNA, 13 nt, Pseudomonas aeruginosa PA01
cgaggcgggcgcg

SEQ ID NO: 1480612 - RNA, 20 nt, Pseudomonas aeruginosa PA01
cgaggcgggcgcggaucggc

SEQ ID NO: 1480613 - RNA, 16 nt, Pseudomonas aeruginosa PA01
cgaggcggcgcagcaa

SEQ ID NO: 1480614 - RNA, 14 nt, Pseudomonas aeruginosa PA01
cgaggcgcucgacg

SEQ ID NO: 1480615 - RNA, 20 nt, Pseudomonas aeruginosa PA01
cgaggcgcucgacgaucagg

SEQ ID NO: 1480616 - RNA, 23 nt, Pseudomonas aeruginosa PA01
cgaggcgcuucugcucggccugg

SEQ ID NO: 1480617 - RNA, 12 nt, Pseudomonas aeruginosa PA01
cgaggcggaaac

SEQ ID NO: 1480618 - RNA, 22 nt, Pseudomonas aeruginosa PA01
cgaggcggaagaaaagaaggcg

SEQ ID NO: 1480619 - RNA, 18 nt, Pseudomonas aeruginosa PA01
cgaggcggaagacgaucu

SEQ ID NO: 1480620 - RNA, 20 nt, Pseudomonas aeruginosa PA01
cgaggcggagaagccgcuga

SEQ ID NO: 1480621 - RNA, 13 nt, Pseudomonas aeruginosa PA01
cgaucaucgccac

SEQ ID NO: 1480622 - RNA, 17 nt, Pseudomonas aeruginosa PA01
cgaucaucgccaccggu

SEQ ID NO: 1480623 - RNA, 15 nt, Pseudomonas aeruginosa PA01
cgaucaucgccagcg

SEQ ID NO: 1480624 - RNA, 17 nt, Pseudomonas aeruginosa PA01
cgaucaucgccagcggc

SEQ ID NO: 1480625 - RNA, 11 nt, Pseudomonas aeruginosa PA01
cgaucagcgaa

SEQ ID NO: 1480626 - RNA, 18 nt, Pseudomonas aeruginosa PA01
cgaucagugcaucggccg

SEQ ID NO: 1480627 - RNA, 23 nt, Pseudomonas aeruginosa PA01
cgaucagugcaucggccgccagg

SEQ ID NO: 1480628 - RNA, 17 nt, Pseudomonas aeruginosa PA01
cgaucaguggucgcagc

SEQ ID NO: 1480629 - RNA, 20 nt, Pseudomonas aeruginosa PA01
cgaucaguggucgcagcucc

SEQ ID NO: 1480630 - RNA, 18 nt, Pseudomonas aeruginosa PA01
cgauccagcagucgcggc

SEQ ID NO: 1480631 - RNA, 20 nt, Pseudomonas aeruginosa PA01
cgauccagcagucgcggccc

SEQ ID NO: 1480632 - RNA, 22 nt, Pseudomonas aeruginosa PA01
cgauccagcagucgcggcccug

SEQ ID NO: 1480633 - RNA, 23 nt, Pseudomonas aeruginosa PA01
cgaucaucggcuggucgucgcgg

SEQ ID NO: 1480634 - RNA, 16 nt, Pseudomonas aeruginosa PA01
cgauccuccgccagcc

SEQ ID NO: 1480635 - RNA, 17 nt, Pseudomonas aeruginosa PA01
cgauccuccgccagccc

SEQ ID NO: 1480636 - RNA, 22 nt, Pseudomonas aeruginosa PA01
cgauccuccgccagccccaggc

SEQ ID NO: 1480637 - RNA, 23 nt, Pseudomonas aeruginosa PA01
cgaucgaagaagcgcaccaccug

SEQ ID NO: 1480638 - RNA, 16 nt, Pseudomonas aeruginosa PA01
cgauccugaccccggc

SEQ ID NO: 1480639 - RNA, 13 nt, Pseudomonas aeruginosa PA01
cgaucccccgccc

SEQ ID NO: 1480640 - RNA, 14 nt, Pseudomonas aeruginosa PA01
cgaucccccgcccc

SEQ ID NO: 1480641 - RNA, 16 nt, Pseudomonas aeruginosa PA01
cgauccccaacccggc

SEQ ID NO: 1480642 - RNA, 22 nt, Pseudomonas aeruginosa PA01
cgauccccaacccggccagccc

SEQ ID NO: 1480643 - RNA, 22 nt, Pseudomonas aeruginosa PA01
cgaucaccggaucgaugcccgg

SEQ ID NO: 1480644 - RNA, 14 nt, Pseudomonas aeruginosa PA01
cgaucagcagcagc

SEQ ID NO: 1480645 - RNA, 17 nt, Pseudomonas aeruginosa PA01
cgaucagcagcagcgcc

SEQ ID NO: 1480646 - RNA, 21 nt, Pseudomonas aeruginosa PA01
cgaucagcagcagcgccaugc

SEQ ID NO: 1480647 - RNA, 16 nt, Pseudomonas aeruginosa PA01
cgaucagcagcaccgc

SEQ ID NO: 1480648 - RNA, 14 nt, Pseudomonas aeruginosa PA01
cgaucagcagcacc

SEQ ID NO: 1480649 - RNA, 14 nt, Pseudomonas aeruginosa PA01
cgaucagcagcgcc

SEQ ID NO: 1480650 - RNA, 16 nt, Pseudomonas aeruginosa PA01
cgaucagcagcgccac

SEQ ID NO: 1480651 - RNA, 14 nt, Pseudomonas aeruginosa PA01
cgaucagcccgccg

SEQ ID NO: 1480652 - RNA, 19 nt, Pseudomonas aeruginosa PA01
cgaucagcccgccggcgau

SEQ ID NO: 1480653 - RNA, 16 nt, Pseudomonas aeruginosa PA01
cgaucagcccgccaac

SEQ ID NO: 1480654 - RNA, 16 nt, Pseudomonas aeruginosa PA01
cgaucagcccgucggc

SEQ ID NO: 1480655 - RNA, 15 nt, Pseudomonas aeruginosa PA01
cgaucagccggcgcg

SEQ ID NO: 1480656 - RNA, 18 nt, Pseudomonas aeruginosa PA01
cgaucagcgagcuucgcc

SEQ ID NO: 1480657 - RNA, 22 nt, Pseudomonas aeruginosa PA01
cgaucagcgagcuucgccgcgc

SEQ ID NO: 1480658 - RNA, 17 nt, Pseudomonas aeruginosa PA01
cgaucaggucgccgccg

SEQ ID NO: 1480659 - RNA, 18 nt, Pseudomonas aeruginosa PA01
cgaucaggucgccgccgc

SEQ ID NO: 1480660 - RNA, 19 nt, Pseudomonas aeruginosa PA01
cgaucaccuugcccucgcg

SEQ ID NO: 1480661 - RNA, 20 nt, Pseudomonas aeruginosa PA01
cgaucaccuugcccucgcgg

SEQ ID NO: 1480662 - RNA, 20 nt, Pseudomonas aeruginosa PA01
cgaucacgccgcgcaccagc

SEQ ID NO: 1480663 - RNA, 14 nt, Pseudomonas aeruginosa PA01
cgaucaccuggcca

SEQ ID NO: 1480664 - RNA, 19 nt, Pseudomonas aeruginosa PA01
cgaucaccaccuggauggu

SEQ ID NO: 1480665 - RNA, 13 nt, Pseudomonas aeruginosa PA01
cgaucaccaccag

SEQ ID NO: 1480666 - RNA, 22 nt, Pseudomonas aeruginosa PA01
cgaucaccaccagcaucagcag

SEQ ID NO: 1480667 - RNA, 20 nt, Pseudomonas aeruginosa PA01
cgaucaccaccagcgccgcc

SEQ ID NO: 1480668 - RNA, 17 nt, Pseudomonas aeruginosa PA01
cgaucucgcucucgagc

SEQ ID NO: 1480669 - RNA, 23 nt, Pseudomonas aeruginosa PA01
cgaucucgcgggcuaccaggaag

SEQ ID NO: 1480670 - RNA, 23 nt, Pseudomonas aeruginosa PA01
cgaucucguagcggucgugcagc

SEQ ID NO: 1480671 - RNA, 13 nt, Pseudomonas aeruginosa PA01
cgaucggcccggg

SEQ ID NO: 1480672 - RNA, 20 nt, Pseudomonas aeruginosa PA01
cgaucggcguccgcggccug

SEQ ID NO: 1480673 - RNA, 21 nt, Pseudomonas aeruginosa PA01
cgaucggaagaucgcccgccu

SEQ ID NO: 1480674 - RNA, 20 nt, Pseudomonas aeruginosa PA01
cgaucggaugcacgugcagc

SEQ ID NO: 1480675 - RNA, 16 nt, Pseudomonas aeruginosa PA01
cgaucgcggcgacgau

SEQ ID NO: 1480676 - RNA, 14 nt, Pseudomonas aeruginosa PA01
cgaucgcguuccag

SEQ ID NO: 1480677 - RNA, 12 nt, Pseudomonas aeruginosa PA01
cgaucgccgggu

SEQ ID NO: 1480678 - RNA, 21 nt, Pseudomonas aeruginosa PA01
cgaucgccggguugccgcugg

SEQ ID NO: 1480679 - RNA, 15 nt, Pseudomonas aeruginosa PA01
cgaucgccucggcca

SEQ ID NO: 1480680 - RNA, 17 nt, Pseudomonas aeruginosa PA01
cgaucgccucggccauc

SEQ ID NO: 1480681 - RNA, 19 nt, Pseudomonas aeruginosa PA01
cgaucgccucggccaucga

SEQ ID NO: 1480682 - RNA, 21 nt, Pseudomonas aeruginosa PA01
cgaucgccucgggcgagcgca

SEQ ID NO: 1480683 - RNA, 12 nt, Pseudomonas aeruginosa PA01
cgaucgccgcgg

SEQ ID NO: 1480684 - RNA, 13 nt, Pseudomonas aeruginosa PA01
cgaucgccgcggc

SEQ ID NO: 1480685 - RNA, 14 nt, Pseudomonas aeruginosa PA01
cgaucgccgcgcgg

SEQ ID NO: 1480686 - RNA, 14 nt, Pseudomonas aeruginosa PA01
cgaucgccgcggcg

SEQ ID NO: 1480687 - RNA, 15 nt, Pseudomonas aeruginosa PA01
cgaucgccgcggcga

SEQ ID NO: 1480688 - RNA, 19 nt, Pseudomonas aeruginosa PA01
cgaucgccaggcgauccag

SEQ ID NO: 1480689 - RNA, 20 nt, Pseudomonas aeruginosa PA01
cgaucgccaggcgauccagc

SEQ ID NO: 1480690 - RNA, 22 nt, Pseudomonas aeruginosa PA01
cgaucgccaggcgauccagcgg

SEQ ID NO: 1480691 - RNA, 14 nt, Pseudomonas aeruginosa PA01
cgaucgcccgcgcc

SEQ ID NO: 1480692 - RNA, 14 nt, Pseudomonas aeruginosa PA01
cgaucgccaggugg

SEQ ID NO: 1480693 - RNA, 19 nt, Pseudomonas aeruginosa PA01
cgaucgccagguggaagcg

SEQ ID NO: 1480694 - RNA, 16 nt, Pseudomonas aeruginosa PA01
cgaucgccccgcuacc

SEQ ID NO: 1480695 - RNA, 22 nt, Pseudomonas aeruginosa PA01
cgaucgccccgcuacccugccc

SEQ ID NO: 1480696 - RNA, 13 nt, Pseudomonas aeruginosa PA01
cgaucgaccugcc

SEQ ID NO: 1480697 - RNA, 17 nt, Pseudomonas aeruginosa PA01
cgaugaacagcgacucg

SEQ ID NO: 1480698 - RNA, 16 nt, Pseudomonas aeruginosa PA01
cgaugaacagcgcgaa

SEQ ID NO: 1480699 - RNA, 21 nt, Pseudomonas aeruginosa PA01
cgaugaaauagcucugccgau

SEQ ID NO: 1480700 - RNA, 23 nt, Pseudomonas aeruginosa PA01
cgaugaacaagugcucgauggcg

SEQ ID NO: 1480701 - RNA, 19 nt, Pseudomonas aeruginosa PA01
cgaucucuucccggcucgg

SEQ ID NO: 1480702 - RNA, 18 nt, Pseudomonas aeruginosa PA01
cgaugaaaccggccucga

SEQ ID NO: 1480703 - RNA, 17 nt, Pseudomonas aeruginosa PA01
cgaugaaacgcagggcc

SEQ ID NO: 1480704 - RNA, 13 nt, Pseudomonas aeruginosa PA01
cgaucucgucggc

SEQ ID NO: 1480705 - RNA, 23 nt, Pseudomonas aeruginosa PA01
cgaucucuacuaccgccagcgca

SEQ ID NO: 1480706 - RNA, 19 nt, Pseudomonas aeruginosa PA01
cgaucucucaguccaucgu

SEQ ID NO: 1480707 - RNA, 14 nt, Pseudomonas aeruginosa PA01
cgaucucguccucg

SEQ ID NO: 1480708 - RNA, 15 nt, Pseudomonas aeruginosa PA01
cgaucuucugcaccc

SEQ ID NO: 1480709 - RNA, 16 nt, Pseudomonas aeruginosa PA01
cgaucuucugcacccc

SEQ ID NO: 1480710 - RNA, 18 nt, Pseudomonas aeruginosa PA01
cgaucuugaucgccagcg

SEQ ID NO: 1480711 - RNA, 19 nt, Pseudomonas aeruginosa PA01
cgaucuugaucgccagcgg

SEQ ID NO: 1480712 - RNA, 17 nt, Pseudomonas aeruginosa PA01
cgaucuugcccaugugc

SEQ ID NO: 1480713 - RNA, 14 nt, Pseudomonas aeruginosa PA01
cgaugaacgccgcg

SEQ ID NO: 1480714 - RNA, 15 nt, Pseudomonas aeruginosa PA01
cgaugaacggcguca

SEQ ID NO: 1480715 - RNA, 19 nt, Pseudomonas aeruginosa PA01
cgaugaacggcgucacgcc

SEQ ID NO: 1480716 - RNA, 20 nt, Pseudomonas aeruginosa PA01
cgaugaacggcgucacgccg

SEQ ID NO: 1480717 - RNA, 14 nt, Pseudomonas aeruginosa PA01
cgaugaagcgguuc

SEQ ID NO: 1480718 - RNA, 16 nt, Pseudomonas aeruginosa PA01
cgaugaaggucagcac

SEQ ID NO: 1480719 - RNA, 16 nt, Pseudomonas aeruginosa PA01
cgaugacgauggcgcc

SEQ ID NO: 1480720 - RNA, 18 nt, Pseudomonas aeruginosa PA01
cgaugacgauggcgccuu

SEQ ID NO: 1480721 - RNA, 15 nt, Pseudomonas aeruginosa PA01
cgaugaaugcgcagg

SEQ ID NO: 1480722 - RNA, 16 nt, Pseudomonas aeruginosa PA01
cgaugaaugcgcaggu

SEQ ID NO: 1480723 - RNA, 16 nt, Pseudomonas aeruginosa PA01
cgaugagcaugccgca

SEQ ID NO: 1480724 - RNA, 16 nt, Pseudomonas aeruginosa PA01
cgaugagccagccugc

SEQ ID NO: 1480725 - RNA, 23 nt, Pseudomonas aeruginosa PA01
cgaugagccagccugcagccagc

SEQ ID NO: 1480726 - RNA, 21 nt, Pseudomonas aeruginosa PA01
cgaugacggugauucguccgg

SEQ ID NO: 1480727 - RNA, 23 nt, Pseudomonas aeruginosa PA01
cgaugaggaugcugaucagcacc

SEQ ID NO: 1480728 - RNA, 17 nt, Pseudomonas aeruginosa PA01
cgaugagcuucgccggg

SEQ ID NO: 1480729 - RNA, 22 nt, Pseudomonas aeruginosa PA01
cgaugaggucgcagcguuccag

SEQ ID NO: 1480730 - RNA, 13 nt, Pseudomonas aeruginosa PA01
cgaugaucagccc

SEQ ID NO: 1480731 - RNA, 19 nt, Pseudomonas aeruginosa PA01
cgaugaucagcccuucgcg

SEQ ID NO: 1480732 - RNA, 21 nt, Pseudomonas aeruginosa PA01
cgaugaggcguggggaagacg

SEQ ID NO: 1480733 - RNA, 20 nt, Pseudomonas aeruginosa PA01
cgaugaggcuguccagcagg

SEQ ID NO: 1480734 - RNA, 23 nt, Pseudomonas aeruginosa PA01
cgaugaggcuguccagcaggcgu

SEQ ID NO: 1480735 - RNA, 12 nt, Pseudomonas aeruginosa PA01
cgaugaugccgc

SEQ ID NO: 1480736 - RNA, 13 nt, Pseudomonas aeruginosa PA01
cgaugaugccgcc

SEQ ID NO: 1480737 - RNA, 15 nt, Pseudomonas aeruginosa PA01
cgaugaugccgccgu

SEQ ID NO: 1480738 - RNA, 23 nt, Pseudomonas aeruginosa PA01
cgaugauccgcucgaucccggcg

SEQ ID NO: 1480739 - RNA, 16 nt, Pseudomonas aeruginosa PA01
cgaugaucuccgcgcc

SEQ ID NO: 1480740 - RNA, 22 nt, Pseudomonas aeruginosa PA01
cgaugaucgguucccgcccgcu

SEQ ID NO: 1480741 - RNA, 22 nt, Pseudomonas aeruginosa PA01
cgaugcccagccagggccgcga

SEQ ID NO: 1480742 - RNA, 19 nt, Pseudomonas aeruginosa PA01
cgaugauggugcgguggaa

SEQ ID NO: 1480743 - RNA, 15 nt, Pseudomonas aeruginosa PA01
ccgcugugcaggguc

SEQ ID NO: 1480744 - RNA, 23 nt, Pseudomonas aeruginosa PA01
ccgcugugcagggucagucgagc

SEQ ID NO: 1480745 - RNA, 16 nt, Pseudomonas aeruginosa PA01
ccgcugucgucuucgg

SEQ ID NO: 1480746 - RNA, 21 nt, Pseudomonas aeruginosa PA01
ccgcugucgucuucggccagu

SEQ ID NO: 1480747 - RNA, 17 nt, Pseudomonas aeruginosa PA01
ccgcuguuacugagcgu

SEQ ID NO: 1480748 - RNA, 22 nt, Pseudomonas aeruginosa PA01
ccgcugugugccucugaccgcg

SEQ ID NO: 1480749 - RNA, 17 nt, Pseudomonas aeruginosa PA01
ccgcugucguccagcgg

SEQ ID NO: 1480750 - RNA, 18 nt, Pseudomonas aeruginosa PA01
ccgcugucguccagcggg

SEQ ID NO: 1480751 - RNA, 17 nt, Pseudomonas aeruginosa PA01
ccgcuguccgccgccgc

SEQ ID NO: 1480752 - RNA, 20 nt, Pseudomonas aeruginosa PA01
ccgcuguccgccgccgcggc

SEQ ID NO: 1480753 - RNA, 14 nt, Pseudomonas aeruginosa PA01
ccgcuguccgccgg

SEQ ID NO: 1480754 - RNA, 20 nt, Pseudomonas aeruginosa PA01
ccgcuguccgccggccucga

SEQ ID NO: 1480755 - RNA, 22 nt, Pseudomonas aeruginosa PA01
ccgcuggguuuccugcauggcu

SEQ ID NO: 1480756 - RNA, 19 nt, Pseudomonas aeruginosa PA01
ccgcugcgcugccagcgcc

SEQ ID NO: 1480757 - RNA, 23 nt, Pseudomonas aeruginosa PA01
ccgcugcgcugccagcgccgccg

SEQ ID NO: 1480758 - RNA, 19 nt, Pseudomonas aeruginosa PA01
ccgcugccggcgggacgcg

SEQ ID NO: 1480759 - RNA, 11 nt, Pseudomonas aeruginosa PA01
ccgcugcgcga

SEQ ID NO: 1480760 - RNA, 23 nt, Pseudomonas aeruginosa PA01
ccgcugcgcgaagccaggaagcg

SEQ ID NO: 1480761 - RNA, 15 nt, Pseudomonas aeruginosa PA01
ccgcugcgccgccgu

SEQ ID NO: 1480762 - RNA, 22 nt, Pseudomonas aeruginosa PA01
ccgcugcgccgccgucuugccg

SEQ ID NO: 1480763 - RNA, 15 nt, Pseudomonas aeruginosa PA01
ccgcugcgcaggccg

SEQ ID NO: 1480764 - RNA, 17 nt, Pseudomonas aeruginosa PA01
ccgcugcgcaggccgag

SEQ ID NO: 1480765 - RNA, 17 nt, Pseudomonas aeruginosa PA01
ccgcugcgcaucagguc

SEQ ID NO: 1480766 - RNA, 17 nt, Pseudomonas aeruginosa PA01
ccgcuggugaucgacca

SEQ ID NO: 1480767 - RNA, 19 nt, Pseudomonas aeruginosa PA01
ccgcuggucggcauccggc

SEQ ID NO: 1480768 - RNA, 22 nt, Pseudomonas aeruginosa PA01
ccgcuggucggcauccggcagg

SEQ ID NO: 1480769 - RNA, 20 nt, Pseudomonas aeruginosa PA01
ccgcugguagcccaggccga

SEQ ID NO: 1480770 - RNA, 21 nt, Pseudomonas aeruginosa PA01
ccgcugguagcccaggccgaa

SEQ ID NO: 1480771 - RNA, 20 nt, Pseudomonas aeruginosa PA01
ccgcugguccagcuggcgca

SEQ ID NO: 1480772 - RNA, 24 nt, Pseudomonas aeruginosa PA01
ccgcugguccagcuggcgcagccg

SEQ ID NO: 1480773 - RNA, 17 nt, Pseudomonas aeruginosa PA01
ccgcuucggcccgcugg

SEQ ID NO: 1480774 - RNA, 17 nt, Pseudomonas aeruginosa PA01
ccgcuuccugggcuucg

SEQ ID NO: 1480775 - RNA, 16 nt, Pseudomonas aeruginosa PA01
ccgcuucagcgcgccg

SEQ ID NO: 1480776 - RNA, 17 nt, Pseudomonas aeruginosa PA01
ccgcuucagcgcgccga

SEQ ID NO: 1480777 - RNA, 20 nt, Pseudomonas aeruginosa PA01
ccgcuucagcgcgccgagcc

SEQ ID NO: 1480778 - RNA, 17 nt, Pseudomonas aeruginosa PA01
ccgcuuccggcccggcc

SEQ ID NO: 1480779 - RNA, 17 nt, Pseudomonas aeruginosa PA01
ccgcuuccgccggcgcc

SEQ ID NO: 1480780 - RNA, 19 nt, Pseudomonas aeruginosa PA01
ccgcuuccgccggcgccgc

SEQ ID NO: 1480781 - RNA, 12 nt, Pseudomonas aeruginosa PA01
ccgcuucgucgg

SEQ ID NO: 1480782 - RNA, 12 nt, Pseudomonas aeruginosa PA01
ccgcuucggcgg

SEQ ID NO: 1480783 - RNA, 16 nt, Pseudomonas aeruginosa PA01
ccgcuucggcggggcu

SEQ ID NO: 1480784 - RNA, 18 nt, Pseudomonas aeruginosa PA01
ccgcuucgucggucgcga

SEQ ID NO: 1480785 - RNA, 18 nt, Pseudomonas aeruginosa PA01
ccgcuugagaccuucgcg

SEQ ID NO: 1480786 - RNA, 13 nt, Pseudomonas aeruginosa PA01
ccgcuucuucccg

SEQ ID NO: 1480787 - RNA, 23 nt, Pseudomonas aeruginosa PA01
ccgcuugcggucauccgccggcg

SEQ ID NO: 1480788 - RNA, 21 nt, Pseudomonas aeruginosa PA01
ccgcuugcgguuauccgccgc

SEQ ID NO: 1480789 - RNA, 22 nt, Pseudomonas aeruginosa PA01
ccgcuugcgguuauccgccgcc

SEQ ID NO: 1480790 - RNA, 21 nt, Pseudomonas aeruginosa PA01
ccgcuugcgguuauccgccgu

SEQ ID NO: 1480791 - RNA, 19 nt, Pseudomonas aeruginosa PA01
ccgcuugcgccgccucgcg

SEQ ID NO: 1480792 - RNA, 21 nt, Pseudomonas aeruginosa PA01
ccgcuugcgccgccucgcgca

SEQ ID NO: 1480793 - RNA, 23 nt, Pseudomonas aeruginosa PA01
ccgcuuucaccagggucgccagg

SEQ ID NO: 1480794 - RNA, 22 nt, Pseudomonas aeruginosa PA01
ccgcuuuccacccgaaagccga

SEQ ID NO: 1480795 - RNA, 17 nt, Pseudomonas aeruginosa PA01
ccggaaccaccggucaa

SEQ ID NO: 1480796 - RNA, 19 nt, Pseudomonas aeruginosa PA01
ccggaaagccuggccggcg

SEQ ID NO: 1480797 - RNA, 20 nt, Pseudomonas aeruginosa PA01
ccggaaaagaagccgcgcaa

SEQ ID NO: 1480798 - RNA, 23 nt, Pseudomonas aeruginosa PA01
ccgcucccaccgcuuucagcgcc

SEQ ID NO: 1480799 - RNA, 18 nt, Pseudomonas aeruginosa PA01
ccgcuccagcaguucguc

SEQ ID NO: 1480800 - RNA, 18 nt, Pseudomonas aeruginosa PA01
ccgcucaugagauccgcc

SEQ ID NO: 1480801 - RNA, 20 nt, Pseudomonas aeruginosa PA01
ccgcucaugagauccgccag

SEQ ID NO: 1480802 - RNA, 14 nt, Pseudomonas aeruginosa PA01
ccgcuccagccggc

SEQ ID NO: 1480803 - RNA, 16 nt, Pseudomonas aeruginosa PA01
ccgcuccagccggcaa

SEQ ID NO: 1480804 - RNA, 18 nt, Pseudomonas aeruginosa PA01
ccgcuccagccggcaagc

SEQ ID NO: 1480805 - RNA, 12 nt, Pseudomonas aeruginosa PA01
ccgcuccagcgc

SEQ ID NO: 1480806 - RNA, 19 nt, Pseudomonas aeruginosa PA01
ccgcucgcgguuauccgcc

SEQ ID NO: 1480807 - RNA, 22 nt, Pseudomonas aeruginosa PA01
ccgcucgcgguuauccgccgcc

SEQ ID NO: 1480808 - RNA, 21 nt, Pseudomonas aeruginosa PA01
ccgcucgcgguuauccgccgg

SEQ ID NO: 1480809 - RNA, 22 nt, Pseudomonas aeruginosa PA01
ccgcucgcgguuauccgccgga

SEQ ID NO: 1480810 - RNA, 14 nt, Pseudomonas aeruginosa PA01
ccgcucgcgcacgg

SEQ ID NO: 1480811 - RNA, 14 nt, Pseudomonas aeruginosa PA01
ccgcucgcgcggca

SEQ ID NO: 1480812 - RNA, 13 nt, Pseudomonas aeruginosa PA01
ccgcucgccggga

SEQ ID NO: 1480813 - RNA, 17 nt, Pseudomonas aeruginosa PA01
ccgcuccgcggccggcu

SEQ ID NO: 1480814 - RNA, 19 nt, Pseudomonas aeruginosa PA01
ccgcuccgauggcgcugga

SEQ ID NO: 1480815 - RNA, 14 nt, Pseudomonas aeruginosa PA01
ccgcuccggcgccg

SEQ ID NO: 1480816 - RNA, 15 nt, Pseudomonas aeruginosa PA01
ccgcucaccaggccc

SEQ ID NO: 1480817 - RNA, 20 nt, Pseudomonas aeruginosa PA01
ccgcucaccaggcccgccgg

SEQ ID NO: 1480818 - RNA, 23 nt, Pseudomonas aeruginosa PA01
ccgcucaccaggcccgccgguca

SEQ ID NO: 1480819 - RNA, 23 nt, Pseudomonas aeruginosa PA01
ccgcucaccgccaccccgccggc

SEQ ID NO: 1480820 - RNA, 21 nt, Pseudomonas aeruginosa PA01
ccgcucagucgaccgucgcca

SEQ ID NO: 1480821 - RNA, 14 nt, Pseudomonas aeruginosa PA01
ccgcucaggcgucc

SEQ ID NO: 1480822 - RNA, 15 nt, Pseudomonas aeruginosa PA01
ccgcuaucgccgccg

SEQ ID NO: 1480823 - RNA, 15 nt, Pseudomonas aeruginosa PA01
ccgcuaucgcuggcg

SEQ ID NO: 1480824 - RNA, 21 nt, Pseudomonas aeruginosa PA01
ccgcuaucgcuggcgcagccg

SEQ ID NO: 1480825 - RNA, 16 nt, Pseudomonas aeruginosa PA01
ccgcgucgcgcgcggc

SEQ ID NO: 1480826 - RNA, 18 nt, Pseudomonas aeruginosa PA01
ccgcgucgcgcgcggcau

SEQ ID NO: 1480827 - RNA, 21 nt, Pseudomonas aeruginosa PA01
ccgcucaaccgaacaggcgac

SEQ ID NO: 1480828 - RNA, 23 nt, Pseudomonas aeruginosa PA01
ccgcuaugggcaccgcgccggcg

SEQ ID NO: 1480829 - RNA, 12 nt, Pseudomonas aeruginosa PA01
ccgcgucgccuu

SEQ ID NO: 1480830 - RNA, 17 nt, Pseudomonas aeruginosa PA01
ccgcgucgccgccagcg

SEQ ID NO: 1480831 - RNA, 20 nt, Pseudomonas aeruginosa PA01
ccgcgucgccgccagcgccg

SEQ ID NO: 1480832 - RNA, 15 nt, Pseudomonas aeruginosa PA01
ccgcgucgcccaggc

SEQ ID NO: 1480833 - RNA, 16 nt, Pseudomonas aeruginosa PA01
ccgcgucgcccaggcc

SEQ ID NO: 1480834 - RNA, 12 nt, Pseudomonas aeruginosa PA01
ccgcucggcggg

SEQ ID NO: 1480835 - RNA, 22 nt, Pseudomonas aeruginosa PA01
ccgcucggcggguauccgccgg

SEQ ID NO: 1480836 - RNA, 15 nt, Pseudomonas aeruginosa PA01
ccgcucggcgagccg

SEQ ID NO: 1480837 - RNA, 18 nt, Pseudomonas aeruginosa PA01
ccgcucggcgagccgccg

SEQ ID NO: 1480838 - RNA, 20 nt, Pseudomonas aeruginosa PA01
ccgcucggcgaguucgcgca

SEQ ID NO: 1480839 - RNA, 19 nt, Pseudomonas aeruginosa PA01
ccgcucggcguagccggcg

SEQ ID NO: 1480840 - RNA, 15 nt, Pseudomonas aeruginosa PA01
ccgcugagcagcagg

SEQ ID NO: 1480841 - RNA, 22 nt, Pseudomonas aeruginosa PA01
ccgcugaucaguaccggcagcg

SEQ ID NO: 1480842 - RNA, 17 nt, Pseudomonas aeruginosa PA01
ccgcugaggauguagcc

SEQ ID NO: 1480843 - RNA, 21 nt, Pseudomonas aeruginosa PA01
ccgcugaggauguagccggcu

SEQ ID NO: 1480844 - RNA, 16 nt, Pseudomonas aeruginosa PA01
ccgcugaugcgcuggu

SEQ ID NO: 1480845 - RNA, 16 nt, Pseudomonas aeruginosa PA01
ccgcugcagggcggcg

SEQ ID NO: 1480846 - RNA, 13 nt, Pseudomonas aeruginosa PA01
ccgcugcaccagc

SEQ ID NO: 1480847 - RNA, 20 nt, Pseudomonas aeruginosa PA01
ccgcugcaaaaaagcgcgcc

SEQ ID NO: 1480848 - RNA, 18 nt, Pseudomonas aeruginosa PA01
ccgcugccgccgcgcagg

SEQ ID NO: 1480849 - RNA, 13 nt, Pseudomonas aeruginosa PA01
ccgcugccgccgu

SEQ ID NO: 1480850 - RNA, 14 nt, Pseudomonas aeruginosa PA01
ccgcugccgccguc

SEQ ID NO: 1480851 - RNA, 21 nt, Pseudomonas aeruginosa PA01
ccgcugccgccgucuccgccg

SEQ ID NO: 1480852 - RNA, 18 nt, Pseudomonas aeruginosa PA01
ccgcugccugucgcagcg

SEQ ID NO: 1480853 - RNA, 22 nt, Pseudomonas aeruginosa PA01
ccgcugccugucgcagcgggca

SEQ ID NO: 1480854 - RNA, 22 nt, Pseudomonas aeruginosa PA01
ccgcugcaugaaaaagcccggc

SEQ ID NO: 1480855 - RNA, 23 nt, Pseudomonas aeruginosa PA01
ccgcugcaugaaaaagcccggcc

SEQ ID NO: 1480856 - RNA, 20 nt, Pseudomonas aeruginosa PA01
ccgcugcaugugccaggccu

SEQ ID NO: 1480857 - RNA, 21 nt, Pseudomonas aeruginosa PA01
ccgcugcaugugccaggccug

SEQ ID NO: 1480858 - RNA, 14 nt, Pseudomonas aeruginosa PA01
ccgcugcaccagcu

SEQ ID NO: 1480859 - RNA, 22 nt, Pseudomonas aeruginosa PA01
ccgcggcgacggcucuuccccu

SEQ ID NO: 1480860 - RNA, 17 nt, Pseudomonas aeruginosa PA01
ccgcggcgaccagcgcg

SEQ ID NO: 1480861 - RNA, 19 nt, Pseudomonas aeruginosa PA01
ccgcggccggggaacaggu

SEQ ID NO: 1480862 - RNA, 19 nt, Pseudomonas aeruginosa PA01
ccgcggccggcuucagcaa

SEQ ID NO: 1480863 - RNA, 16 nt, Pseudomonas aeruginosa PA01
ccgcggcgagcagcgg

SEQ ID NO: 1480864 - RNA, 22 nt, Pseudomonas aeruginosa PA01
ccgcggcgagcaucucggccag

SEQ ID NO: 1480865 - RNA, 22 nt, Pseudomonas aeruginosa PA01
ccgcggcgcgccuucagcgccu

SEQ ID NO: 1480866 - RNA, 12 nt, Pseudomonas aeruginosa PA01
ccgcggcgcgga

SEQ ID NO: 1480867 - RNA, 18 nt, Pseudomonas aeruginosa PA01
ccgcggcgcguaggcgaa

SEQ ID NO: 1480868 - RNA, 20 nt, Pseudomonas aeruginosa PA01
ccgcggcgcguaggcgaaca

SEQ ID NO: 1480869 - RNA, 19 nt, Pseudomonas aeruginosa PA01
ccgcggcgcucggcaucga

SEQ ID NO: 1480870 - RNA, 13 nt, Pseudomonas aeruginosa PA01
ccgcgggcagcuc

SEQ ID NO: 1480871 - RNA, 18 nt, Pseudomonas aeruginosa PA01
ccgcgggcgaacggcagc

SEQ ID NO: 1480872 - RNA, 22 nt, Pseudomonas aeruginosa PA01
ccgcgggcgaacggcagcgucu

SEQ ID NO: 1480873 - RNA, 14 nt, Pseudomonas aeruginosa PA01
ccgcgggccagccg

SEQ ID NO: 1480874 - RNA, 17 nt, Pseudomonas aeruginosa PA01
ccgcgggucucgaucag

SEQ ID NO: 1480875 - RNA, 17 nt, Pseudomonas aeruginosa PA01
ccgcgggucugcucggc

SEQ ID NO: 1480876 - RNA, 20 nt, Pseudomonas aeruginosa PA01
ccgcgggucugcucggcgcc

SEQ ID NO: 1480877 - RNA, 22 nt, Pseudomonas aeruginosa PA01
ccgcgggucuugcgcagggcgg

SEQ ID NO: 1480878 - RNA, 13 nt, Pseudomonas aeruginosa PA01
ccgcgggucacca

SEQ ID NO: 1480879 - RNA, 15 nt, Pseudomonas aeruginosa PA01
ccgcgggucaccagc

SEQ ID NO: 1480880 - RNA, 17 nt, Pseudomonas aeruginosa PA01
ccgcgggucaccagcgc

SEQ ID NO: 1480881 - RNA, 13 nt, Pseudomonas aeruginosa PA01
ccgcggucgggca

SEQ ID NO: 1480882 - RNA, 19 nt, Pseudomonas aeruginosa PA01
ccgcggucgaugucgcggc

SEQ ID NO: 1480883 - RNA, 16 nt, Pseudomonas aeruginosa PA01
ccgcgguacccggcag

SEQ ID NO: 1480884 - RNA, 22 nt, Pseudomonas aeruginosa PA01
ccgcgguacccggcagggccag

SEQ ID NO: 1480885 - RNA, 23 nt, Pseudomonas aeruginosa PA01
ccgcggguuccucacggcgcagc

SEQ ID NO: 1480886 - RNA, 18 nt, Pseudomonas aeruginosa PA01
ccgcggucacucggccuc

SEQ ID NO: 1480887 - RNA, 23 nt, Pseudomonas aeruginosa PA01
ccgcgguagcugcgcagggcgcc

SEQ ID NO: 1480888 - RNA, 20 nt, Pseudomonas aeruginosa PA01
ccgcgguauucuccagcagg

SEQ ID NO: 1480889 - RNA, 21 nt, Pseudomonas aeruginosa PA01
ccgcgguauucuccagcaggc

SEQ ID NO: 1480890 - RNA, 17 nt, Pseudomonas aeruginosa PA01
ccgcgucccuugcgggu

SEQ ID NO: 1480891 - RNA, 14 nt, Pseudomonas aeruginosa PA01
ccgcguccgagagc

SEQ ID NO: 1480892 - RNA, 23 nt, Pseudomonas aeruginosa PA01
ccgcgucgaguaccgcugcggcc

SEQ ID NO: 1480893 - RNA, 12 nt, Pseudomonas aeruginosa PA01
ccgcgucgaagc

SEQ ID NO: 1480894 - RNA, 22 nt, Pseudomonas aeruginosa PA01
ccgcggugucggugcccucgcg

SEQ ID NO: 1480895 - RNA, 15 nt, Pseudomonas aeruginosa PA01
ccgcguaagcggccu

SEQ ID NO: 1480896 - RNA, 16 nt, Pseudomonas aeruginosa PA01
ccgcguaauaggcgaa

SEQ ID NO: 1480897 - RNA, 17 nt, Pseudomonas aeruginosa PA01
ccgcguaauaggcgaag

SEQ ID NO: 1480898 - RNA, 22 nt, Pseudomonas aeruginosa PA01
ccgcguaauaggcgaagcggcu

SEQ ID NO: 1480899 - RNA, 16 nt, Pseudomonas aeruginosa PA01
ccgcguaccaguagcg

SEQ ID NO: 1480900 - RNA, 15 nt, Pseudomonas aeruginosa PA01
ccgcggcagcagcca

SEQ ID NO: 1480901 - RNA, 18 nt, Pseudomonas aeruginosa PA01
ccgcggcaaugcggcgau

SEQ ID NO: 1480902 - RNA, 18 nt, Pseudomonas aeruginosa PA01
ccgcggcaccggcgacga

SEQ ID NO: 1480903 - RNA, 23 nt, Pseudomonas aeruginosa PA01
ccgcggcagaucccaucgcccug

SEQ ID NO: 1480904 - RNA, 11 nt, Pseudomonas aeruginosa PA01
ccgcggcagca

SEQ ID NO: 1480905 - RNA, 14 nt, Pseudomonas aeruginosa PA01
ccgcggccugcucg

SEQ ID NO: 1480906 - RNA, 15 nt, Pseudomonas aeruginosa PA01
ccgcggccugcucgg

SEQ ID NO: 1480907 - RNA, 14 nt, Pseudomonas aeruginosa PA01
ccgcggccggcagg

SEQ ID NO: 1480908 - RNA, 22 nt, Pseudomonas aeruginosa PA01
ccgcgcugcguggguagccgcc

SEQ ID NO: 1480909 - RNA, 12 nt, Pseudomonas aeruginosa PA01
ccgcgcugcugc

SEQ ID NO: 1480910 - RNA, 17 nt, Pseudomonas aeruginosa PA01
ccgcgcuuggccuugcc

SEQ ID NO: 1480911 - RNA, 18 nt, Pseudomonas aeruginosa PA01
ccgcgcuuggccuugccg

SEQ ID NO: 1480912 - RNA, 15 nt, Pseudomonas aeruginosa PA01
ccgcgcugucggccu

SEQ ID NO: 1480913 - RNA, 16 nt, Pseudomonas aeruginosa PA01
ccgcgcugucggccuc

SEQ ID NO: 1480914 - RNA, 18 nt, Pseudomonas aeruginosa PA01
ccgcgcugucggccucga

SEQ ID NO: 1480915 - RNA, 17 nt, Pseudomonas aeruginosa PA01
ccgcgcuugacgacugc

SEQ ID NO: 1480916 - RNA, 21 nt, Pseudomonas aeruginosa PA01
ccgcggacggccggcucggug

SEQ ID NO: 1480917 - RNA, 22 nt, Pseudomonas aeruginosa PA01
ccgcggaaggcccgcgagccgc

SEQ ID NO: 1480918 - RNA, 17 nt, Pseudomonas aeruginosa PA01
ccgcggaagugcgccgg

SEQ ID NO: 1480919 - RNA, 20 nt, Pseudomonas aeruginosa PA01
ccgcggaagugcgccgguug

SEQ ID NO: 1480920 - RNA, 20 nt, Pseudomonas aeruginosa PA01
ccgcgcuuccgcaucggccg

SEQ ID NO: 1480921 - RNA, 18 nt, Pseudomonas aeruginosa PA01
ccgcggaaaacgccgcga

SEQ ID NO: 1480922 - RNA, 20 nt, Pseudomonas aeruginosa PA01
ccgcgcccggcgccaggcug

SEQ ID NO: 1480923 - RNA, 15 nt, Pseudomonas aeruginosa PA01
ccgcgcccggccucc

SEQ ID NO: 1480924 - RNA, 11 nt, Pseudomonas aeruginosa PA01
ccgcgcccggc

SEQ ID NO: 1480925 - RNA, 13 nt, Pseudomonas aeruginosa PA01
ccgcgcccggcca

SEQ ID NO: 1480926 - RNA, 15 nt, Pseudomonas aeruginosa PA01
ccgcgcccggccagg

SEQ ID NO: 1480927 - RNA, 12 nt, Pseudomonas aeruginosa PA01
ccgcgcccggcu

SEQ ID NO: 1480928 - RNA, 13 nt, Pseudomonas aeruginosa PA01
ccgcgccgaaggc

SEQ ID NO: 1480929 - RNA, 17 nt, Pseudomonas aeruginosa PA01
ccgcgccccacggcgcg

SEQ ID NO: 1480930 - RNA, 15 nt, Pseudomonas aeruginosa PA01
ccgcgccccagcggc

SEQ ID NO: 1480931 - RNA, 16 nt, Pseudomonas aeruginosa PA01
ccgcgccccagcggca

SEQ ID NO: 1480932 - RNA, 14 nt, Pseudomonas aeruginosa PA01
ccgcgcccaggcgc

SEQ ID NO: 1480933 - RNA, 14 nt, Pseudomonas aeruginosa PA01
ccgcgcccaggcug

SEQ ID NO: 1480934 - RNA, 18 nt, Pseudomonas aeruginosa PA01
ccgcgcccaggcugccgg

SEQ ID NO: 1480935 - RNA, 19 nt, Pseudomonas aeruginosa PA01
ccgcgcccaggcugccggc

SEQ ID NO: 1480936 - RNA, 17 nt, Pseudomonas aeruginosa PA01
ccgcgcguucagccacg

SEQ ID NO: 1480937 - RNA, 23 nt, Pseudomonas aeruginosa PA01
ccgcgcguggcuucguccagcga

SEQ ID NO: 1480938 - RNA, 18 nt, Pseudomonas aeruginosa PA01
ccgcgcugcaagggcacu

SEQ ID NO: 1480939 - RNA, 17 nt, Pseudomonas aeruginosa PA01
ccgcgcugcgccaggcc

SEQ ID NO: 1480940 - RNA, 15 nt, Pseudomonas aeruginosa PA01
ccggcaccgucgagc

SEQ ID NO: 1480941 - RNA, 20 nt, Pseudomonas aeruginosa PA01
ccggcacgccauccuccgag

SEQ ID NO: 1480942 - RNA, 13 nt, Pseudomonas aeruginosa PA01
ccggcacccggag

SEQ ID NO: 1480943 - RNA, 14 nt, Pseudomonas aeruginosa PA01
ccggcacccugacc

SEQ ID NO: 1480944 - RNA, 15 nt, Pseudomonas aeruginosa PA01
ccggcacgcugccgc

SEQ ID NO: 1480945 - RNA, 18 nt, Pseudomonas aeruginosa PA01
ccggcacgcugccgccga

SEQ ID NO: 1480946 - RNA, 20 nt, Pseudomonas aeruginosa PA01
ccggcacggaaacgccgaga

SEQ ID NO: 1480947 - RNA, 21 nt, Pseudomonas aeruginosa PA01
ccggcacggcaucgauccgca

SEQ ID NO: 1480948 - RNA, 22 nt, Pseudomonas aeruginosa PA01
ccggcacuuccuuggugaucac

SEQ ID NO: 1480949 - RNA, 12 nt, Pseudomonas aeruginosa PA01
ccggcagcagcg

SEQ ID NO: 1480950 - RNA, 19 nt, Pseudomonas aeruginosa PA01
ccggcagcagcggaucggc

SEQ ID NO: 1480951 - RNA, 15 nt, Pseudomonas aeruginosa PA01
ccggcagcacggcga

SEQ ID NO: 1480952 - RNA, 16 nt, Pseudomonas aeruginosa PA01
ccggcagcacccgcac

SEQ ID NO: 1480953 - RNA, 15 nt, Pseudomonas aeruginosa PA01
ccggcaccaggccga

SEQ ID NO: 1480954 - RNA, 15 nt, Pseudomonas aeruginosa PA01
ccggcaccagucgca

SEQ ID NO: 1480955 - RNA, 13 nt, Pseudomonas aeruginosa PA01
ccggcaauagccg

SEQ ID NO: 1480956 - RNA, 17 nt, Pseudomonas aeruginosa PA01
ccggcaauagccgggcu

SEQ ID NO: 1480957 - RNA, 15 nt, Pseudomonas aeruginosa PA01
ccggcaaggcggccu

SEQ ID NO: 1480958 - RNA, 14 nt, Pseudomonas aeruginosa PA01
ccggcaagggccug

SEQ ID NO: 1480959 - RNA, 13 nt, Pseudomonas aeruginosa PA01
ccggcaagcgccg

SEQ ID NO: 1480960 - RNA, 19 nt, Pseudomonas aeruginosa PA01
ccggcaagcgugccccgac

SEQ ID NO: 1480961 - RNA, 16 nt, Pseudomonas aeruginosa PA01
ccggcaagcuccgcga

SEQ ID NO: 1480962 - RNA, 18 nt, Pseudomonas aeruginosa PA01
ccggcaagcuccgcgaug

SEQ ID NO: 1480963 - RNA, 21 nt, Pseudomonas aeruginosa PA01
ccggcaacgaacuucagggcu

SEQ ID NO: 1480964 - RNA, 14 nt, Pseudomonas aeruginosa PA01
ccggcaacagcagc

SEQ ID NO: 1480965 - RNA, 18 nt, Pseudomonas aeruginosa PA01
ccggcaacaggucgaggg

SEQ ID NO: 1480966 - RNA, 17 nt, Pseudomonas aeruginosa PA01
ccggcaaacgccgccac

SEQ ID NO: 1480967 - RNA, 17 nt, Pseudomonas aeruginosa PA01
ccggcaaaugccgggcu

SEQ ID NO: 1480968 - RNA, 12 nt, Pseudomonas aeruginosa PA01
ccggcagcgccg

SEQ ID NO: 1480969 - RNA, 13 nt, Pseudomonas aeruginosa PA01
ccggcagcgccga

SEQ ID NO: 1480970 - RNA, 14 nt, Pseudomonas aeruginosa PA01
ccggcagcgccgag

SEQ ID NO: 1480971 - RNA, 15 nt, Pseudomonas aeruginosa PA01
ccggcagcgccgagg

SEQ ID NO: 1480972 - RNA, 14 nt, Pseudomonas aeruginosa PA01
ccggcagcgccgcc

SEQ ID NO: 1480973 - RNA, 17 nt, Pseudomonas aeruginosa PA01
ccggcagcgccgccagc

SEQ ID NO: 1480974 - RNA, 16 nt, Pseudomonas aeruginosa PA01
ccggcagcgccgcgcg

SEQ ID NO: 1480975 - RNA, 21 nt, Pseudomonas aeruginosa PA01
ccggcagcgccgcgcggcaac

SEQ ID NO: 1480976 - RNA, 13 nt, Pseudomonas aeruginosa PA01
ccggcagcgccgg

SEQ ID NO: 1480977 - RNA, 14 nt, Pseudomonas aeruginosa PA01
ccggcagcgccggg

SEQ ID NO: 1480978 - RNA, 15 nt, Pseudomonas aeruginosa PA01
ccggcagcgccgggc

SEQ ID NO: 1480979 - RNA, 12 nt, Pseudomonas aeruginosa PA01
ccggcagcgccu

SEQ ID NO: 1480980 - RNA, 13 nt, Pseudomonas aeruginosa PA01
ccggcagcggcug

SEQ ID NO: 1480981 - RNA, 20 nt, Pseudomonas aeruginosa PA01
ccggcagcgcguagaccacc

SEQ ID NO: 1480982 - RNA, 16 nt, Pseudomonas aeruginosa PA01
ccggcagccagccgcc

SEQ ID NO: 1480983 - RNA, 17 nt, Pseudomonas aeruginosa PA01
ccggcagccagccgccg

SEQ ID NO: 1480984 - RNA, 23 nt, Pseudomonas aeruginosa PA01
ccggcagcgaccaccaccagguc

SEQ ID NO: 1480985 - RNA, 12 nt, Pseudomonas aeruginosa PA01
ccggcagcgacu

SEQ ID NO: 1480986 - RNA, 14 nt, Pseudomonas aeruginosa PA01
ccggcagcgacugg

SEQ ID NO: 1480987 - RNA, 13 nt, Pseudomonas aeruginosa PA01
ccggcagcaggcc

SEQ ID NO: 1480988 - RNA, 14 nt, Pseudomonas aeruginosa PA01
ccggcagcaggccg

SEQ ID NO: 1480989 - RNA, 16 nt, Pseudomonas aeruginosa PA01
ccggcagcaggccgcc

SEQ ID NO: 1480990 - RNA, 17 nt, Pseudomonas aeruginosa PA01
ccggcagcaggccgccg

SEQ ID NO: 1480991 - RNA, 18 nt, Pseudomonas aeruginosa PA01
ccggcagcaggccgccgc

SEQ ID NO: 1480992 - RNA, 12 nt, Pseudomonas aeruginosa PA01
ccggcagccggg

SEQ ID NO: 1480993 - RNA, 15 nt, Pseudomonas aeruginosa PA01
ccggcagccaccagg

SEQ ID NO: 1480994 - RNA, 12 nt, Pseudomonas aeruginosa PA01
ccggcaggcgcu

SEQ ID NO: 1480995 - RNA, 15 nt, Pseudomonas aeruginosa PA01
ccggcaggcucagcg

SEQ ID NO: 1480996 - RNA, 20 nt, Pseudomonas aeruginosa PA01
ccggcaggcucagcgcaugc

SEQ ID NO: 1480997 - RNA, 15 nt, Pseudomonas aeruginosa PA01
ccggcagggccagcg

SEQ ID NO: 1480998 - RNA, 22 nt, Pseudomonas aeruginosa PA01
ccggcagggccucgggcgggau

SEQ ID NO: 1480999 - RNA, 13 nt, Pseudomonas aeruginosa PA01
ccggcagggcgau

SEQ ID NO: 1481000 - RNA, 18 nt, Pseudomonas aeruginosa PA01
ccggcagggcgauccgcc

SEQ ID NO: 1481001 - RNA, 20 nt, Pseudomonas aeruginosa PA01
ccggcagggcgauccgcccg

SEQ ID NO: 1481002 - RNA, 15 nt, Pseudomonas aeruginosa PA01
ccggcaggucgggca

SEQ ID NO: 1481003 - RNA, 17 nt, Pseudomonas aeruginosa PA01
ccggcagguucagcagg

SEQ ID NO: 1481004 - RNA, 13 nt, Pseudomonas aeruginosa PA01
ccggcaggacgau

SEQ ID NO: 1481005 - RNA, 17 nt, Pseudomonas aeruginosa PA01
ccggcaggaggaucgcg

SEQ ID NO: 1481006 - RNA, 20 nt, Pseudomonas aeruginosa PA01
ccggcaggaggaucgcggcc

SEQ ID NO: 1481007 - RNA, 17 nt, Pseudomonas aeruginosa PA01
ccggcaggaucggcgcg

SEQ ID NO: 1481008 - RNA, 16 nt, Pseudomonas aeruginosa PA01
ccggcaggcaggccug

SEQ ID NO: 1481009 - RNA, 17 nt, Pseudomonas aeruginosa PA01
ccggcaggcagugccgg

SEQ ID NO: 1481010 - RNA, 19 nt, Pseudomonas aeruginosa PA01
ccggcaggcagugccgggc

SEQ ID NO: 1481011 - RNA, 13 nt, Pseudomonas aeruginosa PA01
ccggcaggccgau

SEQ ID NO: 1481012 - RNA, 20 nt, Pseudomonas aeruginosa PA01
ccggcaggccgauggccccg

SEQ ID NO: 1481013 - RNA, 21 nt, Pseudomonas aeruginosa PA01
ccggcaggccgauggccccgg

SEQ ID NO: 1481014 - RNA, 21 nt, Pseudomonas aeruginosa PA01
ccggcagcucccuugccgccg

SEQ ID NO: 1481015 - RNA, 17 nt, Pseudomonas aeruginosa PA01
ccggcagcuccggcggg

SEQ ID NO: 1481016 - RNA, 18 nt, Pseudomonas aeruginosa PA01
ccggcagcucggccgagg

SEQ ID NO: 1481017 - RNA, 22 nt, Pseudomonas aeruginosa PA01
ccggcagcucggccgagggcag

SEQ ID NO: 1481018 - RNA, 16 nt, Pseudomonas aeruginosa PA01
ccggcaggccuucgac

SEQ ID NO: 1481019 - RNA, 18 nt, Pseudomonas aeruginosa PA01
ccggcaggccuucggcgc

SEQ ID NO: 1481020 - RNA, 20 nt, Pseudomonas aeruginosa PA01
ccggcaggccuucggcgccg

SEQ ID NO: 1481021 - RNA, 12 nt, Pseudomonas aeruginosa PA01
ccggcaggcgca

SEQ ID NO: 1481022 - RNA, 18 nt, Pseudomonas aeruginosa PA01
ccggcaugcucagccgcg

SEQ ID NO: 1481023 - RNA, 20 nt, Pseudomonas aeruginosa PA01
ccggcaugcucagccgcgcc

SEQ ID NO: 1481024 - RNA, 21 nt, Pseudomonas aeruginosa PA01
ccggcaugcucagccgcgccg

SEQ ID NO: 1481025 - RNA, 22 nt, Pseudomonas aeruginosa PA01
ccggcaugcucagccgcgccgg

SEQ ID NO: 1481026 - RNA, 13 nt, Pseudomonas aeruginosa PA01
ccggcaucugccg

SEQ ID NO: 1481027 - RNA, 17 nt, Pseudomonas aeruginosa PA01
ccggcaucugccgggcg

SEQ ID NO: 1481028 - RNA, 16 nt, Pseudomonas aeruginosa PA01
ccggcaucgugccgcg

SEQ ID NO: 1481029 - RNA, 17 nt, Pseudomonas aeruginosa PA01
ccggcaugcagguggcg

SEQ ID NO: 1481030 - RNA, 15 nt, Pseudomonas aeruginosa PA01
ccggcaucgccaugg

SEQ ID NO: 1481031 - RNA, 21 nt, Pseudomonas aeruginosa PA01
ccggcaucgccauggcgcugc

SEQ ID NO: 1481032 - RNA, 13 nt, Pseudomonas aeruginosa PA01
ccggcaucgccgg

SEQ ID NO: 1481033 - RNA, 14 nt, Pseudomonas aeruginosa PA01
ccggcaucgccggg

SEQ ID NO: 1481034 - RNA, 13 nt, Pseudomonas aeruginosa PA01
ccggccagcccgg

SEQ ID NO: 1481035 - RNA, 17 nt, Pseudomonas aeruginosa PA01
ccggccagcagcgccuc

SEQ ID NO: 1481036 - RNA, 16 nt, Pseudomonas aeruginosa PA01
ccggccacucgcagcc

SEQ ID NO: 1481037 - RNA, 20 nt, Pseudomonas aeruginosa PA01
ccggccacgcgaccagcgcc

SEQ ID NO: 1481038 - RNA, 21 nt, Pseudomonas aeruginosa PA01
ccggaucgaaguagucggcgu

SEQ ID NO: 1481039 - RNA, 22 nt, Pseudomonas aeruginosa PA01
ccggaucgaaguagucggcgua

SEQ ID NO: 1481040 - RNA, 14 nt, Pseudomonas aeruginosa PA01
ccggauagaucagg

SEQ ID NO: 1481041 - RNA, 20 nt, Pseudomonas aeruginosa PA01
ccggauagaucaggccggcg

SEQ ID NO: 1481042 - RNA, 21 nt, Pseudomonas aeruginosa PA01
ccggauagaucaggccggcgu

SEQ ID NO: 1481043 - RNA, 23 nt, Pseudomonas aeruginosa PA01
ccggauagaucaggccggcgucg

SEQ ID NO: 1481044 - RNA, 15 nt, Pseudomonas aeruginosa PA01
ccggaguuccagcgg

SEQ ID NO: 1481045 - RNA, 20 nt, Pseudomonas aeruginosa PA01
ccggaguucgcccgccccau

SEQ ID NO: 1481046 - RNA, 15 nt, Pseudomonas aeruginosa PA01
ccggagugaugccga

SEQ ID NO: 1481047 - RNA, 19 nt, Pseudomonas aeruginosa PA01
ccggagucguagcgcgcgg

SEQ ID NO: 1481048 - RNA, 21 nt, Pseudomonas aeruginosa PA01
ccggagucguagcgcgcggcg

SEQ ID NO: 1481049 - RNA, 13 nt, Pseudomonas aeruginosa PA01
ccggagggcccgg

SEQ ID NO: 1481050 - RNA, 18 nt, Pseudomonas aeruginosa PA01
ccggaggggcggccgccg

SEQ ID NO: 1481051 - RNA, 22 nt, Pseudomonas aeruginosa PA01
ccggauaccccgguugugcgcc

SEQ ID NO: 1481052 - RNA, 14 nt, Pseudomonas aeruginosa PA01
ccggauacaccagg

SEQ ID NO: 1481053 - RNA, 23 nt, Pseudomonas aeruginosa PA01
ccggauacaccagguuggccagu

SEQ ID NO: 1481054 - RNA, 14 nt, Pseudomonas aeruginosa PA01
ccggauucgccgag

SEQ ID NO: 1481055 - RNA, 15 nt, Pseudomonas aeruginosa PA01
ccggauucgccgagg

SEQ ID NO: 1481056 - RNA, 15 nt, Pseudomonas aeruginosa PA01
ccggauucgcgcagc

SEQ ID NO: 1481057 - RNA, 18 nt, Pseudomonas aeruginosa PA01
ccggauucgcgcagcagg

SEQ ID NO: 1481058 - RNA, 19 nt, Pseudomonas aeruginosa PA01
ccggaugcagauccagcgg

SEQ ID NO: 1481059 - RNA, 20 nt, Pseudomonas aeruginosa PA01
ccggaugcagauccagcggc

SEQ ID NO: 1481060 - RNA, 21 nt, Pseudomonas aeruginosa PA01
ccggaugcagauccagcggca

SEQ ID NO: 1481061 - RNA, 13 nt, Pseudomonas aeruginosa PA01
ccggaucggcuga

SEQ ID NO: 1481062 - RNA, 21 nt, Pseudomonas aeruginosa PA01
ccggaucggcugaccggcauc

SEQ ID NO: 1481063 - RNA, 13 nt, Pseudomonas aeruginosa PA01
ccggaccagccgg

SEQ ID NO: 1481064 - RNA, 21 nt, Pseudomonas aeruginosa PA01
ccggaccagccggucccgggc

SEQ ID NO: 1481065 - RNA, 13 nt, Pseudomonas aeruginosa PA01
ccggaccagccgu

SEQ ID NO: 1481066 - RNA, 16 nt, Pseudomonas aeruginosa PA01
ccggaccagggcgccg

SEQ ID NO: 1481067 - RNA, 19 nt, Pseudomonas aeruginosa PA01
ccggaccagggcgccgggc

SEQ ID NO: 1481068 - RNA, 14 nt, Pseudomonas aeruginosa PA01
ccggacauaucgau

SEQ ID NO: 1481069 - RNA, 18 nt, Pseudomonas aeruginosa PA01
ccggacagccuucgagcc

SEQ ID NO: 1481070 - RNA, 19 nt, Pseudomonas aeruginosa PA01
ccggacaggccacccgccu

SEQ ID NO: 1481071 - RNA, 15 nt, Pseudomonas aeruginosa PA01
ccggacaacaggccg

SEQ ID NO: 1481072 - RNA, 19 nt, Pseudomonas aeruginosa PA01
ccggacgacgaaagaagcc

SEQ ID NO: 1481073 - RNA, 23 nt, Pseudomonas aeruginosa PA01
ccggacgacgaaagaagccgcac

SEQ ID NO: 1481074 - RNA, 14 nt, Pseudomonas aeruginosa PA01
ccggacgcaccagc

SEQ ID NO: 1481075 - RNA, 16 nt, Pseudomonas aeruginosa PA01
ccggacgcaccagcag

SEQ ID NO: 1481076 - RNA, 18 nt, Pseudomonas aeruginosa PA01
ccggacgcaccagcaggc

SEQ ID NO: 1481077 - RNA, 21 nt, Pseudomonas aeruginosa PA01
ccggacgcaccagcaggccga

SEQ ID NO: 1481078 - RNA, 22 nt, Pseudomonas aeruginosa PA01
ccggacgcaccagcaggccgau

SEQ ID NO: 1481079 - RNA, 16 nt, Pseudomonas aeruginosa PA01
ccggacgccgaacgcc

SEQ ID NO: 1481080 - RNA, 22 nt, Pseudomonas aeruginosa PA01
ccggaccgucgcgauagacgcc

SEQ ID NO: 1481081 - RNA, 17 nt, Pseudomonas aeruginosa PA01
ccggaccucucucgcug

SEQ ID NO: 1481082 - RNA, 17 nt, Pseudomonas aeruginosa PA01
ccggaccggcucucuuc

SEQ ID NO: 1481083 - RNA, 12 nt, Pseudomonas aeruginosa PA01
ccggaccgggcg

SEQ ID NO: 1481084 - RNA, 17 nt, Pseudomonas aeruginosa PA01
ccggaccgggcggcagg

SEQ ID NO: 1481085 - RNA, 18 nt, Pseudomonas aeruginosa PA01
ccggaccgggcggcaggc

SEQ ID NO: 1481086 - RNA, 18 nt, Pseudomonas aeruginosa PA01
ccggagaccgugccgccg

SEQ ID NO: 1481087 - RNA, 19 nt, Pseudomonas aeruginosa PA01
ccggagaugugcgcgguga

SEQ ID NO: 1481088 - RNA, 12 nt, Pseudomonas aeruginosa PA01
ccggagcaggcc

SEQ ID NO: 1481089 - RNA, 21 nt, Pseudomonas aeruginosa PA01
ccggagcaggccauggguguc

SEQ ID NO: 1481090 - RNA, 19 nt, Pseudomonas aeruginosa PA01
ccggaggcgcacaggcgga

SEQ ID NO: 1481091 - RNA, 15 nt, Pseudomonas aeruginosa PA01
ccggaggcggcgagc

SEQ ID NO: 1481092 - RNA, 21 nt, Pseudomonas aeruginosa PA01
ccggagcgcgaaagcgccccg

SEQ ID NO: 1481093 - RNA, 15 nt, Pseudomonas aeruginosa PA01
ccggagccgggcaac

SEQ ID NO: 1481094 - RNA, 17 nt, Pseudomonas aeruginosa PA01
ccggacugcccagcgcc

SEQ ID NO: 1481095 - RNA, 22 nt, Pseudomonas aeruginosa PA01
ccggacugcccagcgccgccag

SEQ ID NO: 1481096 - RNA, 23 nt, Pseudomonas aeruginosa PA01
ccggacugcccagcgccgccagc

SEQ ID NO: 1481097 - RNA, 14 nt, Pseudomonas aeruginosa PA01
ccggagaacgccgc

SEQ ID NO: 1481098 - RNA, 15 nt, Pseudomonas aeruginosa PA01
ccggagaacgccgcc

SEQ ID NO: 1481099 - RNA, 21 nt, Pseudomonas aeruginosa PA01
ccggacuuggagaagaucgcc

SEQ ID NO: 1481100 - RNA, 17 nt, Pseudomonas aeruginosa PA01
ccggacuggauucggcc

SEQ ID NO: 1481101 - RNA, 20 nt, Pseudomonas aeruginosa PA01
ccggacuggauucggccugc

SEQ ID NO: 1481102 - RNA, 20 nt, Pseudomonas aeruginosa PA01
ccggacgcgacugcugcugc

SEQ ID NO: 1481103 - RNA, 18 nt, Pseudomonas aeruginosa PA01
ccggacguuuccagcggc

SEQ ID NO: 1481104 - RNA, 17 nt, Pseudomonas aeruginosa PA01
ccggacggccgcgccgg

SEQ ID NO: 1481105 - RNA, 16 nt, Pseudomonas aeruginosa PA01
ccggacggcugaggcu

SEQ ID NO: 1481106 - RNA, 16 nt, Pseudomonas aeruginosa PA01
ccgcaaacccccugcg

SEQ ID NO: 1481107 - RNA, 18 nt, Pseudomonas aeruginosa PA01
ccgcaaacccccugcgcg

SEQ ID NO: 1481108 - RNA, 20 nt, Pseudomonas aeruginosa PA01
ccgauucuuggcucggcagc

SEQ ID NO: 1481109 - RNA, 23 nt, Pseudomonas aeruginosa PA01
ccgauggcgcgcuuuccggcgcg

SEQ ID NO: 1481110 - RNA, 18 nt, Pseudomonas aeruginosa PA01
ccgauggcugucggcgcc

SEQ ID NO: 1481111 - RNA, 19 nt, Pseudomonas aeruginosa PA01
ccgauggcguuauucgccc

SEQ ID NO: 1481112 - RNA, 14 nt, Pseudomonas aeruginosa PA01
ccgauggccccggc

SEQ ID NO: 1481113 - RNA, 12 nt, Pseudomonas aeruginosa PA01
ccgauggccagg

SEQ ID NO: 1481114 - RNA, 20 nt, Pseudomonas aeruginosa PA01
ccgauggccagggggccugg

SEQ ID NO: 1481115 - RNA, 23 nt, Pseudomonas aeruginosa PA01
ccgauggauucgaaccacugcgc

SEQ ID NO: 1481116 - RNA, 19 nt, Pseudomonas aeruginosa PA01
ccgauggcgcuggaacagc

SEQ ID NO: 1481117 - RNA, 15 nt, Pseudomonas aeruginosa PA01
ccgauggcgccgccg

SEQ ID NO: 1481118 - RNA, 16 nt, Pseudomonas aeruginosa PA01
ccgauggcgccgccga

SEQ ID NO: 1481119 - RNA, 18 nt, Pseudomonas aeruginosa PA01
ccgauggcgccgccgagg

SEQ ID NO: 1481120 - RNA, 14 nt, Pseudomonas aeruginosa PA01
ccgauggcgccgcg

SEQ ID NO: 1481121 - RNA, 20 nt, Pseudomonas aeruginosa PA01
ccgaugcgcaacgggcggcg

SEQ ID NO: 1481122 - RNA, 13 nt, Pseudomonas aeruginosa PA01
ccgaugccgccga

SEQ ID NO: 1481123 - RNA, 22 nt, Pseudomonas aeruginosa PA01
ccgaugccgggcaacgcgcaga

SEQ ID NO: 1481124 - RNA, 17 nt, Pseudomonas aeruginosa PA01
ccgaugccgacgucgac

SEQ ID NO: 1481125 - RNA, 14 nt, Pseudomonas aeruginosa PA01
ccgaugccgaaggc

SEQ ID NO: 1481126 - RNA, 18 nt, Pseudomonas aeruginosa PA01
ccgaugcugaucacccgc

SEQ ID NO: 1481127 - RNA, 19 nt, Pseudomonas aeruginosa PA01
ccgaugcuguucagcagga

SEQ ID NO: 1481128 - RNA, 17 nt, Pseudomonas aeruginosa PA01
ccgauggaaaucggcca

SEQ ID NO: 1481129 - RNA, 23 nt, Pseudomonas aeruginosa PA01
ccgauggagauguagucgacgcc

SEQ ID NO: 1481130 - RNA, 20 nt, Pseudomonas aeruginosa PA01
ccgaugcgcgacucgaagcu

SEQ ID NO: 1481131 - RNA, 22 nt, Pseudomonas aeruginosa PA01
ccgaugcgguagucgcugcugg

SEQ ID NO: 1481132 - RNA, 19 nt, Pseudomonas aeruginosa PA01
ccgacgacccggauacccc

SEQ ID NO: 1481133 - RNA, 18 nt, Pseudomonas aeruginosa PA01
ccgacgagcagcucgccg

SEQ ID NO: 1481134 - RNA, 20 nt, Pseudomonas aeruginosa PA01
ccgacgagcagcucgccggc

SEQ ID NO: 1481135 - RNA, 21 nt, Pseudomonas aeruginosa PA01
ccgacgagcagcucgccggcg

SEQ ID NO: 1481136 - RNA, 22 nt, Pseudomonas aeruginosa PA01
ccgacgagcagcucgccggcgu

SEQ ID NO: 1481137 - RNA, 20 nt, Pseudomonas aeruginosa PA01
ccgacgaucucaucgcccau

SEQ ID NO: 1481138 - RNA, 15 nt, Pseudomonas aeruginosa PA01
ccgcagccguggcgc

SEQ ID NO: 1481139 - RNA, 16 nt, Pseudomonas aeruginosa PA01
ccgcagccguggcgcg

SEQ ID NO: 1481140 - RNA, 13 nt, Pseudomonas aeruginosa PA01
ccgcagcagcggc

SEQ ID NO: 1481141 - RNA, 14 nt, Pseudomonas aeruginosa PA01
ccgcagcagcggcg

SEQ ID NO: 1481142 - RNA, 22 nt, Pseudomonas aeruginosa PA01
ccgcagcagguucgaaugcugc

SEQ ID NO: 1481143 - RNA, 22 nt, Pseudomonas aeruginosa PA01
ccgcagccacggcacacgucgg

SEQ ID NO: 1481144 - RNA, 14 nt, Pseudomonas aeruginosa PA01
ccgcagccagccuc

SEQ ID NO: 1481145 - RNA, 19 nt, Pseudomonas aeruginosa PA01
ccgcagacuccggcgcagc

SEQ ID NO: 1481146 - RNA, 22 nt, Pseudomonas aeruginosa PA01
ccgcagacuccggcgcagccca

SEQ ID NO: 1481147 - RNA, 14 nt, Pseudomonas aeruginosa PA01
ccgcagacguggca

SEQ ID NO: 1481148 - RNA, 22 nt, Pseudomonas aeruginosa PA01
ccgcagacguggcauucgucgc

SEQ ID NO: 1481149 - RNA, 23 nt, Pseudomonas aeruginosa PA01
ccgcagacguggcauucgucgcc

SEQ ID NO: 1481150 - RNA, 13 nt, Pseudomonas aeruginosa PA01
ccgcagagccagc

SEQ ID NO: 1481151 - RNA, 18 nt, Pseudomonas aeruginosa PA01
ccgcagcacagccccagc

SEQ ID NO: 1481152 - RNA, 13 nt, Pseudomonas aeruginosa PA01
ccgcacuuccagg

SEQ ID NO: 1481153 - RNA, 12 nt, Pseudomonas aeruginosa PA01
ccgcagaaccag

SEQ ID NO: 1481154 - RNA, 16 nt, Pseudomonas aeruginosa PA01
ccgcagaaccagacgc

SEQ ID NO: 1481155 - RNA, 22 nt, Pseudomonas aeruginosa PA01
ccgcagaaccagacgcucggcc

SEQ ID NO: 1481156 - RNA, 14 nt, Pseudomonas aeruginosa PA01
ccgcagacaucgcc

SEQ ID NO: 1481157 - RNA, 15 nt, Pseudomonas aeruginosa PA01
ccgcagacaucgccg

SEQ ID NO: 1481158 - RNA, 14 nt, Pseudomonas aeruginosa PA01
ccgcagaccagcga

SEQ ID NO: 1481159 - RNA, 16 nt, Pseudomonas aeruginosa PA01
ccgcagaccagcgaac

SEQ ID NO: 1481160 - RNA, 20 nt, Pseudomonas aeruginosa PA01
ccgcagaccagcgaaccgcc

SEQ ID NO: 1481161 - RNA, 18 nt, Pseudomonas aeruginosa PA01
ccgcacugguggcgaaca

SEQ ID NO: 1481162 - RNA, 20 nt, Pseudomonas aeruginosa PA01
ccgcacugguggcgaacagc

SEQ ID NO: 1481163 - RNA, 15 nt, Pseudomonas aeruginosa PA01
ccgcaccuacccgag

SEQ ID NO: 1481164 - RNA, 17 nt, Pseudomonas aeruginosa PA01
ccgcaccggcgcgccgg

SEQ ID NO: 1481165 - RNA, 16 nt, Pseudomonas aeruginosa PA01
ccgcaccuugcccugc

SEQ ID NO: 1481166 - RNA, 16 nt, Pseudomonas aeruginosa PA01
ccgcacgaggcgggcu

SEQ ID NO: 1481167 - RNA, 18 nt, Pseudomonas aeruginosa PA01
ccgcacgaggcgggcugg

SEQ ID NO: 1481168 - RNA, 21 nt, Pseudomonas aeruginosa PA01
ccgcacgaggcgggcuggaaa

SEQ ID NO: 1481169 - RNA, 12 nt, Pseudomonas aeruginosa PA01
ccgcaccuggug

SEQ ID NO: 1481170 - RNA, 14 nt, Pseudomonas aeruginosa PA01
ccgcaccggcaugu

SEQ ID NO: 1481171 - RNA, 21 nt, Pseudomonas aeruginosa PA01
ccgcaccggcauguagcgcgc

SEQ ID NO: 1481172 - RNA, 23 nt, Pseudomonas aeruginosa PA01
ccgcaccggcauguagcgcgccg

SEQ ID NO: 1481173 - RNA, 14 nt, Pseudomonas aeruginosa PA01
ccgcacccgggcaa

SEQ ID NO: 1481174 - RNA, 20 nt, Pseudomonas aeruginosa PA01
ccgcaccccauccucgccgg

SEQ ID NO: 1481175 - RNA, 17 nt, Pseudomonas aeruginosa PA01
ccgcaaggugcgggccg

SEQ ID NO: 1481176 - RNA, 21 nt, Pseudomonas aeruginosa PA01
ccgcaaggugcgggccgucgu

SEQ ID NO: 1481177 - RNA, 17 nt, Pseudomonas aeruginosa PA01
ccgcaaguaccgccggc

SEQ ID NO: 1481178 - RNA, 16 nt, Pseudomonas aeruginosa PA01
ccgcaaguggcggcug

SEQ ID NO: 1481179 - RNA, 19 nt, Pseudomonas aeruginosa PA01
ccgcaagcggauauccccc

SEQ ID NO: 1481180 - RNA, 13 nt, Pseudomonas aeruginosa PA01
ccgcaaggccagg

SEQ ID NO: 1481181 - RNA, 17 nt, Pseudomonas aeruginosa PA01
ccgcaaggccagggcgg

SEQ ID NO: 1481182 - RNA, 20 nt, Pseudomonas aeruginosa PA01
ccgcaagcuccccgccgcca

SEQ ID NO: 1481183 - RNA, 22 nt, Pseudomonas aeruginosa PA01
ccgcaagcuccccgccgccagg

SEQ ID NO: 1481184 - RNA, 13 nt, Pseudomonas aeruginosa PA01
ccgcagcggcagc

SEQ ID NO: 1481185 - RNA, 14 nt, Pseudomonas aeruginosa PA01
ccgcagcggcagcg

SEQ ID NO: 1481186 - RNA, 13 nt, Pseudomonas aeruginosa PA01
ccgcagcggcguc

SEQ ID NO: 1481187 - RNA, 12 nt, Pseudomonas aeruginosa PA01
ccgcagcggcug

SEQ ID NO: 1481188 - RNA, 20 nt, Pseudomonas aeruginosa PA01
ccgcaucgcugaccucgagc

SEQ ID NO: 1481189 - RNA, 23 nt, Pseudomonas aeruginosa PA01
ccgcaucgcgguuauccgccggc

SEQ ID NO: 1481190 - RNA, 16 nt, Pseudomonas aeruginosa PA01
ccgcagcggcagcggc

SEQ ID NO: 1481191 - RNA, 15 nt, Pseudomonas aeruginosa PA01
ccgcagcgccccucc

SEQ ID NO: 1481192 - RNA, 13 nt, Pseudomonas aeruginosa PA01
ccgcagcgcaacg

SEQ ID NO: 1481193 - RNA, 18 nt, Pseudomonas aeruginosa PA01
ccgcagcgcaagucggcc

SEQ ID NO: 1481194 - RNA, 19 nt, Pseudomonas aeruginosa PA01
ccgcagcgcaagucggccu

SEQ ID NO: 1481195 - RNA, 21 nt, Pseudomonas aeruginosa PA01
ccgcagcgcaagucggccugc

SEQ ID NO: 1481196 - RNA, 19 nt, Pseudomonas aeruginosa PA01
ccgcaucguuggcgccguc

SEQ ID NO: 1481197 - RNA, 20 nt, Pseudomonas aeruginosa PA01
ccgcaucguuggcgccgucc

SEQ ID NO: 1481198 - RNA, 22 nt, Pseudomonas aeruginosa PA01
ccgcaucggccaccuucgcccg

SEQ ID NO: 1481199 - RNA, 18 nt, Pseudomonas aeruginosa PA01
ccgccaaccacuccgcca

SEQ ID NO: 1481200 - RNA, 16 nt, Pseudomonas aeruginosa PA01
ccgccaccagcgaguc

SEQ ID NO: 1481201 - RNA, 13 nt, Pseudomonas aeruginosa PA01
ccgccacgccgau

SEQ ID NO: 1481202 - RNA, 18 nt, Pseudomonas aeruginosa PA01
ccgccacgccgauaccgg

SEQ ID NO: 1481203 - RNA, 19 nt, Pseudomonas aeruginosa PA01
ccgccacggcgcgcuccgg

SEQ ID NO: 1481204 - RNA, 23 nt, Pseudomonas aeruginosa PA01
ccgccacggcgcgcuccggcgcg

SEQ ID NO: 1481205 - RNA, 17 nt, Pseudomonas aeruginosa PA01
ccgccacguacagcgcg

SEQ ID NO: 1481206 - RNA, 18 nt, Pseudomonas aeruginosa PA01
ccgccacguacagcgcga

SEQ ID NO: 1481207 - RNA, 19 nt, Pseudomonas aeruginosa PA01
ccgccacguacagcgcgac

SEQ ID NO: 1481208 - RNA, 19 nt, Pseudomonas aeruginosa PA01
ccgccagcaccuggcagug

SEQ ID NO: 1481209 - RNA, 23 nt, Pseudomonas aeruginosa PA01
ccgccagcaccuggcagugcgcc

SEQ ID NO: 1481210 - RNA, 20 nt, Pseudomonas aeruginosa PA01
ccgccaaggccucggcaucc

SEQ ID NO: 1481211 - RNA, 17 nt, Pseudomonas aeruginosa PA01
ccgccaagggcgccgcc

SEQ ID NO: 1481212 - RNA, 18 nt, Pseudomonas aeruginosa PA01
ccgccaagggcgccgccg

SEQ ID NO: 1481213 - RNA, 20 nt, Pseudomonas aeruginosa PA01
ccgccacagaucgccagcuc

SEQ ID NO: 1481214 - RNA, 23 nt, Pseudomonas aeruginosa PA01
ccgccacagaucgccagcucgcc

SEQ ID NO: 1481215 - RNA, 17 nt, Pseudomonas aeruginosa PA01
ccgccaccacggcgaag

SEQ ID NO: 1481216 - RNA, 12 nt, Pseudomonas aeruginosa PA01
ccgccaccacgg

SEQ ID NO: 1481217 - RNA, 11 nt, Pseudomonas aeruginosa PA01
ccgccaccagc

SEQ ID NO: 1481218 - RNA, 14 nt, Pseudomonas aeruginosa PA01
ccgccaugcucggc

SEQ ID NO: 1481219 - RNA, 15 nt, Pseudomonas aeruginosa PA01
ccgccaugcucggcc

SEQ ID NO: 1481220 - RNA, 18 nt, Pseudomonas aeruginosa PA01
ccgccaugcucggccagc

SEQ ID NO: 1481221 - RNA, 14 nt, Pseudomonas aeruginosa PA01
ccgccaucgcccgg

SEQ ID NO: 1481222 - RNA, 16 nt, Pseudomonas aeruginosa PA01
ccgccauggcgcugag

SEQ ID NO: 1481223 - RNA, 17 nt, Pseudomonas aeruginosa PA01
ccgccaguuccgggguc

SEQ ID NO: 1481224 - RNA, 17 nt, Pseudomonas aeruginosa PA01
ccgccaguucgcgcagg

SEQ ID NO: 1481225 - RNA, 12 nt, Pseudomonas aeruginosa PA01
ccgccaguucgg

SEQ ID NO: 1481226 - RNA, 23 nt, Pseudomonas aeruginosa PA01
ccgccauagagugcccaggcgcu

SEQ ID NO: 1481227 - RNA, 22 nt, Pseudomonas aeruginosa PA01
ccgccagcaggucggccugcug

SEQ ID NO: 1481228 - RNA, 22 nt, Pseudomonas aeruginosa PA01
ccgccagcaguggcuccgcgcg

SEQ ID NO: 1481229 - RNA, 20 nt, Pseudomonas aeruginosa PA01
ccgccagccagagcagcguc

SEQ ID NO: 1481230 - RNA, 21 nt, Pseudomonas aeruginosa PA01
ccgccagccagagcagcgucg

SEQ ID NO: 1481231 - RNA, 14 nt, Pseudomonas aeruginosa PA01
ccgccagccagccg

SEQ ID NO: 1481232 - RNA, 12 nt, Pseudomonas aeruginosa PA01
ccgccagcaggc

SEQ ID NO: 1481233 - RNA, 15 nt, Pseudomonas aeruginosa PA01
ccgccagcaggccga

SEQ ID NO: 1481234 - RNA, 19 nt, Pseudomonas aeruginosa PA01
ccgccagcaggccgaaggc

SEQ ID NO: 1481235 - RNA, 20 nt, Pseudomonas aeruginosa PA01
ccgccagcaggccgaaggcc

SEQ ID NO: 1481236 - RNA, 17 nt, Pseudomonas aeruginosa PA01
ccgccagcaggcgccgg

SEQ ID NO: 1481237 - RNA, 19 nt, Pseudomonas aeruginosa PA01
ccgccagcaggcgccggcg

SEQ ID NO: 1481238 - RNA, 15 nt, Pseudomonas aeruginosa PA01
ccgccagcaggcgcg

SEQ ID NO: 1481239 - RNA, 18 nt, Pseudomonas aeruginosa PA01
ccgccagggcgucggaga

SEQ ID NO: 1481240 - RNA, 22 nt, Pseudomonas aeruginosa PA01
ccgccagggucagcucgacagc

SEQ ID NO: 1481241 - RNA, 19 nt, Pseudomonas aeruginosa PA01
ccgccaggguguacuugac

SEQ ID NO: 1481242 - RNA, 21 nt, Pseudomonas aeruginosa PA01
ccgccaggguguuguucgcca

SEQ ID NO: 1481243 - RNA, 17 nt, Pseudomonas aeruginosa PA01
ccgccagguccgccugg

SEQ ID NO: 1481244 - RNA, 13 nt, Pseudomonas aeruginosa PA01
ccgccaggucgau

SEQ ID NO: 1481245 - RNA, 21 nt, Pseudomonas aeruginosa PA01
ccgccaggucgauccccaacc

SEQ ID NO: 1481246 - RNA, 17 nt, Pseudomonas aeruginosa PA01
ccgccagguggcgggca

SEQ ID NO: 1481247 - RNA, 22 nt, Pseudomonas aeruginosa PA01
ccgccagguugcgcaaccagcg

SEQ ID NO: 1481248 - RNA, 12 nt, Pseudomonas aeruginosa PA01
ccgcccacccug

SEQ ID NO: 1481249 - RNA, 14 nt, Pseudomonas aeruginosa PA01
ccgcccacccugcg

SEQ ID NO: 1481250 - RNA, 18 nt, Pseudomonas aeruginosa PA01
ccgcccacccugcgcgag

SEQ ID NO: 1481251 - RNA, 12 nt, Pseudomonas aeruginosa PA01
ccgcccagcgca

SEQ ID NO: 1481252 - RNA, 15 nt, Pseudomonas aeruginosa PA01
ccgcccagcgcagcc

SEQ ID NO: 1481253 - RNA, 14 nt, Pseudomonas aeruginosa PA01
ccgcccagcgcagc

SEQ ID NO: 1481254 - RNA, 15 nt, Pseudomonas aeruginosa PA01
ccgcccaggacaacg

SEQ ID NO: 1481255 - RNA, 20 nt, Pseudomonas aeruginosa PA01
ccgcccaggcugccgccgcc

SEQ ID NO: 1481256 - RNA, 17 nt, Pseudomonas aeruginosa PA01
ccgcccagggggccggg

SEQ ID NO: 1481257 - RNA, 21 nt, Pseudomonas aeruginosa PA01
ccgcccagggggccgggccga

SEQ ID NO: 1481258 - RNA, 17 nt, Pseudomonas aeruginosa PA01
ccgcccaguucgccggc

SEQ ID NO: 1481259 - RNA, 19 nt, Pseudomonas aeruginosa PA01
ccgcccaguucgccggcca

SEQ ID NO: 1481260 - RNA, 16 nt, Pseudomonas aeruginosa PA01
ccgcccaucaacgagc

SEQ ID NO: 1481261 - RNA, 20 nt, Pseudomonas aeruginosa PA01
ccgcccaucaacgagccgag

SEQ ID NO: 1481262 - RNA, 20 nt, Pseudomonas aeruginosa PA01
ccgcccauugcccggccagg

SEQ ID NO: 1481263 - RNA, 23 nt, Pseudomonas aeruginosa PA01
ccgcccauugcccggccaggcgc

SEQ ID NO: 1481264 - RNA, 19 nt, Pseudomonas aeruginosa PA01
ccgccccaccaccaucgcc

SEQ ID NO: 1481265 - RNA, 21 nt, Pseudomonas aeruginosa PA01
ccgcccuguucgucuggcgcc

SEQ ID NO: 1481266 - RNA, 23 nt, Pseudomonas aeruginosa PA01
ccgcccuguucgucuggcgccug

SEQ ID NO: 1481267 - RNA, 23 nt, Pseudomonas aeruginosa PA01
ccgcccuugcggcccgccucggc

SEQ ID NO: 1481268 - RNA, 13 nt, Pseudomonas aeruginosa PA01
ccgcccuggccgc

SEQ ID NO: 1481269 - RNA, 12 nt, Pseudomonas aeruginosa PA01
ccgcccugcgcg

SEQ ID NO: 1481270 - RNA, 17 nt, Pseudomonas aeruginosa PA01
ccgcccugcgcgauccc

SEQ ID NO: 1481271 - RNA, 17 nt, Pseudomonas aeruginosa PA01
ccgccgaacggaucgcg

SEQ ID NO: 1481272 - RNA, 16 nt, Pseudomonas aeruginosa PA01
ccgccgaacaugccga

SEQ ID NO: 1481273 - RNA, 17 nt, Pseudomonas aeruginosa PA01
ccgccgaacgccaccag

SEQ ID NO: 1481274 - RNA, 22 nt, Pseudomonas aeruginosa PA01
ccgccgaacgccaccagggccu

SEQ ID NO: 1481275 - RNA, 14 nt, Pseudomonas aeruginosa PA01
ccgcccuuggcggc

SEQ ID NO: 1481276 - RNA, 22 nt, Pseudomonas aeruginosa PA01
ccgcccuugucgaugagccagc

SEQ ID NO: 1481277 - RNA, 15 nt, Pseudomonas aeruginosa PA01
ccgcccuuucgaacu

SEQ ID NO: 1481278 - RNA, 19 nt, Pseudomonas aeruginosa PA01
ccgcccuuuuucgucgcca

SEQ ID NO: 1481279 - RNA, 20 nt, Pseudomonas aeruginosa PA01
ccgcccuuuuucgucgccag

SEQ ID NO: 1481280 - RNA, 15 nt, Pseudomonas aeruginosa PA01
ccgccgaacagcaac

SEQ ID NO: 1481281 - RNA, 20 nt, Pseudomonas aeruginosa PA01
ccgccgaacagcaacaccgc

SEQ ID NO: 1481282 - RNA, 14 nt, Pseudomonas aeruginosa PA01
ccgccgaucagcgc

SEQ ID NO: 1481283 - RNA, 16 nt, Pseudomonas aeruginosa PA01
ccgccgaucagcgcgc

SEQ ID NO: 1481284 - RNA, 17 nt, Pseudomonas aeruginosa PA01
ccgccgaucagcgcgcc

SEQ ID NO: 1481285 - RNA, 23 nt, Pseudomonas aeruginosa PA01
ccgccgaucagcgcgccuucgac

SEQ ID NO: 1481286 - RNA, 20 nt, Pseudomonas aeruginosa PA01
ccgccgauccaggaaccggc

SEQ ID NO: 1481287 - RNA, 22 nt, Pseudomonas aeruginosa PA01
ccgccgauccaggaaccggcca

SEQ ID NO: 1481288 - RNA, 14 nt, Pseudomonas aeruginosa PA01
ccgccgaucccgac

SEQ ID NO: 1481289 - RNA, 22 nt, Pseudomonas aeruginosa PA01
ccgccgaucugcugggucaucg

SEQ ID NO: 1481290 - RNA, 14 nt, Pseudomonas aeruginosa PA01
ccgccgaucugcug

SEQ ID NO: 1481291 - RNA, 14 nt, Pseudomonas aeruginosa PA01
ccgccgaugccgac

SEQ ID NO: 1481292 - RNA, 21 nt, Pseudomonas aeruginosa PA01
ccgccgaugccgacgucgacu

SEQ ID NO: 1481293 - RNA, 22 nt, Pseudomonas aeruginosa PA01
ccgccgaagccgacgccgagca

SEQ ID NO: 1481294 - RNA, 13 nt, Pseudomonas aeruginosa PA01
ccgccgaagcggg

SEQ ID NO: 1481295 - RNA, 21 nt, Pseudomonas aeruginosa PA01
ccgccgacacccgcgccgccg

SEQ ID NO: 1481296 - RNA, 13 nt, Pseudomonas aeruginosa PA01
ccgccgaccagca

SEQ ID NO: 1481297 - RNA, 20 nt, Pseudomonas aeruginosa PA01
ccgccgaccagcacggcgaa

SEQ ID NO: 1481298 - RNA, 13 nt, Pseudomonas aeruginosa PA01
ccgcccgccgucg

SEQ ID NO: 1481299 - RNA, 10 nt, Pseudomonas aeruginosa PA01
ccgcccggca

SEQ ID NO: 1481300 - RNA, 21 nt, Pseudomonas aeruginosa PA01
ccgcccgcucaagggcuggca

SEQ ID NO: 1481301 - RNA, 15 nt, Pseudomonas aeruginosa PA01
ccgcccggccaggcc

SEQ ID NO: 1481302 - RNA, 16 nt, Pseudomonas aeruginosa PA01
ccgcccggccaggcca

SEQ ID NO: 1481303 - RNA, 17 nt, Pseudomonas aeruginosa PA01
ccgcccggcaccaccgg

SEQ ID NO: 1481304 - RNA, 19 nt, Pseudomonas aeruginosa PA01
ccgcccggcaccgggguga

SEQ ID NO: 1481305 - RNA, 18 nt, Pseudomonas aeruginosa PA01
ccgcccggcagcggcugg

SEQ ID NO: 1481306 - RNA, 20 nt, Pseudomonas aeruginosa PA01
ccgcccggcagcggcuggcc

SEQ ID NO: 1481307 - RNA, 13 nt, Pseudomonas aeruginosa PA01
ccgcccggcgcca

SEQ ID NO: 1481308 - RNA, 13 nt, Pseudomonas aeruginosa PA01
ccgcccggcucgc

SEQ ID NO: 1481309 - RNA, 15 nt, Pseudomonas aeruginosa PA01
ccgcccggcucgccg

SEQ ID NO: 1481310 - RNA, 16 nt, Pseudomonas aeruginosa PA01
ccgcccggcucgccgc

SEQ ID NO: 1481311 - RNA, 19 nt, Pseudomonas aeruginosa PA01
ccgccccuuuccgccggac

SEQ ID NO: 1481312 - RNA, 23 nt, Pseudomonas aeruginosa PA01
ccgcccgagaggguggucgcgcu

SEQ ID NO: 1481313 - RNA, 21 nt, Pseudomonas aeruginosa PA01
ccgccccgcaccagccagccc

SEQ ID NO: 1481314 - RNA, 21 nt, Pseudomonas aeruginosa PA01
ccgcccgagcuuugcgcagcc

SEQ ID NO: 1481315 - RNA, 22 nt, Pseudomonas aeruginosa PA01
ccgcccgcaugccagggccuug

SEQ ID NO: 1481316 - RNA, 18 nt, Pseudomonas aeruginosa PA01
ccgcccccagcgcgccgc

SEQ ID NO: 1481317 - RNA, 17 nt, Pseudomonas aeruginosa PA01
ccgccccggcaagcgcc

SEQ ID NO: 1481318 - RNA, 13 nt, Pseudomonas aeruginosa PA01
ccgccccggcagc

SEQ ID NO: 1481319 - RNA, 15 nt, Pseudomonas aeruginosa PA01
ccgccccggcagcca

SEQ ID NO: 1481320 - RNA, 19 nt, Pseudomonas aeruginosa PA01
ccgccgcgccucgucgcgc

SEQ ID NO: 1481321 - RNA, 23 nt, Pseudomonas aeruginosa PA01
ccgccgcgccucgucgcgccagg

SEQ ID NO: 1481322 - RNA, 13 nt, Pseudomonas aeruginosa PA01
ccgccgcgcgcgc

SEQ ID NO: 1481323 - RNA, 14 nt, Pseudomonas aeruginosa PA01
ccgccgcgcgcgcg

SEQ ID NO: 1481324 - RNA, 17 nt, Pseudomonas aeruginosa PA01
ccgccgcgcgcgcgguc

SEQ ID NO: 1481325 - RNA, 12 nt, Pseudomonas aeruginosa PA01
ccgccgcgccgg

SEQ ID NO: 1481326 - RNA, 13 nt, Pseudomonas aeruginosa PA01
ccgccgcgccggc

SEQ ID NO: 1481327 - RNA, 14 nt, Pseudomonas aeruginosa PA01
ccgccgcgccgcuc

SEQ ID NO: 1481328 - RNA, 17 nt, Pseudomonas aeruginosa PA01
ccgccgcgccgcucagg

SEQ ID NO: 1481329 - RNA, 14 nt, Pseudomonas aeruginosa PA01
ccgccgcgccggcg

SEQ ID NO: 1481330 - RNA, 13 nt, Pseudomonas aeruginosa PA01
ccgccgcgcugca

SEQ ID NO: 1481331 - RNA, 18 nt, Pseudomonas aeruginosa PA01
ccgccgcgcuucaggcag

SEQ ID NO: 1481332 - RNA, 15 nt, Pseudomonas aeruginosa PA01
ccgccgcggcaccgg

SEQ ID NO: 1481333 - RNA, 15 nt, Pseudomonas aeruginosa PA01
ccgccgcggcgcgga

SEQ ID NO: 1481334 - RNA, 21 nt, Pseudomonas aeruginosa PA01
ccgccgaugcuguucagcagg

SEQ ID NO: 1481335 - RNA, 22 nt, Pseudomonas aeruginosa PA01
ccgccgaugcgcuacggcauca

SEQ ID NO: 1481336 - RNA, 21 nt, Pseudomonas aeruginosa PA01
ccgccgcccagcagcaccauc

SEQ ID NO: 1481337 - RNA, 12 nt, Pseudomonas aeruginosa PA01
ccgccgccaggu

SEQ ID NO: 1481338 - RNA, 20 nt, Pseudomonas aeruginosa PA01
ccgccgccagguccgccugg

SEQ ID NO: 1481339 - RNA, 11 nt, Pseudomonas aeruginosa PA01
ccgccgccagg

SEQ ID NO: 1481340 - RNA, 14 nt, Pseudomonas aeruginosa PA01
ccgccgccaggcgc

SEQ ID NO: 1481341 - RNA, 23 nt, Pseudomonas aeruginosa PA01
ccgccggccgggagcuacagcga

SEQ ID NO: 1481342 - RNA, 15 nt, Pseudomonas aeruginosa PA01
ccgccggcgaacggc

SEQ ID NO: 1481343 - RNA, 17 nt, Pseudomonas aeruginosa PA01
ccgccggcgaacggcau

SEQ ID NO: 1481344 - RNA, 15 nt, Pseudomonas aeruginosa PA01
ccgccggcgaugccc

SEQ ID NO: 1481345 - RNA, 18 nt, Pseudomonas aeruginosa PA01
ccgccggcgaugcccagg

SEQ ID NO: 1481346 - RNA, 20 nt, Pseudomonas aeruginosa PA01
ccgccggcgaugcccaggcc

SEQ ID NO: 1481347 - RNA, 23 nt, Pseudomonas aeruginosa PA01
ccgccggcgaugcccaggccgcc

SEQ ID NO: 1481348 - RNA, 18 nt, Pseudomonas aeruginosa PA01
ccgccggcgaccgcgcgc

SEQ ID NO: 1481349 - RNA, 21 nt, Pseudomonas aeruginosa PA01
ccgccggcgaggaucgcgcug

SEQ ID NO: 1481350 - RNA, 24 nt, Pseudomonas aeruginosa PA01
ccgccggcgaggaucgcgcuggcc

SEQ ID NO: 1481351 - RNA, 12 nt, Pseudomonas aeruginosa PA01
ccgccggcgaug

SEQ ID NO: 1481352 - RNA, 15 nt, Pseudomonas aeruginosa PA01
ccgccgggaccacgc

SEQ ID NO: 1481353 - RNA, 20 nt, Pseudomonas aeruginosa PA01
ccgccggcguuauccgccga

SEQ ID NO: 1481354 - RNA, 21 nt, Pseudomonas aeruginosa PA01
ccgccggcguuauccgccgau

SEQ ID NO: 1481355 - RNA, 15 nt, Pseudomonas aeruginosa PA01
ccgccggcguucgac

SEQ ID NO: 1481356 - RNA, 18 nt, Pseudomonas aeruginosa PA01
ccgccggaccgucgcgau

SEQ ID NO: 1481357 - RNA, 21 nt, Pseudomonas aeruginosa PA01
ccgccggagacuucagcgcau

SEQ ID NO: 1481358 - RNA, 14 nt, Pseudomonas aeruginosa PA01
ccgccgcuuccgcc

SEQ ID NO: 1481359 - RNA, 16 nt, Pseudomonas aeruginosa PA01
ccgccgcuuccgccgg

SEQ ID NO: 1481360 - RNA, 18 nt, Pseudomonas aeruginosa PA01
ccgccgcuuccgccggcg

SEQ ID NO: 1481361 - RNA, 15 nt, Pseudomonas aeruginosa PA01
ccgccggaaccugca

SEQ ID NO: 1481362 - RNA, 12 nt, Pseudomonas aeruginosa PA01
ccgccgcuggca

SEQ ID NO: 1481363 - RNA, 13 nt, Pseudomonas aeruginosa PA01
ccgccgcuggccu

SEQ ID NO: 1481364 - RNA, 14 nt, Pseudomonas aeruginosa PA01
ccgccgcuggcggc

SEQ ID NO: 1481365 - RNA, 21 nt, Pseudomonas aeruginosa PA01
ccgccgcuggcggcaugccgu

SEQ ID NO: 1481366 - RNA, 13 nt, Pseudomonas aeruginosa PA01
ccgccgcugggga

SEQ ID NO: 1481367 - RNA, 12 nt, Pseudomonas aeruginosa PA01
ccgccgcgggca

SEQ ID NO: 1481368 - RNA, 14 nt, Pseudomonas aeruginosa PA01
ccgccgcggcguua

SEQ ID NO: 1481369 - RNA, 20 nt, Pseudomonas aeruginosa PA01
ccgccgcggcguuagccgcc

SEQ ID NO: 1481370 - RNA, 16 nt, Pseudomonas aeruginosa PA01
ccgccgcgggacgccg

SEQ ID NO: 1481371 - RNA, 14 nt, Pseudomonas aeruginosa PA01
ccgccguugaggaa

SEQ ID NO: 1481372 - RNA, 20 nt, Pseudomonas aeruginosa PA01
ccgccguucucauugcgccg

SEQ ID NO: 1481373 - RNA, 21 nt, Pseudomonas aeruginosa PA01
ccgccguucucauugcgccgc

SEQ ID NO: 1481374 - RNA, 18 nt, Pseudomonas aeruginosa PA01
ccgccucgaccagcgccg

SEQ ID NO: 1481375 - RNA, 23 nt, Pseudomonas aeruginosa PA01
ccgccucgaccagcgccgcggcg

SEQ ID NO: 1481376 - RNA, 20 nt, Pseudomonas aeruginosa PA01
ccgccucgaccaucggcggc

SEQ ID NO: 1481377 - RNA, 21 nt, Pseudomonas aeruginosa PA01
ccgccucgaccaucggcggcg

SEQ ID NO: 1481378 - RNA, 24 nt, Pseudomonas aeruginosa PA01
ccgccucgaccaucggcggcggcc

SEQ ID NO: 1481379 - RNA, 19 nt, Pseudomonas aeruginosa PA01
ccgccucgaccccggaaag

SEQ ID NO: 1481380 - RNA, 13 nt, Pseudomonas aeruginosa PA01
ccgccucgaaggc

SEQ ID NO: 1481381 - RNA, 19 nt, Pseudomonas aeruginosa PA01
ccgccucgaaggccggcaa

SEQ ID NO: 1481382 - RNA, 13 nt, Pseudomonas aeruginosa PA01
ccgccucgcgcaa

SEQ ID NO: 1481383 - RNA, 18 nt, Pseudomonas aeruginosa PA01
ccgccucgcgcaacgccu

SEQ ID NO: 1481384 - RNA, 13 nt, Pseudomonas aeruginosa PA01
ccgccucgcgccg

SEQ ID NO: 1481385 - RNA, 14 nt, Pseudomonas aeruginosa PA01
ccgccucgcgccgu

SEQ ID NO: 1481386 - RNA, 13 nt, Pseudomonas aeruginosa PA01
ccgccucggcggc

SEQ ID NO: 1481387 - RNA, 14 nt, Pseudomonas aeruginosa PA01
ccgccucgggcagc

SEQ ID NO: 1481388 - RNA, 14 nt, Pseudomonas aeruginosa PA01
ccgccugcucggcc

SEQ ID NO: 1481389 - RNA, 21 nt, Pseudomonas aeruginosa PA01
ccgccugcucggccugcugcg

SEQ ID NO: 1481390 - RNA, 19 nt, Pseudomonas aeruginosa PA01
ccgccucgcugagcaccgg

SEQ ID NO: 1481391 - RNA, 14 nt, Pseudomonas aeruginosa PA01
ccgccucgcugggc

SEQ ID NO: 1481392 - RNA, 15 nt, Pseudomonas aeruginosa PA01
ccgccucgcugggcg

SEQ ID NO: 1481393 - RNA, 13 nt, Pseudomonas aeruginosa PA01
ccgccucggagaa

SEQ ID NO: 1481394 - RNA, 20 nt, Pseudomonas aeruginosa PA01
ccgccucggagaacagcagc

SEQ ID NO: 1481395 - RNA, 22 nt, Pseudomonas aeruginosa PA01
ccgccuggaaggcgcugggcgg

SEQ ID NO: 1481396 - RNA, 23 nt, Pseudomonas aeruginosa PA01
ccgccuggaaggcgcugggcggc

SEQ ID NO: 1481397 - RNA, 12 nt, Pseudomonas aeruginosa PA01
ccgccuggccgg

SEQ ID NO: 1481398 - RNA, 14 nt, Pseudomonas aeruginosa PA01
ccgccuggccggcc

SEQ ID NO: 1481399 - RNA, 15 nt, Pseudomonas aeruginosa PA01
ccgccuggccggcca

SEQ ID NO: 1481400 - RNA, 21 nt, Pseudomonas aeruginosa PA01
ccgccuggccggccagccagg

SEQ ID NO: 1481401 - RNA, 20 nt, Pseudomonas aeruginosa PA01
ccgccuggcgugccgccagg

SEQ ID NO: 1481402 - RNA, 21 nt, Pseudomonas aeruginosa PA01
ccgccuggcgugccgccaggc

SEQ ID NO: 1481403 - RNA, 22 nt, Pseudomonas aeruginosa PA01
ccgccuggcgugccgccaggcc

SEQ ID NO: 1481404 - RNA, 22 nt, Pseudomonas aeruginosa PA01
ccgccugggacggaacgucggc

SEQ ID NO: 1481405 - RNA, 12 nt, Pseudomonas aeruginosa PA01
ccgccuggcgca

SEQ ID NO: 1481406 - RNA, 15 nt, Pseudomonas aeruginosa PA01
ccgccuggucgaucu

SEQ ID NO: 1481407 - RNA, 14 nt, Pseudomonas aeruginosa PA01
ccgccuggucgccg

SEQ ID NO: 1481408 - RNA, 24 nt, Pseudomonas aeruginosa PA01
ccgccuggucggggccggcgaugc

SEQ ID NO: 1481409 - RNA, 19 nt, Pseudomonas aeruginosa PA01
ccgccuggugcccgaugcc

SEQ ID NO: 1481410 - RNA, 12 nt, Pseudomonas aeruginosa PA01
ccgccuguccac

SEQ ID NO: 1481411 - RNA, 19 nt, Pseudomonas aeruginosa PA01
ccgccuguccaccgguggc

SEQ ID NO: 1481412 - RNA, 15 nt, Pseudomonas aeruginosa PA01
ccgccuggguggcga

SEQ ID NO: 1481413 - RNA, 17 nt, Pseudomonas aeruginosa PA01
ccgccuggguggcgacg

SEQ ID NO: 1481414 - RNA, 14 nt, Pseudomonas aeruginosa PA01
ccgccgucgcggcc

SEQ ID NO: 1481415 - RNA, 15 nt, Pseudomonas aeruginosa PA01
ccgccgucgcggcca

SEQ ID NO: 1481416 - RNA, 22 nt, Pseudomonas aeruginosa PA01
ccgccgucgcggccaucggcga

SEQ ID NO: 1481417 - RNA, 21 nt, Pseudomonas aeruginosa PA01
ccgccgucuugccgcugcgcg

SEQ ID NO: 1481418 - RNA, 22 nt, Pseudomonas aeruginosa PA01
ccgccgucuugccgcugcgcgc

SEQ ID NO: 1481419 - RNA, 18 nt, Pseudomonas aeruginosa PA01
ccgccgugaggcgcgcgc

SEQ ID NO: 1481420 - RNA, 21 nt, Pseudomonas aeruginosa PA01
ccgccgugaggcgcgcgccga

SEQ ID NO: 1481421 - RNA, 20 nt, Pseudomonas aeruginosa PA01
ccgccguuccuccucgccgc

SEQ ID NO: 1481422 - RNA, 22 nt, Pseudomonas aeruginosa PA01
ccgccguuccuccucgccgccg

SEQ ID NO: 1481423 - RNA, 23 nt, Pseudomonas aeruginosa PA01
ccgccguuccuccucgccgccga

SEQ ID NO: 1481424 - RNA, 14 nt, Pseudomonas aeruginosa PA01
ccgccguucgcccg

SEQ ID NO: 1481425 - RNA, 16 nt, Pseudomonas aeruginosa PA01
ccgccguucgcccgcc

SEQ ID NO: 1481426 - RNA, 17 nt, Pseudomonas aeruginosa PA01
ccgccguucgcccgcca

SEQ ID NO: 1481427 - RNA, 15 nt, Pseudomonas aeruginosa PA01
ccgccguggaacgca

SEQ ID NO: 1481428 - RNA, 12 nt, Pseudomonas aeruginosa PA01
ccgccgugcgcu

SEQ ID NO: 1481429 - RNA, 16 nt, Pseudomonas aeruginosa PA01
ccgccguggcugugcu

SEQ ID NO: 1481430 - RNA, 22 nt, Pseudomonas aeruginosa PA01
ccgccguggcugugcuggccac

SEQ ID NO: 1481431 - RNA, 17 nt, Pseudomonas aeruginosa PA01
ccgccgugggaacgcga

SEQ ID NO: 1481432 - RNA, 18 nt, Pseudomonas aeruginosa PA01
ccgccgggagcggccgug

SEQ ID NO: 1481433 - RNA, 21 nt, Pseudomonas aeruginosa PA01
ccgccgggagcggccgugcau

SEQ ID NO: 1481434 - RNA, 14 nt, Pseudomonas aeruginosa PA01
ccgccgggccgccu

SEQ ID NO: 1481435 - RNA, 21 nt, Pseudomonas aeruginosa PA01
ccgccgucgacaccgaucacc

SEQ ID NO: 1481436 - RNA, 13 nt, Pseudomonas aeruginosa PA01
ccgcgcagaucgc

SEQ ID NO: 1481437 - RNA, 19 nt, Pseudomonas aeruginosa PA01
ccgcgccagcgccgccagu

SEQ ID NO: 1481438 - RNA, 14 nt, Pseudomonas aeruginosa PA01
ccgcgccagcaggc

SEQ ID NO: 1481439 - RNA, 19 nt, Pseudomonas aeruginosa PA01
ccgcgccagcaggcgcagc

SEQ ID NO: 1481440 - RNA, 18 nt, Pseudomonas aeruginosa PA01
ccgcgcagaugaucgcca

SEQ ID NO: 1481441 - RNA, 20 nt, Pseudomonas aeruginosa PA01
ccgcgcagaugaucgccacc

SEQ ID NO: 1481442 - RNA, 23 nt, Pseudomonas aeruginosa PA01
ccgcgcagaugaucgccaccggg

SEQ ID NO: 1481443 - RNA, 18 nt, Pseudomonas aeruginosa PA01
ccgcgcagcaacggcgca

SEQ ID NO: 1481444 - RNA, 14 nt, Pseudomonas aeruginosa PA01
ccgcgccagugccu

SEQ ID NO: 1481445 - RNA, 14 nt, Pseudomonas aeruginosa PA01
ccgcgccaugccgg

SEQ ID NO: 1481446 - RNA, 15 nt, Pseudomonas aeruginosa PA01
ccgcgccaugccggc

SEQ ID NO: 1481447 - RNA, 17 nt, Pseudomonas aeruginosa PA01
ccgcgccaugccggcgc

SEQ ID NO: 1481448 - RNA, 14 nt, Pseudomonas aeruginosa PA01
ccgcgccaggcgca

SEQ ID NO: 1481449 - RNA, 16 nt, Pseudomonas aeruginosa PA01
ccgcgccaggcgcagu

SEQ ID NO: 1481450 - RNA, 12 nt, Pseudomonas aeruginosa PA01
ccgcgccagcca

SEQ ID NO: 1481451 - RNA, 14 nt, Pseudomonas aeruginosa PA01
ccgcgccagcucga

SEQ ID NO: 1481452 - RNA, 17 nt, Pseudomonas aeruginosa PA01
ccgcgcacuuguagagg

SEQ ID NO: 1481453 - RNA, 19 nt, Pseudomonas aeruginosa PA01
ccgcgcaccuugcuggaca

SEQ ID NO: 1481454 - RNA, 21 nt, Pseudomonas aeruginosa PA01
ccgcgcacaaaaaagcccgcc

SEQ ID NO: 1481455 - RNA, 15 nt, Pseudomonas aeruginosa PA01
ccgcgcaccucgacc

SEQ ID NO: 1481456 - RNA, 22 nt, Pseudomonas aeruginosa PA01
ccgcgcaccucgaccgcgccgg

SEQ ID NO: 1481457 - RNA, 15 nt, Pseudomonas aeruginosa PA01
ccgcgaggaucagcc

SEQ ID NO: 1481458 - RNA, 16 nt, Pseudomonas aeruginosa PA01
ccgcgagcuuggcccu

SEQ ID NO: 1481459 - RNA, 17 nt, Pseudomonas aeruginosa PA01
ccgcgagcuuggcccug

SEQ ID NO: 1481460 - RNA, 18 nt, Pseudomonas aeruginosa PA01
ccgcgagcuuggcccugg

SEQ ID NO: 1481461 - RNA, 22 nt, Pseudomonas aeruginosa PA01
ccgcgaggaaaagacgcuguuc

SEQ ID NO: 1481462 - RNA, 20 nt, Pseudomonas aeruginosa PA01
ccgcgaggcggucaugcgcc

SEQ ID NO: 1481463 - RNA, 14 nt, Pseudomonas aeruginosa PA01
ccgcgacgacugcg

SEQ ID NO: 1481464 - RNA, 19 nt, Pseudomonas aeruginosa PA01
ccgcgacgcgcuggaccau

SEQ ID NO: 1481465 - RNA, 18 nt, Pseudomonas aeruginosa PA01
ccgcgacgcuccagcggc

SEQ ID NO: 1481466 - RNA, 14 nt, Pseudomonas aeruginosa PA01
ccgcgaccugcucg

SEQ ID NO: 1481467 - RNA, 14 nt, Pseudomonas aeruginosa PA01
ccgcgagcagccga

SEQ ID NO: 1481468 - RNA, 16 nt, Pseudomonas aeruginosa PA01
ccgcgagcagccgacg

SEQ ID NO: 1481469 - RNA, 19 nt, Pseudomonas aeruginosa PA01
ccgcgagcaccaugcagcg

SEQ ID NO: 1481470 - RNA, 20 nt, Pseudomonas aeruginosa PA01
ccgcgagagguucaccgacc

SEQ ID NO: 1481471 - RNA, 21 nt, Pseudomonas aeruginosa PA01
ccgcgagagguucaccgacca

SEQ ID NO: 1481472 - RNA, 18 nt, Pseudomonas aeruginosa PA01
ccgcgagccguccugcgg

SEQ ID NO: 1481473 - RNA, 21 nt, Pseudomonas aeruginosa PA01
ccgcgagccguccugcggccg

SEQ ID NO: 1481474 - RNA, 22 nt, Pseudomonas aeruginosa PA01
ccgcgagccguccugcggccgc

SEQ ID NO: 1481475 - RNA, 19 nt, Pseudomonas aeruginosa PA01
ccgcgagccuucagcacgg

SEQ ID NO: 1481476 - RNA, 20 nt, Pseudomonas aeruginosa PA01
ccgcgagccuucagcacggc

SEQ ID NO: 1481477 - RNA, 21 nt, Pseudomonas aeruginosa PA01
ccgcgagccuucagcacggcg

SEQ ID NO: 1481478 - RNA, 20 nt, Pseudomonas aeruginosa PA01
ccgcgagcgaaacggcgcug

SEQ ID NO: 1481479 - RNA, 13 nt, Pseudomonas aeruginosa PA01
ccgcgagcgcggc

SEQ ID NO: 1481480 - RNA, 12 nt, Pseudomonas aeruginosa PA01
ccgcgagccagc

SEQ ID NO: 1481481 - RNA, 19 nt, Pseudomonas aeruginosa PA01
ccgcgagccagccguggca

SEQ ID NO: 1481482 - RNA, 13 nt, Pseudomonas aeruginosa PA01
ccgcgaccgggca

SEQ ID NO: 1481483 - RNA, 19 nt, Pseudomonas aeruginosa PA01
ccgccuuggcaucgccgcc

SEQ ID NO: 1481484 - RNA, 19 nt, Pseudomonas aeruginosa PA01
ccgccuugcguaccagcgc

SEQ ID NO: 1481485 - RNA, 22 nt, Pseudomonas aeruginosa PA01
ccgccuugcguaccagcgcgca

SEQ ID NO: 1481486 - RNA, 15 nt, Pseudomonas aeruginosa PA01
ccgccuugcucgacc

SEQ ID NO: 1481487 - RNA, 20 nt, Pseudomonas aeruginosa PA01
ccgccuugagcggcgcccug

SEQ ID NO: 1481488 - RNA, 22 nt, Pseudomonas aeruginosa PA01
ccgccuugagcggcgcccuggc

SEQ ID NO: 1481489 - RNA, 19 nt, Pseudomonas aeruginosa PA01
ccgccuucggcaggaccuc

SEQ ID NO: 1481490 - RNA, 14 nt, Pseudomonas aeruginosa PA01
ccgccuuccucggc

SEQ ID NO: 1481491 - RNA, 16 nt, Pseudomonas aeruginosa PA01
ccgccuuccucggccg

SEQ ID NO: 1481492 - RNA, 21 nt, Pseudomonas aeruginosa PA01
ccgccuuccucggccgccagg

SEQ ID NO: 1481493 - RNA, 14 nt, Pseudomonas aeruginosa PA01
ccgccuucgcgggc

SEQ ID NO: 1481494 - RNA, 18 nt, Pseudomonas aeruginosa PA01
ccgccuucgcgggccagg

SEQ ID NO: 1481495 - RNA, 21 nt, Pseudomonas aeruginosa PA01
ccgccuucgcgggccaggccg

SEQ ID NO: 1481496 - RNA, 23 nt, Pseudomonas aeruginosa PA01
ccgccuucgcgggccaggccgag

SEQ ID NO: 1481497 - RNA, 17 nt, Pseudomonas aeruginosa PA01
ccgccuuccagcuugcg

SEQ ID NO: 1481498 - RNA, 23 nt, Pseudomonas aeruginosa PA01
ccgccuuccagcuugcgccagag

SEQ ID NO: 1481499 - RNA, 14 nt, Pseudomonas aeruginosa PA01
ccguccaucaggcg

SEQ ID NO: 1481500 - RNA, 17 nt, Pseudomonas aeruginosa PA01
ccguccagugcggcagu

SEQ ID NO: 1481501 - RNA, 14 nt, Pseudomonas aeruginosa PA01
ccguccgcugcgcc

SEQ ID NO: 1481502 - RNA, 15 nt, Pseudomonas aeruginosa PA01
ccguccgcugcgcca

SEQ ID NO: 1481503 - RNA, 15 nt, Pseudomonas aeruginosa PA01
ccguccagcgcuuga

SEQ ID NO: 1481504 - RNA, 15 nt, Pseudomonas aeruginosa PA01
ccguccaggcgcgaa

SEQ ID NO: 1481505 - RNA, 16 nt, Pseudomonas aeruginosa PA01
ccgucccacaggccgg

SEQ ID NO: 1481506 - RNA, 18 nt, Pseudomonas aeruginosa PA01
ccgucccacaggccggcu

SEQ ID NO: 1481507 - RNA, 19 nt, Pseudomonas aeruginosa PA01
ccgucccacaggccggcua

SEQ ID NO: 1481508 - RNA, 18 nt, Pseudomonas aeruginosa PA01
ccguccgggucggucacg

SEQ ID NO: 1481509 - RNA, 23 nt, Pseudomonas aeruginosa PA01
ccguccgggcacgcauagcgcgc

SEQ ID NO: 1481510 - RNA, 19 nt, Pseudomonas aeruginosa PA01
ccguccugcaacugcucga

SEQ ID NO: 1481511 - RNA, 15 nt, Pseudomonas aeruginosa PA01
ccguccugcggccgc

SEQ ID NO: 1481512 - RNA, 13 nt, Pseudomonas aeruginosa PA01
ccguccuggcccu

SEQ ID NO: 1481513 - RNA, 14 nt, Pseudomonas aeruginosa PA01
ccguccuggcgggg

SEQ ID NO: 1481514 - RNA, 15 nt, Pseudomonas aeruginosa PA01
ccguccucgucgagg

SEQ ID NO: 1481515 - RNA, 16 nt, Pseudomonas aeruginosa PA01
ccgucacggccuccgg

SEQ ID NO: 1481516 - RNA, 12 nt, Pseudomonas aeruginosa PA01
ccguccagccgg

SEQ ID NO: 1481517 - RNA, 13 nt, Pseudomonas aeruginosa PA01
ccguccagcgaga

SEQ ID NO: 1481518 - RNA, 20 nt, Pseudomonas aeruginosa PA01
ccguccagcgagaacuugcc

SEQ ID NO: 1481519 - RNA, 19 nt, Pseudomonas aeruginosa PA01
ccguccagcgcgcccggcg

SEQ ID NO: 1481520 - RNA, 15 nt, Pseudomonas aeruginosa PA01
ccguccagcgcgccg

SEQ ID NO: 1481521 - RNA, 16 nt, Pseudomonas aeruginosa PA01
ccguccaccagccagc

SEQ ID NO: 1481522 - RNA, 15 nt, Pseudomonas aeruginosa PA01
ccguccacuggccca

SEQ ID NO: 1481523 - RNA, 13 nt, Pseudomonas aeruginosa PA01
ccgguucccgcag

SEQ ID NO: 1481524 - RNA, 20 nt, Pseudomonas aeruginosa PA01
ccgguucccgcagcgaucag

SEQ ID NO: 1481525 - RNA, 16 nt, Pseudomonas aeruginosa PA01
ccgguuccgcgucgcc

SEQ ID NO: 1481526 - RNA, 23 nt, Pseudomonas aeruginosa PA01
ccgguucgacacgcucagccccg

SEQ ID NO: 1481527 - RNA, 16 nt, Pseudomonas aeruginosa PA01
ccgguuccagcggccg

SEQ ID NO: 1481528 - RNA, 21 nt, Pseudomonas aeruginosa PA01
ccgguuccagcggccgcgagc

SEQ ID NO: 1481529 - RNA, 19 nt, Pseudomonas aeruginosa PA01
ccguagccaugcccggcug

SEQ ID NO: 1481530 - RNA, 20 nt, Pseudomonas aeruginosa PA01
ccguagccaugcccggcugg

SEQ ID NO: 1481531 - RNA, 15 nt, Pseudomonas aeruginosa PA01
ccguagccguagaug

SEQ ID NO: 1481532 - RNA, 18 nt, Pseudomonas aeruginosa PA01
ccguagccgucgaacagc

SEQ ID NO: 1481533 - RNA, 21 nt, Pseudomonas aeruginosa PA01
ccguagccgucgaacagcagc

SEQ ID NO: 1481534 - RNA, 21 nt, Pseudomonas aeruginosa PA01
ccguagaacgccaggaucggc

SEQ ID NO: 1481535 - RNA, 13 nt, Pseudomonas aeruginosa PA01
ccguagcacaugg

SEQ ID NO: 1481536 - RNA, 21 nt, Pseudomonas aeruginosa PA01
ccguacuggcgccaggccgcg

SEQ ID NO: 1481537 - RNA, 18 nt, Pseudomonas aeruginosa PA01
ccguagaccaccagcagc

SEQ ID NO: 1481538 - RNA, 19 nt, Pseudomonas aeruginosa PA01
ccguagcgcaguucgccgc

SEQ ID NO: 1481539 - RNA, 21 nt, Pseudomonas aeruginosa PA01
ccguagcgcaguucgccgccg

SEQ ID NO: 1481540 - RNA, 22 nt, Pseudomonas aeruginosa PA01
ccguagcgcaguucgccgccga

SEQ ID NO: 1481541 - RNA, 13 nt, Pseudomonas aeruginosa PA01
ccguagggcgaac

SEQ ID NO: 1481542 - RNA, 23 nt, Pseudomonas aeruginosa PA01
ccguagggcgaacaaccgcucgc

SEQ ID NO: 1481543 - RNA, 21 nt, Pseudomonas aeruginosa PA01
ccguagggcgaacaacgccgc

SEQ ID NO: 1481544 - RNA, 21 nt, Pseudomonas aeruginosa PA01
ccguagggcgaauaacgccac

SEQ ID NO: 1481545 - RNA, 14 nt, Pseudomonas aeruginosa PA01
ccguagggcgacgc

SEQ ID NO: 1481546 - RNA, 12 nt, Pseudomonas aeruginosa PA01
ccguagcggcug

SEQ ID NO: 1481547 - RNA, 18 nt, Pseudomonas aeruginosa PA01
ccguaggugaccgcccag

SEQ ID NO: 1481548 - RNA, 18 nt, Pseudomonas aeruginosa PA01
ccguaguucgaaccgugg

SEQ ID NO: 1481549 - RNA, 22 nt, Pseudomonas aeruginosa PA01
ccguaguggcguuccaggcggc

SEQ ID NO: 1481550 - RNA, 19 nt, Pseudomonas aeruginosa PA01
ccguagugguugcgcacgc

SEQ ID NO: 1481551 - RNA, 18 nt, Pseudomonas aeruginosa PA01
ccggucuugccggcugcg

SEQ ID NO: 1481552 - RNA, 16 nt, Pseudomonas aeruginosa PA01
ccggugaaccugacca

SEQ ID NO: 1481553 - RNA, 15 nt, Pseudomonas aeruginosa PA01
ccggugccccgcugg

SEQ ID NO: 1481554 - RNA, 14 nt, Pseudomonas aeruginosa PA01
ccggugccgccggc

SEQ ID NO: 1481555 - RNA, 17 nt, Pseudomonas aeruginosa PA01
ccggugccgccggccac

SEQ ID NO: 1481556 - RNA, 20 nt, Pseudomonas aeruginosa PA01
ccggugacauucgacagcag

SEQ ID NO: 1481557 - RNA, 21 nt, Pseudomonas aeruginosa PA01
ccggugacauucgacagcagg

SEQ ID NO: 1481558 - RNA, 23 nt, Pseudomonas aeruginosa PA01
ccggugacccacuccggcaggcg

SEQ ID NO: 1481559 - RNA, 12 nt, Pseudomonas aeruginosa PA01
ccggucgggcac

SEQ ID NO: 1481560 - RNA, 16 nt, Pseudomonas aeruginosa PA01
ccggucuagcgccccg

SEQ ID NO: 1481561 - RNA, 21 nt, Pseudomonas aeruginosa PA01
ccggucuagcgccccggccgc

SEQ ID NO: 1481562 - RNA, 22 nt, Pseudomonas aeruginosa PA01
ccggucuagcgccccggccgcg

SEQ ID NO: 1481563 - RNA, 16 nt, Pseudomonas aeruginosa PA01
ccggucucagccggcg

SEQ ID NO: 1481564 - RNA, 15 nt, Pseudomonas aeruginosa PA01
ccggucucgcgcagc

SEQ ID NO: 1481565 - RNA, 19 nt, Pseudomonas aeruginosa PA01
ccggucucgcgcagcggcg

SEQ ID NO: 1481566 - RNA, 20 nt, Pseudomonas aeruginosa PA01
ccggucgggaugccgugccg

SEQ ID NO: 1481567 - RNA, 21 nt, Pseudomonas aeruginosa PA01
ccggugccuucggcggcgccu

SEQ ID NO: 1481568 - RNA, 20 nt, Pseudomonas aeruginosa PA01
ccggugcggguggucgccgc

SEQ ID NO: 1481569 - RNA, 20 nt, Pseudomonas aeruginosa PA01
ccggugcggucguugaucac

SEQ ID NO: 1481570 - RNA, 19 nt, Pseudomonas aeruginosa PA01
ccgguggaauaccgcugcg

SEQ ID NO: 1481571 - RNA, 15 nt, Pseudomonas aeruginosa PA01
ccggugcuggcgagc

SEQ ID NO: 1481572 - RNA, 17 nt, Pseudomonas aeruginosa PA01
ccggugggcuuucccug

SEQ ID NO: 1481573 - RNA, 21 nt, Pseudomonas aeruginosa PA01
ccggugggacugagccgcugg

SEQ ID NO: 1481574 - RNA, 18 nt, Pseudomonas aeruginosa PA01
ccgguggcguuauucgcc

SEQ ID NO: 1481575 - RNA, 20 nt, Pseudomonas aeruginosa PA01
ccgguggcguuauucgcccu

SEQ ID NO: 1481576 - RNA, 16 nt, Pseudomonas aeruginosa PA01
ccgguuacucgccggc

SEQ ID NO: 1481577 - RNA, 17 nt, Pseudomonas aeruginosa PA01
ccgguuacucgccggca

SEQ ID NO: 1481578 - RNA, 17 nt, Pseudomonas aeruginosa PA01
ccggucgcaccgccagc

SEQ ID NO: 1481579 - RNA, 13 nt, Pseudomonas aeruginosa PA01
ccggucgcgcagc

SEQ ID NO: 1481580 - RNA, 14 nt, Pseudomonas aeruginosa PA01
ccggucgcgcagca

SEQ ID NO: 1481581 - RNA, 13 nt, Pseudomonas aeruginosa PA01
ccggucggccugu

SEQ ID NO: 1481582 - RNA, 12 nt, Pseudomonas aeruginosa PA01
ccggucggccuu

SEQ ID NO: 1481583 - RNA, 21 nt, Pseudomonas aeruginosa PA01
ccggucgcugaccagcccggc

SEQ ID NO: 1481584 - RNA, 21 nt, Pseudomonas aeruginosa PA01
ccggucgcuuuuuccgcugcc

SEQ ID NO: 1481585 - RNA, 18 nt, Pseudomonas aeruginosa PA01
ccggucgcgcucaggcgc

SEQ ID NO: 1481586 - RNA, 19 nt, Pseudomonas aeruginosa PA01
ccggucgcgcucaggcgca

SEQ ID NO: 1481587 - RNA, 12 nt, Pseudomonas aeruginosa PA01
ccggucgcgcug

SEQ ID NO: 1481588 - RNA, 20 nt, Pseudomonas aeruginosa PA01
ccgguccgacaaucagcggc

SEQ ID NO: 1481589 - RNA, 22 nt, Pseudomonas aeruginosa PA01
ccggucauggugccgagcagga

SEQ ID NO: 1481590 - RNA, 15 nt, Pseudomonas aeruginosa PA01
ccgguccugcaacug

SEQ ID NO: 1481591 - RNA, 16 nt, Pseudomonas aeruginosa PA01
ccgguccguccagcgc

SEQ ID NO: 1481592 - RNA, 17 nt, Pseudomonas aeruginosa PA01
ccgguccguccagcgcg

SEQ ID NO: 1481593 - RNA, 13 nt, Pseudomonas aeruginosa PA01
ccgguccucgaca

SEQ ID NO: 1481594 - RNA, 14 nt, Pseudomonas aeruginosa PA01
ccgguccucgcccg

SEQ ID NO: 1481595 - RNA, 15 nt, Pseudomonas aeruginosa PA01
ccgguccucgcccgu

SEQ ID NO: 1481596 - RNA, 16 nt, Pseudomonas aeruginosa PA01
ccgguccucgcccguc

SEQ ID NO: 1481597 - RNA, 14 nt, Pseudomonas aeruginosa PA01
ccggucgaaccccu

SEQ ID NO: 1481598 - RNA, 13 nt, Pseudomonas aeruginosa PA01
ccggucgacggcg

SEQ ID NO: 1481599 - RNA, 19 nt, Pseudomonas aeruginosa PA01
ccggucgagguugcgcggc

SEQ ID NO: 1481600 - RNA, 20 nt, Pseudomonas aeruginosa PA01
ccggucgagguugcgcggca

SEQ ID NO: 1481601 - RNA, 17 nt, Pseudomonas aeruginosa PA01
ccggucaggcgcccggu

SEQ ID NO: 1481602 - RNA, 12 nt, Pseudomonas aeruginosa PA01
ccggucaggcug

SEQ ID NO: 1481603 - RNA, 23 nt, Pseudomonas aeruginosa PA01
ccggucagguaggcaucgacgcc

SEQ ID NO: 1481604 - RNA, 13 nt, Pseudomonas aeruginosa PA01
ccggucaggccga

SEQ ID NO: 1481605 - RNA, 23 nt, Pseudomonas aeruginosa PA01
ccggucaggcaaucucccccucu

SEQ ID NO: 1481606 - RNA, 22 nt, Pseudomonas aeruginosa PA01
ccggucagcuucgccgcccugg

SEQ ID NO: 1481607 - RNA, 20 nt, Pseudomonas aeruginosa PA01
ccggucccagguagcgcugc

SEQ ID NO: 1481608 - RNA, 23 nt, Pseudomonas aeruginosa PA01
ccgguacccguacgcugccaggu

SEQ ID NO: 1481609 - RNA, 23 nt, Pseudomonas aeruginosa PA01
ccgguagggcgaauagcgccgca

SEQ ID NO: 1481610 - RNA, 13 nt, Pseudomonas aeruginosa PA01
ccgguaugccgau

SEQ ID NO: 1481611 - RNA, 21 nt, Pseudomonas aeruginosa PA01
ccgguaguucgcugaccgcga

SEQ ID NO: 1481612 - RNA, 19 nt, Pseudomonas aeruginosa PA01
ccgguauucagccagagcc

SEQ ID NO: 1481613 - RNA, 19 nt, Pseudomonas aeruginosa PA01
ccggucaccacccagccgc

SEQ ID NO: 1481614 - RNA, 22 nt, Pseudomonas aeruginosa PA01
ccggucaccacccagccgcggc

SEQ ID NO: 1481615 - RNA, 18 nt, Pseudomonas aeruginosa PA01
ccggucacgccgggaauc

SEQ ID NO: 1481616 - RNA, 22 nt, Pseudomonas aeruginosa PA01
ccgggcuccggguugucgucgu

SEQ ID NO: 1481617 - RNA, 23 nt, Pseudomonas aeruginosa PA01
ccgggcguuuucguugccgcgcu

SEQ ID NO: 1481618 - RNA, 22 nt, Pseudomonas aeruginosa PA01
ccgggcguuuucguuggcgcga

SEQ ID NO: 1481619 - RNA, 14 nt, Pseudomonas aeruginosa PA01
ccgggcucagcgcg

SEQ ID NO: 1481620 - RNA, 15 nt, Pseudomonas aeruginosa PA01
ccgggcucagcgcgc

SEQ ID NO: 1481621 - RNA, 17 nt, Pseudomonas aeruginosa PA01
ccgggcucagcgcgcgu

SEQ ID NO: 1481622 - RNA, 15 nt, Pseudomonas aeruginosa PA01
ccgggcucacucccg

SEQ ID NO: 1481623 - RNA, 15 nt, Pseudomonas aeruginosa PA01
ccgggucgcgcagcg

SEQ ID NO: 1481624 - RNA, 16 nt, Pseudomonas aeruginosa PA01
ccgggucgcgcagcgg

SEQ ID NO: 1481625 - RNA, 13 nt, Pseudomonas aeruginosa PA01
ccgggucggaugc

SEQ ID NO: 1481626 - RNA, 20 nt, Pseudomonas aeruginosa PA01
ccgggucgcugcccaucgcc

SEQ ID NO: 1481627 - RNA, 14 nt, Pseudomonas aeruginosa PA01
ccgggucgcugcuc

SEQ ID NO: 1481628 - RNA, 22 nt, Pseudomonas aeruginosa PA01
ccgggucgcugcucagggccgc

SEQ ID NO: 1481629 - RNA, 14 nt, Pseudomonas aeruginosa PA01
ccgggucgucgguc

SEQ ID NO: 1481630 - RNA, 15 nt, Pseudomonas aeruginosa PA01
ccgggucggucacga

SEQ ID NO: 1481631 - RNA, 21 nt, Pseudomonas aeruginosa PA01
ccggguggagaggcgugcugg

SEQ ID NO: 1481632 - RNA, 18 nt, Pseudomonas aeruginosa PA01
ccggguugacccagagcc

SEQ ID NO: 1481633 - RNA, 22 nt, Pseudomonas aeruginosa PA01
ccggguugaccgccagacaggc

SEQ ID NO: 1481634 - RNA, 15 nt, Pseudomonas aeruginosa PA01
ccggguucugcucga

SEQ ID NO: 1481635 - RNA, 23 nt, Pseudomonas aeruginosa PA01
ccggguucugcucgaacaucagc

SEQ ID NO: 1481636 - RNA, 21 nt, Pseudomonas aeruginosa PA01
ccggguugguggccgcgccgc

SEQ ID NO: 1481637 - RNA, 20 nt, Pseudomonas aeruginosa PA01
ccggguuguccaggcgaugg

SEQ ID NO: 1481638 - RNA, 15 nt, Pseudomonas aeruginosa PA01
ccggguugccgcugg

SEQ ID NO: 1481639 - RNA, 16 nt, Pseudomonas aeruginosa PA01
ccggguugccguagcg

SEQ ID NO: 1481640 - RNA, 19 nt, Pseudomonas aeruginosa PA01
ccggguugcgccgcaagug

SEQ ID NO: 1481641 - RNA, 23 nt, Pseudomonas aeruginosa PA01
ccggguuuccgugugcagcaggg

SEQ ID NO: 1481642 - RNA, 17 nt, Pseudomonas aeruginosa PA01
ccggguuucgucgguca

SEQ ID NO: 1481643 - RNA, 21 nt, Pseudomonas aeruginosa PA01
ccgguacagcgccuggucggc

SEQ ID NO: 1481644 - RNA, 22 nt, Pseudomonas aeruginosa PA01
ccgguacagcgccuggucggcg

SEQ ID NO: 1481645 - RNA, 22 nt, Pseudomonas aeruginosa PA01
ccgguacagcuguccgcgccgc

SEQ ID NO: 1481646 - RNA, 20 nt, Pseudomonas aeruginosa PA01
ccgguaaugaaaagccccgc

SEQ ID NO: 1481647 - RNA, 18 nt, Pseudomonas aeruginosa PA01
ccgguagacgccucccac

SEQ ID NO: 1481648 - RNA, 18 nt, Pseudomonas aeruginosa PA01
ccgguacucgccgggcgu

SEQ ID NO: 1481649 - RNA, 15 nt, Pseudomonas aeruginosa PA01
ccgguacgcucacca

SEQ ID NO: 1481650 - RNA, 13 nt, Pseudomonas aeruginosa PA01
ccgguacagccaa

SEQ ID NO: 1481651 - RNA, 21 nt, Pseudomonas aeruginosa PA01
ccgguagccguucgacgcugc

SEQ ID NO: 1481652 - RNA, 17 nt, Pseudomonas aeruginosa PA01
ccgguagcggcgcaccg

SEQ ID NO: 1481653 - RNA, 15 nt, Pseudomonas aeruginosa PA01
ccgguaggagcgaga

SEQ ID NO: 1481654 - RNA, 24 nt, Pseudomonas aeruginosa PA01
ccgguaggagcgagagcgcugccg

SEQ ID NO: 1481655 - RNA, 14 nt, Pseudomonas aeruginosa PA01
ccgggauacagcag

SEQ ID NO: 1481656 - RNA, 20 nt, Pseudomonas aeruginosa PA01
ccgggauacagcagccaagg

SEQ ID NO: 1481657 - RNA, 19 nt, Pseudomonas aeruginosa PA01
ccgggaccacgcucagguc

SEQ ID NO: 1481658 - RNA, 21 nt, Pseudomonas aeruginosa PA01
ccgggaccacgcucaggucgg

SEQ ID NO: 1481659 - RNA, 22 nt, Pseudomonas aeruginosa PA01
ccgggaucaccucgaaccccug

SEQ ID NO: 1481660 - RNA, 15 nt, Pseudomonas aeruginosa PA01
ccgggaucagcggcg

SEQ ID NO: 1481661 - RNA, 16 nt, Pseudomonas aeruginosa PA01
ccgggaucagcggcgg

SEQ ID NO: 1481662 - RNA, 11 nt, Pseudomonas aeruginosa PA01
ccgggaagucc

SEQ ID NO: 1481663 - RNA, 17 nt, Pseudomonas aeruginosa PA01
ccgggaaguccgggcgc

SEQ ID NO: 1481664 - RNA, 19 nt, Pseudomonas aeruginosa PA01
ccgggaagucguucccggc

SEQ ID NO: 1481665 - RNA, 19 nt, Pseudomonas aeruginosa PA01
ccgggaauccccaguagcg

SEQ ID NO: 1481666 - RNA, 18 nt, Pseudomonas aeruginosa PA01
ccgggaaugcucagcacg

SEQ ID NO: 1481667 - RNA, 19 nt, Pseudomonas aeruginosa PA01
ccgggaaugcucagcacgg

SEQ ID NO: 1481668 - RNA, 23 nt, Pseudomonas aeruginosa PA01
ccgggaaugcucagcacggcgac

SEQ ID NO: 1481669 - RNA, 22 nt, Pseudomonas aeruginosa PA01
ccgggaagcaccgacucgcccu

SEQ ID NO: 1481670 - RNA, 17 nt, Pseudomonas aeruginosa PA01
ccgggaagccgcucggc

SEQ ID NO: 1481671 - RNA, 18 nt, Pseudomonas aeruginosa PA01
ccgggaagccgcucggcg

SEQ ID NO: 1481672 - RNA, 17 nt, Pseudomonas aeruginosa PA01
ccgggaagcgcaggccg

SEQ ID NO: 1481673 - RNA, 23 nt, Pseudomonas aeruginosa PA01
ccgggaagcgcaggccgccggcg

SEQ ID NO: 1481674 - RNA, 14 nt, Pseudomonas aeruginosa PA01
ccgggaaggccuga

SEQ ID NO: 1481675 - RNA, 23 nt, Pseudomonas aeruginosa PA01
ccgggaaggccugacgcaagcgc

SEQ ID NO: 1481676 - RNA, 16 nt, Pseudomonas aeruginosa PA01
ccggcugacgcuggcg

SEQ ID NO: 1481677 - RNA, 20 nt, Pseudomonas aeruginosa PA01
ccggcugacgcuggcgaagg

SEQ ID NO: 1481678 - RNA, 21 nt, Pseudomonas aeruginosa PA01
ccggcugacgcuggcgaaggc

SEQ ID NO: 1481679 - RNA, 14 nt, Pseudomonas aeruginosa PA01
ccggcuggccaucc

SEQ ID NO: 1481680 - RNA, 23 nt, Pseudomonas aeruginosa PA01
ccggcuggccauccauaucggcc

SEQ ID NO: 1481681 - RNA, 19 nt, Pseudomonas aeruginosa PA01
ccggcuggcggcucggcug

SEQ ID NO: 1481682 - RNA, 14 nt, Pseudomonas aeruginosa PA01
ccggcuggcccucc

SEQ ID NO: 1481683 - RNA, 19 nt, Pseudomonas aeruginosa PA01
ccggcuggguucggcgagg

SEQ ID NO: 1481684 - RNA, 12 nt, Pseudomonas aeruginosa PA01
ccggcuggcgcc

SEQ ID NO: 1481685 - RNA, 14 nt, Pseudomonas aeruginosa PA01
ccggcuggcgccgg

SEQ ID NO: 1481686 - RNA, 16 nt, Pseudomonas aeruginosa PA01
ccggcuggcgccggug

SEQ ID NO: 1481687 - RNA, 12 nt, Pseudomonas aeruginosa PA01
ccggcuggccgc

SEQ ID NO: 1481688 - RNA, 17 nt, Pseudomonas aeruginosa PA01
ccggcugugcagggcag

SEQ ID NO: 1481689 - RNA, 22 nt, Pseudomonas aeruginosa PA01
ccggcugugcucgacgggcgcu

SEQ ID NO: 1481690 - RNA, 14 nt, Pseudomonas aeruginosa PA01
ccggcugguugcca

SEQ ID NO: 1481691 - RNA, 20 nt, Pseudomonas aeruginosa PA01
ccggcugguugccagcagcg

SEQ ID NO: 1481692 - RNA, 14 nt, Pseudomonas aeruginosa PA01
ccggcugucgacgc

SEQ ID NO: 1481693 - RNA, 17 nt, Pseudomonas aeruginosa PA01
ccggcugucgacgcagc

SEQ ID NO: 1481694 - RNA, 19 nt, Pseudomonas aeruginosa PA01
ccggcucuccccgcucccg

SEQ ID NO: 1481695 - RNA, 16 nt, Pseudomonas aeruginosa PA01
ccggcucgugcgacuc

SEQ ID NO: 1481696 - RNA, 16 nt, Pseudomonas aeruginosa PA01
ccggcucguucauguc

SEQ ID NO: 1481697 - RNA, 17 nt, Pseudomonas aeruginosa PA01
ccggcucgguuuccacc

SEQ ID NO: 1481698 - RNA, 19 nt, Pseudomonas aeruginosa PA01
ccggcucgguuuccaccug

SEQ ID NO: 1481699 - RNA, 13 nt, Pseudomonas aeruginosa PA01
ccggcucgucggc

SEQ ID NO: 1481700 - RNA, 15 nt, Pseudomonas aeruginosa PA01
ccggcucgucggcgu

SEQ ID NO: 1481701 - RNA, 15 nt, Pseudomonas aeruginosa PA01
ccggcucauggccgg

SEQ ID NO: 1481702 - RNA, 14 nt, Pseudomonas aeruginosa PA01
ccggcuccagggcg

SEQ ID NO: 1481703 - RNA, 16 nt, Pseudomonas aeruginosa PA01
ccggcuccagggcgaa

SEQ ID NO: 1481704 - RNA, 22 nt, Pseudomonas aeruginosa PA01
ccggcuccccuggaaugccggc

SEQ ID NO: 1481705 - RNA, 17 nt, Pseudomonas aeruginosa PA01
ccggcuccaguugcagc

SEQ ID NO: 1481706 - RNA, 22 nt, Pseudomonas aeruginosa PA01
ccggcuccaguugcagcacccc

SEQ ID NO: 1481707 - RNA, 20 nt, Pseudomonas aeruginosa PA01
ccggcgucucauggaacagc

SEQ ID NO: 1481708 - RNA, 21 nt, Pseudomonas aeruginosa PA01
ccggcgucucauggaacagca

SEQ ID NO: 1481709 - RNA, 22 nt, Pseudomonas aeruginosa PA01
ccggcgucucauggaacagcag

SEQ ID NO: 1481710 - RNA, 12 nt, Pseudomonas aeruginosa PA01
ccggcgucgucc

SEQ ID NO: 1481711 - RNA, 21 nt, Pseudomonas aeruginosa PA01
ccggcgucguccugcgcggcg

SEQ ID NO: 1481712 - RNA, 21 nt, Pseudomonas aeruginosa PA01
ccggcgucggcgcgggcgccg

SEQ ID NO: 1481713 - RNA, 15 nt, Pseudomonas aeruginosa PA01
ccggcgucggcgagc

SEQ ID NO: 1481714 - RNA, 20 nt, Pseudomonas aeruginosa PA01
ccggcgucggcgagcaggcg

SEQ ID NO: 1481715 - RNA, 13 nt, Pseudomonas aeruginosa PA01
ccggcgugaacgc

SEQ ID NO: 1481716 - RNA, 21 nt, Pseudomonas aeruginosa PA01
ccggcucaacugguuggccgc

SEQ ID NO: 1481717 - RNA, 22 nt, Pseudomonas aeruginosa PA01
ccggcucaacugguuggccgcc

SEQ ID NO: 1481718 - RNA, 23 nt, Pseudomonas aeruginosa PA01
ccggcgugagcagggccgagcgc

SEQ ID NO: 1481719 - RNA, 14 nt, Pseudomonas aeruginosa PA01
ccgggccgggggcg

SEQ ID NO: 1481720 - RNA, 23 nt, Pseudomonas aeruginosa PA01
ccgggccgggggcggcgccuggu

SEQ ID NO: 1481721 - RNA, 12 nt, Pseudomonas aeruginosa PA01
ccgggccgcgca

SEQ ID NO: 1481722 - RNA, 23 nt, Pseudomonas aeruginosa PA01
ccgggccgcgcacaaaaaagccc

SEQ ID NO: 1481723 - RNA, 13 nt, Pseudomonas aeruginosa PA01
ccgggccucggca

SEQ ID NO: 1481724 - RNA, 15 nt, Pseudomonas aeruginosa PA01
ccgggcgccggguca

SEQ ID NO: 1481725 - RNA, 13 nt, Pseudomonas aeruginosa PA01
ccgggcgccucgu

SEQ ID NO: 1481726 - RNA, 21 nt, Pseudomonas aeruginosa PA01
ccgggcgcgcgccucagcggc

SEQ ID NO: 1481727 - RNA, 18 nt, Pseudomonas aeruginosa PA01
ccgggcggaggcgagguc

SEQ ID NO: 1481728 - RNA, 22 nt, Pseudomonas aeruginosa PA01
ccgggcggaggcgaggucgccg

SEQ ID NO: 1481729 - RNA, 12 nt, Pseudomonas aeruginosa PA01
ccgggcgcgcug

SEQ ID NO: 1481730 - RNA, 22 nt, Pseudomonas aeruginosa PA01
ccgggcgcggcuggugcgaaaa

SEQ ID NO: 1481731 - RNA, 13 nt, Pseudomonas aeruginosa PA01
ccgggcgugucga

SEQ ID NO: 1481732 - RNA, 13 nt, Pseudomonas aeruginosa PA01
ccgggcguaacgg

SEQ ID NO: 1481733 - RNA, 22 nt, Pseudomonas aeruginosa PA01
ccgggcguaacggcucgccggg

SEQ ID NO: 1481734 - RNA, 14 nt, Pseudomonas aeruginosa PA01
ccgggcggcaggcg

SEQ ID NO: 1481735 - RNA, 16 nt, Pseudomonas aeruginosa PA01
ccgggcggcaggcgcc

SEQ ID NO: 1481736 - RNA, 17 nt, Pseudomonas aeruginosa PA01
ccgggcggcaggcgccg

SEQ ID NO: 1481737 - RNA, 19 nt, Pseudomonas aeruginosa PA01
ccgggcggcaggcgccggc

SEQ ID NO: 1481738 - RNA, 20 nt, Pseudomonas aeruginosa PA01
ccgggcggcaggcgccggcc

SEQ ID NO: 1481739 - RNA, 21 nt, Pseudomonas aeruginosa PA01
ccgggcggcaggcgccggccg

SEQ ID NO: 1481740 - RNA, 14 nt, Pseudomonas aeruginosa PA01
ccgggcagcggcgc

SEQ ID NO: 1481741 - RNA, 15 nt, Pseudomonas aeruginosa PA01
ccgggcagcggcgca

SEQ ID NO: 1481742 - RNA, 15 nt, Pseudomonas aeruginosa PA01
ccgggcaucgccgac

SEQ ID NO: 1481743 - RNA, 16 nt, Pseudomonas aeruginosa PA01
ccgggcaucgccgacc

SEQ ID NO: 1481744 - RNA, 15 nt, Pseudomonas aeruginosa PA01
ccgggcagugcgccc

SEQ ID NO: 1481745 - RNA, 16 nt, Pseudomonas aeruginosa PA01
ccgggcaucaugccga

SEQ ID NO: 1481746 - RNA, 16 nt, Pseudomonas aeruginosa PA01
ccgggccaucgcggaa

SEQ ID NO: 1481747 - RNA, 15 nt, Pseudomonas aeruginosa PA01
ccgggcauuuccucg

SEQ ID NO: 1481748 - RNA, 19 nt, Pseudomonas aeruginosa PA01
ccgggcacggaaucggacg

SEQ ID NO: 1481749 - RNA, 20 nt, Pseudomonas aeruginosa PA01
ccgggcacggaaucggacga

SEQ ID NO: 1481750 - RNA, 20 nt, Pseudomonas aeruginosa PA01
ccgggcacgcauagcgcgcu

SEQ ID NO: 1481751 - RNA, 22 nt, Pseudomonas aeruginosa PA01
ccgggcacgcauagcgcgcugu

SEQ ID NO: 1481752 - RNA, 14 nt, Pseudomonas aeruginosa PA01
ccgggcagaccagc

SEQ ID NO: 1481753 - RNA, 15 nt, Pseudomonas aeruginosa PA01
ccgggcagcagccgg

SEQ ID NO: 1481754 - RNA, 16 nt, Pseudomonas aeruginosa PA01
ccgggcagcagccgga

SEQ ID NO: 1481755 - RNA, 20 nt, Pseudomonas aeruginosa PA01
ccgggcaccccgagcggcgc

SEQ ID NO: 1481756 - RNA, 22 nt, Pseudomonas aeruginosa PA01
ccgggcaccccgagcggcgcga

SEQ ID NO: 1481757 - RNA, 16 nt, Pseudomonas aeruginosa PA01
ccgggaugaacccggc

SEQ ID NO: 1481758 - RNA, 16 nt, Pseudomonas aeruginosa PA01
ccgggaucuccucgac

SEQ ID NO: 1481759 - RNA, 20 nt, Pseudomonas aeruginosa PA01
ccgggaucuccucgacggcg

SEQ ID NO: 1481760 - RNA, 21 nt, Pseudomonas aeruginosa PA01
ccgggaucuggcccugcaaca

SEQ ID NO: 1481761 - RNA, 16 nt, Pseudomonas aeruginosa PA01
ccgggaugccggugcu

SEQ ID NO: 1481762 - RNA, 15 nt, Pseudomonas aeruginosa PA01
ccggccagccgcgcc

SEQ ID NO: 1481763 - RNA, 19 nt, Pseudomonas aeruginosa PA01
ccggccagcgcaucgaggc

SEQ ID NO: 1481764 - RNA, 14 nt, Pseudomonas aeruginosa PA01
ccggccagccuggc

SEQ ID NO: 1481765 - RNA, 16 nt, Pseudomonas aeruginosa PA01
ccggccagccuggcca

SEQ ID NO: 1481766 - RNA, 19 nt, Pseudomonas aeruginosa PA01
ccggccagccuucccggcg

SEQ ID NO: 1481767 - RNA, 15 nt, Pseudomonas aeruginosa PA01
ccggccagcgcggcg

SEQ ID NO: 1481768 - RNA, 13 nt, Pseudomonas aeruginosa PA01
ccggccaggaagg

SEQ ID NO: 1481769 - RNA, 20 nt, Pseudomonas aeruginosa PA01
ccggcgcccacaaccugccg

SEQ ID NO: 1481770 - RNA, 21 nt, Pseudomonas aeruginosa PA01
ccggcgcccagaaaaaagccc

SEQ ID NO: 1481771 - RNA, 22 nt, Pseudomonas aeruginosa PA01
ccggcgccaggcccucggcgac

SEQ ID NO: 1481772 - RNA, 15 nt, Pseudomonas aeruginosa PA01
ccggcgccaggccgg

SEQ ID NO: 1481773 - RNA, 19 nt, Pseudomonas aeruginosa PA01
ccggcgccaggccggagcc

SEQ ID NO: 1481774 - RNA, 18 nt, Pseudomonas aeruginosa PA01
ccggcgccaggcugaccg

SEQ ID NO: 1481775 - RNA, 16 nt, Pseudomonas aeruginosa PA01
ccggcgccaguucgcc

SEQ ID NO: 1481776 - RNA, 22 nt, Pseudomonas aeruginosa PA01
ccggcgccaucgaucagcagcg

SEQ ID NO: 1481777 - RNA, 15 nt, Pseudomonas aeruginosa PA01
ccggcgccccugcgg

SEQ ID NO: 1481778 - RNA, 17 nt, Pseudomonas aeruginosa PA01
ccggcgccccugcggcg

SEQ ID NO: 1481779 - RNA, 20 nt, Pseudomonas aeruginosa PA01
ccggcgccccugcggcgccg

SEQ ID NO: 1481780 - RNA, 21 nt, Pseudomonas aeruginosa PA01
ccggcgccgccggggaucagc

SEQ ID NO: 1481781 - RNA, 13 nt, Pseudomonas aeruginosa PA01
ccggcgcccggcg

SEQ ID NO: 1481782 - RNA, 18 nt, Pseudomonas aeruginosa PA01
ccggcgcccggcgcaugc

SEQ ID NO: 1481783 - RNA, 15 nt, Pseudomonas aeruginosa PA01
ccggcgccagcaggc

SEQ ID NO: 1481784 - RNA, 19 nt, Pseudomonas aeruginosa PA01
ccggcgccgccuggccggu

SEQ ID NO: 1481785 - RNA, 13 nt, Pseudomonas aeruginosa PA01
ccggcgccgggcu

SEQ ID NO: 1481786 - RNA, 19 nt, Pseudomonas aeruginosa PA01
ccggcgccuucaucgccac

SEQ ID NO: 1481787 - RNA, 20 nt, Pseudomonas aeruginosa PA01
ccggcgccuugcgccaggcc

SEQ ID NO: 1481788 - RNA, 17 nt, Pseudomonas aeruginosa PA01
ccggcgcgauccuggcg

SEQ ID NO: 1481789 - RNA, 19 nt, Pseudomonas aeruginosa PA01
ccggcgcgauccuggcggc

SEQ ID NO: 1481790 - RNA, 14 nt, Pseudomonas aeruginosa PA01
ccggcgcgaccguc

SEQ ID NO: 1481791 - RNA, 17 nt, Pseudomonas aeruginosa PA01
ccggcgcgaccgucggc

SEQ ID NO: 1481792 - RNA, 20 nt, Pseudomonas aeruginosa PA01
ccggcgcgaccgucggccgg

SEQ ID NO: 1481793 - RNA, 17 nt, Pseudomonas aeruginosa PA01
ccggcgcgacgcuccag

SEQ ID NO: 1481794 - RNA, 18 nt, Pseudomonas aeruginosa PA01
ccggcgcgcacggaggcg

SEQ ID NO: 1481795 - RNA, 21 nt, Pseudomonas aeruginosa PA01
ccggcgcgcacggaggcgcuc

SEQ ID NO: 1481796 - RNA, 17 nt, Pseudomonas aeruginosa PA01
ccggcgcgcagggugag

SEQ ID NO: 1481797 - RNA, 21 nt, Pseudomonas aeruginosa PA01
ccggcgcgccccugcgcccag

SEQ ID NO: 1481798 - RNA, 14 nt, Pseudomonas aeruginosa PA01
ccggcgcgcacggu

SEQ ID NO: 1481799 - RNA, 15 nt, Pseudomonas aeruginosa PA01
ccggcgcgcacgguc

SEQ ID NO: 1481800 - RNA, 13 nt, Pseudomonas aeruginosa PA01
ccggcgcgcccag

SEQ ID NO: 1481801 - RNA, 16 nt, Pseudomonas aeruginosa PA01
ccggcgcgcccaggcc

SEQ ID NO: 1481802 - RNA, 18 nt, Pseudomonas aeruginosa PA01
ccggcgcgcccaggccca

SEQ ID NO: 1481803 - RNA, 20 nt, Pseudomonas aeruginosa PA01
ccggcgcgccggacaggcca

SEQ ID NO: 1481804 - RNA, 23 nt, Pseudomonas aeruginosa PA01
ccggcgcgcuuccuccaguagcg

SEQ ID NO: 1481805 - RNA, 16 nt, Pseudomonas aeruginosa PA01
ccggcgcgcuugccgc

SEQ ID NO: 1481806 - RNA, 13 nt, Pseudomonas aeruginosa PA01
ccggcgcgcggcg

SEQ ID NO: 1481807 - RNA, 15 nt, Pseudomonas aeruginosa PA01
ccggcgcgcggcggg

SEQ ID NO: 1481808 - RNA, 17 nt, Pseudomonas aeruginosa PA01
ccggcgcggccgaacuc

SEQ ID NO: 1481809 - RNA, 18 nt, Pseudomonas aeruginosa PA01
ccggcgcggaagcgccug

SEQ ID NO: 1481810 - RNA, 18 nt, Pseudomonas aeruginosa PA01
ccggcgcggacgaugguc

SEQ ID NO: 1481811 - RNA, 14 nt, Pseudomonas aeruginosa PA01
ccggcgcggccugc

SEQ ID NO: 1481812 - RNA, 16 nt, Pseudomonas aeruginosa PA01
ccggcgcggcgcagcc

SEQ ID NO: 1481813 - RNA, 21 nt, Pseudomonas aeruginosa PA01
ccggcgcggcgcagcggcgaa

SEQ ID NO: 1481814 - RNA, 13 nt, Pseudomonas aeruginosa PA01
ccggcgcggcggc

SEQ ID NO: 1481815 - RNA, 14 nt, Pseudomonas aeruginosa PA01
ccggcgcggcggcc

SEQ ID NO: 1481816 - RNA, 18 nt, Pseudomonas aeruginosa PA01
ccggcgcguuggcuggcg

SEQ ID NO: 1481817 - RNA, 18 nt, Pseudomonas aeruginosa PA01
ccggcgcuacgccaaucc

SEQ ID NO: 1481818 - RNA, 18 nt, Pseudomonas aeruginosa PA01
ccggcgcuccaacagcag

SEQ ID NO: 1481819 - RNA, 20 nt, Pseudomonas aeruginosa PA01
ccggcgcuccaacagcaggu

SEQ ID NO: 1481820 - RNA, 22 nt, Pseudomonas aeruginosa PA01
ccggcgcucgcugucaaucgcg

SEQ ID NO: 1481821 - RNA, 14 nt, Pseudomonas aeruginosa PA01
ccggcgcucggcca

SEQ ID NO: 1481822 - RNA, 16 nt, Pseudomonas aeruginosa PA01
ccggcgcucggccagg

SEQ ID NO: 1481823 - RNA, 22 nt, Pseudomonas aeruginosa PA01
ccggcgcucggccaggucgcga

SEQ ID NO: 1481824 - RNA, 22 nt, Pseudomonas aeruginosa PA01
ccggcgcgguuucgcagcgcuc

SEQ ID NO: 1481825 - RNA, 21 nt, Pseudomonas aeruginosa PA01
ccggcgcguagaggaugccgg

SEQ ID NO: 1481826 - RNA, 17 nt, Pseudomonas aeruginosa PA01
ccggcgcggucucgcgu

SEQ ID NO: 1481827 - RNA, 21 nt, Pseudomonas aeruginosa PA01
ccggcgcgggcggccucgaug

SEQ ID NO: 1481828 - RNA, 17 nt, Pseudomonas aeruginosa PA01
ccggcgcgucgcugcgc

SEQ ID NO: 1481829 - RNA, 19 nt, Pseudomonas aeruginosa PA01
ccggcgcgucccugggcgc

SEQ ID NO: 1481830 - RNA, 22 nt, Pseudomonas aeruginosa PA01
ccggcgcgucccugggcgcagg

SEQ ID NO: 1481831 - RNA, 21 nt, Pseudomonas aeruginosa PA01
ccggcgcuccacagcugccag

SEQ ID NO: 1481832 - RNA, 13 nt, Pseudomonas aeruginosa PA01
ccggcgcugagcg

SEQ ID NO: 1481833 - RNA, 13 nt, Pseudomonas aeruginosa PA01
ccggcgcugccga

SEQ ID NO: 1481834 - RNA, 14 nt, Pseudomonas aeruginosa PA01
ccggcgcugccgaa

SEQ ID NO: 1481835 - RNA, 19 nt, Pseudomonas aeruginosa PA01
ccggcgcugccgaacagca

SEQ ID NO: 1481836 - RNA, 21 nt, Pseudomonas aeruginosa PA01
ccggcgcugccgaacagcagg

SEQ ID NO: 1481837 - RNA, 22 nt, Pseudomonas aeruginosa PA01
ccggcgcugccgaacagcaggg

SEQ ID NO: 1481838 - RNA, 14 nt, Pseudomonas aeruginosa PA01
ccggcgcugcuucu

SEQ ID NO: 1481839 - RNA, 20 nt, Pseudomonas aeruginosa PA01
ccggcgcugcuucuugucga

SEQ ID NO: 1481840 - RNA, 17 nt, Pseudomonas aeruginosa PA01
ccggcgcugucucgcca

SEQ ID NO: 1481841 - RNA, 19 nt, Pseudomonas aeruginosa PA01
ccggcgcuucgcgcaggac

SEQ ID NO: 1481842 - RNA, 22 nt, Pseudomonas aeruginosa PA01
ccggcgcuucgcgcaggacgag

SEQ ID NO: 1481843 - RNA, 17 nt, Pseudomonas aeruginosa PA01
ccggcgcuucugcgagc

SEQ ID NO: 1481844 - RNA, 19 nt, Pseudomonas aeruginosa PA01
ccggcgcuucugcgagccg

SEQ ID NO: 1481845 - RNA, 18 nt, Pseudomonas aeruginosa PA01
ccggcggacaaccaccau

SEQ ID NO: 1481846 - RNA, 13 nt, Pseudomonas aeruginosa PA01
ccggcggaucagc

SEQ ID NO: 1481847 - RNA, 14 nt, Pseudomonas aeruginosa PA01
ccggcggaucagcc

SEQ ID NO: 1481848 - RNA, 16 nt, Pseudomonas aeruginosa PA01
ccggcggaucagcccg

SEQ ID NO: 1481849 - RNA, 21 nt, Pseudomonas aeruginosa PA01
ccggcggauuacuccgccggc

SEQ ID NO: 1481850 - RNA, 23 nt, Pseudomonas aeruginosa PA01
ccggcggauuacuccgccggcgu

SEQ ID NO: 1481851 - RNA, 16 nt, Pseudomonas aeruginosa PA01
ccggcguaccuugagc

SEQ ID NO: 1481852 - RNA, 23 nt, Pseudomonas aeruginosa PA01
ccggcguacgaaccccgggccgc

SEQ ID NO: 1481853 - RNA, 17 nt, Pseudomonas aeruginosa PA01
ccggcgguuucgccgag

SEQ ID NO: 1481854 - RNA, 21 nt, Pseudomonas aeruginosa PA01
ccggcgguuucgccgaggccc

SEQ ID NO: 1481855 - RNA, 17 nt, Pseudomonas aeruginosa PA01
ccggcguacuucggcgc

SEQ ID NO: 1481856 - RNA, 19 nt, Pseudomonas aeruginosa PA01
ccggcguacuucggcgcgg

SEQ ID NO: 1481857 - RNA, 17 nt, Pseudomonas aeruginosa PA01
ccggcggguucagcccg

SEQ ID NO: 1481858 - RNA, 22 nt, Pseudomonas aeruginosa PA01
ccggcggcgaugaagcugaugc

SEQ ID NO: 1481859 - RNA, 17 nt, Pseudomonas aeruginosa PA01
ccggcggcgaugaucgg

SEQ ID NO: 1481860 - RNA, 19 nt, Pseudomonas aeruginosa PA01
ccggcggcgaugaucggca

SEQ ID NO: 1481861 - RNA, 18 nt, Pseudomonas aeruginosa PA01
ccggcggcgccaggccgg

SEQ ID NO: 1481862 - RNA, 21 nt, Pseudomonas aeruginosa PA01
ccggcggcgccaggccggcga

SEQ ID NO: 1481863 - RNA, 20 nt, Pseudomonas aeruginosa PA01
ccggcgggauguacgccagg

SEQ ID NO: 1481864 - RNA, 11 nt, Pseudomonas aeruginosa PA01
ccggcggcgau

SEQ ID NO: 1481865 - RNA, 14 nt, Pseudomonas aeruginosa PA01
ccggcggcgaacag

SEQ ID NO: 1481866 - RNA, 21 nt, Pseudomonas aeruginosa PA01
ccggcggccugccccgccggc

SEQ ID NO: 1481867 - RNA, 14 nt, Pseudomonas aeruginosa PA01
ccggcggcaugggc

SEQ ID NO: 1481868 - RNA, 21 nt, Pseudomonas aeruginosa PA01
ccggcggccugagccggccgg

SEQ ID NO: 1481869 - RNA, 19 nt, Pseudomonas aeruginosa PA01
ccucggaugccgcacaggc

SEQ ID NO: 1481870 - RNA, 23 nt, Pseudomonas aeruginosa PA01
ccucgcugcgggcguagcgcggc

SEQ ID NO: 1481871 - RNA, 19 nt, Pseudomonas aeruginosa PA01
ccucggagaacagcagcgg

SEQ ID NO: 1481872 - RNA, 20 nt, Pseudomonas aeruginosa PA01
ccucgcugccuaccgucacg

SEQ ID NO: 1481873 - RNA, 21 nt, Pseudomonas aeruginosa PA01
ccucgcugccuaccgucacgc

SEQ ID NO: 1481874 - RNA, 22 nt, Pseudomonas aeruginosa PA01
ccucgcugccuaccgucacgcg

SEQ ID NO: 1481875 - RNA, 21 nt, Pseudomonas aeruginosa PA01
ccucgcugaugugccgcacgg

SEQ ID NO: 1481876 - RNA, 19 nt, Pseudomonas aeruginosa PA01
ccucgcucgcuacagccgg

SEQ ID NO: 1481877 - RNA, 20 nt, Pseudomonas aeruginosa PA01
ccucgcucguuccgcggagu

SEQ ID NO: 1481878 - RNA, 18 nt, Pseudomonas aeruginosa PA01
ccucgcucugcgccgcgg

SEQ ID NO: 1481879 - RNA, 19 nt, Pseudomonas aeruginosa PA01
ccucgcucugcgccgcggc

SEQ ID NO: 1481880 - RNA, 22 nt, Pseudomonas aeruginosa PA01
ccucgacggcgaucucagccau

SEQ ID NO: 1481881 - RNA, 21 nt, Pseudomonas aeruginosa PA01
ccucgacggcgggagcggccu

SEQ ID NO: 1481882 - RNA, 22 nt, Pseudomonas aeruginosa PA01
ccucgacgcccgcuugcgccgc

SEQ ID NO: 1481883 - RNA, 14 nt, Pseudomonas aeruginosa PA01
ccucgacgccgagc

SEQ ID NO: 1481884 - RNA, 17 nt, Pseudomonas aeruginosa PA01
ccucgacgccgagccag

SEQ ID NO: 1481885 - RNA, 15 nt, Pseudomonas aeruginosa PA01
ccucgaccugguagc

SEQ ID NO: 1481886 - RNA, 18 nt, Pseudomonas aeruginosa PA01
ccucgaaggucagcccgu

SEQ ID NO: 1481887 - RNA, 17 nt, Pseudomonas aeruginosa PA01
ccucgaagcccagcgcc

SEQ ID NO: 1481888 - RNA, 19 nt, Pseudomonas aeruginosa PA01
ccucgaagaacuccaucuc

SEQ ID NO: 1481889 - RNA, 21 nt, Pseudomonas aeruginosa PA01
ccucgaagaaaaggcccggcg

SEQ ID NO: 1481890 - RNA, 15 nt, Pseudomonas aeruginosa PA01
ccucgaacggcguga

SEQ ID NO: 1481891 - RNA, 17 nt, Pseudomonas aeruginosa PA01
ccucgaacggcgugagg

SEQ ID NO: 1481892 - RNA, 16 nt, Pseudomonas aeruginosa PA01
ccucgacauggaucac

SEQ ID NO: 1481893 - RNA, 12 nt, Pseudomonas aeruginosa PA01
ccucgaccagcg

SEQ ID NO: 1481894 - RNA, 17 nt, Pseudomonas aeruginosa PA01
ccucgaccagcgccgcg

SEQ ID NO: 1481895 - RNA, 18 nt, Pseudomonas aeruginosa PA01
ccucgaccagcgccgcgg

SEQ ID NO: 1481896 - RNA, 19 nt, Pseudomonas aeruginosa PA01
ccucgaccagcgccgcggc

SEQ ID NO: 1481897 - RNA, 23 nt, Pseudomonas aeruginosa PA01
ccucgaccagcgccgcggcgacc

SEQ ID NO: 1481898 - RNA, 16 nt, Pseudomonas aeruginosa PA01
ccucgaccgcgccggc

SEQ ID NO: 1481899 - RNA, 17 nt, Pseudomonas aeruginosa PA01
ccucgaccgcgccggcg

SEQ ID NO: 1481900 - RNA, 15 nt, Pseudomonas aeruginosa PA01
ccucgacccuggcgc

SEQ ID NO: 1481901 - RNA, 18 nt, Pseudomonas aeruginosa PA01
ccucgacccuggcgccga

SEQ ID NO: 1481902 - RNA, 22 nt, Pseudomonas aeruginosa PA01
ccucgaccagguccggcagcgc

SEQ ID NO: 1481903 - RNA, 15 nt, Pseudomonas aeruginosa PA01
ccucgaccaucggcg

SEQ ID NO: 1481904 - RNA, 20 nt, Pseudomonas aeruginosa PA01
ccucgaccaucggcggcggc

SEQ ID NO: 1481905 - RNA, 12 nt, Pseudomonas aeruginosa PA01
ccucgacgcccg

SEQ ID NO: 1481906 - RNA, 12 nt, Pseudomonas aeruginosa PA01
ccucgaccuggc

SEQ ID NO: 1481907 - RNA, 18 nt, Pseudomonas aeruginosa PA01
ccucggcaucgaccaggg

SEQ ID NO: 1481908 - RNA, 18 nt, Pseudomonas aeruginosa PA01
ccucggcacucagccagc

SEQ ID NO: 1481909 - RNA, 19 nt, Pseudomonas aeruginosa PA01
ccucggcacucagccagcg

SEQ ID NO: 1481910 - RNA, 17 nt, Pseudomonas aeruginosa PA01
ccucggcagcgcuggcg

SEQ ID NO: 1481911 - RNA, 14 nt, Pseudomonas aeruginosa PA01
ccucggcagggcgc

SEQ ID NO: 1481912 - RNA, 20 nt, Pseudomonas aeruginosa PA01
ccucggcagggcgcccgccc

SEQ ID NO: 1481913 - RNA, 20 nt, Pseudomonas aeruginosa PA01
ccucggcauccucgccccgc

SEQ ID NO: 1481914 - RNA, 14 nt, Pseudomonas aeruginosa PA01
ccucggccagcgcc

SEQ ID NO: 1481915 - RNA, 15 nt, Pseudomonas aeruginosa PA01
ccucggccagcgccg

SEQ ID NO: 1481916 - RNA, 20 nt, Pseudomonas aeruginosa PA01
ccucggccagcgccgccgcu

SEQ ID NO: 1481917 - RNA, 21 nt, Pseudomonas aeruginosa PA01
ccucggccagcgccgccgcug

SEQ ID NO: 1481918 - RNA, 13 nt, Pseudomonas aeruginosa PA01
ccucggccagcgc

SEQ ID NO: 1481919 - RNA, 16 nt, Pseudomonas aeruginosa PA01
ccucggcguagccggc

SEQ ID NO: 1481920 - RNA, 18 nt, Pseudomonas aeruginosa PA01
ccucggcguagccggcca

SEQ ID NO: 1481921 - RNA, 15 nt, Pseudomonas aeruginosa PA01
ccucggcguucaccg

SEQ ID NO: 1481922 - RNA, 12 nt, Pseudomonas aeruginosa PA01
ccucggcgacca

SEQ ID NO: 1481923 - RNA, 21 nt, Pseudomonas aeruginosa PA01
ccucggcgaccaacagggcgu

SEQ ID NO: 1481924 - RNA, 16 nt, Pseudomonas aeruginosa PA01
ccucggcgaccaccgc

SEQ ID NO: 1481925 - RNA, 18 nt, Pseudomonas aeruginosa PA01
ccucggcgaccaccgcga

SEQ ID NO: 1481926 - RNA, 17 nt, Pseudomonas aeruginosa PA01
ccucggccuugcuggcg

SEQ ID NO: 1481927 - RNA, 13 nt, Pseudomonas aeruginosa PA01
ccucggccugggc

SEQ ID NO: 1481928 - RNA, 16 nt, Pseudomonas aeruginosa PA01
ccucggccgccaggcg

SEQ ID NO: 1481929 - RNA, 17 nt, Pseudomonas aeruginosa PA01
ccucggccgccaggcgc

SEQ ID NO: 1481930 - RNA, 18 nt, Pseudomonas aeruginosa PA01
ccucggccgccagggcgu

SEQ ID NO: 1481931 - RNA, 18 nt, Pseudomonas aeruginosa PA01
ccucggccauaccuccag

SEQ ID NO: 1481932 - RNA, 19 nt, Pseudomonas aeruginosa PA01
ccucggccauaccuccagc

SEQ ID NO: 1481933 - RNA, 21 nt, Pseudomonas aeruginosa PA01
ccucggccaucgagcgcucca

SEQ ID NO: 1481934 - RNA, 14 nt, Pseudomonas aeruginosa PA01
ccucgggcaccagc

SEQ ID NO: 1481935 - RNA, 17 nt, Pseudomonas aeruginosa PA01
ccucggcgucgcgcagg

SEQ ID NO: 1481936 - RNA, 14 nt, Pseudomonas aeruginosa PA01
ccucggcgucggca

SEQ ID NO: 1481937 - RNA, 16 nt, Pseudomonas aeruginosa PA01
ccucgggggugcccau

SEQ ID NO: 1481938 - RNA, 14 nt, Pseudomonas aeruginosa PA01
ccucggggccgagg

SEQ ID NO: 1481939 - RNA, 20 nt, Pseudomonas aeruginosa PA01
ccucggggccguccgccagg

SEQ ID NO: 1481940 - RNA, 15 nt, Pseudomonas aeruginosa PA01
ccucgggcagccccu

SEQ ID NO: 1481941 - RNA, 24 nt, Pseudomonas aeruginosa PA01
ccucgggcgagcgcagacgggugc

SEQ ID NO: 1481942 - RNA, 16 nt, Pseudomonas aeruginosa PA01
ccucguccgacagcag

SEQ ID NO: 1481943 - RNA, 22 nt, Pseudomonas aeruginosa PA01
ccucguccagcaggacgucgag

SEQ ID NO: 1481944 - RNA, 21 nt, Pseudomonas aeruginosa PA01
ccucggggaagcgcggcucgg

SEQ ID NO: 1481945 - RNA, 22 nt, Pseudomonas aeruginosa PA01
ccucggggaagcgcggcucggg

SEQ ID NO: 1481946 - RNA, 20 nt, Pseudomonas aeruginosa PA01
ccucguauuccacgucgccg

SEQ ID NO: 1481947 - RNA, 23 nt, Pseudomonas aeruginosa PA01
ccucguauuccacgucgccgacc

SEQ ID NO: 1481948 - RNA, 11 nt, Pseudomonas aeruginosa PA01
ccucgucgagc

SEQ ID NO: 1481949 - RNA, 20 nt, Pseudomonas aeruginosa PA01
ccucgucgagcagcgcgcgg

SEQ ID NO: 1481950 - RNA, 13 nt, Pseudomonas aeruginosa PA01
ccucgucgagcau

SEQ ID NO: 1481951 - RNA, 19 nt, Pseudomonas aeruginosa PA01
ccucguucgucgccgacug

SEQ ID NO: 1481952 - RNA, 18 nt, Pseudomonas aeruginosa PA01
ccucguggaacagcgcgu

SEQ ID NO: 1481953 - RNA, 20 nt, Pseudomonas aeruginosa PA01
ccucgugcagcaagccgcag

SEQ ID NO: 1481954 - RNA, 13 nt, Pseudomonas aeruginosa PA01
ccucguggcgcga

SEQ ID NO: 1481955 - RNA, 15 nt, Pseudomonas aeruginosa PA01
ccucguggcgcgccg

SEQ ID NO: 1481956 - RNA, 15 nt, Pseudomonas aeruginosa PA01
ccucgugggugccgg

SEQ ID NO: 1481957 - RNA, 15 nt, Pseudomonas aeruginosa PA01
ccucguugaucggca

SEQ ID NO: 1481958 - RNA, 18 nt, Pseudomonas aeruginosa PA01
ccucguugauuccgccgg

SEQ ID NO: 1481959 - RNA, 18 nt, Pseudomonas aeruginosa PA01
ccugaccgcgagcgccgc

SEQ ID NO: 1481960 - RNA, 16 nt, Pseudomonas aeruginosa PA01
ccucgucgccaugcgg

SEQ ID NO: 1481961 - RNA, 14 nt, Pseudomonas aeruginosa PA01
ccucgucgcccgga

SEQ ID NO: 1481962 - RNA, 14 nt, Pseudomonas aeruginosa PA01
ccucgucgauccgc

SEQ ID NO: 1481963 - RNA, 14 nt, Pseudomonas aeruginosa PA01
ccucgucgaucucg

SEQ ID NO: 1481964 - RNA, 16 nt, Pseudomonas aeruginosa PA01
ccucgucgaucucgcc

SEQ ID NO: 1481965 - RNA, 16 nt, Pseudomonas aeruginosa PA01
ccucgucgcgccaggc

SEQ ID NO: 1481966 - RNA, 22 nt, Pseudomonas aeruginosa PA01
ccugacguugccgcgcgggccg

SEQ ID NO: 1481967 - RNA, 20 nt, Pseudomonas aeruginosa PA01
ccugagaucagcgcccggca

SEQ ID NO: 1481968 - RNA, 20 nt, Pseudomonas aeruginosa PA01
ccugaccguccuggcccugc

SEQ ID NO: 1481969 - RNA, 20 nt, Pseudomonas aeruginosa PA01
ccugacgcaagcgcucggcc

SEQ ID NO: 1481970 - RNA, 21 nt, Pseudomonas aeruginosa PA01
ccugacgcaagcgcucggccu

SEQ ID NO: 1481971 - RNA, 23 nt, Pseudomonas aeruginosa PA01
ccugacgcaagcgcucggccugc

SEQ ID NO: 1481972 - RNA, 16 nt, Pseudomonas aeruginosa PA01
ccugcaaagaggcgcu

SEQ ID NO: 1481973 - RNA, 18 nt, Pseudomonas aeruginosa PA01
ccugcaaagcggcgacgc

SEQ ID NO: 1481974 - RNA, 19 nt, Pseudomonas aeruginosa PA01
ccugagcgacguggcaggg

SEQ ID NO: 1481975 - RNA, 15 nt, Pseudomonas aeruginosa PA01
ccugcaacucgaaaa

SEQ ID NO: 1481976 - RNA, 13 nt, Pseudomonas aeruginosa PA01
ccugcaacucggc

SEQ ID NO: 1481977 - RNA, 16 nt, Pseudomonas aeruginosa PA01
ccugcaacucggcgcc

SEQ ID NO: 1481978 - RNA, 21 nt, Pseudomonas aeruginosa PA01
ccugcaacaguggguaggcca

SEQ ID NO: 1481979 - RNA, 22 nt, Pseudomonas aeruginosa PA01
ccugcaacguccucgcgccgcu

SEQ ID NO: 1481980 - RNA, 18 nt, Pseudomonas aeruginosa PA01
ccugcaacacccaggccu

SEQ ID NO: 1481981 - RNA, 20 nt, Pseudomonas aeruginosa PA01
ccugcaacacccaggccugg

SEQ ID NO: 1481982 - RNA, 21 nt, Pseudomonas aeruginosa PA01
ccugcaacacccaggccuggg

SEQ ID NO: 1481983 - RNA, 15 nt, Pseudomonas aeruginosa PA01
ccugcaacagggcau

SEQ ID NO: 1481984 - RNA, 22 nt, Pseudomonas aeruginosa PA01
ccugcaacagggcauuggccau

SEQ ID NO: 1481985 - RNA, 14 nt, Pseudomonas aeruginosa PA01
ccugcaacgccagc

SEQ ID NO: 1481986 - RNA, 16 nt, Pseudomonas aeruginosa PA01
ccugcaacgccagcag

SEQ ID NO: 1481987 - RNA, 23 nt, Pseudomonas aeruginosa PA01
ccugcaacgcccgcgagccgucc

SEQ ID NO: 1481988 - RNA, 16 nt, Pseudomonas aeruginosa PA01
ccugcaacgccgccaa

SEQ ID NO: 1481989 - RNA, 17 nt, Pseudomonas aeruginosa PA01
ccugcaacgccgccaac

SEQ ID NO: 1481990 - RNA, 18 nt, Pseudomonas aeruginosa PA01
ccugcaacgccgccaacu

SEQ ID NO: 1481991 - RNA, 16 nt, Pseudomonas aeruginosa PA01
ccugcaccugcucggg

SEQ ID NO: 1481992 - RNA, 19 nt, Pseudomonas aeruginosa PA01
ccugcacccuuggcgcagg

SEQ ID NO: 1481993 - RNA, 19 nt, Pseudomonas aeruginosa PA01
ccugcaccacgcaggcgcg

SEQ ID NO: 1481994 - RNA, 21 nt, Pseudomonas aeruginosa PA01
ccugcacaucaccuucgcccu

SEQ ID NO: 1481995 - RNA, 18 nt, Pseudomonas aeruginosa PA01
ccugcaauuccaccggcu

SEQ ID NO: 1481996 - RNA, 16 nt, Pseudomonas aeruginosa PA01
ccugcaggacccgcga

SEQ ID NO: 1481997 - RNA, 15 nt, Pseudomonas aeruginosa PA01
ccugcaggaucgaga

SEQ ID NO: 1481998 - RNA, 16 nt, Pseudomonas aeruginosa PA01
ccugcaggaucgagac

SEQ ID NO: 1481999 - RNA, 19 nt, Pseudomonas aeruginosa PA01
ccugcaccuugggaucguc

SEQ ID NO: 1482000 - RNA, 15 nt, Pseudomonas aeruginosa PA01
ccugcacgcugcgcc

SEQ ID NO: 1482001 - RNA, 23 nt, Pseudomonas aeruginosa PA01
ccugcacgcugcgccggcgcugc

SEQ ID NO: 1482002 - RNA, 16 nt, Pseudomonas aeruginosa PA01
ccugcguuucgccggg

SEQ ID NO: 1482003 - RNA, 17 nt, Pseudomonas aeruginosa PA01
ccugcguuucgccgggc

SEQ ID NO: 1482004 - RNA, 15 nt, Pseudomonas aeruginosa PA01
ccugcucacggccga

SEQ ID NO: 1482005 - RNA, 15 nt, Pseudomonas aeruginosa PA01
ccugcuccagcaggg

SEQ ID NO: 1482006 - RNA, 16 nt, Pseudomonas aeruginosa PA01
ccugcuccagcggagc

SEQ ID NO: 1482007 - RNA, 12 nt, Pseudomonas aeruginosa PA01
ccugcuccagca

SEQ ID NO: 1482008 - RNA, 14 nt, Pseudomonas aeruginosa PA01
ccugcucgauccag

SEQ ID NO: 1482009 - RNA, 21 nt, Pseudomonas aeruginosa PA01
ccugcucgauccagccggcau

SEQ ID NO: 1482010 - RNA, 15 nt, Pseudomonas aeruginosa PA01
ccugcucgccgcuga

SEQ ID NO: 1482011 - RNA, 13 nt, Pseudomonas aeruginosa PA01
ccugcucgccggc

SEQ ID NO: 1482012 - RNA, 13 nt, Pseudomonas aeruginosa PA01
ccugcuccucgcc

SEQ ID NO: 1482013 - RNA, 17 nt, Pseudomonas aeruginosa PA01
ccugcuccucgccguac

SEQ ID NO: 1482014 - RNA, 12 nt, Pseudomonas aeruginosa PA01
ccugcuccucgg

SEQ ID NO: 1482015 - RNA, 14 nt, Pseudomonas aeruginosa PA01
ccugcuccucggca

SEQ ID NO: 1482016 - RNA, 17 nt, Pseudomonas aeruginosa PA01
ccugcuccucggcagcg

SEQ ID NO: 1482017 - RNA, 16 nt, Pseudomonas aeruginosa PA01
ccugcucccuggcgga

SEQ ID NO: 1482018 - RNA, 12 nt, Pseudomonas aeruginosa PA01
ccugcucgaacg

SEQ ID NO: 1482019 - RNA, 23 nt, Pseudomonas aeruginosa PA01
ccugcucgaacggcggaucgauc

SEQ ID NO: 1482020 - RNA, 14 nt, Pseudomonas aeruginosa PA01
ccugcucgccggcg

SEQ ID NO: 1482021 - RNA, 18 nt, Pseudomonas aeruginosa PA01
ccugcucgcggcuggccg

SEQ ID NO: 1482022 - RNA, 12 nt, Pseudomonas aeruginosa PA01
ccugcucgcggg

SEQ ID NO: 1482023 - RNA, 17 nt, Pseudomonas aeruginosa PA01
ccugcucgcgcaccgcg

SEQ ID NO: 1482024 - RNA, 18 nt, Pseudomonas aeruginosa PA01
ccugcucgcgcagccagg

SEQ ID NO: 1482025 - RNA, 21 nt, Pseudomonas aeruginosa PA01
ccugcucgcgcagccaggcga

SEQ ID NO: 1482026 - RNA, 14 nt, Pseudomonas aeruginosa PA01
ccugcucggccugc

SEQ ID NO: 1482027 - RNA, 17 nt, Pseudomonas aeruginosa PA01
ccugcugcgccggcacg

SEQ ID NO: 1482028 - RNA, 16 nt, Pseudomonas aeruginosa PA01
ccugcugcuggccuuc

SEQ ID NO: 1482029 - RNA, 19 nt, Pseudomonas aeruginosa PA01
ccugcuggcgaauuuccug

SEQ ID NO: 1482030 - RNA, 20 nt, Pseudomonas aeruginosa PA01
ccugcuggcgaauuuccugc

SEQ ID NO: 1482031 - RNA, 13 nt, Pseudomonas aeruginosa PA01
ccugcuggcgagc

SEQ ID NO: 1482032 - RNA, 17 nt, Pseudomonas aeruginosa PA01
ccugcuggcgagcgucg

SEQ ID NO: 1482033 - RNA, 14 nt, Pseudomonas aeruginosa PA01
ccugcuggcgcagc

SEQ ID NO: 1482034 - RNA, 13 nt, Pseudomonas aeruginosa PA01
ccugcuggccggu

SEQ ID NO: 1482035 - RNA, 20 nt, Pseudomonas aeruginosa PA01
ccugcuggccggugccgccc

SEQ ID NO: 1482036 - RNA, 18 nt, Pseudomonas aeruginosa PA01
ccugcuguguccggcgga

SEQ ID NO: 1482037 - RNA, 16 nt, Pseudomonas aeruginosa PA01
ccugcuggcugcccag

SEQ ID NO: 1482038 - RNA, 17 nt, Pseudomonas aeruginosa PA01
ccugcugagcagucgcc

SEQ ID NO: 1482039 - RNA, 21 nt, Pseudomonas aeruginosa PA01
ccugcugagcagucgccuggc

SEQ ID NO: 1482040 - RNA, 16 nt, Pseudomonas aeruginosa PA01
ccugcucuucggcggc

SEQ ID NO: 1482041 - RNA, 17 nt, Pseudomonas aeruginosa PA01
ccugcugcagggccucg

SEQ ID NO: 1482042 - RNA, 15 nt, Pseudomonas aeruginosa PA01
ccugcugcccggcau

SEQ ID NO: 1482043 - RNA, 22 nt, Pseudomonas aeruginosa PA01
ccugcugcgacaguucgcggaa

SEQ ID NO: 1482044 - RNA, 19 nt, Pseudomonas aeruginosa PA01
ccugcugcugcucagcgcg

SEQ ID NO: 1482045 - RNA, 20 nt, Pseudomonas aeruginosa PA01
ccugcugcugcucagcgcgc

SEQ ID NO: 1482046 - RNA, 18 nt, Pseudomonas aeruginosa PA01
ccugcugcgggcgcugca

SEQ ID NO: 1482047 - RNA, 21 nt, Pseudomonas aeruginosa PA01
ccugcuucagguagugcaaca

SEQ ID NO: 1482048 - RNA, 16 nt, Pseudomonas aeruginosa PA01
ccugcuuucccugcug

SEQ ID NO: 1482049 - RNA, 14 nt, Pseudomonas aeruginosa PA01
ccuggaaagaccgg

SEQ ID NO: 1482050 - RNA, 16 nt, Pseudomonas aeruginosa PA01
ccuggaaagaccggcg

SEQ ID NO: 1482051 - RNA, 17 nt, Pseudomonas aeruginosa PA01
ccuggaaagaccggcgc

SEQ ID NO: 1482052 - RNA, 20 nt, Pseudomonas aeruginosa PA01
ccuggaaagaccggcgcccc

SEQ ID NO: 1482053 - RNA, 20 nt, Pseudomonas aeruginosa PA01
ccuggaacuagcccucgacc

SEQ ID NO: 1482054 - RNA, 14 nt, Pseudomonas aeruginosa PA01
ccuggaaggcgcug

SEQ ID NO: 1482055 - RNA, 22 nt, Pseudomonas aeruginosa PA01
ccuggaaggcgcugggcggcug

SEQ ID NO: 1482056 - RNA, 19 nt, Pseudomonas aeruginosa PA01
ccuggaaguauucggcggg

SEQ ID NO: 1482057 - RNA, 12 nt, Pseudomonas aeruginosa PA01
ccuggaacagga

SEQ ID NO: 1482058 - RNA, 19 nt, Pseudomonas aeruginosa PA01
ccuggaagaauggcguggc

SEQ ID NO: 1482059 - RNA, 15 nt, Pseudomonas aeruginosa PA01
ccugcuuggccagcg

SEQ ID NO: 1482060 - RNA, 16 nt, Pseudomonas aeruginosa PA01
ccugcuuggccagcgc

SEQ ID NO: 1482061 - RNA, 17 nt, Pseudomonas aeruginosa PA01
ccugcuuggccagcgcg

SEQ ID NO: 1482062 - RNA, 14 nt, Pseudomonas aeruginosa PA01
ccugcuuggcggcg

SEQ ID NO: 1482063 - RNA, 21 nt, Pseudomonas aeruginosa PA01
ccugcuugggcgccucgccgc

SEQ ID NO: 1482064 - RNA, 21 nt, Pseudomonas aeruginosa PA01
ccugcuuccagaccucgagca

SEQ ID NO: 1482065 - RNA, 16 nt, Pseudomonas aeruginosa PA01
ccugcuucgaccaggg

SEQ ID NO: 1482066 - RNA, 21 nt, Pseudomonas aeruginosa PA01
ccugcuucgaccagggcaucc

SEQ ID NO: 1482067 - RNA, 14 nt, Pseudomonas aeruginosa PA01
ccugcuucagcccg

SEQ ID NO: 1482068 - RNA, 12 nt, Pseudomonas aeruginosa PA01
ccugcugguggg

SEQ ID NO: 1482069 - RNA, 23 nt, Pseudomonas aeruginosa PA01
ccugcuggugggugaucucgcug

SEQ ID NO: 1482070 - RNA, 20 nt, Pseudomonas aeruginosa PA01
ccuggaucagcgccucgacc

SEQ ID NO: 1482071 - RNA, 14 nt, Pseudomonas aeruginosa PA01
ccuggaucgccagg

SEQ ID NO: 1482072 - RNA, 13 nt, Pseudomonas aeruginosa PA01
ccuggaucgccuu

SEQ ID NO: 1482073 - RNA, 15 nt, Pseudomonas aeruginosa PA01
ccuggaucaccgcgg

SEQ ID NO: 1482074 - RNA, 16 nt, Pseudomonas aeruginosa PA01
ccuggaucacgcugag

SEQ ID NO: 1482075 - RNA, 12 nt, Pseudomonas aeruginosa PA01
ccuggaucggca

SEQ ID NO: 1482076 - RNA, 14 nt, Pseudomonas aeruginosa PA01
ccuggaucggcagc

SEQ ID NO: 1482077 - RNA, 16 nt, Pseudomonas aeruginosa PA01
ccuggaucggcagcuc

SEQ ID NO: 1482078 - RNA, 13 nt, Pseudomonas aeruginosa PA01
ccuggaucuccug

SEQ ID NO: 1482079 - RNA, 17 nt, Pseudomonas aeruginosa PA01
ccuggagguagcugcgc

SEQ ID NO: 1482080 - RNA, 22 nt, Pseudomonas aeruginosa PA01
ccuggagguagcugcgccgccu

SEQ ID NO: 1482081 - RNA, 20 nt, Pseudomonas aeruginosa PA01
ccuggauaucugggccaucg

SEQ ID NO: 1482082 - RNA, 13 nt, Pseudomonas aeruginosa PA01
ccuggaggacgcg

SEQ ID NO: 1482083 - RNA, 17 nt, Pseudomonas aeruginosa PA01
ccuggaggcacgaaccg

SEQ ID NO: 1482084 - RNA, 17 nt, Pseudomonas aeruginosa PA01
ccuggauacgcucggcc

SEQ ID NO: 1482085 - RNA, 18 nt, Pseudomonas aeruginosa PA01
ccuggauacgcucggcca

SEQ ID NO: 1482086 - RNA, 15 nt, Pseudomonas aeruginosa PA01
ccuggaccccgcccu

SEQ ID NO: 1482087 - RNA, 20 nt, Pseudomonas aeruginosa PA01
ccuggacccgggccuccugg

SEQ ID NO: 1482088 - RNA, 13 nt, Pseudomonas aeruginosa PA01
ccuggaagccggc

SEQ ID NO: 1482089 - RNA, 20 nt, Pseudomonas aeruginosa PA01
ccuggaagcgaugggcgaga

SEQ ID NO: 1482090 - RNA, 16 nt, Pseudomonas aeruginosa PA01
ccuggagcagggcgau

SEQ ID NO: 1482091 - RNA, 17 nt, Pseudomonas aeruginosa PA01
ccuggacgaaugcccgu

SEQ ID NO: 1482092 - RNA, 17 nt, Pseudomonas aeruginosa PA01
ccuggagaaacucgcgg

SEQ ID NO: 1482093 - RNA, 18 nt, Pseudomonas aeruginosa PA01
ccuggagaaauccggcug

SEQ ID NO: 1482094 - RNA, 14 nt, Pseudomonas aeruginosa PA01
ccugcgccucgacc

SEQ ID NO: 1482095 - RNA, 17 nt, Pseudomonas aeruginosa PA01
ccugcgccucgaccugg

SEQ ID NO: 1482096 - RNA, 18 nt, Pseudomonas aeruginosa PA01
ccugcgccucggcccugg

SEQ ID NO: 1482097 - RNA, 23 nt, Pseudomonas aeruginosa PA01
ccugcgccucggcccuggcggcg

SEQ ID NO: 1482098 - RNA, 15 nt, Pseudomonas aeruginosa PA01
ccugcgccgcagcgg

SEQ ID NO: 1482099 - RNA, 17 nt, Pseudomonas aeruginosa PA01
ccugcgccgcagcggcc

SEQ ID NO: 1482100 - RNA, 22 nt, Pseudomonas aeruginosa PA01
ccugcgccggaccagaucggcg

SEQ ID NO: 1482101 - RNA, 13 nt, Pseudomonas aeruginosa PA01
ccugcgccggcuc

SEQ ID NO: 1482102 - RNA, 17 nt, Pseudomonas aeruginosa PA01
ccugcgaauugcgcugg

SEQ ID NO: 1482103 - RNA, 21 nt, Pseudomonas aeruginosa PA01
ccugcgaauugcgcuggaagu

SEQ ID NO: 1482104 - RNA, 15 nt, Pseudomonas aeruginosa PA01
ccugcgccagcaucg

SEQ ID NO: 1482105 - RNA, 12 nt, Pseudomonas aeruginosa PA01
ccugcgaggcgu

SEQ ID NO: 1482106 - RNA, 17 nt, Pseudomonas aeruginosa PA01
ccugcgaggcgucgauc

SEQ ID NO: 1482107 - RNA, 19 nt, Pseudomonas aeruginosa PA01
ccugcgaggcgucgaucau

SEQ ID NO: 1482108 - RNA, 22 nt, Pseudomonas aeruginosa PA01
ccugcgcaaggaacuggaagcc

SEQ ID NO: 1482109 - RNA, 23 nt, Pseudomonas aeruginosa PA01
ccugcgcaaggaacuggaagccu

SEQ ID NO: 1482110 - RNA, 22 nt, Pseudomonas aeruginosa PA01
ccugcaucaccaggcugccgcc

SEQ ID NO: 1482111 - RNA, 24 nt, Pseudomonas aeruginosa PA01
ccugcaggucgaggcgcuccaccg

SEQ ID NO: 1482112 - RNA, 19 nt, Pseudomonas aeruginosa PA01
ccugcagguuguccagggc

SEQ ID NO: 1482113 - RNA, 20 nt, Pseudomonas aeruginosa PA01
ccugcagggcguagugcucc

SEQ ID NO: 1482114 - RNA, 17 nt, Pseudomonas aeruginosa PA01
ccugcagguagcgcugc

SEQ ID NO: 1482115 - RNA, 16 nt, Pseudomonas aeruginosa PA01
ccugcaggccgaaucc

SEQ ID NO: 1482116 - RNA, 19 nt, Pseudomonas aeruginosa PA01
ccugcaggccgaauccgcc

SEQ ID NO: 1482117 - RNA, 22 nt, Pseudomonas aeruginosa PA01
ccugcaggccgaauccgccggc

SEQ ID NO: 1482118 - RNA, 15 nt, Pseudomonas aeruginosa PA01
ccugcgucagcgagg

SEQ ID NO: 1482119 - RNA, 14 nt, Pseudomonas aeruginosa PA01
ccugcgucgcaucc

SEQ ID NO: 1482120 - RNA, 18 nt, Pseudomonas aeruginosa PA01
ccugcguggaaccgcggc

SEQ ID NO: 1482121 - RNA, 21 nt, Pseudomonas aeruginosa PA01
ccugcguggaaccgcggcgcc

SEQ ID NO: 1482122 - RNA, 22 nt, Pseudomonas aeruginosa PA01
ccugcguggaaccgcggcgccc

SEQ ID NO: 1482123 - RNA, 21 nt, Pseudomonas aeruginosa PA01
ccugcguggcgaacgcccggc

SEQ ID NO: 1482124 - RNA, 23 nt, Pseudomonas aeruginosa PA01
ccugcguggcgaacgcccggcuu

SEQ ID NO: 1482125 - RNA, 18 nt, Pseudomonas aeruginosa PA01
ccugcggcguuauccgcc

SEQ ID NO: 1482126 - RNA, 12 nt, Pseudomonas aeruginosa PA01
ccugcggcgaga

SEQ ID NO: 1482127 - RNA, 13 nt, Pseudomonas aeruginosa PA01
ccugcggcgagaa

SEQ ID NO: 1482128 - RNA, 18 nt, Pseudomonas aeruginosa PA01
ccugcggguucggcgaga

SEQ ID NO: 1482129 - RNA, 18 nt, Pseudomonas aeruginosa PA01
ccugcggguuggucggca

SEQ ID NO: 1482130 - RNA, 15 nt, Pseudomonas aeruginosa PA01
ccugcggccgcaacc

SEQ ID NO: 1482131 - RNA, 17 nt, Pseudomonas aeruginosa PA01
ccugcggccguucgccc

SEQ ID NO: 1482132 - RNA, 16 nt, Pseudomonas aeruginosa PA01
ccugcggcccgagggc

SEQ ID NO: 1482133 - RNA, 16 nt, Pseudomonas aeruginosa PA01
ccugcggaccgcagaa

SEQ ID NO: 1482134 - RNA, 22 nt, Pseudomonas aeruginosa PA01
ccugcggcacgaaccauugcgg

SEQ ID NO: 1482135 - RNA, 14 nt, Pseudomonas aeruginosa PA01
ccugcggaucgagg

SEQ ID NO: 1482136 - RNA, 13 nt, Pseudomonas aeruginosa PA01
ccugcggauggcg

SEQ ID NO: 1482137 - RNA, 19 nt, Pseudomonas aeruginosa PA01
ccugcggauucaucggcgg

SEQ ID NO: 1482138 - RNA, 15 nt, Pseudomonas aeruginosa PA01
ccugcgcggcgacga

SEQ ID NO: 1482139 - RNA, 21 nt, Pseudomonas aeruginosa PA01
ccugcgcuuccggcagccagc

SEQ ID NO: 1482140 - RNA, 23 nt, Pseudomonas aeruginosa PA01
ccugcgcuuccggcagccagccg

SEQ ID NO: 1482141 - RNA, 18 nt, Pseudomonas aeruginosa PA01
ccugcgcuucguuggcga

SEQ ID NO: 1482142 - RNA, 22 nt, Pseudomonas aeruginosa PA01
ccugcgcuucguuggcgacgac

SEQ ID NO: 1482143 - RNA, 21 nt, Pseudomonas aeruginosa PA01
ccugcgcgcaccaggccuccc

SEQ ID NO: 1482144 - RNA, 15 nt, Pseudomonas aeruginosa PA01
ccguugcacgaaaac

SEQ ID NO: 1482145 - RNA, 14 nt, Pseudomonas aeruginosa PA01
ccguucucccgcgc

SEQ ID NO: 1482146 - RNA, 13 nt, Pseudomonas aeruginosa PA01
ccguugcccucgc

SEQ ID NO: 1482147 - RNA, 15 nt, Pseudomonas aeruginosa PA01
ccguugcccucgcgc

SEQ ID NO: 1482148 - RNA, 18 nt, Pseudomonas aeruginosa PA01
ccguugcccucgcgcugg

SEQ ID NO: 1482149 - RNA, 14 nt, Pseudomonas aeruginosa PA01
ccguugccgaugcc

SEQ ID NO: 1482150 - RNA, 13 nt, Pseudomonas aeruginosa PA01
ccgugucgagggc

SEQ ID NO: 1482151 - RNA, 16 nt, Pseudomonas aeruginosa PA01
ccgugucgagggcgaa

SEQ ID NO: 1482152 - RNA, 18 nt, Pseudomonas aeruginosa PA01
ccgugucgagggcgaaca

SEQ ID NO: 1482153 - RNA, 14 nt, Pseudomonas aeruginosa PA01
ccgugucgaagccu

SEQ ID NO: 1482154 - RNA, 16 nt, Pseudomonas aeruginosa PA01
ccguguaccacgcccg

SEQ ID NO: 1482155 - RNA, 19 nt, Pseudomonas aeruginosa PA01
ccguguaccacgcccgcgg

SEQ ID NO: 1482156 - RNA, 15 nt, Pseudomonas aeruginosa PA01
ccguucgucaccggc

SEQ ID NO: 1482157 - RNA, 18 nt, Pseudomonas aeruginosa PA01
ccguucugccgcagcgcc

SEQ ID NO: 1482158 - RNA, 15 nt, Pseudomonas aeruginosa PA01
ccguucucgaagagc

SEQ ID NO: 1482159 - RNA, 14 nt, Pseudomonas aeruginosa PA01
ccguucucgaucaa

SEQ ID NO: 1482160 - RNA, 22 nt, Pseudomonas aeruginosa PA01
ccguucucauugcgccgccggc

SEQ ID NO: 1482161 - RNA, 21 nt, Pseudomonas aeruginosa PA01
ccguucugugcggcgaugucg

SEQ ID NO: 1482162 - RNA, 14 nt, Pseudomonas aeruginosa PA01
ccguucuugaucac

SEQ ID NO: 1482163 - RNA, 18 nt, Pseudomonas aeruginosa PA01
ccguucuugaucaccgcg

SEQ ID NO: 1482164 - RNA, 20 nt, Pseudomonas aeruginosa PA01
ccguucuuguugagcuggcc

SEQ ID NO: 1482165 - RNA, 21 nt, Pseudomonas aeruginosa PA01
ccguucuuguugagcuggccg

SEQ ID NO: 1482166 - RNA, 15 nt, Pseudomonas aeruginosa PA01
ccguugaccagcgcg

SEQ ID NO: 1482167 - RNA, 18 nt, Pseudomonas aeruginosa PA01
ccguugaccagcgcgucg

SEQ ID NO: 1482168 - RNA, 19 nt, Pseudomonas aeruginosa PA01
ccguugaacucggcgccca

SEQ ID NO: 1482169 - RNA, 20 nt, Pseudomonas aeruginosa PA01
ccguugaacucggcgcccag

SEQ ID NO: 1482170 - RNA, 15 nt, Pseudomonas aeruginosa PA01
ccguuucgccgccgg

SEQ ID NO: 1482171 - RNA, 16 nt, Pseudomonas aeruginosa PA01
ccguuucgccgccggc

SEQ ID NO: 1482172 - RNA, 15 nt, Pseudomonas aeruginosa PA01
ccguuuccggcaugc

SEQ ID NO: 1482173 - RNA, 12 nt, Pseudomonas aeruginosa PA01
ccguuucggcga

SEQ ID NO: 1482174 - RNA, 23 nt, Pseudomonas aeruginosa PA01
ccguugucugggaguuccgcgca

SEQ ID NO: 1482175 - RNA, 18 nt, Pseudomonas aeruginosa PA01
ccguuguagaucggcagc

SEQ ID NO: 1482176 - RNA, 23 nt, Pseudomonas aeruginosa PA01
ccguuuuucaugguccgucgcgc

SEQ ID NO: 1482177 - RNA, 23 nt, Pseudomonas aeruginosa PA01
ccguuugcucucaucccugugcg

SEQ ID NO: 1482178 - RNA, 23 nt, Pseudomonas aeruginosa PA01
ccguugcggcagcauccguacca

SEQ ID NO: 1482179 - RNA, 19 nt, Pseudomonas aeruginosa PA01
ccguugcgccucgccgccc

SEQ ID NO: 1482180 - RNA, 22 nt, Pseudomonas aeruginosa PA01
ccguugcgcauuugcacgucgg

SEQ ID NO: 1482181 - RNA, 19 nt, Pseudomonas aeruginosa PA01
ccguuggccuucacuucgg

SEQ ID NO: 1482182 - RNA, 18 nt, Pseudomonas aeruginosa PA01
ccguuggcgaacaaucgg

SEQ ID NO: 1482183 - RNA, 13 nt, Pseudomonas aeruginosa PA01
ccguuggccagca

SEQ ID NO: 1482184 - RNA, 17 nt, Pseudomonas aeruginosa PA01
ccguuggccagcaggcg

SEQ ID NO: 1482185 - RNA, 15 nt, Pseudomonas aeruginosa PA01
ccguuggcgucgcgc

SEQ ID NO: 1482186 - RNA, 18 nt, Pseudomonas aeruginosa PA01
ccguuggcguuaugcgcc

SEQ ID NO: 1482187 - RNA, 13 nt, Pseudomonas aeruginosa PA01
ccguuggcgcggg

SEQ ID NO: 1482188 - RNA, 19 nt, Pseudomonas aeruginosa PA01
ccguuggcgcgggcgaagg

SEQ ID NO: 1482189 - RNA, 17 nt, Pseudomonas aeruginosa PA01
ccguugggccagggccu

SEQ ID NO: 1482190 - RNA, 13 nt, Pseudomonas aeruginosa PA01
ccucaacgaccgc

SEQ ID NO: 1482191 - RNA, 18 nt, Pseudomonas aeruginosa PA01
ccuauccacgacgucggc

SEQ ID NO: 1482192 - RNA, 21 nt, Pseudomonas aeruginosa PA01
ccucaaggugaagugaucgau

SEQ ID NO: 1482193 - RNA, 17 nt, Pseudomonas aeruginosa PA01
ccucaagucuccagcga

SEQ ID NO: 1482194 - RNA, 17 nt, Pseudomonas aeruginosa PA01
ccucacccugcugggcg

SEQ ID NO: 1482195 - RNA, 12 nt, Pseudomonas aeruginosa PA01
ccucacgggccg

SEQ ID NO: 1482196 - RNA, 22 nt, Pseudomonas aeruginosa PA01
ccucacggguguuucggccgcu

SEQ ID NO: 1482197 - RNA, 23 nt, Pseudomonas aeruginosa PA01
ccucacggguguuucggccgcug

SEQ ID NO: 1482198 - RNA, 13 nt, Pseudomonas aeruginosa PA01
ccuccagcaacgc

SEQ ID NO: 1482199 - RNA, 21 nt, Pseudomonas aeruginosa PA01
ccuccagagugcgcagcagcg

SEQ ID NO: 1482200 - RNA, 18 nt, Pseudomonas aeruginosa PA01
ccucagaggcgaccagcc

SEQ ID NO: 1482201 - RNA, 21 nt, Pseudomonas aeruginosa PA01
ccucagaggcgaccagccggg

SEQ ID NO: 1482202 - RNA, 16 nt, Pseudomonas aeruginosa PA01
ccucagcagcgccgcc

SEQ ID NO: 1482203 - RNA, 17 nt, Pseudomonas aeruginosa PA01
ccucagcagcgccgccc

SEQ ID NO: 1482204 - RNA, 12 nt, Pseudomonas aeruginosa PA01
ccuccagcagcu

SEQ ID NO: 1482205 - RNA, 21 nt, Pseudomonas aeruginosa PA01
ccuccagcaggaccuggccgu

SEQ ID NO: 1482206 - RNA, 23 nt, Pseudomonas aeruginosa PA01
ccuccagcacuacgcccauggcg

SEQ ID NO: 1482207 - RNA, 17 nt, Pseudomonas aeruginosa PA01
ccuccagcagacggcug

SEQ ID NO: 1482208 - RNA, 13 nt, Pseudomonas aeruginosa PA01
ccuccagccggcc

SEQ ID NO: 1482209 - RNA, 14 nt, Pseudomonas aeruginosa PA01
ccuccagccggcca

SEQ ID NO: 1482210 - RNA, 16 nt, Pseudomonas aeruginosa PA01
ccuccagccggcgacg

SEQ ID NO: 1482211 - RNA, 17 nt, Pseudomonas aeruginosa PA01
ccuccagcgccgccagg

SEQ ID NO: 1482212 - RNA, 18 nt, Pseudomonas aeruginosa PA01
ccuccagcgccucgccga

SEQ ID NO: 1482213 - RNA, 13 nt, Pseudomonas aeruginosa PA01
ccuccagcgccug

SEQ ID NO: 1482214 - RNA, 21 nt, Pseudomonas aeruginosa PA01
ccuccaggccgaagccgccgg

SEQ ID NO: 1482215 - RNA, 21 nt, Pseudomonas aeruginosa PA01
ccuccaggccgccggcgaccg

SEQ ID NO: 1482216 - RNA, 19 nt, Pseudomonas aeruginosa PA01
ccuccaggcgcgccuggau

SEQ ID NO: 1482217 - RNA, 17 nt, Pseudomonas aeruginosa PA01
ccuccagcauccagcga

SEQ ID NO: 1482218 - RNA, 21 nt, Pseudomonas aeruginosa PA01
ccuccagccagcagcccggcc

SEQ ID NO: 1482219 - RNA, 12 nt, Pseudomonas aeruginosa PA01
ccucccaccgcg

SEQ ID NO: 1482220 - RNA, 20 nt, Pseudomonas aeruginosa PA01
ccuccauuagcgucgcgcgg

SEQ ID NO: 1482221 - RNA, 21 nt, Pseudomonas aeruginosa PA01
ccuccauuagcgucgcgcggc

SEQ ID NO: 1482222 - RNA, 23 nt, Pseudomonas aeruginosa PA01
ccuccauuagcgucgcgcggcca

SEQ ID NO: 1482223 - RNA, 16 nt, Pseudomonas aeruginosa PA01
ccuccagggucgcccg

SEQ ID NO: 1482224 - RNA, 22 nt, Pseudomonas aeruginosa PA01
ccuccaggcucuucagcacgcg

SEQ ID NO: 1482225 - RNA, 14 nt, Pseudomonas aeruginosa PA01
ccuccaguuccucg

SEQ ID NO: 1482226 - RNA, 16 nt, Pseudomonas aeruginosa PA01
ccuccccguccuggcg

SEQ ID NO: 1482227 - RNA, 16 nt, Pseudomonas aeruginosa PA01
ccuccccuguggucag

SEQ ID NO: 1482228 - RNA, 22 nt, Pseudomonas aeruginosa PA01
ccucccgaguucaccaccccga

SEQ ID NO: 1482229 - RNA, 12 nt, Pseudomonas aeruginosa PA01
ccucccgccgcg

SEQ ID NO: 1482230 - RNA, 20 nt, Pseudomonas aeruginosa PA01
ccucccgcgccagcgccgcc

SEQ ID NO: 1482231 - RNA, 16 nt, Pseudomonas aeruginosa PA01
ccucccgcgccagcuc

SEQ ID NO: 1482232 - RNA, 13 nt, Pseudomonas aeruginosa PA01
ccuccgccagcgu

SEQ ID NO: 1482233 - RNA, 17 nt, Pseudomonas aeruginosa PA01
ccuccuugggaucggcg

SEQ ID NO: 1482234 - RNA, 22 nt, Pseudomonas aeruginosa PA01
ccucgaacagcuugaaccgcga

SEQ ID NO: 1482235 - RNA, 19 nt, Pseudomonas aeruginosa PA01
ccucgaacauggccaccga

SEQ ID NO: 1482236 - RNA, 14 nt, Pseudomonas aeruginosa PA01
ccucccggcucgcc

SEQ ID NO: 1482237 - RNA, 15 nt, Pseudomonas aeruginosa PA01
ccucccggcucgccg

SEQ ID NO: 1482238 - RNA, 16 nt, Pseudomonas aeruginosa PA01
ccucccggcucgccga

SEQ ID NO: 1482239 - RNA, 16 nt, Pseudomonas aeruginosa PA01
ccgucuagcgcaggcg

SEQ ID NO: 1482240 - RNA, 14 nt, Pseudomonas aeruginosa PA01
ccgucucaggcgcc

SEQ ID NO: 1482241 - RNA, 19 nt, Pseudomonas aeruginosa PA01
ccgucucaggcgccaggcc

SEQ ID NO: 1482242 - RNA, 21 nt, Pseudomonas aeruginosa PA01
ccgucguuuuguccggcggcu

SEQ ID NO: 1482243 - RNA, 22 nt, Pseudomonas aeruginosa PA01
ccgucguuuuguccggcggcug

SEQ ID NO: 1482244 - RNA, 14 nt, Pseudomonas aeruginosa PA01
ccgugacgucggcg

SEQ ID NO: 1482245 - RNA, 16 nt, Pseudomonas aeruginosa PA01
ccgugacgucggcggc

SEQ ID NO: 1482246 - RNA, 18 nt, Pseudomonas aeruginosa PA01
ccgucguagcgcagcggc

SEQ ID NO: 1482247 - RNA, 19 nt, Pseudomonas aeruginosa PA01
ccgucguagcgcagcggca

SEQ ID NO: 1482248 - RNA, 22 nt, Pseudomonas aeruginosa PA01
ccgugagcuuguccagggcgcc

SEQ ID NO: 1482249 - RNA, 23 nt, Pseudomonas aeruginosa PA01
ccgugaggcgcgcgccgaacucg

SEQ ID NO: 1482250 - RNA, 16 nt, Pseudomonas aeruginosa PA01
ccgugaucccgcgcgg

SEQ ID NO: 1482251 - RNA, 18 nt, Pseudomonas aeruginosa PA01
ccgugcaccgaggcgcgc

SEQ ID NO: 1482252 - RNA, 20 nt, Pseudomonas aeruginosa PA01
ccgugcaccgaggcgcgccg

SEQ ID NO: 1482253 - RNA, 21 nt, Pseudomonas aeruginosa PA01
ccgugcaccgaggcgcgccga

SEQ ID NO: 1482254 - RNA, 17 nt, Pseudomonas aeruginosa PA01
ccgugaugcccagcggc

SEQ ID NO: 1482255 - RNA, 18 nt, Pseudomonas aeruginosa PA01
ccgugaugcccagcggcg

SEQ ID NO: 1482256 - RNA, 20 nt, Pseudomonas aeruginosa PA01
ccgugaugcccagcggcgcc

SEQ ID NO: 1482257 - RNA, 21 nt, Pseudomonas aeruginosa PA01
ccgugggaucgccacgccggc

SEQ ID NO: 1482258 - RNA, 15 nt, Pseudomonas aeruginosa PA01
ccgugggccggcgcg

SEQ ID NO: 1482259 - RNA, 18 nt, Pseudomonas aeruginosa PA01
ccgugggccggcgcgccg

SEQ ID NO: 1482260 - RNA, 21 nt, Pseudomonas aeruginosa PA01
ccgugggucgccucgaacaug

SEQ ID NO: 1482261 - RNA, 23 nt, Pseudomonas aeruginosa PA01
ccgugggucgccucgaacauggc

SEQ ID NO: 1482262 - RNA, 14 nt, Pseudomonas aeruginosa PA01
ccgugguacaccgc

SEQ ID NO: 1482263 - RNA, 18 nt, Pseudomonas aeruginosa PA01
ccguggcgggccagcagg

SEQ ID NO: 1482264 - RNA, 19 nt, Pseudomonas aeruginosa PA01
ccguggcgggccagcaggc

SEQ ID NO: 1482265 - RNA, 20 nt, Pseudomonas aeruginosa PA01
ccguggcgggccagcaggcg

SEQ ID NO: 1482266 - RNA, 19 nt, Pseudomonas aeruginosa PA01
ccguggcuggggccggccu

SEQ ID NO: 1482267 - RNA, 17 nt, Pseudomonas aeruginosa PA01
ccguggcugugcuggcc

SEQ ID NO: 1482268 - RNA, 14 nt, Pseudomonas aeruginosa PA01
ccguggcucgauga

SEQ ID NO: 1482269 - RNA, 19 nt, Pseudomonas aeruginosa PA01
ccguggcucggcggcaggc

SEQ ID NO: 1482270 - RNA, 19 nt, Pseudomonas aeruginosa PA01
ccgugguccgccagcaggc

SEQ ID NO: 1482271 - RNA, 20 nt, Pseudomonas aeruginosa PA01
ccgugguccgccagcaggcg

SEQ ID NO: 1482272 - RNA, 16 nt, Pseudomonas aeruginosa PA01
ccguggucauggcgca

SEQ ID NO: 1482273 - RNA, 17 nt, Pseudomonas aeruginosa PA01
ccguggucagcaccagg

SEQ ID NO: 1482274 - RNA, 20 nt, Pseudomonas aeruginosa PA01
ccguggucagcaccagggcc

SEQ ID NO: 1482275 - RNA, 19 nt, Pseudomonas aeruginosa PA01
ccgugguggccguggcgcc

SEQ ID NO: 1482276 - RNA, 13 nt, Pseudomonas aeruginosa PA01
ccguggucgcgca

SEQ ID NO: 1482277 - RNA, 16 nt, Pseudomonas aeruginosa PA01
ccguggucgcgcaggc

SEQ ID NO: 1482278 - RNA, 19 nt, Pseudomonas aeruginosa PA01
ccgugcggcguucgccgcg

SEQ ID NO: 1482279 - RNA, 23 nt, Pseudomonas aeruginosa PA01
ccgugcgcgcggccuguucggcc

SEQ ID NO: 1482280 - RNA, 16 nt, Pseudomonas aeruginosa PA01
ccgugcgcaccucgcc

SEQ ID NO: 1482281 - RNA, 12 nt, Pseudomonas aeruginosa PA01
ccgugcgccgcg

SEQ ID NO: 1482282 - RNA, 19 nt, Pseudomonas aeruginosa PA01
ccgugcgcuccgccaggcc

SEQ ID NO: 1482283 - RNA, 24 nt, Pseudomonas aeruginosa PA01
ccgugcgcuccgccaggccgcgca

SEQ ID NO: 1482284 - RNA, 14 nt, Pseudomonas aeruginosa PA01
ccgugcgcugcgcg

SEQ ID NO: 1482285 - RNA, 21 nt, Pseudomonas aeruginosa PA01
ccgugcggagggucaggccga

SEQ ID NO: 1482286 - RNA, 22 nt, Pseudomonas aeruginosa PA01
ccgugcggagggucaggccgag

SEQ ID NO: 1482287 - RNA, 14 nt, Pseudomonas aeruginosa PA01
ccgugccucggcgg

SEQ ID NO: 1482288 - RNA, 15 nt, Pseudomonas aeruginosa PA01
ccgugccucggcgga

SEQ ID NO: 1482289 - RNA, 18 nt, Pseudomonas aeruginosa PA01
ccgugcgaacacaccgac

SEQ ID NO: 1482290 - RNA, 19 nt, Pseudomonas aeruginosa PA01
ccgugcgaacacaccgacc

SEQ ID NO: 1482291 - RNA, 12 nt, Pseudomonas aeruginosa PA01
ccgugcagcagc

SEQ ID NO: 1482292 - RNA, 13 nt, Pseudomonas aeruginosa PA01
ccgugcagcagcg

SEQ ID NO: 1482293 - RNA, 17 nt, Pseudomonas aeruginosa PA01
ccgugcagcagcgaccu

SEQ ID NO: 1482294 - RNA, 12 nt, Pseudomonas aeruginosa PA01
ccgugcagcccu

SEQ ID NO: 1482295 - RNA, 18 nt, Pseudomonas aeruginosa PA01
ccgugccagagcuugagg

SEQ ID NO: 1482296 - RNA, 18 nt, Pseudomonas aeruginosa PA01
ccgugcaucaccggcagc

SEQ ID NO: 1482297 - RNA, 21 nt, Pseudomonas aeruginosa PA01
ccgugcaucaccggcagcagc

SEQ ID NO: 1482298 - RNA, 22 nt, Pseudomonas aeruginosa PA01
ccguccuugaguagcuggcgca

SEQ ID NO: 1482299 - RNA, 14 nt, Pseudomonas aeruginosa PA01
ccguccuucggccg

SEQ ID NO: 1482300 - RNA, 17 nt, Pseudomonas aeruginosa PA01
ccgucgaucuugcaauc

SEQ ID NO: 1482301 - RNA, 20 nt, Pseudomonas aeruginosa PA01
ccgucgcgauagacgccggc

SEQ ID NO: 1482302 - RNA, 21 nt, Pseudomonas aeruginosa PA01
ccgucgcgauagacgccggcg

SEQ ID NO: 1482303 - RNA, 21 nt, Pseudomonas aeruginosa PA01
ccgucgcgaagaccggccggc

SEQ ID NO: 1482304 - RNA, 23 nt, Pseudomonas aeruginosa PA01
ccgucgcgaagaccggccggcuc

SEQ ID NO: 1482305 - RNA, 18 nt, Pseudomonas aeruginosa PA01
ccgucgcgaccuucggug

SEQ ID NO: 1482306 - RNA, 13 nt, Pseudomonas aeruginosa PA01
ccgucgcgcgccc

SEQ ID NO: 1482307 - RNA, 14 nt, Pseudomonas aeruginosa PA01
ccgucgcgcgccgg

SEQ ID NO: 1482308 - RNA, 16 nt, Pseudomonas aeruginosa PA01
ccgucgcgccggccau

SEQ ID NO: 1482309 - RNA, 12 nt, Pseudomonas aeruginosa PA01
ccgucgcccugg

SEQ ID NO: 1482310 - RNA, 15 nt, Pseudomonas aeruginosa PA01
ccgucgcccuggugc

SEQ ID NO: 1482311 - RNA, 19 nt, Pseudomonas aeruginosa PA01
ccgucgcccuggugcacgg

SEQ ID NO: 1482312 - RNA, 17 nt, Pseudomonas aeruginosa PA01
ccgucgccauucggcga

SEQ ID NO: 1482313 - RNA, 20 nt, Pseudomonas aeruginosa PA01
ccgucgggcaguuccgccag

SEQ ID NO: 1482314 - RNA, 16 nt, Pseudomonas aeruginosa PA01
ccgucgggcauggcga

SEQ ID NO: 1482315 - RNA, 17 nt, Pseudomonas aeruginosa PA01
ccgucgggcauggcgau

SEQ ID NO: 1482316 - RNA, 13 nt, Pseudomonas aeruginosa PA01
ccgucgcuggagc

SEQ ID NO: 1482317 - RNA, 21 nt, Pseudomonas aeruginosa PA01
ccgucgcggccaucggcgaag

SEQ ID NO: 1482318 - RNA, 18 nt, Pseudomonas aeruginosa PA01
ccgucggcggucagcuug

SEQ ID NO: 1482319 - RNA, 13 nt, Pseudomonas aeruginosa PA01
ccgucggauggcc

SEQ ID NO: 1482320 - RNA, 18 nt, Pseudomonas aeruginosa PA01
ccgucgcuucgcccgccg

SEQ ID NO: 1482321 - RNA, 22 nt, Pseudomonas aeruginosa PA01
ccgucgcuucgcccgccgccug

SEQ ID NO: 1482322 - RNA, 23 nt, Pseudomonas aeruginosa PA01
ccgucgcuucgcccgccgccugg

SEQ ID NO: 1482323 - RNA, 16 nt, Pseudomonas aeruginosa PA01
cgccgaacgccaccag

SEQ ID NO: 1482324 - RNA, 16 nt, Pseudomonas aeruginosa PA01
cgccgaacgccccagu

SEQ ID NO: 1482325 - RNA, 14 nt, Pseudomonas aeruginosa PA01
cgccgaacggcagc

SEQ ID NO: 1482326 - RNA, 15 nt, Pseudomonas aeruginosa PA01
cgccgaaggcgucgg

SEQ ID NO: 1482327 - RNA, 17 nt, Pseudomonas aeruginosa PA01
cgccgaagggccgcagg

SEQ ID NO: 1482328 - RNA, 13 nt, Pseudomonas aeruginosa PA01
cgccgaaggugaa

SEQ ID NO: 1482329 - RNA, 20 nt, Pseudomonas aeruginosa PA01
cgccgaaggugaaguccggc

SEQ ID NO: 1482330 - RNA, 22 nt, Pseudomonas aeruginosa PA01
cgccgaaggugcaggccgcgcg

SEQ ID NO: 1482331 - RNA, 15 nt, Pseudomonas aeruginosa PA01
cgccgaccagccgca

SEQ ID NO: 1482332 - RNA, 16 nt, Pseudomonas aeruginosa PA01
cgccgaccagccgcag

SEQ ID NO: 1482333 - RNA, 17 nt, Pseudomonas aeruginosa PA01
cgccgaccagccgcagg

SEQ ID NO: 1482334 - RNA, 17 nt, Pseudomonas aeruginosa PA01
cgccgacaucggagugc

SEQ ID NO: 1482335 - RNA, 13 nt, Pseudomonas aeruginosa PA01
cgccgaaguccug

SEQ ID NO: 1482336 - RNA, 19 nt, Pseudomonas aeruginosa PA01
cgccgaaguccugcaacag

SEQ ID NO: 1482337 - RNA, 22 nt, Pseudomonas aeruginosa PA01
cgccgaaguccugcaacagggc

SEQ ID NO: 1482338 - RNA, 15 nt, Pseudomonas aeruginosa PA01
cgccgaagucggcga

SEQ ID NO: 1482339 - RNA, 22 nt, Pseudomonas aeruginosa PA01
cgccgaagucggcgagccggcg

SEQ ID NO: 1482340 - RNA, 20 nt, Pseudomonas aeruginosa PA01
cgccgaaguucuucagcagc

SEQ ID NO: 1482341 - RNA, 21 nt, Pseudomonas aeruginosa PA01
cgccgaaguucuucagcagca

SEQ ID NO: 1482342 - RNA, 19 nt, Pseudomonas aeruginosa PA01
cgccgaagugaucuggcau

SEQ ID NO: 1482343 - RNA, 22 nt, Pseudomonas aeruginosa PA01
cgccgaagugaucuggcauacc

SEQ ID NO: 1482344 - RNA, 17 nt, Pseudomonas aeruginosa PA01
cgccgaagaacucggcg

SEQ ID NO: 1482345 - RNA, 15 nt, Pseudomonas aeruginosa PA01
cgccgaauccaggcc

SEQ ID NO: 1482346 - RNA, 16 nt, Pseudomonas aeruginosa PA01
cgccgaauccaggccg

SEQ ID NO: 1482347 - RNA, 18 nt, Pseudomonas aeruginosa PA01
cgccgaauccaggccgac

SEQ ID NO: 1482348 - RNA, 19 nt, Pseudomonas aeruginosa PA01
cgccgaauccaggccgacg

SEQ ID NO: 1482349 - RNA, 22 nt, Pseudomonas aeruginosa PA01
cgccgaauccaggccgacgaag

SEQ ID NO: 1482350 - RNA, 13 nt, Pseudomonas aeruginosa PA01
cgccgaacagggc

SEQ ID NO: 1482351 - RNA, 22 nt, Pseudomonas aeruginosa PA01
cgccgaacaugccgaagagcuu

SEQ ID NO: 1482352 - RNA, 12 nt, Pseudomonas aeruginosa PA01
cgccgaacagcc

SEQ ID NO: 1482353 - RNA, 14 nt, Pseudomonas aeruginosa PA01
cgccgaacagccgc

SEQ ID NO: 1482354 - RNA, 15 nt, Pseudomonas aeruginosa PA01
cgccgaacagccgcc

SEQ ID NO: 1482355 - RNA, 18 nt, Pseudomonas aeruginosa PA01
cgccgaacagccgcccca

SEQ ID NO: 1482356 - RNA, 19 nt, Pseudomonas aeruginosa PA01
cgccgaacagccgccccac

SEQ ID NO: 1482357 - RNA, 13 nt, Pseudomonas aeruginosa PA01
cgccgaacagcaa

SEQ ID NO: 1482358 - RNA, 14 nt, Pseudomonas aeruginosa PA01
cgccgaacagcaac

SEQ ID NO: 1482359 - RNA, 15 nt, Pseudomonas aeruginosa PA01
cgccgaacagcaaca

SEQ ID NO: 1482360 - RNA, 19 nt, Pseudomonas aeruginosa PA01
cgccgaacagcaacaccgc

SEQ ID NO: 1482361 - RNA, 20 nt, Pseudomonas aeruginosa PA01
cgccgaacagcaacaccgcg

SEQ ID NO: 1482362 - RNA, 21 nt, Pseudomonas aeruginosa PA01
cgccgaacagcaacaccgcgc

SEQ ID NO: 1482363 - RNA, 22 nt, Pseudomonas aeruginosa PA01
cgccgaacagcaacaccgcgca

SEQ ID NO: 1482364 - RNA, 23 nt, Pseudomonas aeruginosa PA01
cgcccuguuucggguccaggcgc

SEQ ID NO: 1482365 - RNA, 12 nt, Pseudomonas aeruginosa PA01
cgcccugggugg

SEQ ID NO: 1482366 - RNA, 15 nt, Pseudomonas aeruginosa PA01
cgcccuguucggcgg

SEQ ID NO: 1482367 - RNA, 16 nt, Pseudomonas aeruginosa PA01
cgcccuguucggcggg

SEQ ID NO: 1482368 - RNA, 18 nt, Pseudomonas aeruginosa PA01
cgcccuguucgucuggcg

SEQ ID NO: 1482369 - RNA, 22 nt, Pseudomonas aeruginosa PA01
cgcccuguucgucuggcgccug

SEQ ID NO: 1482370 - RNA, 19 nt, Pseudomonas aeruginosa PA01
cgcccugggcgcgaauggc

SEQ ID NO: 1482371 - RNA, 14 nt, Pseudomonas aeruginosa PA01
cgcccugggacagg

SEQ ID NO: 1482372 - RNA, 20 nt, Pseudomonas aeruginosa PA01
cgcccugggcgacgcggaca

SEQ ID NO: 1482373 - RNA, 16 nt, Pseudomonas aeruginosa PA01
cgcccuggugcacggc

SEQ ID NO: 1482374 - RNA, 17 nt, Pseudomonas aeruginosa PA01
cgcccuggugcacggcg

SEQ ID NO: 1482375 - RNA, 20 nt, Pseudomonas aeruginosa PA01
cgcccuggugcacggcgacc

SEQ ID NO: 1482376 - RNA, 23 nt, Pseudomonas aeruginosa PA01
cgcccuggugcacggcgacccgc

SEQ ID NO: 1482377 - RNA, 22 nt, Pseudomonas aeruginosa PA01
cgcccugggguuucugcuggcc

SEQ ID NO: 1482378 - RNA, 23 nt, Pseudomonas aeruginosa PA01
cgcccugggguuucugcuggcca

SEQ ID NO: 1482379 - RNA, 22 nt, Pseudomonas aeruginosa PA01
cgcccugaggcuuuccugcgcc

SEQ ID NO: 1482380 - RNA, 15 nt, Pseudomonas aeruginosa PA01
cgcccugacgaugca

SEQ ID NO: 1482381 - RNA, 20 nt, Pseudomonas aeruginosa PA01
cgcccugacccgcaccggca

SEQ ID NO: 1482382 - RNA, 18 nt, Pseudomonas aeruginosa PA01
cgcccucgcucguuccgc

SEQ ID NO: 1482383 - RNA, 19 nt, Pseudomonas aeruginosa PA01
cgcccucgcucguuccgcg

SEQ ID NO: 1482384 - RNA, 14 nt, Pseudomonas aeruginosa PA01
cgcccucguggcgg

SEQ ID NO: 1482385 - RNA, 15 nt, Pseudomonas aeruginosa PA01
cgcccucguggcggg

SEQ ID NO: 1482386 - RNA, 22 nt, Pseudomonas aeruginosa PA01
cgcccucucaggagcgccgcgc

SEQ ID NO: 1482387 - RNA, 14 nt, Pseudomonas aeruginosa PA01
cgcccugcaggccg

SEQ ID NO: 1482388 - RNA, 16 nt, Pseudomonas aeruginosa PA01
cgcccugcaggccgaa

SEQ ID NO: 1482389 - RNA, 20 nt, Pseudomonas aeruginosa PA01
cgcccugcaacacguagcgc

SEQ ID NO: 1482390 - RNA, 16 nt, Pseudomonas aeruginosa PA01
cgcccugcaccuuggg

SEQ ID NO: 1482391 - RNA, 17 nt, Pseudomonas aeruginosa PA01
cgcccuggcucuugccg

SEQ ID NO: 1482392 - RNA, 14 nt, Pseudomonas aeruginosa PA01
cgcccuggccgucg

SEQ ID NO: 1482393 - RNA, 20 nt, Pseudomonas aeruginosa PA01
cgcccuggccgucggccugc

SEQ ID NO: 1482394 - RNA, 13 nt, Pseudomonas aeruginosa PA01
cgcccuggccucg

SEQ ID NO: 1482395 - RNA, 14 nt, Pseudomonas aeruginosa PA01
cgcccuggcgcuug

SEQ ID NO: 1482396 - RNA, 23 nt, Pseudomonas aeruginosa PA01
cgccgagggcuguaaucgccgcu

SEQ ID NO: 1482397 - RNA, 16 nt, Pseudomonas aeruginosa PA01
cgccgaggggcgggau

SEQ ID NO: 1482398 - RNA, 17 nt, Pseudomonas aeruginosa PA01
cgccgaggucuuggcca

SEQ ID NO: 1482399 - RNA, 18 nt, Pseudomonas aeruginosa PA01
cgccgaggugcggcuugc

SEQ ID NO: 1482400 - RNA, 19 nt, Pseudomonas aeruginosa PA01
cgccgaggugcugcaccgg

SEQ ID NO: 1482401 - RNA, 18 nt, Pseudomonas aeruginosa PA01
cgccgagguugcgcagga

SEQ ID NO: 1482402 - RNA, 20 nt, Pseudomonas aeruginosa PA01
cgccgagguugcugcggcau

SEQ ID NO: 1482403 - RNA, 22 nt, Pseudomonas aeruginosa PA01
cgccgaguacacaaugaucgcg

SEQ ID NO: 1482404 - RNA, 14 nt, Pseudomonas aeruginosa PA01
cgccgagggcgcgg

SEQ ID NO: 1482405 - RNA, 13 nt, Pseudomonas aeruginosa PA01
cgccgagggcgaa

SEQ ID NO: 1482406 - RNA, 17 nt, Pseudomonas aeruginosa PA01
cgccgagggcaccgacg

SEQ ID NO: 1482407 - RNA, 22 nt, Pseudomonas aeruginosa PA01
cgccgagggcaccgacgauggg

SEQ ID NO: 1482408 - RNA, 23 nt, Pseudomonas aeruginosa PA01
cgccgagggcaccgacgaugggc

SEQ ID NO: 1482409 - RNA, 13 nt, Pseudomonas aeruginosa PA01
cgccgaggucagu

SEQ ID NO: 1482410 - RNA, 22 nt, Pseudomonas aeruginosa PA01
cgccgaggucaguucggugccg

SEQ ID NO: 1482411 - RNA, 22 nt, Pseudomonas aeruginosa PA01
cgccgagcugauugagggucag

SEQ ID NO: 1482412 - RNA, 16 nt, Pseudomonas aeruginosa PA01
cgccgauacaccacca

SEQ ID NO: 1482413 - RNA, 22 nt, Pseudomonas aeruginosa PA01
cgccgauacaccaccauaccga

SEQ ID NO: 1482414 - RNA, 18 nt, Pseudomonas aeruginosa PA01
cgccgauacagcgcgcga

SEQ ID NO: 1482415 - RNA, 14 nt, Pseudomonas aeruginosa PA01
cgccgagugugccg

SEQ ID NO: 1482416 - RNA, 16 nt, Pseudomonas aeruginosa PA01
cgccgagugugccggc

SEQ ID NO: 1482417 - RNA, 17 nt, Pseudomonas aeruginosa PA01
cgccgagugugccggcc

SEQ ID NO: 1482418 - RNA, 23 nt, Pseudomonas aeruginosa PA01
cgccgagugugccggccaugcag

SEQ ID NO: 1482419 - RNA, 17 nt, Pseudomonas aeruginosa PA01
cgccgaguucgccgcga

SEQ ID NO: 1482420 - RNA, 23 nt, Pseudomonas aeruginosa PA01
cgccgaguucgccgcgagcacca

SEQ ID NO: 1482421 - RNA, 14 nt, Pseudomonas aeruginosa PA01
cgccgagcaccccg

SEQ ID NO: 1482422 - RNA, 13 nt, Pseudomonas aeruginosa PA01
cgccgagcaacgg

SEQ ID NO: 1482423 - RNA, 18 nt, Pseudomonas aeruginosa PA01
cgccgagcaacggcagca

SEQ ID NO: 1482424 - RNA, 20 nt, Pseudomonas aeruginosa PA01
cgccgagcaacggcagcaug

SEQ ID NO: 1482425 - RNA, 13 nt, Pseudomonas aeruginosa PA01
cgccgagcaagcc

SEQ ID NO: 1482426 - RNA, 13 nt, Pseudomonas aeruginosa PA01
cgccgagcaaccg

SEQ ID NO: 1482427 - RNA, 21 nt, Pseudomonas aeruginosa PA01
cgccgagcaaccgcgauggcg

SEQ ID NO: 1482428 - RNA, 17 nt, Pseudomonas aeruginosa PA01
cgccgagcgccgccagg

SEQ ID NO: 1482429 - RNA, 18 nt, Pseudomonas aeruginosa PA01
cgccgagcgccgccaggc

SEQ ID NO: 1482430 - RNA, 23 nt, Pseudomonas aeruginosa PA01
cgccgagcgccgccaggcaggcc

SEQ ID NO: 1482431 - RNA, 14 nt, Pseudomonas aeruginosa PA01
cgccgagcgccugg

SEQ ID NO: 1482432 - RNA, 16 nt, Pseudomonas aeruginosa PA01
cgccgagcgccuggca

SEQ ID NO: 1482433 - RNA, 14 nt, Pseudomonas aeruginosa PA01
cgccgagcgcucgc

SEQ ID NO: 1482434 - RNA, 15 nt, Pseudomonas aeruginosa PA01
cgccgagcgcucgcc

SEQ ID NO: 1482435 - RNA, 16 nt, Pseudomonas aeruginosa PA01
cgccgagcgcucgccg

SEQ ID NO: 1482436 - RNA, 21 nt, Pseudomonas aeruginosa PA01
cgccgagcgcucgccgucauc

SEQ ID NO: 1482437 - RNA, 17 nt, Pseudomonas aeruginosa PA01
cgccgagcugaccacca

SEQ ID NO: 1482438 - RNA, 18 nt, Pseudomonas aeruginosa PA01
cgccgagcugaccaccag

SEQ ID NO: 1482439 - RNA, 18 nt, Pseudomonas aeruginosa PA01
cgccgagcguugggccuc

SEQ ID NO: 1482440 - RNA, 22 nt, Pseudomonas aeruginosa PA01
cgccgaggaacuucaugaugcg

SEQ ID NO: 1482441 - RNA, 17 nt, Pseudomonas aeruginosa PA01
cgccgaggaagccgacc

SEQ ID NO: 1482442 - RNA, 20 nt, Pseudomonas aeruginosa PA01
cgccgaggaagccgaccggc

SEQ ID NO: 1482443 - RNA, 17 nt, Pseudomonas aeruginosa PA01
cgccgaggaacauccgc

SEQ ID NO: 1482444 - RNA, 20 nt, Pseudomonas aeruginosa PA01
cgccgaggaacauccgcggc

SEQ ID NO: 1482445 - RNA, 22 nt, Pseudomonas aeruginosa PA01
cgccgacgucguggauaggcgg

SEQ ID NO: 1482446 - RNA, 23 nt, Pseudomonas aeruginosa PA01
cgccgacgucguggauaggcggc

SEQ ID NO: 1482447 - RNA, 20 nt, Pseudomonas aeruginosa PA01
cgccgacggcuucgaccacg

SEQ ID NO: 1482448 - RNA, 18 nt, Pseudomonas aeruginosa PA01
cgccgacggcgugccgug

SEQ ID NO: 1482449 - RNA, 19 nt, Pseudomonas aeruginosa PA01
cgccgacggcgugccgugg

SEQ ID NO: 1482450 - RNA, 23 nt, Pseudomonas aeruginosa PA01
cgccgaccguggcgacaggcgau

SEQ ID NO: 1482451 - RNA, 23 nt, Pseudomonas aeruginosa PA01
cgccgacccagagcgcgcccugc

SEQ ID NO: 1482452 - RNA, 16 nt, Pseudomonas aeruginosa PA01
cgccgaccaggcggcc

SEQ ID NO: 1482453 - RNA, 17 nt, Pseudomonas aeruginosa PA01
cgccgaccaggcggccg

SEQ ID NO: 1482454 - RNA, 20 nt, Pseudomonas aeruginosa PA01
cgccgaccaggcggccgucg

SEQ ID NO: 1482455 - RNA, 15 nt, Pseudomonas aeruginosa PA01
cgccgaccagguccg

SEQ ID NO: 1482456 - RNA, 19 nt, Pseudomonas aeruginosa PA01
cgccgaccagguccgccac

SEQ ID NO: 1482457 - RNA, 19 nt, Pseudomonas aeruginosa PA01
cgccgaccagcuugggcac

SEQ ID NO: 1482458 - RNA, 23 nt, Pseudomonas aeruginosa PA01
cgccgacgacccggauaccccgg

SEQ ID NO: 1482459 - RNA, 12 nt, Pseudomonas aeruginosa PA01
cgcccccucccc

SEQ ID NO: 1482460 - RNA, 13 nt, Pseudomonas aeruginosa PA01
cgcccccuggccg

SEQ ID NO: 1482461 - RNA, 19 nt, Pseudomonas aeruginosa PA01
cgccaugccguucaggccg

SEQ ID NO: 1482462 - RNA, 20 nt, Pseudomonas aeruginosa PA01
cgccaugccguucaggccgg

SEQ ID NO: 1482463 - RNA, 21 nt, Pseudomonas aeruginosa PA01
cgccaugccguucaggccggc

SEQ ID NO: 1482464 - RNA, 14 nt, Pseudomonas aeruginosa PA01
cgcccccggcgcca

SEQ ID NO: 1482465 - RNA, 16 nt, Pseudomonas aeruginosa PA01
cgcccccggcgccacc

SEQ ID NO: 1482466 - RNA, 22 nt, Pseudomonas aeruginosa PA01
cgccaugcaugauuucguuggc

SEQ ID NO: 1482467 - RNA, 14 nt, Pseudomonas aeruginosa PA01
cgccaugccggcgc

SEQ ID NO: 1482468 - RNA, 16 nt, Pseudomonas aeruginosa PA01
cgccaugccggcgccg

SEQ ID NO: 1482469 - RNA, 13 nt, Pseudomonas aeruginosa PA01
cgccccggcggcg

SEQ ID NO: 1482470 - RNA, 14 nt, Pseudomonas aeruginosa PA01
cgccccggcggcga

SEQ ID NO: 1482471 - RNA, 21 nt, Pseudomonas aeruginosa PA01
cgcccgaccccacgccggccg

SEQ ID NO: 1482472 - RNA, 13 nt, Pseudomonas aeruginosa PA01
cgccccggccgcg

SEQ ID NO: 1482473 - RNA, 16 nt, Pseudomonas aeruginosa PA01
cgccccggccgcgcca

SEQ ID NO: 1482474 - RNA, 19 nt, Pseudomonas aeruginosa PA01
cgccccggccgcgccagcc

SEQ ID NO: 1482475 - RNA, 13 nt, Pseudomonas aeruginosa PA01
cgccccggcagcc

SEQ ID NO: 1482476 - RNA, 13 nt, Pseudomonas aeruginosa PA01
cgccccgccuacc

SEQ ID NO: 1482477 - RNA, 13 nt, Pseudomonas aeruginosa PA01
cgccccgccggga

SEQ ID NO: 1482478 - RNA, 24 nt, Pseudomonas aeruginosa PA01
cgccccgccgggagcggccgugca

SEQ ID NO: 1482479 - RNA, 12 nt, Pseudomonas aeruginosa PA01
cgccccgccagg

SEQ ID NO: 1482480 - RNA, 15 nt, Pseudomonas aeruginosa PA01
cgccccgcaccagcc

SEQ ID NO: 1482481 - RNA, 22 nt, Pseudomonas aeruginosa PA01
cgccccggcaagcgccggcaac

SEQ ID NO: 1482482 - RNA, 14 nt, Pseudomonas aeruginosa PA01
cgccccgcuugccg

SEQ ID NO: 1482483 - RNA, 18 nt, Pseudomonas aeruginosa PA01
cgccccgcuugccgucga

SEQ ID NO: 1482484 - RNA, 15 nt, Pseudomonas aeruginosa PA01
cgcccgaucgccucg

SEQ ID NO: 1482485 - RNA, 18 nt, Pseudomonas aeruginosa PA01
cgcccgaucgccucgucg

SEQ ID NO: 1482486 - RNA, 19 nt, Pseudomonas aeruginosa PA01
cgcccgaucgccucgucga

SEQ ID NO: 1482487 - RNA, 19 nt, Pseudomonas aeruginosa PA01
cgcccgauaggcgccggcg

SEQ ID NO: 1482488 - RNA, 21 nt, Pseudomonas aeruginosa PA01
cgcccgauaggcgccggcgcg

SEQ ID NO: 1482489 - RNA, 22 nt, Pseudomonas aeruginosa PA01
cgcccgauaggcgccggcgcgc

SEQ ID NO: 1482490 - RNA, 17 nt, Pseudomonas aeruginosa PA01
cgcccgaggcgaccuug

SEQ ID NO: 1482491 - RNA, 17 nt, Pseudomonas aeruginosa PA01
cgcccgagucccuugcg

SEQ ID NO: 1482492 - RNA, 13 nt, Pseudomonas aeruginosa PA01
cgcccgagggcgc

SEQ ID NO: 1482493 - RNA, 17 nt, Pseudomonas aeruginosa PA01
cgcccgagggcgccguu

SEQ ID NO: 1482494 - RNA, 12 nt, Pseudomonas aeruginosa PA01
cgcccgccggcc

SEQ ID NO: 1482495 - RNA, 15 nt, Pseudomonas aeruginosa PA01
cgcccgccggcgugc

SEQ ID NO: 1482496 - RNA, 13 nt, Pseudomonas aeruginosa PA01
cgcccgccgccug

SEQ ID NO: 1482497 - RNA, 16 nt, Pseudomonas aeruginosa PA01
cgcccgccgccuggug

SEQ ID NO: 1482498 - RNA, 12 nt, Pseudomonas aeruginosa PA01
cgcccgccgcga

SEQ ID NO: 1482499 - RNA, 14 nt, Pseudomonas aeruginosa PA01
cgcccgccgucgcc

SEQ ID NO: 1482500 - RNA, 15 nt, Pseudomonas aeruginosa PA01
cgcccgccgucgccc

SEQ ID NO: 1482501 - RNA, 16 nt, Pseudomonas aeruginosa PA01
cgcccgcccggcacca

SEQ ID NO: 1482502 - RNA, 15 nt, Pseudomonas aeruginosa PA01
cgcccgcccucgucg

SEQ ID NO: 1482503 - RNA, 22 nt, Pseudomonas aeruginosa PA01
cgcccgugggguauuccaggcg

SEQ ID NO: 1482504 - RNA, 23 nt, Pseudomonas aeruginosa PA01
cgcccgugggguauuccaggcga

SEQ ID NO: 1482505 - RNA, 17 nt, Pseudomonas aeruginosa PA01
cgcccuaccccaggggu

SEQ ID NO: 1482506 - RNA, 12 nt, Pseudomonas aeruginosa PA01
cgcccuacccga

SEQ ID NO: 1482507 - RNA, 16 nt, Pseudomonas aeruginosa PA01
cgcccuacccgacagg

SEQ ID NO: 1482508 - RNA, 15 nt, Pseudomonas aeruginosa PA01
cgcccuaccguccgc

SEQ ID NO: 1482509 - RNA, 23 nt, Pseudomonas aeruginosa PA01
cgcccuaccugucccggacgacg

SEQ ID NO: 1482510 - RNA, 19 nt, Pseudomonas aeruginosa PA01
cgcccuacgcggcaccgcu

SEQ ID NO: 1482511 - RNA, 16 nt, Pseudomonas aeruginosa PA01
cgcccuacggaucggg

SEQ ID NO: 1482512 - RNA, 17 nt, Pseudomonas aeruginosa PA01
cgcccuacggccccagg

SEQ ID NO: 1482513 - RNA, 18 nt, Pseudomonas aeruginosa PA01
cgcccuacggccccaggc

SEQ ID NO: 1482514 - RNA, 22 nt, Pseudomonas aeruginosa PA01
cgcccuacggggcgugucgagg

SEQ ID NO: 1482515 - RNA, 14 nt, Pseudomonas aeruginosa PA01
cgcccuacgggggc

SEQ ID NO: 1482516 - RNA, 17 nt, Pseudomonas aeruginosa PA01
cgcccuacuccaggggu

SEQ ID NO: 1482517 - RNA, 15 nt, Pseudomonas aeruginosa PA01
cgcccuagcgguccg

SEQ ID NO: 1482518 - RNA, 19 nt, Pseudomonas aeruginosa PA01
cgcccucaagucuccagcg

SEQ ID NO: 1482519 - RNA, 20 nt, Pseudomonas aeruginosa PA01
cgcccucaagucuccagcga

SEQ ID NO: 1482520 - RNA, 12 nt, Pseudomonas aeruginosa PA01
cgcccgucgcgc

SEQ ID NO: 1482521 - RNA, 17 nt, Pseudomonas aeruginosa PA01
cgcccgucgcgccggcc

SEQ ID NO: 1482522 - RNA, 19 nt, Pseudomonas aeruginosa PA01
cgcccgucgcgccggccau

SEQ ID NO: 1482523 - RNA, 23 nt, Pseudomonas aeruginosa PA01
cgcccguccuccaaagccuggag

SEQ ID NO: 1482524 - RNA, 14 nt, Pseudomonas aeruginosa PA01
cgcccgucgucgug

SEQ ID NO: 1482525 - RNA, 17 nt, Pseudomonas aeruginosa PA01
cgcccgucgucguggcg

SEQ ID NO: 1482526 - RNA, 14 nt, Pseudomonas aeruginosa PA01
cgcccgucaugacc

SEQ ID NO: 1482527 - RNA, 14 nt, Pseudomonas aeruginosa PA01
cgcccguagcacau

SEQ ID NO: 1482528 - RNA, 15 nt, Pseudomonas aeruginosa PA01
cgcccguagcacaug

SEQ ID NO: 1482529 - RNA, 14 nt, Pseudomonas aeruginosa PA01
cgcccucagcagcg

SEQ ID NO: 1482530 - RNA, 15 nt, Pseudomonas aeruginosa PA01
cgcccucagcagcgc

SEQ ID NO: 1482531 - RNA, 21 nt, Pseudomonas aeruginosa PA01
cgcccucagcagcgccgcccu

SEQ ID NO: 1482532 - RNA, 22 nt, Pseudomonas aeruginosa PA01
cgcccuccagcaccgccuggcg

SEQ ID NO: 1482533 - RNA, 13 nt, Pseudomonas aeruginosa PA01
cgcccucggcgac

SEQ ID NO: 1482534 - RNA, 15 nt, Pseudomonas aeruginosa PA01
cgcccucggccaggc

SEQ ID NO: 1482535 - RNA, 16 nt, Pseudomonas aeruginosa PA01
cgcccucggccaggca

SEQ ID NO: 1482536 - RNA, 17 nt, Pseudomonas aeruginosa PA01
cgcccucggccaggcau

SEQ ID NO: 1482537 - RNA, 14 nt, Pseudomonas aeruginosa PA01
cgcccucgucgcac

SEQ ID NO: 1482538 - RNA, 15 nt, Pseudomonas aeruginosa PA01
cgcccucgucgcacc

SEQ ID NO: 1482539 - RNA, 17 nt, Pseudomonas aeruginosa PA01
cgcccucgucgcaccug

SEQ ID NO: 1482540 - RNA, 13 nt, Pseudomonas aeruginosa PA01
cgcccucgggccg

SEQ ID NO: 1482541 - RNA, 16 nt, Pseudomonas aeruginosa PA01
cgcccucggggccgag

SEQ ID NO: 1482542 - RNA, 23 nt, Pseudomonas aeruginosa PA01
cgcccucggugauaccgccggcg

SEQ ID NO: 1482543 - RNA, 12 nt, Pseudomonas aeruginosa PA01
cgcccucggcgc

SEQ ID NO: 1482544 - RNA, 19 nt, Pseudomonas aeruginosa PA01
cgcccucggcgcuggccag

SEQ ID NO: 1482545 - RNA, 13 nt, Pseudomonas aeruginosa PA01
cgcccgcgggcgc

SEQ ID NO: 1482546 - RNA, 16 nt, Pseudomonas aeruginosa PA01
cgcccgcggcagcagc

SEQ ID NO: 1482547 - RNA, 18 nt, Pseudomonas aeruginosa PA01
cgcccgcggaccgggcgg

SEQ ID NO: 1482548 - RNA, 19 nt, Pseudomonas aeruginosa PA01
cgcccgccucaggccggga

SEQ ID NO: 1482549 - RNA, 13 nt, Pseudomonas aeruginosa PA01
cgcccgccucgga

SEQ ID NO: 1482550 - RNA, 14 nt, Pseudomonas aeruginosa PA01
cgcccgcggcggcg

SEQ ID NO: 1482551 - RNA, 15 nt, Pseudomonas aeruginosa PA01
cgcccgcggcggcga

SEQ ID NO: 1482552 - RNA, 13 nt, Pseudomonas aeruginosa PA01
cgcccgcggcguu

SEQ ID NO: 1482553 - RNA, 14 nt, Pseudomonas aeruginosa PA01
cgcccgcgggcagc

SEQ ID NO: 1482554 - RNA, 22 nt, Pseudomonas aeruginosa PA01
cgcccgcucaagggcuggcagg

SEQ ID NO: 1482555 - RNA, 19 nt, Pseudomonas aeruginosa PA01
cgcccgcuugcgccgccuc

SEQ ID NO: 1482556 - RNA, 20 nt, Pseudomonas aeruginosa PA01
cgcccgcuugcgccgccucg

SEQ ID NO: 1482557 - RNA, 24 nt, Pseudomonas aeruginosa PA01
cgcccgcuugcgccgccucgcgca

SEQ ID NO: 1482558 - RNA, 24 nt, Pseudomonas aeruginosa PA01
cgcccggaaaaaaaagcccgcacg

SEQ ID NO: 1482559 - RNA, 14 nt, Pseudomonas aeruginosa PA01
cgcccggagcgcga

SEQ ID NO: 1482560 - RNA, 22 nt, Pseudomonas aeruginosa PA01
cgcccggagcuuugcagggcga

SEQ ID NO: 1482561 - RNA, 14 nt, Pseudomonas aeruginosa PA01
cgcccggaccgauc

SEQ ID NO: 1482562 - RNA, 23 nt, Pseudomonas aeruginosa PA01
cgcccggaccgaucucguucggg

SEQ ID NO: 1482563 - RNA, 16 nt, Pseudomonas aeruginosa PA01
cgcccgggcgccaccg

SEQ ID NO: 1482564 - RNA, 17 nt, Pseudomonas aeruginosa PA01
cgcccgggcgccaccga

SEQ ID NO: 1482565 - RNA, 13 nt, Pseudomonas aeruginosa PA01
cgcccgggccggg

SEQ ID NO: 1482566 - RNA, 15 nt, Pseudomonas aeruginosa PA01
cgcccggcaccaccg

SEQ ID NO: 1482567 - RNA, 15 nt, Pseudomonas aeruginosa PA01
cgcccggcuucggcg

SEQ ID NO: 1482568 - RNA, 24 nt, Pseudomonas aeruginosa PA01
cgcccggcuucggcggcgcgcugc

SEQ ID NO: 1482569 - RNA, 14 nt, Pseudomonas aeruginosa PA01
cgcccggcuugagg

SEQ ID NO: 1482570 - RNA, 17 nt, Pseudomonas aeruginosa PA01
cgcccggcuuuccucgg

SEQ ID NO: 1482571 - RNA, 19 nt, Pseudomonas aeruginosa PA01
cgcccggcuuuccucggcc

SEQ ID NO: 1482572 - RNA, 12 nt, Pseudomonas aeruginosa PA01
cgcccggcucgg

SEQ ID NO: 1482573 - RNA, 17 nt, Pseudomonas aeruginosa PA01
cgcccggcucggccgug

SEQ ID NO: 1482574 - RNA, 12 nt, Pseudomonas aeruginosa PA01
cgcccggcuucg

SEQ ID NO: 1482575 - RNA, 18 nt, Pseudomonas aeruginosa PA01
cgcccggcaaucaggcgc

SEQ ID NO: 1482576 - RNA, 19 nt, Pseudomonas aeruginosa PA01
cgcccggcaaucaggcgcg

SEQ ID NO: 1482577 - RNA, 20 nt, Pseudomonas aeruginosa PA01
cgcccggcaaucaggcgcga

SEQ ID NO: 1482578 - RNA, 14 nt, Pseudomonas aeruginosa PA01
cgcccggcacgcuc

SEQ ID NO: 1482579 - RNA, 17 nt, Pseudomonas aeruginosa PA01
cgcccggcacucgccgg

SEQ ID NO: 1482580 - RNA, 18 nt, Pseudomonas aeruginosa PA01
cgcccggcacucgccggg

SEQ ID NO: 1482581 - RNA, 15 nt, Pseudomonas aeruginosa PA01
cgcccggcagcaggc

SEQ ID NO: 1482582 - RNA, 19 nt, Pseudomonas aeruginosa PA01
cgcccggcagcaggccgcc

SEQ ID NO: 1482583 - RNA, 17 nt, Pseudomonas aeruginosa PA01
cgcccggcucgaccuug

SEQ ID NO: 1482584 - RNA, 17 nt, Pseudomonas aeruginosa PA01
cgcccggcucgccgccg

SEQ ID NO: 1482585 - RNA, 18 nt, Pseudomonas aeruginosa PA01
cgcccggcucgccgccgg

SEQ ID NO: 1482586 - RNA, 21 nt, Pseudomonas aeruginosa PA01
cgcccggcucgccgccgggcg

SEQ ID NO: 1482587 - RNA, 13 nt, Pseudomonas aeruginosa PA01
cgccgcggcgcgg

SEQ ID NO: 1482588 - RNA, 16 nt, Pseudomonas aeruginosa PA01
cgccgcggcgcggaga

SEQ ID NO: 1482589 - RNA, 22 nt, Pseudomonas aeruginosa PA01
cgccgcggcggcgugcaggccg

SEQ ID NO: 1482590 - RNA, 23 nt, Pseudomonas aeruginosa PA01
cgccgcggcguuagccgccugcg

SEQ ID NO: 1482591 - RNA, 14 nt, Pseudomonas aeruginosa PA01
cgccgcgggcaacc

SEQ ID NO: 1482592 - RNA, 19 nt, Pseudomonas aeruginosa PA01
cgccgcgggcguugcgcgc

SEQ ID NO: 1482593 - RNA, 14 nt, Pseudomonas aeruginosa PA01
cgccgcgggcgcua

SEQ ID NO: 1482594 - RNA, 22 nt, Pseudomonas aeruginosa PA01
cgccgcggguuccucacggcgc

SEQ ID NO: 1482595 - RNA, 13 nt, Pseudomonas aeruginosa PA01
cgccgcggccagc

SEQ ID NO: 1482596 - RNA, 15 nt, Pseudomonas aeruginosa PA01
cgccgcggccagccc

SEQ ID NO: 1482597 - RNA, 21 nt, Pseudomonas aeruginosa PA01
cgccgcggaaucgcguagcgc

SEQ ID NO: 1482598 - RNA, 21 nt, Pseudomonas aeruginosa PA01
cgccgcggcaaugcggcgaug

SEQ ID NO: 1482599 - RNA, 15 nt, Pseudomonas aeruginosa PA01
cgccgcggcaccggc

SEQ ID NO: 1482600 - RNA, 20 nt, Pseudomonas aeruginosa PA01
cgccgcggcaccggcgacga

SEQ ID NO: 1482601 - RNA, 18 nt, Pseudomonas aeruginosa PA01
cgccgcggcagaucccau

SEQ ID NO: 1482602 - RNA, 14 nt, Pseudomonas aeruginosa PA01
cgccgcggcgaagc

SEQ ID NO: 1482603 - RNA, 12 nt, Pseudomonas aeruginosa PA01
cgccgcggcgaa

SEQ ID NO: 1482604 - RNA, 17 nt, Pseudomonas aeruginosa PA01
cgccgcggccggcgacc

SEQ ID NO: 1482605 - RNA, 22 nt, Pseudomonas aeruginosa PA01
cgccgcggccggcgaccuuguc

SEQ ID NO: 1482606 - RNA, 15 nt, Pseudomonas aeruginosa PA01
cgccgcggcccggcg

SEQ ID NO: 1482607 - RNA, 16 nt, Pseudomonas aeruginosa PA01
cgccgcgccucgucgc

SEQ ID NO: 1482608 - RNA, 15 nt, Pseudomonas aeruginosa PA01
cgccgcgccugcugc

SEQ ID NO: 1482609 - RNA, 14 nt, Pseudomonas aeruginosa PA01
cgccgcgcgcgcgg

SEQ ID NO: 1482610 - RNA, 18 nt, Pseudomonas aeruginosa PA01
cgccgcgcguucgcgcga

SEQ ID NO: 1482611 - RNA, 19 nt, Pseudomonas aeruginosa PA01
cgccgcgcugauaucgaua

SEQ ID NO: 1482612 - RNA, 13 nt, Pseudomonas aeruginosa PA01
cgccgcgcuuggc

SEQ ID NO: 1482613 - RNA, 20 nt, Pseudomonas aeruginosa PA01
cgccgcgcuuggccuugccg

SEQ ID NO: 1482614 - RNA, 17 nt, Pseudomonas aeruginosa PA01
cgccgcgcugcgccagg

SEQ ID NO: 1482615 - RNA, 14 nt, Pseudomonas aeruginosa PA01
cgccgcgcccggcg

SEQ ID NO: 1482616 - RNA, 17 nt, Pseudomonas aeruginosa PA01
cgccgcgcccggcgcca

SEQ ID NO: 1482617 - RNA, 19 nt, Pseudomonas aeruginosa PA01
cgccgcgcccggcgccagg

SEQ ID NO: 1482618 - RNA, 13 nt, Pseudomonas aeruginosa PA01
cgccgcgccgccg

SEQ ID NO: 1482619 - RNA, 14 nt, Pseudomonas aeruginosa PA01
cgccgcgccgccga

SEQ ID NO: 1482620 - RNA, 14 nt, Pseudomonas aeruginosa PA01
cgccgcgccggcga

SEQ ID NO: 1482621 - RNA, 16 nt, Pseudomonas aeruginosa PA01
cgccgcgccggcgauc

SEQ ID NO: 1482622 - RNA, 12 nt, Pseudomonas aeruginosa PA01
cgccgcgcaucc

SEQ ID NO: 1482623 - RNA, 19 nt, Pseudomonas aeruginosa PA01
cgccgcgcauccucggcau

SEQ ID NO: 1482624 - RNA, 20 nt, Pseudomonas aeruginosa PA01
cgccgcgcauccucggcauc

SEQ ID NO: 1482625 - RNA, 20 nt, Pseudomonas aeruginosa PA01
cgccgcgccaacuggcgcaa

SEQ ID NO: 1482626 - RNA, 13 nt, Pseudomonas aeruginosa PA01
cgccgcgccagca

SEQ ID NO: 1482627 - RNA, 14 nt, Pseudomonas aeruginosa PA01
cgccggacgcacca

SEQ ID NO: 1482628 - RNA, 23 nt, Pseudomonas aeruginosa PA01
cgccggacgcaccagcaggccga

SEQ ID NO: 1482629 - RNA, 18 nt, Pseudomonas aeruginosa PA01
cgccggcaacagcagcag

SEQ ID NO: 1482630 - RNA, 19 nt, Pseudomonas aeruginosa PA01
cgccggauuucacggcgga

SEQ ID NO: 1482631 - RNA, 23 nt, Pseudomonas aeruginosa PA01
cgccggcacggcaucgauccgca

SEQ ID NO: 1482632 - RNA, 15 nt, Pseudomonas aeruginosa PA01
cgccggcaccgucga

SEQ ID NO: 1482633 - RNA, 17 nt, Pseudomonas aeruginosa PA01
cgccggcaccgucgagc

SEQ ID NO: 1482634 - RNA, 21 nt, Pseudomonas aeruginosa PA01
cgccgcuggggaccgcaccug

SEQ ID NO: 1482635 - RNA, 17 nt, Pseudomonas aeruginosa PA01
cgccgcuggccuggcca

SEQ ID NO: 1482636 - RNA, 21 nt, Pseudomonas aeruginosa PA01
cgccgcuggccuggccacccu

SEQ ID NO: 1482637 - RNA, 16 nt, Pseudomonas aeruginosa PA01
cgccgcuggcgaggau

SEQ ID NO: 1482638 - RNA, 23 nt, Pseudomonas aeruginosa PA01
cgccgcuggcgaggauuuccucg

SEQ ID NO: 1482639 - RNA, 14 nt, Pseudomonas aeruginosa PA01
cgccgcuggcgcug

SEQ ID NO: 1482640 - RNA, 23 nt, Pseudomonas aeruginosa PA01
cgccgcugggcagcacgcuggcg

SEQ ID NO: 1482641 - RNA, 13 nt, Pseudomonas aeruginosa PA01
cgccgcuggcggc

SEQ ID NO: 1482642 - RNA, 19 nt, Pseudomonas aeruginosa PA01
cgccgcuggcggcaugccg

SEQ ID NO: 1482643 - RNA, 18 nt, Pseudomonas aeruginosa PA01
cgccgcuggcggcgcuca

SEQ ID NO: 1482644 - RNA, 21 nt, Pseudomonas aeruginosa PA01
cgccgcugucuaucugcgccg

SEQ ID NO: 1482645 - RNA, 12 nt, Pseudomonas aeruginosa PA01
cgccgcugugca

SEQ ID NO: 1482646 - RNA, 17 nt, Pseudomonas aeruginosa PA01
cgccgcugugcaggguc

SEQ ID NO: 1482647 - RNA, 19 nt, Pseudomonas aeruginosa PA01
cgccgcugugcagggucag

SEQ ID NO: 1482648 - RNA, 17 nt, Pseudomonas aeruginosa PA01
cgccggaaguggcagcg

SEQ ID NO: 1482649 - RNA, 20 nt, Pseudomonas aeruginosa PA01
cgccggaaguggcagcgccg

SEQ ID NO: 1482650 - RNA, 21 nt, Pseudomonas aeruginosa PA01
cgccggaccagaucggcgcgc

SEQ ID NO: 1482651 - RNA, 15 nt, Pseudomonas aeruginosa PA01
cgccggaccagccgg

SEQ ID NO: 1482652 - RNA, 16 nt, Pseudomonas aeruginosa PA01
cgccggaccagccggu

SEQ ID NO: 1482653 - RNA, 13 nt, Pseudomonas aeruginosa PA01
cgccggacaggcc

SEQ ID NO: 1482654 - RNA, 16 nt, Pseudomonas aeruginosa PA01
cgccggacaggccacc

SEQ ID NO: 1482655 - RNA, 16 nt, Pseudomonas aeruginosa PA01
cgccgcgggccagccg

SEQ ID NO: 1482656 - RNA, 15 nt, Pseudomonas aeruginosa PA01
cgccgcgggucacca

SEQ ID NO: 1482657 - RNA, 17 nt, Pseudomonas aeruginosa PA01
cgccgcgggucaccagc

SEQ ID NO: 1482658 - RNA, 20 nt, Pseudomonas aeruginosa PA01
cgccgcgggucaccagcgcc

SEQ ID NO: 1482659 - RNA, 17 nt, Pseudomonas aeruginosa PA01
cgccgcggugucggcga

SEQ ID NO: 1482660 - RNA, 22 nt, Pseudomonas aeruginosa PA01
cgccgcggucuucgcguuggcg

SEQ ID NO: 1482661 - RNA, 19 nt, Pseudomonas aeruginosa PA01
cgccgcguagcgccaggcc

SEQ ID NO: 1482662 - RNA, 19 nt, Pseudomonas aeruginosa PA01
cgccgcgucgaagcugucg

SEQ ID NO: 1482663 - RNA, 21 nt, Pseudomonas aeruginosa PA01
cgccgcgucgaagcugucggc

SEQ ID NO: 1482664 - RNA, 20 nt, Pseudomonas aeruginosa PA01
cgccgcgucccugcacaggg

SEQ ID NO: 1482665 - RNA, 15 nt, Pseudomonas aeruginosa PA01
cgccgcgucgccgcc

SEQ ID NO: 1482666 - RNA, 16 nt, Pseudomonas aeruginosa PA01
cgccgcgucgccgcca

SEQ ID NO: 1482667 - RNA, 17 nt, Pseudomonas aeruginosa PA01
cgccgcgucgucggcga

SEQ ID NO: 1482668 - RNA, 23 nt, Pseudomonas aeruginosa PA01
cgccgcgucgucggcgacgcuga

SEQ ID NO: 1482669 - RNA, 17 nt, Pseudomonas aeruginosa PA01
cgccgcuaucgccgccg

SEQ ID NO: 1482670 - RNA, 20 nt, Pseudomonas aeruginosa PA01
cgccgcuaugggcaccgcgc

SEQ ID NO: 1482671 - RNA, 23 nt, Pseudomonas aeruginosa PA01
cgccgcucccggcuugcugacga

SEQ ID NO: 1482672 - RNA, 12 nt, Pseudomonas aeruginosa PA01
cgccgcucaucc

SEQ ID NO: 1482673 - RNA, 14 nt, Pseudomonas aeruginosa PA01
cgccgcucauccgc

SEQ ID NO: 1482674 - RNA, 16 nt, Pseudomonas aeruginosa PA01
cgccgcucauccgcug

SEQ ID NO: 1482675 - RNA, 17 nt, Pseudomonas aeruginosa PA01
cgccgcuccacacccgg

SEQ ID NO: 1482676 - RNA, 21 nt, Pseudomonas aeruginosa PA01
cgccgcuccacacccggucgc

SEQ ID NO: 1482677 - RNA, 23 nt, Pseudomonas aeruginosa PA01
cgccgcuccacacccggucgcgc

SEQ ID NO: 1482678 - RNA, 11 nt, Pseudomonas aeruginosa PA01
cgccgcuccgc

SEQ ID NO: 1482679 - RNA, 15 nt, Pseudomonas aeruginosa PA01
cgccgcuccggcugc

SEQ ID NO: 1482680 - RNA, 18 nt, Pseudomonas aeruginosa PA01
cgccgcuccggcugcgcg

SEQ ID NO: 1482681 - RNA, 15 nt, Pseudomonas aeruginosa PA01
cgccgcuccuccucg

SEQ ID NO: 1482682 - RNA, 16 nt, Pseudomonas aeruginosa PA01
cgccgcuccuccucgc

SEQ ID NO: 1482683 - RNA, 18 nt, Pseudomonas aeruginosa PA01
cgccgcuccuccucgcuc

SEQ ID NO: 1482684 - RNA, 20 nt, Pseudomonas aeruginosa PA01
cgccgcuccuccucgcucug

SEQ ID NO: 1482685 - RNA, 21 nt, Pseudomonas aeruginosa PA01
cgccgcuccuccucgcucugc

SEQ ID NO: 1482686 - RNA, 17 nt, Pseudomonas aeruginosa PA01
cgccgcuccuggcaggc

SEQ ID NO: 1482687 - RNA, 18 nt, Pseudomonas aeruginosa PA01
cgccgcuccuggcaggcu

SEQ ID NO: 1482688 - RNA, 21 nt, Pseudomonas aeruginosa PA01
cgccgcucgaugcccgccagc

SEQ ID NO: 1482689 - RNA, 13 nt, Pseudomonas aeruginosa PA01
cgccgcuggaacc

SEQ ID NO: 1482690 - RNA, 13 nt, Pseudomonas aeruginosa PA01
cgccgcuggacga

SEQ ID NO: 1482691 - RNA, 15 nt, Pseudomonas aeruginosa PA01
cgccgcucgcgcacg

SEQ ID NO: 1482692 - RNA, 19 nt, Pseudomonas aeruginosa PA01
cgccgcucgcgcacggcga

SEQ ID NO: 1482693 - RNA, 15 nt, Pseudomonas aeruginosa PA01
cgccgcgagguggau

SEQ ID NO: 1482694 - RNA, 17 nt, Pseudomonas aeruginosa PA01
cgccgcgagcaccaugc

SEQ ID NO: 1482695 - RNA, 13 nt, Pseudomonas aeruginosa PA01
cgccgcgagcgcc

SEQ ID NO: 1482696 - RNA, 16 nt, Pseudomonas aeruginosa PA01
cgccgcgagcgccgcc

SEQ ID NO: 1482697 - RNA, 20 nt, Pseudomonas aeruginosa PA01
cgccgcgauggcucgcggcg

SEQ ID NO: 1482698 - RNA, 22 nt, Pseudomonas aeruginosa PA01
cgccgcgauggcucgcggcgcu

SEQ ID NO: 1482699 - RNA, 14 nt, Pseudomonas aeruginosa PA01
cgccgcgcagcacc

SEQ ID NO: 1482700 - RNA, 20 nt, Pseudomonas aeruginosa PA01
cgccgcgcaccucgaccgcg

SEQ ID NO: 1482701 - RNA, 14 nt, Pseudomonas aeruginosa PA01
cgccgcgcacgucg

SEQ ID NO: 1482702 - RNA, 17 nt, Pseudomonas aeruginosa PA01
cgccgcgcacgucgagg

SEQ ID NO: 1482703 - RNA, 13 nt, Pseudomonas aeruginosa PA01
cgccgcgcaucac

SEQ ID NO: 1482704 - RNA, 20 nt, Pseudomonas aeruginosa PA01
cgccgcgcaucaccccgcaa

SEQ ID NO: 1482705 - RNA, 13 nt, Pseudomonas aeruginosa PA01
cgccgcgcagcgc

SEQ ID NO: 1482706 - RNA, 14 nt, Pseudomonas aeruginosa PA01
cgccgcgcagcgcg

SEQ ID NO: 1482707 - RNA, 18 nt, Pseudomonas aeruginosa PA01
cgccgcgcagcgcggcgc

SEQ ID NO: 1482708 - RNA, 16 nt, Pseudomonas aeruginosa PA01
cgccgccuugagcggc

SEQ ID NO: 1482709 - RNA, 17 nt, Pseudomonas aeruginosa PA01
cgccgccuugagcggcg

SEQ ID NO: 1482710 - RNA, 22 nt, Pseudomonas aeruginosa PA01
cgccgccuugagcggcgcccug

SEQ ID NO: 1482711 - RNA, 23 nt, Pseudomonas aeruginosa PA01
cgccgccuugagcggcgcccugg

SEQ ID NO: 1482712 - RNA, 19 nt, Pseudomonas aeruginosa PA01
cgccgcgaacacacccugc

SEQ ID NO: 1482713 - RNA, 21 nt, Pseudomonas aeruginosa PA01
cgccgcgaacacacccugcgc

SEQ ID NO: 1482714 - RNA, 22 nt, Pseudomonas aeruginosa PA01
cgccgcgaacacacccugcgca

SEQ ID NO: 1482715 - RNA, 21 nt, Pseudomonas aeruginosa PA01
cgccgccuugcguaccagcgc

SEQ ID NO: 1482716 - RNA, 22 nt, Pseudomonas aeruginosa PA01
cgccgccuugcguaccagcgcg

SEQ ID NO: 1482717 - RNA, 13 nt, Pseudomonas aeruginosa PA01
cgccgccuuggca

SEQ ID NO: 1482718 - RNA, 19 nt, Pseudomonas aeruginosa PA01
cgccgccuuucugcccggc

SEQ ID NO: 1482719 - RNA, 13 nt, Pseudomonas aeruginosa PA01
cgccgcgaccucg

SEQ ID NO: 1482720 - RNA, 23 nt, Pseudomonas aeruginosa PA01
cgccgcgaccucguugcaggcac

SEQ ID NO: 1482721 - RNA, 16 nt, Pseudomonas aeruginosa PA01
cgccgcgaccugcucg

SEQ ID NO: 1482722 - RNA, 17 nt, Pseudomonas aeruginosa PA01
cgccgcgaccgaagccg

SEQ ID NO: 1482723 - RNA, 12 nt, Pseudomonas aeruginosa PA01
cgccgccgggcg

SEQ ID NO: 1482724 - RNA, 13 nt, Pseudomonas aeruginosa PA01
cgccgccgggcgc

SEQ ID NO: 1482725 - RNA, 12 nt, Pseudomonas aeruginosa PA01
cgccgccggcgu

SEQ ID NO: 1482726 - RNA, 13 nt, Pseudomonas aeruginosa PA01
cgccgccggcucc

SEQ ID NO: 1482727 - RNA, 18 nt, Pseudomonas aeruginosa PA01
cgccgccggcuccuugcg

SEQ ID NO: 1482728 - RNA, 15 nt, Pseudomonas aeruginosa PA01
cgccgccgguagccg

SEQ ID NO: 1482729 - RNA, 18 nt, Pseudomonas aeruginosa PA01
cgccgccgggcgcgcgcc

SEQ ID NO: 1482730 - RNA, 16 nt, Pseudomonas aeruginosa PA01
cgccgccucgaaggcc

SEQ ID NO: 1482731 - RNA, 18 nt, Pseudomonas aeruginosa PA01
cgccgccucgaaggccgg

SEQ ID NO: 1482732 - RNA, 14 nt, Pseudomonas aeruginosa PA01
cgccgccucgcgca

SEQ ID NO: 1482733 - RNA, 22 nt, Pseudomonas aeruginosa PA01
cgccgccugcucgccgcugaag

SEQ ID NO: 1482734 - RNA, 17 nt, Pseudomonas aeruginosa PA01
cgccgccugcuggcugc

SEQ ID NO: 1482735 - RNA, 14 nt, Pseudomonas aeruginosa PA01
cgccgccugcggcu

SEQ ID NO: 1482736 - RNA, 14 nt, Pseudomonas aeruginosa PA01
cgccgccuucggca

SEQ ID NO: 1482737 - RNA, 16 nt, Pseudomonas aeruginosa PA01
cgccgccuucggcagg

SEQ ID NO: 1482738 - RNA, 20 nt, Pseudomonas aeruginosa PA01
cgccgccuggguggcgacga

SEQ ID NO: 1482739 - RNA, 22 nt, Pseudomonas aeruginosa PA01
cgccgccuggguggcgacgaag

SEQ ID NO: 1482740 - RNA, 14 nt, Pseudomonas aeruginosa PA01
cgccgccuggccgg

SEQ ID NO: 1482741 - RNA, 13 nt, Pseudomonas aeruginosa PA01
cgccgccugcgcc

SEQ ID NO: 1482742 - RNA, 12 nt, Pseudomonas aeruginosa PA01
cgccgccugcgg

SEQ ID NO: 1482743 - RNA, 18 nt, Pseudomonas aeruginosa PA01
cgccgccucgcugggcgg

SEQ ID NO: 1482744 - RNA, 15 nt, Pseudomonas aeruginosa PA01
cgccgccggcgaacg

SEQ ID NO: 1482745 - RNA, 15 nt, Pseudomonas aeruginosa PA01
cgccgcccggcucgc

SEQ ID NO: 1482746 - RNA, 19 nt, Pseudomonas aeruginosa PA01
cgccgcccggcucgccgcc

SEQ ID NO: 1482747 - RNA, 14 nt, Pseudomonas aeruginosa PA01
cgccgcccggcacc

SEQ ID NO: 1482748 - RNA, 13 nt, Pseudomonas aeruginosa PA01
cgccgcccggcag

SEQ ID NO: 1482749 - RNA, 15 nt, Pseudomonas aeruginosa PA01
cgccgcccggcagcg

SEQ ID NO: 1482750 - RNA, 14 nt, Pseudomonas aeruginosa PA01
cgccgccggcgagg

SEQ ID NO: 1482751 - RNA, 15 nt, Pseudomonas aeruginosa PA01
cgccgccccguuggc

SEQ ID NO: 1482752 - RNA, 16 nt, Pseudomonas aeruginosa PA01
cgccgccccguuggcg

SEQ ID NO: 1482753 - RNA, 17 nt, Pseudomonas aeruginosa PA01
cgccgcccgaggcgacc

SEQ ID NO: 1482754 - RNA, 19 nt, Pseudomonas aeruginosa PA01
cgccgccacgugcacgccg

SEQ ID NO: 1482755 - RNA, 11 nt, Pseudomonas aeruginosa PA01
cgccgccagca

SEQ ID NO: 1482756 - RNA, 13 nt, Pseudomonas aeruginosa PA01
cgccgccagcaac

SEQ ID NO: 1482757 - RNA, 14 nt, Pseudomonas aeruginosa PA01
cgccgccagcaaca

SEQ ID NO: 1482758 - RNA, 14 nt, Pseudomonas aeruginosa PA01
cgccgccaguucgg

SEQ ID NO: 1482759 - RNA, 12 nt, Pseudomonas aeruginosa PA01
cgccgccagcag

SEQ ID NO: 1482760 - RNA, 16 nt, Pseudomonas aeruginosa PA01
cgccgccauugacgaa

SEQ ID NO: 1482761 - RNA, 18 nt, Pseudomonas aeruginosa PA01
cgccgcccccggcccggg

SEQ ID NO: 1482762 - RNA, 15 nt, Pseudomonas aeruginosa PA01
cgccgccaccgccac

SEQ ID NO: 1482763 - RNA, 13 nt, Pseudomonas aeruginosa PA01
cgccgccacgccg

SEQ ID NO: 1482764 - RNA, 19 nt, Pseudomonas aeruginosa PA01
cgccgccaccacgaucagg

SEQ ID NO: 1482765 - RNA, 12 nt, Pseudomonas aeruginosa PA01
cgccgccaacug

SEQ ID NO: 1482766 - RNA, 17 nt, Pseudomonas aeruginosa PA01
cgccgccaacuggcugu

SEQ ID NO: 1482767 - RNA, 20 nt, Pseudomonas aeruginosa PA01
cgccgaucuccuccgccccg

SEQ ID NO: 1482768 - RNA, 21 nt, Pseudomonas aeruginosa PA01
cgccgaucuccuccgccccgg

SEQ ID NO: 1482769 - RNA, 23 nt, Pseudomonas aeruginosa PA01
cgccgaucuccuccgccccggca

SEQ ID NO: 1482770 - RNA, 13 nt, Pseudomonas aeruginosa PA01
cgccgauaccggc

SEQ ID NO: 1482771 - RNA, 22 nt, Pseudomonas aeruginosa PA01
cgccgauaccggccucgaugaa

SEQ ID NO: 1482772 - RNA, 16 nt, Pseudomonas aeruginosa PA01
cgccgcauuggccagg

SEQ ID NO: 1482773 - RNA, 17 nt, Pseudomonas aeruginosa PA01
cgccgcauuggccaggc

SEQ ID NO: 1482774 - RNA, 12 nt, Pseudomonas aeruginosa PA01
cgccgcaucgcu

SEQ ID NO: 1482775 - RNA, 23 nt, Pseudomonas aeruginosa PA01
cgccgaugaaagagcccgcggaa

SEQ ID NO: 1482776 - RNA, 22 nt, Pseudomonas aeruginosa PA01
cgccgcagggugcggcugcuca

SEQ ID NO: 1482777 - RNA, 22 nt, Pseudomonas aeruginosa PA01
cgccgcaguuguuccucgcggc

SEQ ID NO: 1482778 - RNA, 13 nt, Pseudomonas aeruginosa PA01
cgccgcagguccg

SEQ ID NO: 1482779 - RNA, 19 nt, Pseudomonas aeruginosa PA01
cgcgauguuggcgucgaac

SEQ ID NO: 1482780 - RNA, 13 nt, Pseudomonas aeruginosa PA01
cgcgauucgccgg

SEQ ID NO: 1482781 - RNA, 23 nt, Pseudomonas aeruginosa PA01
cgcgauucgccgggcuccagcau

SEQ ID NO: 1482782 - RNA, 14 nt, Pseudomonas aeruginosa PA01
cgcgaugguagucc

SEQ ID NO: 1482783 - RNA, 24 nt, Pseudomonas aeruginosa PA01
cgcgaugguaguccgcugcgagca

SEQ ID NO: 1482784 - RNA, 19 nt, Pseudomonas aeruginosa PA01
cgcgauguccccggccagc

SEQ ID NO: 1482785 - RNA, 12 nt, Pseudomonas aeruginosa PA01
cgcgauggccgg

SEQ ID NO: 1482786 - RNA, 13 nt, Pseudomonas aeruginosa PA01
cgcgauggccggc

SEQ ID NO: 1482787 - RNA, 21 nt, Pseudomonas aeruginosa PA01
cgcgaugccgaugccgccgac

SEQ ID NO: 1482788 - RNA, 16 nt, Pseudomonas aeruginosa PA01
cgcgaugcucccgagc

SEQ ID NO: 1482789 - RNA, 17 nt, Pseudomonas aeruginosa PA01
cgcgaugcucccgagca

SEQ ID NO: 1482790 - RNA, 19 nt, Pseudomonas aeruginosa PA01
cgcgaugcguuccagggcg

SEQ ID NO: 1482791 - RNA, 17 nt, Pseudomonas aeruginosa PA01
cgcgauccuccgccagc

SEQ ID NO: 1482792 - RNA, 21 nt, Pseudomonas aeruginosa PA01
cgcgauccuccgccagcccca

SEQ ID NO: 1482793 - RNA, 22 nt, Pseudomonas aeruginosa PA01
cgcgaucgaggccuacccgcgc

SEQ ID NO: 1482794 - RNA, 16 nt, Pseudomonas aeruginosa PA01
cgcgaucgaucggcug

SEQ ID NO: 1482795 - RNA, 18 nt, Pseudomonas aeruginosa PA01
cgcgaucgaucggcuggu

SEQ ID NO: 1482796 - RNA, 16 nt, Pseudomonas aeruginosa PA01
cgcgauccgcgcggca

SEQ ID NO: 1482797 - RNA, 18 nt, Pseudomonas aeruginosa PA01
cgcgauccgcgcggcaac

SEQ ID NO: 1482798 - RNA, 13 nt, Pseudomonas aeruginosa PA01
cgcgauccgcgcg

SEQ ID NO: 1482799 - RNA, 15 nt, Pseudomonas aeruginosa PA01
cgcgauccaccgcca

SEQ ID NO: 1482800 - RNA, 18 nt, Pseudomonas aeruginosa PA01
cgcgauccaccgccaggg

SEQ ID NO: 1482801 - RNA, 16 nt, Pseudomonas aeruginosa PA01
cgcgaugaugccgccg

SEQ ID NO: 1482802 - RNA, 17 nt, Pseudomonas aeruginosa PA01
cgcgaugaugccgccgu

SEQ ID NO: 1482803 - RNA, 18 nt, Pseudomonas aeruginosa PA01
cgcgaugaugccgccguu

SEQ ID NO: 1482804 - RNA, 17 nt, Pseudomonas aeruginosa PA01
cgcgaucggcguccgcg

SEQ ID NO: 1482805 - RNA, 17 nt, Pseudomonas aeruginosa PA01
cgcgaucuaccugcgug

SEQ ID NO: 1482806 - RNA, 20 nt, Pseudomonas aeruginosa PA01
cgcgaucuaccugcgugcgc

SEQ ID NO: 1482807 - RNA, 22 nt, Pseudomonas aeruginosa PA01
cgcgaucucuacuaccgccagc

SEQ ID NO: 1482808 - RNA, 15 nt, Pseudomonas aeruginosa PA01
cgcgagcuuggcccu

SEQ ID NO: 1482809 - RNA, 15 nt, Pseudomonas aeruginosa PA01
cgcgaggagaucggc

SEQ ID NO: 1482810 - RNA, 18 nt, Pseudomonas aeruginosa PA01
cgcgaggagaucggcguu

SEQ ID NO: 1482811 - RNA, 12 nt, Pseudomonas aeruginosa PA01
cgcgaggagccg

SEQ ID NO: 1482812 - RNA, 20 nt, Pseudomonas aeruginosa PA01
cgcgaggcauucucgcgacc

SEQ ID NO: 1482813 - RNA, 22 nt, Pseudomonas aeruginosa PA01
cgcgaggaucagccacgggcgc

SEQ ID NO: 1482814 - RNA, 13 nt, Pseudomonas aeruginosa PA01
cgcgaggcgcccg

SEQ ID NO: 1482815 - RNA, 16 nt, Pseudomonas aeruginosa PA01
cgcgaggcgcccgccg

SEQ ID NO: 1482816 - RNA, 19 nt, Pseudomonas aeruginosa PA01
cgcgaggcgcccgccggcc

SEQ ID NO: 1482817 - RNA, 18 nt, Pseudomonas aeruginosa PA01
cgcgaggccggccccacc

SEQ ID NO: 1482818 - RNA, 18 nt, Pseudomonas aeruginosa PA01
cgcgagcgauccgcugca

SEQ ID NO: 1482819 - RNA, 14 nt, Pseudomonas aeruginosa PA01
cgcgagcgcggccg

SEQ ID NO: 1482820 - RNA, 17 nt, Pseudomonas aeruginosa PA01
cgcgagcgcggccggcc

SEQ ID NO: 1482821 - RNA, 20 nt, Pseudomonas aeruginosa PA01
cgcgagcgcggccggccacg

SEQ ID NO: 1482822 - RNA, 12 nt, Pseudomonas aeruginosa PA01
cgcgagcggcag

SEQ ID NO: 1482823 - RNA, 13 nt, Pseudomonas aeruginosa PA01
cgcgagcggcaga

SEQ ID NO: 1482824 - RNA, 18 nt, Pseudomonas aeruginosa PA01
cgcgagcggcagauccgc

SEQ ID NO: 1482825 - RNA, 12 nt, Pseudomonas aeruginosa PA01
cgcgagcuggcg

SEQ ID NO: 1482826 - RNA, 15 nt, Pseudomonas aeruginosa PA01
cgcgagcuggcgccg

SEQ ID NO: 1482827 - RNA, 20 nt, Pseudomonas aeruginosa PA01
cgcgagcgguuauucgcccu

SEQ ID NO: 1482828 - RNA, 19 nt, Pseudomonas aeruginosa PA01
cgcgagcagggcgaugccg

SEQ ID NO: 1482829 - RNA, 13 nt, Pseudomonas aeruginosa PA01
cgcgagccgcgca

SEQ ID NO: 1482830 - RNA, 15 nt, Pseudomonas aeruginosa PA01
cgcgagccgcgcagc

SEQ ID NO: 1482831 - RNA, 15 nt, Pseudomonas aeruginosa PA01
cgcgagccguccugc

SEQ ID NO: 1482832 - RNA, 17 nt, Pseudomonas aeruginosa PA01
cgcgagccguccugcgg

SEQ ID NO: 1482833 - RNA, 19 nt, Pseudomonas aeruginosa PA01
cgcgagccguccugcggcc

SEQ ID NO: 1482834 - RNA, 21 nt, Pseudomonas aeruginosa PA01
cgcgagccguccugcggccgc

SEQ ID NO: 1482835 - RNA, 17 nt, Pseudomonas aeruginosa PA01
cgcgagccuucagcacg

SEQ ID NO: 1482836 - RNA, 19 nt, Pseudomonas aeruginosa PA01
cgcgagccuucagcacggc

SEQ ID NO: 1482837 - RNA, 14 nt, Pseudomonas aeruginosa PA01
cgcgagcgccgccu

SEQ ID NO: 1482838 - RNA, 21 nt, Pseudomonas aeruginosa PA01
cgcgagcagccgacgauccgg

SEQ ID NO: 1482839 - RNA, 22 nt, Pseudomonas aeruginosa PA01
cgcgagcaugcucacugcgagc

SEQ ID NO: 1482840 - RNA, 15 nt, Pseudomonas aeruginosa PA01
cgcgagcaccgcgca

SEQ ID NO: 1482841 - RNA, 19 nt, Pseudomonas aeruginosa PA01
cgcgagcaccgcgcagacc

SEQ ID NO: 1482842 - RNA, 20 nt, Pseudomonas aeruginosa PA01
cgcgagggggccucggccag

SEQ ID NO: 1482843 - RNA, 21 nt, Pseudomonas aeruginosa PA01
cgcgaggcggucaugcgcccu

SEQ ID NO: 1482844 - RNA, 13 nt, Pseudomonas aeruginosa PA01
cgcgagguccggc

SEQ ID NO: 1482845 - RNA, 19 nt, Pseudomonas aeruginosa PA01
cgcgagguuccgcggcgac

SEQ ID NO: 1482846 - RNA, 22 nt, Pseudomonas aeruginosa PA01
cgcgagguuucgcuuuccucgg

SEQ ID NO: 1482847 - RNA, 23 nt, Pseudomonas aeruginosa PA01
cgcgagguuucgcuuuccucggu

SEQ ID NO: 1482848 - RNA, 24 nt, Pseudomonas aeruginosa PA01
cgcgagguuucgcuuuccucgguc

SEQ ID NO: 1482849 - RNA, 17 nt, Pseudomonas aeruginosa PA01
cgcgagguggaugaaca

SEQ ID NO: 1482850 - RNA, 20 nt, Pseudomonas aeruginosa PA01
cgcgagguggaugaacagcg

SEQ ID NO: 1482851 - RNA, 22 nt, Pseudomonas aeruginosa PA01
cgcgagguggaugaacagcgga

SEQ ID NO: 1482852 - RNA, 18 nt, Pseudomonas aeruginosa PA01
cgcgaguccuucggcgca

SEQ ID NO: 1482853 - RNA, 20 nt, Pseudomonas aeruginosa PA01
cgcgauaaaaagccccgcuu

SEQ ID NO: 1482854 - RNA, 18 nt, Pseudomonas aeruginosa PA01
cgcgaguucgccggccag

SEQ ID NO: 1482855 - RNA, 15 nt, Pseudomonas aeruginosa PA01
cgcgaguggaugaag

SEQ ID NO: 1482856 - RNA, 13 nt, Pseudomonas aeruginosa PA01
cgcgagugcagcg

SEQ ID NO: 1482857 - RNA, 14 nt, Pseudomonas aeruginosa PA01
cgcgagugcagcga

SEQ ID NO: 1482858 - RNA, 15 nt, Pseudomonas aeruginosa PA01
cgcgagugcagcgag

SEQ ID NO: 1482859 - RNA, 20 nt, Pseudomonas aeruginosa PA01
cgcgagugcagcgagucgcc

SEQ ID NO: 1482860 - RNA, 18 nt, Pseudomonas aeruginosa PA01
cgcgaucagccgcuccag

SEQ ID NO: 1482861 - RNA, 14 nt, Pseudomonas aeruginosa PA01
cgcgaucaccgcgu

SEQ ID NO: 1482862 - RNA, 13 nt, Pseudomonas aeruginosa PA01
cgcgaucaccgcg

SEQ ID NO: 1482863 - RNA, 20 nt, Pseudomonas aeruginosa PA01
cgcgauacucgugggccggu

SEQ ID NO: 1482864 - RNA, 16 nt, Pseudomonas aeruginosa PA01
cgcgauauccgccagg

SEQ ID NO: 1482865 - RNA, 16 nt, Pseudomonas aeruginosa PA01
cgcgauagacgccggc

SEQ ID NO: 1482866 - RNA, 17 nt, Pseudomonas aeruginosa PA01
cgcgauagacgccggcg

SEQ ID NO: 1482867 - RNA, 20 nt, Pseudomonas aeruginosa PA01
cgcgauagacgccggcgacg

SEQ ID NO: 1482868 - RNA, 16 nt, Pseudomonas aeruginosa PA01
cgcgauacccuggccg

SEQ ID NO: 1482869 - RNA, 17 nt, Pseudomonas aeruginosa PA01
cgcgauacccuggccgg

SEQ ID NO: 1482870 - RNA, 18 nt, Pseudomonas aeruginosa PA01
cgcgauacccuggccggc

SEQ ID NO: 1482871 - RNA, 19 nt, Pseudomonas aeruginosa PA01
cgcgauacccuggccggcc

SEQ ID NO: 1482872 - RNA, 13 nt, Pseudomonas aeruginosa PA01
cgcgauaccgaca

SEQ ID NO: 1482873 - RNA, 18 nt, Pseudomonas aeruginosa PA01
cgccuuuuucauggccug

SEQ ID NO: 1482874 - RNA, 13 nt, Pseudomonas aeruginosa PA01
cgccuuuucggca

SEQ ID NO: 1482875 - RNA, 20 nt, Pseudomonas aeruginosa PA01
cgccuuuuuucauccugcgg

SEQ ID NO: 1482876 - RNA, 23 nt, Pseudomonas aeruginosa PA01
cgccuuuuuucauuucguugcgc

SEQ ID NO: 1482877 - RNA, 19 nt, Pseudomonas aeruginosa PA01
cgccuuuuuugugcccggc

SEQ ID NO: 1482878 - RNA, 21 nt, Pseudomonas aeruginosa PA01
cgcgaaaacucccggccuggu

SEQ ID NO: 1482879 - RNA, 12 nt, Pseudomonas aeruginosa PA01
cgccugcuggcc

SEQ ID NO: 1482880 - RNA, 13 nt, Pseudomonas aeruginosa PA01
cgccugcuggccg

SEQ ID NO: 1482881 - RNA, 20 nt, Pseudomonas aeruginosa PA01
cgccugcuggugggugaucu

SEQ ID NO: 1482882 - RNA, 17 nt, Pseudomonas aeruginosa PA01
cgccugcuucagcccgg

SEQ ID NO: 1482883 - RNA, 19 nt, Pseudomonas aeruginosa PA01
cgccugcuucagcccggca

SEQ ID NO: 1482884 - RNA, 22 nt, Pseudomonas aeruginosa PA01
cgccugcuucagcccggcacca

SEQ ID NO: 1482885 - RNA, 14 nt, Pseudomonas aeruginosa PA01
cgccugcuggccgg

SEQ ID NO: 1482886 - RNA, 20 nt, Pseudomonas aeruginosa PA01
cgccuugcucaggucgucga

SEQ ID NO: 1482887 - RNA, 23 nt, Pseudomonas aeruginosa PA01
cgccuugcugcggguugaugucg

SEQ ID NO: 1482888 - RNA, 15 nt, Pseudomonas aeruginosa PA01
cgccuggaaggcgcu

SEQ ID NO: 1482889 - RNA, 16 nt, Pseudomonas aeruginosa PA01
cgccuggaaggcgcug

SEQ ID NO: 1482890 - RNA, 17 nt, Pseudomonas aeruginosa PA01
cgccuuggcaucgccgc

SEQ ID NO: 1482891 - RNA, 23 nt, Pseudomonas aeruginosa PA01
cgccuugguguagccgagcacgc

SEQ ID NO: 1482892 - RNA, 17 nt, Pseudomonas aeruginosa PA01
cgccuuguucgccagca

SEQ ID NO: 1482893 - RNA, 15 nt, Pseudomonas aeruginosa PA01
cgccuuucgcucagg

SEQ ID NO: 1482894 - RNA, 17 nt, Pseudomonas aeruginosa PA01
cgcgaacucggcgccga

SEQ ID NO: 1482895 - RNA, 19 nt, Pseudomonas aeruginosa PA01
cgcgaacucggcgccgauc

SEQ ID NO: 1482896 - RNA, 14 nt, Pseudomonas aeruginosa PA01
cgcgaagucgcagu

SEQ ID NO: 1482897 - RNA, 14 nt, Pseudomonas aeruginosa PA01
cgcgaagaacacgc

SEQ ID NO: 1482898 - RNA, 18 nt, Pseudomonas aeruginosa PA01
cgcgaauaccgcgcgcgc

SEQ ID NO: 1482899 - RNA, 19 nt, Pseudomonas aeruginosa PA01
cgcgaauaccgcgcgcgca

SEQ ID NO: 1482900 - RNA, 21 nt, Pseudomonas aeruginosa PA01
cgcgaauaccgcgcgcgcaag

SEQ ID NO: 1482901 - RNA, 17 nt, Pseudomonas aeruginosa PA01
cgcgaauagggcggcgc

SEQ ID NO: 1482902 - RNA, 19 nt, Pseudomonas aeruginosa PA01
cgcgaauagggcggcgcca

SEQ ID NO: 1482903 - RNA, 22 nt, Pseudomonas aeruginosa PA01
cgcgaauagggcggcgccaccg

SEQ ID NO: 1482904 - RNA, 15 nt, Pseudomonas aeruginosa PA01
cgcgacagauagcag

SEQ ID NO: 1482905 - RNA, 18 nt, Pseudomonas aeruginosa PA01
cgcgaaucuucggcgcgc

SEQ ID NO: 1482906 - RNA, 15 nt, Pseudomonas aeruginosa PA01
cgcgaauggcagcag

SEQ ID NO: 1482907 - RNA, 16 nt, Pseudomonas aeruginosa PA01
cgcgaauggcagcagg

SEQ ID NO: 1482908 - RNA, 19 nt, Pseudomonas aeruginosa PA01
cgcgaauggcagcaggcac

SEQ ID NO: 1482909 - RNA, 13 nt, Pseudomonas aeruginosa PA01
cgcgaauccgcgg

SEQ ID NO: 1482910 - RNA, 19 nt, Pseudomonas aeruginosa PA01
cgcgaauccgcggcccugc

SEQ ID NO: 1482911 - RNA, 15 nt, Pseudomonas aeruginosa PA01
cgcgaaugcccggca

SEQ ID NO: 1482912 - RNA, 21 nt, Pseudomonas aeruginosa PA01
cgcgacagguucaggacgcuc

SEQ ID NO: 1482913 - RNA, 13 nt, Pseudomonas aeruginosa PA01
cgcgacagcucug

SEQ ID NO: 1482914 - RNA, 15 nt, Pseudomonas aeruginosa PA01
cgcgacaucggcgau

SEQ ID NO: 1482915 - RNA, 19 nt, Pseudomonas aeruginosa PA01
cgcgacaucggcgauggcc

SEQ ID NO: 1482916 - RNA, 18 nt, Pseudomonas aeruginosa PA01
cgcgagaagccagccagg

SEQ ID NO: 1482917 - RNA, 13 nt, Pseudomonas aeruginosa PA01
cgcgagaccccgg

SEQ ID NO: 1482918 - RNA, 17 nt, Pseudomonas aeruginosa PA01
cgcgagaccccggcggc

SEQ ID NO: 1482919 - RNA, 15 nt, Pseudomonas aeruginosa PA01
cgcgagaaggcguag

SEQ ID NO: 1482920 - RNA, 16 nt, Pseudomonas aeruginosa PA01
cgcgagaugaagcgcc

SEQ ID NO: 1482921 - RNA, 20 nt, Pseudomonas aeruginosa PA01
cgcgagauggcgucgauccc

SEQ ID NO: 1482922 - RNA, 14 nt, Pseudomonas aeruginosa PA01
cgcgacucgagcac

SEQ ID NO: 1482923 - RNA, 15 nt, Pseudomonas aeruginosa PA01
cgcgacucggcugca

SEQ ID NO: 1482924 - RNA, 23 nt, Pseudomonas aeruginosa PA01
cgcgacucggcugcaacgccgcg

SEQ ID NO: 1482925 - RNA, 15 nt, Pseudomonas aeruginosa PA01
cgcgacugccgucgg

SEQ ID NO: 1482926 - RNA, 17 nt, Pseudomonas aeruginosa PA01
cgcgacugcugaucagc

SEQ ID NO: 1482927 - RNA, 23 nt, Pseudomonas aeruginosa PA01
cgcgacugcugcugcggggccug

SEQ ID NO: 1482928 - RNA, 19 nt, Pseudomonas aeruginosa PA01
cgcgacgggugcguccauc

SEQ ID NO: 1482929 - RNA, 14 nt, Pseudomonas aeruginosa PA01
cgcgacggcugcuc

SEQ ID NO: 1482930 - RNA, 19 nt, Pseudomonas aeruginosa PA01
cgcgacggcugcuccggau

SEQ ID NO: 1482931 - RNA, 22 nt, Pseudomonas aeruginosa PA01
cgcgacggcugcuccggaucgc

SEQ ID NO: 1482932 - RNA, 13 nt, Pseudomonas aeruginosa PA01
cgcgacggcauuc

SEQ ID NO: 1482933 - RNA, 20 nt, Pseudomonas aeruginosa PA01
cgcgacggcauuccuggucc

SEQ ID NO: 1482934 - RNA, 22 nt, Pseudomonas aeruginosa PA01
cgcgacggcauuccugguccag

SEQ ID NO: 1482935 - RNA, 20 nt, Pseudomonas aeruginosa PA01
cgcgacggaacaagccgccu

SEQ ID NO: 1482936 - RNA, 13 nt, Pseudomonas aeruginosa PA01
cgcgacgaggcgc

SEQ ID NO: 1482937 - RNA, 13 nt, Pseudomonas aeruginosa PA01
cgcgacgacugcg

SEQ ID NO: 1482938 - RNA, 18 nt, Pseudomonas aeruginosa PA01
cgcgacgacugcggcagc

SEQ ID NO: 1482939 - RNA, 14 nt, Pseudomonas aeruginosa PA01
cgcgacgcgaccuc

SEQ ID NO: 1482940 - RNA, 16 nt, Pseudomonas aeruginosa PA01
cgcgacgcgaccuccg

SEQ ID NO: 1482941 - RNA, 24 nt, Pseudomonas aeruginosa PA01
cgcgacggaccgcgacaacccugu

SEQ ID NO: 1482942 - RNA, 21 nt, Pseudomonas aeruginosa PA01
cgcgacgcuacguuccagggc

SEQ ID NO: 1482943 - RNA, 14 nt, Pseudomonas aeruginosa PA01
cgcgacgcuccagc

SEQ ID NO: 1482944 - RNA, 16 nt, Pseudomonas aeruginosa PA01
cgcgacgcuccagcgg

SEQ ID NO: 1482945 - RNA, 18 nt, Pseudomonas aeruginosa PA01
cgcgacgcuccagcggca

SEQ ID NO: 1482946 - RNA, 19 nt, Pseudomonas aeruginosa PA01
cgcgacgcuccagcggcag

SEQ ID NO: 1482947 - RNA, 20 nt, Pseudomonas aeruginosa PA01
cgcgacgcuccagcggcagc

SEQ ID NO: 1482948 - RNA, 15 nt, Pseudomonas aeruginosa PA01
cgcgacgcuccaggu

SEQ ID NO: 1482949 - RNA, 16 nt, Pseudomonas aeruginosa PA01
cgcgacgcuccaggug

SEQ ID NO: 1482950 - RNA, 21 nt, Pseudomonas aeruginosa PA01
cgcgaccugcucgucgaugcu

SEQ ID NO: 1482951 - RNA, 21 nt, Pseudomonas aeruginosa PA01
cgcgaccucguugcaggcacg

SEQ ID NO: 1482952 - RNA, 16 nt, Pseudomonas aeruginosa PA01
cgcgaccuccggcgcc

SEQ ID NO: 1482953 - RNA, 17 nt, Pseudomonas aeruginosa PA01
cgcgaccuccggcgcca

SEQ ID NO: 1482954 - RNA, 21 nt, Pseudomonas aeruginosa PA01
cgcgaccuccggcgccaggcc

SEQ ID NO: 1482955 - RNA, 17 nt, Pseudomonas aeruginosa PA01
cgcgaccuucggugucg

SEQ ID NO: 1482956 - RNA, 14 nt, Pseudomonas aeruginosa PA01
cgcgaccgggcaug

SEQ ID NO: 1482957 - RNA, 16 nt, Pseudomonas aeruginosa PA01
cgcgaccgucggccgg

SEQ ID NO: 1482958 - RNA, 17 nt, Pseudomonas aeruginosa PA01
cgcgaccgucggccggg

SEQ ID NO: 1482959 - RNA, 19 nt, Pseudomonas aeruginosa PA01
cgcgaccgguaacuggcca

SEQ ID NO: 1482960 - RNA, 13 nt, Pseudomonas aeruginosa PA01
cgcgaccggucag

SEQ ID NO: 1482961 - RNA, 20 nt, Pseudomonas aeruginosa PA01
cgcgaccggucaggcaaucu

SEQ ID NO: 1482962 - RNA, 23 nt, Pseudomonas aeruginosa PA01
cgccucuucgcaggagucgacga

SEQ ID NO: 1482963 - RNA, 19 nt, Pseudomonas aeruginosa PA01
cgccucguucgucgccgac

SEQ ID NO: 1482964 - RNA, 18 nt, Pseudomonas aeruginosa PA01
cgccucugcgcugagcag

SEQ ID NO: 1482965 - RNA, 15 nt, Pseudomonas aeruginosa PA01
cgccucuuccuggac

SEQ ID NO: 1482966 - RNA, 22 nt, Pseudomonas aeruginosa PA01
cgccucuuccuggaccuccgcc

SEQ ID NO: 1482967 - RNA, 16 nt, Pseudomonas aeruginosa PA01
cgccucguggaacagc

SEQ ID NO: 1482968 - RNA, 22 nt, Pseudomonas aeruginosa PA01
cgccucguggaacagcgcgucg

SEQ ID NO: 1482969 - RNA, 15 nt, Pseudomonas aeruginosa PA01
cgccucguucagcag

SEQ ID NO: 1482970 - RNA, 18 nt, Pseudomonas aeruginosa PA01
cgccucguucagcagcau

SEQ ID NO: 1482971 - RNA, 22 nt, Pseudomonas aeruginosa PA01
cgccucguucagcagcaugccg

SEQ ID NO: 1482972 - RNA, 15 nt, Pseudomonas aeruginosa PA01
cgccucgugcagcaa

SEQ ID NO: 1482973 - RNA, 22 nt, Pseudomonas aeruginosa PA01
cgccucgugcagcaagccgcag

SEQ ID NO: 1482974 - RNA, 20 nt, Pseudomonas aeruginosa PA01
cgccucgcgccagagaucgc

SEQ ID NO: 1482975 - RNA, 14 nt, Pseudomonas aeruginosa PA01
cgccucgcgcaacg

SEQ ID NO: 1482976 - RNA, 20 nt, Pseudomonas aeruginosa PA01
cgccucgcgcaacgccgacg

SEQ ID NO: 1482977 - RNA, 15 nt, Pseudomonas aeruginosa PA01
cgccucgccggccag

SEQ ID NO: 1482978 - RNA, 20 nt, Pseudomonas aeruginosa PA01
cgccugccauccgggguggg

SEQ ID NO: 1482979 - RNA, 22 nt, Pseudomonas aeruginosa PA01
cgccugccaggcggggauggcg

SEQ ID NO: 1482980 - RNA, 14 nt, Pseudomonas aeruginosa PA01
cgccugagcagcgc

SEQ ID NO: 1482981 - RNA, 16 nt, Pseudomonas aeruginosa PA01
cgccugagcagcgcuu

SEQ ID NO: 1482982 - RNA, 17 nt, Pseudomonas aeruginosa PA01
cgccugagcagcgcuug

SEQ ID NO: 1482983 - RNA, 24 nt, Pseudomonas aeruginosa PA01
cgccugccccacuuccggcccggc

SEQ ID NO: 1482984 - RNA, 13 nt, Pseudomonas aeruginosa PA01
cgccugcugcgcg

SEQ ID NO: 1482985 - RNA, 20 nt, Pseudomonas aeruginosa PA01
cgccugcugcgggucgcggg

SEQ ID NO: 1482986 - RNA, 15 nt, Pseudomonas aeruginosa PA01
cgccugcucgccgcu

SEQ ID NO: 1482987 - RNA, 19 nt, Pseudomonas aeruginosa PA01
cgccugcucggccugcugc

SEQ ID NO: 1482988 - RNA, 16 nt, Pseudomonas aeruginosa PA01
cgccugcucuucggcg

SEQ ID NO: 1482989 - RNA, 15 nt, Pseudomonas aeruginosa PA01
cgccugccuuccuug

SEQ ID NO: 1482990 - RNA, 16 nt, Pseudomonas aeruginosa PA01
cgccucgaccagcgcc

SEQ ID NO: 1482991 - RNA, 19 nt, Pseudomonas aeruginosa PA01
cgccucgaccagcgccgcg

SEQ ID NO: 1482992 - RNA, 22 nt, Pseudomonas aeruginosa PA01
cgccucgaccagcgccgcggcg

SEQ ID NO: 1482993 - RNA, 23 nt, Pseudomonas aeruginosa PA01
cgccucgaccagcgccgcggcga

SEQ ID NO: 1482994 - RNA, 17 nt, Pseudomonas aeruginosa PA01
cgccucgaccaucggcg

SEQ ID NO: 1482995 - RNA, 20 nt, Pseudomonas aeruginosa PA01
cgccucgaccaucggcggcg

SEQ ID NO: 1482996 - RNA, 21 nt, Pseudomonas aeruginosa PA01
cgccucgaccaucggcggcgg

SEQ ID NO: 1482997 - RNA, 19 nt, Pseudomonas aeruginosa PA01
cgccucgaggaucuugcgc

SEQ ID NO: 1482998 - RNA, 16 nt, Pseudomonas aeruginosa PA01
cgccucgaccucggcc

SEQ ID NO: 1482999 - RNA, 22 nt, Pseudomonas aeruginosa PA01
cgccucgaccucggccgcaucg

SEQ ID NO: 1483000 - RNA, 18 nt, Pseudomonas aeruginosa PA01
cgccucgaccuggccacg

SEQ ID NO: 1483001 - RNA, 13 nt, Pseudomonas aeruginosa PA01
cgccucgccggcc

SEQ ID NO: 1483002 - RNA, 12 nt, Pseudomonas aeruginosa PA01
cgccucgccgag

SEQ ID NO: 1483003 - RNA, 14 nt, Pseudomonas aeruginosa PA01
cgccucgccgagca

SEQ ID NO: 1483004 - RNA, 14 nt, Pseudomonas aeruginosa PA01
cgccucgccgcccg

SEQ ID NO: 1483005 - RNA, 22 nt, Pseudomonas aeruginosa PA01
cgccucgccaaccaggaaggcg

SEQ ID NO: 1483006 - RNA, 17 nt, Pseudomonas aeruginosa PA01
cgccucgaacauggcca

SEQ ID NO: 1483007 - RNA, 16 nt, Pseudomonas aeruginosa PA01
cgccucgauggcggca

SEQ ID NO: 1483008 - RNA, 19 nt, Pseudomonas aeruginosa PA01
cgccucgcaaaggucggcg

SEQ ID NO: 1483009 - RNA, 20 nt, Pseudomonas aeruginosa PA01
cgccucgcaaaggucggcga

SEQ ID NO: 1483010 - RNA, 21 nt, Pseudomonas aeruginosa PA01
cgccucgcaaaggucggcgaa

SEQ ID NO: 1483011 - RNA, 15 nt, Pseudomonas aeruginosa PA01
cgccucgcagagcgc

SEQ ID NO: 1483012 - RNA, 17 nt, Pseudomonas aeruginosa PA01
cgccucgcagagcgcca

SEQ ID NO: 1483013 - RNA, 18 nt, Pseudomonas aeruginosa PA01
cgccucgcagagcgccag

SEQ ID NO: 1483014 - RNA, 20 nt, Pseudomonas aeruginosa PA01
cgccucgcagagcgccagcc

SEQ ID NO: 1483015 - RNA, 14 nt, Pseudomonas aeruginosa PA01
cgccuccucggcgg

SEQ ID NO: 1483016 - RNA, 15 nt, Pseudomonas aeruginosa PA01
cgccuccucggcggc

SEQ ID NO: 1483017 - RNA, 20 nt, Pseudomonas aeruginosa PA01
cgccucgaagaaaaggcccg

SEQ ID NO: 1483018 - RNA, 14 nt, Pseudomonas aeruginosa PA01
cgccucgaagcgga

SEQ ID NO: 1483019 - RNA, 14 nt, Pseudomonas aeruginosa PA01
cgccucgaaggccg

SEQ ID NO: 1483020 - RNA, 15 nt, Pseudomonas aeruginosa PA01
cgccucgaaggccgg

SEQ ID NO: 1483021 - RNA, 20 nt, Pseudomonas aeruginosa PA01
cgccucgaaggccucgguca

SEQ ID NO: 1483022 - RNA, 16 nt, Pseudomonas aeruginosa PA01
cgccuccacggcggcc

SEQ ID NO: 1483023 - RNA, 16 nt, Pseudomonas aeruginosa PA01
cgccuccagcaccggg

SEQ ID NO: 1483024 - RNA, 20 nt, Pseudomonas aeruginosa PA01
cgccucagcggaacuugcgc

SEQ ID NO: 1483025 - RNA, 14 nt, Pseudomonas aeruginosa PA01
cgccuccaccagcg

SEQ ID NO: 1483026 - RNA, 17 nt, Pseudomonas aeruginosa PA01
cgccuccaccagcgccg

SEQ ID NO: 1483027 - RNA, 19 nt, Pseudomonas aeruginosa PA01
cgccuccaccagcgccggc

SEQ ID NO: 1483028 - RNA, 14 nt, Pseudomonas aeruginosa PA01
cgccucacggucgc

SEQ ID NO: 1483029 - RNA, 14 nt, Pseudomonas aeruginosa PA01
cgccucaggccggg

SEQ ID NO: 1483030 - RNA, 23 nt, Pseudomonas aeruginosa PA01
cgccucaaggugaagugaucgau

SEQ ID NO: 1483031 - RNA, 12 nt, Pseudomonas aeruginosa PA01
cgccguccgagg

SEQ ID NO: 1483032 - RNA, 22 nt, Pseudomonas aeruginosa PA01
cgccguccgaggauaccgcacg

SEQ ID NO: 1483033 - RNA, 15 nt, Pseudomonas aeruginosa PA01
cgccguccuccagca

SEQ ID NO: 1483034 - RNA, 17 nt, Pseudomonas aeruginosa PA01
cgccguccuccagcaag

SEQ ID NO: 1483035 - RNA, 21 nt, Pseudomonas aeruginosa PA01
cgccguccuugucgcagcggc

SEQ ID NO: 1483036 - RNA, 14 nt, Pseudomonas aeruginosa PA01
cgccgucgacaccg

SEQ ID NO: 1483037 - RNA, 23 nt, Pseudomonas aeruginosa PA01
cgccgucuuauucgacgcucugc

SEQ ID NO: 1483038 - RNA, 13 nt, Pseudomonas aeruginosa PA01
cgccgugaggcgc

SEQ ID NO: 1483039 - RNA, 14 nt, Pseudomonas aeruginosa PA01
cgccgugaggcgcg

SEQ ID NO: 1483040 - RNA, 19 nt, Pseudomonas aeruginosa PA01
cgccgucuugccgcugcgc

SEQ ID NO: 1483041 - RNA, 20 nt, Pseudomonas aeruginosa PA01
cgccgucuugccgcugcgcg

SEQ ID NO: 1483042 - RNA, 18 nt, Pseudomonas aeruginosa PA01
cgccgugacgaggggcug

SEQ ID NO: 1483043 - RNA, 15 nt, Pseudomonas aeruginosa PA01
cgccgugcaggguca

SEQ ID NO: 1483044 - RNA, 21 nt, Pseudomonas aeruginosa PA01
cgccgugcagggucaggucgu

SEQ ID NO: 1483045 - RNA, 15 nt, Pseudomonas aeruginosa PA01
cgccgugcaucaccg

SEQ ID NO: 1483046 - RNA, 16 nt, Pseudomonas aeruginosa PA01
cgccgugcaucaccgg

SEQ ID NO: 1483047 - RNA, 18 nt, Pseudomonas aeruginosa PA01
cgccgugcaucaccggca

SEQ ID NO: 1483048 - RNA, 19 nt, Pseudomonas aeruginosa PA01
cgccgugcaucaccggcag

SEQ ID NO: 1483049 - RNA, 21 nt, Pseudomonas aeruginosa PA01
cgccgugcaucaccggcagca

SEQ ID NO: 1483050 - RNA, 22 nt, Pseudomonas aeruginosa PA01
cgccuaccagaccgcagccggc

SEQ ID NO: 1483051 - RNA, 23 nt, Pseudomonas aeruginosa PA01
cgccuaccagaccgcagccggcg

SEQ ID NO: 1483052 - RNA, 20 nt, Pseudomonas aeruginosa PA01
cgccguucucauugcgccgc

SEQ ID NO: 1483053 - RNA, 21 nt, Pseudomonas aeruginosa PA01
cgccguucucauugcgccgcc

SEQ ID NO: 1483054 - RNA, 20 nt, Pseudomonas aeruginosa PA01
cgccuauccacgacgucggc

SEQ ID NO: 1483055 - RNA, 20 nt, Pseudomonas aeruginosa PA01
cgccuauccgugacgucggc

SEQ ID NO: 1483056 - RNA, 17 nt, Pseudomonas aeruginosa PA01
cgccuaccggggcgcgg

SEQ ID NO: 1483057 - RNA, 14 nt, Pseudomonas aeruginosa PA01
cgccguugaugacg

SEQ ID NO: 1483058 - RNA, 20 nt, Pseudomonas aeruginosa PA01
cgccguugaugacgaacugc

SEQ ID NO: 1483059 - RNA, 15 nt, Pseudomonas aeruginosa PA01
cgccguuacgccgga

SEQ ID NO: 1483060 - RNA, 15 nt, Pseudomonas aeruginosa PA01
cgccguuacgccggg

SEQ ID NO: 1483061 - RNA, 13 nt, Pseudomonas aeruginosa PA01
cgccguucacgcc

SEQ ID NO: 1483062 - RNA, 17 nt, Pseudomonas aeruginosa PA01
cgccguucacgccuggc

SEQ ID NO: 1483063 - RNA, 18 nt, Pseudomonas aeruginosa PA01
cgccguucacguugaccu

SEQ ID NO: 1483064 - RNA, 13 nt, Pseudomonas aeruginosa PA01
cgccguucgcccg

SEQ ID NO: 1483065 - RNA, 14 nt, Pseudomonas aeruginosa PA01
cgccguucgcccgc

SEQ ID NO: 1483066 - RNA, 15 nt, Pseudomonas aeruginosa PA01
cgccguucgcccgcc

SEQ ID NO: 1483067 - RNA, 17 nt, Pseudomonas aeruginosa PA01
cgccguguugaugccga

SEQ ID NO: 1483068 - RNA, 14 nt, Pseudomonas aeruginosa PA01
cgccguggaacgca

SEQ ID NO: 1483069 - RNA, 17 nt, Pseudomonas aeruginosa PA01
cgccgugcgcuccgcca

SEQ ID NO: 1483070 - RNA, 20 nt, Pseudomonas aeruginosa PA01
cgccggucgcgcucaggcgc

SEQ ID NO: 1483071 - RNA, 19 nt, Pseudomonas aeruginosa PA01
cgccggucgguucggucga

SEQ ID NO: 1483072 - RNA, 13 nt, Pseudomonas aeruginosa PA01
cgccgguccucga

SEQ ID NO: 1483073 - RNA, 14 nt, Pseudomonas aeruginosa PA01
cgccgguccucgac

SEQ ID NO: 1483074 - RNA, 16 nt, Pseudomonas aeruginosa PA01
cgccgguccucgacau

SEQ ID NO: 1483075 - RNA, 16 nt, Pseudomonas aeruginosa PA01
cgccggucucgauggc

SEQ ID NO: 1483076 - RNA, 13 nt, Pseudomonas aeruginosa PA01
cgccggucucggc

SEQ ID NO: 1483077 - RNA, 15 nt, Pseudomonas aeruginosa PA01
cgccggucucggcga

SEQ ID NO: 1483078 - RNA, 16 nt, Pseudomonas aeruginosa PA01
cgccggucucggcgau

SEQ ID NO: 1483079 - RNA, 16 nt, Pseudomonas aeruginosa PA01
cgccggucuucacgcc

SEQ ID NO: 1483080 - RNA, 17 nt, Pseudomonas aeruginosa PA01
cgccggucuucacgccu

SEQ ID NO: 1483081 - RNA, 19 nt, Pseudomonas aeruginosa PA01
cgccggucuucacgccuug

SEQ ID NO: 1483082 - RNA, 23 nt, Pseudomonas aeruginosa PA01
cgccgguaaugaaaagccccgcg

SEQ ID NO: 1483083 - RNA, 21 nt, Pseudomonas aeruginosa PA01
cgccgguaaugacgaucucga

SEQ ID NO: 1483084 - RNA, 19 nt, Pseudomonas aeruginosa PA01
cgccggguuucacggcgga

SEQ ID NO: 1483085 - RNA, 20 nt, Pseudomonas aeruginosa PA01
cgccggguuucacggcggau

SEQ ID NO: 1483086 - RNA, 18 nt, Pseudomonas aeruginosa PA01
cgccgggggucucguagc

SEQ ID NO: 1483087 - RNA, 19 nt, Pseudomonas aeruginosa PA01
cgccggguggaacgaggcg

SEQ ID NO: 1483088 - RNA, 21 nt, Pseudomonas aeruginosa PA01
cgccggguggaacgaggcgac

SEQ ID NO: 1483089 - RNA, 22 nt, Pseudomonas aeruginosa PA01
cgccggguugccgcuggccucg

SEQ ID NO: 1483090 - RNA, 23 nt, Pseudomonas aeruginosa PA01
cgccggguugccgcuggccucga

SEQ ID NO: 1483091 - RNA, 22 nt, Pseudomonas aeruginosa PA01
cgccggguguuuuuccucggau

SEQ ID NO: 1483092 - RNA, 23 nt, Pseudomonas aeruginosa PA01
cgccggguucaucgacaccccgg

SEQ ID NO: 1483093 - RNA, 13 nt, Pseudomonas aeruginosa PA01
cgccggggcgcag

SEQ ID NO: 1483094 - RNA, 23 nt, Pseudomonas aeruginosa PA01
cgccggggcgcaggucgcuggcg

SEQ ID NO: 1483095 - RNA, 19 nt, Pseudomonas aeruginosa PA01
cgccggggccuacugcugg

SEQ ID NO: 1483096 - RNA, 19 nt, Pseudomonas aeruginosa PA01
cgccggggcagcagggcgu

SEQ ID NO: 1483097 - RNA, 18 nt, Pseudomonas aeruginosa PA01
cgccggggaucaggucgc

SEQ ID NO: 1483098 - RNA, 21 nt, Pseudomonas aeruginosa PA01
cgccggggaucaggucgccgc

SEQ ID NO: 1483099 - RNA, 20 nt, Pseudomonas aeruginosa PA01
cgccggggcgugcaggccgc

SEQ ID NO: 1483100 - RNA, 15 nt, Pseudomonas aeruginosa PA01
cgccggggcgggccg

SEQ ID NO: 1483101 - RNA, 18 nt, Pseudomonas aeruginosa PA01
cgccggggcgggccgcgc

SEQ ID NO: 1483102 - RNA, 19 nt, Pseudomonas aeruginosa PA01
cgccgggcaucaugccgag

SEQ ID NO: 1483103 - RNA, 21 nt, Pseudomonas aeruginosa PA01
cgccgggcaucaugccgagca

SEQ ID NO: 1483104 - RNA, 13 nt, Pseudomonas aeruginosa PA01
cgccgggcaacgc

SEQ ID NO: 1483105 - RNA, 14 nt, Pseudomonas aeruginosa PA01
cgccgggccgcauc

SEQ ID NO: 1483106 - RNA, 17 nt, Pseudomonas aeruginosa PA01
cgccgggccgccuugcg

SEQ ID NO: 1483107 - RNA, 24 nt, Pseudomonas aeruginosa PA01
cgccgggccgccuugcgcagcaac

SEQ ID NO: 1483108 - RNA, 17 nt, Pseudomonas aeruginosa PA01
cgccggaaugacgagcc

SEQ ID NO: 1483109 - RNA, 13 nt, Pseudomonas aeruginosa PA01
cgccggcagcgcc

SEQ ID NO: 1483110 - RNA, 19 nt, Pseudomonas aeruginosa PA01
cgccggcagcgccgcgcgg

SEQ ID NO: 1483111 - RNA, 23 nt, Pseudomonas aeruginosa PA01
cgccggcaggaacgcccgcggca

SEQ ID NO: 1483112 - RNA, 12 nt, Pseudomonas aeruginosa PA01
cgccggcaggcc

SEQ ID NO: 1483113 - RNA, 21 nt, Pseudomonas aeruginosa PA01
cgccggcaggccuucggcgcc

SEQ ID NO: 1483114 - RNA, 22 nt, Pseudomonas aeruginosa PA01
cgccggcaggccuucggcgccg

SEQ ID NO: 1483115 - RNA, 20 nt, Pseudomonas aeruginosa PA01
cgccggcacuguuccucagc

SEQ ID NO: 1483116 - RNA, 21 nt, Pseudomonas aeruginosa PA01
cgccggcacuguuccucagcc

SEQ ID NO: 1483117 - RNA, 15 nt, Pseudomonas aeruginosa PA01
cgccggcaucgccau

SEQ ID NO: 1483118 - RNA, 19 nt, Pseudomonas aeruginosa PA01
cgccggcaucgccauggcg

SEQ ID NO: 1483119 - RNA, 18 nt, Pseudomonas aeruginosa PA01
cgccggcagugugccgcc

SEQ ID NO: 1483120 - RNA, 13 nt, Pseudomonas aeruginosa PA01
cgccggcagguag

SEQ ID NO: 1483121 - RNA, 21 nt, Pseudomonas aeruginosa PA01
cgccgggaugcucaccgcgcu

SEQ ID NO: 1483122 - RNA, 15 nt, Pseudomonas aeruginosa PA01
cgccggugaucgagc

SEQ ID NO: 1483123 - RNA, 20 nt, Pseudomonas aeruginosa PA01
cgccggugaucgagccgccg

SEQ ID NO: 1483124 - RNA, 16 nt, Pseudomonas aeruginosa PA01
cgccggugccaggacc

SEQ ID NO: 1483125 - RNA, 17 nt, Pseudomonas aeruginosa PA01
cgccggugccaggacca

SEQ ID NO: 1483126 - RNA, 22 nt, Pseudomonas aeruginosa PA01
cgccggugccaggaccagcccg

SEQ ID NO: 1483127 - RNA, 19 nt, Pseudomonas aeruginosa PA01
cgccggugcaugaaggcgc

SEQ ID NO: 1483128 - RNA, 21 nt, Pseudomonas aeruginosa PA01
cgccggugcaugaaggcgcug

SEQ ID NO: 1483129 - RNA, 22 nt, Pseudomonas aeruginosa PA01
cgccggugcaugaaggcgcuga

SEQ ID NO: 1483130 - RNA, 17 nt, Pseudomonas aeruginosa PA01
cgccggugcaccaggcg

SEQ ID NO: 1483131 - RNA, 18 nt, Pseudomonas aeruginosa PA01
cgccggugcaccaggcga

SEQ ID NO: 1483132 - RNA, 21 nt, Pseudomonas aeruginosa PA01
cgccggugcaccaggcgaugc

SEQ ID NO: 1483133 - RNA, 23 nt, Pseudomonas aeruginosa PA01
cgccggugcaccaggcgaugcgc

SEQ ID NO: 1483134 - RNA, 19 nt, Pseudomonas aeruginosa PA01
cgccgguucaguucagccg

SEQ ID NO: 1483135 - RNA, 19 nt, Pseudomonas aeruginosa PA01
cgccgguucgcaggccagg

SEQ ID NO: 1483136 - RNA, 22 nt, Pseudomonas aeruginosa PA01
cgccgguucgcaggccaggcgc

SEQ ID NO: 1483137 - RNA, 23 nt, Pseudomonas aeruginosa PA01
cgccgguucgcaggccaggcgca

SEQ ID NO: 1483138 - RNA, 20 nt, Pseudomonas aeruginosa PA01
cgccgguucguugaccgucc

SEQ ID NO: 1483139 - RNA, 14 nt, Pseudomonas aeruginosa PA01
cgccggugacgcug

SEQ ID NO: 1483140 - RNA, 18 nt, Pseudomonas aeruginosa PA01
cgccggugacgcugcuca

SEQ ID NO: 1483141 - RNA, 14 nt, Pseudomonas aeruginosa PA01
cgccggugaacagg

SEQ ID NO: 1483142 - RNA, 16 nt, Pseudomonas aeruginosa PA01
cgccggugaacaggua

SEQ ID NO: 1483143 - RNA, 12 nt, Pseudomonas aeruginosa PA01
cgccggugaccc

SEQ ID NO: 1483144 - RNA, 21 nt, Pseudomonas aeruginosa PA01
cgccggugaggcgcagcagcg

SEQ ID NO: 1483145 - RNA, 20 nt, Pseudomonas aeruginosa PA01
cgccggugauguaggacgcc

SEQ ID NO: 1483146 - RNA, 16 nt, Pseudomonas aeruginosa PA01
cgccguacgcaccgcg

SEQ ID NO: 1483147 - RNA, 14 nt, Pseudomonas aeruginosa PA01
cgccguacagcagg

SEQ ID NO: 1483148 - RNA, 20 nt, Pseudomonas aeruginosa PA01
cgccguacagcaggcaggca

SEQ ID NO: 1483149 - RNA, 18 nt, Pseudomonas aeruginosa PA01
cgccgguugcugcugcgg

SEQ ID NO: 1483150 - RNA, 17 nt, Pseudomonas aeruginosa PA01
cgccgguuucgaccggc

SEQ ID NO: 1483151 - RNA, 20 nt, Pseudomonas aeruginosa PA01
cgccgguuucgaccggcgcg

SEQ ID NO: 1483152 - RNA, 19 nt, Pseudomonas aeruginosa PA01
cgccguagaguucggcugc

SEQ ID NO: 1483153 - RNA, 17 nt, Pseudomonas aeruginosa PA01
cgccguagaacagcacg

SEQ ID NO: 1483154 - RNA, 19 nt, Pseudomonas aeruginosa PA01
cgccguagaacagcacguc

SEQ ID NO: 1483155 - RNA, 23 nt, Pseudomonas aeruginosa PA01
cgccguagaacagcacgucgaua

SEQ ID NO: 1483156 - RNA, 22 nt, Pseudomonas aeruginosa PA01
cgccguaggccacuucccggcg

SEQ ID NO: 1483157 - RNA, 20 nt, Pseudomonas aeruginosa PA01
cgccguagccgucguagcgc

SEQ ID NO: 1483158 - RNA, 23 nt, Pseudomonas aeruginosa PA01
cgccguagccgucguagcgcagc

SEQ ID NO: 1483159 - RNA, 13 nt, Pseudomonas aeruginosa PA01
cgccguagcgcag

SEQ ID NO: 1483160 - RNA, 14 nt, Pseudomonas aeruginosa PA01
cgccgucaccagca

SEQ ID NO: 1483161 - RNA, 23 nt, Pseudomonas aeruginosa PA01
cgccgucaccagcagccccgagg

SEQ ID NO: 1483162 - RNA, 13 nt, Pseudomonas aeruginosa PA01
cgccgucagacgc

SEQ ID NO: 1483163 - RNA, 15 nt, Pseudomonas aeruginosa PA01
cgccgucagacgcgg

SEQ ID NO: 1483164 - RNA, 14 nt, Pseudomonas aeruginosa PA01
cgccgucaucgagc

SEQ ID NO: 1483165 - RNA, 16 nt, Pseudomonas aeruginosa PA01
cgccgucaucgcugac

SEQ ID NO: 1483166 - RNA, 17 nt, Pseudomonas aeruginosa PA01
cgccgucaucgcugacc

SEQ ID NO: 1483167 - RNA, 17 nt, Pseudomonas aeruginosa PA01
cgccgucauggcgggcg

SEQ ID NO: 1483168 - RNA, 18 nt, Pseudomonas aeruginosa PA01
cgccgucauggcgggcgu

SEQ ID NO: 1483169 - RNA, 15 nt, Pseudomonas aeruginosa PA01
cgccguccaccagcc

SEQ ID NO: 1483170 - RNA, 22 nt, Pseudomonas aeruginosa PA01
cgccguccaccagccagcucgg

SEQ ID NO: 1483171 - RNA, 17 nt, Pseudomonas aeruginosa PA01
cgcgccuggcuggccag

SEQ ID NO: 1483172 - RNA, 19 nt, Pseudomonas aeruginosa PA01
cgcgccuggcuggccagca

SEQ ID NO: 1483173 - RNA, 18 nt, Pseudomonas aeruginosa PA01
cgcgccugggccgcgagg

SEQ ID NO: 1483174 - RNA, 20 nt, Pseudomonas aeruginosa PA01
cgcgccugguauugcgccca

SEQ ID NO: 1483175 - RNA, 21 nt, Pseudomonas aeruginosa PA01
cgcgccugcucuucggcggcc

SEQ ID NO: 1483176 - RNA, 20 nt, Pseudomonas aeruginosa PA01
cgcgccugcuucagguagug

SEQ ID NO: 1483177 - RNA, 19 nt, Pseudomonas aeruginosa PA01
cgcgccuggaucagcgccu

SEQ ID NO: 1483178 - RNA, 11 nt, Pseudomonas aeruginosa PA01
cgcgccuggcc

SEQ ID NO: 1483179 - RNA, 14 nt, Pseudomonas aeruginosa PA01
cgcgccuggcccug

SEQ ID NO: 1483180 - RNA, 17 nt, Pseudomonas aeruginosa PA01
cgcgccuggcccuggcg

SEQ ID NO: 1483181 - RNA, 12 nt, Pseudomonas aeruginosa PA01
cgcgccuggccg

SEQ ID NO: 1483182 - RNA, 13 nt, Pseudomonas aeruginosa PA01
cgcgccuggccgu

SEQ ID NO: 1483183 - RNA, 14 nt, Pseudomonas aeruginosa PA01
cgcgccuggccguc

SEQ ID NO: 1483184 - RNA, 16 nt, Pseudomonas aeruginosa PA01
cgcgccuucagcccca

SEQ ID NO: 1483185 - RNA, 14 nt, Pseudomonas aeruginosa PA01
cgcgccuucagcgc

SEQ ID NO: 1483186 - RNA, 21 nt, Pseudomonas aeruginosa PA01
cgcgccuucagcgccagcagg

SEQ ID NO: 1483187 - RNA, 16 nt, Pseudomonas aeruginosa PA01
cgcgccuucagcgccu

SEQ ID NO: 1483188 - RNA, 13 nt, Pseudomonas aeruginosa PA01
cgcgccuucgacg

SEQ ID NO: 1483189 - RNA, 17 nt, Pseudomonas aeruginosa PA01
cgcgccuucugcaccuu

SEQ ID NO: 1483190 - RNA, 21 nt, Pseudomonas aeruginosa PA01
cgcgccuucugcaccuuggcc

SEQ ID NO: 1483191 - RNA, 16 nt, Pseudomonas aeruginosa PA01
cgcgccgguggccagg

SEQ ID NO: 1483192 - RNA, 18 nt, Pseudomonas aeruginosa PA01
cgcgccgguggccaggac

SEQ ID NO: 1483193 - RNA, 20 nt, Pseudomonas aeruginosa PA01
cgcgccgguuucgaccggcg

SEQ ID NO: 1483194 - RNA, 17 nt, Pseudomonas aeruginosa PA01
cgcgccgucgcuggcga

SEQ ID NO: 1483195 - RNA, 13 nt, Pseudomonas aeruginosa PA01
cgcgccucgucgc

SEQ ID NO: 1483196 - RNA, 15 nt, Pseudomonas aeruginosa PA01
cgcgccucgccccag

SEQ ID NO: 1483197 - RNA, 12 nt, Pseudomonas aeruginosa PA01
cgcgccucgcgc

SEQ ID NO: 1483198 - RNA, 13 nt, Pseudomonas aeruginosa PA01
cgcgccucgcgca

SEQ ID NO: 1483199 - RNA, 14 nt, Pseudomonas aeruginosa PA01
cgcgccucgcgcaa

SEQ ID NO: 1483200 - RNA, 20 nt, Pseudomonas aeruginosa PA01
cgcgccugcaggucgaggcg

SEQ ID NO: 1483201 - RNA, 16 nt, Pseudomonas aeruginosa PA01
cgcgccugcaacgcca

SEQ ID NO: 1483202 - RNA, 18 nt, Pseudomonas aeruginosa PA01
cgcgccugcaacgccagc

SEQ ID NO: 1483203 - RNA, 21 nt, Pseudomonas aeruginosa PA01
cgcgccugcaacgccagcagg

SEQ ID NO: 1483204 - RNA, 20 nt, Pseudomonas aeruginosa PA01
cgcgccugcaacguccucgc

SEQ ID NO: 1483205 - RNA, 19 nt, Pseudomonas aeruginosa PA01
cgcgccucugagacgcgaa

SEQ ID NO: 1483206 - RNA, 22 nt, Pseudomonas aeruginosa PA01
cgcgccucuuccuggaccuccg

SEQ ID NO: 1483207 - RNA, 16 nt, Pseudomonas aeruginosa PA01
cgcgccucuucgcagg

SEQ ID NO: 1483208 - RNA, 17 nt, Pseudomonas aeruginosa PA01
cgcgccucuucgcagga

SEQ ID NO: 1483209 - RNA, 21 nt, Pseudomonas aeruginosa PA01
cgcgccugaaacugcggaugu

SEQ ID NO: 1483210 - RNA, 16 nt, Pseudomonas aeruginosa PA01
cgcgcgauggccggcg

SEQ ID NO: 1483211 - RNA, 12 nt, Pseudomonas aeruginosa PA01
cgcgcgaucaca

SEQ ID NO: 1483212 - RNA, 16 nt, Pseudomonas aeruginosa PA01
cgcgcgcaaggccgaa

SEQ ID NO: 1483213 - RNA, 21 nt, Pseudomonas aeruginosa PA01
cgcgcgcaggaccagacgcgg

SEQ ID NO: 1483214 - RNA, 13 nt, Pseudomonas aeruginosa PA01
cgcgcgaggcgcu

SEQ ID NO: 1483215 - RNA, 19 nt, Pseudomonas aeruginosa PA01
cgcgcgauaccgacaagca

SEQ ID NO: 1483216 - RNA, 22 nt, Pseudomonas aeruginosa PA01
cgcgcgacacauggucggccag

SEQ ID NO: 1483217 - RNA, 23 nt, Pseudomonas aeruginosa PA01
cgcgcgacacauggucggccagg

SEQ ID NO: 1483218 - RNA, 14 nt, Pseudomonas aeruginosa PA01
cgcgcgaagcacgc

SEQ ID NO: 1483219 - RNA, 21 nt, Pseudomonas aeruginosa PA01
cgcgccuugcucaggucgucg

SEQ ID NO: 1483220 - RNA, 18 nt, Pseudomonas aeruginosa PA01
cgcgccuuucgcucaggc

SEQ ID NO: 1483221 - RNA, 15 nt, Pseudomonas aeruginosa PA01
cgcgcgaccgcggcg

SEQ ID NO: 1483222 - RNA, 14 nt, Pseudomonas aeruginosa PA01
cgcgccgcgccagc

SEQ ID NO: 1483223 - RNA, 17 nt, Pseudomonas aeruginosa PA01
cgcgccgcgccagcagg

SEQ ID NO: 1483224 - RNA, 16 nt, Pseudomonas aeruginosa PA01
cgcgccgggcuggccg

SEQ ID NO: 1483225 - RNA, 17 nt, Pseudomonas aeruginosa PA01
cgcgccgggcuggccgu

SEQ ID NO: 1483226 - RNA, 23 nt, Pseudomonas aeruginosa PA01
cgcgccgguaaugacgaucucga

SEQ ID NO: 1483227 - RNA, 19 nt, Pseudomonas aeruginosa PA01
cgcgccgggaagcaccgac

SEQ ID NO: 1483228 - RNA, 20 nt, Pseudomonas aeruginosa PA01
cgcgccgggaagcaccgacu

SEQ ID NO: 1483229 - RNA, 15 nt, Pseudomonas aeruginosa PA01
cgcgccgggucgaca

SEQ ID NO: 1483230 - RNA, 17 nt, Pseudomonas aeruginosa PA01
cgcgccgggucgacaug

SEQ ID NO: 1483231 - RNA, 22 nt, Pseudomonas aeruginosa PA01
cgcgccgggucgacaugcaggc

SEQ ID NO: 1483232 - RNA, 12 nt, Pseudomonas aeruginosa PA01
cgcgccgccgga

SEQ ID NO: 1483233 - RNA, 15 nt, Pseudomonas aeruginosa PA01
cgcgccgccgggcgc

SEQ ID NO: 1483234 - RNA, 16 nt, Pseudomonas aeruginosa PA01
cgcgccgccgggcgcc

SEQ ID NO: 1483235 - RNA, 15 nt, Pseudomonas aeruginosa PA01
cgcgccgccgguagc

SEQ ID NO: 1483236 - RNA, 20 nt, Pseudomonas aeruginosa PA01
cgcgccgccgaucugcuggg

SEQ ID NO: 1483237 - RNA, 16 nt, Pseudomonas aeruginosa PA01
cgcgccgcccuggccg

SEQ ID NO: 1483238 - RNA, 17 nt, Pseudomonas aeruginosa PA01
cgcgccgcccuggccgc

SEQ ID NO: 1483239 - RNA, 14 nt, Pseudomonas aeruginosa PA01
cgcgccgccgaagc

SEQ ID NO: 1483240 - RNA, 22 nt, Pseudomonas aeruginosa PA01
cgcgccgccgaagccgacgccg

SEQ ID NO: 1483241 - RNA, 15 nt, Pseudomonas aeruginosa PA01
cgcgccgccgccgcg

SEQ ID NO: 1483242 - RNA, 17 nt, Pseudomonas aeruginosa PA01
cgcgccgccgccgcggu

SEQ ID NO: 1483243 - RNA, 14 nt, Pseudomonas aeruginosa PA01
cgcgccgccgcggc

SEQ ID NO: 1483244 - RNA, 18 nt, Pseudomonas aeruginosa PA01
cgcgccgccgcggccagc

SEQ ID NO: 1483245 - RNA, 14 nt, Pseudomonas aeruginosa PA01
cgcgccgagccagg

SEQ ID NO: 1483246 - RNA, 17 nt, Pseudomonas aeruginosa PA01
cgcgccgagccagguac

SEQ ID NO: 1483247 - RNA, 14 nt, Pseudomonas aeruginosa PA01
cgcgccgaguuggc

SEQ ID NO: 1483248 - RNA, 17 nt, Pseudomonas aeruginosa PA01
cgcgccgacgacccgga

SEQ ID NO: 1483249 - RNA, 20 nt, Pseudomonas aeruginosa PA01
cgcgccgagauagcggcaac

SEQ ID NO: 1483250 - RNA, 24 nt, Pseudomonas aeruginosa PA01
cgcgcaaccguuccagcgccucgg

SEQ ID NO: 1483251 - RNA, 13 nt, Pseudomonas aeruginosa PA01
cgcgcaacgccga

SEQ ID NO: 1483252 - RNA, 14 nt, Pseudomonas aeruginosa PA01
cgcgcaacgccgac

SEQ ID NO: 1483253 - RNA, 15 nt, Pseudomonas aeruginosa PA01
cgcgcaacgccgacg

SEQ ID NO: 1483254 - RNA, 16 nt, Pseudomonas aeruginosa PA01
cgcgcaacgccgacgg

SEQ ID NO: 1483255 - RNA, 19 nt, Pseudomonas aeruginosa PA01
cgcgcaacgccgacggcgu

SEQ ID NO: 1483256 - RNA, 21 nt, Pseudomonas aeruginosa PA01
cgcgcaacgccgacggcgugc

SEQ ID NO: 1483257 - RNA, 14 nt, Pseudomonas aeruginosa PA01
cgcgcaacggcagc

SEQ ID NO: 1483258 - RNA, 20 nt, Pseudomonas aeruginosa PA01
cgcgcaacggcagcgcuucg

SEQ ID NO: 1483259 - RNA, 14 nt, Pseudomonas aeruginosa PA01
cgcgccccacggcg

SEQ ID NO: 1483260 - RNA, 13 nt, Pseudomonas aeruginosa PA01
cgcgccccagcgg

SEQ ID NO: 1483261 - RNA, 15 nt, Pseudomonas aeruginosa PA01
cgcgccccagcggca

SEQ ID NO: 1483262 - RNA, 17 nt, Pseudomonas aeruginosa PA01
cgcgccccagcggcagg

SEQ ID NO: 1483263 - RNA, 20 nt, Pseudomonas aeruginosa PA01
cgcgccccagcggcaggcac

SEQ ID NO: 1483264 - RNA, 14 nt, Pseudomonas aeruginosa PA01
cgcgccccgccagg

SEQ ID NO: 1483265 - RNA, 16 nt, Pseudomonas aeruginosa PA01
cgcgcccccuggccgu

SEQ ID NO: 1483266 - RNA, 15 nt, Pseudomonas aeruginosa PA01
cgcgccccggcgagc

SEQ ID NO: 1483267 - RNA, 20 nt, Pseudomonas aeruginosa PA01
cgcgccccgcuugccgucga

SEQ ID NO: 1483268 - RNA, 13 nt, Pseudomonas aeruginosa PA01
cgcgccccugcgc

SEQ ID NO: 1483269 - RNA, 14 nt, Pseudomonas aeruginosa PA01
cgcgcccgccaggu

SEQ ID NO: 1483270 - RNA, 23 nt, Pseudomonas aeruginosa PA01
cgcgcccgccuggaaggcgcugg

SEQ ID NO: 1483271 - RNA, 21 nt, Pseudomonas aeruginosa PA01
cgcgccgacccagagcgcgcc

SEQ ID NO: 1483272 - RNA, 14 nt, Pseudomonas aeruginosa PA01
cgcgcccggccuuc

SEQ ID NO: 1483273 - RNA, 16 nt, Pseudomonas aeruginosa PA01
cgcgcccggccaggcc

SEQ ID NO: 1483274 - RNA, 19 nt, Pseudomonas aeruginosa PA01
cgcgcccggccaggccgcc

SEQ ID NO: 1483275 - RNA, 21 nt, Pseudomonas aeruginosa PA01
cgcgcccggccaggccgccca

SEQ ID NO: 1483276 - RNA, 23 nt, Pseudomonas aeruginosa PA01
cgcgcccggcgccaccccgccgc

SEQ ID NO: 1483277 - RNA, 17 nt, Pseudomonas aeruginosa PA01
cgcgcccggcgccaggc

SEQ ID NO: 1483278 - RNA, 21 nt, Pseudomonas aeruginosa PA01
cgcgcccggcgccaggcugac

SEQ ID NO: 1483279 - RNA, 14 nt, Pseudomonas aeruginosa PA01
cgcgcccggcgccc

SEQ ID NO: 1483280 - RNA, 13 nt, Pseudomonas aeruginosa PA01
cgcgcgccgggcu

SEQ ID NO: 1483281 - RNA, 21 nt, Pseudomonas aeruginosa PA01
cgcgcgccugcaacgccagca

SEQ ID NO: 1483282 - RNA, 16 nt, Pseudomonas aeruginosa PA01
cgcgcgccuggcuggc

SEQ ID NO: 1483283 - RNA, 14 nt, Pseudomonas aeruginosa PA01
cgcgcgccuucagc

SEQ ID NO: 1483284 - RNA, 19 nt, Pseudomonas aeruginosa PA01
cgcgcgccgagcccccggc

SEQ ID NO: 1483285 - RNA, 10 nt, Pseudomonas aeruginosa PA01
cgcgcgccga

SEQ ID NO: 1483286 - RNA, 18 nt, Pseudomonas aeruginosa PA01
cgcgcgccagucccgcaa

SEQ ID NO: 1483287 - RNA, 21 nt, Pseudomonas aeruginosa PA01
cgcgcgccaucaguuccucgc

SEQ ID NO: 1483288 - RNA, 13 nt, Pseudomonas aeruginosa PA01
cgcgcgccagguc

SEQ ID NO: 1483289 - RNA, 15 nt, Pseudomonas aeruginosa PA01
cgcgcgggucgucga

SEQ ID NO: 1483290 - RNA, 13 nt, Pseudomonas aeruginosa PA01
cgcgcgcgcaagg

SEQ ID NO: 1483291 - RNA, 21 nt, Pseudomonas aeruginosa PA01
cgcgcgggugcggcuggcgcg

SEQ ID NO: 1483292 - RNA, 16 nt, Pseudomonas aeruginosa PA01
cgcgcgucguccaggg

SEQ ID NO: 1483293 - RNA, 14 nt, Pseudomonas aeruginosa PA01
cgcgcgucggcggc

SEQ ID NO: 1483294 - RNA, 17 nt, Pseudomonas aeruginosa PA01
cgcgcgugccccguggc

SEQ ID NO: 1483295 - RNA, 17 nt, Pseudomonas aeruginosa PA01
cgcgcggggucuggccg

SEQ ID NO: 1483296 - RNA, 18 nt, Pseudomonas aeruginosa PA01
cgcgcggggucuggccgg

SEQ ID NO: 1483297 - RNA, 17 nt, Pseudomonas aeruginosa PA01
cgcgcgggccuucgccu

SEQ ID NO: 1483298 - RNA, 14 nt, Pseudomonas aeruginosa PA01
cgcgcucgcugucg

SEQ ID NO: 1483299 - RNA, 17 nt, Pseudomonas aeruginosa PA01
cgcgcucgcugucgcuc

SEQ ID NO: 1483300 - RNA, 14 nt, Pseudomonas aeruginosa PA01
cgcgcucggccagu

SEQ ID NO: 1483301 - RNA, 22 nt, Pseudomonas aeruginosa PA01
cgcgcucggaucaggcgggcuc

SEQ ID NO: 1483302 - RNA, 13 nt, Pseudomonas aeruginosa PA01
cgcgcucagcgcg

SEQ ID NO: 1483303 - RNA, 16 nt, Pseudomonas aeruginosa PA01
cgcgcucuucgccgcg

SEQ ID NO: 1483304 - RNA, 13 nt, Pseudomonas aeruginosa PA01
cgcgcucggccgc

SEQ ID NO: 1483305 - RNA, 16 nt, Pseudomonas aeruginosa PA01
cgcgcucggccgccug

SEQ ID NO: 1483306 - RNA, 18 nt, Pseudomonas aeruginosa PA01
cgcgcucggccgccuggc

SEQ ID NO: 1483307 - RNA, 13 nt, Pseudomonas aeruginosa PA01
cgcgcucggccug

SEQ ID NO: 1483308 - RNA, 18 nt, Pseudomonas aeruginosa PA01
cgcgcucggccuggugca

SEQ ID NO: 1483309 - RNA, 12 nt, Pseudomonas aeruginosa PA01
cgcgcucggcgg

SEQ ID NO: 1483310 - RNA, 16 nt, Pseudomonas aeruginosa PA01
cgcgcucggcggucag

SEQ ID NO: 1483311 - RNA, 23 nt, Pseudomonas aeruginosa PA01
cgcgcucggcggucaggccaagc

SEQ ID NO: 1483312 - RNA, 15 nt, Pseudomonas aeruginosa PA01
cgcgcguuucagcgc

SEQ ID NO: 1483313 - RNA, 12 nt, Pseudomonas aeruginosa PA01
cgcgcguggccg

SEQ ID NO: 1483314 - RNA, 15 nt, Pseudomonas aeruginosa PA01
cgcgcguggccgcca

SEQ ID NO: 1483315 - RNA, 17 nt, Pseudomonas aeruginosa PA01
cgcgcguggccgccagg

SEQ ID NO: 1483316 - RNA, 22 nt, Pseudomonas aeruginosa PA01
cgcgcguggcuucguccagcga

SEQ ID NO: 1483317 - RNA, 15 nt, Pseudomonas aeruginosa PA01
cgcgcguucgcgcga

SEQ ID NO: 1483318 - RNA, 15 nt, Pseudomonas aeruginosa PA01
cgcgcguuccagguc

SEQ ID NO: 1483319 - RNA, 16 nt, Pseudomonas aeruginosa PA01
cgcgcguuccaggucg

SEQ ID NO: 1483320 - RNA, 22 nt, Pseudomonas aeruginosa PA01
cgcgcguuccaggucgcugcug

SEQ ID NO: 1483321 - RNA, 16 nt, Pseudomonas aeruginosa PA01
cgcggaucagucagga

SEQ ID NO: 1483322 - RNA, 19 nt, Pseudomonas aeruginosa PA01
cgcggaucugcuccugcag

SEQ ID NO: 1483323 - RNA, 16 nt, Pseudomonas aeruginosa PA01
cgcggaugacgggcga

SEQ ID NO: 1483324 - RNA, 13 nt, Pseudomonas aeruginosa PA01
cgcggaucaccug

SEQ ID NO: 1483325 - RNA, 20 nt, Pseudomonas aeruginosa PA01
cgcggaucaccuggccgugc

SEQ ID NO: 1483326 - RNA, 13 nt, Pseudomonas aeruginosa PA01
cgcggauccacgc

SEQ ID NO: 1483327 - RNA, 19 nt, Pseudomonas aeruginosa PA01
cgcggauccccucccgcgc

SEQ ID NO: 1483328 - RNA, 21 nt, Pseudomonas aeruginosa PA01
cgcggauccccucccgcgcca

SEQ ID NO: 1483329 - RNA, 23 nt, Pseudomonas aeruginosa PA01
cgcggauccccucccgcgccagc

SEQ ID NO: 1483330 - RNA, 14 nt, Pseudomonas aeruginosa PA01
cgcggaucaacgcc

SEQ ID NO: 1483331 - RNA, 18 nt, Pseudomonas aeruginosa PA01
cgcggaucaacgccgguc

SEQ ID NO: 1483332 - RNA, 17 nt, Pseudomonas aeruginosa PA01
cgcggauaucgcuggcg

SEQ ID NO: 1483333 - RNA, 16 nt, Pseudomonas aeruginosa PA01
cgcggauacggcaggg

SEQ ID NO: 1483334 - RNA, 19 nt, Pseudomonas aeruginosa PA01
cgcggagcaccgcgccuuc

SEQ ID NO: 1483335 - RNA, 24 nt, Pseudomonas aeruginosa PA01
cgcggagaggaucagcgaacccgg

SEQ ID NO: 1483336 - RNA, 17 nt, Pseudomonas aeruginosa PA01
cgcggacuccggaggcg

SEQ ID NO: 1483337 - RNA, 19 nt, Pseudomonas aeruginosa PA01
cgcggagcguccaccagcg

SEQ ID NO: 1483338 - RNA, 23 nt, Pseudomonas aeruginosa PA01
cgcggagcguccaccagcgcccg

SEQ ID NO: 1483339 - RNA, 12 nt, Pseudomonas aeruginosa PA01
cgcggagggcgg

SEQ ID NO: 1483340 - RNA, 13 nt, Pseudomonas aeruginosa PA01
cgcggagucgccg

SEQ ID NO: 1483341 - RNA, 19 nt, Pseudomonas aeruginosa PA01
cgcggaaguaggcggcgga

SEQ ID NO: 1483342 - RNA, 11 nt, Pseudomonas aeruginosa PA01
cgcggaagucg

SEQ ID NO: 1483343 - RNA, 19 nt, Pseudomonas aeruginosa PA01
cgcggaccuucgacggcag

SEQ ID NO: 1483344 - RNA, 20 nt, Pseudomonas aeruginosa PA01
cgcggaccuucgacggcagg

SEQ ID NO: 1483345 - RNA, 23 nt, Pseudomonas aeruginosa PA01
cgcggaccuucgacggcaggugg

SEQ ID NO: 1483346 - RNA, 21 nt, Pseudomonas aeruginosa PA01
cgcggacguaacggcuugagg

SEQ ID NO: 1483347 - RNA, 13 nt, Pseudomonas aeruginosa PA01
cgcggacgggccg

SEQ ID NO: 1483348 - RNA, 15 nt, Pseudomonas aeruginosa PA01
cgcggacgggccgcg

SEQ ID NO: 1483349 - RNA, 19 nt, Pseudomonas aeruginosa PA01
cgcggacgggccgcgccgc

SEQ ID NO: 1483350 - RNA, 13 nt, Pseudomonas aeruginosa PA01
cgcggacggccgg

SEQ ID NO: 1483351 - RNA, 15 nt, Pseudomonas aeruginosa PA01
cgcggacggccggcu

SEQ ID NO: 1483352 - RNA, 14 nt, Pseudomonas aeruginosa PA01
cgcggacggccugc

SEQ ID NO: 1483353 - RNA, 15 nt, Pseudomonas aeruginosa PA01
cgcggacggccugcg

SEQ ID NO: 1483354 - RNA, 14 nt, Pseudomonas aeruginosa PA01
cgcggacgcuggcg

SEQ ID NO: 1483355 - RNA, 22 nt, Pseudomonas aeruginosa PA01
cgcggacgcuggcgaucaugcc

SEQ ID NO: 1483356 - RNA, 15 nt, Pseudomonas aeruginosa PA01
cgcggacgccgaagc

SEQ ID NO: 1483357 - RNA, 18 nt, Pseudomonas aeruginosa PA01
cgcggacgccgaagcggg

SEQ ID NO: 1483358 - RNA, 22 nt, Pseudomonas aeruginosa PA01
cgcggacgauggucgccgcgac

SEQ ID NO: 1483359 - RNA, 18 nt, Pseudomonas aeruginosa PA01
cgcgcuggucguaggcgc

SEQ ID NO: 1483360 - RNA, 21 nt, Pseudomonas aeruginosa PA01
cgcgcuggucguaggcgcggg

SEQ ID NO: 1483361 - RNA, 15 nt, Pseudomonas aeruginosa PA01
cgcgcugggcgcagc

SEQ ID NO: 1483362 - RNA, 15 nt, Pseudomonas aeruginosa PA01
cgcggaagccgugca

SEQ ID NO: 1483363 - RNA, 16 nt, Pseudomonas aeruginosa PA01
cgcggaagccgugcaa

SEQ ID NO: 1483364 - RNA, 13 nt, Pseudomonas aeruginosa PA01
cgcggaacuucgc

SEQ ID NO: 1483365 - RNA, 20 nt, Pseudomonas aeruginosa PA01
cgcgcugguuuagcucggcg

SEQ ID NO: 1483366 - RNA, 17 nt, Pseudomonas aeruginosa PA01
cgcgcuguagccggcgc

SEQ ID NO: 1483367 - RNA, 21 nt, Pseudomonas aeruginosa PA01
cgcggcggcaggccagcuucc

SEQ ID NO: 1483368 - RNA, 16 nt, Pseudomonas aeruginosa PA01
cgcggcggcggacagc

SEQ ID NO: 1483369 - RNA, 12 nt, Pseudomonas aeruginosa PA01
cgcggcggcggc

SEQ ID NO: 1483370 - RNA, 13 nt, Pseudomonas aeruginosa PA01
cgcggcggcgcgg

SEQ ID NO: 1483371 - RNA, 16 nt, Pseudomonas aeruginosa PA01
cgcggcggcgcggaga

SEQ ID NO: 1483372 - RNA, 15 nt, Pseudomonas aeruginosa PA01
cgcggcggcgcgucg

SEQ ID NO: 1483373 - RNA, 13 nt, Pseudomonas aeruginosa PA01
cgcggcggcggcc

SEQ ID NO: 1483374 - RNA, 15 nt, Pseudomonas aeruginosa PA01
cgcggcggcggccag

SEQ ID NO: 1483375 - RNA, 16 nt, Pseudomonas aeruginosa PA01
cgcggcggcggccagc

SEQ ID NO: 1483376 - RNA, 17 nt, Pseudomonas aeruginosa PA01
cgcggcggcggccagca

SEQ ID NO: 1483377 - RNA, 16 nt, Pseudomonas aeruginosa PA01
cgcggcggcggccgca

SEQ ID NO: 1483378 - RNA, 19 nt, Pseudomonas aeruginosa PA01
cgcggcggcgugcaggccg

SEQ ID NO: 1483379 - RNA, 23 nt, Pseudomonas aeruginosa PA01
cgcggcggguagagucgcucgcg

SEQ ID NO: 1483380 - RNA, 20 nt, Pseudomonas aeruginosa PA01
cgcggcggguggcgcugucg

SEQ ID NO: 1483381 - RNA, 17 nt, Pseudomonas aeruginosa PA01
cgcggcguaaucgcgcc

SEQ ID NO: 1483382 - RNA, 19 nt, Pseudomonas aeruginosa PA01
cgcggcguaaucgcgccag

SEQ ID NO: 1483383 - RNA, 21 nt, Pseudomonas aeruginosa PA01
cgcggcguaaucgcgccaggc

SEQ ID NO: 1483384 - RNA, 18 nt, Pseudomonas aeruginosa PA01
cgcggcguaccagccgcg

SEQ ID NO: 1483385 - RNA, 15 nt, Pseudomonas aeruginosa PA01
cgcggcguaggcgcg

SEQ ID NO: 1483386 - RNA, 14 nt, Pseudomonas aeruginosa PA01
cgcggcguaggcgg

SEQ ID NO: 1483387 - RNA, 21 nt, Pseudomonas aeruginosa PA01
cgcggcguaccuucgagcagg

SEQ ID NO: 1483388 - RNA, 18 nt, Pseudomonas aeruginosa PA01
cgcggcguaggcggugcg

SEQ ID NO: 1483389 - RNA, 19 nt, Pseudomonas aeruginosa PA01
cgcggcguggccggcgacc

SEQ ID NO: 1483390 - RNA, 22 nt, Pseudomonas aeruginosa PA01
cgcggcguggccggcgaccagc

SEQ ID NO: 1483391 - RNA, 15 nt, Pseudomonas aeruginosa PA01
cgcggcguggcggaa

SEQ ID NO: 1483392 - RNA, 19 nt, Pseudomonas aeruginosa PA01
cgcggcguucaucgcucau

SEQ ID NO: 1483393 - RNA, 17 nt, Pseudomonas aeruginosa PA01
cgcggcguucgcccugc

SEQ ID NO: 1483394 - RNA, 23 nt, Pseudomonas aeruginosa PA01
cgcggcguuagccgccugcggcg

SEQ ID NO: 1483395 - RNA, 17 nt, Pseudomonas aeruginosa PA01
cgcggcguuauccgccc

SEQ ID NO: 1483396 - RNA, 15 nt, Pseudomonas aeruginosa PA01
cgcggcguugcgcgg

SEQ ID NO: 1483397 - RNA, 16 nt, Pseudomonas aeruginosa PA01
cgcggcguuguaggaa

SEQ ID NO: 1483398 - RNA, 19 nt, Pseudomonas aeruginosa PA01
cgcggcguugucggccagc

SEQ ID NO: 1483399 - RNA, 21 nt, Pseudomonas aeruginosa PA01
cgcggcguugucggccagcag

SEQ ID NO: 1483400 - RNA, 22 nt, Pseudomonas aeruginosa PA01
cgcggcguugucggccagcagc

SEQ ID NO: 1483401 - RNA, 23 nt, Pseudomonas aeruginosa PA01
cgcggcguugucggccagcagca

SEQ ID NO: 1483402 - RNA, 19 nt, Pseudomonas aeruginosa PA01
cgcggcuacccucucccca

SEQ ID NO: 1483403 - RNA, 22 nt, Pseudomonas aeruginosa PA01
cgcggcuacccucuccccaacc

SEQ ID NO: 1483404 - RNA, 14 nt, Pseudomonas aeruginosa PA01
cgcggcuccagccg

SEQ ID NO: 1483405 - RNA, 19 nt, Pseudomonas aeruginosa PA01
cgcggcuccagccgcugca

SEQ ID NO: 1483406 - RNA, 15 nt, Pseudomonas aeruginosa PA01
cgcggcugaagaagc

SEQ ID NO: 1483407 - RNA, 20 nt, Pseudomonas aeruginosa PA01
cgcggcugaagaagcugccc

SEQ ID NO: 1483408 - RNA, 13 nt, Pseudomonas aeruginosa PA01
cgcggcugacgaa

SEQ ID NO: 1483409 - RNA, 21 nt, Pseudomonas aeruginosa PA01
cgcggcugaucggccgccagu

SEQ ID NO: 1483410 - RNA, 16 nt, Pseudomonas aeruginosa PA01
cgcggauguucgccac

SEQ ID NO: 1483411 - RNA, 15 nt, Pseudomonas aeruginosa PA01
cgcggauuggccggg

SEQ ID NO: 1483412 - RNA, 18 nt, Pseudomonas aeruginosa PA01
cgcggauuggccgggccg

SEQ ID NO: 1483413 - RNA, 16 nt, Pseudomonas aeruginosa PA01
cgcggcaaagugcggu

SEQ ID NO: 1483414 - RNA, 14 nt, Pseudomonas aeruginosa PA01
cgcggccccagcac

SEQ ID NO: 1483415 - RNA, 17 nt, Pseudomonas aeruginosa PA01
cgcggccccagcacugg

SEQ ID NO: 1483416 - RNA, 22 nt, Pseudomonas aeruginosa PA01
cgcggcccgccgccggggcggg

SEQ ID NO: 1483417 - RNA, 19 nt, Pseudomonas aeruginosa PA01
cgcggcccguccgcgccac

SEQ ID NO: 1483418 - RNA, 13 nt, Pseudomonas aeruginosa PA01
cgcggcccggcgc

SEQ ID NO: 1483419 - RNA, 15 nt, Pseudomonas aeruginosa PA01
cgcggcccugcgccg

SEQ ID NO: 1483420 - RNA, 19 nt, Pseudomonas aeruginosa PA01
cgcggcccugcgccgcagc

SEQ ID NO: 1483421 - RNA, 21 nt, Pseudomonas aeruginosa PA01
cgcggcccugcgccgcagcgg

SEQ ID NO: 1483422 - RNA, 14 nt, Pseudomonas aeruginosa PA01
cgcggcccugcucg

SEQ ID NO: 1483423 - RNA, 19 nt, Pseudomonas aeruginosa PA01
cgcggcccugcucgccggc

SEQ ID NO: 1483424 - RNA, 20 nt, Pseudomonas aeruginosa PA01
cgcggcccugcucgccggcg

SEQ ID NO: 1483425 - RNA, 17 nt, Pseudomonas aeruginosa PA01
cgcggcccuucgacgac

SEQ ID NO: 1483426 - RNA, 22 nt, Pseudomonas aeruginosa PA01
cgcggccggccacgcgaccagc

SEQ ID NO: 1483427 - RNA, 16 nt, Pseudomonas aeruginosa PA01
cgcggccggcaggccg

SEQ ID NO: 1483428 - RNA, 14 nt, Pseudomonas aeruginosa PA01
cgcggccggcgccg

SEQ ID NO: 1483429 - RNA, 11 nt, Pseudomonas aeruginosa PA01
cgcggccggcg

SEQ ID NO: 1483430 - RNA, 17 nt, Pseudomonas aeruginosa PA01
cgcggccggcgaccuug

SEQ ID NO: 1483431 - RNA, 22 nt, Pseudomonas aeruginosa PA01
cgcggccggcuucagcaacucu

SEQ ID NO: 1483432 - RNA, 12 nt, Pseudomonas aeruginosa PA01
cgcggcgcagcg

SEQ ID NO: 1483433 - RNA, 13 nt, Pseudomonas aeruginosa PA01
cgcggcgcagcgg

SEQ ID NO: 1483434 - RNA, 14 nt, Pseudomonas aeruginosa PA01
cgcggcgcagcggc

SEQ ID NO: 1483435 - RNA, 15 nt, Pseudomonas aeruginosa PA01
cgcggcgcagcggcg

SEQ ID NO: 1483436 - RNA, 16 nt, Pseudomonas aeruginosa PA01
cgcggcgcagcggcga

SEQ ID NO: 1483437 - RNA, 13 nt, Pseudomonas aeruginosa PA01
cgcggcgcaggcg

SEQ ID NO: 1483438 - RNA, 18 nt, Pseudomonas aeruginosa PA01
cgcggcgcaggcgaugau

SEQ ID NO: 1483439 - RNA, 20 nt, Pseudomonas aeruginosa PA01
cgcggcgcaggcugucggcc

SEQ ID NO: 1483440 - RNA, 21 nt, Pseudomonas aeruginosa PA01
cgcggcgcaggcugucggcca

SEQ ID NO: 1483441 - RNA, 16 nt, Pseudomonas aeruginosa PA01
cgcggcgccagcgccc

SEQ ID NO: 1483442 - RNA, 20 nt, Pseudomonas aeruginosa PA01
cgcggcgccagcgccccacc

SEQ ID NO: 1483443 - RNA, 22 nt, Pseudomonas aeruginosa PA01
cgcggcgccugcugcgcgggug

SEQ ID NO: 1483444 - RNA, 12 nt, Pseudomonas aeruginosa PA01
cgcggcgccugg

SEQ ID NO: 1483445 - RNA, 18 nt, Pseudomonas aeruginosa PA01
cgcggcgcaguucgucga

SEQ ID NO: 1483446 - RNA, 14 nt, Pseudomonas aeruginosa PA01
cgcggcgcagcuuc

SEQ ID NO: 1483447 - RNA, 18 nt, Pseudomonas aeruginosa PA01
cgcggcgauggccgccag

SEQ ID NO: 1483448 - RNA, 21 nt, Pseudomonas aeruginosa PA01
cgcggcgauggccgccagcag

SEQ ID NO: 1483449 - RNA, 17 nt, Pseudomonas aeruginosa PA01
cgcggcgagcagcggcg

SEQ ID NO: 1483450 - RNA, 22 nt, Pseudomonas aeruginosa PA01
cgcggcgagcaucucggccagg

SEQ ID NO: 1483451 - RNA, 13 nt, Pseudomonas aeruginosa PA01
cgcggucgagcag

SEQ ID NO: 1483452 - RNA, 17 nt, Pseudomonas aeruginosa PA01
cgcggucgagcagcgcc

SEQ ID NO: 1483453 - RNA, 18 nt, Pseudomonas aeruginosa PA01
cgcggucgagcagcgccg

SEQ ID NO: 1483454 - RNA, 20 nt, Pseudomonas aeruginosa PA01
cgcggucgagcagcgccgcg

SEQ ID NO: 1483455 - RNA, 21 nt, Pseudomonas aeruginosa PA01
cgcggucccuggaucugcggg

SEQ ID NO: 1483456 - RNA, 18 nt, Pseudomonas aeruginosa PA01
cgcggucgagcucggcca

SEQ ID NO: 1483457 - RNA, 18 nt, Pseudomonas aeruginosa PA01
cgcggggucuggccggcg

SEQ ID NO: 1483458 - RNA, 17 nt, Pseudomonas aeruginosa PA01
cgcggguuacuucgccg

SEQ ID NO: 1483459 - RNA, 18 nt, Pseudomonas aeruginosa PA01
cgcggguuccucacggcg

SEQ ID NO: 1483460 - RNA, 22 nt, Pseudomonas aeruginosa PA01
cgcggguuccucacggcgcagc

SEQ ID NO: 1483461 - RNA, 23 nt, Pseudomonas aeruginosa PA01
cgcggggcguuccuucaacagcg

SEQ ID NO: 1483462 - RNA, 17 nt, Pseudomonas aeruginosa PA01
cgcgggguagggguggc

SEQ ID NO: 1483463 - RNA, 23 nt, Pseudomonas aeruginosa PA01
cgcgggguagggguggccaggcg

SEQ ID NO: 1483464 - RNA, 22 nt, Pseudomonas aeruginosa PA01
cgcggggcccggcuccagccgg

SEQ ID NO: 1483465 - RNA, 15 nt, Pseudomonas aeruginosa PA01
cgcgggcggccucga

SEQ ID NO: 1483466 - RNA, 15 nt, Pseudomonas aeruginosa PA01
cgcggggcgaggucg

SEQ ID NO: 1483467 - RNA, 21 nt, Pseudomonas aeruginosa PA01
cgcggggcgaggucggccugc

SEQ ID NO: 1483468 - RNA, 12 nt, Pseudomonas aeruginosa PA01
cgcgguggaggc

SEQ ID NO: 1483469 - RNA, 18 nt, Pseudomonas aeruginosa PA01
cgcgguggaggcggcggu

SEQ ID NO: 1483470 - RNA, 19 nt, Pseudomonas aeruginosa PA01
cgcggugcgguuguucgcc

SEQ ID NO: 1483471 - RNA, 17 nt, Pseudomonas aeruginosa PA01
cgcggugggcuccagcg

SEQ ID NO: 1483472 - RNA, 19 nt, Pseudomonas aeruginosa PA01
cgcggugggcuccagcggg

SEQ ID NO: 1483473 - RNA, 17 nt, Pseudomonas aeruginosa PA01
cgcggugcgcgccauca

SEQ ID NO: 1483474 - RNA, 17 nt, Pseudomonas aeruginosa PA01
cgcggugccgccauaga

SEQ ID NO: 1483475 - RNA, 12 nt, Pseudomonas aeruginosa PA01
cgcggugccgcc

SEQ ID NO: 1483476 - RNA, 12 nt, Pseudomonas aeruginosa PA01
cgcgggcagcuc

SEQ ID NO: 1483477 - RNA, 15 nt, Pseudomonas aeruginosa PA01
cgcgggccaggccga

SEQ ID NO: 1483478 - RNA, 17 nt, Pseudomonas aeruginosa PA01
cgcgggccaggccgagc

SEQ ID NO: 1483479 - RNA, 18 nt, Pseudomonas aeruginosa PA01
cgcgggcaugcugcucgg

SEQ ID NO: 1483480 - RNA, 17 nt, Pseudomonas aeruginosa PA01
cgcgggccgacggcccu

SEQ ID NO: 1483481 - RNA, 19 nt, Pseudomonas aeruginosa PA01
cgcgggccgaggucgcggg

SEQ ID NO: 1483482 - RNA, 12 nt, Pseudomonas aeruginosa PA01
cgcgggccgacg

SEQ ID NO: 1483483 - RNA, 16 nt, Pseudomonas aeruginosa PA01
cgcgggccgcggcgac

SEQ ID NO: 1483484 - RNA, 13 nt, Pseudomonas aeruginosa PA01
cgcgggccggcga

SEQ ID NO: 1483485 - RNA, 15 nt, Pseudomonas aeruginosa PA01
cgcgggcgcgcgcca

SEQ ID NO: 1483486 - RNA, 18 nt, Pseudomonas aeruginosa PA01
cgcgggcgcgcgccaccg

SEQ ID NO: 1483487 - RNA, 17 nt, Pseudomonas aeruginosa PA01
cgcgggcgcuaugcgcc

SEQ ID NO: 1483488 - RNA, 12 nt, Pseudomonas aeruginosa PA01
cgcgggcggcgg

SEQ ID NO: 1483489 - RNA, 13 nt, Pseudomonas aeruginosa PA01
cgcgggcggcggc

SEQ ID NO: 1483490 - RNA, 14 nt, Pseudomonas aeruginosa PA01
cgcgggcggcggcg

SEQ ID NO: 1483491 - RNA, 17 nt, Pseudomonas aeruginosa PA01
cgcgggcggcggcgcgg

SEQ ID NO: 1483492 - RNA, 13 nt, Pseudomonas aeruginosa PA01
cgcgggcgccgug

SEQ ID NO: 1483493 - RNA, 18 nt, Pseudomonas aeruginosa PA01
cgcgggcgcgcagcaggu

SEQ ID NO: 1483494 - RNA, 15 nt, Pseudomonas aeruginosa PA01
cgcgggcgccgaugc

SEQ ID NO: 1483495 - RNA, 17 nt, Pseudomonas aeruginosa PA01
cgcgggcgccgaugccg

SEQ ID NO: 1483496 - RNA, 21 nt, Pseudomonas aeruginosa PA01
cgcgggcgauggcccguucca

SEQ ID NO: 1483497 - RNA, 20 nt, Pseudomonas aeruginosa PA01
cgcgggcgaacggcagcguc

SEQ ID NO: 1483498 - RNA, 12 nt, Pseudomonas aeruginosa PA01
cgcgggcgaggu

SEQ ID NO: 1483499 - RNA, 13 nt, Pseudomonas aeruginosa PA01
cgcggcuggccgc

SEQ ID NO: 1483500 - RNA, 16 nt, Pseudomonas aeruginosa PA01
cgcggcuggccgccug

SEQ ID NO: 1483501 - RNA, 21 nt, Pseudomonas aeruginosa PA01
cgcggcuggccgccuggccgg

SEQ ID NO: 1483502 - RNA, 16 nt, Pseudomonas aeruginosa PA01
cgcggcugcuugccgc

SEQ ID NO: 1483503 - RNA, 22 nt, Pseudomonas aeruginosa PA01
cgcggcugcuugccgcucaggc

SEQ ID NO: 1483504 - RNA, 15 nt, Pseudomonas aeruginosa PA01
cgcggcuggaagucg

SEQ ID NO: 1483505 - RNA, 18 nt, Pseudomonas aeruginosa PA01
cgcggcuggaagucgccc

SEQ ID NO: 1483506 - RNA, 15 nt, Pseudomonas aeruginosa PA01
cgcggcuggccaucc

SEQ ID NO: 1483507 - RNA, 12 nt, Pseudomonas aeruginosa PA01
cgcggcugcgcg

SEQ ID NO: 1483508 - RNA, 16 nt, Pseudomonas aeruginosa PA01
cgcggcugcgcgccgg

SEQ ID NO: 1483509 - RNA, 17 nt, Pseudomonas aeruginosa PA01
cgcggcugcgcgccggg

SEQ ID NO: 1483510 - RNA, 21 nt, Pseudomonas aeruginosa PA01
cgcggcuucagagcuggacga

SEQ ID NO: 1483511 - RNA, 17 nt, Pseudomonas aeruginosa PA01
cgcggcuugccggcgcg

SEQ ID NO: 1483512 - RNA, 18 nt, Pseudomonas aeruginosa PA01
cgcggcuugccggcgcgc

SEQ ID NO: 1483513 - RNA, 21 nt, Pseudomonas aeruginosa PA01
cgcggcuugccggcgcgcggu

SEQ ID NO: 1483514 - RNA, 20 nt, Pseudomonas aeruginosa PA01
cgcggcuguagccacggcga

SEQ ID NO: 1483515 - RNA, 19 nt, Pseudomonas aeruginosa PA01
cgcggcuucggucaggugg

SEQ ID NO: 1483516 - RNA, 15 nt, Pseudomonas aeruginosa PA01
cgcgggacgccgcag

SEQ ID NO: 1483517 - RNA, 18 nt, Pseudomonas aeruginosa PA01
cgcgggcagcagucgcag

SEQ ID NO: 1483518 - RNA, 19 nt, Pseudomonas aeruginosa PA01
cgcgggauaaacggcggau

SEQ ID NO: 1483519 - RNA, 17 nt, Pseudomonas aeruginosa PA01
cgcgggcaaccgcggcg

SEQ ID NO: 1483520 - RNA, 19 nt, Pseudomonas aeruginosa PA01
cgcgggcaaccgcggcggc

SEQ ID NO: 1483521 - RNA, 14 nt, Pseudomonas aeruginosa PA01
cgcugaggaucacg

SEQ ID NO: 1483522 - RNA, 20 nt, Pseudomonas aeruginosa PA01
cgcugaggaucacgauggcc

SEQ ID NO: 1483523 - RNA, 22 nt, Pseudomonas aeruginosa PA01
cgcugaggaucacgauggccgg

SEQ ID NO: 1483524 - RNA, 21 nt, Pseudomonas aeruginosa PA01
cgcugaggaucagccagccgg

SEQ ID NO: 1483525 - RNA, 20 nt, Pseudomonas aeruginosa PA01
cgcugagcgccucgaucgcc

SEQ ID NO: 1483526 - RNA, 20 nt, Pseudomonas aeruginosa PA01
cgcugagcggcugguggccg

SEQ ID NO: 1483527 - RNA, 18 nt, Pseudomonas aeruginosa PA01
cgcugaggaagagcagcg

SEQ ID NO: 1483528 - RNA, 20 nt, Pseudomonas aeruginosa PA01
cgcugaggaagagcagcgcg

SEQ ID NO: 1483529 - RNA, 22 nt, Pseudomonas aeruginosa PA01
cgcugaggaagagcagcgcggc

SEQ ID NO: 1483530 - RNA, 23 nt, Pseudomonas aeruginosa PA01
cgcugaggaagagcagcgcggcg

SEQ ID NO: 1483531 - RNA, 17 nt, Pseudomonas aeruginosa PA01
cgcugaggacugccagg

SEQ ID NO: 1483532 - RNA, 15 nt, Pseudomonas aeruginosa PA01
cgcugauugcgggcc

SEQ ID NO: 1483533 - RNA, 19 nt, Pseudomonas aeruginosa PA01
cgcugcaaaaaagcgcgcc

SEQ ID NO: 1483534 - RNA, 22 nt, Pseudomonas aeruginosa PA01
cgcugcaaucgcugccggucag

SEQ ID NO: 1483535 - RNA, 16 nt, Pseudomonas aeruginosa PA01
cgcugcaauucgucgg

SEQ ID NO: 1483536 - RNA, 18 nt, Pseudomonas aeruginosa PA01
cgcugcaauucgucggcc

SEQ ID NO: 1483537 - RNA, 20 nt, Pseudomonas aeruginosa PA01
cgcugcaauucgucggccug

SEQ ID NO: 1483538 - RNA, 18 nt, Pseudomonas aeruginosa PA01
cgcugaugccggcgucgg

SEQ ID NO: 1483539 - RNA, 22 nt, Pseudomonas aeruginosa PA01
cgcugaugccggcgucggcgag

SEQ ID NO: 1483540 - RNA, 15 nt, Pseudomonas aeruginosa PA01
cgcugaccacccggu

SEQ ID NO: 1483541 - RNA, 19 nt, Pseudomonas aeruginosa PA01
cgcugaccacccggugcag

SEQ ID NO: 1483542 - RNA, 15 nt, Pseudomonas aeruginosa PA01
cgcugaccagcccgg

SEQ ID NO: 1483543 - RNA, 19 nt, Pseudomonas aeruginosa PA01
cgcugaccagcccggcggc

SEQ ID NO: 1483544 - RNA, 15 nt, Pseudomonas aeruginosa PA01
cgcugacccagcgca

SEQ ID NO: 1483545 - RNA, 22 nt, Pseudomonas aeruginosa PA01
cgcugacccaggcuucggcgcg

SEQ ID NO: 1483546 - RNA, 23 nt, Pseudomonas aeruginosa PA01
cgcugacccaggcuucggcgcgc

SEQ ID NO: 1483547 - RNA, 23 nt, Pseudomonas aeruginosa PA01
cgcugaccaggucguggaaggcu

SEQ ID NO: 1483548 - RNA, 20 nt, Pseudomonas aeruginosa PA01
cgcugagcaguugcgggcgc

SEQ ID NO: 1483549 - RNA, 14 nt, Pseudomonas aeruginosa PA01
cgcugagcagcagg

SEQ ID NO: 1483550 - RNA, 20 nt, Pseudomonas aeruginosa PA01
cgcugagcaggaacucgauc

SEQ ID NO: 1483551 - RNA, 14 nt, Pseudomonas aeruginosa PA01
cgcugagcaccggg

SEQ ID NO: 1483552 - RNA, 15 nt, Pseudomonas aeruginosa PA01
cgcugagcaccggga

SEQ ID NO: 1483553 - RNA, 17 nt, Pseudomonas aeruginosa PA01
cgcugagcaccgggacg

SEQ ID NO: 1483554 - RNA, 22 nt, Pseudomonas aeruginosa PA01
cgcugaccgcucccaggcaacg

SEQ ID NO: 1483555 - RNA, 15 nt, Pseudomonas aeruginosa PA01
cgcugaccggccgca

SEQ ID NO: 1483556 - RNA, 19 nt, Pseudomonas aeruginosa PA01
cgcugagaccgauccagca

SEQ ID NO: 1483557 - RNA, 13 nt, Pseudomonas aeruginosa PA01
cgcugccgccgca

SEQ ID NO: 1483558 - RNA, 13 nt, Pseudomonas aeruginosa PA01
cgcugccgccgcg

SEQ ID NO: 1483559 - RNA, 15 nt, Pseudomonas aeruginosa PA01
cgcugccgccgcgcc

SEQ ID NO: 1483560 - RNA, 23 nt, Pseudomonas aeruginosa PA01
cgcugccgcucuggcugcuggcg

SEQ ID NO: 1483561 - RNA, 13 nt, Pseudomonas aeruginosa PA01
cgcugccggcgcg

SEQ ID NO: 1483562 - RNA, 15 nt, Pseudomonas aeruginosa PA01
cgcugccggcgcgca

SEQ ID NO: 1483563 - RNA, 16 nt, Pseudomonas aeruginosa PA01
cgcugccggcgcgcac

SEQ ID NO: 1483564 - RNA, 23 nt, Pseudomonas aeruginosa PA01
cgcugccacaguuucauggugcc

SEQ ID NO: 1483565 - RNA, 14 nt, Pseudomonas aeruginosa PA01
cgcugccagcgccg

SEQ ID NO: 1483566 - RNA, 18 nt, Pseudomonas aeruginosa PA01
cgcugccagcgccgccgc

SEQ ID NO: 1483567 - RNA, 23 nt, Pseudomonas aeruginosa PA01
cgcugccagcgccgccgcguggg

SEQ ID NO: 1483568 - RNA, 13 nt, Pseudomonas aeruginosa PA01
cgcugccagcagg

SEQ ID NO: 1483569 - RNA, 16 nt, Pseudomonas aeruginosa PA01
cgcugccagcaggccg

SEQ ID NO: 1483570 - RNA, 18 nt, Pseudomonas aeruginosa PA01
cgcugccagcaggccgag

SEQ ID NO: 1483571 - RNA, 15 nt, Pseudomonas aeruginosa PA01
cgcugcaucggcgcg

SEQ ID NO: 1483572 - RNA, 20 nt, Pseudomonas aeruginosa PA01
cgcugcaucggcgcgccgaa

SEQ ID NO: 1483573 - RNA, 18 nt, Pseudomonas aeruginosa PA01
cgcugcaugggcucgcgc

SEQ ID NO: 1483574 - RNA, 18 nt, Pseudomonas aeruginosa PA01
cgcugcaugugccaggcc

SEQ ID NO: 1483575 - RNA, 14 nt, Pseudomonas aeruginosa PA01
cgcugcagggcggc

SEQ ID NO: 1483576 - RNA, 17 nt, Pseudomonas aeruginosa PA01
cgcugcacgcacgcgcc

SEQ ID NO: 1483577 - RNA, 15 nt, Pseudomonas aeruginosa PA01
cgcugcaccgcggcg

SEQ ID NO: 1483578 - RNA, 16 nt, Pseudomonas aeruginosa PA01
cgcugcaccgcggcgc

SEQ ID NO: 1483579 - RNA, 18 nt, Pseudomonas aeruginosa PA01
cgcugcaccgcggcgcgg

SEQ ID NO: 1483580 - RNA, 13 nt, Pseudomonas aeruginosa PA01
cgcugcaccagcu

SEQ ID NO: 1483581 - RNA, 16 nt, Pseudomonas aeruginosa PA01
cgcugcaccagcuucu

SEQ ID NO: 1483582 - RNA, 16 nt, Pseudomonas aeruginosa PA01
cgcucgcuacagccgg

SEQ ID NO: 1483583 - RNA, 11 nt, Pseudomonas aeruginosa PA01
cgcucggccaa

SEQ ID NO: 1483584 - RNA, 17 nt, Pseudomonas aeruginosa PA01
cgcucgcuucagcgagc

SEQ ID NO: 1483585 - RNA, 16 nt, Pseudomonas aeruginosa PA01
cgcucggaucaggcgg

SEQ ID NO: 1483586 - RNA, 19 nt, Pseudomonas aeruginosa PA01
cgcucggauuccagcgcgg

SEQ ID NO: 1483587 - RNA, 21 nt, Pseudomonas aeruginosa PA01
cgcucgcugcgugcguugcgc

SEQ ID NO: 1483588 - RNA, 17 nt, Pseudomonas aeruginosa PA01
cgcucggccagcguccu

SEQ ID NO: 1483589 - RNA, 11 nt, Pseudomonas aeruginosa PA01
cgcucggccag

SEQ ID NO: 1483590 - RNA, 18 nt, Pseudomonas aeruginosa PA01
cgcucggccaggucgcga

SEQ ID NO: 1483591 - RNA, 21 nt, Pseudomonas aeruginosa PA01
cgcucggccaguucgucgagc

SEQ ID NO: 1483592 - RNA, 13 nt, Pseudomonas aeruginosa PA01
cgcucggccgcca

SEQ ID NO: 1483593 - RNA, 14 nt, Pseudomonas aeruginosa PA01
cgcucggccuggug

SEQ ID NO: 1483594 - RNA, 18 nt, Pseudomonas aeruginosa PA01
cgcucggccuugagcgcc

SEQ ID NO: 1483595 - RNA, 14 nt, Pseudomonas aeruginosa PA01
cgcucgcgcggcac

SEQ ID NO: 1483596 - RNA, 22 nt, Pseudomonas aeruginosa PA01
cgcucgcgguuauccgccgccu

SEQ ID NO: 1483597 - RNA, 23 nt, Pseudomonas aeruginosa PA01
cgcucgcgguuauccgccgccua

SEQ ID NO: 1483598 - RNA, 18 nt, Pseudomonas aeruginosa PA01
cgcucgcgggccgccugg

SEQ ID NO: 1483599 - RNA, 21 nt, Pseudomonas aeruginosa PA01
cgcucgcgggccgccuggucg

SEQ ID NO: 1483600 - RNA, 16 nt, Pseudomonas aeruginosa PA01
cgcucgcgcacggcga

SEQ ID NO: 1483601 - RNA, 12 nt, Pseudomonas aeruginosa PA01
cgcucgcgcagg

SEQ ID NO: 1483602 - RNA, 17 nt, Pseudomonas aeruginosa PA01
cgcucaggucggucgaa

SEQ ID NO: 1483603 - RNA, 21 nt, Pseudomonas aeruginosa PA01
cgcucagucgaccgucgccac

SEQ ID NO: 1483604 - RNA, 23 nt, Pseudomonas aeruginosa PA01
cgcucaggcugugcaggaaggcg

SEQ ID NO: 1483605 - RNA, 14 nt, Pseudomonas aeruginosa PA01
cgcucagggaaugg

SEQ ID NO: 1483606 - RNA, 13 nt, Pseudomonas aeruginosa PA01
cgcucaggaugcg

SEQ ID NO: 1483607 - RNA, 15 nt, Pseudomonas aeruginosa PA01
cgcucaggaugcgau

SEQ ID NO: 1483608 - RNA, 18 nt, Pseudomonas aeruginosa PA01
cgcucgccgggucgccgc

SEQ ID NO: 1483609 - RNA, 20 nt, Pseudomonas aeruginosa PA01
cgcucgccgucaucgagcag

SEQ ID NO: 1483610 - RNA, 14 nt, Pseudomonas aeruginosa PA01
cgcucgcccuugcg

SEQ ID NO: 1483611 - RNA, 15 nt, Pseudomonas aeruginosa PA01
cgcucgcccuugcgc

SEQ ID NO: 1483612 - RNA, 21 nt, Pseudomonas aeruginosa PA01
cgcucguugauccgcguggcg

SEQ ID NO: 1483613 - RNA, 12 nt, Pseudomonas aeruginosa PA01
cgcucguugcgc

SEQ ID NO: 1483614 - RNA, 20 nt, Pseudomonas aeruginosa PA01
cgcucggcgaggccggcgau

SEQ ID NO: 1483615 - RNA, 23 nt, Pseudomonas aeruginosa PA01
cgcucggcgaguucgcgcaggcg

SEQ ID NO: 1483616 - RNA, 17 nt, Pseudomonas aeruginosa PA01
cgcucggcgagccgccg

SEQ ID NO: 1483617 - RNA, 18 nt, Pseudomonas aeruginosa PA01
cgcucggcgagccgccgg

SEQ ID NO: 1483618 - RNA, 19 nt, Pseudomonas aeruginosa PA01
cgcucggcgagccgccggg

SEQ ID NO: 1483619 - RNA, 17 nt, Pseudomonas aeruginosa PA01
cgcucggcgaccuugcg

SEQ ID NO: 1483620 - RNA, 12 nt, Pseudomonas aeruginosa PA01
cgcucggcgacg

SEQ ID NO: 1483621 - RNA, 13 nt, Pseudomonas aeruginosa PA01
cgcucucgaacac

SEQ ID NO: 1483622 - RNA, 21 nt, Pseudomonas aeruginosa PA01
cgcucucgaacaccaggcgcc

SEQ ID NO: 1483623 - RNA, 22 nt, Pseudomonas aeruginosa PA01
cgcucucgaacaccaggcgcca

SEQ ID NO: 1483624 - RNA, 19 nt, Pseudomonas aeruginosa PA01
cgcucucgaacaccggcga

SEQ ID NO: 1483625 - RNA, 21 nt, Pseudomonas aeruginosa PA01
cgcucucgaacaccggcgagc

SEQ ID NO: 1483626 - RNA, 16 nt, Pseudomonas aeruginosa PA01
cgcucucgaacagcag

SEQ ID NO: 1483627 - RNA, 14 nt, Pseudomonas aeruginosa PA01
cgcucucgaggacg

SEQ ID NO: 1483628 - RNA, 20 nt, Pseudomonas aeruginosa PA01
cgcucucggugaccaccagg

SEQ ID NO: 1483629 - RNA, 12 nt, Pseudomonas aeruginosa PA01
cgcucucgccgc

SEQ ID NO: 1483630 - RNA, 21 nt, Pseudomonas aeruginosa PA01
cgcucucgccgccuucggcag

SEQ ID NO: 1483631 - RNA, 18 nt, Pseudomonas aeruginosa PA01
cgcucuaucgacgguuuc

SEQ ID NO: 1483632 - RNA, 15 nt, Pseudomonas aeruginosa PA01
cgcucguuggcggcc

SEQ ID NO: 1483633 - RNA, 17 nt, Pseudomonas aeruginosa PA01
cgcugaagcggccgaga

SEQ ID NO: 1483634 - RNA, 22 nt, Pseudomonas aeruginosa PA01
cgcugaauaccaccgggccguc

SEQ ID NO: 1483635 - RNA, 15 nt, Pseudomonas aeruginosa PA01
cgcugaaggucgccg

SEQ ID NO: 1483636 - RNA, 18 nt, Pseudomonas aeruginosa PA01
cgcugaaggucgccgcgc

SEQ ID NO: 1483637 - RNA, 21 nt, Pseudomonas aeruginosa PA01
cgcugaaggucgccgcgcuga

SEQ ID NO: 1483638 - RNA, 19 nt, Pseudomonas aeruginosa PA01
cgcugaaguccuggccgag

SEQ ID NO: 1483639 - RNA, 20 nt, Pseudomonas aeruginosa PA01
cgcugaaguccuggccgagc

SEQ ID NO: 1483640 - RNA, 16 nt, Pseudomonas aeruginosa PA01
cgcugaaacgcgcguc

SEQ ID NO: 1483641 - RNA, 22 nt, Pseudomonas aeruginosa PA01
cgcugaaccgcgucaugcucuc

SEQ ID NO: 1483642 - RNA, 17 nt, Pseudomonas aeruginosa PA01
cgcugaaauagcgcguc

SEQ ID NO: 1483643 - RNA, 22 nt, Pseudomonas aeruginosa PA01
cgcugaaauggaaacgccagcc

SEQ ID NO: 1483644 - RNA, 21 nt, Pseudomonas aeruginosa PA01
cgcugaacaagcccugguggu

SEQ ID NO: 1483645 - RNA, 16 nt, Pseudomonas aeruginosa PA01
cgcguucucccugagc

SEQ ID NO: 1483646 - RNA, 22 nt, Pseudomonas aeruginosa PA01
cgcguucucccugagccugucg

SEQ ID NO: 1483647 - RNA, 13 nt, Pseudomonas aeruginosa PA01
cgcguucgucggc

SEQ ID NO: 1483648 - RNA, 16 nt, Pseudomonas aeruginosa PA01
cgcguucgucggccac

SEQ ID NO: 1483649 - RNA, 14 nt, Pseudomonas aeruginosa PA01
cgcguucggcgaug

SEQ ID NO: 1483650 - RNA, 17 nt, Pseudomonas aeruginosa PA01
cgcguucggcgaugccg

SEQ ID NO: 1483651 - RNA, 22 nt, Pseudomonas aeruginosa PA01
cgcguucggcgaugccgcgcca

SEQ ID NO: 1483652 - RNA, 12 nt, Pseudomonas aeruginosa PA01
cgcguucgccga

SEQ ID NO: 1483653 - RNA, 13 nt, Pseudomonas aeruginosa PA01
cgcguucgccgag

SEQ ID NO: 1483654 - RNA, 14 nt, Pseudomonas aeruginosa PA01
cgcguucgccgagg

SEQ ID NO: 1483655 - RNA, 16 nt, Pseudomonas aeruginosa PA01
cgcguucgcggucggu

SEQ ID NO: 1483656 - RNA, 16 nt, Pseudomonas aeruginosa PA01
cgcguggcccggcgcg

SEQ ID NO: 1483657 - RNA, 17 nt, Pseudomonas aeruginosa PA01
cgcguggcccggcgcgg

SEQ ID NO: 1483658 - RNA, 21 nt, Pseudomonas aeruginosa PA01
cgcguggcccggcgcggcggc

SEQ ID NO: 1483659 - RNA, 22 nt, Pseudomonas aeruginosa PA01
cgcguggcuucguccagcgagg

SEQ ID NO: 1483660 - RNA, 22 nt, Pseudomonas aeruginosa PA01
cgcgugggauucagugggucga

SEQ ID NO: 1483661 - RNA, 14 nt, Pseudomonas aeruginosa PA01
cgcguggccgccag

SEQ ID NO: 1483662 - RNA, 18 nt, Pseudomonas aeruginosa PA01
cgcguggcgucggcgcuu

SEQ ID NO: 1483663 - RNA, 19 nt, Pseudomonas aeruginosa PA01
cgcguggcgugcucggcga

SEQ ID NO: 1483664 - RNA, 21 nt, Pseudomonas aeruginosa PA01
cgcguggcgugcucggcgauc

SEQ ID NO: 1483665 - RNA, 12 nt, Pseudomonas aeruginosa PA01
cgcgugggccac

SEQ ID NO: 1483666 - RNA, 16 nt, Pseudomonas aeruginosa PA01
cgcgugggccaccauc

SEQ ID NO: 1483667 - RNA, 15 nt, Pseudomonas aeruginosa PA01
cgcgugggcuucgcc

SEQ ID NO: 1483668 - RNA, 16 nt, Pseudomonas aeruginosa PA01
cgcgugggcuucgccg

SEQ ID NO: 1483669 - RNA, 23 nt, Pseudomonas aeruginosa PA01
cgcgugggcuucgccgccgcgcg

SEQ ID NO: 1483670 - RNA, 22 nt, Pseudomonas aeruginosa PA01
cgcuaagcgucacucccaggcu

SEQ ID NO: 1483671 - RNA, 14 nt, Pseudomonas aeruginosa PA01
cgcuacagccggga

SEQ ID NO: 1483672 - RNA, 20 nt, Pseudomonas aeruginosa PA01
cgcgguuccacucccaugcc

SEQ ID NO: 1483673 - RNA, 21 nt, Pseudomonas aeruginosa PA01
cgcgguuccagcucgucgagc

SEQ ID NO: 1483674 - RNA, 14 nt, Pseudomonas aeruginosa PA01
cgcgguuauccgcc

SEQ ID NO: 1483675 - RNA, 21 nt, Pseudomonas aeruginosa PA01
cgcgguuauccgccgccgggc

SEQ ID NO: 1483676 - RNA, 23 nt, Pseudomonas aeruginosa PA01
cgcgguuauccgccgccgggcuu

SEQ ID NO: 1483677 - RNA, 16 nt, Pseudomonas aeruginosa PA01
cgcgguuauccgccgg

SEQ ID NO: 1483678 - RNA, 17 nt, Pseudomonas aeruginosa PA01
cgcgguuauccgccgga

SEQ ID NO: 1483679 - RNA, 14 nt, Pseudomonas aeruginosa PA01
cgcggugucggugc

SEQ ID NO: 1483680 - RNA, 13 nt, Pseudomonas aeruginosa PA01
cgcgugcgcgccg

SEQ ID NO: 1483681 - RNA, 19 nt, Pseudomonas aeruginosa PA01
cgcgugcgcgccgccgggc

SEQ ID NO: 1483682 - RNA, 22 nt, Pseudomonas aeruginosa PA01
cgcgugcuccgugucggcggcg

SEQ ID NO: 1483683 - RNA, 15 nt, Pseudomonas aeruginosa PA01
cgcgugcuggugccg

SEQ ID NO: 1483684 - RNA, 14 nt, Pseudomonas aeruginosa PA01
cgcgugccgccgga

SEQ ID NO: 1483685 - RNA, 13 nt, Pseudomonas aeruginosa PA01
cgcgugcaggcgc

SEQ ID NO: 1483686 - RNA, 17 nt, Pseudomonas aeruginosa PA01
cgcucaagacggcccgc

SEQ ID NO: 1483687 - RNA, 20 nt, Pseudomonas aeruginosa PA01
cgcucaagacggcccgcaga

SEQ ID NO: 1483688 - RNA, 13 nt, Pseudomonas aeruginosa PA01
cgcucaacgccuc

SEQ ID NO: 1483689 - RNA, 19 nt, Pseudomonas aeruginosa PA01
cgcucaacggcgugccggg

SEQ ID NO: 1483690 - RNA, 18 nt, Pseudomonas aeruginosa PA01
cgcuaugggcaccgcgcc

SEQ ID NO: 1483691 - RNA, 21 nt, Pseudomonas aeruginosa PA01
cgcuaugggcaccgcgccggc

SEQ ID NO: 1483692 - RNA, 20 nt, Pseudomonas aeruginosa PA01
cgcucaaccgaacaggcgac

SEQ ID NO: 1483693 - RNA, 21 nt, Pseudomonas aeruginosa PA01
cgcucaaccgaacaggcgacg

SEQ ID NO: 1483694 - RNA, 23 nt, Pseudomonas aeruginosa PA01
cgcucaccaggcccgccggucaa

SEQ ID NO: 1483695 - RNA, 16 nt, Pseudomonas aeruginosa PA01
cgcucacccacauggc

SEQ ID NO: 1483696 - RNA, 21 nt, Pseudomonas aeruginosa PA01
cgcucaccgaggcgaacggca

SEQ ID NO: 1483697 - RNA, 14 nt, Pseudomonas aeruginosa PA01
cgcucaccgccacc

SEQ ID NO: 1483698 - RNA, 20 nt, Pseudomonas aeruginosa PA01
cgcucaccgccaccccgccg

SEQ ID NO: 1483699 - RNA, 13 nt, Pseudomonas aeruginosa PA01
cgcucaccaccac

SEQ ID NO: 1483700 - RNA, 18 nt, Pseudomonas aeruginosa PA01
cgcucaccaccaccgcgc

SEQ ID NO: 1483701 - RNA, 19 nt, Pseudomonas aeruginosa PA01
cgcucaccaccaccgcgcc

SEQ ID NO: 1483702 - RNA, 21 nt, Pseudomonas aeruginosa PA01
cgcucaccaccaccgcgccga

SEQ ID NO: 1483703 - RNA, 12 nt, Pseudomonas aeruginosa PA01
cgcucagcgcga

SEQ ID NO: 1483704 - RNA, 21 nt, Pseudomonas aeruginosa PA01
cgcucagccgaggucgccgcc

SEQ ID NO: 1483705 - RNA, 22 nt, Pseudomonas aeruginosa PA01
cgcucagccgaggucgccgcca

SEQ ID NO: 1483706 - RNA, 17 nt, Pseudomonas aeruginosa PA01
cgcucagccguggcacc

SEQ ID NO: 1483707 - RNA, 20 nt, Pseudomonas aeruginosa PA01
cgcucagcgggccgauccgc

SEQ ID NO: 1483708 - RNA, 20 nt, Pseudomonas aeruginosa PA01
cgcucagcgcuucucggcag

SEQ ID NO: 1483709 - RNA, 21 nt, Pseudomonas aeruginosa PA01
cgcucagcgcuucucggcagc

SEQ ID NO: 1483710 - RNA, 14 nt, Pseudomonas aeruginosa PA01
cgcucaggccucga

SEQ ID NO: 1483711 - RNA, 12 nt, Pseudomonas aeruginosa PA01
cgcucaggcgca

SEQ ID NO: 1483712 - RNA, 14 nt, Pseudomonas aeruginosa PA01
cgcucaggcgcagc

SEQ ID NO: 1483713 - RNA, 17 nt, Pseudomonas aeruginosa PA01
cgcucagcaucagcgac

SEQ ID NO: 1483714 - RNA, 18 nt, Pseudomonas aeruginosa PA01
cgcucagcaucagcgaca

SEQ ID NO: 1483715 - RNA, 21 nt, Pseudomonas aeruginosa PA01
cgcucaccggucgagagggau

SEQ ID NO: 1483716 - RNA, 18 nt, Pseudomonas aeruginosa PA01
cgcucaccggaccguggu

SEQ ID NO: 1483717 - RNA, 20 nt, Pseudomonas aeruginosa PA01
cgcucaccgcauagucgcga

SEQ ID NO: 1483718 - RNA, 20 nt, Pseudomonas aeruginosa PA01
cgcucacgcaccucgucgag

SEQ ID NO: 1483719 - RNA, 21 nt, Pseudomonas aeruginosa PA01
cgcucacgcaccucgucgagc

SEQ ID NO: 1483720 - RNA, 16 nt, Pseudomonas aeruginosa PA01
cgcuauccaccgucgc

SEQ ID NO: 1483721 - RNA, 22 nt, Pseudomonas aeruginosa PA01
cgcuauccgccgcuacugcgcg

SEQ ID NO: 1483722 - RNA, 14 nt, Pseudomonas aeruginosa PA01
cgcuaucgccgccg

SEQ ID NO: 1483723 - RNA, 17 nt, Pseudomonas aeruginosa PA01
cgcuaucgccgccgcag

SEQ ID NO: 1483724 - RNA, 20 nt, Pseudomonas aeruginosa PA01
cgcuaucgccgccgcagccg

SEQ ID NO: 1483725 - RNA, 20 nt, Pseudomonas aeruginosa PA01
cgcuaucgcuggcgcagccg

SEQ ID NO: 1483726 - RNA, 15 nt, Pseudomonas aeruginosa PA01
cgcuaucggcccggg

SEQ ID NO: 1483727 - RNA, 22 nt, Pseudomonas aeruginosa PA01
cgcuaucgggcagggcagccgc

SEQ ID NO: 1483728 - RNA, 14 nt, Pseudomonas aeruginosa PA01
cgcuacugcgcggg

SEQ ID NO: 1483729 - RNA, 22 nt, Pseudomonas aeruginosa PA01
cgcuacggaaggucgccgggcu

SEQ ID NO: 1483730 - RNA, 21 nt, Pseudomonas aeruginosa PA01
cgcuagcgcauggcgaccugg

SEQ ID NO: 1483731 - RNA, 19 nt, Pseudomonas aeruginosa PA01
cgcuacguuccagggccug

SEQ ID NO: 1483732 - RNA, 20 nt, Pseudomonas aeruginosa PA01
cgcuacguuccagggccugg

SEQ ID NO: 1483733 - RNA, 18 nt, Pseudomonas aeruginosa PA01
cgcuacggcaucaccggc

SEQ ID NO: 1483734 - RNA, 22 nt, Pseudomonas aeruginosa PA01
cgcuacggcaucaccggcggga

SEQ ID NO: 1483735 - RNA, 17 nt, Pseudomonas aeruginosa PA01
cgcuacccucaggggug

SEQ ID NO: 1483736 - RNA, 22 nt, Pseudomonas aeruginosa PA01
cgcuaccgcgcauggcggcgac

SEQ ID NO: 1483737 - RNA, 13 nt, Pseudomonas aeruginosa PA01
cgcuacgaaggcg

SEQ ID NO: 1483738 - RNA, 20 nt, Pseudomonas aeruginosa PA01
cgcuacgaaggcgugccgcu

SEQ ID NO: 1483739 - RNA, 16 nt, Pseudomonas aeruginosa PA01
cgcuacgcucgccgac

SEQ ID NO: 1483740 - RNA, 17 nt, Pseudomonas aeruginosa PA01
cgcuacgcucgccgacg

SEQ ID NO: 1483741 - RNA, 15 nt, Pseudomonas aeruginosa PA01
cgcuacgcaggcccu

SEQ ID NO: 1483742 - RNA, 18 nt, Pseudomonas aeruginosa PA01
cgcuugaagccggcguag

SEQ ID NO: 1483743 - RNA, 14 nt, Pseudomonas aeruginosa PA01
cgcuugaacgcgcg

SEQ ID NO: 1483744 - RNA, 21 nt, Pseudomonas aeruginosa PA01
cgcuucugcgccuccucggcg

SEQ ID NO: 1483745 - RNA, 16 nt, Pseudomonas aeruginosa PA01
cgcuucugcucggccu

SEQ ID NO: 1483746 - RNA, 23 nt, Pseudomonas aeruginosa PA01
cgcuucgggagucaacgccuggc

SEQ ID NO: 1483747 - RNA, 15 nt, Pseudomonas aeruginosa PA01
cgcuucgucggucgc

SEQ ID NO: 1483748 - RNA, 18 nt, Pseudomonas aeruginosa PA01
cgcuucgucggucgcgac

SEQ ID NO: 1483749 - RNA, 16 nt, Pseudomonas aeruginosa PA01
cgcuucgucccaugac

SEQ ID NO: 1483750 - RNA, 17 nt, Pseudomonas aeruginosa PA01
cgcuucguuggcgacga

SEQ ID NO: 1483751 - RNA, 15 nt, Pseudomonas aeruginosa PA01
cgcuucuccucggcc

SEQ ID NO: 1483752 - RNA, 16 nt, Pseudomonas aeruginosa PA01
cgcuucuccucggccg

SEQ ID NO: 1483753 - RNA, 19 nt, Pseudomonas aeruginosa PA01
cgcuucuccucggccgaca

SEQ ID NO: 1483754 - RNA, 15 nt, Pseudomonas aeruginosa PA01
cgcuucucggcagcg

SEQ ID NO: 1483755 - RNA, 15 nt, Pseudomonas aeruginosa PA01
cgcuucugcaggccg

SEQ ID NO: 1483756 - RNA, 15 nt, Pseudomonas aeruginosa PA01
cgcuugcguuccucc

SEQ ID NO: 1483757 - RNA, 21 nt, Pseudomonas aeruginosa PA01
cgcuugcucuccacuaccgcc

SEQ ID NO: 1483758 - RNA, 15 nt, Pseudomonas aeruginosa PA01
cgcuugcuggcgcga

SEQ ID NO: 1483759 - RNA, 13 nt, Pseudomonas aeruginosa PA01
cgcuuggagcggg

SEQ ID NO: 1483760 - RNA, 15 nt, Pseudomonas aeruginosa PA01
cgcuuggagcgggcg

SEQ ID NO: 1483761 - RNA, 13 nt, Pseudomonas aeruginosa PA01
cgcuugcgguagu

SEQ ID NO: 1483762 - RNA, 20 nt, Pseudomonas aeruginosa PA01
cgcuugcggucauccgccgg

SEQ ID NO: 1483763 - RNA, 18 nt, Pseudomonas aeruginosa PA01
cgcuugcgguuauccgcc

SEQ ID NO: 1483764 - RNA, 22 nt, Pseudomonas aeruginosa PA01
cgcuugcgguuauccgccgccg

SEQ ID NO: 1483765 - RNA, 21 nt, Pseudomonas aeruginosa PA01
cgcuugcgguuauccgccgug

SEQ ID NO: 1483766 - RNA, 18 nt, Pseudomonas aeruginosa PA01
cgcuugccuuccugggcg

SEQ ID NO: 1483767 - RNA, 19 nt, Pseudomonas aeruginosa PA01
cgcuugcccucgcgcccgg

SEQ ID NO: 1483768 - RNA, 19 nt, Pseudomonas aeruginosa PA01
cgcuugagccccggcaggc

SEQ ID NO: 1483769 - RNA, 22 nt, Pseudomonas aeruginosa PA01
cgcuugagccccggcaggcagg

SEQ ID NO: 1483770 - RNA, 16 nt, Pseudomonas aeruginosa PA01
cgcuugagcagccagg

SEQ ID NO: 1483771 - RNA, 17 nt, Pseudomonas aeruginosa PA01
cgcuugagcagccaggc

SEQ ID NO: 1483772 - RNA, 18 nt, Pseudomonas aeruginosa PA01
cgcuugagcagccaggcg

SEQ ID NO: 1483773 - RNA, 19 nt, Pseudomonas aeruginosa PA01
cgcuugaguugccagacga

SEQ ID NO: 1483774 - RNA, 20 nt, Pseudomonas aeruginosa PA01
cgcuugaguugccagacgau

SEQ ID NO: 1483775 - RNA, 17 nt, Pseudomonas aeruginosa PA01
cgcuugaggucgugcag

SEQ ID NO: 1483776 - RNA, 19 nt, Pseudomonas aeruginosa PA01
cgcuugaggucgugcagca

SEQ ID NO: 1483777 - RNA, 13 nt, Pseudomonas aeruginosa PA01
cgcuugccgcgcc

SEQ ID NO: 1483778 - RNA, 16 nt, Pseudomonas aeruginosa PA01
cgcuugccgcgcccgg

SEQ ID NO: 1483779 - RNA, 18 nt, Pseudomonas aeruginosa PA01
cgcuugccgcgcccggcc

SEQ ID NO: 1483780 - RNA, 23 nt, Pseudomonas aeruginosa PA01
cgcuugccggccgccagcaggua

SEQ ID NO: 1483781 - RNA, 14 nt, Pseudomonas aeruginosa PA01
cgcuugccgucgac

SEQ ID NO: 1483782 - RNA, 15 nt, Pseudomonas aeruginosa PA01
cgcuugccgucgcgg

SEQ ID NO: 1483783 - RNA, 16 nt, Pseudomonas aeruginosa PA01
cgcuugcccagguagu

SEQ ID NO: 1483784 - RNA, 13 nt, Pseudomonas aeruginosa PA01
cgcuuucgcgcag

SEQ ID NO: 1483785 - RNA, 16 nt, Pseudomonas aeruginosa PA01
cgcuuuccuggccgac

SEQ ID NO: 1483786 - RNA, 17 nt, Pseudomonas aeruginosa PA01
cgcuuuccuggccgacc

SEQ ID NO: 1483787 - RNA, 23 nt, Pseudomonas aeruginosa PA01
cgcuuuccacccgaaagccgaag

SEQ ID NO: 1483788 - RNA, 12 nt, Pseudomonas aeruginosa PA01
cgcuuucgagaa

SEQ ID NO: 1483789 - RNA, 15 nt, Pseudomonas aeruginosa PA01
cgcuuuuccucgacc

SEQ ID NO: 1483790 - RNA, 20 nt, Pseudomonas aeruginosa PA01
cgcuuuuuucuugccgccag

SEQ ID NO: 1483791 - RNA, 17 nt, Pseudomonas aeruginosa PA01
cgcuuuuuccgcugccg

SEQ ID NO: 1483792 - RNA, 20 nt, Pseudomonas aeruginosa PA01
cgcuuggccaggucgucgcg

SEQ ID NO: 1483793 - RNA, 21 nt, Pseudomonas aeruginosa PA01
cgcuuggccaggucgucgcgc

SEQ ID NO: 1483794 - RNA, 15 nt, Pseudomonas aeruginosa PA01
cgcuuggccuugccg

SEQ ID NO: 1483795 - RNA, 20 nt, Pseudomonas aeruginosa PA01
cgcuuggcgaucacggcgcc

SEQ ID NO: 1483796 - RNA, 18 nt, Pseudomonas aeruginosa PA01
cgcuuguagcagccgcag

SEQ ID NO: 1483797 - RNA, 22 nt, Pseudomonas aeruginosa PA01
cgcuuguagcagccgcaggaug

SEQ ID NO: 1483798 - RNA, 14 nt, Pseudomonas aeruginosa PA01
cgcuuguagcccag

SEQ ID NO: 1483799 - RNA, 19 nt, Pseudomonas aeruginosa PA01
cgcuuguagcccaggggca

SEQ ID NO: 1483800 - RNA, 16 nt, Pseudomonas aeruginosa PA01
cgcuuguccgagaccg

SEQ ID NO: 1483801 - RNA, 21 nt, Pseudomonas aeruginosa PA01
cgcuuguccgagaccggcagc

SEQ ID NO: 1483802 - RNA, 19 nt, Pseudomonas aeruginosa PA01
cgcuuguccuccagcugcg

SEQ ID NO: 1483803 - RNA, 18 nt, Pseudomonas aeruginosa PA01
cgcuuguccuucggccag

SEQ ID NO: 1483804 - RNA, 21 nt, Pseudomonas aeruginosa PA01
cgcuuguugaucaccaccggc

SEQ ID NO: 1483805 - RNA, 23 nt, Pseudomonas aeruginosa PA01
cgcuuguugaugguuucuuccca

SEQ ID NO: 1483806 - RNA, 16 nt, Pseudomonas aeruginosa PA01
cgcuuuccccggcggc

SEQ ID NO: 1483807 - RNA, 17 nt, Pseudomonas aeruginosa PA01
cgcuuuccccggcggca

SEQ ID NO: 1483808 - RNA, 15 nt, Pseudomonas aeruginosa PA01
cgcuuucccgcuucg

SEQ ID NO: 1483809 - RNA, 14 nt, Pseudomonas aeruginosa PA01
cgcuuuccggcgcg

SEQ ID NO: 1483810 - RNA, 15 nt, Pseudomonas aeruginosa PA01
cgcuuuccggcgcgg

SEQ ID NO: 1483811 - RNA, 17 nt, Pseudomonas aeruginosa PA01
cgcuuuccggcgcggcc

SEQ ID NO: 1483812 - RNA, 23 nt, Pseudomonas aeruginosa PA01
cgcuuuccggcgcggccugcagc

SEQ ID NO: 1483813 - RNA, 14 nt, Pseudomonas aeruginosa PA01
cggaagucggcggg

SEQ ID NO: 1483814 - RNA, 21 nt, Pseudomonas aeruginosa PA01
cggaagucggcggguccgcgu

SEQ ID NO: 1483815 - RNA, 15 nt, Pseudomonas aeruginosa PA01
cggaagugcgccggu

SEQ ID NO: 1483816 - RNA, 15 nt, Pseudomonas aeruginosa PA01
cggaaguggcagcgc

SEQ ID NO: 1483817 - RNA, 16 nt, Pseudomonas aeruginosa PA01
cggaaggccacgccgc

SEQ ID NO: 1483818 - RNA, 16 nt, Pseudomonas aeruginosa PA01
cggaaggcccgcgagc

SEQ ID NO: 1483819 - RNA, 18 nt, Pseudomonas aeruginosa PA01
cggaaggcccgcgagccg

SEQ ID NO: 1483820 - RNA, 18 nt, Pseudomonas aeruginosa PA01
cggaagcguugcucgagc

SEQ ID NO: 1483821 - RNA, 22 nt, Pseudomonas aeruginosa PA01
cggaaggcuuccugguggaaca

SEQ ID NO: 1483822 - RNA, 14 nt, Pseudomonas aeruginosa PA01
cggaaggcggcgaa

SEQ ID NO: 1483823 - RNA, 11 nt, Pseudomonas aeruginosa PA01
cggaagcgcuc

SEQ ID NO: 1483824 - RNA, 12 nt, Pseudomonas aeruginosa PA01
cggaagcgcucg

SEQ ID NO: 1483825 - RNA, 15 nt, Pseudomonas aeruginosa PA01
cggaagcgcucgcgc

SEQ ID NO: 1483826 - RNA, 16 nt, Pseudomonas aeruginosa PA01
cggaagcgcucgcgcu

SEQ ID NO: 1483827 - RNA, 13 nt, Pseudomonas aeruginosa PA01
cggaagcggccga

SEQ ID NO: 1483828 - RNA, 16 nt, Pseudomonas aeruginosa PA01
cggaagcggccgagca

SEQ ID NO: 1483829 - RNA, 12 nt, Pseudomonas aeruginosa PA01
cggaagccggga

SEQ ID NO: 1483830 - RNA, 17 nt, Pseudomonas aeruginosa PA01
cggaagccgucggcgau

SEQ ID NO: 1483831 - RNA, 18 nt, Pseudomonas aeruginosa PA01
cggaagccgucggcgauc

SEQ ID NO: 1483832 - RNA, 21 nt, Pseudomonas aeruginosa PA01
cggaagccgucggcgaucgcc

SEQ ID NO: 1483833 - RNA, 20 nt, Pseudomonas aeruginosa PA01
cggaacgggacgccuggcgu

SEQ ID NO: 1483834 - RNA, 13 nt, Pseudomonas aeruginosa PA01
cggaacgucggcc

SEQ ID NO: 1483835 - RNA, 14 nt, Pseudomonas aeruginosa PA01
cggaacgucggccu

SEQ ID NO: 1483836 - RNA, 15 nt, Pseudomonas aeruginosa PA01
cggaacgucggccug

SEQ ID NO: 1483837 - RNA, 16 nt, Pseudomonas aeruginosa PA01
cggaacgucggccugg

SEQ ID NO: 1483838 - RNA, 19 nt, Pseudomonas aeruginosa PA01
cggaacgaaggacaggucg

SEQ ID NO: 1483839 - RNA, 22 nt, Pseudomonas aeruginosa PA01
cggaacgaaggacaggucgcgg

SEQ ID NO: 1483840 - RNA, 21 nt, Pseudomonas aeruginosa PA01
cggaaccucuccccucgcccu

SEQ ID NO: 1483841 - RNA, 15 nt, Pseudomonas aeruginosa PA01
cggaagcccagcagg

SEQ ID NO: 1483842 - RNA, 15 nt, Pseudomonas aeruginosa PA01
cggaagcccugcugg

SEQ ID NO: 1483843 - RNA, 17 nt, Pseudomonas aeruginosa PA01
cggaagcccugcuggcg

SEQ ID NO: 1483844 - RNA, 21 nt, Pseudomonas aeruginosa PA01
cggaagcacggcucggcgagg

SEQ ID NO: 1483845 - RNA, 17 nt, Pseudomonas aeruginosa PA01
cggaagcagccauggcu

SEQ ID NO: 1483846 - RNA, 15 nt, Pseudomonas aeruginosa PA01
cggaagcauggccgg

SEQ ID NO: 1483847 - RNA, 17 nt, Pseudomonas aeruginosa PA01
cggaagcauggccggcu

SEQ ID NO: 1483848 - RNA, 19 nt, Pseudomonas aeruginosa PA01
cggaagaaaagaaggcgga

SEQ ID NO: 1483849 - RNA, 14 nt, Pseudomonas aeruginosa PA01
cggaagaaacugcg

SEQ ID NO: 1483850 - RNA, 15 nt, Pseudomonas aeruginosa PA01
cggaaaugcucgccg

SEQ ID NO: 1483851 - RNA, 19 nt, Pseudomonas aeruginosa PA01
cggaaaugaaaaaggccgg

SEQ ID NO: 1483852 - RNA, 15 nt, Pseudomonas aeruginosa PA01
cggaacaagccgccu

SEQ ID NO: 1483853 - RNA, 20 nt, Pseudomonas aeruginosa PA01
cggaacacacgcuucugcug

SEQ ID NO: 1483854 - RNA, 12 nt, Pseudomonas aeruginosa PA01
cggaacagcgcc

SEQ ID NO: 1483855 - RNA, 20 nt, Pseudomonas aeruginosa PA01
cggaaccgaguuucccggcg

SEQ ID NO: 1483856 - RNA, 16 nt, Pseudomonas aeruginosa PA01
cggaacaugguguugg

SEQ ID NO: 1483857 - RNA, 12 nt, Pseudomonas aeruginosa PA01
cggaacccgcgc

SEQ ID NO: 1483858 - RNA, 19 nt, Pseudomonas aeruginosa PA01
cggaaccagugcgcggucc

SEQ ID NO: 1483859 - RNA, 16 nt, Pseudomonas aeruginosa PA01
cggaacaggagccauc

SEQ ID NO: 1483860 - RNA, 20 nt, Pseudomonas aeruginosa PA01
cggaaagcagggcgauggcc

SEQ ID NO: 1483861 - RNA, 15 nt, Pseudomonas aeruginosa PA01
cggaaagccuggccg

SEQ ID NO: 1483862 - RNA, 16 nt, Pseudomonas aeruginosa PA01
cggaaagccuggccgg

SEQ ID NO: 1483863 - RNA, 19 nt, Pseudomonas aeruginosa PA01
cggaaagccuggccggcga

SEQ ID NO: 1483864 - RNA, 18 nt, Pseudomonas aeruginosa PA01
cggaaagcgacgccgcga

SEQ ID NO: 1483865 - RNA, 15 nt, Pseudomonas aeruginosa PA01
cggaaaccgcggccg

SEQ ID NO: 1483866 - RNA, 20 nt, Pseudomonas aeruginosa PA01
cggaaaccugcaacucggcg

SEQ ID NO: 1483867 - RNA, 19 nt, Pseudomonas aeruginosa PA01
cggaaaccgcauugacccg

SEQ ID NO: 1483868 - RNA, 21 nt, Pseudomonas aeruginosa PA01
cggaaacgaaaaagcccggcg

SEQ ID NO: 1483869 - RNA, 18 nt, Pseudomonas aeruginosa PA01
cggaaacucuugaucccg

SEQ ID NO: 1483870 - RNA, 16 nt, Pseudomonas aeruginosa PA01
cggaaacacagcacga

SEQ ID NO: 1483871 - RNA, 22 nt, Pseudomonas aeruginosa PA01
cggaaaacgccgcgaagcccag

SEQ ID NO: 1483872 - RNA, 23 nt, Pseudomonas aeruginosa PA01
cggaaaaauaccccgggucgcgc

SEQ ID NO: 1483873 - RNA, 17 nt, Pseudomonas aeruginosa PA01
cgcuguuccgccguggg

SEQ ID NO: 1483874 - RNA, 18 nt, Pseudomonas aeruginosa PA01
cgcuguuccgccguggga

SEQ ID NO: 1483875 - RNA, 15 nt, Pseudomonas aeruginosa PA01
cgcuguucgggucgc

SEQ ID NO: 1483876 - RNA, 21 nt, Pseudomonas aeruginosa PA01
cgcuguuccucguccaguuca

SEQ ID NO: 1483877 - RNA, 19 nt, Pseudomonas aeruginosa PA01
cgcuguggaaguacggcgc

SEQ ID NO: 1483878 - RNA, 20 nt, Pseudomonas aeruginosa PA01
cgcuguggaaguacggcgcg

SEQ ID NO: 1483879 - RNA, 22 nt, Pseudomonas aeruginosa PA01
cgcuguggaaguacggcgcggu

SEQ ID NO: 1483880 - RNA, 20 nt, Pseudomonas aeruginosa PA01
cgcugugaggugggcgcgcc

SEQ ID NO: 1483881 - RNA, 17 nt, Pseudomonas aeruginosa PA01
cgcugugcggcagcagg

SEQ ID NO: 1483882 - RNA, 18 nt, Pseudomonas aeruginosa PA01
cgcugugcggcagcaggc

SEQ ID NO: 1483883 - RNA, 16 nt, Pseudomonas aeruginosa PA01
cgcuguuugcggcgca

SEQ ID NO: 1483884 - RNA, 18 nt, Pseudomonas aeruginosa PA01
cgcuguuugcggcgcagg

SEQ ID NO: 1483885 - RNA, 22 nt, Pseudomonas aeruginosa PA01
cgcuguuucuccaguucggcga

SEQ ID NO: 1483886 - RNA, 23 nt, Pseudomonas aeruginosa PA01
cgcuguuucuccaguucggcgau

SEQ ID NO: 1483887 - RNA, 14 nt, Pseudomonas aeruginosa PA01
cgcuguuggcguga

SEQ ID NO: 1483888 - RNA, 23 nt, Pseudomonas aeruginosa PA01
cgcuguugguguugauggucacc

SEQ ID NO: 1483889 - RNA, 15 nt, Pseudomonas aeruginosa PA01
cgcuucgcggaucaa

SEQ ID NO: 1483890 - RNA, 16 nt, Pseudomonas aeruginosa PA01
cgcuucgcgaucggcg

SEQ ID NO: 1483891 - RNA, 18 nt, Pseudomonas aeruginosa PA01
cgcuucgcgaucggcguc

SEQ ID NO: 1483892 - RNA, 18 nt, Pseudomonas aeruginosa PA01
cgcuucgcgcagcucggc

SEQ ID NO: 1483893 - RNA, 18 nt, Pseudomonas aeruginosa PA01
cgcuuccugggcuucguc

SEQ ID NO: 1483894 - RNA, 13 nt, Pseudomonas aeruginosa PA01
cgcuucgcccgcc

SEQ ID NO: 1483895 - RNA, 17 nt, Pseudomonas aeruginosa PA01
cgcuuccucggcacuca

SEQ ID NO: 1483896 - RNA, 22 nt, Pseudomonas aeruginosa PA01
cgcuuccucggcacucagccag

SEQ ID NO: 1483897 - RNA, 15 nt, Pseudomonas aeruginosa PA01
cgcuuccucgggcag

SEQ ID NO: 1483898 - RNA, 15 nt, Pseudomonas aeruginosa PA01
cgcuucgaagcucuc

SEQ ID NO: 1483899 - RNA, 16 nt, Pseudomonas aeruginosa PA01
cgcuucgaagcucucg

SEQ ID NO: 1483900 - RNA, 17 nt, Pseudomonas aeruginosa PA01
cgcuucgaagcucucgc

SEQ ID NO: 1483901 - RNA, 21 nt, Pseudomonas aeruginosa PA01
cgcuucgaagcucucgccgcg

SEQ ID NO: 1483902 - RNA, 12 nt, Pseudomonas aeruginosa PA01
cgcuucggccac

SEQ ID NO: 1483903 - RNA, 15 nt, Pseudomonas aeruginosa PA01
cgcuucggcccgcug

SEQ ID NO: 1483904 - RNA, 11 nt, Pseudomonas aeruginosa PA01
cgcuucggcgg

SEQ ID NO: 1483905 - RNA, 12 nt, Pseudomonas aeruginosa PA01
cgcuucggcgga

SEQ ID NO: 1483906 - RNA, 16 nt, Pseudomonas aeruginosa PA01
cgcuucggcugcugcu

SEQ ID NO: 1483907 - RNA, 15 nt, Pseudomonas aeruginosa PA01
cgcuucggcggcuuc

SEQ ID NO: 1483908 - RNA, 12 nt, Pseudomonas aeruginosa PA01
cgcuucggcggg

SEQ ID NO: 1483909 - RNA, 19 nt, Pseudomonas aeruginosa PA01
cgcuucggcuccagcacca

SEQ ID NO: 1483910 - RNA, 21 nt, Pseudomonas aeruginosa PA01
cgcuucggcuccagcaccagc

SEQ ID NO: 1483911 - RNA, 21 nt, Pseudomonas aeruginosa PA01
cgcuucaucaggcugcugucg

SEQ ID NO: 1483912 - RNA, 16 nt, Pseudomonas aeruginosa PA01
cgcuucauccugcgcg

SEQ ID NO: 1483913 - RNA, 20 nt, Pseudomonas aeruginosa PA01
cgcuucauccugcgcgccuc

SEQ ID NO: 1483914 - RNA, 13 nt, Pseudomonas aeruginosa PA01
cgcuucagcgcgc

SEQ ID NO: 1483915 - RNA, 18 nt, Pseudomonas aeruginosa PA01
cgcuucagcgcgccgagc

SEQ ID NO: 1483916 - RNA, 17 nt, Pseudomonas aeruginosa PA01
cgcuuccgcaucggccg

SEQ ID NO: 1483917 - RNA, 17 nt, Pseudomonas aeruginosa PA01
cgcuuccggcccggcca

SEQ ID NO: 1483918 - RNA, 20 nt, Pseudomonas aeruginosa PA01
cgcuuccggcccggccaggu

SEQ ID NO: 1483919 - RNA, 20 nt, Pseudomonas aeruginosa PA01
cgcuuccgccaggcgcagcc

SEQ ID NO: 1483920 - RNA, 15 nt, Pseudomonas aeruginosa PA01
cgcuuccgccggcgc

SEQ ID NO: 1483921 - RNA, 16 nt, Pseudomonas aeruginosa PA01
cgcuuccgccggcgcc

SEQ ID NO: 1483922 - RNA, 20 nt, Pseudomonas aeruginosa PA01
cgcuuccgccggcgccgccu

SEQ ID NO: 1483923 - RNA, 23 nt, Pseudomonas aeruginosa PA01
cgcuuccgccggcgccgccucgg

SEQ ID NO: 1483924 - RNA, 20 nt, Pseudomonas aeruginosa PA01
cgcuuccgcgcggcgcccug

SEQ ID NO: 1483925 - RNA, 19 nt, Pseudomonas aeruginosa PA01
cgcuuccggcagccagccg

SEQ ID NO: 1483926 - RNA, 22 nt, Pseudomonas aeruginosa PA01
cgcuuccggcagccagccgccg

SEQ ID NO: 1483927 - RNA, 23 nt, Pseudomonas aeruginosa PA01
cgcuuccggcagccagccgccga

SEQ ID NO: 1483928 - RNA, 14 nt, Pseudomonas aeruginosa PA01
cgcuuccagcaccu

SEQ ID NO: 1483929 - RNA, 21 nt, Pseudomonas aeruginosa PA01
cgcuuccaggguagcgccgcg

SEQ ID NO: 1483930 - RNA, 23 nt, Pseudomonas aeruginosa PA01
cgcuuccaggguagcgccgcggg

SEQ ID NO: 1483931 - RNA, 14 nt, Pseudomonas aeruginosa PA01
cgcugccggccagg

SEQ ID NO: 1483932 - RNA, 16 nt, Pseudomonas aeruginosa PA01
cgcugccggccagggu

SEQ ID NO: 1483933 - RNA, 13 nt, Pseudomonas aeruginosa PA01
cgcugccggucag

SEQ ID NO: 1483934 - RNA, 16 nt, Pseudomonas aeruginosa PA01
cgcugccggucaggcu

SEQ ID NO: 1483935 - RNA, 17 nt, Pseudomonas aeruginosa PA01
cgcugccggucaggcug

SEQ ID NO: 1483936 - RNA, 21 nt, Pseudomonas aeruginosa PA01
cgcugccggucaggcuggugc

SEQ ID NO: 1483937 - RNA, 20 nt, Pseudomonas aeruginosa PA01
cgcugcgagcagguccuguc

SEQ ID NO: 1483938 - RNA, 14 nt, Pseudomonas aeruginosa PA01
cgcugcgcaacugc

SEQ ID NO: 1483939 - RNA, 21 nt, Pseudomonas aeruginosa PA01
cgcugcgcaacugccggucgg

SEQ ID NO: 1483940 - RNA, 12 nt, Pseudomonas aeruginosa PA01
cgcugcgcaggc

SEQ ID NO: 1483941 - RNA, 13 nt, Pseudomonas aeruginosa PA01
cgcugcgcaggcc

SEQ ID NO: 1483942 - RNA, 15 nt, Pseudomonas aeruginosa PA01
cgcugcgcaggccga

SEQ ID NO: 1483943 - RNA, 19 nt, Pseudomonas aeruginosa PA01
cgcugcgcaggccgagaag

SEQ ID NO: 1483944 - RNA, 14 nt, Pseudomonas aeruginosa PA01
cgcuggcgcagccg

SEQ ID NO: 1483945 - RNA, 15 nt, Pseudomonas aeruginosa PA01
cgcuggcgcagccgc

SEQ ID NO: 1483946 - RNA, 16 nt, Pseudomonas aeruginosa PA01
cgcuggcgcagccgcu

SEQ ID NO: 1483947 - RNA, 22 nt, Pseudomonas aeruginosa PA01
cgcuggcgcagccgcugcugca

SEQ ID NO: 1483948 - RNA, 13 nt, Pseudomonas aeruginosa PA01
cgcugcgccgccg

SEQ ID NO: 1483949 - RNA, 17 nt, Pseudomonas aeruginosa PA01
cgcugcgccgccgucuu

SEQ ID NO: 1483950 - RNA, 15 nt, Pseudomonas aeruginosa PA01
cgcugcgcccgcucg

SEQ ID NO: 1483951 - RNA, 18 nt, Pseudomonas aeruginosa PA01
cgcugcgcccgcucgacc

SEQ ID NO: 1483952 - RNA, 20 nt, Pseudomonas aeruginosa PA01
cgcugcgcagaugcggggcg

SEQ ID NO: 1483953 - RNA, 12 nt, Pseudomonas aeruginosa PA01
cgcugcgccagg

SEQ ID NO: 1483954 - RNA, 14 nt, Pseudomonas aeruginosa PA01
cgcugcgccaggcu

SEQ ID NO: 1483955 - RNA, 15 nt, Pseudomonas aeruginosa PA01
cgcuggcgcccaacg

SEQ ID NO: 1483956 - RNA, 13 nt, Pseudomonas aeruginosa PA01
cgcuggcgccgau

SEQ ID NO: 1483957 - RNA, 20 nt, Pseudomonas aeruginosa PA01
cgcuggcgcuguaggcgagc

SEQ ID NO: 1483958 - RNA, 14 nt, Pseudomonas aeruginosa PA01
cgcuggcggccuuc

SEQ ID NO: 1483959 - RNA, 13 nt, Pseudomonas aeruginosa PA01
cgcuggcggcgac

SEQ ID NO: 1483960 - RNA, 15 nt, Pseudomonas aeruginosa PA01
cgcuggcggcgacga

SEQ ID NO: 1483961 - RNA, 13 nt, Pseudomonas aeruginosa PA01
cgcuggcgggcgc

SEQ ID NO: 1483962 - RNA, 21 nt, Pseudomonas aeruginosa PA01
cgcuggcguuauucgcccuac

SEQ ID NO: 1483963 - RNA, 20 nt, Pseudomonas aeruginosa PA01
cgcuguccgccgccgcggcg

SEQ ID NO: 1483964 - RNA, 16 nt, Pseudomonas aeruginosa PA01
cgcuguccgccggccu

SEQ ID NO: 1483965 - RNA, 14 nt, Pseudomonas aeruginosa PA01
cgcugucccggcca

SEQ ID NO: 1483966 - RNA, 18 nt, Pseudomonas aeruginosa PA01
cgcugucagggcuugcgc

SEQ ID NO: 1483967 - RNA, 21 nt, Pseudomonas aeruginosa PA01
cgcugucagggcuugcgcgcc

SEQ ID NO: 1483968 - RNA, 19 nt, Pseudomonas aeruginosa PA01
cgcugucaaucgcgcaacg

SEQ ID NO: 1483969 - RNA, 21 nt, Pseudomonas aeruginosa PA01
cgcugucaaucgcgcaacggc

SEQ ID NO: 1483970 - RNA, 16 nt, Pseudomonas aeruginosa PA01
cgcugucucgccagcc

SEQ ID NO: 1483971 - RNA, 16 nt, Pseudomonas aeruginosa PA01
cgcugucguccagcgg

SEQ ID NO: 1483972 - RNA, 18 nt, Pseudomonas aeruginosa PA01
cgcugucguccagcgggu

SEQ ID NO: 1483973 - RNA, 13 nt, Pseudomonas aeruginosa PA01
cgcugucgucggc

SEQ ID NO: 1483974 - RNA, 15 nt, Pseudomonas aeruginosa PA01
cgcugucgucggcgc

SEQ ID NO: 1483975 - RNA, 20 nt, Pseudomonas aeruginosa PA01
cgcugucgucggcgcggccg

SEQ ID NO: 1483976 - RNA, 19 nt, Pseudomonas aeruginosa PA01
cgcugucgucuucggccag

SEQ ID NO: 1483977 - RNA, 17 nt, Pseudomonas aeruginosa PA01
cgcugucggccucgacg

SEQ ID NO: 1483978 - RNA, 18 nt, Pseudomonas aeruginosa PA01
cgcugucggccucgacga

SEQ ID NO: 1483979 - RNA, 19 nt, Pseudomonas aeruginosa PA01
cgcugucgccggucaggcu

SEQ ID NO: 1483980 - RNA, 13 nt, Pseudomonas aeruginosa PA01
cgcugucgccguu

SEQ ID NO: 1483981 - RNA, 22 nt, Pseudomonas aeruginosa PA01
cgcugucgccguuggccuucac

SEQ ID NO: 1483982 - RNA, 23 nt, Pseudomonas aeruginosa PA01
cgcuggggaccgcaccuggugga

SEQ ID NO: 1483983 - RNA, 21 nt, Pseudomonas aeruginosa PA01
cgcuguaguuguucggcuggg

SEQ ID NO: 1483984 - RNA, 21 nt, Pseudomonas aeruginosa PA01
cgcugguccagcacgcuggcg

SEQ ID NO: 1483985 - RNA, 17 nt, Pseudomonas aeruginosa PA01
cgcugguccagcuggcg

SEQ ID NO: 1483986 - RNA, 20 nt, Pseudomonas aeruginosa PA01
cgcugguccagcuggcgcag

SEQ ID NO: 1483987 - RNA, 19 nt, Pseudomonas aeruginosa PA01
cgcugguagcccaggccga

SEQ ID NO: 1483988 - RNA, 22 nt, Pseudomonas aeruginosa PA01
cgcugguagcgcuccagcuccu

SEQ ID NO: 1483989 - RNA, 15 nt, Pseudomonas aeruginosa PA01
cgcugguaauccagg

SEQ ID NO: 1483990 - RNA, 15 nt, Pseudomonas aeruginosa PA01
cgcugguaccugccg

SEQ ID NO: 1483991 - RNA, 17 nt, Pseudomonas aeruginosa PA01
cgcugguaccugccggc

SEQ ID NO: 1483992 - RNA, 21 nt, Pseudomonas aeruginosa PA01
cgcugguaccugccggcacgc

SEQ ID NO: 1483993 - RNA, 14 nt, Pseudomonas aeruginosa PA01
cggcgcaagcgguu

SEQ ID NO: 1483994 - RNA, 15 nt, Pseudomonas aeruginosa PA01
cggcgcaagcgguug

SEQ ID NO: 1483995 - RNA, 23 nt, Pseudomonas aeruginosa PA01
cggcgcaagggcgccgccgacgc

SEQ ID NO: 1483996 - RNA, 18 nt, Pseudomonas aeruginosa PA01
cggcgcacauuacccccu

SEQ ID NO: 1483997 - RNA, 14 nt, Pseudomonas aeruginosa PA01
cggcgcagcagggc

SEQ ID NO: 1483998 - RNA, 16 nt, Pseudomonas aeruginosa PA01
cggcgcagcagggcgu

SEQ ID NO: 1483999 - RNA, 17 nt, Pseudomonas aeruginosa PA01
cggcgcagcagggcguc

SEQ ID NO: 1484000 - RNA, 21 nt, Pseudomonas aeruginosa PA01
cggcgcagcagggcgucggcg

SEQ ID NO: 1484001 - RNA, 13 nt, Pseudomonas aeruginosa PA01
cggcgcagccaga

SEQ ID NO: 1484002 - RNA, 16 nt, Pseudomonas aeruginosa PA01
cggcgcagcccagccg

SEQ ID NO: 1484003 - RNA, 12 nt, Pseudomonas aeruginosa PA01
cggcgcagccgc

SEQ ID NO: 1484004 - RNA, 19 nt, Pseudomonas aeruginosa PA01
cggcgcagccgcaaggcca

SEQ ID NO: 1484005 - RNA, 22 nt, Pseudomonas aeruginosa PA01
cggcgauggcguagaggcucgg

SEQ ID NO: 1484006 - RNA, 19 nt, Pseudomonas aeruginosa PA01
cggcgauggcccagaugau

SEQ ID NO: 1484007 - RNA, 14 nt, Pseudomonas aeruginosa PA01
cggcgaugcugcug

SEQ ID NO: 1484008 - RNA, 16 nt, Pseudomonas aeruginosa PA01
cggcgauggacucgau

SEQ ID NO: 1484009 - RNA, 16 nt, Pseudomonas aeruginosa PA01
cggcgauggccgccag

SEQ ID NO: 1484010 - RNA, 17 nt, Pseudomonas aeruginosa PA01
cggcgauggccgccagc

SEQ ID NO: 1484011 - RNA, 19 nt, Pseudomonas aeruginosa PA01
cggcgauggccgccugcag

SEQ ID NO: 1484012 - RNA, 21 nt, Pseudomonas aeruginosa PA01
cggcgaugcguuugucgaccu

SEQ ID NO: 1484013 - RNA, 23 nt, Pseudomonas aeruginosa PA01
cggcgaugcguuugucgaccugc

SEQ ID NO: 1484014 - RNA, 14 nt, Pseudomonas aeruginosa PA01
cggcgaugcucagc

SEQ ID NO: 1484015 - RNA, 16 nt, Pseudomonas aeruginosa PA01
cggcgaugcucagcgc

SEQ ID NO: 1484016 - RNA, 17 nt, Pseudomonas aeruginosa PA01
cggcgaugcucagcgcc

SEQ ID NO: 1484017 - RNA, 21 nt, Pseudomonas aeruginosa PA01
cggcgaugcucagcgccggcc

SEQ ID NO: 1484018 - RNA, 16 nt, Pseudomonas aeruginosa PA01
cggcgacggugccggu

SEQ ID NO: 1484019 - RNA, 20 nt, Pseudomonas aeruginosa PA01
cggcgacgggaagcgaacca

SEQ ID NO: 1484020 - RNA, 23 nt, Pseudomonas aeruginosa PA01
cggcgacgggaagcgaaccaggc

SEQ ID NO: 1484021 - RNA, 22 nt, Pseudomonas aeruginosa PA01
cggcgacgcugaugaugccgcg

SEQ ID NO: 1484022 - RNA, 15 nt, Pseudomonas aeruginosa PA01
cggcgacgcuggcgg

SEQ ID NO: 1484023 - RNA, 17 nt, Pseudomonas aeruginosa PA01
cggcgacgucgccguga

SEQ ID NO: 1484024 - RNA, 15 nt, Pseudomonas aeruginosa PA01
cggcgaucagaacga

SEQ ID NO: 1484025 - RNA, 16 nt, Pseudomonas aeruginosa PA01
cggcgaucaggccgau

SEQ ID NO: 1484026 - RNA, 17 nt, Pseudomonas aeruginosa PA01
cggcgaucaggccgaug

SEQ ID NO: 1484027 - RNA, 23 nt, Pseudomonas aeruginosa PA01
cggcgaucaggccgaugcgcaac

SEQ ID NO: 1484028 - RNA, 14 nt, Pseudomonas aeruginosa PA01
cggcgaucauccag

SEQ ID NO: 1484029 - RNA, 16 nt, Pseudomonas aeruginosa PA01
cggcgaucauccagcc

SEQ ID NO: 1484030 - RNA, 17 nt, Pseudomonas aeruginosa PA01
cggcgaucauccagccc

SEQ ID NO: 1484031 - RNA, 19 nt, Pseudomonas aeruginosa PA01
cggcgaucagcucgcggua

SEQ ID NO: 1484032 - RNA, 13 nt, Pseudomonas aeruginosa PA01
cggcgaucuucag

SEQ ID NO: 1484033 - RNA, 22 nt, Pseudomonas aeruginosa PA01
cggcgaucuucagguaggcgcg

SEQ ID NO: 1484034 - RNA, 15 nt, Pseudomonas aeruginosa PA01
cggcgaucuucuccg

SEQ ID NO: 1484035 - RNA, 19 nt, Pseudomonas aeruginosa PA01
cggcgaucuucuccgccgc

SEQ ID NO: 1484036 - RNA, 20 nt, Pseudomonas aeruginosa PA01
cggcgaucuucuccgccgcg

SEQ ID NO: 1484037 - RNA, 23 nt, Pseudomonas aeruginosa PA01
cggcgaugaccagcucggcggga

SEQ ID NO: 1484038 - RNA, 22 nt, Pseudomonas aeruginosa PA01
cggcgaugaccaggguggcggc

SEQ ID NO: 1484039 - RNA, 13 nt, Pseudomonas aeruginosa PA01
cggcgaucagcgg

SEQ ID NO: 1484040 - RNA, 12 nt, Pseudomonas aeruginosa PA01
cggcgcccgccu

SEQ ID NO: 1484041 - RNA, 14 nt, Pseudomonas aeruginosa PA01
cggcgcccgccugc

SEQ ID NO: 1484042 - RNA, 15 nt, Pseudomonas aeruginosa PA01
cggcgcccugggcgc

SEQ ID NO: 1484043 - RNA, 14 nt, Pseudomonas aeruginosa PA01
cggcgcccuucgag

SEQ ID NO: 1484044 - RNA, 15 nt, Pseudomonas aeruginosa PA01
cggcgcccucugccg

SEQ ID NO: 1484045 - RNA, 21 nt, Pseudomonas aeruginosa PA01
cggcgcccucugccggucgga

SEQ ID NO: 1484046 - RNA, 13 nt, Pseudomonas aeruginosa PA01
cggcgccgaggcc

SEQ ID NO: 1484047 - RNA, 14 nt, Pseudomonas aeruginosa PA01
cggcgccgaggccc

SEQ ID NO: 1484048 - RNA, 16 nt, Pseudomonas aeruginosa PA01
cggcgccgaggcccua

SEQ ID NO: 1484049 - RNA, 13 nt, Pseudomonas aeruginosa PA01
cggcgccgagcau

SEQ ID NO: 1484050 - RNA, 14 nt, Pseudomonas aeruginosa PA01
cggcgccgaugccg

SEQ ID NO: 1484051 - RNA, 15 nt, Pseudomonas aeruginosa PA01
cggcgccgaugccgc

SEQ ID NO: 1484052 - RNA, 13 nt, Pseudomonas aeruginosa PA01
cggcgccgaugcg

SEQ ID NO: 1484053 - RNA, 14 nt, Pseudomonas aeruginosa PA01
cggcgcagcggcga

SEQ ID NO: 1484054 - RNA, 12 nt, Pseudomonas aeruginosa PA01
cggcgcagcgga

SEQ ID NO: 1484055 - RNA, 14 nt, Pseudomonas aeruginosa PA01
cggcgccacgcuca

SEQ ID NO: 1484056 - RNA, 13 nt, Pseudomonas aeruginosa PA01
cggcgccagcagg

SEQ ID NO: 1484057 - RNA, 14 nt, Pseudomonas aeruginosa PA01
cggcgccagcaggc

SEQ ID NO: 1484058 - RNA, 21 nt, Pseudomonas aeruginosa PA01
cggcgcccaaugcaucggccg

SEQ ID NO: 1484059 - RNA, 13 nt, Pseudomonas aeruginosa PA01
cggcgccccaggc

SEQ ID NO: 1484060 - RNA, 14 nt, Pseudomonas aeruginosa PA01
cggcgccccaggcg

SEQ ID NO: 1484061 - RNA, 15 nt, Pseudomonas aeruginosa PA01
cggcgccccaggcgc

SEQ ID NO: 1484062 - RNA, 21 nt, Pseudomonas aeruginosa PA01
cggcgccccaggcgcccaggc

SEQ ID NO: 1484063 - RNA, 18 nt, Pseudomonas aeruginosa PA01
cggcgccccugcggcgcc

SEQ ID NO: 1484064 - RNA, 20 nt, Pseudomonas aeruginosa PA01
cggcgccccugcggcgccgg

SEQ ID NO: 1484065 - RNA, 20 nt, Pseudomonas aeruginosa PA01
cggcgccccggcccagccgc

SEQ ID NO: 1484066 - RNA, 22 nt, Pseudomonas aeruginosa PA01
cggcgccccgggucggcacggc

SEQ ID NO: 1484067 - RNA, 15 nt, Pseudomonas aeruginosa PA01
cggcgcccgagggcg

SEQ ID NO: 1484068 - RNA, 13 nt, Pseudomonas aeruginosa PA01
cggcgcccagcac

SEQ ID NO: 1484069 - RNA, 14 nt, Pseudomonas aeruginosa PA01
cggcgcccagcacc

SEQ ID NO: 1484070 - RNA, 12 nt, Pseudomonas aeruginosa PA01
cggcgcgccaga

SEQ ID NO: 1484071 - RNA, 14 nt, Pseudomonas aeruginosa PA01
cggcgcgccagaag

SEQ ID NO: 1484072 - RNA, 23 nt, Pseudomonas aeruginosa PA01
cggcgcgccagaagcggccgacc

SEQ ID NO: 1484073 - RNA, 21 nt, Pseudomonas aeruginosa PA01
cggcgcgccauggcgguuccu

SEQ ID NO: 1484074 - RNA, 16 nt, Pseudomonas aeruginosa PA01
cggcgcgccgaaggcg

SEQ ID NO: 1484075 - RNA, 18 nt, Pseudomonas aeruginosa PA01
cggcgcgcccggcgcaga

SEQ ID NO: 1484076 - RNA, 13 nt, Pseudomonas aeruginosa PA01
cggcgcgccgaag

SEQ ID NO: 1484077 - RNA, 15 nt, Pseudomonas aeruginosa PA01
cggcgcgccggacag

SEQ ID NO: 1484078 - RNA, 13 nt, Pseudomonas aeruginosa PA01
cggcgcgccggug

SEQ ID NO: 1484079 - RNA, 15 nt, Pseudomonas aeruginosa PA01
cggcgcgccggugau

SEQ ID NO: 1484080 - RNA, 20 nt, Pseudomonas aeruginosa PA01
cggcgcgccggugaucgagc

SEQ ID NO: 1484081 - RNA, 17 nt, Pseudomonas aeruginosa PA01
cggcgcgccuucagcgc

SEQ ID NO: 1484082 - RNA, 13 nt, Pseudomonas aeruginosa PA01
cggcgcgcggggu

SEQ ID NO: 1484083 - RNA, 17 nt, Pseudomonas aeruginosa PA01
cggcgcgcggcagcacc

SEQ ID NO: 1484084 - RNA, 18 nt, Pseudomonas aeruginosa PA01
cggcgcgcggcagcacca

SEQ ID NO: 1484085 - RNA, 19 nt, Pseudomonas aeruginosa PA01
cggcgcggaagcgccugcg

SEQ ID NO: 1484086 - RNA, 20 nt, Pseudomonas aeruginosa PA01
cggcgcgcuccggcgcgcca

SEQ ID NO: 1484087 - RNA, 11 nt, Pseudomonas aeruginosa PA01
cggcgcgcuga

SEQ ID NO: 1484088 - RNA, 18 nt, Pseudomonas aeruginosa PA01
cggcgcgaggcggaagaa

SEQ ID NO: 1484089 - RNA, 16 nt, Pseudomonas aeruginosa PA01
cggcgcgauauccgcc

SEQ ID NO: 1484090 - RNA, 19 nt, Pseudomonas aeruginosa PA01
cggcgcgauauccgccagg

SEQ ID NO: 1484091 - RNA, 18 nt, Pseudomonas aeruginosa PA01
cggcgcgauccuccgcca

SEQ ID NO: 1484092 - RNA, 20 nt, Pseudomonas aeruginosa PA01
cggcgcgauccuccgccagc

SEQ ID NO: 1484093 - RNA, 19 nt, Pseudomonas aeruginosa PA01
cggcgcgauccuggcggca

SEQ ID NO: 1484094 - RNA, 22 nt, Pseudomonas aeruginosa PA01
cggcgcgauccuggcggcacuc

SEQ ID NO: 1484095 - RNA, 13 nt, Pseudomonas aeruginosa PA01
cggcgcgaagucg

SEQ ID NO: 1484096 - RNA, 17 nt, Pseudomonas aeruginosa PA01
cggcgcgaaccagcagc

SEQ ID NO: 1484097 - RNA, 17 nt, Pseudomonas aeruginosa PA01
cggcgcgaccgucggcc

SEQ ID NO: 1484098 - RNA, 18 nt, Pseudomonas aeruginosa PA01
cggcgcgaccgucggccg

SEQ ID NO: 1484099 - RNA, 21 nt, Pseudomonas aeruginosa PA01
cggcgcgacuguucucuacgc

SEQ ID NO: 1484100 - RNA, 21 nt, Pseudomonas aeruginosa PA01
cggcgcgagaugaagcgccgc

SEQ ID NO: 1484101 - RNA, 23 nt, Pseudomonas aeruginosa PA01
cggcgcgagaugaagcgccgcag

SEQ ID NO: 1484102 - RNA, 21 nt, Pseudomonas aeruginosa PA01
cggcgcgacggcccacggcga

SEQ ID NO: 1484103 - RNA, 23 nt, Pseudomonas aeruginosa PA01
cggcgcgacggcccacggcgaga

SEQ ID NO: 1484104 - RNA, 22 nt, Pseudomonas aeruginosa PA01
cggcgcgcaccuguuucagcgg

SEQ ID NO: 1484105 - RNA, 20 nt, Pseudomonas aeruginosa PA01
cggcgcgaugaugccgccgu

SEQ ID NO: 1484106 - RNA, 12 nt, Pseudomonas aeruginosa PA01
cggcgcgaugcc

SEQ ID NO: 1484107 - RNA, 15 nt, Pseudomonas aeruginosa PA01
cggcgcgcagggcca

SEQ ID NO: 1484108 - RNA, 21 nt, Pseudomonas aeruginosa PA01
cggcgcgcagggccagcaaca

SEQ ID NO: 1484109 - RNA, 21 nt, Pseudomonas aeruginosa PA01
cggcgcgcagggugagcaugg

SEQ ID NO: 1484110 - RNA, 12 nt, Pseudomonas aeruginosa PA01
cggcgccgccga

SEQ ID NO: 1484111 - RNA, 13 nt, Pseudomonas aeruginosa PA01
cggcgccgccucg

SEQ ID NO: 1484112 - RNA, 14 nt, Pseudomonas aeruginosa PA01
cggcgccgcgcacc

SEQ ID NO: 1484113 - RNA, 20 nt, Pseudomonas aeruginosa PA01
cggcgccgcgcaccugggcg

SEQ ID NO: 1484114 - RNA, 17 nt, Pseudomonas aeruginosa PA01
cggcgccgccuggccgg

SEQ ID NO: 1484115 - RNA, 11 nt, Pseudomonas aeruginosa PA01
cggcgccggcc

SEQ ID NO: 1484116 - RNA, 12 nt, Pseudomonas aeruginosa PA01
cggcgccggcag

SEQ ID NO: 1484117 - RNA, 17 nt, Pseudomonas aeruginosa PA01
cggcgccggugcuggcg

SEQ ID NO: 1484118 - RNA, 23 nt, Pseudomonas aeruginosa PA01
cggcgccggugcuggcgagcagg

SEQ ID NO: 1484119 - RNA, 20 nt, Pseudomonas aeruginosa PA01
cggcgccgguugcugcugcg

SEQ ID NO: 1484120 - RNA, 19 nt, Pseudomonas aeruginosa PA01
cggcgccgguugcugcugg

SEQ ID NO: 1484121 - RNA, 17 nt, Pseudomonas aeruginosa PA01
cggcgccuugcgccagg

SEQ ID NO: 1484122 - RNA, 18 nt, Pseudomonas aeruginosa PA01
cggcgccuugcgccaggc

SEQ ID NO: 1484123 - RNA, 21 nt, Pseudomonas aeruginosa PA01
cggcgccuugcgguccagcga

SEQ ID NO: 1484124 - RNA, 17 nt, Pseudomonas aeruginosa PA01
cggcgccuucagcgccg

SEQ ID NO: 1484125 - RNA, 16 nt, Pseudomonas aeruginosa PA01
cggcgccuucaucgcc

SEQ ID NO: 1484126 - RNA, 13 nt, Pseudomonas aeruginosa PA01
cggcgccugcugc

SEQ ID NO: 1484127 - RNA, 14 nt, Pseudomonas aeruginosa PA01
cggcgccuggagca

SEQ ID NO: 1484128 - RNA, 14 nt, Pseudomonas aeruginosa PA01
cggcgccugcggac

SEQ ID NO: 1484129 - RNA, 20 nt, Pseudomonas aeruginosa PA01
cggcgccugcggaccacagg

SEQ ID NO: 1484130 - RNA, 14 nt, Pseudomonas aeruginosa PA01
cggcgccucgaagc

SEQ ID NO: 1484131 - RNA, 15 nt, Pseudomonas aeruginosa PA01
cggcgccucgaagcg

SEQ ID NO: 1484132 - RNA, 23 nt, Pseudomonas aeruginosa PA01
cggcgccuccaggaauccuccgc

SEQ ID NO: 1484133 - RNA, 24 nt, Pseudomonas aeruginosa PA01
cggcgccuccaggaauccuccgcc

SEQ ID NO: 1484134 - RNA, 20 nt, Pseudomonas aeruginosa PA01
cggcgccucccagggucgcc

SEQ ID NO: 1484135 - RNA, 21 nt, Pseudomonas aeruginosa PA01
cggcgccucccagggucgccu

SEQ ID NO: 1484136 - RNA, 14 nt, Pseudomonas aeruginosa PA01
cggccggauggccg

SEQ ID NO: 1484137 - RNA, 17 nt, Pseudomonas aeruginosa PA01
cggccggauggccgccg

SEQ ID NO: 1484138 - RNA, 18 nt, Pseudomonas aeruginosa PA01
cggccggauggccgccgu

SEQ ID NO: 1484139 - RNA, 13 nt, Pseudomonas aeruginosa PA01
cggccggauggcc

SEQ ID NO: 1484140 - RNA, 14 nt, Pseudomonas aeruginosa PA01
cggccggcgaggcg

SEQ ID NO: 1484141 - RNA, 15 nt, Pseudomonas aeruginosa PA01
cggccggcgaccuug

SEQ ID NO: 1484142 - RNA, 18 nt, Pseudomonas aeruginosa PA01
cggccggcgaccuugucc

SEQ ID NO: 1484143 - RNA, 15 nt, Pseudomonas aeruginosa PA01
cggccggcgcagucg

SEQ ID NO: 1484144 - RNA, 18 nt, Pseudomonas aeruginosa PA01
cggccgggauacagcagc

SEQ ID NO: 1484145 - RNA, 19 nt, Pseudomonas aeruginosa PA01
cggccgggauacagcagcc

SEQ ID NO: 1484146 - RNA, 16 nt, Pseudomonas aeruginosa PA01
cggccggggcgcgccc

SEQ ID NO: 1484147 - RNA, 21 nt, Pseudomonas aeruginosa PA01
cggccggggcggauucaggcg

SEQ ID NO: 1484148 - RNA, 23 nt, Pseudomonas aeruginosa PA01
cggccggggcggauucaggcgcg

SEQ ID NO: 1484149 - RNA, 15 nt, Pseudomonas aeruginosa PA01
cggccggggccggca

SEQ ID NO: 1484150 - RNA, 19 nt, Pseudomonas aeruginosa PA01
cggccggggccggcacccg

SEQ ID NO: 1484151 - RNA, 18 nt, Pseudomonas aeruginosa PA01
cggccgucccagucggcg

SEQ ID NO: 1484152 - RNA, 20 nt, Pseudomonas aeruginosa PA01
cggccgucccagucggcguc

SEQ ID NO: 1484153 - RNA, 23 nt, Pseudomonas aeruginosa PA01
cggccgucccagucggcguccgc

SEQ ID NO: 1484154 - RNA, 16 nt, Pseudomonas aeruginosa PA01
cggccgucgcgcacca

SEQ ID NO: 1484155 - RNA, 18 nt, Pseudomonas aeruginosa PA01
cggccguagccgucgaac

SEQ ID NO: 1484156 - RNA, 21 nt, Pseudomonas aeruginosa PA01
cggccguagccgucgaacagc

SEQ ID NO: 1484157 - RNA, 23 nt, Pseudomonas aeruginosa PA01
cggccggggucaggccgaggcgc

SEQ ID NO: 1484158 - RNA, 19 nt, Pseudomonas aeruginosa PA01
cggccgggucgaggucgag

SEQ ID NO: 1484159 - RNA, 13 nt, Pseudomonas aeruginosa PA01
cggccgguagucg

SEQ ID NO: 1484160 - RNA, 13 nt, Pseudomonas aeruginosa PA01
cggccggugccuu

SEQ ID NO: 1484161 - RNA, 20 nt, Pseudomonas aeruginosa PA01
cggccggugccuucggcggc

SEQ ID NO: 1484162 - RNA, 21 nt, Pseudomonas aeruginosa PA01
cggccggugccuucggcggcg

SEQ ID NO: 1484163 - RNA, 12 nt, Pseudomonas aeruginosa PA01
cggccgccgcgc

SEQ ID NO: 1484164 - RNA, 13 nt, Pseudomonas aeruginosa PA01
cggccgccggcgc

SEQ ID NO: 1484165 - RNA, 14 nt, Pseudomonas aeruginosa PA01
cggccgccggcgcc

SEQ ID NO: 1484166 - RNA, 17 nt, Pseudomonas aeruginosa PA01
cggccgccggcgcccug

SEQ ID NO: 1484167 - RNA, 21 nt, Pseudomonas aeruginosa PA01
cggccgcgagcgcggccggcc

SEQ ID NO: 1484168 - RNA, 22 nt, Pseudomonas aeruginosa PA01
cggccgcgagcgcggccggcca

SEQ ID NO: 1484169 - RNA, 23 nt, Pseudomonas aeruginosa PA01
cggccgcgagcgcggccggccac

SEQ ID NO: 1484170 - RNA, 15 nt, Pseudomonas aeruginosa PA01
cggccgcgaggacaa

SEQ ID NO: 1484171 - RNA, 14 nt, Pseudomonas aeruginosa PA01
cggccgcgccagcc

SEQ ID NO: 1484172 - RNA, 16 nt, Pseudomonas aeruginosa PA01
cggccgcgccagccac

SEQ ID NO: 1484173 - RNA, 16 nt, Pseudomonas aeruginosa PA01
cggccgcgucgcccag

SEQ ID NO: 1484174 - RNA, 18 nt, Pseudomonas aeruginosa PA01
cggccgcgucgcccaggc

SEQ ID NO: 1484175 - RNA, 19 nt, Pseudomonas aeruginosa PA01
cggccgcgucgcccaggcc

SEQ ID NO: 1484176 - RNA, 22 nt, Pseudomonas aeruginosa PA01
cggccgccgaaaugcugcaggc

SEQ ID NO: 1484177 - RNA, 14 nt, Pseudomonas aeruginosa PA01
cggccgccagcagg

SEQ ID NO: 1484178 - RNA, 14 nt, Pseudomonas aeruginosa PA01
cggccgcaccagga

SEQ ID NO: 1484179 - RNA, 24 nt, Pseudomonas aeruginosa PA01
cggccgauggaaaucggccacucc

SEQ ID NO: 1484180 - RNA, 17 nt, Pseudomonas aeruginosa PA01
cggccgcaaccagcccu

SEQ ID NO: 1484181 - RNA, 18 nt, Pseudomonas aeruginosa PA01
cggccgcaaccagcccug

SEQ ID NO: 1484182 - RNA, 21 nt, Pseudomonas aeruginosa PA01
cggccgcaaccagcccuggcg

SEQ ID NO: 1484183 - RNA, 22 nt, Pseudomonas aeruginosa PA01
cggccgaugugaaaacggcgca

SEQ ID NO: 1484184 - RNA, 22 nt, Pseudomonas aeruginosa PA01
cggccccgcgguacccggcagg

SEQ ID NO: 1484185 - RNA, 12 nt, Pseudomonas aeruginosa PA01
cggccccggcca

SEQ ID NO: 1484186 - RNA, 15 nt, Pseudomonas aeruginosa PA01
cggccgaugaucucc

SEQ ID NO: 1484187 - RNA, 18 nt, Pseudomonas aeruginosa PA01
cggccgaugaucuccgcg

SEQ ID NO: 1484188 - RNA, 20 nt, Pseudomonas aeruginosa PA01
cggccgaugaucuccgcgcc

SEQ ID NO: 1484189 - RNA, 14 nt, Pseudomonas aeruginosa PA01
cggcgacgaucacc

SEQ ID NO: 1484190 - RNA, 22 nt, Pseudomonas aeruginosa PA01
cggcgacgaucacccccagcga

SEQ ID NO: 1484191 - RNA, 14 nt, Pseudomonas aeruginosa PA01
cggcgacgaucagc

SEQ ID NO: 1484192 - RNA, 17 nt, Pseudomonas aeruginosa PA01
cggcgacgccacccgca

SEQ ID NO: 1484193 - RNA, 15 nt, Pseudomonas aeruginosa PA01
cggcgaccaccgccg

SEQ ID NO: 1484194 - RNA, 18 nt, Pseudomonas aeruginosa PA01
cggcgaccaccgccggga

SEQ ID NO: 1484195 - RNA, 14 nt, Pseudomonas aeruginosa PA01
cggcgaccaccgcg

SEQ ID NO: 1484196 - RNA, 15 nt, Pseudomonas aeruginosa PA01
cggcgaccagcccgc

SEQ ID NO: 1484197 - RNA, 18 nt, Pseudomonas aeruginosa PA01
cggcgaccagcccgcgcg

SEQ ID NO: 1484198 - RNA, 23 nt, Pseudomonas aeruginosa PA01
cggcgaccauguucaccagcgcu

SEQ ID NO: 1484199 - RNA, 19 nt, Pseudomonas aeruginosa PA01
cggcgacccagaccugccg

SEQ ID NO: 1484200 - RNA, 21 nt, Pseudomonas aeruginosa PA01
cggcgacccagaccugccgcc

SEQ ID NO: 1484201 - RNA, 18 nt, Pseudomonas aeruginosa PA01
cggcgaccccgaucaccg

SEQ ID NO: 1484202 - RNA, 19 nt, Pseudomonas aeruginosa PA01
cggcgaccccgaucaccgg

SEQ ID NO: 1484203 - RNA, 19 nt, Pseudomonas aeruginosa PA01
cggcgacgacgaagaguaa

SEQ ID NO: 1484204 - RNA, 14 nt, Pseudomonas aeruginosa PA01
cggcgacgacgauc

SEQ ID NO: 1484205 - RNA, 16 nt, Pseudomonas aeruginosa PA01
cggcgacgacgauccc

SEQ ID NO: 1484206 - RNA, 13 nt, Pseudomonas aeruginosa PA01
cggcgaccaucca

SEQ ID NO: 1484207 - RNA, 15 nt, Pseudomonas aeruginosa PA01
cggcgaccauccagc

SEQ ID NO: 1484208 - RNA, 16 nt, Pseudomonas aeruginosa PA01
cggcgaccauccagcc

SEQ ID NO: 1484209 - RNA, 22 nt, Pseudomonas aeruginosa PA01
cggcgaccauccagccugcgcu

SEQ ID NO: 1484210 - RNA, 12 nt, Pseudomonas aeruginosa PA01
cggcgaccagcg

SEQ ID NO: 1484211 - RNA, 13 nt, Pseudomonas aeruginosa PA01
cggcgaccagcgc

SEQ ID NO: 1484212 - RNA, 14 nt, Pseudomonas aeruginosa PA01
cggcgaccagcgcg

SEQ ID NO: 1484213 - RNA, 13 nt, Pseudomonas aeruginosa PA01
cggcgaccagcgu

SEQ ID NO: 1484214 - RNA, 19 nt, Pseudomonas aeruginosa PA01
cggcgaccagcgucgcgcg

SEQ ID NO: 1484215 - RNA, 22 nt, Pseudomonas aeruginosa PA01
cggcgaccagcgucgcgcgugc

SEQ ID NO: 1484216 - RNA, 17 nt, Pseudomonas aeruginosa PA01
cggcgaaguccaccagg

SEQ ID NO: 1484217 - RNA, 18 nt, Pseudomonas aeruginosa PA01
cggcgaaguccaccaggc

SEQ ID NO: 1484218 - RNA, 21 nt, Pseudomonas aeruginosa PA01
cggcgaaguccggguugagca

SEQ ID NO: 1484219 - RNA, 15 nt, Pseudomonas aeruginosa PA01
cggcgaacagccagc

SEQ ID NO: 1484220 - RNA, 15 nt, Pseudomonas aeruginosa PA01
cggcgaagguggcga

SEQ ID NO: 1484221 - RNA, 18 nt, Pseudomonas aeruginosa PA01
cggcgaagguggcgaccu

SEQ ID NO: 1484222 - RNA, 15 nt, Pseudomonas aeruginosa PA01
cggcgaagucgccgu

SEQ ID NO: 1484223 - RNA, 18 nt, Pseudomonas aeruginosa PA01
cggcgaagucgccgucgu

SEQ ID NO: 1484224 - RNA, 12 nt, Pseudomonas aeruginosa PA01
cggcgaccacca

SEQ ID NO: 1484225 - RNA, 15 nt, Pseudomonas aeruginosa PA01
cggcgaccacccggc

SEQ ID NO: 1484226 - RNA, 20 nt, Pseudomonas aeruginosa PA01
cggcgaccaccacgucgaug

SEQ ID NO: 1484227 - RNA, 22 nt, Pseudomonas aeruginosa PA01
cggcgaccaccacgucgaugcc

SEQ ID NO: 1484228 - RNA, 16 nt, Pseudomonas aeruginosa PA01
cggcgacauagccggc

SEQ ID NO: 1484229 - RNA, 16 nt, Pseudomonas aeruginosa PA01
cggcgaccaacagggc

SEQ ID NO: 1484230 - RNA, 20 nt, Pseudomonas aeruginosa PA01
cggcgaacaucauccacagc

SEQ ID NO: 1484231 - RNA, 20 nt, Pseudomonas aeruginosa PA01
cggcgaacaggguggugucg

SEQ ID NO: 1484232 - RNA, 13 nt, Pseudomonas aeruginosa PA01
cggcgaaccaggc

SEQ ID NO: 1484233 - RNA, 12 nt, Pseudomonas aeruginosa PA01
cggcgaagcguu

SEQ ID NO: 1484234 - RNA, 16 nt, Pseudomonas aeruginosa PA01
cggcgaagggcaggcc

SEQ ID NO: 1484235 - RNA, 19 nt, Pseudomonas aeruginosa PA01
cggcgaagggcaggccgau

SEQ ID NO: 1484236 - RNA, 14 nt, Pseudomonas aeruginosa PA01
cggcgaagggcgcu

SEQ ID NO: 1484237 - RNA, 20 nt, Pseudomonas aeruginosa PA01
cggcgaagggcgcuucggcg

SEQ ID NO: 1484238 - RNA, 19 nt, Pseudomonas aeruginosa PA01
cggcgaaaugcaggccggu

SEQ ID NO: 1484239 - RNA, 24 nt, Pseudomonas aeruginosa PA01
cggcgaaauggguucccagcagca

SEQ ID NO: 1484240 - RNA, 23 nt, Pseudomonas aeruginosa PA01
cggcgaaauccucgcgcaccgcc

SEQ ID NO: 1484241 - RNA, 15 nt, Pseudomonas aeruginosa PA01
cggcgaacaccgggc

SEQ ID NO: 1484242 - RNA, 20 nt, Pseudomonas aeruginosa PA01
cggcgaacaccgggccgccg

SEQ ID NO: 1484243 - RNA, 23 nt, Pseudomonas aeruginosa PA01
cggcgaacaccgggccgccggcg

SEQ ID NO: 1484244 - RNA, 15 nt, Pseudomonas aeruginosa PA01
cggccuugcuggcga

SEQ ID NO: 1484245 - RNA, 16 nt, Pseudomonas aeruginosa PA01
cggccuugcuggcgac

SEQ ID NO: 1484246 - RNA, 14 nt, Pseudomonas aeruginosa PA01
cggccuugagcgcc

SEQ ID NO: 1484247 - RNA, 16 nt, Pseudomonas aeruginosa PA01
cggccuugagcgccga

SEQ ID NO: 1484248 - RNA, 21 nt, Pseudomonas aeruginosa PA01
cggccuugagcgccgaaggcg

SEQ ID NO: 1484249 - RNA, 19 nt, Pseudomonas aeruginosa PA01
cggccuucuugcugccggc

SEQ ID NO: 1484250 - RNA, 13 nt, Pseudomonas aeruginosa PA01
cggccuucggcag

SEQ ID NO: 1484251 - RNA, 18 nt, Pseudomonas aeruginosa PA01
cggccuucggcaggaagg

SEQ ID NO: 1484252 - RNA, 14 nt, Pseudomonas aeruginosa PA01
cggccuucggcguc

SEQ ID NO: 1484253 - RNA, 18 nt, Pseudomonas aeruginosa PA01
cggccuucggcgucgaag

SEQ ID NO: 1484254 - RNA, 13 nt, Pseudomonas aeruginosa PA01
cggccuucgacga

SEQ ID NO: 1484255 - RNA, 16 nt, Pseudomonas aeruginosa PA01
cggccuucucgucgcc

SEQ ID NO: 1484256 - RNA, 19 nt, Pseudomonas aeruginosa PA01
cggccuucucgucgccgcc

SEQ ID NO: 1484257 - RNA, 21 nt, Pseudomonas aeruginosa PA01
cggccuucucgucgccgcccg

SEQ ID NO: 1484258 - RNA, 23 nt, Pseudomonas aeruginosa PA01
cggccuucucgucgccgcccggc

SEQ ID NO: 1484259 - RNA, 24 nt, Pseudomonas aeruginosa PA01
cggccuucucgucgccgcccggca

SEQ ID NO: 1484260 - RNA, 15 nt, Pseudomonas aeruginosa PA01
cggccugggccgaag

SEQ ID NO: 1484261 - RNA, 18 nt, Pseudomonas aeruginosa PA01
cggccugggccgaaggcc

SEQ ID NO: 1484262 - RNA, 23 nt, Pseudomonas aeruginosa PA01
cggccugggccgaaggccaggcc

SEQ ID NO: 1484263 - RNA, 15 nt, Pseudomonas aeruginosa PA01
cggccugggccgggu

SEQ ID NO: 1484264 - RNA, 16 nt, Pseudomonas aeruginosa PA01
cggccugggccggguu

SEQ ID NO: 1484265 - RNA, 12 nt, Pseudomonas aeruginosa PA01
cggccuggucgu

SEQ ID NO: 1484266 - RNA, 21 nt, Pseudomonas aeruginosa PA01
cggccuggugacccggacagc

SEQ ID NO: 1484267 - RNA, 23 nt, Pseudomonas aeruginosa PA01
cggccuggugacccggacagccu

SEQ ID NO: 1484268 - RNA, 19 nt, Pseudomonas aeruginosa PA01
cggccuggugcaccuggcg

SEQ ID NO: 1484269 - RNA, 20 nt, Pseudomonas aeruginosa PA01
cggccuggugcaccuggcga

SEQ ID NO: 1484270 - RNA, 15 nt, Pseudomonas aeruginosa PA01
cggccugggcgcagg

SEQ ID NO: 1484271 - RNA, 20 nt, Pseudomonas aeruginosa PA01
cggccugggcgcaggccgag

SEQ ID NO: 1484272 - RNA, 16 nt, Pseudomonas aeruginosa PA01
cggccugguccggcac

SEQ ID NO: 1484273 - RNA, 14 nt, Pseudomonas aeruginosa PA01
cggccuggggcucg

SEQ ID NO: 1484274 - RNA, 20 nt, Pseudomonas aeruginosa PA01
cggccuggggcucggcuucc

SEQ ID NO: 1484275 - RNA, 16 nt, Pseudomonas aeruginosa PA01
cggccuggguacgcac

SEQ ID NO: 1484276 - RNA, 21 nt, Pseudomonas aeruginosa PA01
cggccuggguacgcaccggcu

SEQ ID NO: 1484277 - RNA, 21 nt, Pseudomonas aeruginosa PA01
cggccugggugaacagcggcc

SEQ ID NO: 1484278 - RNA, 15 nt, Pseudomonas aeruginosa PA01
cggccuggcuggccu

SEQ ID NO: 1484279 - RNA, 20 nt, Pseudomonas aeruginosa PA01
cggccuggcgguugaugccg

SEQ ID NO: 1484280 - RNA, 16 nt, Pseudomonas aeruginosa PA01
cggccuggcgucccgg

SEQ ID NO: 1484281 - RNA, 21 nt, Pseudomonas aeruginosa PA01
cggccugcucgaacggcggau

SEQ ID NO: 1484282 - RNA, 20 nt, Pseudomonas aeruginosa PA01
cggccugguuguaggcgccg

SEQ ID NO: 1484283 - RNA, 18 nt, Pseudomonas aeruginosa PA01
cggccuguaccgcuuccu

SEQ ID NO: 1484284 - RNA, 16 nt, Pseudomonas aeruginosa PA01
cggccugucacgccgg

SEQ ID NO: 1484285 - RNA, 17 nt, Pseudomonas aeruginosa PA01
cggccugucacgccggg

SEQ ID NO: 1484286 - RNA, 18 nt, Pseudomonas aeruginosa PA01
cggccugucacgccgggg

SEQ ID NO: 1484287 - RNA, 14 nt, Pseudomonas aeruginosa PA01
cggccuucaccgcg

SEQ ID NO: 1484288 - RNA, 15 nt, Pseudomonas aeruginosa PA01
cggccuucaccgcgc

SEQ ID NO: 1484289 - RNA, 20 nt, Pseudomonas aeruginosa PA01
cggccuucaccgcgccgcgc

SEQ ID NO: 1484290 - RNA, 22 nt, Pseudomonas aeruginosa PA01
cggccuucacgcagcucugcga

SEQ ID NO: 1484291 - RNA, 18 nt, Pseudomonas aeruginosa PA01
cggccuguuuccagaagg

SEQ ID NO: 1484292 - RNA, 16 nt, Pseudomonas aeruginosa PA01
cggccgucggccuggc

SEQ ID NO: 1484293 - RNA, 22 nt, Pseudomonas aeruginosa PA01
cggccucgcgcaacugcggggc

SEQ ID NO: 1484294 - RNA, 15 nt, Pseudomonas aeruginosa PA01
cggccucggucaggu

SEQ ID NO: 1484295 - RNA, 17 nt, Pseudomonas aeruginosa PA01
cggccucggucagguau

SEQ ID NO: 1484296 - RNA, 20 nt, Pseudomonas aeruginosa PA01
cggccucggucagguauucg

SEQ ID NO: 1484297 - RNA, 17 nt, Pseudomonas aeruginosa PA01
cggccucggcgucgcgc

SEQ ID NO: 1484298 - RNA, 20 nt, Pseudomonas aeruginosa PA01
cggccucggcgucgcgcagg

SEQ ID NO: 1484299 - RNA, 12 nt, Pseudomonas aeruginosa PA01
cggccucggcgg

SEQ ID NO: 1484300 - RNA, 13 nt, Pseudomonas aeruginosa PA01
cggccucggcgag

SEQ ID NO: 1484301 - RNA, 17 nt, Pseudomonas aeruginosa PA01
cggccucggcggcgcga

SEQ ID NO: 1484302 - RNA, 13 nt, Pseudomonas aeruginosa PA01
cggccucggcguc

SEQ ID NO: 1484303 - RNA, 15 nt, Pseudomonas aeruginosa PA01
cggccucgcugccgc

SEQ ID NO: 1484304 - RNA, 18 nt, Pseudomonas aeruginosa PA01
cggccucgcugccgccgc

SEQ ID NO: 1484305 - RNA, 20 nt, Pseudomonas aeruginosa PA01
cggccucgcugccgccgcag

SEQ ID NO: 1484306 - RNA, 14 nt, Pseudomonas aeruginosa PA01
cggccucgcuggcg

SEQ ID NO: 1484307 - RNA, 17 nt, Pseudomonas aeruginosa PA01
cggccgugcaugccgac

SEQ ID NO: 1484308 - RNA, 17 nt, Pseudomonas aeruginosa PA01
cggccucgcggguaucg

SEQ ID NO: 1484309 - RNA, 15 nt, Pseudomonas aeruginosa PA01
cggccucgcgugcgc

SEQ ID NO: 1484310 - RNA, 18 nt, Pseudomonas aeruginosa PA01
cggccucggccucgucga

SEQ ID NO: 1484311 - RNA, 18 nt, Pseudomonas aeruginosa PA01
cggccugcgucgcaucca

SEQ ID NO: 1484312 - RNA, 19 nt, Pseudomonas aeruginosa PA01
cggccugcgucgcauccac

SEQ ID NO: 1484313 - RNA, 20 nt, Pseudomonas aeruginosa PA01
cggccugcggguucggcgag

SEQ ID NO: 1484314 - RNA, 15 nt, Pseudomonas aeruginosa PA01
cggccugcgguucgc

SEQ ID NO: 1484315 - RNA, 20 nt, Pseudomonas aeruginosa PA01
cggccugcgguucgccuucc

SEQ ID NO: 1484316 - RNA, 18 nt, Pseudomonas aeruginosa PA01
cggccucgguugagacga

SEQ ID NO: 1484317 - RNA, 14 nt, Pseudomonas aeruginosa PA01
cggccucgucgagc

SEQ ID NO: 1484318 - RNA, 17 nt, Pseudomonas aeruginosa PA01
cggccucgucgagcauc

SEQ ID NO: 1484319 - RNA, 13 nt, Pseudomonas aeruginosa PA01
cggccugcgccgg

SEQ ID NO: 1484320 - RNA, 14 nt, Pseudomonas aeruginosa PA01
cggccugcgccgga

SEQ ID NO: 1484321 - RNA, 15 nt, Pseudomonas aeruginosa PA01
cggccugcgccggac

SEQ ID NO: 1484322 - RNA, 19 nt, Pseudomonas aeruginosa PA01
cggccugcgccggaccaga

SEQ ID NO: 1484323 - RNA, 16 nt, Pseudomonas aeruginosa PA01
cggcauuacuugccca

SEQ ID NO: 1484324 - RNA, 20 nt, Pseudomonas aeruginosa PA01
cggcauuacuugcccacgca

SEQ ID NO: 1484325 - RNA, 16 nt, Pseudomonas aeruginosa PA01
cggcauguagcgcgcc

SEQ ID NO: 1484326 - RNA, 20 nt, Pseudomonas aeruginosa PA01
cggcaugguccguucggcgc

SEQ ID NO: 1484327 - RNA, 22 nt, Pseudomonas aeruginosa PA01
cggcaugguccguucggcgccc

SEQ ID NO: 1484328 - RNA, 19 nt, Pseudomonas aeruginosa PA01
cggcaucuucaaucgcgcg

SEQ ID NO: 1484329 - RNA, 23 nt, Pseudomonas aeruginosa PA01
cggcaugaagcuuuuccagcgca

SEQ ID NO: 1484330 - RNA, 23 nt, Pseudomonas aeruginosa PA01
cggccaaugcccggaccugggca

SEQ ID NO: 1484331 - RNA, 14 nt, Pseudomonas aeruginosa PA01
cggcaucgauccgc

SEQ ID NO: 1484332 - RNA, 17 nt, Pseudomonas aeruginosa PA01
cggcagggccucgggcg

SEQ ID NO: 1484333 - RNA, 18 nt, Pseudomonas aeruginosa PA01
cggcagggcgauccgccc

SEQ ID NO: 1484334 - RNA, 21 nt, Pseudomonas aeruginosa PA01
cggcagggcgauccgcccgca

SEQ ID NO: 1484335 - RNA, 14 nt, Pseudomonas aeruginosa PA01
cggcagggcgcccg

SEQ ID NO: 1484336 - RNA, 15 nt, Pseudomonas aeruginosa PA01
cggcagggcgcccgc

SEQ ID NO: 1484337 - RNA, 16 nt, Pseudomonas aeruginosa PA01
cggcagggcgcccgcc

SEQ ID NO: 1484338 - RNA, 21 nt, Pseudomonas aeruginosa PA01
cggcagggcgcccgcccggca

SEQ ID NO: 1484339 - RNA, 16 nt, Pseudomonas aeruginosa PA01
cggcagggcgccgacc

SEQ ID NO: 1484340 - RNA, 19 nt, Pseudomonas aeruginosa PA01
cggcagggcgccgaccagc

SEQ ID NO: 1484341 - RNA, 17 nt, Pseudomonas aeruginosa PA01
cggcaggcgccggccgg

SEQ ID NO: 1484342 - RNA, 16 nt, Pseudomonas aeruginosa PA01
cggcagggccagcgga

SEQ ID NO: 1484343 - RNA, 19 nt, Pseudomonas aeruginosa PA01
cggcagggaucacgaagcg

SEQ ID NO: 1484344 - RNA, 18 nt, Pseudomonas aeruginosa PA01
cggcaggccuuccacgcc

SEQ ID NO: 1484345 - RNA, 18 nt, Pseudomonas aeruginosa PA01
cggcaggccuucggcgcc

SEQ ID NO: 1484346 - RNA, 19 nt, Pseudomonas aeruginosa PA01
cggcaggccuucggcgccg

SEQ ID NO: 1484347 - RNA, 13 nt, Pseudomonas aeruginosa PA01
cggcaggcgcacg

SEQ ID NO: 1484348 - RNA, 17 nt, Pseudomonas aeruginosa PA01
cggcaggcgcacgcgca

SEQ ID NO: 1484349 - RNA, 18 nt, Pseudomonas aeruginosa PA01
cggcaggcgcaucaggcc

SEQ ID NO: 1484350 - RNA, 14 nt, Pseudomonas aeruginosa PA01
cggcaggccgaugg

SEQ ID NO: 1484351 - RNA, 15 nt, Pseudomonas aeruginosa PA01
cggcaggccgauggc

SEQ ID NO: 1484352 - RNA, 12 nt, Pseudomonas aeruginosa PA01
cggcaggccguc

SEQ ID NO: 1484353 - RNA, 13 nt, Pseudomonas aeruginosa PA01
cggcaggcggcgg

SEQ ID NO: 1484354 - RNA, 14 nt, Pseudomonas aeruginosa PA01
cggcaggcggcggc

SEQ ID NO: 1484355 - RNA, 15 nt, Pseudomonas aeruginosa PA01
cggcaggcggcggcg

SEQ ID NO: 1484356 - RNA, 16 nt, Pseudomonas aeruginosa PA01
cggcaggcugcaucgg

SEQ ID NO: 1484357 - RNA, 21 nt, Pseudomonas aeruginosa PA01
cggcaggcugcaucggcucgg

SEQ ID NO: 1484358 - RNA, 14 nt, Pseudomonas aeruginosa PA01
cggcaggcugcgcc

SEQ ID NO: 1484359 - RNA, 19 nt, Pseudomonas aeruginosa PA01
cggcaggcugcgccgcugc

SEQ ID NO: 1484360 - RNA, 20 nt, Pseudomonas aeruginosa PA01
cggcaggcugcgccgcugcg

SEQ ID NO: 1484361 - RNA, 15 nt, Pseudomonas aeruginosa PA01
cggcaucggccuggu

SEQ ID NO: 1484362 - RNA, 13 nt, Pseudomonas aeruginosa PA01
cggcaucggcgcc

SEQ ID NO: 1484363 - RNA, 17 nt, Pseudomonas aeruginosa PA01
cggcaucggcgccgcgc

SEQ ID NO: 1484364 - RNA, 18 nt, Pseudomonas aeruginosa PA01
cggcaucggcgccgcgca

SEQ ID NO: 1484365 - RNA, 17 nt, Pseudomonas aeruginosa PA01
cggcaucgucgaagcug

SEQ ID NO: 1484366 - RNA, 15 nt, Pseudomonas aeruginosa PA01
cggcaucgugccgcg

SEQ ID NO: 1484367 - RNA, 17 nt, Pseudomonas aeruginosa PA01
cggcaucgugccgcgga

SEQ ID NO: 1484368 - RNA, 14 nt, Pseudomonas aeruginosa PA01
cggcaucguggcca

SEQ ID NO: 1484369 - RNA, 20 nt, Pseudomonas aeruginosa PA01
cggcaucgcguagggcgcau

SEQ ID NO: 1484370 - RNA, 16 nt, Pseudomonas aeruginosa PA01
cggcaucgccauggcg

SEQ ID NO: 1484371 - RNA, 19 nt, Pseudomonas aeruginosa PA01
cggccagcaaugcccgcgc

SEQ ID NO: 1484372 - RNA, 20 nt, Pseudomonas aeruginosa PA01
cggccagcaaugcccgcgcc

SEQ ID NO: 1484373 - RNA, 19 nt, Pseudomonas aeruginosa PA01
cggccacuucguccggccg

SEQ ID NO: 1484374 - RNA, 23 nt, Pseudomonas aeruginosa PA01
cggccacuucguccggccgcccg

SEQ ID NO: 1484375 - RNA, 13 nt, Pseudomonas aeruginosa PA01
cggccagcagcgc

SEQ ID NO: 1484376 - RNA, 12 nt, Pseudomonas aeruginosa PA01
cggccagcagca

SEQ ID NO: 1484377 - RNA, 17 nt, Pseudomonas aeruginosa PA01
cggccagcagcacgccc

SEQ ID NO: 1484378 - RNA, 19 nt, Pseudomonas aeruginosa PA01
cggccagcagcacgcccug

SEQ ID NO: 1484379 - RNA, 15 nt, Pseudomonas aeruginosa PA01
cggccagcagcacgg

SEQ ID NO: 1484380 - RNA, 16 nt, Pseudomonas aeruginosa PA01
cggccagcagcacggc

SEQ ID NO: 1484381 - RNA, 17 nt, Pseudomonas aeruginosa PA01
cggccagcagcacggcg

SEQ ID NO: 1484382 - RNA, 23 nt, Pseudomonas aeruginosa PA01
cggccagcagcacggcgacgaag

SEQ ID NO: 1484383 - RNA, 13 nt, Pseudomonas aeruginosa PA01
cggccaccaccac

SEQ ID NO: 1484384 - RNA, 14 nt, Pseudomonas aeruginosa PA01
cggccaccaccacg

SEQ ID NO: 1484385 - RNA, 17 nt, Pseudomonas aeruginosa PA01
cggccaccaccacgauc

SEQ ID NO: 1484386 - RNA, 13 nt, Pseudomonas aeruginosa PA01
cggccaccagcga

SEQ ID NO: 1484387 - RNA, 16 nt, Pseudomonas aeruginosa PA01
cggccacuaucgccaa

SEQ ID NO: 1484388 - RNA, 13 nt, Pseudomonas aeruginosa PA01
cggccacuccagc

SEQ ID NO: 1484389 - RNA, 15 nt, Pseudomonas aeruginosa PA01
cggccacuccagccc

SEQ ID NO: 1484390 - RNA, 16 nt, Pseudomonas aeruginosa PA01
cggccacucgcagccg

SEQ ID NO: 1484391 - RNA, 17 nt, Pseudomonas aeruginosa PA01
cggccacucgcagccgc

SEQ ID NO: 1484392 - RNA, 18 nt, Pseudomonas aeruginosa PA01
cggccacucgcagccgcg

SEQ ID NO: 1484393 - RNA, 22 nt, Pseudomonas aeruginosa PA01
cggccacucgcagccgcgcucg

SEQ ID NO: 1484394 - RNA, 23 nt, Pseudomonas aeruginosa PA01
cggccacgcgaccagcgccaggc

SEQ ID NO: 1484395 - RNA, 20 nt, Pseudomonas aeruginosa PA01
cggccauucgcugucgagca

SEQ ID NO: 1484396 - RNA, 22 nt, Pseudomonas aeruginosa PA01
cggccauucgcugucgagcagg

SEQ ID NO: 1484397 - RNA, 16 nt, Pseudomonas aeruginosa PA01
cggccauucggccugg

SEQ ID NO: 1484398 - RNA, 17 nt, Pseudomonas aeruginosa PA01
cggccauucggccuggc

SEQ ID NO: 1484399 - RNA, 18 nt, Pseudomonas aeruginosa PA01
cggccauucggccuggca

SEQ ID NO: 1484400 - RNA, 15 nt, Pseudomonas aeruginosa PA01
cggccauuacgccga

SEQ ID NO: 1484401 - RNA, 16 nt, Pseudomonas aeruginosa PA01
cggccauuacgccgag

SEQ ID NO: 1484402 - RNA, 18 nt, Pseudomonas aeruginosa PA01
cggccauuacgccgagca

SEQ ID NO: 1484403 - RNA, 21 nt, Pseudomonas aeruginosa PA01
cggccauugcccgguggccuc

SEQ ID NO: 1484404 - RNA, 22 nt, Pseudomonas aeruginosa PA01
cggccauugcccgguggccucc

SEQ ID NO: 1484405 - RNA, 15 nt, Pseudomonas aeruginosa PA01
cggccauugccgcca

SEQ ID NO: 1484406 - RNA, 22 nt, Pseudomonas aeruginosa PA01
cggcccacgcucagugcgccgg

SEQ ID NO: 1484407 - RNA, 18 nt, Pseudomonas aeruginosa PA01
cggcccagcguucggcgc

SEQ ID NO: 1484408 - RNA, 19 nt, Pseudomonas aeruginosa PA01
cggcccagcggcaggucgu

SEQ ID NO: 1484409 - RNA, 13 nt, Pseudomonas aeruginosa PA01
cggcccagcagcg

SEQ ID NO: 1484410 - RNA, 14 nt, Pseudomonas aeruginosa PA01
cggcccagcagcgc

SEQ ID NO: 1484411 - RNA, 12 nt, Pseudomonas aeruginosa PA01
cggcccagcagg

SEQ ID NO: 1484412 - RNA, 13 nt, Pseudomonas aeruginosa PA01
cggcccagcaggc

SEQ ID NO: 1484413 - RNA, 16 nt, Pseudomonas aeruginosa PA01
cggcccagcaggccgg

SEQ ID NO: 1484414 - RNA, 18 nt, Pseudomonas aeruginosa PA01
cggcccagcaggccggcc

SEQ ID NO: 1484415 - RNA, 21 nt, Pseudomonas aeruginosa PA01
cggcccagcaggccggccagc

SEQ ID NO: 1484416 - RNA, 15 nt, Pseudomonas aeruginosa PA01
cggcccagccgcggc

SEQ ID NO: 1484417 - RNA, 16 nt, Pseudomonas aeruginosa PA01
cggcccagccgcggcg

SEQ ID NO: 1484418 - RNA, 14 nt, Pseudomonas aeruginosa PA01
cggccccaccagca

SEQ ID NO: 1484419 - RNA, 15 nt, Pseudomonas aeruginosa PA01
cggccccaccagcaa

SEQ ID NO: 1484420 - RNA, 12 nt, Pseudomonas aeruginosa PA01
cggccccaccgc

SEQ ID NO: 1484421 - RNA, 15 nt, Pseudomonas aeruginosa PA01
cggccccaccgcacu

SEQ ID NO: 1484422 - RNA, 17 nt, Pseudomonas aeruginosa PA01
cggccccaccuggcgac

SEQ ID NO: 1484423 - RNA, 20 nt, Pseudomonas aeruginosa PA01
cggccccaccuggcgacagg

SEQ ID NO: 1484424 - RNA, 12 nt, Pseudomonas aeruginosa PA01
cggccaggccgc

SEQ ID NO: 1484425 - RNA, 15 nt, Pseudomonas aeruginosa PA01
cggccaggccgccca

SEQ ID NO: 1484426 - RNA, 14 nt, Pseudomonas aeruginosa PA01
cggccaggcgaaug

SEQ ID NO: 1484427 - RNA, 20 nt, Pseudomonas aeruginosa PA01
cggccaggcgaauggaggga

SEQ ID NO: 1484428 - RNA, 15 nt, Pseudomonas aeruginosa PA01
cggccaggcgccagg

SEQ ID NO: 1484429 - RNA, 21 nt, Pseudomonas aeruginosa PA01
cggccaggcgccagggccggg

SEQ ID NO: 1484430 - RNA, 22 nt, Pseudomonas aeruginosa PA01
cggccaggcgccagggccgggu

SEQ ID NO: 1484431 - RNA, 15 nt, Pseudomonas aeruginosa PA01
cggccaggcggccga

SEQ ID NO: 1484432 - RNA, 17 nt, Pseudomonas aeruginosa PA01
cggccaggcggccgacg

SEQ ID NO: 1484433 - RNA, 15 nt, Pseudomonas aeruginosa PA01
cggccaggcgcggcg

SEQ ID NO: 1484434 - RNA, 18 nt, Pseudomonas aeruginosa PA01
cggccaggcgcgggucuu

SEQ ID NO: 1484435 - RNA, 20 nt, Pseudomonas aeruginosa PA01
cggccaggcgguccagccag

SEQ ID NO: 1484436 - RNA, 21 nt, Pseudomonas aeruginosa PA01
cggccaggcgguccagccaga

SEQ ID NO: 1484437 - RNA, 12 nt, Pseudomonas aeruginosa PA01
cggccaggcgcc

SEQ ID NO: 1484438 - RNA, 14 nt, Pseudomonas aeruginosa PA01
cggccagggccgcu

SEQ ID NO: 1484439 - RNA, 15 nt, Pseudomonas aeruginosa PA01
cggccagggccgcuc

SEQ ID NO: 1484440 - RNA, 18 nt, Pseudomonas aeruginosa PA01
cggccagggagucgcugg

SEQ ID NO: 1484441 - RNA, 19 nt, Pseudomonas aeruginosa PA01
cggccagggagucgcuggc

SEQ ID NO: 1484442 - RNA, 21 nt, Pseudomonas aeruginosa PA01
cggccagggagucgcuggcca

SEQ ID NO: 1484443 - RNA, 14 nt, Pseudomonas aeruginosa PA01
cggccagggcgcgg

SEQ ID NO: 1484444 - RNA, 16 nt, Pseudomonas aeruginosa PA01
cggccagggcgcggua

SEQ ID NO: 1484445 - RNA, 17 nt, Pseudomonas aeruginosa PA01
cggccagggcgcgguag

SEQ ID NO: 1484446 - RNA, 24 nt, Pseudomonas aeruginosa PA01
cggccagggcgaacagcgccgcgg

SEQ ID NO: 1484447 - RNA, 20 nt, Pseudomonas aeruginosa PA01
cggccagggcgaggccgcuc

SEQ ID NO: 1484448 - RNA, 16 nt, Pseudomonas aeruginosa PA01
cggccauccuggccgg

SEQ ID NO: 1484449 - RNA, 17 nt, Pseudomonas aeruginosa PA01
cggccauccuggccggu

SEQ ID NO: 1484450 - RNA, 22 nt, Pseudomonas aeruginosa PA01
cggccagggcaugggucagcgc

SEQ ID NO: 1484451 - RNA, 18 nt, Pseudomonas aeruginosa PA01
cggccauccagccaggcg

SEQ ID NO: 1484452 - RNA, 13 nt, Pseudomonas aeruginosa PA01
cggccaucagcgc

SEQ ID NO: 1484453 - RNA, 15 nt, Pseudomonas aeruginosa PA01
cggccaucagcgcca

SEQ ID NO: 1484454 - RNA, 17 nt, Pseudomonas aeruginosa PA01
cggccaucagcgccagg

SEQ ID NO: 1484455 - RNA, 20 nt, Pseudomonas aeruginosa PA01
cggccaucagcgccagggca

SEQ ID NO: 1484456 - RNA, 15 nt, Pseudomonas aeruginosa PA01
cggccaucaggcgcu

SEQ ID NO: 1484457 - RNA, 14 nt, Pseudomonas aeruginosa PA01
cggccaucagcacg

SEQ ID NO: 1484458 - RNA, 15 nt, Pseudomonas aeruginosa PA01
cggccaucagcacgu

SEQ ID NO: 1484459 - RNA, 16 nt, Pseudomonas aeruginosa PA01
cggccaucagcacguc

SEQ ID NO: 1484460 - RNA, 13 nt, Pseudomonas aeruginosa PA01
cggccaucagcac

SEQ ID NO: 1484461 - RNA, 17 nt, Pseudomonas aeruginosa PA01
cggccaucgagcgcucc

SEQ ID NO: 1484462 - RNA, 22 nt, Pseudomonas aeruginosa PA01
cggccaucgagcgcuccaccgc

SEQ ID NO: 1484463 - RNA, 23 nt, Pseudomonas aeruginosa PA01
cggccaucgagcgcuccaccgcg

SEQ ID NO: 1484464 - RNA, 19 nt, Pseudomonas aeruginosa PA01
cggccagcgugaagaccug

SEQ ID NO: 1484465 - RNA, 15 nt, Pseudomonas aeruginosa PA01
cggccagcguccuuc

SEQ ID NO: 1484466 - RNA, 15 nt, Pseudomonas aeruginosa PA01
cggccagcucgccgg

SEQ ID NO: 1484467 - RNA, 17 nt, Pseudomonas aeruginosa PA01
cggccagcuucuccagc

SEQ ID NO: 1484468 - RNA, 17 nt, Pseudomonas aeruginosa PA01
cggccaggauguucgcc

SEQ ID NO: 1484469 - RNA, 18 nt, Pseudomonas aeruginosa PA01
cggccaggacgccaccag

SEQ ID NO: 1484470 - RNA, 22 nt, Pseudomonas aeruginosa PA01
cggccaggacgccaccaggccg

SEQ ID NO: 1484471 - RNA, 16 nt, Pseudomonas aeruginosa PA01
cggccaggccacggcc

SEQ ID NO: 1484472 - RNA, 17 nt, Pseudomonas aeruginosa PA01
cggccaggccacggccg

SEQ ID NO: 1484473 - RNA, 19 nt, Pseudomonas aeruginosa PA01
cggccaggccacggcggaa

SEQ ID NO: 1484474 - RNA, 14 nt, Pseudomonas aeruginosa PA01
cggccaggcccacg

SEQ ID NO: 1484475 - RNA, 16 nt, Pseudomonas aeruginosa PA01
cggccaggcccacgcc

SEQ ID NO: 1484476 - RNA, 13 nt, Pseudomonas aeruginosa PA01
cggccaggcacag

SEQ ID NO: 1484477 - RNA, 19 nt, Pseudomonas aeruginosa PA01
cggccaggcccucagcggc

SEQ ID NO: 1484478 - RNA, 20 nt, Pseudomonas aeruginosa PA01
cggccaggcccucagcggcg

SEQ ID NO: 1484479 - RNA, 13 nt, Pseudomonas aeruginosa PA01
cggccagcgcggc

SEQ ID NO: 1484480 - RNA, 17 nt, Pseudomonas aeruginosa PA01
cggccagcgcggccgcc

SEQ ID NO: 1484481 - RNA, 19 nt, Pseudomonas aeruginosa PA01
cggccagcgcggccgccgc

SEQ ID NO: 1484482 - RNA, 12 nt, Pseudomonas aeruginosa PA01
cggccagcgcgg

SEQ ID NO: 1484483 - RNA, 14 nt, Pseudomonas aeruginosa PA01
cggccagcgcaucg

SEQ ID NO: 1484484 - RNA, 23 nt, Pseudomonas aeruginosa PA01
cggccagcgcaucgaggccggca

SEQ ID NO: 1484485 - RNA, 12 nt, Pseudomonas aeruginosa PA01
cggccagcgcca

SEQ ID NO: 1484486 - RNA, 19 nt, Pseudomonas aeruginosa PA01
cggccagcgccacggcgcg

SEQ ID NO: 1484487 - RNA, 13 nt, Pseudomonas aeruginosa PA01
cggccagcgccag

SEQ ID NO: 1484488 - RNA, 15 nt, Pseudomonas aeruginosa PA01
cggccagcgccagga

SEQ ID NO: 1484489 - RNA, 18 nt, Pseudomonas aeruginosa PA01
cggccagcgccaggagca

SEQ ID NO: 1484490 - RNA, 13 nt, Pseudomonas aeruginosa PA01
cggccagccgcgc

SEQ ID NO: 1484491 - RNA, 15 nt, Pseudomonas aeruginosa PA01
cggccagccgcgcca

SEQ ID NO: 1484492 - RNA, 12 nt, Pseudomonas aeruginosa PA01
cggccagccgcu

SEQ ID NO: 1484493 - RNA, 13 nt, Pseudomonas aeruginosa PA01
cggccagccgcua

SEQ ID NO: 1484494 - RNA, 14 nt, Pseudomonas aeruginosa PA01
cggccagccccugc

SEQ ID NO: 1484495 - RNA, 16 nt, Pseudomonas aeruginosa PA01
cggccagccccugcgg

SEQ ID NO: 1484496 - RNA, 16 nt, Pseudomonas aeruginosa PA01
cggccagcccggccuc

SEQ ID NO: 1484497 - RNA, 20 nt, Pseudomonas aeruginosa PA01
cggccagcccggccucgccg

SEQ ID NO: 1484498 - RNA, 18 nt, Pseudomonas aeruginosa PA01
cggccagccagggcagca

SEQ ID NO: 1484499 - RNA, 17 nt, Pseudomonas aeruginosa PA01
cggccagccuggccagc

SEQ ID NO: 1484500 - RNA, 10 nt, Pseudomonas aeruginosa PA01
cggccagcgc

SEQ ID NO: 1484501 - RNA, 20 nt, Pseudomonas aeruginosa PA01
cggcaacgucaggcuguagc

SEQ ID NO: 1484502 - RNA, 15 nt, Pseudomonas aeruginosa PA01
cggcacacgucggca

SEQ ID NO: 1484503 - RNA, 16 nt, Pseudomonas aeruginosa PA01
cggcacagcguggcca

SEQ ID NO: 1484504 - RNA, 21 nt, Pseudomonas aeruginosa PA01
cggcacagcguggccagcgcc

SEQ ID NO: 1484505 - RNA, 17 nt, Pseudomonas aeruginosa PA01
cggcaacgaaaacgccc

SEQ ID NO: 1484506 - RNA, 22 nt, Pseudomonas aeruginosa PA01
cggcaacgaaaacgcccggcag

SEQ ID NO: 1484507 - RNA, 15 nt, Pseudomonas aeruginosa PA01
cggcacccggcuggg

SEQ ID NO: 1484508 - RNA, 20 nt, Pseudomonas aeruginosa PA01
cggcacccugaccgcgagcg

SEQ ID NO: 1484509 - RNA, 16 nt, Pseudomonas aeruginosa PA01
cggcaccgaucgcccg

SEQ ID NO: 1484510 - RNA, 18 nt, Pseudomonas aeruginosa PA01
cggcaccgaucgcccgcg

SEQ ID NO: 1484511 - RNA, 19 nt, Pseudomonas aeruginosa PA01
cggcaccgaucgcccgcgc

SEQ ID NO: 1484512 - RNA, 13 nt, Pseudomonas aeruginosa PA01
cggcaccgacgcc

SEQ ID NO: 1484513 - RNA, 16 nt, Pseudomonas aeruginosa PA01
cggcaccaccggucaa

SEQ ID NO: 1484514 - RNA, 18 nt, Pseudomonas aeruginosa PA01
cggcaccaccaccgacag

SEQ ID NO: 1484515 - RNA, 19 nt, Pseudomonas aeruginosa PA01
cggcaccaccaccgacagg

SEQ ID NO: 1484516 - RNA, 22 nt, Pseudomonas aeruginosa PA01
cggcaccccuugcagccagccg

SEQ ID NO: 1484517 - RNA, 14 nt, Pseudomonas aeruginosa PA01
cggcaccgggguga

SEQ ID NO: 1484518 - RNA, 14 nt, Pseudomonas aeruginosa PA01
cggcaccggcgacg

SEQ ID NO: 1484519 - RNA, 15 nt, Pseudomonas aeruginosa PA01
cggcaccgucgagca

SEQ ID NO: 1484520 - RNA, 22 nt, Pseudomonas aeruginosa PA01
cggcaccgucgagcaccaggcg

SEQ ID NO: 1484521 - RNA, 18 nt, Pseudomonas aeruginosa PA01
cggcaccugcagacgguu

SEQ ID NO: 1484522 - RNA, 13 nt, Pseudomonas aeruginosa PA01
cggcacgccgaag

SEQ ID NO: 1484523 - RNA, 16 nt, Pseudomonas aeruginosa PA01
cggcacgccgaagucc

SEQ ID NO: 1484524 - RNA, 22 nt, Pseudomonas aeruginosa PA01
cggcacgccgaaguccugcaac

SEQ ID NO: 1484525 - RNA, 23 nt, Pseudomonas aeruginosa PA01
cggcacgccgaaguccugcaaca

SEQ ID NO: 1484526 - RNA, 11 nt, Pseudomonas aeruginosa PA01
cggcacgcccu

SEQ ID NO: 1484527 - RNA, 21 nt, Pseudomonas aeruginosa PA01
cggcacuuccuuggugaucac

SEQ ID NO: 1484528 - RNA, 22 nt, Pseudomonas aeruginosa PA01
cggcacuuccuuggugaucacc

SEQ ID NO: 1484529 - RNA, 16 nt, Pseudomonas aeruginosa PA01
cggcacgcuccagauc

SEQ ID NO: 1484530 - RNA, 17 nt, Pseudomonas aeruginosa PA01
cggcacgcuccagaucg

SEQ ID NO: 1484531 - RNA, 18 nt, Pseudomonas aeruginosa PA01
cggcacgcuccagggcgg

SEQ ID NO: 1484532 - RNA, 14 nt, Pseudomonas aeruginosa PA01
cggcacgcucuggc

SEQ ID NO: 1484533 - RNA, 16 nt, Pseudomonas aeruginosa PA01
cggcacgcucuggccg

SEQ ID NO: 1484534 - RNA, 14 nt, Pseudomonas aeruginosa PA01
cggcacgcguggcg

SEQ ID NO: 1484535 - RNA, 15 nt, Pseudomonas aeruginosa PA01
cggcacgcguggcga

SEQ ID NO: 1484536 - RNA, 17 nt, Pseudomonas aeruginosa PA01
cggcacgcugccgccga

SEQ ID NO: 1484537 - RNA, 15 nt, Pseudomonas aeruginosa PA01
cggcacgcugcuugc

SEQ ID NO: 1484538 - RNA, 13 nt, Pseudomonas aeruginosa PA01
cggcagcacccgc

SEQ ID NO: 1484539 - RNA, 14 nt, Pseudomonas aeruginosa PA01
cggcagcacccgca

SEQ ID NO: 1484540 - RNA, 22 nt, Pseudomonas aeruginosa PA01
cggcagcacccgcaccagccgg

SEQ ID NO: 1484541 - RNA, 16 nt, Pseudomonas aeruginosa PA01
cggcagcaucagccgc

SEQ ID NO: 1484542 - RNA, 17 nt, Pseudomonas aeruginosa PA01
cggcagcaucagccgcg

SEQ ID NO: 1484543 - RNA, 17 nt, Pseudomonas aeruginosa PA01
cggcagcaccaggccau

SEQ ID NO: 1484544 - RNA, 21 nt, Pseudomonas aeruginosa PA01
cggcagaucggugcgggcaga

SEQ ID NO: 1484545 - RNA, 16 nt, Pseudomonas aeruginosa PA01
cggcagaucccaucgc

SEQ ID NO: 1484546 - RNA, 14 nt, Pseudomonas aeruginosa PA01
cggcagauccgccg

SEQ ID NO: 1484547 - RNA, 16 nt, Pseudomonas aeruginosa PA01
cggcagauccgccgug

SEQ ID NO: 1484548 - RNA, 19 nt, Pseudomonas aeruginosa PA01
cggcagauccgccgugagg

SEQ ID NO: 1484549 - RNA, 18 nt, Pseudomonas aeruginosa PA01
cggcagcaucucggugcg

SEQ ID NO: 1484550 - RNA, 19 nt, Pseudomonas aeruginosa PA01
cggcagcaucucggugcgc

SEQ ID NO: 1484551 - RNA, 15 nt, Pseudomonas aeruginosa PA01
cggcagccagccgcc

SEQ ID NO: 1484552 - RNA, 16 nt, Pseudomonas aeruginosa PA01
cggcagccagccgccg

SEQ ID NO: 1484553 - RNA, 17 nt, Pseudomonas aeruginosa PA01
cggcagccacucggcca

SEQ ID NO: 1484554 - RNA, 19 nt, Pseudomonas aeruginosa PA01
cggcagccacucggccagg

SEQ ID NO: 1484555 - RNA, 22 nt, Pseudomonas aeruginosa PA01
cggcagccaucgcauagccggc

SEQ ID NO: 1484556 - RNA, 23 nt, Pseudomonas aeruginosa PA01
cggcagccaucgcauagccggcg

SEQ ID NO: 1484557 - RNA, 16 nt, Pseudomonas aeruginosa PA01
cggcagcgagcggguc

SEQ ID NO: 1484558 - RNA, 13 nt, Pseudomonas aeruginosa PA01
cggcagcgccagg

SEQ ID NO: 1484559 - RNA, 17 nt, Pseudomonas aeruginosa PA01
cggcagcgccagguagu

SEQ ID NO: 1484560 - RNA, 18 nt, Pseudomonas aeruginosa PA01
cggcaggaaggccuggaa

SEQ ID NO: 1484561 - RNA, 20 nt, Pseudomonas aeruginosa PA01
cggcaggaaggccuggaaca

SEQ ID NO: 1484562 - RNA, 16 nt, Pseudomonas aeruginosa PA01
cggcaggaacgcccgc

SEQ ID NO: 1484563 - RNA, 17 nt, Pseudomonas aeruginosa PA01
cggcaggaacgcccgcg

SEQ ID NO: 1484564 - RNA, 22 nt, Pseudomonas aeruginosa PA01
cggcaggaacgcccgcggcagc

SEQ ID NO: 1484565 - RNA, 12 nt, Pseudomonas aeruginosa PA01
cggcagcgccgc

SEQ ID NO: 1484566 - RNA, 16 nt, Pseudomonas aeruginosa PA01
cggcagcgccucggcg

SEQ ID NO: 1484567 - RNA, 19 nt, Pseudomonas aeruginosa PA01
cggcagcgccucggcggcg

SEQ ID NO: 1484568 - RNA, 20 nt, Pseudomonas aeruginosa PA01
cggcagcgccuuuucggcac

SEQ ID NO: 1484569 - RNA, 16 nt, Pseudomonas aeruginosa PA01
cggcagcgccgccagc

SEQ ID NO: 1484570 - RNA, 17 nt, Pseudomonas aeruginosa PA01
cggcagcgccgccagca

SEQ ID NO: 1484571 - RNA, 13 nt, Pseudomonas aeruginosa PA01
cggcagcgccgcg

SEQ ID NO: 1484572 - RNA, 14 nt, Pseudomonas aeruginosa PA01
cggcagcgccgcgc

SEQ ID NO: 1484573 - RNA, 15 nt, Pseudomonas aeruginosa PA01
cggcagcgccgcgcg

SEQ ID NO: 1484574 - RNA, 18 nt, Pseudomonas aeruginosa PA01
cggcagcgccgcgcggca

SEQ ID NO: 1484575 - RNA, 23 nt, Pseudomonas aeruginosa PA01
cggcagcgccgcgcggcaacacc

SEQ ID NO: 1484576 - RNA, 15 nt, Pseudomonas aeruginosa PA01
cggcagcgccgggca

SEQ ID NO: 1484577 - RNA, 20 nt, Pseudomonas aeruginosa PA01
cggcagcgccgggcauucgc

SEQ ID NO: 1484578 - RNA, 17 nt, Pseudomonas aeruginosa PA01
cggcaggaucggcgcgg

SEQ ID NO: 1484579 - RNA, 18 nt, Pseudomonas aeruginosa PA01
cggcaggaccucgggcga

SEQ ID NO: 1484580 - RNA, 19 nt, Pseudomonas aeruginosa PA01
cggcaggacgaugaucacc

SEQ ID NO: 1484581 - RNA, 14 nt, Pseudomonas aeruginosa PA01
cggcaggagcauga

SEQ ID NO: 1484582 - RNA, 12 nt, Pseudomonas aeruginosa PA01
cggcaggagcgu

SEQ ID NO: 1484583 - RNA, 17 nt, Pseudomonas aeruginosa PA01
cggcaggagcguugcgg

SEQ ID NO: 1484584 - RNA, 23 nt, Pseudomonas aeruginosa PA01
cggcaggagcguugcgggcaggu

SEQ ID NO: 1484585 - RNA, 13 nt, Pseudomonas aeruginosa PA01
cggcaggccgccg

SEQ ID NO: 1484586 - RNA, 14 nt, Pseudomonas aeruginosa PA01
cggcaggccgccga

SEQ ID NO: 1484587 - RNA, 17 nt, Pseudomonas aeruginosa PA01
cggcaggccgccgaucc

SEQ ID NO: 1484588 - RNA, 22 nt, Pseudomonas aeruginosa PA01
cggcaggcacgcugccagcagg

SEQ ID NO: 1484589 - RNA, 14 nt, Pseudomonas aeruginosa PA01
cggcaggcaggccu

SEQ ID NO: 1484590 - RNA, 20 nt, Pseudomonas aeruginosa PA01
cggcaggcagugccgggcgu

SEQ ID NO: 1484591 - RNA, 12 nt, Pseudomonas aeruginosa PA01
cggcaggccacg

SEQ ID NO: 1484592 - RNA, 19 nt, Pseudomonas aeruginosa PA01
cggcaggccagcagguagc

SEQ ID NO: 1484593 - RNA, 22 nt, Pseudomonas aeruginosa PA01
cggcaggccagcuuccaggcgc

SEQ ID NO: 1484594 - RNA, 13 nt, Pseudomonas aeruginosa PA01
cggaguucgcccg

SEQ ID NO: 1484595 - RNA, 17 nt, Pseudomonas aeruginosa PA01
cggaguucgcccgcccc

SEQ ID NO: 1484596 - RNA, 21 nt, Pseudomonas aeruginosa PA01
cggaguucgucaaccagcacc

SEQ ID NO: 1484597 - RNA, 22 nt, Pseudomonas aeruginosa PA01
cggaguucgucaaccagcaccg

SEQ ID NO: 1484598 - RNA, 16 nt, Pseudomonas aeruginosa PA01
cggauacaggcgcagc

SEQ ID NO: 1484599 - RNA, 16 nt, Pseudomonas aeruginosa PA01
cggauaaacggcaugc

SEQ ID NO: 1484600 - RNA, 14 nt, Pseudomonas aeruginosa PA01
cggagugccgcgga

SEQ ID NO: 1484601 - RNA, 21 nt, Pseudomonas aeruginosa PA01
cggagugugucggggccguga

SEQ ID NO: 1484602 - RNA, 15 nt, Pseudomonas aeruginosa PA01
cggaguuccagcggg

SEQ ID NO: 1484603 - RNA, 14 nt, Pseudomonas aeruginosa PA01
cggagugggccgcg

SEQ ID NO: 1484604 - RNA, 10 nt, Pseudomonas aeruginosa PA01
cggagugaac

SEQ ID NO: 1484605 - RNA, 16 nt, Pseudomonas aeruginosa PA01
cggagugaggccgagc

SEQ ID NO: 1484606 - RNA, 14 nt, Pseudomonas aeruginosa PA01
cggaaucgcgcccu

SEQ ID NO: 1484607 - RNA, 18 nt, Pseudomonas aeruginosa PA01
cggaaucggacgaucgac

SEQ ID NO: 1484608 - RNA, 13 nt, Pseudomonas aeruginosa PA01
cggaaucggcgau

SEQ ID NO: 1484609 - RNA, 15 nt, Pseudomonas aeruginosa PA01
cggaaucggcgaucg

SEQ ID NO: 1484610 - RNA, 16 nt, Pseudomonas aeruginosa PA01
cggaaucacgucgauc

SEQ ID NO: 1484611 - RNA, 19 nt, Pseudomonas aeruginosa PA01
cggaguagccggcggcgaa

SEQ ID NO: 1484612 - RNA, 15 nt, Pseudomonas aeruginosa PA01
cggaucggcccggcg

SEQ ID NO: 1484613 - RNA, 16 nt, Pseudomonas aeruginosa PA01
cggaucgcucucgcgc

SEQ ID NO: 1484614 - RNA, 16 nt, Pseudomonas aeruginosa PA01
cggaucggccuuggcg

SEQ ID NO: 1484615 - RNA, 18 nt, Pseudomonas aeruginosa PA01
cggaucgcgcugggcgca

SEQ ID NO: 1484616 - RNA, 15 nt, Pseudomonas aeruginosa PA01
cggaucgcgccgucg

SEQ ID NO: 1484617 - RNA, 18 nt, Pseudomonas aeruginosa PA01
cggaucgcgccgucgcug

SEQ ID NO: 1484618 - RNA, 19 nt, Pseudomonas aeruginosa PA01
cggaucgccuccggcacgc

SEQ ID NO: 1484619 - RNA, 17 nt, Pseudomonas aeruginosa PA01
cggauccccucccgcgc

SEQ ID NO: 1484620 - RNA, 18 nt, Pseudomonas aeruginosa PA01
cggauccccucccgcgcc

SEQ ID NO: 1484621 - RNA, 21 nt, Pseudomonas aeruginosa PA01
cggaucagucaggaucggcgc

SEQ ID NO: 1484622 - RNA, 12 nt, Pseudomonas aeruginosa PA01
cggauccacgcc

SEQ ID NO: 1484623 - RNA, 17 nt, Pseudomonas aeruginosa PA01
cggauccacgccuggcc

SEQ ID NO: 1484624 - RNA, 13 nt, Pseudomonas aeruginosa PA01
cggauagcaccga

SEQ ID NO: 1484625 - RNA, 20 nt, Pseudomonas aeruginosa PA01
cggauagcgcgcaggcgcua

SEQ ID NO: 1484626 - RNA, 17 nt, Pseudomonas aeruginosa PA01
cggauagaucaggccgg

SEQ ID NO: 1484627 - RNA, 21 nt, Pseudomonas aeruginosa PA01
cggauacaccagguuggccag

SEQ ID NO: 1484628 - RNA, 22 nt, Pseudomonas aeruginosa PA01
cggauagagcuucccgcauggc

SEQ ID NO: 1484629 - RNA, 22 nt, Pseudomonas aeruginosa PA01
cggauagacgccguccaccagc

SEQ ID NO: 1484630 - RNA, 19 nt, Pseudomonas aeruginosa PA01
cggauuggccgagguggag

SEQ ID NO: 1484631 - RNA, 13 nt, Pseudomonas aeruginosa PA01
cggauuggccggg

SEQ ID NO: 1484632 - RNA, 13 nt, Pseudomonas aeruginosa PA01
cggauuugccgcc

SEQ ID NO: 1484633 - RNA, 19 nt, Pseudomonas aeruginosa PA01
cggauucaucggcggcagg

SEQ ID NO: 1484634 - RNA, 21 nt, Pseudomonas aeruginosa PA01
cggauugacgauggccagccc

SEQ ID NO: 1484635 - RNA, 16 nt, Pseudomonas aeruginosa PA01
cggcaaaugccgggcu

SEQ ID NO: 1484636 - RNA, 14 nt, Pseudomonas aeruginosa PA01
cggcaacaggucga

SEQ ID NO: 1484637 - RNA, 14 nt, Pseudomonas aeruginosa PA01
cggcaaaggcccgg

SEQ ID NO: 1484638 - RNA, 16 nt, Pseudomonas aeruginosa PA01
cggcaaaggcccggcg

SEQ ID NO: 1484639 - RNA, 14 nt, Pseudomonas aeruginosa PA01
cggaugcacgugca

SEQ ID NO: 1484640 - RNA, 15 nt, Pseudomonas aeruginosa PA01
cggaugcacgugcag

SEQ ID NO: 1484641 - RNA, 20 nt, Pseudomonas aeruginosa PA01
cggaugcacgugcagcucgg

SEQ ID NO: 1484642 - RNA, 20 nt, Pseudomonas aeruginosa PA01
cggaugcagauccagcggca

SEQ ID NO: 1484643 - RNA, 16 nt, Pseudomonas aeruginosa PA01
cggaugcagucccgcc

SEQ ID NO: 1484644 - RNA, 20 nt, Pseudomonas aeruginosa PA01
cggaugcagucccgccaggc

SEQ ID NO: 1484645 - RNA, 21 nt, Pseudomonas aeruginosa PA01
cggaugcagucccgccaggcg

SEQ ID NO: 1484646 - RNA, 21 nt, Pseudomonas aeruginosa PA01
cggaugaccuucggaucgguc

SEQ ID NO: 1484647 - RNA, 13 nt, Pseudomonas aeruginosa PA01
cggaugcccuggu

SEQ ID NO: 1484648 - RNA, 21 nt, Pseudomonas aeruginosa PA01
cggaugccgcacaggcuggcc

SEQ ID NO: 1484649 - RNA, 15 nt, Pseudomonas aeruginosa PA01
cggaugccaccgcuc

SEQ ID NO: 1484650 - RNA, 17 nt, Pseudomonas aeruginosa PA01
cggauguaguccagcgc

SEQ ID NO: 1484651 - RNA, 18 nt, Pseudomonas aeruginosa PA01
cggauguaguccagcgcc

SEQ ID NO: 1484652 - RNA, 19 nt, Pseudomonas aeruginosa PA01
cggauguaguccagcgccg

SEQ ID NO: 1484653 - RNA, 21 nt, Pseudomonas aeruginosa PA01
cggauguaguccagcgccgcg

SEQ ID NO: 1484654 - RNA, 13 nt, Pseudomonas aeruginosa PA01
cggaugggcgacg

SEQ ID NO: 1484655 - RNA, 20 nt, Pseudomonas aeruginosa PA01
cggaugggcgacgacgaacg

SEQ ID NO: 1484656 - RNA, 13 nt, Pseudomonas aeruginosa PA01
cggauggcugacc

SEQ ID NO: 1484657 - RNA, 18 nt, Pseudomonas aeruginosa PA01
cggauucaggcgcgcucg

SEQ ID NO: 1484658 - RNA, 19 nt, Pseudomonas aeruginosa PA01
cggauuacuccgccggcgu

SEQ ID NO: 1484659 - RNA, 16 nt, Pseudomonas aeruginosa PA01
cggauguucaccaggu

SEQ ID NO: 1484660 - RNA, 17 nt, Pseudomonas aeruginosa PA01
cggauguucgccacgcu

SEQ ID NO: 1484661 - RNA, 21 nt, Pseudomonas aeruginosa PA01
cggggaagcugccuuccagca

SEQ ID NO: 1484662 - RNA, 18 nt, Pseudomonas aeruginosa PA01
cggggacaugucgagggu

SEQ ID NO: 1484663 - RNA, 20 nt, Pseudomonas aeruginosa PA01
cggggaccugucggcucgcg

SEQ ID NO: 1484664 - RNA, 21 nt, Pseudomonas aeruginosa PA01
cggggacgcugucccggccau

SEQ ID NO: 1484665 - RNA, 23 nt, Pseudomonas aeruginosa PA01
cggggaaacccucaggucggcgc

SEQ ID NO: 1484666 - RNA, 19 nt, Pseudomonas aeruginosa PA01
cggggaaagcuccucggcc

SEQ ID NO: 1484667 - RNA, 13 nt, Pseudomonas aeruginosa PA01
cggggaacacgcg

SEQ ID NO: 1484668 - RNA, 17 nt, Pseudomonas aeruginosa PA01
cggggaacagcgccagc

SEQ ID NO: 1484669 - RNA, 22 nt, Pseudomonas aeruginosa PA01
cggggaaauccuugagcacccg

SEQ ID NO: 1484670 - RNA, 17 nt, Pseudomonas aeruginosa PA01
cggggaaccacaccugc

SEQ ID NO: 1484671 - RNA, 18 nt, Pseudomonas aeruginosa PA01
cggggaaccacaccugca

SEQ ID NO: 1484672 - RNA, 24 nt, Pseudomonas aeruginosa PA01
cgggcuuuuuucauucauggcgcc

SEQ ID NO: 1484673 - RNA, 19 nt, Pseudomonas aeruginosa PA01
cgggcuuuuucauggcugg

SEQ ID NO: 1484674 - RNA, 23 nt, Pseudomonas aeruginosa PA01
cgggcuuuuucaugggcgcgcgc

SEQ ID NO: 1484675 - RNA, 22 nt, Pseudomonas aeruginosa PA01
cgggcuuuuucauuuccgcagg

SEQ ID NO: 1484676 - RNA, 20 nt, Pseudomonas aeruginosa PA01
cgggcuuuuucguuggccag

SEQ ID NO: 1484677 - RNA, 20 nt, Pseudomonas aeruginosa PA01
cgggcuuuuucucgucgcgc

SEQ ID NO: 1484678 - RNA, 23 nt, Pseudomonas aeruginosa PA01
cgggcuguagugcuccggggcgc

SEQ ID NO: 1484679 - RNA, 19 nt, Pseudomonas aeruginosa PA01
cgggcugguucagcggguu

SEQ ID NO: 1484680 - RNA, 14 nt, Pseudomonas aeruginosa PA01
cgggcuggccgucg

SEQ ID NO: 1484681 - RNA, 18 nt, Pseudomonas aeruginosa PA01
cgggcuggucguagcagc

SEQ ID NO: 1484682 - RNA, 20 nt, Pseudomonas aeruginosa PA01
cgggcuggucguagcagcgg

SEQ ID NO: 1484683 - RNA, 21 nt, Pseudomonas aeruginosa PA01
cgggcuggucguagcagcgga

SEQ ID NO: 1484684 - RNA, 24 nt, Pseudomonas aeruginosa PA01
cgggcuucuucaccaggccgaacg

SEQ ID NO: 1484685 - RNA, 21 nt, Pseudomonas aeruginosa PA01
cgggcuucgguguaucggcgg

SEQ ID NO: 1484686 - RNA, 13 nt, Pseudomonas aeruginosa PA01
cgggcuucgcgac

SEQ ID NO: 1484687 - RNA, 16 nt, Pseudomonas aeruginosa PA01
cgggcuucagcgccgg

SEQ ID NO: 1484688 - RNA, 17 nt, Pseudomonas aeruginosa PA01
cgggcuucagcgccggg

SEQ ID NO: 1484689 - RNA, 18 nt, Pseudomonas aeruginosa PA01
cgggcuucagcgccgggu

SEQ ID NO: 1484690 - RNA, 13 nt, Pseudomonas aeruginosa PA01
cgggccuucaggc

SEQ ID NO: 1484691 - RNA, 19 nt, Pseudomonas aeruginosa PA01
cgggccuucaggcugcgcg

SEQ ID NO: 1484692 - RNA, 14 nt, Pseudomonas aeruginosa PA01
cgggccuucgccag

SEQ ID NO: 1484693 - RNA, 19 nt, Pseudomonas aeruginosa PA01
cgggccuucgccuucggcg

SEQ ID NO: 1484694 - RNA, 22 nt, Pseudomonas aeruginosa PA01
cgggccuucgccuucggcgugc

SEQ ID NO: 1484695 - RNA, 19 nt, Pseudomonas aeruginosa PA01
cgggccuugaccaccgcca

SEQ ID NO: 1484696 - RNA, 22 nt, Pseudomonas aeruginosa PA01
cgggccuugaccaccgccaggc

SEQ ID NO: 1484697 - RNA, 14 nt, Pseudomonas aeruginosa PA01
cgggcguugcgcgc

SEQ ID NO: 1484698 - RNA, 19 nt, Pseudomonas aeruginosa PA01
cgggcguuggcuccgggcc

SEQ ID NO: 1484699 - RNA, 22 nt, Pseudomonas aeruginosa PA01
cgggcguuggcuccgggccgag

SEQ ID NO: 1484700 - RNA, 14 nt, Pseudomonas aeruginosa PA01
cgggcguugccggc

SEQ ID NO: 1484701 - RNA, 16 nt, Pseudomonas aeruginosa PA01
cgggcguugccggcau

SEQ ID NO: 1484702 - RNA, 15 nt, Pseudomonas aeruginosa PA01
cgggcgugucgagga

SEQ ID NO: 1484703 - RNA, 17 nt, Pseudomonas aeruginosa PA01
cgggcucuaugcgcggg

SEQ ID NO: 1484704 - RNA, 22 nt, Pseudomonas aeruginosa PA01
cgggcucgugcccucgcuacgg

SEQ ID NO: 1484705 - RNA, 16 nt, Pseudomonas aeruginosa PA01
cgggcucugguagccg

SEQ ID NO: 1484706 - RNA, 22 nt, Pseudomonas aeruginosa PA01
cgggcuagguuuccccguggcg

SEQ ID NO: 1484707 - RNA, 21 nt, Pseudomonas aeruginosa PA01
cgggcguuuucguugccgcgc

SEQ ID NO: 1484708 - RNA, 20 nt, Pseudomonas aeruginosa PA01
cgggcguugguacagcucgc

SEQ ID NO: 1484709 - RNA, 16 nt, Pseudomonas aeruginosa PA01
cgggcguuguccacgg

SEQ ID NO: 1484710 - RNA, 15 nt, Pseudomonas aeruginosa PA01
cggggccccucgccg

SEQ ID NO: 1484711 - RNA, 18 nt, Pseudomonas aeruginosa PA01
cggggcaggcaugcggcc

SEQ ID NO: 1484712 - RNA, 11 nt, Pseudomonas aeruginosa PA01
cggggcaggcg

SEQ ID NO: 1484713 - RNA, 18 nt, Pseudomonas aeruginosa PA01
cggggcaggcgcaggcga

SEQ ID NO: 1484714 - RNA, 17 nt, Pseudomonas aeruginosa PA01
cggggcauucguccagc

SEQ ID NO: 1484715 - RNA, 19 nt, Pseudomonas aeruginosa PA01
cggggcauucguccagccg

SEQ ID NO: 1484716 - RNA, 22 nt, Pseudomonas aeruginosa PA01
cggggcauucguccagccgccg

SEQ ID NO: 1484717 - RNA, 22 nt, Pseudomonas aeruginosa PA01
cggggccaggucgguccgccga

SEQ ID NO: 1484718 - RNA, 22 nt, Pseudomonas aeruginosa PA01
cggggccaucagugccugcacg

SEQ ID NO: 1484719 - RNA, 17 nt, Pseudomonas aeruginosa PA01
cggggcccggcuccagc

SEQ ID NO: 1484720 - RNA, 20 nt, Pseudomonas aeruginosa PA01
cggggcccggcuccagccgg

SEQ ID NO: 1484721 - RNA, 14 nt, Pseudomonas aeruginosa PA01
cggggcccggcagg

SEQ ID NO: 1484722 - RNA, 18 nt, Pseudomonas aeruginosa PA01
cggggcccuccaggcgaa

SEQ ID NO: 1484723 - RNA, 15 nt, Pseudomonas aeruginosa PA01
cggggaucagcgaga

SEQ ID NO: 1484724 - RNA, 18 nt, Pseudomonas aeruginosa PA01
cggggaucaggucgccgc

SEQ ID NO: 1484725 - RNA, 11 nt, Pseudomonas aeruginosa PA01
cggggaucacu

SEQ ID NO: 1484726 - RNA, 13 nt, Pseudomonas aeruginosa PA01
cggggaucacucg

SEQ ID NO: 1484727 - RNA, 21 nt, Pseudomonas aeruginosa PA01
cggggaguucgacccaugccg

SEQ ID NO: 1484728 - RNA, 14 nt, Pseudomonas aeruginosa PA01
cggggauguccgcc

SEQ ID NO: 1484729 - RNA, 19 nt, Pseudomonas aeruginosa PA01
cggggauguccgccgccca

SEQ ID NO: 1484730 - RNA, 13 nt, Pseudomonas aeruginosa PA01
cggggauggcggg

SEQ ID NO: 1484731 - RNA, 16 nt, Pseudomonas aeruginosa PA01
cggggcagcagggcgu

SEQ ID NO: 1484732 - RNA, 16 nt, Pseudomonas aeruginosa PA01
cggggcagaacacccg

SEQ ID NO: 1484733 - RNA, 21 nt, Pseudomonas aeruginosa PA01
cggggucaguuccaggucggc

SEQ ID NO: 1484734 - RNA, 23 nt, Pseudomonas aeruginosa PA01
cggggucaguuccaggucggcgg

SEQ ID NO: 1484735 - RNA, 17 nt, Pseudomonas aeruginosa PA01
cgggggcggcgccuggu

SEQ ID NO: 1484736 - RNA, 16 nt, Pseudomonas aeruginosa PA01
cgggguauccgggcac

SEQ ID NO: 1484737 - RNA, 20 nt, Pseudomonas aeruginosa PA01
cgggguauccgggcacuugu

SEQ ID NO: 1484738 - RNA, 19 nt, Pseudomonas aeruginosa PA01
cggggcuuuuuccaacgcg

SEQ ID NO: 1484739 - RNA, 21 nt, Pseudomonas aeruginosa PA01
cggggcuuuuucguuuccggc

SEQ ID NO: 1484740 - RNA, 18 nt, Pseudomonas aeruginosa PA01
cggggcgccgcgcggcgc

SEQ ID NO: 1484741 - RNA, 19 nt, Pseudomonas aeruginosa PA01
cggggcgccgcgcggcgcc

SEQ ID NO: 1484742 - RNA, 20 nt, Pseudomonas aeruginosa PA01
cggggcgcgcccgccagguc

SEQ ID NO: 1484743 - RNA, 24 nt, Pseudomonas aeruginosa PA01
cggggcgcgcugcgaaucgucgcc

SEQ ID NO: 1484744 - RNA, 17 nt, Pseudomonas aeruginosa PA01
cggggcgccuccagcgg

SEQ ID NO: 1484745 - RNA, 12 nt, Pseudomonas aeruginosa PA01
cggggccggcga

SEQ ID NO: 1484746 - RNA, 15 nt, Pseudomonas aeruginosa PA01
cggggccggcgaugc

SEQ ID NO: 1484747 - RNA, 14 nt, Pseudomonas aeruginosa PA01
cggggcgcagcagg

SEQ ID NO: 1484748 - RNA, 15 nt, Pseudomonas aeruginosa PA01
cggggcgcagcagga

SEQ ID NO: 1484749 - RNA, 18 nt, Pseudomonas aeruginosa PA01
cggggcgcaggucgcugg

SEQ ID NO: 1484750 - RNA, 15 nt, Pseudomonas aeruginosa PA01
cggggccggacgcga

SEQ ID NO: 1484751 - RNA, 17 nt, Pseudomonas aeruginosa PA01
cggggccggacgcgacu

SEQ ID NO: 1484752 - RNA, 18 nt, Pseudomonas aeruginosa PA01
cggggccggacgcgacug

SEQ ID NO: 1484753 - RNA, 14 nt, Pseudomonas aeruginosa PA01
cggggcgcucgccc

SEQ ID NO: 1484754 - RNA, 14 nt, Pseudomonas aeruginosa PA01
cggggcgcgggcga

SEQ ID NO: 1484755 - RNA, 19 nt, Pseudomonas aeruginosa PA01
cggggcgcgggcgaagcgc

SEQ ID NO: 1484756 - RNA, 22 nt, Pseudomonas aeruginosa PA01
cggggcgcuguuggccugggcg

SEQ ID NO: 1484757 - RNA, 19 nt, Pseudomonas aeruginosa PA01
cggggcggauucaggcgcg

SEQ ID NO: 1484758 - RNA, 20 nt, Pseudomonas aeruginosa PA01
cggggcggauucaggcgcgc

SEQ ID NO: 1484759 - RNA, 23 nt, Pseudomonas aeruginosa PA01
cggggcuuuccgucucaggcgcc

SEQ ID NO: 1484760 - RNA, 17 nt, Pseudomonas aeruginosa PA01
cgggugccccaggcgag

SEQ ID NO: 1484761 - RNA, 18 nt, Pseudomonas aeruginosa PA01
cgggucggucacgaaggc

SEQ ID NO: 1484762 - RNA, 20 nt, Pseudomonas aeruginosa PA01
cgggucgggcucaugggcga

SEQ ID NO: 1484763 - RNA, 13 nt, Pseudomonas aeruginosa PA01
cgggucggcggau

SEQ ID NO: 1484764 - RNA, 20 nt, Pseudomonas aeruginosa PA01
cgggucgucgaagcgcagca

SEQ ID NO: 1484765 - RNA, 12 nt, Pseudomonas aeruginosa PA01
cgggucgucagc

SEQ ID NO: 1484766 - RNA, 17 nt, Pseudomonas aeruginosa PA01
cgggucguacaccgcgc

SEQ ID NO: 1484767 - RNA, 18 nt, Pseudomonas aeruginosa PA01
cgggucguacaccgcgcg

SEQ ID NO: 1484768 - RNA, 21 nt, Pseudomonas aeruginosa PA01
cgggucgaucaggcgcaugcc

SEQ ID NO: 1484769 - RNA, 13 nt, Pseudomonas aeruginosa PA01
cgggucgaggccg

SEQ ID NO: 1484770 - RNA, 15 nt, Pseudomonas aeruginosa PA01
cgggucgaggccgaa

SEQ ID NO: 1484771 - RNA, 16 nt, Pseudomonas aeruginosa PA01
cggguccuggaucacg

SEQ ID NO: 1484772 - RNA, 19 nt, Pseudomonas aeruginosa PA01
cggguccuggguggcgacg

SEQ ID NO: 1484773 - RNA, 12 nt, Pseudomonas aeruginosa PA01
cgggucgaccuu

SEQ ID NO: 1484774 - RNA, 17 nt, Pseudomonas aeruginosa PA01
cgggucgagccaggcgu

SEQ ID NO: 1484775 - RNA, 21 nt, Pseudomonas aeruginosa PA01
cgggucgacuucgcaccagcc

SEQ ID NO: 1484776 - RNA, 23 nt, Pseudomonas aeruginosa PA01
cgggucgacuucgcaccagccgg

SEQ ID NO: 1484777 - RNA, 13 nt, Pseudomonas aeruginosa PA01
cgggucggcgaag

SEQ ID NO: 1484778 - RNA, 15 nt, Pseudomonas aeruginosa PA01
cgggucgccgcagcc

SEQ ID NO: 1484779 - RNA, 14 nt, Pseudomonas aeruginosa PA01
cgggucgccauggu

SEQ ID NO: 1484780 - RNA, 14 nt, Pseudomonas aeruginosa PA01
cgggucacgccgag

SEQ ID NO: 1484781 - RNA, 14 nt, Pseudomonas aeruginosa PA01
cgggucaccagcgc

SEQ ID NO: 1484782 - RNA, 16 nt, Pseudomonas aeruginosa PA01
cgggucagcagcaccg

SEQ ID NO: 1484783 - RNA, 14 nt, Pseudomonas aeruginosa PA01
cgggucagcagugc

SEQ ID NO: 1484784 - RNA, 15 nt, Pseudomonas aeruginosa PA01
cgggucagaccacga

SEQ ID NO: 1484785 - RNA, 13 nt, Pseudomonas aeruginosa PA01
cggggugcgcugg

SEQ ID NO: 1484786 - RNA, 13 nt, Pseudomonas aeruginosa PA01
cgggguggcgcgg

SEQ ID NO: 1484787 - RNA, 22 nt, Pseudomonas aeruginosa PA01
cgggguggccgugcagcccucg

SEQ ID NO: 1484788 - RNA, 14 nt, Pseudomonas aeruginosa PA01
cgggguggcgaagg

SEQ ID NO: 1484789 - RNA, 17 nt, Pseudomonas aeruginosa PA01
cgggucaccagcgccgg

SEQ ID NO: 1484790 - RNA, 16 nt, Pseudomonas aeruginosa PA01
cgggucaccagcgggu

SEQ ID NO: 1484791 - RNA, 21 nt, Pseudomonas aeruginosa PA01
cgggucaccagcggguaguag

SEQ ID NO: 1484792 - RNA, 17 nt, Pseudomonas aeruginosa PA01
cgggguccgccggucac

SEQ ID NO: 1484793 - RNA, 14 nt, Pseudomonas aeruginosa PA01
cggggucgcgccgg

SEQ ID NO: 1484794 - RNA, 15 nt, Pseudomonas aeruginosa PA01
cggggucgcgccggu

SEQ ID NO: 1484795 - RNA, 16 nt, Pseudomonas aeruginosa PA01
cggggucgcgccggug

SEQ ID NO: 1484796 - RNA, 17 nt, Pseudomonas aeruginosa PA01
cggggucgcgccggugg

SEQ ID NO: 1484797 - RNA, 12 nt, Pseudomonas aeruginosa PA01
cggggugcaggg

SEQ ID NO: 1484798 - RNA, 18 nt, Pseudomonas aeruginosa PA01
cggggugcauagggucca

SEQ ID NO: 1484799 - RNA, 20 nt, Pseudomonas aeruginosa PA01
cggggugccgccagucggcc

SEQ ID NO: 1484800 - RNA, 22 nt, Pseudomonas aeruginosa PA01
cggggugccgccagucggccug

SEQ ID NO: 1484801 - RNA, 23 nt, Pseudomonas aeruginosa PA01
cggguguuguucuucauccaguc

SEQ ID NO: 1484802 - RNA, 17 nt, Pseudomonas aeruginosa PA01
cggguguuucggccgcu

SEQ ID NO: 1484803 - RNA, 19 nt, Pseudomonas aeruginosa PA01
cggguggcgucgaucaggc

SEQ ID NO: 1484804 - RNA, 13 nt, Pseudomonas aeruginosa PA01
cggguggcgcugu

SEQ ID NO: 1484805 - RNA, 20 nt, Pseudomonas aeruginosa PA01
cggguggcgcugucgccggu

SEQ ID NO: 1484806 - RNA, 16 nt, Pseudomonas aeruginosa PA01
cgggugccggugcggg

SEQ ID NO: 1484807 - RNA, 19 nt, Pseudomonas aeruginosa PA01
cgggugccggugcgggugg

SEQ ID NO: 1484808 - RNA, 19 nt, Pseudomonas aeruginosa PA01
cgggugccuuccgcgccca

SEQ ID NO: 1484809 - RNA, 13 nt, Pseudomonas aeruginosa PA01
cgggugcgcgcca

SEQ ID NO: 1484810 - RNA, 13 nt, Pseudomonas aeruginosa PA01
cgggugcgcaggc

SEQ ID NO: 1484811 - RNA, 23 nt, Pseudomonas aeruginosa PA01
cgggugcguggugcauccgccgc

SEQ ID NO: 1484812 - RNA, 15 nt, Pseudomonas aeruginosa PA01
cgggugcuaugcgcc

SEQ ID NO: 1484813 - RNA, 17 nt, Pseudomonas aeruginosa PA01
cgggugcuaugcgccgg

SEQ ID NO: 1484814 - RNA, 17 nt, Pseudomonas aeruginosa PA01
cggguggaacgaggcga

SEQ ID NO: 1484815 - RNA, 17 nt, Pseudomonas aeruginosa PA01
cggguggcaugggccag

SEQ ID NO: 1484816 - RNA, 19 nt, Pseudomonas aeruginosa PA01
cggguggauaucgucggga

SEQ ID NO: 1484817 - RNA, 19 nt, Pseudomonas aeruginosa PA01
cggguugguggccgcgccg

SEQ ID NO: 1484818 - RNA, 22 nt, Pseudomonas aeruginosa PA01
cggguugguggccgcgccgccc

SEQ ID NO: 1484819 - RNA, 22 nt, Pseudomonas aeruginosa PA01
cggguuacuucgccgaucacca

SEQ ID NO: 1484820 - RNA, 17 nt, Pseudomonas aeruginosa PA01
cggguuuccgugcgcug

SEQ ID NO: 1484821 - RNA, 16 nt, Pseudomonas aeruginosa PA01
cggguuuccugcccga

SEQ ID NO: 1484822 - RNA, 16 nt, Pseudomonas aeruginosa PA01
cggguuguccaggcga

SEQ ID NO: 1484823 - RNA, 19 nt, Pseudomonas aeruginosa PA01
cggguugucguugcgcagc

SEQ ID NO: 1484824 - RNA, 20 nt, Pseudomonas aeruginosa PA01
cggguuucgcugcugccgcg

SEQ ID NO: 1484825 - RNA, 23 nt, Pseudomonas aeruginosa PA01
cggguuuuuuuaugccucggcgg

SEQ ID NO: 1484826 - RNA, 17 nt, Pseudomonas aeruginosa PA01
cgguaauuggccaggcu

SEQ ID NO: 1484827 - RNA, 13 nt, Pseudomonas aeruginosa PA01
cgguacagcgccu

SEQ ID NO: 1484828 - RNA, 23 nt, Pseudomonas aeruginosa PA01
cgguacagcgccuggucggcggc

SEQ ID NO: 1484829 - RNA, 18 nt, Pseudomonas aeruginosa PA01
cgguacagcucguccuug

SEQ ID NO: 1484830 - RNA, 19 nt, Pseudomonas aeruginosa PA01
cgguacagcuguccgcgcc

SEQ ID NO: 1484831 - RNA, 13 nt, Pseudomonas aeruginosa PA01
cgguacagccccc

SEQ ID NO: 1484832 - RNA, 17 nt, Pseudomonas aeruginosa PA01
cgguaauccggcacuuu

SEQ ID NO: 1484833 - RNA, 13 nt, Pseudomonas aeruginosa PA01
cgguaccagcagc

SEQ ID NO: 1484834 - RNA, 15 nt, Pseudomonas aeruginosa PA01
cgguaccagcagcgc

SEQ ID NO: 1484835 - RNA, 18 nt, Pseudomonas aeruginosa PA01
cgguaccagcagcgccga

SEQ ID NO: 1484836 - RNA, 22 nt, Pseudomonas aeruginosa PA01
cgguagccgaucaacgcggcca

SEQ ID NO: 1484837 - RNA, 21 nt, Pseudomonas aeruginosa PA01
cgguagccguucgacgcugcu

SEQ ID NO: 1484838 - RNA, 21 nt, Pseudomonas aeruginosa PA01
cgguacccagcuugcuggcgu

SEQ ID NO: 1484839 - RNA, 15 nt, Pseudomonas aeruginosa PA01
cgguaccagggaagc

SEQ ID NO: 1484840 - RNA, 13 nt, Pseudomonas aeruginosa PA01
cgguagccggcga

SEQ ID NO: 1484841 - RNA, 14 nt, Pseudomonas aeruginosa PA01
cgguagccggcgau

SEQ ID NO: 1484842 - RNA, 15 nt, Pseudomonas aeruginosa PA01
cgguagccggcgauc

SEQ ID NO: 1484843 - RNA, 20 nt, Pseudomonas aeruginosa PA01
cgguagccggcgaucagcgc

SEQ ID NO: 1484844 - RNA, 17 nt, Pseudomonas aeruginosa PA01
cgguagcggaucagccg

SEQ ID NO: 1484845 - RNA, 19 nt, Pseudomonas aeruginosa PA01
cgguagcggaucagccggc

SEQ ID NO: 1484846 - RNA, 16 nt, Pseudomonas aeruginosa PA01
cgguagcggcaggagc

SEQ ID NO: 1484847 - RNA, 21 nt, Pseudomonas aeruginosa PA01
cgguagcggcgcaccgacgcc

SEQ ID NO: 1484848 - RNA, 22 nt, Pseudomonas aeruginosa PA01
cgguagcggcgcaccgacgccg

SEQ ID NO: 1484849 - RNA, 13 nt, Pseudomonas aeruginosa PA01
cgguagcgccgcg

SEQ ID NO: 1484850 - RNA, 14 nt, Pseudomonas aeruginosa PA01
cgguagcgccgcgc

SEQ ID NO: 1484851 - RNA, 17 nt, Pseudomonas aeruginosa PA01
cgguagcuccaggccga

SEQ ID NO: 1484852 - RNA, 18 nt, Pseudomonas aeruginosa PA01
cgguagcuccaggccgaa

SEQ ID NO: 1484853 - RNA, 16 nt, Pseudomonas aeruginosa PA01
cgguagcgggccagca

SEQ ID NO: 1484854 - RNA, 18 nt, Pseudomonas aeruginosa PA01
cgguagcgggccagcagc

SEQ ID NO: 1484855 - RNA, 15 nt, Pseudomonas aeruginosa PA01
cgguagcugcgcagg

SEQ ID NO: 1484856 - RNA, 16 nt, Pseudomonas aeruginosa PA01
cgguagcugcgcaggg

SEQ ID NO: 1484857 - RNA, 21 nt, Pseudomonas aeruginosa PA01
cgguagcugcgcagggcgccg

SEQ ID NO: 1484858 - RNA, 13 nt, Pseudomonas aeruginosa PA01
cggucagcggcgc

SEQ ID NO: 1484859 - RNA, 14 nt, Pseudomonas aeruginosa PA01
cggucagcggcgca

SEQ ID NO: 1484860 - RNA, 19 nt, Pseudomonas aeruginosa PA01
cggucagcggacaaccgcc

SEQ ID NO: 1484861 - RNA, 19 nt, Pseudomonas aeruginosa PA01
cggucagcgcguucacccc

SEQ ID NO: 1484862 - RNA, 21 nt, Pseudomonas aeruginosa PA01
cggucagcgcguucaccccgc

SEQ ID NO: 1484863 - RNA, 16 nt, Pseudomonas aeruginosa PA01
cggucaggacagcgug

SEQ ID NO: 1484864 - RNA, 21 nt, Pseudomonas aeruginosa PA01
cggucaggacgagcguccgcc

SEQ ID NO: 1484865 - RNA, 15 nt, Pseudomonas aeruginosa PA01
cggucagcuucgccg

SEQ ID NO: 1484866 - RNA, 17 nt, Pseudomonas aeruginosa PA01
cggucagcuucgccgcc

SEQ ID NO: 1484867 - RNA, 22 nt, Pseudomonas aeruginosa PA01
cggucagcuucgccgcccugga

SEQ ID NO: 1484868 - RNA, 20 nt, Pseudomonas aeruginosa PA01
cggucaggcugaucggcgcg

SEQ ID NO: 1484869 - RNA, 23 nt, Pseudomonas aeruginosa PA01
cggucaggcugcggcggaaggcg

SEQ ID NO: 1484870 - RNA, 23 nt, Pseudomonas aeruginosa PA01
cggucaggccgagcagcgccagc

SEQ ID NO: 1484871 - RNA, 13 nt, Pseudomonas aeruginosa PA01
cggucaggccgau

SEQ ID NO: 1484872 - RNA, 18 nt, Pseudomonas aeruginosa PA01
cggucaggccgaucacca

SEQ ID NO: 1484873 - RNA, 16 nt, Pseudomonas aeruginosa PA01
cggucaggccaagcuu

SEQ ID NO: 1484874 - RNA, 14 nt, Pseudomonas aeruginosa PA01
cggucaucgccggc

SEQ ID NO: 1484875 - RNA, 15 nt, Pseudomonas aeruginosa PA01
cggucaucgccggcg

SEQ ID NO: 1484876 - RNA, 14 nt, Pseudomonas aeruginosa PA01
cggucaucgcgccg

SEQ ID NO: 1484877 - RNA, 16 nt, Pseudomonas aeruginosa PA01
cggucaucgcgccgcc

SEQ ID NO: 1484878 - RNA, 14 nt, Pseudomonas aeruginosa PA01
cggucauccgccgg

SEQ ID NO: 1484879 - RNA, 17 nt, Pseudomonas aeruginosa PA01
cggucauccgccggcgc

SEQ ID NO: 1484880 - RNA, 18 nt, Pseudomonas aeruginosa PA01
cggucauccgccggcgcg

SEQ ID NO: 1484881 - RNA, 19 nt, Pseudomonas aeruginosa PA01
cggucauccgccggcgcgu

SEQ ID NO: 1484882 - RNA, 17 nt, Pseudomonas aeruginosa PA01
cggucaugcgcccuacg

SEQ ID NO: 1484883 - RNA, 15 nt, Pseudomonas aeruginosa PA01
cggucauggccagcu

SEQ ID NO: 1484884 - RNA, 20 nt, Pseudomonas aeruginosa PA01
cggucauggccagcucgacc

SEQ ID NO: 1484885 - RNA, 18 nt, Pseudomonas aeruginosa PA01
cggucagguaggcaucga

SEQ ID NO: 1484886 - RNA, 22 nt, Pseudomonas aeruginosa PA01
cggucagguaggcaucgacgcc

SEQ ID NO: 1484887 - RNA, 20 nt, Pseudomonas aeruginosa PA01
cggucagguauucgccggcc

SEQ ID NO: 1484888 - RNA, 15 nt, Pseudomonas aeruginosa PA01
cgguccgcgaaccgc

SEQ ID NO: 1484889 - RNA, 14 nt, Pseudomonas aeruginosa PA01
cgguccgcgccacg

SEQ ID NO: 1484890 - RNA, 23 nt, Pseudomonas aeruginosa PA01
cgguccgccgaugcgcuacggca

SEQ ID NO: 1484891 - RNA, 21 nt, Pseudomonas aeruginosa PA01
cggucccgggaaaccaccagg

SEQ ID NO: 1484892 - RNA, 18 nt, Pseudomonas aeruginosa PA01
cgguccgacaaucagcgg

SEQ ID NO: 1484893 - RNA, 14 nt, Pseudomonas aeruginosa PA01
cgguccgccgcggg

SEQ ID NO: 1484894 - RNA, 20 nt, Pseudomonas aeruginosa PA01
cgguccgccgcgggacgccg

SEQ ID NO: 1484895 - RNA, 16 nt, Pseudomonas aeruginosa PA01
cggucgacggcgugca

SEQ ID NO: 1484896 - RNA, 16 nt, Pseudomonas aeruginosa PA01
cggucgagcucggcca

SEQ ID NO: 1484897 - RNA, 12 nt, Pseudomonas aeruginosa PA01
cggucgaggccc

SEQ ID NO: 1484898 - RNA, 17 nt, Pseudomonas aeruginosa PA01
cggucgagacgccauca

SEQ ID NO: 1484899 - RNA, 21 nt, Pseudomonas aeruginosa PA01
cggucgagacgccaucaacgg

SEQ ID NO: 1484900 - RNA, 15 nt, Pseudomonas aeruginosa PA01
cggucgagcagcgcc

SEQ ID NO: 1484901 - RNA, 17 nt, Pseudomonas aeruginosa PA01
cggucgagcagcgccgc

SEQ ID NO: 1484902 - RNA, 13 nt, Pseudomonas aeruginosa PA01
cgguccucgcccg

SEQ ID NO: 1484903 - RNA, 19 nt, Pseudomonas aeruginosa PA01
cgguccucgggcaccagca

SEQ ID NO: 1484904 - RNA, 15 nt, Pseudomonas aeruginosa PA01
cgguccguccagcgc

SEQ ID NO: 1484905 - RNA, 18 nt, Pseudomonas aeruginosa PA01
cggucgaacugaccacca

SEQ ID NO: 1484906 - RNA, 20 nt, Pseudomonas aeruginosa PA01
cggucgaacugaccaccagg

SEQ ID NO: 1484907 - RNA, 17 nt, Pseudomonas aeruginosa PA01
cggucgaaccccuuccc

SEQ ID NO: 1484908 - RNA, 13 nt, Pseudomonas aeruginosa PA01
cgguccaccaggg

SEQ ID NO: 1484909 - RNA, 15 nt, Pseudomonas aeruginosa PA01
cggucauggugccga

SEQ ID NO: 1484910 - RNA, 18 nt, Pseudomonas aeruginosa PA01
cggucauggugccgagca

SEQ ID NO: 1484911 - RNA, 18 nt, Pseudomonas aeruginosa PA01
cggucauguccggggcga

SEQ ID NO: 1484912 - RNA, 23 nt, Pseudomonas aeruginosa PA01
cgguccagccagacguccggcag

SEQ ID NO: 1484913 - RNA, 17 nt, Pseudomonas aeruginosa PA01
cgguccagcuccuugcg

SEQ ID NO: 1484914 - RNA, 19 nt, Pseudomonas aeruginosa PA01
cgguccagcgagcgggcga

SEQ ID NO: 1484915 - RNA, 18 nt, Pseudomonas aeruginosa PA01
cgguccaggaucauccgc

SEQ ID NO: 1484916 - RNA, 22 nt, Pseudomonas aeruginosa PA01
cgguccaggucaugcccuggcc

SEQ ID NO: 1484917 - RNA, 23 nt, Pseudomonas aeruginosa PA01
cgguccaggucaugcccuggccg

SEQ ID NO: 1484918 - RNA, 14 nt, Pseudomonas aeruginosa PA01
cgguccagggccgc

SEQ ID NO: 1484919 - RNA, 18 nt, Pseudomonas aeruginosa PA01
cggucccagaccagcagc

SEQ ID NO: 1484920 - RNA, 19 nt, Pseudomonas aeruginosa PA01
cggucccagaccagcagcg

SEQ ID NO: 1484921 - RNA, 19 nt, Pseudomonas aeruginosa PA01
cggucccagguagcgcugc

SEQ ID NO: 1484922 - RNA, 16 nt, Pseudomonas aeruginosa PA01
cggucccaucagcagu

SEQ ID NO: 1484923 - RNA, 15 nt, Pseudomonas aeruginosa PA01
cggugaacagguagc

SEQ ID NO: 1484924 - RNA, 17 nt, Pseudomonas aeruginosa PA01
cggugaacagguagcug

SEQ ID NO: 1484925 - RNA, 18 nt, Pseudomonas aeruginosa PA01
cggugaacgagcccaggc

SEQ ID NO: 1484926 - RNA, 21 nt, Pseudomonas aeruginosa PA01
cggucuugccggcugcgccgc

SEQ ID NO: 1484927 - RNA, 14 nt, Pseudomonas aeruginosa PA01
cggucuugcgcuug

SEQ ID NO: 1484928 - RNA, 16 nt, Pseudomonas aeruginosa PA01
cggucuugcgcuugcc

SEQ ID NO: 1484929 - RNA, 18 nt, Pseudomonas aeruginosa PA01
cggucuugcgcuugccgg

SEQ ID NO: 1484930 - RNA, 19 nt, Pseudomonas aeruginosa PA01
cggucuugcgcuugccggc

SEQ ID NO: 1484931 - RNA, 16 nt, Pseudomonas aeruginosa PA01
cggucuuuuucgcgug

SEQ ID NO: 1484932 - RNA, 14 nt, Pseudomonas aeruginosa PA01
cggugaaaccggca

SEQ ID NO: 1484933 - RNA, 16 nt, Pseudomonas aeruginosa PA01
cggucuuggcggcgau

SEQ ID NO: 1484934 - RNA, 17 nt, Pseudomonas aeruginosa PA01
cggucuuggcggcgauc

SEQ ID NO: 1484935 - RNA, 21 nt, Pseudomonas aeruginosa PA01
cggucuuggcguugccgugcc

SEQ ID NO: 1484936 - RNA, 15 nt, Pseudomonas aeruginosa PA01
cggucuuccgccgac

SEQ ID NO: 1484937 - RNA, 19 nt, Pseudomonas aeruginosa PA01
cggucuuccgccgacugca

SEQ ID NO: 1484938 - RNA, 23 nt, Pseudomonas aeruginosa PA01
cggucugcucggaaaccucgccg

SEQ ID NO: 1484939 - RNA, 19 nt, Pseudomonas aeruginosa PA01
cggucugcugcgcgcacca

SEQ ID NO: 1484940 - RNA, 17 nt, Pseudomonas aeruginosa PA01
cggucucgaucggcccg

SEQ ID NO: 1484941 - RNA, 14 nt, Pseudomonas aeruginosa PA01
cggucucgaacgcc

SEQ ID NO: 1484942 - RNA, 13 nt, Pseudomonas aeruginosa PA01
cggucucggcggg

SEQ ID NO: 1484943 - RNA, 17 nt, Pseudomonas aeruginosa PA01
cggucucgccaccccgc

SEQ ID NO: 1484944 - RNA, 22 nt, Pseudomonas aeruginosa PA01
cggucucgccaccccgcuccgc

SEQ ID NO: 1484945 - RNA, 13 nt, Pseudomonas aeruginosa PA01
cggucucgccgcc

SEQ ID NO: 1484946 - RNA, 14 nt, Pseudomonas aeruginosa PA01
cggucucgccgccg

SEQ ID NO: 1484947 - RNA, 15 nt, Pseudomonas aeruginosa PA01
cggucucgccgccga

SEQ ID NO: 1484948 - RNA, 17 nt, Pseudomonas aeruginosa PA01
cggucucgcgcagcggc

SEQ ID NO: 1484949 - RNA, 13 nt, Pseudomonas aeruginosa PA01
cggucuagcgccc

SEQ ID NO: 1484950 - RNA, 21 nt, Pseudomonas aeruginosa PA01
cggucguaggaacgugcggcc

SEQ ID NO: 1484951 - RNA, 14 nt, Pseudomonas aeruginosa PA01
cggucguccugcgg

SEQ ID NO: 1484952 - RNA, 13 nt, Pseudomonas aeruginosa PA01
cggucggcgaggg

SEQ ID NO: 1484953 - RNA, 12 nt, Pseudomonas aeruginosa PA01
cggucggcggcg

SEQ ID NO: 1484954 - RNA, 16 nt, Pseudomonas aeruginosa PA01
cggucggcucagccga

SEQ ID NO: 1484955 - RNA, 21 nt, Pseudomonas aeruginosa PA01
cggucggcucagccgaccacc

SEQ ID NO: 1484956 - RNA, 15 nt, Pseudomonas aeruginosa PA01
cggucgggcacuugu

SEQ ID NO: 1484957 - RNA, 21 nt, Pseudomonas aeruginosa PA01
cggucgggaugccgugccgug

SEQ ID NO: 1484958 - RNA, 18 nt, Pseudomonas aeruginosa PA01
cggucggugagcacgccg

SEQ ID NO: 1484959 - RNA, 21 nt, Pseudomonas aeruginosa PA01
cggucggugagcacgccgcga

SEQ ID NO: 1484960 - RNA, 13 nt, Pseudomonas aeruginosa PA01
cggucgguugcgg

SEQ ID NO: 1484961 - RNA, 14 nt, Pseudomonas aeruginosa PA01
cggucggccaggcg

SEQ ID NO: 1484962 - RNA, 16 nt, Pseudomonas aeruginosa PA01
cggucggccaggcggc

SEQ ID NO: 1484963 - RNA, 18 nt, Pseudomonas aeruginosa PA01
cggucggccaggcggccg

SEQ ID NO: 1484964 - RNA, 22 nt, Pseudomonas aeruginosa PA01
cggucggccaggcggccgacga

SEQ ID NO: 1484965 - RNA, 21 nt, Pseudomonas aeruginosa PA01
cggucggccaggggagcgccg

SEQ ID NO: 1484966 - RNA, 13 nt, Pseudomonas aeruginosa PA01
cggucggccagga

SEQ ID NO: 1484967 - RNA, 16 nt, Pseudomonas aeruginosa PA01
cggucggccaggacgc

SEQ ID NO: 1484968 - RNA, 23 nt, Pseudomonas aeruginosa PA01
cggucggaucggauagccgugca

SEQ ID NO: 1484969 - RNA, 16 nt, Pseudomonas aeruginosa PA01
cggucggacuccgccc

SEQ ID NO: 1484970 - RNA, 19 nt, Pseudomonas aeruginosa PA01
cggucggaaagcagggcga

SEQ ID NO: 1484971 - RNA, 17 nt, Pseudomonas aeruginosa PA01
cggucggccaucuggcu

SEQ ID NO: 1484972 - RNA, 14 nt, Pseudomonas aeruginosa PA01
cggucggccauggc

SEQ ID NO: 1484973 - RNA, 21 nt, Pseudomonas aeruginosa PA01
cggucgcgcuggaccuggccg

SEQ ID NO: 1484974 - RNA, 15 nt, Pseudomonas aeruginosa PA01
cggucgcggaccucc

SEQ ID NO: 1484975 - RNA, 22 nt, Pseudomonas aeruginosa PA01
cggucgcggaccuccagccggc

SEQ ID NO: 1484976 - RNA, 15 nt, Pseudomonas aeruginosa PA01
cggucgcgccccgcc

SEQ ID NO: 1484977 - RNA, 20 nt, Pseudomonas aeruginosa PA01
cggucgcgcgggugcggcug

SEQ ID NO: 1484978 - RNA, 16 nt, Pseudomonas aeruginosa PA01
cggucgcugaccagcc

SEQ ID NO: 1484979 - RNA, 21 nt, Pseudomonas aeruginosa PA01
cggucgcugaccagcccggcg

SEQ ID NO: 1484980 - RNA, 18 nt, Pseudomonas aeruginosa PA01
cggucgagguugcgcggc

SEQ ID NO: 1484981 - RNA, 21 nt, Pseudomonas aeruginosa PA01
cggucgagguugcgcggcagg

SEQ ID NO: 1484982 - RNA, 21 nt, Pseudomonas aeruginosa PA01
cggucgaggcccucggcggcg

SEQ ID NO: 1484983 - RNA, 18 nt, Pseudomonas aeruginosa PA01
cggucgagccccacgucg

SEQ ID NO: 1484984 - RNA, 18 nt, Pseudomonas aeruginosa PA01
cggucgaucguugccagc

SEQ ID NO: 1484985 - RNA, 14 nt, Pseudomonas aeruginosa PA01
cggucgcaauggcg

SEQ ID NO: 1484986 - RNA, 17 nt, Pseudomonas aeruginosa PA01
cggucgcaccgccagca

SEQ ID NO: 1484987 - RNA, 16 nt, Pseudomonas aeruginosa PA01
cggucgcccucggcca

SEQ ID NO: 1484988 - RNA, 16 nt, Pseudomonas aeruginosa PA01
cggucgcgaucugcug

SEQ ID NO: 1484989 - RNA, 18 nt, Pseudomonas aeruginosa PA01
cggucgcgaucugcuggu

SEQ ID NO: 1484990 - RNA, 12 nt, Pseudomonas aeruginosa PA01
cggucgccggcg

SEQ ID NO: 1484991 - RNA, 14 nt, Pseudomonas aeruginosa PA01
cggucgccgccggc

SEQ ID NO: 1484992 - RNA, 16 nt, Pseudomonas aeruginosa PA01
cggucgccgccggcga

SEQ ID NO: 1484993 - RNA, 12 nt, Pseudomonas aeruginosa PA01
cggucgccgcca

SEQ ID NO: 1484994 - RNA, 14 nt, Pseudomonas aeruginosa PA01
cggucgccgccagc

SEQ ID NO: 1484995 - RNA, 16 nt, Pseudomonas aeruginosa PA01
cgggacagcuugccgu

SEQ ID NO: 1484996 - RNA, 18 nt, Pseudomonas aeruginosa PA01
cgggacagcuugccgucc

SEQ ID NO: 1484997 - RNA, 21 nt, Pseudomonas aeruginosa PA01
cgggacagcuugccguccagc

SEQ ID NO: 1484998 - RNA, 15 nt, Pseudomonas aeruginosa PA01
cgggacagguugucg

SEQ ID NO: 1484999 - RNA, 19 nt, Pseudomonas aeruginosa PA01
cggcuuggcgggcucgccc

SEQ ID NO: 1485000 - RNA, 23 nt, Pseudomonas aeruginosa PA01
cgggaaccacgacgaagcgccgg

SEQ ID NO: 1485001 - RNA, 18 nt, Pseudomonas aeruginosa PA01
cgggaacagcccgucgcg

SEQ ID NO: 1485002 - RNA, 20 nt, Pseudomonas aeruginosa PA01
cgggaacagcccgucgcgcg

SEQ ID NO: 1485003 - RNA, 23 nt, Pseudomonas aeruginosa PA01
cgggaacagcccgucgcgcgccg

SEQ ID NO: 1485004 - RNA, 14 nt, Pseudomonas aeruginosa PA01
cgggaacgccgggc

SEQ ID NO: 1485005 - RNA, 15 nt, Pseudomonas aeruginosa PA01
cgggaacgccgggca

SEQ ID NO: 1485006 - RNA, 14 nt, Pseudomonas aeruginosa PA01
cgggaacgaugccg

SEQ ID NO: 1485007 - RNA, 14 nt, Pseudomonas aeruginosa PA01
cgggaaucgccagc

SEQ ID NO: 1485008 - RNA, 17 nt, Pseudomonas aeruginosa PA01
cgggaaucgccagcagg

SEQ ID NO: 1485009 - RNA, 19 nt, Pseudomonas aeruginosa PA01
cgggaaucgccagcaggcu

SEQ ID NO: 1485010 - RNA, 21 nt, Pseudomonas aeruginosa PA01
cgggaacuuggcgcgcagggc

SEQ ID NO: 1485011 - RNA, 19 nt, Pseudomonas aeruginosa PA01
cgggaacuggcguugcuga

SEQ ID NO: 1485012 - RNA, 13 nt, Pseudomonas aeruginosa PA01
cggcuucggucag

SEQ ID NO: 1485013 - RNA, 16 nt, Pseudomonas aeruginosa PA01
cggcugcaacgccgcg

SEQ ID NO: 1485014 - RNA, 19 nt, Pseudomonas aeruginosa PA01
cggcugcaacuuccacucg

SEQ ID NO: 1485015 - RNA, 23 nt, Pseudomonas aeruginosa PA01
cggcugcaacuuccacucgccga

SEQ ID NO: 1485016 - RNA, 23 nt, Pseudomonas aeruginosa PA01
cggcugaugcccgggucgucggu

SEQ ID NO: 1485017 - RNA, 21 nt, Pseudomonas aeruginosa PA01
cggcugagcuguuucagccca

SEQ ID NO: 1485018 - RNA, 14 nt, Pseudomonas aeruginosa PA01
cggcugaggcuggc

SEQ ID NO: 1485019 - RNA, 14 nt, Pseudomonas aeruginosa PA01
cggcugagcgccag

SEQ ID NO: 1485020 - RNA, 17 nt, Pseudomonas aeruginosa PA01
cggcugagcgccaggcg

SEQ ID NO: 1485021 - RNA, 19 nt, Pseudomonas aeruginosa PA01
cggcugagcgccaggcgca

SEQ ID NO: 1485022 - RNA, 22 nt, Pseudomonas aeruginosa PA01
cggcucggcuccaggaccggca

SEQ ID NO: 1485023 - RNA, 22 nt, Pseudomonas aeruginosa PA01
cggcugagaccuuccugccagc

SEQ ID NO: 1485024 - RNA, 22 nt, Pseudomonas aeruginosa PA01
cggcuugaucgagcccuugcgc

SEQ ID NO: 1485025 - RNA, 13 nt, Pseudomonas aeruginosa PA01
cggcuugaucacg

SEQ ID NO: 1485026 - RNA, 18 nt, Pseudomonas aeruginosa PA01
cggcuugccggcagcgac

SEQ ID NO: 1485027 - RNA, 22 nt, Pseudomonas aeruginosa PA01
cggcuugccggcagcgaccacc

SEQ ID NO: 1485028 - RNA, 14 nt, Pseudomonas aeruginosa PA01
cggcuugccggcgc

SEQ ID NO: 1485029 - RNA, 15 nt, Pseudomonas aeruginosa PA01
cggcuugccggcgcg

SEQ ID NO: 1485030 - RNA, 17 nt, Pseudomonas aeruginosa PA01
cggcuugccgucggugu

SEQ ID NO: 1485031 - RNA, 16 nt, Pseudomonas aeruginosa PA01
cggcuugacgaugccg

SEQ ID NO: 1485032 - RNA, 21 nt, Pseudomonas aeruginosa PA01
cggcuugacuggcaguccagg

SEQ ID NO: 1485033 - RNA, 22 nt, Pseudomonas aeruginosa PA01
cggcuucuggaaggcggucagc

SEQ ID NO: 1485034 - RNA, 23 nt, Pseudomonas aeruginosa PA01
cggcuucugguucguccgcgcga

SEQ ID NO: 1485035 - RNA, 14 nt, Pseudomonas aeruginosa PA01
cgggacgccuggcg

SEQ ID NO: 1485036 - RNA, 12 nt, Pseudomonas aeruginosa PA01
cgggacgaugcc

SEQ ID NO: 1485037 - RNA, 15 nt, Pseudomonas aeruginosa PA01
cgggacgccaggcgu

SEQ ID NO: 1485038 - RNA, 13 nt, Pseudomonas aeruginosa PA01
cgggacgcggcgu

SEQ ID NO: 1485039 - RNA, 15 nt, Pseudomonas aeruginosa PA01
cgggacgcggcgugg

SEQ ID NO: 1485040 - RNA, 17 nt, Pseudomonas aeruginosa PA01
cgggagagcccgggcgc

SEQ ID NO: 1485041 - RNA, 15 nt, Pseudomonas aeruginosa PA01
cgggagcgcgaggcg

SEQ ID NO: 1485042 - RNA, 20 nt, Pseudomonas aeruginosa PA01
cgggagcgcgaggcgcaggc

SEQ ID NO: 1485043 - RNA, 15 nt, Pseudomonas aeruginosa PA01
cgggagagggcggcg

SEQ ID NO: 1485044 - RNA, 17 nt, Pseudomonas aeruginosa PA01
cgggagagggcggcgac

SEQ ID NO: 1485045 - RNA, 18 nt, Pseudomonas aeruginosa PA01
cgggagagggcggcgacc

SEQ ID NO: 1485046 - RNA, 21 nt, Pseudomonas aeruginosa PA01
cgggacuggggcaugggcgcg

SEQ ID NO: 1485047 - RNA, 23 nt, Pseudomonas aeruginosa PA01
cgggacuggggcaugggcgcggg

SEQ ID NO: 1485048 - RNA, 18 nt, Pseudomonas aeruginosa PA01
cgggacuuguacucgccg

SEQ ID NO: 1485049 - RNA, 19 nt, Pseudomonas aeruginosa PA01
cgggacuuguacucgccgg

SEQ ID NO: 1485050 - RNA, 22 nt, Pseudomonas aeruginosa PA01
cgggacuuguacucgccggugc

SEQ ID NO: 1485051 - RNA, 22 nt, Pseudomonas aeruginosa PA01
cgggauaccggccaucagcacc

SEQ ID NO: 1485052 - RNA, 20 nt, Pseudomonas aeruginosa PA01
cgggauaaacggcggauaac

SEQ ID NO: 1485053 - RNA, 16 nt, Pseudomonas aeruginosa PA01
cgggauacagcagcca

SEQ ID NO: 1485054 - RNA, 17 nt, Pseudomonas aeruginosa PA01
cgggauacagcagccaa

SEQ ID NO: 1485055 - RNA, 19 nt, Pseudomonas aeruginosa PA01
cgggauacagcagccaagg

SEQ ID NO: 1485056 - RNA, 20 nt, Pseudomonas aeruginosa PA01
cgggauagacggcggauaac

SEQ ID NO: 1485057 - RNA, 14 nt, Pseudomonas aeruginosa PA01
cgggaggcgccgcg

SEQ ID NO: 1485058 - RNA, 15 nt, Pseudomonas aeruginosa PA01
cgggaggcgccgcgc

SEQ ID NO: 1485059 - RNA, 19 nt, Pseudomonas aeruginosa PA01
cgggagcggccgugcaugc

SEQ ID NO: 1485060 - RNA, 13 nt, Pseudomonas aeruginosa PA01
cgggagcggccug

SEQ ID NO: 1485061 - RNA, 14 nt, Pseudomonas aeruginosa PA01
cgggagcggccuga

SEQ ID NO: 1485062 - RNA, 22 nt, Pseudomonas aeruginosa PA01
cgggagucaacgccuggccacg

SEQ ID NO: 1485063 - RNA, 19 nt, Pseudomonas aeruginosa PA01
cgggaucaggucgccagcg

SEQ ID NO: 1485064 - RNA, 23 nt, Pseudomonas aeruginosa PA01
cgggaucagccgcgacucggcug

SEQ ID NO: 1485065 - RNA, 12 nt, Pseudomonas aeruginosa PA01
cgggaucagcgg

SEQ ID NO: 1485066 - RNA, 13 nt, Pseudomonas aeruginosa PA01
cgggaucgaugcg

SEQ ID NO: 1485067 - RNA, 15 nt, Pseudomonas aeruginosa PA01
cgggaucgacgccgc

SEQ ID NO: 1485068 - RNA, 20 nt, Pseudomonas aeruginosa PA01
cgggaucgacgccgcuggcg

SEQ ID NO: 1485069 - RNA, 20 nt, Pseudomonas aeruginosa PA01
cgggaucgagcaacagcagg

SEQ ID NO: 1485070 - RNA, 14 nt, Pseudomonas aeruginosa PA01
cgggaucgccucgu

SEQ ID NO: 1485071 - RNA, 13 nt, Pseudomonas aeruginosa PA01
cgggccgccuggu

SEQ ID NO: 1485072 - RNA, 15 nt, Pseudomonas aeruginosa PA01
cgggccgccuggucg

SEQ ID NO: 1485073 - RNA, 19 nt, Pseudomonas aeruginosa PA01
cgggccgccuugcgcagca

SEQ ID NO: 1485074 - RNA, 14 nt, Pseudomonas aeruginosa PA01
cgggccgcgccgca

SEQ ID NO: 1485075 - RNA, 16 nt, Pseudomonas aeruginosa PA01
cgggccgcgccgcaag

SEQ ID NO: 1485076 - RNA, 21 nt, Pseudomonas aeruginosa PA01
cgggccguuuuuuaugccgag

SEQ ID NO: 1485077 - RNA, 21 nt, Pseudomonas aeruginosa PA01
cgggccgucguuuuguccggc

SEQ ID NO: 1485078 - RNA, 17 nt, Pseudomonas aeruginosa PA01
cgggccuccuggcggcg

SEQ ID NO: 1485079 - RNA, 20 nt, Pseudomonas aeruginosa PA01
cgggccuccuggcggcgugg

SEQ ID NO: 1485080 - RNA, 12 nt, Pseudomonas aeruginosa PA01
cgggccucggcg

SEQ ID NO: 1485081 - RNA, 22 nt, Pseudomonas aeruginosa PA01
cgggccucucgacguaccgccu

SEQ ID NO: 1485082 - RNA, 13 nt, Pseudomonas aeruginosa PA01
cgggccgccggcg

SEQ ID NO: 1485083 - RNA, 15 nt, Pseudomonas aeruginosa PA01
cgggccgccggcgac

SEQ ID NO: 1485084 - RNA, 19 nt, Pseudomonas aeruginosa PA01
cgggccgccggcgacgagg

SEQ ID NO: 1485085 - RNA, 22 nt, Pseudomonas aeruginosa PA01
cgggccgccggcgacgagguag

SEQ ID NO: 1485086 - RNA, 14 nt, Pseudomonas aeruginosa PA01
cgggcccugccaga

SEQ ID NO: 1485087 - RNA, 13 nt, Pseudomonas aeruginosa PA01
cgggcccucccaa

SEQ ID NO: 1485088 - RNA, 19 nt, Pseudomonas aeruginosa PA01
cgggccagcagcuccgggc

SEQ ID NO: 1485089 - RNA, 24 nt, Pseudomonas aeruginosa PA01
cgggcagugcgcccucgaacggcg

SEQ ID NO: 1485090 - RNA, 21 nt, Pseudomonas aeruginosa PA01
cgggcaguacucaugaccgcc

SEQ ID NO: 1485091 - RNA, 17 nt, Pseudomonas aeruginosa PA01
cgggcagguggacggca

SEQ ID NO: 1485092 - RNA, 13 nt, Pseudomonas aeruginosa PA01
cgggccagcucca

SEQ ID NO: 1485093 - RNA, 17 nt, Pseudomonas aeruginosa PA01
cgggccagcuccagcac

SEQ ID NO: 1485094 - RNA, 18 nt, Pseudomonas aeruginosa PA01
cgggccagcuccagcacc

SEQ ID NO: 1485095 - RNA, 13 nt, Pseudomonas aeruginosa PA01
cgggccaggccga

SEQ ID NO: 1485096 - RNA, 14 nt, Pseudomonas aeruginosa PA01
cgggccaggccgag

SEQ ID NO: 1485097 - RNA, 13 nt, Pseudomonas aeruginosa PA01
cgggccagcuccg

SEQ ID NO: 1485098 - RNA, 17 nt, Pseudomonas aeruginosa PA01
cgggccagcaggcgcuc

SEQ ID NO: 1485099 - RNA, 23 nt, Pseudomonas aeruginosa PA01
cgggccagcaggcgcucggcgac

SEQ ID NO: 1485100 - RNA, 20 nt, Pseudomonas aeruginosa PA01
cgggccagcaggguggccag

SEQ ID NO: 1485101 - RNA, 15 nt, Pseudomonas aeruginosa PA01
cgggcaccgccagcc

SEQ ID NO: 1485102 - RNA, 17 nt, Pseudomonas aeruginosa PA01
cgggcaacugaucagcc

SEQ ID NO: 1485103 - RNA, 19 nt, Pseudomonas aeruginosa PA01
cgggcaacugaucagccgg

SEQ ID NO: 1485104 - RNA, 14 nt, Pseudomonas aeruginosa PA01
cgggcaacugccga

SEQ ID NO: 1485105 - RNA, 14 nt, Pseudomonas aeruginosa PA01
cgggcaagcucgac

SEQ ID NO: 1485106 - RNA, 16 nt, Pseudomonas aeruginosa PA01
cgggcaagcucgacga

SEQ ID NO: 1485107 - RNA, 18 nt, Pseudomonas aeruginosa PA01
cgggcaagcucgacgagc

SEQ ID NO: 1485108 - RNA, 12 nt, Pseudomonas aeruginosa PA01
cgggcagccccu

SEQ ID NO: 1485109 - RNA, 15 nt, Pseudomonas aeruginosa PA01
cgggcagcagccgga

SEQ ID NO: 1485110 - RNA, 20 nt, Pseudomonas aeruginosa PA01
cgggcaccgucaccuguucg

SEQ ID NO: 1485111 - RNA, 15 nt, Pseudomonas aeruginosa PA01
cgggauugucgccgc

SEQ ID NO: 1485112 - RNA, 19 nt, Pseudomonas aeruginosa PA01
cgggauugucgccgccgag

SEQ ID NO: 1485113 - RNA, 14 nt, Pseudomonas aeruginosa PA01
cgggauggucgagg

SEQ ID NO: 1485114 - RNA, 17 nt, Pseudomonas aeruginosa PA01
cgggauggucgagggcg

SEQ ID NO: 1485115 - RNA, 14 nt, Pseudomonas aeruginosa PA01
cgggcaacgccagg

SEQ ID NO: 1485116 - RNA, 15 nt, Pseudomonas aeruginosa PA01
cgggcaaccgcggcg

SEQ ID NO: 1485117 - RNA, 16 nt, Pseudomonas aeruginosa PA01
cgggcaaccgcggcgg

SEQ ID NO: 1485118 - RNA, 17 nt, Pseudomonas aeruginosa PA01
cgggcaaccgcggcggc

SEQ ID NO: 1485119 - RNA, 16 nt, Pseudomonas aeruginosa PA01
cgggaugcccggccgc

SEQ ID NO: 1485120 - RNA, 16 nt, Pseudomonas aeruginosa PA01
cgggaugcucaccgcg

SEQ ID NO: 1485121 - RNA, 20 nt, Pseudomonas aeruginosa PA01
cgggaugcucaccgcgcuug

SEQ ID NO: 1485122 - RNA, 15 nt, Pseudomonas aeruginosa PA01
cgggauggcgaagcc

SEQ ID NO: 1485123 - RNA, 16 nt, Pseudomonas aeruginosa PA01
cgggauggcgaagccg

SEQ ID NO: 1485124 - RNA, 16 nt, Pseudomonas aeruginosa PA01
cgggaucuccgcgcca

SEQ ID NO: 1485125 - RNA, 15 nt, Pseudomonas aeruginosa PA01
cgggaucuccucgac

SEQ ID NO: 1485126 - RNA, 22 nt, Pseudomonas aeruginosa PA01
cgggaucuggcccugcaacagg

SEQ ID NO: 1485127 - RNA, 19 nt, Pseudomonas aeruginosa PA01
cgggaucuucuaccuggcg

SEQ ID NO: 1485128 - RNA, 21 nt, Pseudomonas aeruginosa PA01
cggcucgccgacuuccaggcg

SEQ ID NO: 1485129 - RNA, 13 nt, Pseudomonas aeruginosa PA01
cggcucgccgaaa

SEQ ID NO: 1485130 - RNA, 17 nt, Pseudomonas aeruginosa PA01
cggcucgcccagcaggc

SEQ ID NO: 1485131 - RNA, 20 nt, Pseudomonas aeruginosa PA01
cggcucgcccagcaggcgcg

SEQ ID NO: 1485132 - RNA, 17 nt, Pseudomonas aeruginosa PA01
cggcucgcccaugcgcg

SEQ ID NO: 1485133 - RNA, 19 nt, Pseudomonas aeruginosa PA01
cggcucgcccaugcgcggc

SEQ ID NO: 1485134 - RNA, 21 nt, Pseudomonas aeruginosa PA01
cggcucgcccaugcgcggcga

SEQ ID NO: 1485135 - RNA, 13 nt, Pseudomonas aeruginosa PA01
cggcucggccagg

SEQ ID NO: 1485136 - RNA, 22 nt, Pseudomonas aeruginosa PA01
cggcucggccagggccgcucga

SEQ ID NO: 1485137 - RNA, 18 nt, Pseudomonas aeruginosa PA01
cggcucggccgugugccu

SEQ ID NO: 1485138 - RNA, 20 nt, Pseudomonas aeruginosa PA01
cggcucggcgaggaacagca

SEQ ID NO: 1485139 - RNA, 22 nt, Pseudomonas aeruginosa PA01
cggcucgcucucgaacaccggc

SEQ ID NO: 1485140 - RNA, 22 nt, Pseudomonas aeruginosa PA01
cggcucgcugaaauccaccagc

SEQ ID NO: 1485141 - RNA, 13 nt, Pseudomonas aeruginosa PA01
cggcucgcugacg

SEQ ID NO: 1485142 - RNA, 16 nt, Pseudomonas aeruginosa PA01
cggcucgcgcagcggc

SEQ ID NO: 1485143 - RNA, 18 nt, Pseudomonas aeruginosa PA01
cggcucgcgcagcggcgc

SEQ ID NO: 1485144 - RNA, 15 nt, Pseudomonas aeruginosa PA01
cggcucgcgccggcg

SEQ ID NO: 1485145 - RNA, 16 nt, Pseudomonas aeruginosa PA01
cggcucgcgggucacc

SEQ ID NO: 1485146 - RNA, 21 nt, Pseudomonas aeruginosa PA01
cggcuccggguacuggcgcug

SEQ ID NO: 1485147 - RNA, 13 nt, Pseudomonas aeruginosa PA01
cggcuccucggcc

SEQ ID NO: 1485148 - RNA, 14 nt, Pseudomonas aeruginosa PA01
cggcuccucggccu

SEQ ID NO: 1485149 - RNA, 13 nt, Pseudomonas aeruginosa PA01
cggcuccucugcc

SEQ ID NO: 1485150 - RNA, 17 nt, Pseudomonas aeruginosa PA01
cggcuccggcuccgcgc

SEQ ID NO: 1485151 - RNA, 15 nt, Pseudomonas aeruginosa PA01
cggcucauggccggg

SEQ ID NO: 1485152 - RNA, 17 nt, Pseudomonas aeruginosa PA01
cggcucauggccggggu

SEQ ID NO: 1485153 - RNA, 18 nt, Pseudomonas aeruginosa PA01
cggcucaauccggcugga

SEQ ID NO: 1485154 - RNA, 19 nt, Pseudomonas aeruginosa PA01
cggcuacccucuccccaac

SEQ ID NO: 1485155 - RNA, 16 nt, Pseudomonas aeruginosa PA01
cggcuacucgcccgac

SEQ ID NO: 1485156 - RNA, 19 nt, Pseudomonas aeruginosa PA01
cggcucacgccccagcgca

SEQ ID NO: 1485157 - RNA, 23 nt, Pseudomonas aeruginosa PA01
cggcucagaaauccaccuugccg

SEQ ID NO: 1485158 - RNA, 15 nt, Pseudomonas aeruginosa PA01
cggcucagccgcugg

SEQ ID NO: 1485159 - RNA, 16 nt, Pseudomonas aeruginosa PA01
cggcucagccgcuggc

SEQ ID NO: 1485160 - RNA, 15 nt, Pseudomonas aeruginosa PA01
cggcucagcgcuucg

SEQ ID NO: 1485161 - RNA, 15 nt, Pseudomonas aeruginosa PA01
cggcucaggccgccg

SEQ ID NO: 1485162 - RNA, 15 nt, Pseudomonas aeruginosa PA01
cggcguucggaccug

SEQ ID NO: 1485163 - RNA, 22 nt, Pseudomonas aeruginosa PA01
cggcguucggggcccuccaggc

SEQ ID NO: 1485164 - RNA, 12 nt, Pseudomonas aeruginosa PA01
cggcguucgccc

SEQ ID NO: 1485165 - RNA, 13 nt, Pseudomonas aeruginosa PA01
cggcguucgcccu

SEQ ID NO: 1485166 - RNA, 13 nt, Pseudomonas aeruginosa PA01
cggcguucgccga

SEQ ID NO: 1485167 - RNA, 21 nt, Pseudomonas aeruginosa PA01
cggcguucgccgagcaagccu

SEQ ID NO: 1485168 - RNA, 16 nt, Pseudomonas aeruginosa PA01
cggcguucgccgcggg

SEQ ID NO: 1485169 - RNA, 19 nt, Pseudomonas aeruginosa PA01
cggcguucgccgcgggcgu

SEQ ID NO: 1485170 - RNA, 14 nt, Pseudomonas aeruginosa PA01
cggcuacaggccgu

SEQ ID NO: 1485171 - RNA, 20 nt, Pseudomonas aeruginosa PA01
cggcuaccagcgcuucggcg

SEQ ID NO: 1485172 - RNA, 22 nt, Pseudomonas aeruginosa PA01
cggcuaccagcgcuucggcggc

SEQ ID NO: 1485173 - RNA, 14 nt, Pseudomonas aeruginosa PA01
cggcguuauccgcc

SEQ ID NO: 1485174 - RNA, 18 nt, Pseudomonas aeruginosa PA01
cggcguuauccgccgaua

SEQ ID NO: 1485175 - RNA, 19 nt, Pseudomonas aeruginosa PA01
cggcguuauccgccgcuca

SEQ ID NO: 1485176 - RNA, 15 nt, Pseudomonas aeruginosa PA01
cggcguucgacgccu

SEQ ID NO: 1485177 - RNA, 16 nt, Pseudomonas aeruginosa PA01
cggcgucguccugcgc

SEQ ID NO: 1485178 - RNA, 21 nt, Pseudomonas aeruginosa PA01
cggcgucguccugcgcggcga

SEQ ID NO: 1485179 - RNA, 18 nt, Pseudomonas aeruginosa PA01
cggcgucgucgcugcgcg

SEQ ID NO: 1485180 - RNA, 13 nt, Pseudomonas aeruginosa PA01
cggcgucgggcga

SEQ ID NO: 1485181 - RNA, 22 nt, Pseudomonas aeruginosa PA01
cggcgucucauggaacagcagc

SEQ ID NO: 1485182 - RNA, 23 nt, Pseudomonas aeruginosa PA01
cggcgucucauggaacagcagcc

SEQ ID NO: 1485183 - RNA, 24 nt, Pseudomonas aeruginosa PA01
cggcgucucauggaacagcagcca

SEQ ID NO: 1485184 - RNA, 15 nt, Pseudomonas aeruginosa PA01
cggcguacuucggcg

SEQ ID NO: 1485185 - RNA, 16 nt, Pseudomonas aeruginosa PA01
cggcguacuucggcgc

SEQ ID NO: 1485186 - RNA, 18 nt, Pseudomonas aeruginosa PA01
cggcguaggccucggagu

SEQ ID NO: 1485187 - RNA, 16 nt, Pseudomonas aeruginosa PA01
cggcguagcgcugggc

SEQ ID NO: 1485188 - RNA, 16 nt, Pseudomonas aeruginosa PA01
cggcguagccggccag

SEQ ID NO: 1485189 - RNA, 19 nt, Pseudomonas aeruginosa PA01
cggcguagccggcgauccg

SEQ ID NO: 1485190 - RNA, 20 nt, Pseudomonas aeruginosa PA01
cggcguagccggcgauccgc

SEQ ID NO: 1485191 - RNA, 21 nt, Pseudomonas aeruginosa PA01
cggcguauccaagagagcgcc

SEQ ID NO: 1485192 - RNA, 15 nt, Pseudomonas aeruginosa PA01
cggcguauccucggc

SEQ ID NO: 1485193 - RNA, 17 nt, Pseudomonas aeruginosa PA01
cggcguauccucggcca

SEQ ID NO: 1485194 - RNA, 15 nt, Pseudomonas aeruginosa PA01
cggcguauucgccga

SEQ ID NO: 1485195 - RNA, 17 nt, Pseudomonas aeruginosa PA01
cggcguauucgccgaag

SEQ ID NO: 1485196 - RNA, 16 nt, Pseudomonas aeruginosa PA01
cggcgucuucggcggc

SEQ ID NO: 1485197 - RNA, 22 nt, Pseudomonas aeruginosa PA01
cggcgucucggagugaggccga

SEQ ID NO: 1485198 - RNA, 23 nt, Pseudomonas aeruginosa PA01
cggcgucuggggugaggccgagc

SEQ ID NO: 1485199 - RNA, 22 nt, Pseudomonas aeruginosa PA01
cggcgugcccauccgcucggcg

SEQ ID NO: 1485200 - RNA, 14 nt, Pseudomonas aeruginosa PA01
cggcgugccgggca

SEQ ID NO: 1485201 - RNA, 12 nt, Pseudomonas aeruginosa PA01
cggcgugccgca

SEQ ID NO: 1485202 - RNA, 15 nt, Pseudomonas aeruginosa PA01
cggcgugccgcaacg

SEQ ID NO: 1485203 - RNA, 20 nt, Pseudomonas aeruginosa PA01
cggcgugccgcaggccgcgg

SEQ ID NO: 1485204 - RNA, 20 nt, Pseudomonas aeruginosa PA01
cggcgugccguggcucggcg

SEQ ID NO: 1485205 - RNA, 23 nt, Pseudomonas aeruginosa PA01
cggcgugccguggcucggcggca

SEQ ID NO: 1485206 - RNA, 15 nt, Pseudomonas aeruginosa PA01
cggcguggaaggcca

SEQ ID NO: 1485207 - RNA, 22 nt, Pseudomonas aeruginosa PA01
cggcgugcugggucuccuccuc

SEQ ID NO: 1485208 - RNA, 13 nt, Pseudomonas aeruginosa PA01
cggcguggcggau

SEQ ID NO: 1485209 - RNA, 15 nt, Pseudomonas aeruginosa PA01
cggcguggcgaucag

SEQ ID NO: 1485210 - RNA, 23 nt, Pseudomonas aeruginosa PA01
cggcguggcgaucaggcagcgcg

SEQ ID NO: 1485211 - RNA, 15 nt, Pseudomonas aeruginosa PA01
cggcguggcucgauc

SEQ ID NO: 1485212 - RNA, 18 nt, Pseudomonas aeruginosa PA01
cggcguggcucgaucagc

SEQ ID NO: 1485213 - RNA, 20 nt, Pseudomonas aeruginosa PA01
cggcgugggcggucggcgag

SEQ ID NO: 1485214 - RNA, 18 nt, Pseudomonas aeruginosa PA01
cggcgggagagggcggcg

SEQ ID NO: 1485215 - RNA, 13 nt, Pseudomonas aeruginosa PA01
cggcgggacggcg

SEQ ID NO: 1485216 - RNA, 14 nt, Pseudomonas aeruginosa PA01
cggcgggacggcgc

SEQ ID NO: 1485217 - RNA, 15 nt, Pseudomonas aeruginosa PA01
cggcgggacggcgca

SEQ ID NO: 1485218 - RNA, 17 nt, Pseudomonas aeruginosa PA01
cggcgggacggcgcaua

SEQ ID NO: 1485219 - RNA, 13 nt, Pseudomonas aeruginosa PA01
cggcgggaacgcc

SEQ ID NO: 1485220 - RNA, 20 nt, Pseudomonas aeruginosa PA01
cggcggcuuccuccaucgcc

SEQ ID NO: 1485221 - RNA, 23 nt, Pseudomonas aeruginosa PA01
cggcggcuucagccagaccggca

SEQ ID NO: 1485222 - RNA, 21 nt, Pseudomonas aeruginosa PA01
cggcggcuucgcgcuccaggc

SEQ ID NO: 1485223 - RNA, 22 nt, Pseudomonas aeruginosa PA01
cggcggcgguucgccgagcgcc

SEQ ID NO: 1485224 - RNA, 13 nt, Pseudomonas aeruginosa PA01
cggcgggcaccgc

SEQ ID NO: 1485225 - RNA, 14 nt, Pseudomonas aeruginosa PA01
cggcgggagcggcc

SEQ ID NO: 1485226 - RNA, 16 nt, Pseudomonas aeruginosa PA01
cggcgggcccguggca

SEQ ID NO: 1485227 - RNA, 14 nt, Pseudomonas aeruginosa PA01
cggcgggccgcuca

SEQ ID NO: 1485228 - RNA, 20 nt, Pseudomonas aeruginosa PA01
cggcgggccggcguccagga

SEQ ID NO: 1485229 - RNA, 23 nt, Pseudomonas aeruginosa PA01
cggcgggugcguggugcauccgc

SEQ ID NO: 1485230 - RNA, 14 nt, Pseudomonas aeruginosa PA01
cggcggguggcgcu

SEQ ID NO: 1485231 - RNA, 22 nt, Pseudomonas aeruginosa PA01
cggcgggugugguccgcggugu

SEQ ID NO: 1485232 - RNA, 16 nt, Pseudomonas aeruginosa PA01
cggcgcggcggccgcc

SEQ ID NO: 1485233 - RNA, 12 nt, Pseudomonas aeruginosa PA01
cggcgcggcggg

SEQ ID NO: 1485234 - RNA, 16 nt, Pseudomonas aeruginosa PA01
cggcgcggcccguccg

SEQ ID NO: 1485235 - RNA, 17 nt, Pseudomonas aeruginosa PA01
cggcgcggcgcguuccg

SEQ ID NO: 1485236 - RNA, 20 nt, Pseudomonas aeruginosa PA01
cggcgcggcgcuccaggcgg

SEQ ID NO: 1485237 - RNA, 21 nt, Pseudomonas aeruginosa PA01
cggcgcggcgcuccaggcggg

SEQ ID NO: 1485238 - RNA, 20 nt, Pseudomonas aeruginosa PA01
cggcgcggauguucgccacg

SEQ ID NO: 1485239 - RNA, 21 nt, Pseudomonas aeruginosa PA01
cggcgcggauguucgccacgc

SEQ ID NO: 1485240 - RNA, 14 nt, Pseudomonas aeruginosa PA01
cggcgcggaccgca

SEQ ID NO: 1485241 - RNA, 22 nt, Pseudomonas aeruginosa PA01
cggcgcggacgauggucgccgc

SEQ ID NO: 1485242 - RNA, 20 nt, Pseudomonas aeruginosa PA01
cggcgcggacauggcgcucg

SEQ ID NO: 1485243 - RNA, 16 nt, Pseudomonas aeruginosa PA01
cggcgcgcugcgugcg

SEQ ID NO: 1485244 - RNA, 20 nt, Pseudomonas aeruginosa PA01
cggcggcgaucuucuccgcc

SEQ ID NO: 1485245 - RNA, 22 nt, Pseudomonas aeruginosa PA01
cggcggcgagcauuccucagcg

SEQ ID NO: 1485246 - RNA, 12 nt, Pseudomonas aeruginosa PA01
cggcggcgccgg

SEQ ID NO: 1485247 - RNA, 14 nt, Pseudomonas aeruginosa PA01
cggcggcgccggca

SEQ ID NO: 1485248 - RNA, 13 nt, Pseudomonas aeruginosa PA01
cggcggcgccagg

SEQ ID NO: 1485249 - RNA, 14 nt, Pseudomonas aeruginosa PA01
cggcggcggccagc

SEQ ID NO: 1485250 - RNA, 16 nt, Pseudomonas aeruginosa PA01
cggcggcgccggugag

SEQ ID NO: 1485251 - RNA, 14 nt, Pseudomonas aeruginosa PA01
cggcggcggccugc

SEQ ID NO: 1485252 - RNA, 12 nt, Pseudomonas aeruginosa PA01
cggcggcggccc

SEQ ID NO: 1485253 - RNA, 15 nt, Pseudomonas aeruginosa PA01
cggcggcggcccgca

SEQ ID NO: 1485254 - RNA, 20 nt, Pseudomonas aeruginosa PA01
cggcgguacgcccuccagca

SEQ ID NO: 1485255 - RNA, 15 nt, Pseudomonas aeruginosa PA01
cggcgguagccgagg

SEQ ID NO: 1485256 - RNA, 17 nt, Pseudomonas aeruginosa PA01
cggcgguagccgaggcg

SEQ ID NO: 1485257 - RNA, 18 nt, Pseudomonas aeruginosa PA01
cggcgguagcgcgaaggc

SEQ ID NO: 1485258 - RNA, 17 nt, Pseudomonas aeruginosa PA01
cggcgguagcuccaggc

SEQ ID NO: 1485259 - RNA, 19 nt, Pseudomonas aeruginosa PA01
cggcgguagcuccaggccg

SEQ ID NO: 1485260 - RNA, 22 nt, Pseudomonas aeruginosa PA01
cggcgguagcuccaggccgaag

SEQ ID NO: 1485261 - RNA, 14 nt, Pseudomonas aeruginosa PA01
cggcggucaucgcg

SEQ ID NO: 1485262 - RNA, 11 nt, Pseudomonas aeruginosa PA01
cggcgguccag

SEQ ID NO: 1485263 - RNA, 13 nt, Pseudomonas aeruginosa PA01
cggcggucaggcu

SEQ ID NO: 1485264 - RNA, 12 nt, Pseudomonas aeruginosa PA01
cggcggucaggu

SEQ ID NO: 1485265 - RNA, 23 nt, Pseudomonas aeruginosa PA01
cggcggucccuucgugggccugc

SEQ ID NO: 1485266 - RNA, 14 nt, Pseudomonas aeruginosa PA01
cggcgguccgccgc

SEQ ID NO: 1485267 - RNA, 20 nt, Pseudomonas aeruginosa PA01
cggcgguccaggggccgaug

SEQ ID NO: 1485268 - RNA, 22 nt, Pseudomonas aeruginosa PA01
cggcgguccaggggccgaugcc

SEQ ID NO: 1485269 - RNA, 23 nt, Pseudomonas aeruginosa PA01
cggcgguccaggggccgaugccg

SEQ ID NO: 1485270 - RNA, 20 nt, Pseudomonas aeruginosa PA01
cggcggucccagaccagcag

SEQ ID NO: 1485271 - RNA, 21 nt, Pseudomonas aeruginosa PA01
cggcggucccagaccagcagc

SEQ ID NO: 1485272 - RNA, 22 nt, Pseudomonas aeruginosa PA01
cggcggucccagaccagcagcg

SEQ ID NO: 1485273 - RNA, 17 nt, Pseudomonas aeruginosa PA01
cggcggucccaucagca

SEQ ID NO: 1485274 - RNA, 18 nt, Pseudomonas aeruginosa PA01
cggcggucucgaacgcca

SEQ ID NO: 1485275 - RNA, 20 nt, Pseudomonas aeruginosa PA01
cggcggucucgaacgccagg

SEQ ID NO: 1485276 - RNA, 21 nt, Pseudomonas aeruginosa PA01
cggcggucucgaacgccaggc

SEQ ID NO: 1485277 - RNA, 22 nt, Pseudomonas aeruginosa PA01
cggcggucucgaacgccaggca

SEQ ID NO: 1485278 - RNA, 24 nt, Pseudomonas aeruginosa PA01
cggcggucucgaacgccaggcagg

SEQ ID NO: 1485279 - RNA, 16 nt, Pseudomonas aeruginosa PA01
cggcggugaaggcgaa

SEQ ID NO: 1485280 - RNA, 14 nt, Pseudomonas aeruginosa PA01
cggcggugagggcg

SEQ ID NO: 1485281 - RNA, 17 nt, Pseudomonas aeruginosa PA01
cggcggugagggcgacg

SEQ ID NO: 1485282 - RNA, 15 nt, Pseudomonas aeruginosa PA01
cggcgguggggccgc

SEQ ID NO: 1485283 - RNA, 17 nt, Pseudomonas aeruginosa PA01
cggcgguggggccgccg

SEQ ID NO: 1485284 - RNA, 21 nt, Pseudomonas aeruginosa PA01
cggcgguggggccgccgaugc

SEQ ID NO: 1485285 - RNA, 23 nt, Pseudomonas aeruginosa PA01
cggcgguggggccgccgaugccg

SEQ ID NO: 1485286 - RNA, 15 nt, Pseudomonas aeruginosa PA01
cggcgguggagcaga

SEQ ID NO: 1485287 - RNA, 21 nt, Pseudomonas aeruginosa PA01
cggcggugccauggaucacca

SEQ ID NO: 1485288 - RNA, 14 nt, Pseudomonas aeruginosa PA01
cggcggugaugccg

SEQ ID NO: 1485289 - RNA, 14 nt, Pseudomonas aeruginosa PA01
cggcggugcgccgg

SEQ ID NO: 1485290 - RNA, 15 nt, Pseudomonas aeruginosa PA01
cggcggugcgccggc

SEQ ID NO: 1485291 - RNA, 19 nt, Pseudomonas aeruginosa PA01
cggcgguuggagcgagcga

SEQ ID NO: 1485292 - RNA, 21 nt, Pseudomonas aeruginosa PA01
cggcgguucgaucccgucauc

SEQ ID NO: 1485293 - RNA, 23 nt, Pseudomonas aeruginosa PA01
cggcgguucgccgagcgccgcca

SEQ ID NO: 1485294 - RNA, 24 nt, Pseudomonas aeruginosa PA01
cggcgguucgccgagcgccgccag

SEQ ID NO: 1485295 - RNA, 19 nt, Pseudomonas aeruginosa PA01
cggcgguuucgucgaagcc

SEQ ID NO: 1485296 - RNA, 19 nt, Pseudomonas aeruginosa PA01
cggcgguuucgccgaggcc

SEQ ID NO: 1485297 - RNA, 15 nt, Pseudomonas aeruginosa PA01
cggcguaccagccgc

SEQ ID NO: 1485298 - RNA, 20 nt, Pseudomonas aeruginosa PA01
cggcguaccaggaugcccug

SEQ ID NO: 1485299 - RNA, 12 nt, Pseudomonas aeruginosa PA01
aaaagcccgcca

SEQ ID NO: 1485300 - RNA, 22 nt, Pseudomonas aeruginosa PA01
aaaagccgcccacgggcggcuu

SEQ ID NO: 1485301 - RNA, 21 nt, Pseudomonas aeruginosa PA01
aaaaggcgaucgaaggaucgc

SEQ ID NO: 1485302 - RNA, 21 nt, Pseudomonas aeruginosa PA01
aaaagggaugccggcggcauc

SEQ ID NO: 1485303 - RNA, 13 nt, Pseudomonas aeruginosa PA01
aaaaagcccggca

SEQ ID NO: 1485304 - RNA, 12 nt, Pseudomonas aeruginosa PA01
aaaacggcgccc

SEQ ID NO: 1485305 - RNA, 18 nt, Pseudomonas aeruginosa PA01
aaaaccgguuucguggau

SEQ ID NO: 1485306 - RNA, 18 nt, Pseudomonas aeruginosa PA01
aaacgaaaaagcccggcg

SEQ ID NO: 1485307 - RNA, 22 nt, Pseudomonas aeruginosa PA01
aaacgcgccuccggcagcgucg

SEQ ID NO: 1485308 - RNA, 20 nt, Pseudomonas aeruginosa PA01
aaacgccggcgaucgccggc

SEQ ID NO: 1485309 - RNA, 23 nt, Pseudomonas aeruginosa PA01
aaacgccgcgaagcccagcgccg

SEQ ID NO: 1485310 - RNA, 15 nt, Pseudomonas aeruginosa PA01
aaacgggcgaucugc

SEQ ID NO: 1485311 - RNA, 22 nt, Pseudomonas aeruginosa PA01
aaagcauuucuucaccacccca

SEQ ID NO: 1485312 - RNA, 17 nt, Pseudomonas aeruginosa PA01
aaagacgcugcgaccug

SEQ ID NO: 1485313 - RNA, 22 nt, Pseudomonas aeruginosa PA01
aaagcgguaccgggccaggcaa

SEQ ID NO: 1485314 - RNA, 14 nt, Pseudomonas aeruginosa PA01
aaagggcagcggcg

SEQ ID NO: 1485315 - RNA, 15 nt, Pseudomonas aeruginosa PA01
aaagggcagcggcga

SEQ ID NO: 1485316 - RNA, 14 nt, Pseudomonas aeruginosa PA01
aaagggucaggccu

SEQ ID NO: 1485317 - RNA, 18 nt, Pseudomonas aeruginosa PA01
aaagccccugccgcggau

SEQ ID NO: 1485318 - RNA, 18 nt, Pseudomonas aeruginosa PA01
aaagccccugcgaccgug

SEQ ID NO: 1485319 - RNA, 21 nt, Pseudomonas aeruginosa PA01
aaagccccgcaucgcggggcu

SEQ ID NO: 1485320 - RNA, 22 nt, Pseudomonas aeruginosa PA01
aaagccccgccaaggcggggcu

SEQ ID NO: 1485321 - RNA, 22 nt, Pseudomonas aeruginosa PA01
aaagccccgcuucggcggggcu

SEQ ID NO: 1485322 - RNA, 22 nt, Pseudomonas aeruginosa PA01
aaagccgccccgaggggcggcu

SEQ ID NO: 1485323 - RNA, 22 nt, Pseudomonas aeruginosa PA01
aaagccggcgcaugcgccggcu

SEQ ID NO: 1485324 - RNA, 17 nt, Pseudomonas aeruginosa PA01
aaagccuggagcagggc

SEQ ID NO: 1485325 - RNA, 12 nt, Pseudomonas aeruginosa PA01
aaacagcuccgg

SEQ ID NO: 1485326 - RNA, 11 nt, Pseudomonas aeruginosa PA01
aaaccgcggcc

SEQ ID NO: 1485327 - RNA, 20 nt, Pseudomonas aeruginosa PA01
aaaccccggccuggcgccgg

SEQ ID NO: 1485328 - RNA, 22 nt, Pseudomonas aeruginosa PA01
aaaccggcgaugcucagcgccg

SEQ ID NO: 1485329 - RNA, 20 nt, Pseudomonas aeruginosa PA01
aacaccagcgccgccaggca

SEQ ID NO: 1485330 - RNA, 15 nt, Pseudomonas aeruginosa PA01
aaauccgccgcgcac

SEQ ID NO: 1485331 - RNA, 14 nt, Pseudomonas aeruginosa PA01
aaauccaccagcac

SEQ ID NO: 1485332 - RNA, 23 nt, Pseudomonas aeruginosa PA01
aaaucgccguugccuucgccguc

SEQ ID NO: 1485333 - RNA, 15 nt, Pseudomonas aeruginosa PA01
aaaguuuuucgcggc

SEQ ID NO: 1485334 - RNA, 21 nt, Pseudomonas aeruginosa PA01
aaaacccuguuccgggcccag

SEQ ID NO: 1485335 - RNA, 16 nt, Pseudomonas aeruginosa PA01
acaaaaaagcccgcca

SEQ ID NO: 1485336 - RNA, 13 nt, Pseudomonas aeruginosa PA01
acaacaggccggg

SEQ ID NO: 1485337 - RNA, 20 nt, Pseudomonas aeruginosa PA01
acaaccgcucgcgguuaucc

SEQ ID NO: 1485338 - RNA, 19 nt, Pseudomonas aeruginosa PA01
acaacccggcgcuggccgc

SEQ ID NO: 1485339 - RNA, 21 nt, Pseudomonas aeruginosa PA01
acaacccggcgcuggccgcgc

SEQ ID NO: 1485340 - RNA, 13 nt, Pseudomonas aeruginosa PA01
acaacccgccagc

SEQ ID NO: 1485341 - RNA, 22 nt, Pseudomonas aeruginosa PA01
acaacccgccagcaagacgguc

SEQ ID NO: 1485342 - RNA, 14 nt, Pseudomonas aeruginosa PA01
acaacgccgccggc

SEQ ID NO: 1485343 - RNA, 14 nt, Pseudomonas aeruginosa PA01
acaacgacagcccc

SEQ ID NO: 1485344 - RNA, 12 nt, Pseudomonas aeruginosa PA01
acaagccgccuu

SEQ ID NO: 1485345 - RNA, 17 nt, Pseudomonas aeruginosa PA01
acaagccuccagcgccg

SEQ ID NO: 1485346 - RNA, 13 nt, Pseudomonas aeruginosa PA01
acaagcccagcuc

SEQ ID NO: 1485347 - RNA, 16 nt, Pseudomonas aeruginosa PA01
acaagcccugguggug

SEQ ID NO: 1485348 - RNA, 20 nt, Pseudomonas aeruginosa PA01
acaagaagccccgcuauggc

SEQ ID NO: 1485349 - RNA, 17 nt, Pseudomonas aeruginosa PA01
acaaucagcggcgggcg

SEQ ID NO: 1485350 - RNA, 20 nt, Pseudomonas aeruginosa PA01
acacacgcuucugcuggccg

SEQ ID NO: 1485351 - RNA, 22 nt, Pseudomonas aeruginosa PA01
acacacgcuucugcuggccgcg

SEQ ID NO: 1485352 - RNA, 23 nt, Pseudomonas aeruginosa PA01
acacacgcuucugcuggccgcgc

SEQ ID NO: 1485353 - RNA, 17 nt, Pseudomonas aeruginosa PA01
acacacccugcgcaagg

SEQ ID NO: 1485354 - RNA, 18 nt, Pseudomonas aeruginosa PA01
acaaugaaaaacgccggc

SEQ ID NO: 1485355 - RNA, 21 nt, Pseudomonas aeruginosa PA01
acaaugauggcccuucgcccu

SEQ ID NO: 1485356 - RNA, 17 nt, Pseudomonas aeruginosa PA01
aaugcccggcagcgccg

SEQ ID NO: 1485357 - RNA, 15 nt, Pseudomonas aeruginosa PA01
aaugcccagcgcagg

SEQ ID NO: 1485358 - RNA, 16 nt, Pseudomonas aeruginosa PA01
aaugcccagcgcaggc

SEQ ID NO: 1485359 - RNA, 16 nt, Pseudomonas aeruginosa PA01
aaugagaggugggccg

SEQ ID NO: 1485360 - RNA, 14 nt, Pseudomonas aeruginosa PA01
aauggcgcagccgc

SEQ ID NO: 1485361 - RNA, 15 nt, Pseudomonas aeruginosa PA01
aauggcgcagccgcu

SEQ ID NO: 1485362 - RNA, 15 nt, Pseudomonas aeruginosa PA01
aaugcggcguggaag

SEQ ID NO: 1485363 - RNA, 14 nt, Pseudomonas aeruginosa PA01
aaucaccgccaccu

SEQ ID NO: 1485364 - RNA, 15 nt, Pseudomonas aeruginosa PA01
aauggcuucuugagc

SEQ ID NO: 1485365 - RNA, 14 nt, Pseudomonas aeruginosa PA01
aauggcuugcgacc

SEQ ID NO: 1485366 - RNA, 19 nt, Pseudomonas aeruginosa PA01
aauggcguggcuuggcccu

SEQ ID NO: 1485367 - RNA, 17 nt, Pseudomonas aeruginosa PA01
aauggcggacgaucacu

SEQ ID NO: 1485368 - RNA, 16 nt, Pseudomonas aeruginosa PA01
aauugccagaggcugc

SEQ ID NO: 1485369 - RNA, 20 nt, Pseudomonas aeruginosa PA01
acaccccgaaguagcgacgg

SEQ ID NO: 1485370 - RNA, 15 nt, Pseudomonas aeruginosa PA01
acacccgguccugca

SEQ ID NO: 1485371 - RNA, 22 nt, Pseudomonas aeruginosa PA01
acacccggucgcgcuggaccug

SEQ ID NO: 1485372 - RNA, 16 nt, Pseudomonas aeruginosa PA01
acacccgcgccgccgc

SEQ ID NO: 1485373 - RNA, 23 nt, Pseudomonas aeruginosa PA01
acacccugcgcaaggaacuggaa

SEQ ID NO: 1485374 - RNA, 17 nt, Pseudomonas aeruginosa PA01
acaccgaagucgcccgc

SEQ ID NO: 1485375 - RNA, 22 nt, Pseudomonas aeruginosa PA01
acaccgaagucgcccgccggcg

SEQ ID NO: 1485376 - RNA, 17 nt, Pseudomonas aeruginosa PA01
acaccgcaucgaagcgc

SEQ ID NO: 1485377 - RNA, 22 nt, Pseudomonas aeruginosa PA01
acaccgagcgcaguucgucgcc

SEQ ID NO: 1485378 - RNA, 14 nt, Pseudomonas aeruginosa PA01
acaccgaccgcgag

SEQ ID NO: 1485379 - RNA, 20 nt, Pseudomonas aeruginosa PA01
acaccgcggugucggugccc

SEQ ID NO: 1485380 - RNA, 13 nt, Pseudomonas aeruginosa PA01
acaccgcgcgcgc

SEQ ID NO: 1485381 - RNA, 15 nt, Pseudomonas aeruginosa PA01
acaccgcgcgcgccu

SEQ ID NO: 1485382 - RNA, 23 nt, Pseudomonas aeruginosa PA01
acaccgcgcagaugaucgccacc

SEQ ID NO: 1485383 - RNA, 19 nt, Pseudomonas aeruginosa PA01
acaccgcugcgccgccguc

SEQ ID NO: 1485384 - RNA, 19 nt, Pseudomonas aeruginosa PA01
acaccggcgccgccuggcc

SEQ ID NO: 1485385 - RNA, 17 nt, Pseudomonas aeruginosa PA01
acaccgggccgccggcg

SEQ ID NO: 1485386 - RNA, 20 nt, Pseudomonas aeruginosa PA01
acaccgggccgccggcgacg

SEQ ID NO: 1485387 - RNA, 15 nt, Pseudomonas aeruginosa PA01
acaccaggagcgcca

SEQ ID NO: 1485388 - RNA, 16 nt, Pseudomonas aeruginosa PA01
acaccaggagcgccag

SEQ ID NO: 1485389 - RNA, 18 nt, Pseudomonas aeruginosa PA01
acaccaggccggcggccg

SEQ ID NO: 1485390 - RNA, 13 nt, Pseudomonas aeruginosa PA01
acaccaggcgcca

SEQ ID NO: 1485391 - RNA, 12 nt, Pseudomonas aeruginosa PA01
acaccaggucgc

SEQ ID NO: 1485392 - RNA, 15 nt, Pseudomonas aeruginosa PA01
acaccaggucgccgc

SEQ ID NO: 1485393 - RNA, 13 nt, Pseudomonas aeruginosa PA01
acaccagguuggc

SEQ ID NO: 1485394 - RNA, 15 nt, Pseudomonas aeruginosa PA01
acaccaugcuccgcc

SEQ ID NO: 1485395 - RNA, 17 nt, Pseudomonas aeruginosa PA01
acacccagaagccgacc

SEQ ID NO: 1485396 - RNA, 14 nt, Pseudomonas aeruginosa PA01
acacccaggccugg

SEQ ID NO: 1485397 - RNA, 13 nt, Pseudomonas aeruginosa PA01
acacccagggcag

SEQ ID NO: 1485398 - RNA, 18 nt, Pseudomonas aeruginosa PA01
acacggauauccgggccc

SEQ ID NO: 1485399 - RNA, 19 nt, Pseudomonas aeruginosa PA01
acacgcuucugcuggccgc

SEQ ID NO: 1485400 - RNA, 23 nt, Pseudomonas aeruginosa PA01
acacgcuucugcuggccgcgcag

SEQ ID NO: 1485401 - RNA, 19 nt, Pseudomonas aeruginosa PA01
acaccuggucuucgguggc

SEQ ID NO: 1485402 - RNA, 21 nt, Pseudomonas aeruginosa PA01
acaccuggucuucgguggcgg

SEQ ID NO: 1485403 - RNA, 15 nt, Pseudomonas aeruginosa PA01
acaccuuggcgcgac

SEQ ID NO: 1485404 - RNA, 14 nt, Pseudomonas aeruginosa PA01
acaccucccgggcc

SEQ ID NO: 1485405 - RNA, 18 nt, Pseudomonas aeruginosa PA01
acaccucgaucagcgggu

SEQ ID NO: 1485406 - RNA, 21 nt, Pseudomonas aeruginosa PA01
acaccguuggcguuaugcgcc

SEQ ID NO: 1485407 - RNA, 17 nt, Pseudomonas aeruginosa PA01
acaccguguugaucgcc

SEQ ID NO: 1485408 - RNA, 22 nt, Pseudomonas aeruginosa PA01
acaccguguugaucgccgcgcc

SEQ ID NO: 1485409 - RNA, 22 nt, Pseudomonas aeruginosa PA01
acaggcgauagccgaccaggcc

SEQ ID NO: 1485410 - RNA, 21 nt, Pseudomonas aeruginosa PA01
acaggcgucccuggagcaggg

SEQ ID NO: 1485411 - RNA, 11 nt, Pseudomonas aeruginosa PA01
acaggcggcgg

SEQ ID NO: 1485412 - RNA, 20 nt, Pseudomonas aeruginosa PA01
acaggcggcggaagaagccc

SEQ ID NO: 1485413 - RNA, 11 nt, Pseudomonas aeruginosa PA01
acaggcgccag

SEQ ID NO: 1485414 - RNA, 16 nt, Pseudomonas aeruginosa PA01
acaggcgcuucagcuc

SEQ ID NO: 1485415 - RNA, 15 nt, Pseudomonas aeruginosa PA01
acaggcguaccagcu

SEQ ID NO: 1485416 - RNA, 14 nt, Pseudomonas aeruginosa PA01
acaggcucgaggcc

SEQ ID NO: 1485417 - RNA, 15 nt, Pseudomonas aeruginosa PA01
acaggucgacgccau

SEQ ID NO: 1485418 - RNA, 14 nt, Pseudomonas aeruginosa PA01
acaggucgcggaag

SEQ ID NO: 1485419 - RNA, 18 nt, Pseudomonas aeruginosa PA01
acaggugcugguggcccu

SEQ ID NO: 1485420 - RNA, 16 nt, Pseudomonas aeruginosa PA01
acagguuguucggcga

SEQ ID NO: 1485421 - RNA, 13 nt, Pseudomonas aeruginosa PA01
acagcuucaggcg

SEQ ID NO: 1485422 - RNA, 15 nt, Pseudomonas aeruginosa PA01
acagcuucaggcgca

SEQ ID NO: 1485423 - RNA, 22 nt, Pseudomonas aeruginosa PA01
acagcuuggccagcaggccgag

SEQ ID NO: 1485424 - RNA, 15 nt, Pseudomonas aeruginosa PA01
acaggccuccagcaa

SEQ ID NO: 1485425 - RNA, 19 nt, Pseudomonas aeruginosa PA01
acaggcgacgguaccaggg

SEQ ID NO: 1485426 - RNA, 15 nt, Pseudomonas aeruginosa PA01
acaggccgggcggcg

SEQ ID NO: 1485427 - RNA, 16 nt, Pseudomonas aeruginosa PA01
acaggagccaucgcuc

SEQ ID NO: 1485428 - RNA, 13 nt, Pseudomonas aeruginosa PA01
acagcugcaccgc

SEQ ID NO: 1485429 - RNA, 21 nt, Pseudomonas aeruginosa PA01
acagcgggucgcggcuggccg

SEQ ID NO: 1485430 - RNA, 15 nt, Pseudomonas aeruginosa PA01
acagcgggucggcga

SEQ ID NO: 1485431 - RNA, 14 nt, Pseudomonas aeruginosa PA01
acagcggcuggccc

SEQ ID NO: 1485432 - RNA, 14 nt, Pseudomonas aeruginosa PA01
acagcggcuggcgc

SEQ ID NO: 1485433 - RNA, 14 nt, Pseudomonas aeruginosa PA01
acagcgcuuccugg

SEQ ID NO: 1485434 - RNA, 21 nt, Pseudomonas aeruginosa PA01
acagcgacucgcugccggcgc

SEQ ID NO: 1485435 - RNA, 23 nt, Pseudomonas aeruginosa PA01
acagcgacucgcugccggcgcgc

SEQ ID NO: 1485436 - RNA, 14 nt, Pseudomonas aeruginosa PA01
acagcgaggcccgc

SEQ ID NO: 1485437 - RNA, 22 nt, Pseudomonas aeruginosa PA01
acagcgaaugcuugccggcgcc

SEQ ID NO: 1485438 - RNA, 15 nt, Pseudomonas aeruginosa PA01
acagccugggcggcu

SEQ ID NO: 1485439 - RNA, 18 nt, Pseudomonas aeruginosa PA01
acagccuucgagccacuc

SEQ ID NO: 1485440 - RNA, 16 nt, Pseudomonas aeruginosa PA01
acagcaggagcgccau

SEQ ID NO: 1485441 - RNA, 19 nt, Pseudomonas aeruginosa PA01
acagcagggaggcgcacau

SEQ ID NO: 1485442 - RNA, 11 nt, Pseudomonas aeruginosa PA01
acagcaggcag

SEQ ID NO: 1485443 - RNA, 13 nt, Pseudomonas aeruginosa PA01
acagcaggcaggc

SEQ ID NO: 1485444 - RNA, 14 nt, Pseudomonas aeruginosa PA01
acagcagcucgccg

SEQ ID NO: 1485445 - RNA, 19 nt, Pseudomonas aeruginosa PA01
acacgugccccaggccgaa

SEQ ID NO: 1485446 - RNA, 13 nt, Pseudomonas aeruginosa PA01
acacguucaggcg

SEQ ID NO: 1485447 - RNA, 18 nt, Pseudomonas aeruginosa PA01
acacuuccuucucccggc

SEQ ID NO: 1485448 - RNA, 13 nt, Pseudomonas aeruginosa PA01
acagcaccacgcu

SEQ ID NO: 1485449 - RNA, 20 nt, Pseudomonas aeruginosa PA01
acagcaccuuggccaugggc

SEQ ID NO: 1485450 - RNA, 16 nt, Pseudomonas aeruginosa PA01
acagcacgauggcgag

SEQ ID NO: 1485451 - RNA, 16 nt, Pseudomonas aeruginosa PA01
acagaucuuccucgga

SEQ ID NO: 1485452 - RNA, 19 nt, Pseudomonas aeruginosa PA01
acagaucgccagcucgccg

SEQ ID NO: 1485453 - RNA, 12 nt, Pseudomonas aeruginosa PA01
acagagcggccg

SEQ ID NO: 1485454 - RNA, 14 nt, Pseudomonas aeruginosa PA01
acagagcggccggc

SEQ ID NO: 1485455 - RNA, 15 nt, Pseudomonas aeruginosa PA01
acagagcggccggcg

SEQ ID NO: 1485456 - RNA, 16 nt, Pseudomonas aeruginosa PA01
acagagcggccggcgc

SEQ ID NO: 1485457 - RNA, 13 nt, Pseudomonas aeruginosa PA01
aaggucggcagca

SEQ ID NO: 1485458 - RNA, 16 nt, Pseudomonas aeruginosa PA01
aaggucucgccgccgg

SEQ ID NO: 1485459 - RNA, 16 nt, Pseudomonas aeruginosa PA01
aagguccgcgccaugc

SEQ ID NO: 1485460 - RNA, 14 nt, Pseudomonas aeruginosa PA01
aaggucgccgcgcu

SEQ ID NO: 1485461 - RNA, 11 nt, Pseudomonas aeruginosa PA01
aaggucggcga

SEQ ID NO: 1485462 - RNA, 17 nt, Pseudomonas aeruginosa PA01
aaggucggcgcaagcgg

SEQ ID NO: 1485463 - RNA, 15 nt, Pseudomonas aeruginosa PA01
aaggucggcggcagc

SEQ ID NO: 1485464 - RNA, 19 nt, Pseudomonas aeruginosa PA01
aagguacggggcugcggcc

SEQ ID NO: 1485465 - RNA, 20 nt, Pseudomonas aeruginosa PA01
aagguaguccaucaccgcgg

SEQ ID NO: 1485466 - RNA, 22 nt, Pseudomonas aeruginosa PA01
aaggcgaaccacaccaggucgc

SEQ ID NO: 1485467 - RNA, 18 nt, Pseudomonas aeruginosa PA01
aaggccgccacggcgguu

SEQ ID NO: 1485468 - RNA, 18 nt, Pseudomonas aeruginosa PA01
aaggccgcguaagcggcc

SEQ ID NO: 1485469 - RNA, 12 nt, Pseudomonas aeruginosa PA01
aaggccucggca

SEQ ID NO: 1485470 - RNA, 21 nt, Pseudomonas aeruginosa PA01
aaggccucgucgaucucgccg

SEQ ID NO: 1485471 - RNA, 21 nt, Pseudomonas aeruginosa PA01
aaggccugcgcuuccggcagc

SEQ ID NO: 1485472 - RNA, 20 nt, Pseudomonas aeruginosa PA01
aaggccuggaacaccaggcc

SEQ ID NO: 1485473 - RNA, 15 nt, Pseudomonas aeruginosa PA01
aaggcaacagcccgc

SEQ ID NO: 1485474 - RNA, 23 nt, Pseudomonas aeruginosa PA01
aaggaugggaacgaguugggcga

SEQ ID NO: 1485475 - RNA, 17 nt, Pseudomonas aeruginosa PA01
aaggauuuccgcggccg

SEQ ID NO: 1485476 - RNA, 15 nt, Pseudomonas aeruginosa PA01
aaggccacgccgccg

SEQ ID NO: 1485477 - RNA, 15 nt, Pseudomonas aeruginosa PA01
aaggccaccagagcc

SEQ ID NO: 1485478 - RNA, 18 nt, Pseudomonas aeruginosa PA01
aaggccagcucgucgccc

SEQ ID NO: 1485479 - RNA, 14 nt, Pseudomonas aeruginosa PA01
aaggccaggaccgc

SEQ ID NO: 1485480 - RNA, 17 nt, Pseudomonas aeruginosa PA01
aaggccaggccggcgcc

SEQ ID NO: 1485481 - RNA, 13 nt, Pseudomonas aeruginosa PA01
aaggccaggucgc

SEQ ID NO: 1485482 - RNA, 18 nt, Pseudomonas aeruginosa PA01
aaggccaggucgcccacc

SEQ ID NO: 1485483 - RNA, 20 nt, Pseudomonas aeruginosa PA01
aaggcccgcgagccgcgcag

SEQ ID NO: 1485484 - RNA, 11 nt, Pseudomonas aeruginosa PA01
aaggcccggag

SEQ ID NO: 1485485 - RNA, 20 nt, Pseudomonas aeruginosa PA01
aaggcccggcguccucgcga

SEQ ID NO: 1485486 - RNA, 21 nt, Pseudomonas aeruginosa PA01
aaggcccggucuagccgggcc

SEQ ID NO: 1485487 - RNA, 17 nt, Pseudomonas aeruginosa PA01
aaggcaugcccaggcuc

SEQ ID NO: 1485488 - RNA, 13 nt, Pseudomonas aeruginosa PA01
aaggcagcguccg

SEQ ID NO: 1485489 - RNA, 13 nt, Pseudomonas aeruginosa PA01
aagcggucgccgg

SEQ ID NO: 1485490 - RNA, 15 nt, Pseudomonas aeruginosa PA01
aagcggucgccggcg

SEQ ID NO: 1485491 - RNA, 14 nt, Pseudomonas aeruginosa PA01
aagcggcucggcca

SEQ ID NO: 1485492 - RNA, 17 nt, Pseudomonas aeruginosa PA01
aagcgguuagccggcga

SEQ ID NO: 1485493 - RNA, 16 nt, Pseudomonas aeruginosa PA01
aagcggcgacgccacc

SEQ ID NO: 1485494 - RNA, 19 nt, Pseudomonas aeruginosa PA01
aagcggcgacgccacccgc

SEQ ID NO: 1485495 - RNA, 21 nt, Pseudomonas aeruginosa PA01
aagcggcgacgccacccgcau

SEQ ID NO: 1485496 - RNA, 20 nt, Pseudomonas aeruginosa PA01
aagcggguucccugcgccuc

SEQ ID NO: 1485497 - RNA, 22 nt, Pseudomonas aeruginosa PA01
aagcgguagugggcgaggcgcu

SEQ ID NO: 1485498 - RNA, 14 nt, Pseudomonas aeruginosa PA01
aagcgccccgggcg

SEQ ID NO: 1485499 - RNA, 14 nt, Pseudomonas aeruginosa PA01
aagcgcccgcgcau

SEQ ID NO: 1485500 - RNA, 20 nt, Pseudomonas aeruginosa PA01
aagccggccccugggccggc

SEQ ID NO: 1485501 - RNA, 21 nt, Pseudomonas aeruginosa PA01
aagccguuguagaucggcagc

SEQ ID NO: 1485502 - RNA, 15 nt, Pseudomonas aeruginosa PA01
aagccuccagcgccg

SEQ ID NO: 1485503 - RNA, 17 nt, Pseudomonas aeruginosa PA01
aagcgcaacgcgcgcag

SEQ ID NO: 1485504 - RNA, 13 nt, Pseudomonas aeruginosa PA01
aagcgcagcaggu

SEQ ID NO: 1485505 - RNA, 15 nt, Pseudomonas aeruginosa PA01
aagcgcagcuccggc

SEQ ID NO: 1485506 - RNA, 20 nt, Pseudomonas aeruginosa PA01
aagcgcaggccgccggcggc

SEQ ID NO: 1485507 - RNA, 11 nt, Pseudomonas aeruginosa PA01
aagcgcaggcg

SEQ ID NO: 1485508 - RNA, 19 nt, Pseudomonas aeruginosa PA01
aagcgcaggcggcuggcgc

SEQ ID NO: 1485509 - RNA, 14 nt, Pseudomonas aeruginosa PA01
aagcgcaggugcac

SEQ ID NO: 1485510 - RNA, 20 nt, Pseudomonas aeruginosa PA01
aagcgcaguacccggccgcc

SEQ ID NO: 1485511 - RNA, 20 nt, Pseudomonas aeruginosa PA01
aagcgaucggaagaucgccc

SEQ ID NO: 1485512 - RNA, 21 nt, Pseudomonas aeruginosa PA01
aagcgaucuccugccgcggcg

SEQ ID NO: 1485513 - RNA, 22 nt, Pseudomonas aeruginosa PA01
aagcgaucuccugccgcggcga

SEQ ID NO: 1485514 - RNA, 17 nt, Pseudomonas aeruginosa PA01
aagccucgcgacugcug

SEQ ID NO: 1485515 - RNA, 22 nt, Pseudomonas aeruginosa PA01
aagcccgugggaucgccacgcc

SEQ ID NO: 1485516 - RNA, 21 nt, Pseudomonas aeruginosa PA01
aagcccuuguucgggucgcgg

SEQ ID NO: 1485517 - RNA, 20 nt, Pseudomonas aeruginosa PA01
aagcccugcaaagcggcgac

SEQ ID NO: 1485518 - RNA, 12 nt, Pseudomonas aeruginosa PA01
aagccgaucacc

SEQ ID NO: 1485519 - RNA, 21 nt, Pseudomonas aeruginosa PA01
aagccgaugaaauagccggcg

SEQ ID NO: 1485520 - RNA, 22 nt, Pseudomonas aeruginosa PA01
aagccgaugaaauagccggcga

SEQ ID NO: 1485521 - RNA, 15 nt, Pseudomonas aeruginosa PA01
aagccgacgccgagc

SEQ ID NO: 1485522 - RNA, 15 nt, Pseudomonas aeruginosa PA01
aagcccugcuggcgc

SEQ ID NO: 1485523 - RNA, 18 nt, Pseudomonas aeruginosa PA01
aagccgaccggcgccggg

SEQ ID NO: 1485524 - RNA, 15 nt, Pseudomonas aeruginosa PA01
aagccgagcugccgg

SEQ ID NO: 1485525 - RNA, 21 nt, Pseudomonas aeruginosa PA01
aagccgccgggaaucuggccg

SEQ ID NO: 1485526 - RNA, 20 nt, Pseudomonas aeruginosa PA01
aagccgcgcaaggcagcguc

SEQ ID NO: 1485527 - RNA, 19 nt, Pseudomonas aeruginosa PA01
aagccgcgcagcacuuccu

SEQ ID NO: 1485528 - RNA, 18 nt, Pseudomonas aeruginosa PA01
aagccgcgccccagcggc

SEQ ID NO: 1485529 - RNA, 22 nt, Pseudomonas aeruginosa PA01
aagccgcgccccagcggcaggc

SEQ ID NO: 1485530 - RNA, 20 nt, Pseudomonas aeruginosa PA01
aagccgccgcccagcagcac

SEQ ID NO: 1485531 - RNA, 18 nt, Pseudomonas aeruginosa PA01
aagccgccgccgcgccgg

SEQ ID NO: 1485532 - RNA, 12 nt, Pseudomonas aeruginosa PA01
aagccgcagcgc

SEQ ID NO: 1485533 - RNA, 13 nt, Pseudomonas aeruginosa PA01
aagccgcagcgcc

SEQ ID NO: 1485534 - RNA, 14 nt, Pseudomonas aeruginosa PA01
aagccgcucggcgu

SEQ ID NO: 1485535 - RNA, 20 nt, Pseudomonas aeruginosa PA01
aagccgcucggcguagccgg

SEQ ID NO: 1485536 - RNA, 23 nt, Pseudomonas aeruginosa PA01
aagccgcucggcguagccggcga

SEQ ID NO: 1485537 - RNA, 19 nt, Pseudomonas aeruginosa PA01
aagccgcugaccucgguga

SEQ ID NO: 1485538 - RNA, 14 nt, Pseudomonas aeruginosa PA01
aagccggaagcgcu

SEQ ID NO: 1485539 - RNA, 15 nt, Pseudomonas aeruginosa PA01
aagacguuccgcgau

SEQ ID NO: 1485540 - RNA, 17 nt, Pseudomonas aeruginosa PA01
aagcauuucuucaccac

SEQ ID NO: 1485541 - RNA, 21 nt, Pseudomonas aeruginosa PA01
aagacguacagcgggucggcg

SEQ ID NO: 1485542 - RNA, 22 nt, Pseudomonas aeruginosa PA01
aagacguacagcgggucggcga

SEQ ID NO: 1485543 - RNA, 19 nt, Pseudomonas aeruginosa PA01
aagacgaaguuggcggccg

SEQ ID NO: 1485544 - RNA, 16 nt, Pseudomonas aeruginosa PA01
aaguucaccucgguga

SEQ ID NO: 1485545 - RNA, 15 nt, Pseudomonas aeruginosa PA01
aagugcccugggcga

SEQ ID NO: 1485546 - RNA, 21 nt, Pseudomonas aeruginosa PA01
aagugcgcugcuugaacaccu

SEQ ID NO: 1485547 - RNA, 14 nt, Pseudomonas aeruginosa PA01
aaggugcaggccgc

SEQ ID NO: 1485548 - RNA, 22 nt, Pseudomonas aeruginosa PA01
aagucgcgagguuccgcggcga

SEQ ID NO: 1485549 - RNA, 14 nt, Pseudomonas aeruginosa PA01
aagguggcgaccug

SEQ ID NO: 1485550 - RNA, 15 nt, Pseudomonas aeruginosa PA01
aagucgcccgccggc

SEQ ID NO: 1485551 - RNA, 16 nt, Pseudomonas aeruginosa PA01
aagucgcccgccggcg

SEQ ID NO: 1485552 - RNA, 17 nt, Pseudomonas aeruginosa PA01
aagucgcccgccggcgu

SEQ ID NO: 1485553 - RNA, 16 nt, Pseudomonas aeruginosa PA01
aagucggcgagccggc

SEQ ID NO: 1485554 - RNA, 15 nt, Pseudomonas aeruginosa PA01
aagugaagcgaucca

SEQ ID NO: 1485555 - RNA, 14 nt, Pseudomonas aeruginosa PA01
aagugaccgcgcgc

SEQ ID NO: 1485556 - RNA, 19 nt, Pseudomonas aeruginosa PA01
aaguuguacagcgaggccc

SEQ ID NO: 1485557 - RNA, 15 nt, Pseudomonas aeruginosa PA01
aaguugcgcacccgc

SEQ ID NO: 1485558 - RNA, 19 nt, Pseudomonas aeruginosa PA01
aaguugccgccgcuggccu

SEQ ID NO: 1485559 - RNA, 18 nt, Pseudomonas aeruginosa PA01
aaguugcaggccagcgcc

SEQ ID NO: 1485560 - RNA, 17 nt, Pseudomonas aeruginosa PA01
aauacucgucgacggcc

SEQ ID NO: 1485561 - RNA, 18 nt, Pseudomonas aeruginosa PA01
aacaccgggccgccggcg

SEQ ID NO: 1485562 - RNA, 17 nt, Pseudomonas aeruginosa PA01
aacaccgcgcagaugau

SEQ ID NO: 1485563 - RNA, 18 nt, Pseudomonas aeruginosa PA01
aacaccuggcgcucgccg

SEQ ID NO: 1485564 - RNA, 14 nt, Pseudomonas aeruginosa PA01
aaccggcgaaccag

SEQ ID NO: 1485565 - RNA, 18 nt, Pseudomonas aeruginosa PA01
aaccggcguccucggaga

SEQ ID NO: 1485566 - RNA, 14 nt, Pseudomonas aeruginosa PA01
aaccggccagcgca

SEQ ID NO: 1485567 - RNA, 17 nt, Pseudomonas aeruginosa PA01
aaccucgccgaucuccu

SEQ ID NO: 1485568 - RNA, 19 nt, Pseudomonas aeruginosa PA01
aaccugccugcgcagggcu

SEQ ID NO: 1485569 - RNA, 19 nt, Pseudomonas aeruginosa PA01
aaccguucugccgcagcgc

SEQ ID NO: 1485570 - RNA, 13 nt, Pseudomonas aeruginosa PA01
aaccgucgcccug

SEQ ID NO: 1485571 - RNA, 23 nt, Pseudomonas aeruginosa PA01
aaccgguuucccucgagcaccgc

SEQ ID NO: 1485572 - RNA, 18 nt, Pseudomonas aeruginosa PA01
aaccggaaaagaagccgc

SEQ ID NO: 1485573 - RNA, 18 nt, Pseudomonas aeruginosa PA01
aaccggguaccugcucgc

SEQ ID NO: 1485574 - RNA, 21 nt, Pseudomonas aeruginosa PA01
aaccggguaccugcucgcggg

SEQ ID NO: 1485575 - RNA, 22 nt, Pseudomonas aeruginosa PA01
aacgcugcaauucgucggccug

SEQ ID NO: 1485576 - RNA, 23 nt, Pseudomonas aeruginosa PA01
aacgcugcaauucgucggccugc

SEQ ID NO: 1485577 - RNA, 12 nt, Pseudomonas aeruginosa PA01
aacgcucggcgu

SEQ ID NO: 1485578 - RNA, 17 nt, Pseudomonas aeruginosa PA01
aacgcuugagcuggcgc

SEQ ID NO: 1485579 - RNA, 23 nt, Pseudomonas aeruginosa PA01
aacgcuucgaagcucucgccgcg

SEQ ID NO: 1485580 - RNA, 17 nt, Pseudomonas aeruginosa PA01
aacgcggguugcccggc

SEQ ID NO: 1485581 - RNA, 16 nt, Pseudomonas aeruginosa PA01
aacgccuuccuugucg

SEQ ID NO: 1485582 - RNA, 21 nt, Pseudomonas aeruginosa PA01
aacgccuggugcaggucgcgc

SEQ ID NO: 1485583 - RNA, 17 nt, Pseudomonas aeruginosa PA01
aacgccugucgcuccgg

SEQ ID NO: 1485584 - RNA, 18 nt, Pseudomonas aeruginosa PA01
aacgccugucgcuccggc

SEQ ID NO: 1485585 - RNA, 20 nt, Pseudomonas aeruginosa PA01
aacgccugucgcuccggcag

SEQ ID NO: 1485586 - RNA, 23 nt, Pseudomonas aeruginosa PA01
aacgcccggcuuuccucggccau

SEQ ID NO: 1485587 - RNA, 21 nt, Pseudomonas aeruginosa PA01
aacgcccugacccgcaccggc

SEQ ID NO: 1485588 - RNA, 22 nt, Pseudomonas aeruginosa PA01
aacgccccucuuccacgcgccg

SEQ ID NO: 1485589 - RNA, 14 nt, Pseudomonas aeruginosa PA01
aacgcccgcggcag

SEQ ID NO: 1485590 - RNA, 13 nt, Pseudomonas aeruginosa PA01
aacgccguuggcg

SEQ ID NO: 1485591 - RNA, 17 nt, Pseudomonas aeruginosa PA01
aacgccggucauugucg

SEQ ID NO: 1485592 - RNA, 22 nt, Pseudomonas aeruginosa PA01
aacgccgacaggccggugccgc

SEQ ID NO: 1485593 - RNA, 22 nt, Pseudomonas aeruginosa PA01
aaccuguggaauguccugccgc

SEQ ID NO: 1485594 - RNA, 18 nt, Pseudomonas aeruginosa PA01
aacgaccacgccugccau

SEQ ID NO: 1485595 - RNA, 20 nt, Pseudomonas aeruginosa PA01
aacgaggcucggucgcgcgg

SEQ ID NO: 1485596 - RNA, 12 nt, Pseudomonas aeruginosa PA01
aacgaggcgacc

SEQ ID NO: 1485597 - RNA, 17 nt, Pseudomonas aeruginosa PA01
aacgccaccgcgcgccc

SEQ ID NO: 1485598 - RNA, 15 nt, Pseudomonas aeruginosa PA01
aacgccaacggcguu

SEQ ID NO: 1485599 - RNA, 22 nt, Pseudomonas aeruginosa PA01
aacggcgcuuucaucaggcgcu

SEQ ID NO: 1485600 - RNA, 19 nt, Pseudomonas aeruginosa PA01
aacggcagccgcguugucc

SEQ ID NO: 1485601 - RNA, 23 nt, Pseudomonas aeruginosa PA01
aacggcagguggucguugcgcgc

SEQ ID NO: 1485602 - RNA, 12 nt, Pseudomonas aeruginosa PA01
aacggcagcgcu

SEQ ID NO: 1485603 - RNA, 12 nt, Pseudomonas aeruginosa PA01
aacggcgaccgc

SEQ ID NO: 1485604 - RNA, 16 nt, Pseudomonas aeruginosa PA01
aacucaucaggcugcc

SEQ ID NO: 1485605 - RNA, 17 nt, Pseudomonas aeruginosa PA01
aacucaucaggcugccg

SEQ ID NO: 1485606 - RNA, 14 nt, Pseudomonas aeruginosa PA01
aacucagucgaggu

SEQ ID NO: 1485607 - RNA, 16 nt, Pseudomonas aeruginosa PA01
aacucgaucagcgcgg

SEQ ID NO: 1485608 - RNA, 17 nt, Pseudomonas aeruginosa PA01
aacucgaucagcgcggc

SEQ ID NO: 1485609 - RNA, 23 nt, Pseudomonas aeruginosa PA01
aacucgacuucuucgcuggacca

SEQ ID NO: 1485610 - RNA, 15 nt, Pseudomonas aeruginosa PA01
aacuccgccagcacc

SEQ ID NO: 1485611 - RNA, 22 nt, Pseudomonas aeruginosa PA01
aacuccgccagcaccacccggc

SEQ ID NO: 1485612 - RNA, 15 nt, Pseudomonas aeruginosa PA01
aacucgccgccgaca

SEQ ID NO: 1485613 - RNA, 20 nt, Pseudomonas aeruginosa PA01
aacucgccgccgacacccgc

SEQ ID NO: 1485614 - RNA, 12 nt, Pseudomonas aeruginosa PA01
aacucggcgccg

SEQ ID NO: 1485615 - RNA, 12 nt, Pseudomonas aeruginosa PA01
aacucuggcggc

SEQ ID NO: 1485616 - RNA, 21 nt, Pseudomonas aeruginosa PA01
aacugcccgcaggggcugccg

SEQ ID NO: 1485617 - RNA, 17 nt, Pseudomonas aeruginosa PA01
aacugccgcccgcucaa

SEQ ID NO: 1485618 - RNA, 18 nt, Pseudomonas aeruginosa PA01
aacugccgggccagcucc

SEQ ID NO: 1485619 - RNA, 15 nt, Pseudomonas aeruginosa PA01
aacugagcggcggca

SEQ ID NO: 1485620 - RNA, 20 nt, Pseudomonas aeruginosa PA01
aacugccaaccgcgcucggc

SEQ ID NO: 1485621 - RNA, 16 nt, Pseudomonas aeruginosa PA01
aacuuccacucgccga

SEQ ID NO: 1485622 - RNA, 18 nt, Pseudomonas aeruginosa PA01
aacuuccacucgccgacc

SEQ ID NO: 1485623 - RNA, 14 nt, Pseudomonas aeruginosa PA01
aacuucaggccggc

SEQ ID NO: 1485624 - RNA, 20 nt, Pseudomonas aeruginosa PA01
aacuugcgccgaccgcgcgc

SEQ ID NO: 1485625 - RNA, 13 nt, Pseudomonas aeruginosa PA01
aacugucggcgga

SEQ ID NO: 1485626 - RNA, 17 nt, Pseudomonas aeruginosa PA01
aacugguuggccgccug

SEQ ID NO: 1485627 - RNA, 14 nt, Pseudomonas aeruginosa PA01
aacuggucgccgca

SEQ ID NO: 1485628 - RNA, 20 nt, Pseudomonas aeruginosa PA01
aacuggucgcggcugcgcgc

SEQ ID NO: 1485629 - RNA, 24 nt, Pseudomonas aeruginosa PA01
aacuggucggggcgcaaggccagc

SEQ ID NO: 1485630 - RNA, 14 nt, Pseudomonas aeruginosa PA01
aacuggaagccugc

SEQ ID NO: 1485631 - RNA, 16 nt, Pseudomonas aeruginosa PA01
aacugcuucaggcgcg

SEQ ID NO: 1485632 - RNA, 17 nt, Pseudomonas aeruginosa PA01
aacugcuucaggcgcgc

SEQ ID NO: 1485633 - RNA, 16 nt, Pseudomonas aeruginosa PA01
aagaagcugccggcau

SEQ ID NO: 1485634 - RNA, 19 nt, Pseudomonas aeruginosa PA01
aagaaguaaucaccuuccu

SEQ ID NO: 1485635 - RNA, 19 nt, Pseudomonas aeruginosa PA01
aagacccggcguucgccgg

SEQ ID NO: 1485636 - RNA, 19 nt, Pseudomonas aeruginosa PA01
aagaccagcggagcgucgg

SEQ ID NO: 1485637 - RNA, 15 nt, Pseudomonas aeruginosa PA01
aagaccagucggccg

SEQ ID NO: 1485638 - RNA, 14 nt, Pseudomonas aeruginosa PA01
aagaacgccccgca

SEQ ID NO: 1485639 - RNA, 22 nt, Pseudomonas aeruginosa PA01
aagaacaucgccugcuuggcgg

SEQ ID NO: 1485640 - RNA, 12 nt, Pseudomonas aeruginosa PA01
acgacgccggug

SEQ ID NO: 1485641 - RNA, 14 nt, Pseudomonas aeruginosa PA01
acgagacgccgagg

SEQ ID NO: 1485642 - RNA, 19 nt, Pseudomonas aeruginosa PA01
acgagacguugacgaucgc

SEQ ID NO: 1485643 - RNA, 22 nt, Pseudomonas aeruginosa PA01
acgaggauuuccgcgcccggcu

SEQ ID NO: 1485644 - RNA, 23 nt, Pseudomonas aeruginosa PA01
acgaggauuuccgcgcccggcug

SEQ ID NO: 1485645 - RNA, 16 nt, Pseudomonas aeruginosa PA01
acgaggcgaggguggc

SEQ ID NO: 1485646 - RNA, 18 nt, Pseudomonas aeruginosa PA01
acgagcuuggccacuccg

SEQ ID NO: 1485647 - RNA, 21 nt, Pseudomonas aeruginosa PA01
acgaggaacgccucgcagagc

SEQ ID NO: 1485648 - RNA, 17 nt, Pseudomonas aeruginosa PA01
acgaggaaggcgcgcac

SEQ ID NO: 1485649 - RNA, 15 nt, Pseudomonas aeruginosa PA01
acgaggacgccgccg

SEQ ID NO: 1485650 - RNA, 19 nt, Pseudomonas aeruginosa PA01
acgaggcgcggcggaggcc

SEQ ID NO: 1485651 - RNA, 18 nt, Pseudomonas aeruginosa PA01
acgagguacaacggcauc

SEQ ID NO: 1485652 - RNA, 13 nt, Pseudomonas aeruginosa PA01
acgacgucggcgg

SEQ ID NO: 1485653 - RNA, 14 nt, Pseudomonas aeruginosa PA01
acgacgucggcggc

SEQ ID NO: 1485654 - RNA, 12 nt, Pseudomonas aeruginosa PA01
acgacucacccg

SEQ ID NO: 1485655 - RNA, 19 nt, Pseudomonas aeruginosa PA01
acgacgugcccauuuucca

SEQ ID NO: 1485656 - RNA, 20 nt, Pseudomonas aeruginosa PA01
acgauguuguugcccaccag

SEQ ID NO: 1485657 - RNA, 19 nt, Pseudomonas aeruginosa PA01
acgauguucgaggcgccga

SEQ ID NO: 1485658 - RNA, 21 nt, Pseudomonas aeruginosa PA01
acgauguucgaggcgccgacc

SEQ ID NO: 1485659 - RNA, 20 nt, Pseudomonas aeruginosa PA01
acgaucggcaccaucaccga

SEQ ID NO: 1485660 - RNA, 22 nt, Pseudomonas aeruginosa PA01
acgaucgcggcgacgaucaccc

SEQ ID NO: 1485661 - RNA, 14 nt, Pseudomonas aeruginosa PA01
acgaucccggcggu

SEQ ID NO: 1485662 - RNA, 13 nt, Pseudomonas aeruginosa PA01
acgcaccagcucc

SEQ ID NO: 1485663 - RNA, 17 nt, Pseudomonas aeruginosa PA01
acgcaacccgcccggcu

SEQ ID NO: 1485664 - RNA, 16 nt, Pseudomonas aeruginosa PA01
acgcaaacgccauccg

SEQ ID NO: 1485665 - RNA, 17 nt, Pseudomonas aeruginosa PA01
acgcaaacgccauccgc

SEQ ID NO: 1485666 - RNA, 22 nt, Pseudomonas aeruginosa PA01
acgaagcgaccgaucaugcccu

SEQ ID NO: 1485667 - RNA, 23 nt, Pseudomonas aeruginosa PA01
acgaagcgacugcgcuggccgag

SEQ ID NO: 1485668 - RNA, 13 nt, Pseudomonas aeruginosa PA01
acgaagcgccggc

SEQ ID NO: 1485669 - RNA, 19 nt, Pseudomonas aeruginosa PA01
acgaagcgccggcggccug

SEQ ID NO: 1485670 - RNA, 16 nt, Pseudomonas aeruginosa PA01
acgaaggccuccucgu

SEQ ID NO: 1485671 - RNA, 18 nt, Pseudomonas aeruginosa PA01
acgaagggcucagcccag

SEQ ID NO: 1485672 - RNA, 22 nt, Pseudomonas aeruginosa PA01
acgaagggcucagcccaggcgc

SEQ ID NO: 1485673 - RNA, 22 nt, Pseudomonas aeruginosa PA01
acgaagguaucgaagucgccau

SEQ ID NO: 1485674 - RNA, 15 nt, Pseudomonas aeruginosa PA01
acgaaggucggcggc

SEQ ID NO: 1485675 - RNA, 13 nt, Pseudomonas aeruginosa PA01
acgaagucgccgg

SEQ ID NO: 1485676 - RNA, 14 nt, Pseudomonas aeruginosa PA01
acgaagucgccggc

SEQ ID NO: 1485677 - RNA, 15 nt, Pseudomonas aeruginosa PA01
acgaagucgccggca

SEQ ID NO: 1485678 - RNA, 21 nt, Pseudomonas aeruginosa PA01
acgaaguugcaggccagcgcc

SEQ ID NO: 1485679 - RNA, 20 nt, Pseudomonas aeruginosa PA01
acgaaguuggcggccgacgg

SEQ ID NO: 1485680 - RNA, 22 nt, Pseudomonas aeruginosa PA01
acgacaguaccuuccauuucga

SEQ ID NO: 1485681 - RNA, 23 nt, Pseudomonas aeruginosa PA01
acgacaucgacgcccucggcgac

SEQ ID NO: 1485682 - RNA, 22 nt, Pseudomonas aeruginosa PA01
acgacagcgaaugcuugccggc

SEQ ID NO: 1485683 - RNA, 13 nt, Pseudomonas aeruginosa PA01
acgacagccccgg

SEQ ID NO: 1485684 - RNA, 20 nt, Pseudomonas aeruginosa PA01
acgaccgcccaggcugccgc

SEQ ID NO: 1485685 - RNA, 19 nt, Pseudomonas aeruginosa PA01
acgacgaaagaagccgcac

SEQ ID NO: 1485686 - RNA, 13 nt, Pseudomonas aeruginosa PA01
acgacgaaaggcc

SEQ ID NO: 1485687 - RNA, 23 nt, Pseudomonas aeruginosa PA01
acgacgaagugaccgcgcgccau

SEQ ID NO: 1485688 - RNA, 23 nt, Pseudomonas aeruginosa PA01
acgaccggaagguugucgaagcg

SEQ ID NO: 1485689 - RNA, 20 nt, Pseudomonas aeruginosa PA01
acgaaaaagccccugcgccu

SEQ ID NO: 1485690 - RNA, 16 nt, Pseudomonas aeruginosa PA01
acgaaaaagcccggcg

SEQ ID NO: 1485691 - RNA, 20 nt, Pseudomonas aeruginosa PA01
acgaaaacggcgcccgaggg

SEQ ID NO: 1485692 - RNA, 15 nt, Pseudomonas aeruginosa PA01
acgaaagaagccgca

SEQ ID NO: 1485693 - RNA, 21 nt, Pseudomonas aeruginosa PA01
acgaaagacgcugcgaccugg

SEQ ID NO: 1485694 - RNA, 17 nt, Pseudomonas aeruginosa PA01
acgaaaggccgcgccgg

SEQ ID NO: 1485695 - RNA, 14 nt, Pseudomonas aeruginosa PA01
acgaaagccaugcc

SEQ ID NO: 1485696 - RNA, 19 nt, Pseudomonas aeruginosa PA01
acgaaagccaugcccagac

SEQ ID NO: 1485697 - RNA, 17 nt, Pseudomonas aeruginosa PA01
acgaacuucagggcucc

SEQ ID NO: 1485698 - RNA, 17 nt, Pseudomonas aeruginosa PA01
acgaagaagccggcccc

SEQ ID NO: 1485699 - RNA, 20 nt, Pseudomonas aeruginosa PA01
acgaagaguaaaugcuugaa

SEQ ID NO: 1485700 - RNA, 15 nt, Pseudomonas aeruginosa PA01
acgaagaaccccggc

SEQ ID NO: 1485701 - RNA, 20 nt, Pseudomonas aeruginosa PA01
acgaagaacggcgcggucuc

SEQ ID NO: 1485702 - RNA, 21 nt, Pseudomonas aeruginosa PA01
acgaacggaucgcucucgcgc

SEQ ID NO: 1485703 - RNA, 14 nt, Pseudomonas aeruginosa PA01
acgaacucgacgcg

SEQ ID NO: 1485704 - RNA, 20 nt, Pseudomonas aeruginosa PA01
acgaacaggcugugcgccag

SEQ ID NO: 1485705 - RNA, 20 nt, Pseudomonas aeruginosa PA01
accuuggcuugcagguagcu

SEQ ID NO: 1485706 - RNA, 17 nt, Pseudomonas aeruginosa PA01
accuugggaucgucgaa

SEQ ID NO: 1485707 - RNA, 20 nt, Pseudomonas aeruginosa PA01
accuuggcacgaacccaggc

SEQ ID NO: 1485708 - RNA, 15 nt, Pseudomonas aeruginosa PA01
accuuggccacgcug

SEQ ID NO: 1485709 - RNA, 18 nt, Pseudomonas aeruginosa PA01
accuugcuggacaagguu

SEQ ID NO: 1485710 - RNA, 23 nt, Pseudomonas aeruginosa PA01
accuugcuggugcccugggcggc

SEQ ID NO: 1485711 - RNA, 20 nt, Pseudomonas aeruginosa PA01
accuugcggaacccgcgcag

SEQ ID NO: 1485712 - RNA, 22 nt, Pseudomonas aeruginosa PA01
accuugcccgaggugucgccgc

SEQ ID NO: 1485713 - RNA, 14 nt, Pseudomonas aeruginosa PA01
accuugccgcgccc

SEQ ID NO: 1485714 - RNA, 23 nt, Pseudomonas aeruginosa PA01
accuugcgcaccagggccaggag

SEQ ID NO: 1485715 - RNA, 14 nt, Pseudomonas aeruginosa PA01
accuuguccaggcg

SEQ ID NO: 1485716 - RNA, 16 nt, Pseudomonas aeruginosa PA01
accuuguccaggcgcu

SEQ ID NO: 1485717 - RNA, 18 nt, Pseudomonas aeruginosa PA01
accuuguccugcggccgg

SEQ ID NO: 1485718 - RNA, 21 nt, Pseudomonas aeruginosa PA01
accuuucuccccucaggcgcc

SEQ ID NO: 1485719 - RNA, 15 nt, Pseudomonas aeruginosa PA01
accugcagcgccucg

SEQ ID NO: 1485720 - RNA, 16 nt, Pseudomonas aeruginosa PA01
accugcaaggcgguga

SEQ ID NO: 1485721 - RNA, 19 nt, Pseudomonas aeruginosa PA01
accugcaucaccaggcugc

SEQ ID NO: 1485722 - RNA, 23 nt, Pseudomonas aeruginosa PA01
accugcaucaccaggcugccgcc

SEQ ID NO: 1485723 - RNA, 19 nt, Pseudomonas aeruginosa PA01
accugcaacgcccgcgagc

SEQ ID NO: 1485724 - RNA, 16 nt, Pseudomonas aeruginosa PA01
accugcaacucggcgc

SEQ ID NO: 1485725 - RNA, 16 nt, Pseudomonas aeruginosa PA01
accugcaacucggcgu

SEQ ID NO: 1485726 - RNA, 23 nt, Pseudomonas aeruginosa PA01
accugcaacucggcgucgcgcuu

SEQ ID NO: 1485727 - RNA, 21 nt, Pseudomonas aeruginosa PA01
accguguugaucgccgcgccg

SEQ ID NO: 1485728 - RNA, 22 nt, Pseudomonas aeruginosa PA01
accguguugaucgccgcgccgc

SEQ ID NO: 1485729 - RNA, 15 nt, Pseudomonas aeruginosa PA01
accguugcgcaggcg

SEQ ID NO: 1485730 - RNA, 17 nt, Pseudomonas aeruginosa PA01
accguucuugaucaccg

SEQ ID NO: 1485731 - RNA, 15 nt, Pseudomonas aeruginosa PA01
accguuccagcgccu

SEQ ID NO: 1485732 - RNA, 16 nt, Pseudomonas aeruginosa PA01
accguucccagcagcg

SEQ ID NO: 1485733 - RNA, 20 nt, Pseudomonas aeruginosa PA01
accguucccagcagcgccuc

SEQ ID NO: 1485734 - RNA, 12 nt, Pseudomonas aeruginosa PA01
accguggcggcc

SEQ ID NO: 1485735 - RNA, 14 nt, Pseudomonas aeruginosa PA01
accguggucauggc

SEQ ID NO: 1485736 - RNA, 20 nt, Pseudomonas aeruginosa PA01
accguggaaaccucgccgau

SEQ ID NO: 1485737 - RNA, 21 nt, Pseudomonas aeruginosa PA01
accguggcgcuacgcucgccg

SEQ ID NO: 1485738 - RNA, 13 nt, Pseudomonas aeruginosa PA01
accguggcgcugg

SEQ ID NO: 1485739 - RNA, 16 nt, Pseudomonas aeruginosa PA01
accguggcgcuggccg

SEQ ID NO: 1485740 - RNA, 17 nt, Pseudomonas aeruginosa PA01
accguggcgcuggccga

SEQ ID NO: 1485741 - RNA, 18 nt, Pseudomonas aeruginosa PA01
accguggcgacgaugcgc

SEQ ID NO: 1485742 - RNA, 16 nt, Pseudomonas aeruginosa PA01
accgugcgcgcggccu

SEQ ID NO: 1485743 - RNA, 17 nt, Pseudomonas aeruginosa PA01
accgugcgcgcggccug

SEQ ID NO: 1485744 - RNA, 15 nt, Pseudomonas aeruginosa PA01
accgucguucggcug

SEQ ID NO: 1485745 - RNA, 16 nt, Pseudomonas aeruginosa PA01
accgugccgccggggc

SEQ ID NO: 1485746 - RNA, 16 nt, Pseudomonas aeruginosa PA01
accgugcccgccggcg

SEQ ID NO: 1485747 - RNA, 17 nt, Pseudomonas aeruginosa PA01
accgugcccgccggcgc

SEQ ID NO: 1485748 - RNA, 21 nt, Pseudomonas aeruginosa PA01
accuccgccaggaccuccugc

SEQ ID NO: 1485749 - RNA, 21 nt, Pseudomonas aeruginosa PA01
accucagaccacgcccugcgc

SEQ ID NO: 1485750 - RNA, 16 nt, Pseudomonas aeruginosa PA01
accucgugcucgggga

SEQ ID NO: 1485751 - RNA, 17 nt, Pseudomonas aeruginosa PA01
accucgguagccggcca

SEQ ID NO: 1485752 - RNA, 24 nt, Pseudomonas aeruginosa PA01
accucgggcgagaaucgccgaggc

SEQ ID NO: 1485753 - RNA, 19 nt, Pseudomonas aeruginosa PA01
accucgucgagcagcgcgc

SEQ ID NO: 1485754 - RNA, 22 nt, Pseudomonas aeruginosa PA01
accucguauuccacgucgccga

SEQ ID NO: 1485755 - RNA, 21 nt, Pseudomonas aeruginosa PA01
accucguaggccgacucgcga

SEQ ID NO: 1485756 - RNA, 22 nt, Pseudomonas aeruginosa PA01
accucguaggccgacucgcgau

SEQ ID NO: 1485757 - RNA, 13 nt, Pseudomonas aeruginosa PA01
accucggugagga

SEQ ID NO: 1485758 - RNA, 17 nt, Pseudomonas aeruginosa PA01
accucggugagguagca

SEQ ID NO: 1485759 - RNA, 12 nt, Pseudomonas aeruginosa PA01
accugaacgcgc

SEQ ID NO: 1485760 - RNA, 18 nt, Pseudomonas aeruginosa PA01
accugaccaucgucgcuu

SEQ ID NO: 1485761 - RNA, 21 nt, Pseudomonas aeruginosa PA01
accugacccgcuccucgucga

SEQ ID NO: 1485762 - RNA, 17 nt, Pseudomonas aeruginosa PA01
accucugcguucugcug

SEQ ID NO: 1485763 - RNA, 19 nt, Pseudomonas aeruginosa PA01
accucgcgggaacggcgua

SEQ ID NO: 1485764 - RNA, 22 nt, Pseudomonas aeruginosa PA01
accucgcugacuuccaucagcu

SEQ ID NO: 1485765 - RNA, 13 nt, Pseudomonas aeruginosa PA01
accucggccgcca

SEQ ID NO: 1485766 - RNA, 14 nt, Pseudomonas aeruginosa PA01
accucggccaggcg

SEQ ID NO: 1485767 - RNA, 20 nt, Pseudomonas aeruginosa PA01
accucggcggucagguugac

SEQ ID NO: 1485768 - RNA, 22 nt, Pseudomonas aeruginosa PA01
accuccucgaugaaacgcaggg

SEQ ID NO: 1485769 - RNA, 19 nt, Pseudomonas aeruginosa PA01
accuccuugggaucggcga

SEQ ID NO: 1485770 - RNA, 17 nt, Pseudomonas aeruginosa PA01
accucgaaccccuggcg

SEQ ID NO: 1485771 - RNA, 13 nt, Pseudomonas aeruginosa PA01
accuccuggcgcg

SEQ ID NO: 1485772 - RNA, 15 nt, Pseudomonas aeruginosa PA01
accucgacgcccgcu

SEQ ID NO: 1485773 - RNA, 15 nt, Pseudomonas aeruginosa PA01
accucgacccuggcg

SEQ ID NO: 1485774 - RNA, 16 nt, Pseudomonas aeruginosa PA01
accucgacccuggcgc

SEQ ID NO: 1485775 - RNA, 21 nt, Pseudomonas aeruginosa PA01
accucgacccuggcgccgacc

SEQ ID NO: 1485776 - RNA, 17 nt, Pseudomonas aeruginosa PA01
accucgaaggugugcag

SEQ ID NO: 1485777 - RNA, 14 nt, Pseudomonas aeruginosa PA01
accucgaagcccag

SEQ ID NO: 1485778 - RNA, 15 nt, Pseudomonas aeruginosa PA01
accucgaagcccagc

SEQ ID NO: 1485779 - RNA, 16 nt, Pseudomonas aeruginosa PA01
accucgcccaucgcca

SEQ ID NO: 1485780 - RNA, 20 nt, Pseudomonas aeruginosa PA01
accucgccgaucuccuccgc

SEQ ID NO: 1485781 - RNA, 18 nt, Pseudomonas aeruginosa PA01
accucgccaagcuggcga

SEQ ID NO: 1485782 - RNA, 16 nt, Pseudomonas aeruginosa PA01
accucgauggcggcgg

SEQ ID NO: 1485783 - RNA, 22 nt, Pseudomonas aeruginosa PA01
accgucacgcggacccaguugg

SEQ ID NO: 1485784 - RNA, 22 nt, Pseudomonas aeruginosa PA01
accgucaccuguucggcgcuga

SEQ ID NO: 1485785 - RNA, 15 nt, Pseudomonas aeruginosa PA01
accgucagccaggcu

SEQ ID NO: 1485786 - RNA, 18 nt, Pseudomonas aeruginosa PA01
accgucagccaggcuggc

SEQ ID NO: 1485787 - RNA, 16 nt, Pseudomonas aeruginosa PA01
accguccagcgcgccg

SEQ ID NO: 1485788 - RNA, 19 nt, Pseudomonas aeruginosa PA01
accguccgcagcacagccc

SEQ ID NO: 1485789 - RNA, 17 nt, Pseudomonas aeruginosa PA01
accguccgcagcgccac

SEQ ID NO: 1485790 - RNA, 15 nt, Pseudomonas aeruginosa PA01
accguaggccaggca

SEQ ID NO: 1485791 - RNA, 18 nt, Pseudomonas aeruginosa PA01
accgguuucccucgagca

SEQ ID NO: 1485792 - RNA, 21 nt, Pseudomonas aeruginosa PA01
accgucuucaguaggccagcg

SEQ ID NO: 1485793 - RNA, 21 nt, Pseudomonas aeruginosa PA01
accgucgcgauagacgccggc

SEQ ID NO: 1485794 - RNA, 18 nt, Pseudomonas aeruginosa PA01
accgucgaacagguggcu

SEQ ID NO: 1485795 - RNA, 21 nt, Pseudomonas aeruginosa PA01
accgucgaaccagggacgccc

SEQ ID NO: 1485796 - RNA, 18 nt, Pseudomonas aeruginosa PA01
accgucgaucucgagcau

SEQ ID NO: 1485797 - RNA, 14 nt, Pseudomonas aeruginosa PA01
accguccgcgccgc

SEQ ID NO: 1485798 - RNA, 18 nt, Pseudomonas aeruginosa PA01
accguccuucggccgcac

SEQ ID NO: 1485799 - RNA, 20 nt, Pseudomonas aeruginosa PA01
accguccuucggccgcacca

SEQ ID NO: 1485800 - RNA, 14 nt, Pseudomonas aeruginosa PA01
accggggaucagcu

SEQ ID NO: 1485801 - RNA, 19 nt, Pseudomonas aeruginosa PA01
accggggccuucaggcgcu

SEQ ID NO: 1485802 - RNA, 18 nt, Pseudomonas aeruginosa PA01
accgggcggaucgccaac

SEQ ID NO: 1485803 - RNA, 14 nt, Pseudomonas aeruginosa PA01
accgggcggcgcgg

SEQ ID NO: 1485804 - RNA, 14 nt, Pseudomonas aeruginosa PA01
accgggcgggucug

SEQ ID NO: 1485805 - RNA, 19 nt, Pseudomonas aeruginosa PA01
accgggcgggucuggcgga

SEQ ID NO: 1485806 - RNA, 18 nt, Pseudomonas aeruginosa PA01
accggguaccugcucgcg

SEQ ID NO: 1485807 - RNA, 15 nt, Pseudomonas aeruginosa PA01
accggcaaggcgcug

SEQ ID NO: 1485808 - RNA, 16 nt, Pseudomonas aeruginosa PA01
accggcaaggcggccu

SEQ ID NO: 1485809 - RNA, 15 nt, Pseudomonas aeruginosa PA01
accgggccgccggcg

SEQ ID NO: 1485810 - RNA, 16 nt, Pseudomonas aeruginosa PA01
accgggccgccggcga

SEQ ID NO: 1485811 - RNA, 17 nt, Pseudomonas aeruginosa PA01
accgggcgccucgucga

SEQ ID NO: 1485812 - RNA, 23 nt, Pseudomonas aeruginosa PA01
accgggccgucgggcauggcgau

SEQ ID NO: 1485813 - RNA, 24 nt, Pseudomonas aeruginosa PA01
accgggccgucgggcauggcgauc

SEQ ID NO: 1485814 - RNA, 21 nt, Pseudomonas aeruginosa PA01
accgguccucgcccgucacuu

SEQ ID NO: 1485815 - RNA, 16 nt, Pseudomonas aeruginosa PA01
accggucccucggggc

SEQ ID NO: 1485816 - RNA, 20 nt, Pseudomonas aeruginosa PA01
accggucaaaccauggcgua

SEQ ID NO: 1485817 - RNA, 16 nt, Pseudomonas aeruginosa PA01
accgguacgcucacca

SEQ ID NO: 1485818 - RNA, 20 nt, Pseudomonas aeruginosa PA01
accgguacgcucaccaccac

SEQ ID NO: 1485819 - RNA, 22 nt, Pseudomonas aeruginosa PA01
accgguacgcucaccaccaccg

SEQ ID NO: 1485820 - RNA, 18 nt, Pseudomonas aeruginosa PA01
accggucuuggcgcgcga

SEQ ID NO: 1485821 - RNA, 15 nt, Pseudomonas aeruginosa PA01
accggugccccgcug

SEQ ID NO: 1485822 - RNA, 22 nt, Pseudomonas aeruginosa PA01
accgcuugcgguuauccgccgc

SEQ ID NO: 1485823 - RNA, 18 nt, Pseudomonas aeruginosa PA01
accgcuugccagccgcuu

SEQ ID NO: 1485824 - RNA, 15 nt, Pseudomonas aeruginosa PA01
accgcugccgccguc

SEQ ID NO: 1485825 - RNA, 22 nt, Pseudomonas aeruginosa PA01
accgcuuucaccagggucgcca

SEQ ID NO: 1485826 - RNA, 17 nt, Pseudomonas aeruginosa PA01
accggauguucgaaggc

SEQ ID NO: 1485827 - RNA, 17 nt, Pseudomonas aeruginosa PA01
accggaucgcccuggcg

SEQ ID NO: 1485828 - RNA, 21 nt, Pseudomonas aeruginosa PA01
accggaucgcccuggcgccag

SEQ ID NO: 1485829 - RNA, 15 nt, Pseudomonas aeruginosa PA01
accgcuggcgcuggg

SEQ ID NO: 1485830 - RNA, 18 nt, Pseudomonas aeruginosa PA01
accgcugggacggcggcu

SEQ ID NO: 1485831 - RNA, 14 nt, Pseudomonas aeruginosa PA01
accgcuggucggca

SEQ ID NO: 1485832 - RNA, 16 nt, Pseudomonas aeruginosa PA01
accgcugcgugccagg

SEQ ID NO: 1485833 - RNA, 17 nt, Pseudomonas aeruginosa PA01
accgcugcgugccaggg

SEQ ID NO: 1485834 - RNA, 17 nt, Pseudomonas aeruginosa PA01
accgcugcgccgccguc

SEQ ID NO: 1485835 - RNA, 13 nt, Pseudomonas aeruginosa PA01
accgcugcggccg

SEQ ID NO: 1485836 - RNA, 14 nt, Pseudomonas aeruginosa PA01
accgcugcggccgg

SEQ ID NO: 1485837 - RNA, 22 nt, Pseudomonas aeruginosa PA01
accgcggucuucccguaaggcc

SEQ ID NO: 1485838 - RNA, 12 nt, Pseudomonas aeruginosa PA01
accgcgggcuca

SEQ ID NO: 1485839 - RNA, 15 nt, Pseudomonas aeruginosa PA01
accgcgcucggcggu

SEQ ID NO: 1485840 - RNA, 20 nt, Pseudomonas aeruginosa PA01
accgcgcucggcggucaggc

SEQ ID NO: 1485841 - RNA, 13 nt, Pseudomonas aeruginosa PA01
accgcguggugcu

SEQ ID NO: 1485842 - RNA, 23 nt, Pseudomonas aeruginosa PA01
accgcucucgaggacgugcacca

SEQ ID NO: 1485843 - RNA, 19 nt, Pseudomonas aeruginosa PA01
accgcgguggaggcggcgg

SEQ ID NO: 1485844 - RNA, 16 nt, Pseudomonas aeruginosa PA01
accgccugcagcacca

SEQ ID NO: 1485845 - RNA, 21 nt, Pseudomonas aeruginosa PA01
accgccugccagaccguggcg

SEQ ID NO: 1485846 - RNA, 19 nt, Pseudomonas aeruginosa PA01
accgccucgaccaucggcg

SEQ ID NO: 1485847 - RNA, 13 nt, Pseudomonas aeruginosa PA01
accgccucgaccc

SEQ ID NO: 1485848 - RNA, 19 nt, Pseudomonas aeruginosa PA01
accgccucggagaacagca

SEQ ID NO: 1485849 - RNA, 11 nt, Pseudomonas aeruginosa PA01
accgcgagcgg

SEQ ID NO: 1485850 - RNA, 16 nt, Pseudomonas aeruginosa PA01
accgccugcucgcggc

SEQ ID NO: 1485851 - RNA, 20 nt, Pseudomonas aeruginosa PA01
accgccugcucgcggcuggc

SEQ ID NO: 1485852 - RNA, 18 nt, Pseudomonas aeruginosa PA01
accgcgcaaaccggcagc

SEQ ID NO: 1485853 - RNA, 23 nt, Pseudomonas aeruginosa PA01
accgcgcaaaccggcagcaucuc

SEQ ID NO: 1485854 - RNA, 20 nt, Pseudomonas aeruginosa PA01
accgcgcgcgcaaggccgaa

SEQ ID NO: 1485855 - RNA, 19 nt, Pseudomonas aeruginosa PA01
accgcgcggcacaggcggc

SEQ ID NO: 1485856 - RNA, 20 nt, Pseudomonas aeruginosa PA01
accgcgcagaugaucgccac

SEQ ID NO: 1485857 - RNA, 15 nt, Pseudomonas aeruginosa PA01
accgcgcauggcggc

SEQ ID NO: 1485858 - RNA, 17 nt, Pseudomonas aeruginosa PA01
accgcgcauggcggcga

SEQ ID NO: 1485859 - RNA, 19 nt, Pseudomonas aeruginosa PA01
accgcgcauggcggcgacc

SEQ ID NO: 1485860 - RNA, 21 nt, Pseudomonas aeruginosa PA01
accgcgcauggcggcgaccgc

SEQ ID NO: 1485861 - RNA, 17 nt, Pseudomonas aeruginosa PA01
accgcgcagcgucaccg

SEQ ID NO: 1485862 - RNA, 20 nt, Pseudomonas aeruginosa PA01
accgccgccuggguggcgac

SEQ ID NO: 1485863 - RNA, 15 nt, Pseudomonas aeruginosa PA01
accgccgccgccuug

SEQ ID NO: 1485864 - RNA, 12 nt, Pseudomonas aeruginosa PA01
accgcccgccuc

SEQ ID NO: 1485865 - RNA, 19 nt, Pseudomonas aeruginosa PA01
accgcccgccucaggccgg

SEQ ID NO: 1485866 - RNA, 15 nt, Pseudomonas aeruginosa PA01
accgcccuuucgaac

SEQ ID NO: 1485867 - RNA, 17 nt, Pseudomonas aeruginosa PA01
accgccgcucaucugca

SEQ ID NO: 1485868 - RNA, 13 nt, Pseudomonas aeruginosa PA01
accgccggccucg

SEQ ID NO: 1485869 - RNA, 20 nt, Pseudomonas aeruginosa PA01
accgccggccucgcugccgc

SEQ ID NO: 1485870 - RNA, 17 nt, Pseudomonas aeruginosa PA01
accgcagcccaguucgc

SEQ ID NO: 1485871 - RNA, 19 nt, Pseudomonas aeruginosa PA01
accgcaggauagaugcguc

SEQ ID NO: 1485872 - RNA, 13 nt, Pseudomonas aeruginosa PA01
accgccagcgcac

SEQ ID NO: 1485873 - RNA, 14 nt, Pseudomonas aeruginosa PA01
accgccagcgcacc

SEQ ID NO: 1485874 - RNA, 11 nt, Pseudomonas aeruginosa PA01
accgccagcgg

SEQ ID NO: 1485875 - RNA, 22 nt, Pseudomonas aeruginosa PA01
accgccagcgggacgaugccga

SEQ ID NO: 1485876 - RNA, 18 nt, Pseudomonas aeruginosa PA01
accgccaggccgacccgc

SEQ ID NO: 1485877 - RNA, 22 nt, Pseudomonas aeruginosa PA01
accgccaggaccucgaagcugg

SEQ ID NO: 1485878 - RNA, 11 nt, Pseudomonas aeruginosa PA01
accgccaggcg

SEQ ID NO: 1485879 - RNA, 17 nt, Pseudomonas aeruginosa PA01
accgccaggcggccgcu

SEQ ID NO: 1485880 - RNA, 18 nt, Pseudomonas aeruginosa PA01
accgccagacaggccagc

SEQ ID NO: 1485881 - RNA, 19 nt, Pseudomonas aeruginosa PA01
accgccacguacagcgcga

SEQ ID NO: 1485882 - RNA, 13 nt, Pseudomonas aeruginosa PA01
accgaucggcugc

SEQ ID NO: 1485883 - RNA, 20 nt, Pseudomonas aeruginosa PA01
accgaucgcccgcgccucga

SEQ ID NO: 1485884 - RNA, 20 nt, Pseudomonas aeruginosa PA01
accgauggccagggggccug

SEQ ID NO: 1485885 - RNA, 23 nt, Pseudomonas aeruginosa PA01
accgcacggccgucacggccucc

SEQ ID NO: 1485886 - RNA, 14 nt, Pseudomonas aeruginosa PA01
accgcaccgccagc

SEQ ID NO: 1485887 - RNA, 15 nt, Pseudomonas aeruginosa PA01
accgcaccgccagcg

SEQ ID NO: 1485888 - RNA, 17 nt, Pseudomonas aeruginosa PA01
accgcaaccgguccucg

SEQ ID NO: 1485889 - RNA, 18 nt, Pseudomonas aeruginosa PA01
accgcaaccgguccucgc

SEQ ID NO: 1485890 - RNA, 22 nt, Pseudomonas aeruginosa PA01
accgaggcgaacggcagguggu

SEQ ID NO: 1485891 - RNA, 14 nt, Pseudomonas aeruginosa PA01
accgaggcgcgccg

SEQ ID NO: 1485892 - RNA, 15 nt, Pseudomonas aeruginosa PA01
accgaggcgcgccga

SEQ ID NO: 1485893 - RNA, 17 nt, Pseudomonas aeruginosa PA01
accgaggcgcgccgaca

SEQ ID NO: 1485894 - RNA, 19 nt, Pseudomonas aeruginosa PA01
accgaggcgcgccgacagc

SEQ ID NO: 1485895 - RNA, 16 nt, Pseudomonas aeruginosa PA01
accgaucaccuggccg

SEQ ID NO: 1485896 - RNA, 18 nt, Pseudomonas aeruginosa PA01
accgaucagcaccgccac

SEQ ID NO: 1485897 - RNA, 17 nt, Pseudomonas aeruginosa PA01
accgauauaggcgacga

SEQ ID NO: 1485898 - RNA, 21 nt, Pseudomonas aeruginosa PA01
accgaguggcgcagcgcccga

SEQ ID NO: 1485899 - RNA, 17 nt, Pseudomonas aeruginosa PA01
accgaguugaccagcau

SEQ ID NO: 1485900 - RNA, 19 nt, Pseudomonas aeruginosa PA01
accgaguuucccggcgcgg

SEQ ID NO: 1485901 - RNA, 22 nt, Pseudomonas aeruginosa PA01
accgaguuucccggcgcggccg

SEQ ID NO: 1485902 - RNA, 23 nt, Pseudomonas aeruginosa PA01
accgaguuucccggcgcggccga

SEQ ID NO: 1485903 - RNA, 15 nt, Pseudomonas aeruginosa PA01
accgacccucggcga

SEQ ID NO: 1485904 - RNA, 15 nt, Pseudomonas aeruginosa PA01
accgacgccgccugc

SEQ ID NO: 1485905 - RNA, 12 nt, Pseudomonas aeruginosa PA01
accgacgccgga

SEQ ID NO: 1485906 - RNA, 22 nt, Pseudomonas aeruginosa PA01
accgacgccggacgcaccagca

SEQ ID NO: 1485907 - RNA, 14 nt, Pseudomonas aeruginosa PA01
acccgcuucgucgg

SEQ ID NO: 1485908 - RNA, 16 nt, Pseudomonas aeruginosa PA01
acccgcugcaccagcu

SEQ ID NO: 1485909 - RNA, 17 nt, Pseudomonas aeruginosa PA01
accgaacaucagcagca

SEQ ID NO: 1485910 - RNA, 16 nt, Pseudomonas aeruginosa PA01
accgaacagcgcgcca

SEQ ID NO: 1485911 - RNA, 14 nt, Pseudomonas aeruginosa PA01
accgaagccgcgca

SEQ ID NO: 1485912 - RNA, 23 nt, Pseudomonas aeruginosa PA01
accgaagguacugccgcuaucgc

SEQ ID NO: 1485913 - RNA, 19 nt, Pseudomonas aeruginosa PA01
accgaaguagucgccccgg

SEQ ID NO: 1485914 - RNA, 17 nt, Pseudomonas aeruginosa PA01
accgaagucgcccgccg

SEQ ID NO: 1485915 - RNA, 19 nt, Pseudomonas aeruginosa PA01
accgaagucgcccgccggc

SEQ ID NO: 1485916 - RNA, 16 nt, Pseudomonas aeruginosa PA01
accgaaggcaacagcc

SEQ ID NO: 1485917 - RNA, 20 nt, Pseudomonas aeruginosa PA01
accgaaggcaacagcccgcg

SEQ ID NO: 1485918 - RNA, 16 nt, Pseudomonas aeruginosa PA01
accgacaaucgccgag

SEQ ID NO: 1485919 - RNA, 18 nt, Pseudomonas aeruginosa PA01
accgacaaucgccgagaa

SEQ ID NO: 1485920 - RNA, 18 nt, Pseudomonas aeruginosa PA01
accgacaugccccgccga

SEQ ID NO: 1485921 - RNA, 19 nt, Pseudomonas aeruginosa PA01
accgacaugccccgccgac

SEQ ID NO: 1485922 - RNA, 16 nt, Pseudomonas aeruginosa PA01
accgacaggccgacca

SEQ ID NO: 1485923 - RNA, 20 nt, Pseudomonas aeruginosa PA01
accgacaggccgaccagcag

SEQ ID NO: 1485924 - RNA, 16 nt, Pseudomonas aeruginosa PA01
accaggccgccaugcu

SEQ ID NO: 1485925 - RNA, 13 nt, Pseudomonas aeruginosa PA01
accaggccgagca

SEQ ID NO: 1485926 - RNA, 20 nt, Pseudomonas aeruginosa PA01
acaguugccgcagcagcggc

SEQ ID NO: 1485927 - RNA, 13 nt, Pseudomonas aeruginosa PA01
accagggccucgg

SEQ ID NO: 1485928 - RNA, 21 nt, Pseudomonas aeruginosa PA01
accaggcuggccaguugcgcu

SEQ ID NO: 1485929 - RNA, 17 nt, Pseudomonas aeruginosa PA01
accaggcuuacccgcga

SEQ ID NO: 1485930 - RNA, 20 nt, Pseudomonas aeruginosa PA01
accaggcuuacccgcgacca

SEQ ID NO: 1485931 - RNA, 17 nt, Pseudomonas aeruginosa PA01
accagggaagcgcgcgc

SEQ ID NO: 1485932 - RNA, 16 nt, Pseudomonas aeruginosa PA01
accaggcucgccccgg

SEQ ID NO: 1485933 - RNA, 22 nt, Pseudomonas aeruginosa PA01
accaggcucgccccggcggcga

SEQ ID NO: 1485934 - RNA, 14 nt, Pseudomonas aeruginosa PA01
accaggcugaucag

SEQ ID NO: 1485935 - RNA, 16 nt, Pseudomonas aeruginosa PA01
accaggcugccgccgu

SEQ ID NO: 1485936 - RNA, 15 nt, Pseudomonas aeruginosa PA01
accaggccgcugccg

SEQ ID NO: 1485937 - RNA, 17 nt, Pseudomonas aeruginosa PA01
accaggccggcggccga

SEQ ID NO: 1485938 - RNA, 12 nt, Pseudomonas aeruginosa PA01
accaggcgaugc

SEQ ID NO: 1485939 - RNA, 14 nt, Pseudomonas aeruginosa PA01
accaggcgaugcgc

SEQ ID NO: 1485940 - RNA, 19 nt, Pseudomonas aeruginosa PA01
accaggcgguacaccgcca

SEQ ID NO: 1485941 - RNA, 21 nt, Pseudomonas aeruginosa PA01
accaggcgguacaccgccagg

SEQ ID NO: 1485942 - RNA, 14 nt, Pseudomonas aeruginosa PA01
accaguagcgacag

SEQ ID NO: 1485943 - RNA, 22 nt, Pseudomonas aeruginosa PA01
accaguagggggugaagcgcag

SEQ ID NO: 1485944 - RNA, 13 nt, Pseudomonas aeruginosa PA01
accaguccagcac

SEQ ID NO: 1485945 - RNA, 22 nt, Pseudomonas aeruginosa PA01
accagucccggcuugccggcag

SEQ ID NO: 1485946 - RNA, 16 nt, Pseudomonas aeruginosa PA01
accagucccuggccgg

SEQ ID NO: 1485947 - RNA, 22 nt, Pseudomonas aeruginosa PA01
accagucccuggccggcgaugg

SEQ ID NO: 1485948 - RNA, 22 nt, Pseudomonas aeruginosa PA01
accaggucgcuggcaccggcca

SEQ ID NO: 1485949 - RNA, 18 nt, Pseudomonas aeruginosa PA01
accaggucggcgcgcgac

SEQ ID NO: 1485950 - RNA, 23 nt, Pseudomonas aeruginosa PA01
accagguugaagaacggcccgcu

SEQ ID NO: 1485951 - RNA, 15 nt, Pseudomonas aeruginosa PA01
accagggggcgacau

SEQ ID NO: 1485952 - RNA, 15 nt, Pseudomonas aeruginosa PA01
accagggucgggccg

SEQ ID NO: 1485953 - RNA, 18 nt, Pseudomonas aeruginosa PA01
accagggucgggccgcgc

SEQ ID NO: 1485954 - RNA, 19 nt, Pseudomonas aeruginosa PA01
accagggucgggccgcgcu

SEQ ID NO: 1485955 - RNA, 22 nt, Pseudomonas aeruginosa PA01
accaggggauggucggugaccc

SEQ ID NO: 1485956 - RNA, 16 nt, Pseudomonas aeruginosa PA01
accagggugcgaugga

SEQ ID NO: 1485957 - RNA, 18 nt, Pseudomonas aeruginosa PA01
accagggcuucgcgcaga

SEQ ID NO: 1485958 - RNA, 16 nt, Pseudomonas aeruginosa PA01
accagggcgggccgcu

SEQ ID NO: 1485959 - RNA, 13 nt, Pseudomonas aeruginosa PA01
accagggcgaugg

SEQ ID NO: 1485960 - RNA, 23 nt, Pseudomonas aeruginosa PA01
accagggccgggucguacaccag

SEQ ID NO: 1485961 - RNA, 20 nt, Pseudomonas aeruginosa PA01
accagguccggcagcgccuu

SEQ ID NO: 1485962 - RNA, 22 nt, Pseudomonas aeruginosa PA01
accaucacgucgcgcaccuggc

SEQ ID NO: 1485963 - RNA, 23 nt, Pseudomonas aeruginosa PA01
accaucaccgacagucccaggcc

SEQ ID NO: 1485964 - RNA, 12 nt, Pseudomonas aeruginosa PA01
accaucaccgcc

SEQ ID NO: 1485965 - RNA, 17 nt, Pseudomonas aeruginosa PA01
accaucgcggcgauggc

SEQ ID NO: 1485966 - RNA, 21 nt, Pseudomonas aeruginosa PA01
accaucggguugaucgacgcc

SEQ ID NO: 1485967 - RNA, 12 nt, Pseudomonas aeruginosa PA01
accaucgccggc

SEQ ID NO: 1485968 - RNA, 18 nt, Pseudomonas aeruginosa PA01
accaucgucgcuuccggc

SEQ ID NO: 1485969 - RNA, 11 nt, Pseudomonas aeruginosa PA01
accaucggcac

SEQ ID NO: 1485970 - RNA, 12 nt, Pseudomonas aeruginosa PA01
accaucggcggc

SEQ ID NO: 1485971 - RNA, 13 nt, Pseudomonas aeruginosa PA01
accaucggcggcg

SEQ ID NO: 1485972 - RNA, 17 nt, Pseudomonas aeruginosa PA01
accaucggcggcggccc

SEQ ID NO: 1485973 - RNA, 23 nt, Pseudomonas aeruginosa PA01
accaucuuuuccugcuggcgaau

SEQ ID NO: 1485974 - RNA, 16 nt, Pseudomonas aeruginosa PA01
accaugaaacaguugg

SEQ ID NO: 1485975 - RNA, 20 nt, Pseudomonas aeruginosa PA01
accaugaucaucggcuggcc

SEQ ID NO: 1485976 - RNA, 22 nt, Pseudomonas aeruginosa PA01
accaugaucaucggcuggccga

SEQ ID NO: 1485977 - RNA, 23 nt, Pseudomonas aeruginosa PA01
accaugaucaucggcuggccgag

SEQ ID NO: 1485978 - RNA, 21 nt, Pseudomonas aeruginosa PA01
accaugcggcuacucgcccga

SEQ ID NO: 1485979 - RNA, 14 nt, Pseudomonas aeruginosa PA01
accaugcagcggca

SEQ ID NO: 1485980 - RNA, 17 nt, Pseudomonas aeruginosa PA01
accaugcccgcugggca

SEQ ID NO: 1485981 - RNA, 21 nt, Pseudomonas aeruginosa PA01
accaguucagcgcgcucgcug

SEQ ID NO: 1485982 - RNA, 15 nt, Pseudomonas aeruginosa PA01
accaguucgccgccg

SEQ ID NO: 1485983 - RNA, 14 nt, Pseudomonas aeruginosa PA01
accagugcaccgcc

SEQ ID NO: 1485984 - RNA, 16 nt, Pseudomonas aeruginosa PA01
accaguggcgccgcca

SEQ ID NO: 1485985 - RNA, 20 nt, Pseudomonas aeruginosa PA01
accaguggcgccgccauggu

SEQ ID NO: 1485986 - RNA, 19 nt, Pseudomonas aeruginosa PA01
aaaaucaguacucuggcca

SEQ ID NO: 1485987 - RNA, 17 nt, Pseudomonas aeruginosa PA01
accauagcgagccgcgc

SEQ ID NO: 1485988 - RNA, 19 nt, Pseudomonas aeruginosa PA01
accauagcgagccgcgcug

SEQ ID NO: 1485989 - RNA, 23 nt, Pseudomonas aeruginosa PA01
accaguuucuucgcgugggccag

SEQ ID NO: 1485990 - RNA, 16 nt, Pseudomonas aeruginosa PA01
accaguugcccgagug

SEQ ID NO: 1485991 - RNA, 22 nt, Pseudomonas aeruginosa PA01
accaguugcccgagugccggcg

SEQ ID NO: 1485992 - RNA, 18 nt, Pseudomonas aeruginosa PA01
accaguugcucgcuccga

SEQ ID NO: 1485993 - RNA, 13 nt, Pseudomonas aeruginosa PA01
accauggccggcg

SEQ ID NO: 1485994 - RNA, 22 nt, Pseudomonas aeruginosa PA01
accaugguguuggcggccuggg

SEQ ID NO: 1485995 - RNA, 22 nt, Pseudomonas aeruginosa PA01
acccagccauugagcgcgccca

SEQ ID NO: 1485996 - RNA, 13 nt, Pseudomonas aeruginosa PA01
accauugcgcggg

SEQ ID NO: 1485997 - RNA, 23 nt, Pseudomonas aeruginosa PA01
accauuagaggaacccaaucaca

SEQ ID NO: 1485998 - RNA, 16 nt, Pseudomonas aeruginosa PA01
acccaucgaugcucau

SEQ ID NO: 1485999 - RNA, 13 nt, Pseudomonas aeruginosa PA01
acccagcgcacgc

SEQ ID NO: 1486000 - RNA, 16 nt, Pseudomonas aeruginosa PA01
acccccaccgggccau

SEQ ID NO: 1486001 - RNA, 17 nt, Pseudomonas aeruginosa PA01
acccccagcccggccau

SEQ ID NO: 1486002 - RNA, 16 nt, Pseudomonas aeruginosa PA01
acccauucgaugccgc

SEQ ID NO: 1486003 - RNA, 15 nt, Pseudomonas aeruginosa PA01
acccaugccgcuagc

SEQ ID NO: 1486004 - RNA, 18 nt, Pseudomonas aeruginosa PA01
acccauggcgcgaugcuc

SEQ ID NO: 1486005 - RNA, 24 nt, Pseudomonas aeruginosa PA01
acccccgcaaccgcugccgccguc

SEQ ID NO: 1486006 - RNA, 15 nt, Pseudomonas aeruginosa PA01
acccccaucgcccgc

SEQ ID NO: 1486007 - RNA, 18 nt, Pseudomonas aeruginosa PA01
acccccaucgcccgcagc

SEQ ID NO: 1486008 - RNA, 19 nt, Pseudomonas aeruginosa PA01
accccgacgcuguugccgg

SEQ ID NO: 1486009 - RNA, 20 nt, Pseudomonas aeruginosa PA01
accccgacgcuguugccggc

SEQ ID NO: 1486010 - RNA, 16 nt, Pseudomonas aeruginosa PA01
accccgaccagcgcgc

SEQ ID NO: 1486011 - RNA, 22 nt, Pseudomonas aeruginosa PA01
accccgaaguagcgacggaagc

SEQ ID NO: 1486012 - RNA, 14 nt, Pseudomonas aeruginosa PA01
acccccugccgccc

SEQ ID NO: 1486013 - RNA, 22 nt, Pseudomonas aeruginosa PA01
acccccugcgcggacguaacgg

SEQ ID NO: 1486014 - RNA, 19 nt, Pseudomonas aeruginosa PA01
accccgaaaccggcgaugc

SEQ ID NO: 1486015 - RNA, 15 nt, Pseudomonas aeruginosa PA01
accccggacugcccg

SEQ ID NO: 1486016 - RNA, 17 nt, Pseudomonas aeruginosa PA01
accccgcggccgaggaa

SEQ ID NO: 1486017 - RNA, 14 nt, Pseudomonas aeruginosa PA01
accccggcggcgcg

SEQ ID NO: 1486018 - RNA, 12 nt, Pseudomonas aeruginosa PA01
accccggccugg

SEQ ID NO: 1486019 - RNA, 15 nt, Pseudomonas aeruginosa PA01
accccggccuggcgc

SEQ ID NO: 1486020 - RNA, 18 nt, Pseudomonas aeruginosa PA01
accccggccuggcuggcc

SEQ ID NO: 1486021 - RNA, 16 nt, Pseudomonas aeruginosa PA01
accccggcgaugcugc

SEQ ID NO: 1486022 - RNA, 14 nt, Pseudomonas aeruginosa PA01
acccgcaacaccug

SEQ ID NO: 1486023 - RNA, 15 nt, Pseudomonas aeruginosa PA01
acccgcaacaccugu

SEQ ID NO: 1486024 - RNA, 19 nt, Pseudomonas aeruginosa PA01
acccgcaguuccuugggca

SEQ ID NO: 1486025 - RNA, 22 nt, Pseudomonas aeruginosa PA01
acccgcaucgaggccgcccagc

SEQ ID NO: 1486026 - RNA, 19 nt, Pseudomonas aeruginosa PA01
acccgccccugcuccucgc

SEQ ID NO: 1486027 - RNA, 14 nt, Pseudomonas aeruginosa PA01
acccgcccgccguc

SEQ ID NO: 1486028 - RNA, 13 nt, Pseudomonas aeruginosa PA01
acccgcucggccu

SEQ ID NO: 1486029 - RNA, 11 nt, Pseudomonas aeruginosa PA01
acccgcgccgg

SEQ ID NO: 1486030 - RNA, 15 nt, Pseudomonas aeruginosa PA01
acccgcgccggcagc

SEQ ID NO: 1486031 - RNA, 20 nt, Pseudomonas aeruginosa PA01
acccgcgccggcagcucggc

SEQ ID NO: 1486032 - RNA, 13 nt, Pseudomonas aeruginosa PA01
acgguagguagcg

SEQ ID NO: 1486033 - RNA, 19 nt, Pseudomonas aeruginosa PA01
acgguagguagcguugcgc

SEQ ID NO: 1486034 - RNA, 17 nt, Pseudomonas aeruginosa PA01
acgguagagacggcggc

SEQ ID NO: 1486035 - RNA, 14 nt, Pseudomonas aeruginosa PA01
acggucauggccag

SEQ ID NO: 1486036 - RNA, 15 nt, Pseudomonas aeruginosa PA01
acggucagcucggca

SEQ ID NO: 1486037 - RNA, 14 nt, Pseudomonas aeruginosa PA01
acgggugcugcgga

SEQ ID NO: 1486038 - RNA, 20 nt, Pseudomonas aeruginosa PA01
acggguugaucagguucggc

SEQ ID NO: 1486039 - RNA, 16 nt, Pseudomonas aeruginosa PA01
acggguuucgcugcug

SEQ ID NO: 1486040 - RNA, 14 nt, Pseudomonas aeruginosa PA01
acgggucgcagccg

SEQ ID NO: 1486041 - RNA, 15 nt, Pseudomonas aeruginosa PA01
acgggucgcagccga

SEQ ID NO: 1486042 - RNA, 17 nt, Pseudomonas aeruginosa PA01
acgggucgcagccgagc

SEQ ID NO: 1486043 - RNA, 14 nt, Pseudomonas aeruginosa PA01
acgggucaguccuu

SEQ ID NO: 1486044 - RNA, 22 nt, Pseudomonas aeruginosa PA01
acggucgaggcggagaagccgc

SEQ ID NO: 1486045 - RNA, 15 nt, Pseudomonas aeruginosa PA01
acgguccagggccgc

SEQ ID NO: 1486046 - RNA, 19 nt, Pseudomonas aeruginosa PA01
acgguccaggaucauccgc

SEQ ID NO: 1486047 - RNA, 23 nt, Pseudomonas aeruginosa PA01
acgguccaggaucauccgcacca

SEQ ID NO: 1486048 - RNA, 22 nt, Pseudomonas aeruginosa PA01
acggucucgccgccgagcaggc

SEQ ID NO: 1486049 - RNA, 15 nt, Pseudomonas aeruginosa PA01
acggucugccagcuc

SEQ ID NO: 1486050 - RNA, 16 nt, Pseudomonas aeruginosa PA01
acggucuuggcggcga

SEQ ID NO: 1486051 - RNA, 23 nt, Pseudomonas aeruginosa PA01
acggucuugcgcuugccggccgc

SEQ ID NO: 1486052 - RNA, 21 nt, Pseudomonas aeruginosa PA01
acgguguuguggcuggccucg

SEQ ID NO: 1486053 - RNA, 22 nt, Pseudomonas aeruginosa PA01
acgguguuguggcuggccucgg

SEQ ID NO: 1486054 - RNA, 17 nt, Pseudomonas aeruginosa PA01
acgguguugccgugguc

SEQ ID NO: 1486055 - RNA, 15 nt, Pseudomonas aeruginosa PA01
acgguucagcagcgg

SEQ ID NO: 1486056 - RNA, 17 nt, Pseudomonas aeruginosa PA01
acgguucagcagcggca

SEQ ID NO: 1486057 - RNA, 16 nt, Pseudomonas aeruginosa PA01
acggugaaccaggcgc

SEQ ID NO: 1486058 - RNA, 19 nt, Pseudomonas aeruginosa PA01
acggugaaccaggcgccga

SEQ ID NO: 1486059 - RNA, 19 nt, Pseudomonas aeruginosa PA01
acgggcgcucuggccgcgc

SEQ ID NO: 1486060 - RNA, 17 nt, Pseudomonas aeruginosa PA01
acgggagcgcgaggcgc

SEQ ID NO: 1486061 - RNA, 17 nt, Pseudomonas aeruginosa PA01
acgggcguugccggcau

SEQ ID NO: 1486062 - RNA, 17 nt, Pseudomonas aeruginosa PA01
acgggcgguaugccgga

SEQ ID NO: 1486063 - RNA, 15 nt, Pseudomonas aeruginosa PA01
acggcguaccaggau

SEQ ID NO: 1486064 - RNA, 18 nt, Pseudomonas aeruginosa PA01
acggcgggccgcucagga

SEQ ID NO: 1486065 - RNA, 22 nt, Pseudomonas aeruginosa PA01
acgggaaguaggccuggccgcc

SEQ ID NO: 1486066 - RNA, 13 nt, Pseudomonas aeruginosa PA01
acggcgucacgcc

SEQ ID NO: 1486067 - RNA, 14 nt, Pseudomonas aeruginosa PA01
acgggacgccaggc

SEQ ID NO: 1486068 - RNA, 22 nt, Pseudomonas aeruginosa PA01
acggcggacugcucgccgccgg

SEQ ID NO: 1486069 - RNA, 23 nt, Pseudomonas aeruginosa PA01
acggcggacugcucgccgccggc

SEQ ID NO: 1486070 - RNA, 16 nt, Pseudomonas aeruginosa PA01
acggcggauaaccgcg

SEQ ID NO: 1486071 - RNA, 18 nt, Pseudomonas aeruginosa PA01
acggcggauaacgccguu

SEQ ID NO: 1486072 - RNA, 20 nt, Pseudomonas aeruginosa PA01
acggcaugcacgcccuggag

SEQ ID NO: 1486073 - RNA, 14 nt, Pseudomonas aeruginosa PA01
acggcccacggcga

SEQ ID NO: 1486074 - RNA, 20 nt, Pseudomonas aeruginosa PA01
acggcgcuuucaucaggcgc

SEQ ID NO: 1486075 - RNA, 21 nt, Pseudomonas aeruginosa PA01
acggcgcuuucaucaggcgcu

SEQ ID NO: 1486076 - RNA, 12 nt, Pseudomonas aeruginosa PA01
acggccagcagg

SEQ ID NO: 1486077 - RNA, 20 nt, Pseudomonas aeruginosa PA01
acggcggccucgaggucggc

SEQ ID NO: 1486078 - RNA, 19 nt, Pseudomonas aeruginosa PA01
acuagcccucgaccuggcu

SEQ ID NO: 1486079 - RNA, 21 nt, Pseudomonas aeruginosa PA01
acguuggccgucuccaggcgc

SEQ ID NO: 1486080 - RNA, 22 nt, Pseudomonas aeruginosa PA01
acguucaguucugggcggccag

SEQ ID NO: 1486081 - RNA, 13 nt, Pseudomonas aeruginosa PA01
acguuguugccca

SEQ ID NO: 1486082 - RNA, 15 nt, Pseudomonas aeruginosa PA01
acguuuuucccgugg

SEQ ID NO: 1486083 - RNA, 12 nt, Pseudomonas aeruginosa PA01
acgugcaccauc

SEQ ID NO: 1486084 - RNA, 18 nt, Pseudomonas aeruginosa PA01
acgucguuucucggcgau

SEQ ID NO: 1486085 - RNA, 17 nt, Pseudomonas aeruginosa PA01
acgucguacucggcggg

SEQ ID NO: 1486086 - RNA, 20 nt, Pseudomonas aeruginosa PA01
acgucguggauaggcggcgg

SEQ ID NO: 1486087 - RNA, 14 nt, Pseudomonas aeruginosa PA01
acgucguccggcgc

SEQ ID NO: 1486088 - RNA, 16 nt, Pseudomonas aeruginosa PA01
acguggcauucgucgc

SEQ ID NO: 1486089 - RNA, 21 nt, Pseudomonas aeruginosa PA01
acgugggccugcuccucggca

SEQ ID NO: 1486090 - RNA, 21 nt, Pseudomonas aeruginosa PA01
acguguucgcagucgcuuccg

SEQ ID NO: 1486091 - RNA, 16 nt, Pseudomonas aeruginosa PA01
acgugcagcucggcac

SEQ ID NO: 1486092 - RNA, 19 nt, Pseudomonas aeruginosa PA01
acgugcaggaucaccugcu

SEQ ID NO: 1486093 - RNA, 15 nt, Pseudomonas aeruginosa PA01
acgguugucgaugcg

SEQ ID NO: 1486094 - RNA, 16 nt, Pseudomonas aeruginosa PA01
acgguugucgaugcgc

SEQ ID NO: 1486095 - RNA, 18 nt, Pseudomonas aeruginosa PA01
acgguugucgaugcgccc

SEQ ID NO: 1486096 - RNA, 23 nt, Pseudomonas aeruginosa PA01
acgguuggccucggcccgguuuu

SEQ ID NO: 1486097 - RNA, 19 nt, Pseudomonas aeruginosa PA01
acguaggacaggucggugu

SEQ ID NO: 1486098 - RNA, 16 nt, Pseudomonas aeruginosa PA01
acguagcgcaggucgc

SEQ ID NO: 1486099 - RNA, 22 nt, Pseudomonas aeruginosa PA01
acguaggcggcgaaggccgcuu

SEQ ID NO: 1486100 - RNA, 20 nt, Pseudomonas aeruginosa PA01
acguaguaggcgcggguggc

SEQ ID NO: 1486101 - RNA, 22 nt, Pseudomonas aeruginosa PA01
acguaguaggcgcggguggcgu

SEQ ID NO: 1486102 - RNA, 18 nt, Pseudomonas aeruginosa PA01
acgucgguucagcgcgga

SEQ ID NO: 1486103 - RNA, 15 nt, Pseudomonas aeruginosa PA01
acgucguaggccgag

SEQ ID NO: 1486104 - RNA, 15 nt, Pseudomonas aeruginosa PA01
acgucguccagcgcc

SEQ ID NO: 1486105 - RNA, 14 nt, Pseudomonas aeruginosa PA01
acgucgucggcgac

SEQ ID NO: 1486106 - RNA, 20 nt, Pseudomonas aeruginosa PA01
acgucgcggauguucaccag

SEQ ID NO: 1486107 - RNA, 23 nt, Pseudomonas aeruginosa PA01
acgucgcggauguucaccagguu

SEQ ID NO: 1486108 - RNA, 12 nt, Pseudomonas aeruginosa PA01
acgucgccgacc

SEQ ID NO: 1486109 - RNA, 13 nt, Pseudomonas aeruginosa PA01
acgucgccgacca

SEQ ID NO: 1486110 - RNA, 17 nt, Pseudomonas aeruginosa PA01
acgucgccgaccaggcg

SEQ ID NO: 1486111 - RNA, 17 nt, Pseudomonas aeruginosa PA01
acgucgcgcaccuggcg

SEQ ID NO: 1486112 - RNA, 18 nt, Pseudomonas aeruginosa PA01
acgucgcgcaccuggcgg

SEQ ID NO: 1486113 - RNA, 21 nt, Pseudomonas aeruginosa PA01
acgcucagccccgaucgccuc

SEQ ID NO: 1486114 - RNA, 13 nt, Pseudomonas aeruginosa PA01
acgcucaggccaa

SEQ ID NO: 1486115 - RNA, 17 nt, Pseudomonas aeruginosa PA01
acgcucagcacccuggc

SEQ ID NO: 1486116 - RNA, 24 nt, Pseudomonas aeruginosa PA01
acgcuccugcgccggcucgugcga

SEQ ID NO: 1486117 - RNA, 21 nt, Pseudomonas aeruginosa PA01
acgcuccuggaagaacaggcg

SEQ ID NO: 1486118 - RNA, 18 nt, Pseudomonas aeruginosa PA01
acgcucgacauugcugcc

SEQ ID NO: 1486119 - RNA, 17 nt, Pseudomonas aeruginosa PA01
acgcucaccaccaccgc

SEQ ID NO: 1486120 - RNA, 20 nt, Pseudomonas aeruginosa PA01
acgcucaccaccaccgcgcc

SEQ ID NO: 1486121 - RNA, 21 nt, Pseudomonas aeruginosa PA01
acgcucacguagcccccgccg

SEQ ID NO: 1486122 - RNA, 15 nt, Pseudomonas aeruginosa PA01
acgcucaggucgguc

SEQ ID NO: 1486123 - RNA, 15 nt, Pseudomonas aeruginosa PA01
acgcggugccauucg

SEQ ID NO: 1486124 - RNA, 13 nt, Pseudomonas aeruginosa PA01
acgcucgccgacg

SEQ ID NO: 1486125 - RNA, 14 nt, Pseudomonas aeruginosa PA01
acgcucgccgacgg

SEQ ID NO: 1486126 - RNA, 15 nt, Pseudomonas aeruginosa PA01
acgcugacgccggca

SEQ ID NO: 1486127 - RNA, 17 nt, Pseudomonas aeruginosa PA01
acgcucggcgucgucga

SEQ ID NO: 1486128 - RNA, 18 nt, Pseudomonas aeruginosa PA01
acgcucggcgucgucgau

SEQ ID NO: 1486129 - RNA, 19 nt, Pseudomonas aeruginosa PA01
acgcucgcggcaucccgcc

SEQ ID NO: 1486130 - RNA, 17 nt, Pseudomonas aeruginosa PA01
acgcugaggaucacgau

SEQ ID NO: 1486131 - RNA, 20 nt, Pseudomonas aeruginosa PA01
acgcugaggaucacgauggc

SEQ ID NO: 1486132 - RNA, 17 nt, Pseudomonas aeruginosa PA01
acgcggguugcccggcu

SEQ ID NO: 1486133 - RNA, 20 nt, Pseudomonas aeruginosa PA01
acgcggguaauccaucgcuu

SEQ ID NO: 1486134 - RNA, 23 nt, Pseudomonas aeruginosa PA01
acgcgggacuuguacucgccggu

SEQ ID NO: 1486135 - RNA, 13 nt, Pseudomonas aeruginosa PA01
acgcggacagccu

SEQ ID NO: 1486136 - RNA, 16 nt, Pseudomonas aeruginosa PA01
acgcggacagccuggg

SEQ ID NO: 1486137 - RNA, 17 nt, Pseudomonas aeruginosa PA01
acgcggacagccugggc

SEQ ID NO: 1486138 - RNA, 21 nt, Pseudomonas aeruginosa PA01
acgcggaccuugucgccggug

SEQ ID NO: 1486139 - RNA, 14 nt, Pseudomonas aeruginosa PA01
acgcggagggcggc

SEQ ID NO: 1486140 - RNA, 18 nt, Pseudomonas aeruginosa PA01
acgcgcuuguccuccagc

SEQ ID NO: 1486141 - RNA, 20 nt, Pseudomonas aeruginosa PA01
acgcgcuuguccuccagcug

SEQ ID NO: 1486142 - RNA, 22 nt, Pseudomonas aeruginosa PA01
acgcgcuggaccauggccggcg

SEQ ID NO: 1486143 - RNA, 15 nt, Pseudomonas aeruginosa PA01
aaacaguuggacugc

SEQ ID NO: 1486144 - RNA, 21 nt, Pseudomonas aeruginosa PA01
acgccuugcagcaccgccugg

SEQ ID NO: 1486145 - RNA, 11 nt, Pseudomonas aeruginosa PA01
acgccuugcca

SEQ ID NO: 1486146 - RNA, 14 nt, Pseudomonas aeruginosa PA01
acgcagcacggcgg

SEQ ID NO: 1486147 - RNA, 19 nt, Pseudomonas aeruginosa PA01
acgcagagcggcaggccgc

SEQ ID NO: 1486148 - RNA, 16 nt, Pseudomonas aeruginosa PA01
acgcacugguugaagc

SEQ ID NO: 1486149 - RNA, 14 nt, Pseudomonas aeruginosa PA01
acgcgcggcugcuu

SEQ ID NO: 1486150 - RNA, 16 nt, Pseudomonas aeruginosa PA01
acgcgcagggucaggc

SEQ ID NO: 1486151 - RNA, 19 nt, Pseudomonas aeruginosa PA01
acgcgcaguacgaucagcc

SEQ ID NO: 1486152 - RNA, 19 nt, Pseudomonas aeruginosa PA01
acgcgcgcucucgccggcc

SEQ ID NO: 1486153 - RNA, 22 nt, Pseudomonas aeruginosa PA01
acgcgcgcucucgccggccugg

SEQ ID NO: 1486154 - RNA, 13 nt, Pseudomonas aeruginosa PA01
acgcgcagcggcg

SEQ ID NO: 1486155 - RNA, 14 nt, Pseudomonas aeruginosa PA01
acgcgcagcgccgc

SEQ ID NO: 1486156 - RNA, 17 nt, Pseudomonas aeruginosa PA01
acgcgcagcgccgccgc

SEQ ID NO: 1486157 - RNA, 19 nt, Pseudomonas aeruginosa PA01
acgcgaccuccggcgccag

SEQ ID NO: 1486158 - RNA, 21 nt, Pseudomonas aeruginosa PA01
acgcgaccuccggcgccaggc

SEQ ID NO: 1486159 - RNA, 22 nt, Pseudomonas aeruginosa PA01
acgcgaccuccggcgccaggcc

SEQ ID NO: 1486160 - RNA, 17 nt, Pseudomonas aeruginosa PA01
acgcgaaugcccggcag

SEQ ID NO: 1486161 - RNA, 22 nt, Pseudomonas aeruginosa PA01
acgcgaaugcccggcagcgccg

SEQ ID NO: 1486162 - RNA, 15 nt, Pseudomonas aeruginosa PA01
acgcgacagcgacuc

SEQ ID NO: 1486163 - RNA, 13 nt, Pseudomonas aeruginosa PA01
acgcgaccagcgc

SEQ ID NO: 1486164 - RNA, 15 nt, Pseudomonas aeruginosa PA01
acgcgaccagcgcca

SEQ ID NO: 1486165 - RNA, 18 nt, Pseudomonas aeruginosa PA01
acgcgaccagcgccaggc

SEQ ID NO: 1486166 - RNA, 22 nt, Pseudomonas aeruginosa PA01
acggaaugucgucgucgaagcu

SEQ ID NO: 1486167 - RNA, 14 nt, Pseudomonas aeruginosa PA01
acggacccgcucgg

SEQ ID NO: 1486168 - RNA, 21 nt, Pseudomonas aeruginosa PA01
acggaacaggagccaucgcuc

SEQ ID NO: 1486169 - RNA, 21 nt, Pseudomonas aeruginosa PA01
acggaacaugguguugggcag

SEQ ID NO: 1486170 - RNA, 20 nt, Pseudomonas aeruginosa PA01
acgcuugcguuccuccucgu

SEQ ID NO: 1486171 - RNA, 23 nt, Pseudomonas aeruginosa PA01
acgcuucugcgccuccucggcgg

SEQ ID NO: 1486172 - RNA, 13 nt, Pseudomonas aeruginosa PA01
acgcuucgaagcu

SEQ ID NO: 1486173 - RNA, 18 nt, Pseudomonas aeruginosa PA01
acgcuucuccucggccga

SEQ ID NO: 1486174 - RNA, 16 nt, Pseudomonas aeruginosa PA01
acgcugccagcaggcc

SEQ ID NO: 1486175 - RNA, 20 nt, Pseudomonas aeruginosa PA01
acgcugccagcaggccgagc

SEQ ID NO: 1486176 - RNA, 21 nt, Pseudomonas aeruginosa PA01
acgcugccagcaggccgagcc

SEQ ID NO: 1486177 - RNA, 16 nt, Pseudomonas aeruginosa PA01
acgcugaugccggcga

SEQ ID NO: 1486178 - RNA, 17 nt, Pseudomonas aeruginosa PA01
acgcugcaauucgucgg

SEQ ID NO: 1486179 - RNA, 20 nt, Pseudomonas aeruginosa PA01
acgcugcaauucgucggccu

SEQ ID NO: 1486180 - RNA, 21 nt, Pseudomonas aeruginosa PA01
acgcugcaauucgucggccug

SEQ ID NO: 1486181 - RNA, 16 nt, Pseudomonas aeruginosa PA01
acgcugcucgcagccg

SEQ ID NO: 1486182 - RNA, 19 nt, Pseudomonas aeruginosa PA01
acgcugcucgcagccggug

SEQ ID NO: 1486183 - RNA, 21 nt, Pseudomonas aeruginosa PA01
acgcugcggaucaacuccgcc

SEQ ID NO: 1486184 - RNA, 18 nt, Pseudomonas aeruginosa PA01
acgcugcucgacggcacc

SEQ ID NO: 1486185 - RNA, 13 nt, Pseudomonas aeruginosa PA01
acgcugcgccggc

SEQ ID NO: 1486186 - RNA, 14 nt, Pseudomonas aeruginosa PA01
acgcugcgccggcg

SEQ ID NO: 1486187 - RNA, 21 nt, Pseudomonas aeruginosa PA01
acgcugcgccggcgcugcgag

SEQ ID NO: 1486188 - RNA, 13 nt, Pseudomonas aeruginosa PA01
acgcugucgugga

SEQ ID NO: 1486189 - RNA, 14 nt, Pseudomonas aeruginosa PA01
acgcugucguggac

SEQ ID NO: 1486190 - RNA, 21 nt, Pseudomonas aeruginosa PA01
acgcugucguggacgccggug

SEQ ID NO: 1486191 - RNA, 21 nt, Pseudomonas aeruginosa PA01
acggcauaaccgucgcuggag

SEQ ID NO: 1486192 - RNA, 12 nt, Pseudomonas aeruginosa PA01
acggcagguggc

SEQ ID NO: 1486193 - RNA, 23 nt, Pseudomonas aeruginosa PA01
acggcagguggcgggucggcgga

SEQ ID NO: 1486194 - RNA, 14 nt, Pseudomonas aeruginosa PA01
acggcagggucagc

SEQ ID NO: 1486195 - RNA, 13 nt, Pseudomonas aeruginosa PA01
acggcaggccagc

SEQ ID NO: 1486196 - RNA, 16 nt, Pseudomonas aeruginosa PA01
acggcaggccagcagg

SEQ ID NO: 1486197 - RNA, 20 nt, Pseudomonas aeruginosa PA01
acggcaggccagcagguagc

SEQ ID NO: 1486198 - RNA, 15 nt, Pseudomonas aeruginosa PA01
acggcacggggcgcc

SEQ ID NO: 1486199 - RNA, 23 nt, Pseudomonas aeruginosa PA01
acggcagcgucucagcccucggc

SEQ ID NO: 1486200 - RNA, 20 nt, Pseudomonas aeruginosa PA01
acggcaucggagaccacggu

SEQ ID NO: 1486201 - RNA, 21 nt, Pseudomonas aeruginosa PA01
acggcauuggagaugaucagc

SEQ ID NO: 1486202 - RNA, 23 nt, Pseudomonas aeruginosa PA01
acggcauuccugguccagccagc

SEQ ID NO: 1486203 - RNA, 16 nt, Pseudomonas aeruginosa PA01
acggaugcccagccuc

SEQ ID NO: 1486204 - RNA, 16 nt, Pseudomonas aeruginosa PA01
acggauagcgauaggc

SEQ ID NO: 1486205 - RNA, 16 nt, Pseudomonas aeruginosa PA01
acggauaggcggcgga

SEQ ID NO: 1486206 - RNA, 16 nt, Pseudomonas aeruginosa PA01
acggaucacgaucgcg

SEQ ID NO: 1486207 - RNA, 22 nt, Pseudomonas aeruginosa PA01
acggaucgcgcugggcgcagcc

SEQ ID NO: 1486208 - RNA, 15 nt, Pseudomonas aeruginosa PA01
acggcaccaccaccg

SEQ ID NO: 1486209 - RNA, 17 nt, Pseudomonas aeruginosa PA01
acggcaccaccaccgac

SEQ ID NO: 1486210 - RNA, 15 nt, Pseudomonas aeruginosa PA01
acggcacgaccuucu

SEQ ID NO: 1486211 - RNA, 17 nt, Pseudomonas aeruginosa PA01
acggcacacgucggcau

SEQ ID NO: 1486212 - RNA, 18 nt, Pseudomonas aeruginosa PA01
acggcaaggaccugcugc

SEQ ID NO: 1486213 - RNA, 15 nt, Pseudomonas aeruginosa PA01
agaccuguucgcgcc

SEQ ID NO: 1486214 - RNA, 23 nt, Pseudomonas aeruginosa PA01
agaccuguugcagagcggccagg

SEQ ID NO: 1486215 - RNA, 15 nt, Pseudomonas aeruginosa PA01
agacgaucagcagga

SEQ ID NO: 1486216 - RNA, 21 nt, Pseudomonas aeruginosa PA01
agacgaucagcggcccgagca

SEQ ID NO: 1486217 - RNA, 22 nt, Pseudomonas aeruginosa PA01
agacgaucagcggcccgagcag

SEQ ID NO: 1486218 - RNA, 15 nt, Pseudomonas aeruginosa PA01
agacgauggcgacgu

SEQ ID NO: 1486219 - RNA, 13 nt, Pseudomonas aeruginosa PA01
agacgcagcgcua

SEQ ID NO: 1486220 - RNA, 17 nt, Pseudomonas aeruginosa PA01
agacgccagccgcccug

SEQ ID NO: 1486221 - RNA, 19 nt, Pseudomonas aeruginosa PA01
agacgcccagcagggccag

SEQ ID NO: 1486222 - RNA, 19 nt, Pseudomonas aeruginosa PA01
agacgcccggaccgaucuc

SEQ ID NO: 1486223 - RNA, 21 nt, Pseudomonas aeruginosa PA01
agacgcccggaccgaucucgu

SEQ ID NO: 1486224 - RNA, 16 nt, Pseudomonas aeruginosa PA01
agaccugccgcccggc

SEQ ID NO: 1486225 - RNA, 15 nt, Pseudomonas aeruginosa PA01
agaccucgaaguccu

SEQ ID NO: 1486226 - RNA, 15 nt, Pseudomonas aeruginosa PA01
agaccucgagcaggc

SEQ ID NO: 1486227 - RNA, 22 nt, Pseudomonas aeruginosa PA01
agaccucgagcaggccgaggag

SEQ ID NO: 1486228 - RNA, 14 nt, Pseudomonas aeruginosa PA01
agaccgugccgccg

SEQ ID NO: 1486229 - RNA, 15 nt, Pseudomonas aeruginosa PA01
agaccgugccgccgg

SEQ ID NO: 1486230 - RNA, 23 nt, Pseudomonas aeruginosa PA01
agaccggcgccccugcggcgccg

SEQ ID NO: 1486231 - RNA, 18 nt, Pseudomonas aeruginosa PA01
agaccggcuccagggcga

SEQ ID NO: 1486232 - RNA, 13 nt, Pseudomonas aeruginosa PA01
agacccuggcgcu

SEQ ID NO: 1486233 - RNA, 21 nt, Pseudomonas aeruginosa PA01
agacccuggcgcugucgcccg

SEQ ID NO: 1486234 - RNA, 20 nt, Pseudomonas aeruginosa PA01
agacccugggccaacgguag

SEQ ID NO: 1486235 - RNA, 20 nt, Pseudomonas aeruginosa PA01
agaccgagauuggccgccug

SEQ ID NO: 1486236 - RNA, 23 nt, Pseudomonas aeruginosa PA01
agacaggccuccagcaacgccgc

SEQ ID NO: 1486237 - RNA, 18 nt, Pseudomonas aeruginosa PA01
agaccaccgugcgcaccu

SEQ ID NO: 1486238 - RNA, 18 nt, Pseudomonas aeruginosa PA01
agaccaccucgacggcga

SEQ ID NO: 1486239 - RNA, 15 nt, Pseudomonas aeruginosa PA01
agaccaccagcagca

SEQ ID NO: 1486240 - RNA, 20 nt, Pseudomonas aeruginosa PA01
agaccaccagcagcagcggu

SEQ ID NO: 1486241 - RNA, 19 nt, Pseudomonas aeruginosa PA01
agaccaccagcaggaucga

SEQ ID NO: 1486242 - RNA, 17 nt, Pseudomonas aeruginosa PA01
agaccacgcccugcgcc

SEQ ID NO: 1486243 - RNA, 15 nt, Pseudomonas aeruginosa PA01
agaccagcccuggcg

SEQ ID NO: 1486244 - RNA, 12 nt, Pseudomonas aeruginosa PA01
agaccagcagcg

SEQ ID NO: 1486245 - RNA, 15 nt, Pseudomonas aeruginosa PA01
agaccagcagcggca

SEQ ID NO: 1486246 - RNA, 19 nt, Pseudomonas aeruginosa PA01
agacccaggugcgcaggcg

SEQ ID NO: 1486247 - RNA, 17 nt, Pseudomonas aeruginosa PA01
agaccaggaaggccggg

SEQ ID NO: 1486248 - RNA, 16 nt, Pseudomonas aeruginosa PA01
agaccaggccgagcag

SEQ ID NO: 1486249 - RNA, 17 nt, Pseudomonas aeruginosa PA01
agacgcugcaccgcggc

SEQ ID NO: 1486250 - RNA, 19 nt, Pseudomonas aeruginosa PA01
agacgcugccgaggaacuc

SEQ ID NO: 1486251 - RNA, 21 nt, Pseudomonas aeruginosa PA01
agacgcugccgaggaacucgc

SEQ ID NO: 1486252 - RNA, 20 nt, Pseudomonas aeruginosa PA01
agacgcugcgaccuggcgcc

SEQ ID NO: 1486253 - RNA, 19 nt, Pseudomonas aeruginosa PA01
agacgcugcucgacggcac

SEQ ID NO: 1486254 - RNA, 17 nt, Pseudomonas aeruginosa PA01
agacgggcgacgcccau

SEQ ID NO: 1486255 - RNA, 17 nt, Pseudomonas aeruginosa PA01
agacgcgggcccagcgg

SEQ ID NO: 1486256 - RNA, 19 nt, Pseudomonas aeruginosa PA01
agacgguucagcagcggca

SEQ ID NO: 1486257 - RNA, 18 nt, Pseudomonas aeruginosa PA01
agacguccuccaccgcuc

SEQ ID NO: 1486258 - RNA, 18 nt, Pseudomonas aeruginosa PA01
agacguacagcgggucgg

SEQ ID NO: 1486259 - RNA, 13 nt, Pseudomonas aeruginosa PA01
agacguccagcgc

SEQ ID NO: 1486260 - RNA, 16 nt, Pseudomonas aeruginosa PA01
agacguccagcgccac

SEQ ID NO: 1486261 - RNA, 19 nt, Pseudomonas aeruginosa PA01
agacguuguugacguugac

SEQ ID NO: 1486262 - RNA, 15 nt, Pseudomonas aeruginosa PA01
agacguugacgaucg

SEQ ID NO: 1486263 - RNA, 16 nt, Pseudomonas aeruginosa PA01
agacgugaagccccug

SEQ ID NO: 1486264 - RNA, 23 nt, Pseudomonas aeruginosa PA01
agacguggcauucgucgccgcug

SEQ ID NO: 1486265 - RNA, 15 nt, Pseudomonas aeruginosa PA01
agacgucguccaccg

SEQ ID NO: 1486266 - RNA, 14 nt, Pseudomonas aeruginosa PA01
agagaagcguucgc

SEQ ID NO: 1486267 - RNA, 13 nt, Pseudomonas aeruginosa PA01
agagagcgccagc

SEQ ID NO: 1486268 - RNA, 21 nt, Pseudomonas aeruginosa PA01
agagcgcugccugcaccgggc

SEQ ID NO: 1486269 - RNA, 22 nt, Pseudomonas aeruginosa PA01
agagcgcugccugcaccgggcc

SEQ ID NO: 1486270 - RNA, 23 nt, Pseudomonas aeruginosa PA01
agagcgcgcccugcaggccgaau

SEQ ID NO: 1486271 - RNA, 14 nt, Pseudomonas aeruginosa PA01
agagcccgccgaac

SEQ ID NO: 1486272 - RNA, 16 nt, Pseudomonas aeruginosa PA01
agagccaugggccggc

SEQ ID NO: 1486273 - RNA, 21 nt, Pseudomonas aeruginosa PA01
agagcgaauacaccgagcgca

SEQ ID NO: 1486274 - RNA, 12 nt, Pseudomonas aeruginosa PA01
agagccgccgaa

SEQ ID NO: 1486275 - RNA, 21 nt, Pseudomonas aeruginosa PA01
agagcaccuugucgcugaccg

SEQ ID NO: 1486276 - RNA, 13 nt, Pseudomonas aeruginosa PA01
agagaucgcccag

SEQ ID NO: 1486277 - RNA, 14 nt, Pseudomonas aeruginosa PA01
agagcagagucgcc

SEQ ID NO: 1486278 - RNA, 15 nt, Pseudomonas aeruginosa PA01
agagcagagucgccg

SEQ ID NO: 1486279 - RNA, 15 nt, Pseudomonas aeruginosa PA01
agagcagcaccacgg

SEQ ID NO: 1486280 - RNA, 23 nt, Pseudomonas aeruginosa PA01
agauguccaucagccgcgcgcug

SEQ ID NO: 1486281 - RNA, 18 nt, Pseudomonas aeruginosa PA01
agauggucgaaccagcuc

SEQ ID NO: 1486282 - RNA, 15 nt, Pseudomonas aeruginosa PA01
agauguucgccgccg

SEQ ID NO: 1486283 - RNA, 16 nt, Pseudomonas aeruginosa PA01
agauguucgccgccgc

SEQ ID NO: 1486284 - RNA, 12 nt, Pseudomonas aeruginosa PA01
agaugcggcugu

SEQ ID NO: 1486285 - RNA, 19 nt, Pseudomonas aeruginosa PA01
agaugcggcugugcucgag

SEQ ID NO: 1486286 - RNA, 17 nt, Pseudomonas aeruginosa PA01
agaugcugcgggcgccg

SEQ ID NO: 1486287 - RNA, 20 nt, Pseudomonas aeruginosa PA01
agaugcugcgggcgccgccg

SEQ ID NO: 1486288 - RNA, 19 nt, Pseudomonas aeruginosa PA01
agaugcuugcacaccuggu

SEQ ID NO: 1486289 - RNA, 18 nt, Pseudomonas aeruginosa PA01
agauggcuaaacaagcca

SEQ ID NO: 1486290 - RNA, 14 nt, Pseudomonas aeruginosa PA01
agaugccacugacg

SEQ ID NO: 1486291 - RNA, 19 nt, Pseudomonas aeruginosa PA01
agaugccacugacgcgcag

SEQ ID NO: 1486292 - RNA, 24 nt, Pseudomonas aeruginosa PA01
agaugccacugacgcgcagcgccg

SEQ ID NO: 1486293 - RNA, 15 nt, Pseudomonas aeruginosa PA01
agaugcgcgucgccg

SEQ ID NO: 1486294 - RNA, 21 nt, Pseudomonas aeruginosa PA01
agaugacgauggccgccgccg

SEQ ID NO: 1486295 - RNA, 16 nt, Pseudomonas aeruginosa PA01
agaugaagcgccgcag

SEQ ID NO: 1486296 - RNA, 15 nt, Pseudomonas aeruginosa PA01
agaugcacaccagcu

SEQ ID NO: 1486297 - RNA, 16 nt, Pseudomonas aeruginosa PA01
agaugcacaccagcuc

SEQ ID NO: 1486298 - RNA, 19 nt, Pseudomonas aeruginosa PA01
agauccuggccggcggcgu

SEQ ID NO: 1486299 - RNA, 21 nt, Pseudomonas aeruginosa PA01
agauccgccgugaggcgcgcg

SEQ ID NO: 1486300 - RNA, 13 nt, Pseudomonas aeruginosa PA01
agaucgagcgcgc

SEQ ID NO: 1486301 - RNA, 15 nt, Pseudomonas aeruginosa PA01
agaucgagcgcgccc

SEQ ID NO: 1486302 - RNA, 16 nt, Pseudomonas aeruginosa PA01
agaucgccagcucgcc

SEQ ID NO: 1486303 - RNA, 14 nt, Pseudomonas aeruginosa PA01
agaucgcccagcgg

SEQ ID NO: 1486304 - RNA, 15 nt, Pseudomonas aeruginosa PA01
agaucgccagcgcca

SEQ ID NO: 1486305 - RNA, 16 nt, Pseudomonas aeruginosa PA01
agaucgccagcgccag

SEQ ID NO: 1486306 - RNA, 22 nt, Pseudomonas aeruginosa PA01
agaucgccagcgccagcaggua

SEQ ID NO: 1486307 - RNA, 15 nt, Pseudomonas aeruginosa PA01
agaucgccaccccgc

SEQ ID NO: 1486308 - RNA, 21 nt, Pseudomonas aeruginosa PA01
agaucgccaccccgccgcugg

SEQ ID NO: 1486309 - RNA, 21 nt, Pseudomonas aeruginosa PA01
agaucggcagcaucagccgcg

SEQ ID NO: 1486310 - RNA, 22 nt, Pseudomonas aeruginosa PA01
agaucggcgcgcagggccagca

SEQ ID NO: 1486311 - RNA, 19 nt, Pseudomonas aeruginosa PA01
agaucgcgccgagcuggcg

SEQ ID NO: 1486312 - RNA, 15 nt, Pseudomonas aeruginosa PA01
agaucgcguccaggg

SEQ ID NO: 1486313 - RNA, 18 nt, Pseudomonas aeruginosa PA01
agaucgcguuugccgucc

SEQ ID NO: 1486314 - RNA, 14 nt, Pseudomonas aeruginosa PA01
agaucgccgcgccg

SEQ ID NO: 1486315 - RNA, 22 nt, Pseudomonas aeruginosa PA01
agaucgccguguugaugccgau

SEQ ID NO: 1486316 - RNA, 13 nt, Pseudomonas aeruginosa PA01
agaucggcggcgc

SEQ ID NO: 1486317 - RNA, 17 nt, Pseudomonas aeruginosa PA01
agaucggcggcgcggcg

SEQ ID NO: 1486318 - RNA, 19 nt, Pseudomonas aeruginosa PA01
agaucggugcgggcagaca

SEQ ID NO: 1486319 - RNA, 14 nt, Pseudomonas aeruginosa PA01
agaugaaacugccc

SEQ ID NO: 1486320 - RNA, 19 nt, Pseudomonas aeruginosa PA01
agaucugcaccaggcucgc

SEQ ID NO: 1486321 - RNA, 14 nt, Pseudomonas aeruginosa PA01
agaucugcaccgcc

SEQ ID NO: 1486322 - RNA, 15 nt, Pseudomonas aeruginosa PA01
agaucugugcggugc

SEQ ID NO: 1486323 - RNA, 15 nt, Pseudomonas aeruginosa PA01
agagugcccaggcgc

SEQ ID NO: 1486324 - RNA, 17 nt, Pseudomonas aeruginosa PA01
agagugcgcagcagcgu

SEQ ID NO: 1486325 - RNA, 14 nt, Pseudomonas aeruginosa PA01
agagggucagccgg

SEQ ID NO: 1486326 - RNA, 16 nt, Pseudomonas aeruginosa PA01
agagggucgccagcga

SEQ ID NO: 1486327 - RNA, 20 nt, Pseudomonas aeruginosa PA01
agagggcgaugcccuuggcc

SEQ ID NO: 1486328 - RNA, 14 nt, Pseudomonas aeruginosa PA01
agagggcggcgacc

SEQ ID NO: 1486329 - RNA, 12 nt, Pseudomonas aeruginosa PA01
agaggucgccga

SEQ ID NO: 1486330 - RNA, 19 nt, Pseudomonas aeruginosa PA01
agaggucggcgcgcccggc

SEQ ID NO: 1486331 - RNA, 14 nt, Pseudomonas aeruginosa PA01
agagguugcgcccg

SEQ ID NO: 1486332 - RNA, 17 nt, Pseudomonas aeruginosa PA01
agaggaucuccgagucc

SEQ ID NO: 1486333 - RNA, 21 nt, Pseudomonas aeruginosa PA01
agaggcauucaucaccagcuc

SEQ ID NO: 1486334 - RNA, 15 nt, Pseudomonas aeruginosa PA01
agaggcccucggcgc

SEQ ID NO: 1486335 - RNA, 17 nt, Pseudomonas aeruginosa PA01
agaggaacaguucggcg

SEQ ID NO: 1486336 - RNA, 18 nt, Pseudomonas aeruginosa PA01
agaggcguucaugaaagc

SEQ ID NO: 1486337 - RNA, 22 nt, Pseudomonas aeruginosa PA01
agagcuaguuauugaaguggug

SEQ ID NO: 1486338 - RNA, 16 nt, Pseudomonas aeruginosa PA01
agagcucccugccgcc

SEQ ID NO: 1486339 - RNA, 17 nt, Pseudomonas aeruginosa PA01
agagcucccugccgccc

SEQ ID NO: 1486340 - RNA, 12 nt, Pseudomonas aeruginosa PA01
agagcggcgcca

SEQ ID NO: 1486341 - RNA, 14 nt, Pseudomonas aeruginosa PA01
agagcuggcggccg

SEQ ID NO: 1486342 - RNA, 16 nt, Pseudomonas aeruginosa PA01
agagcuguccggcgcu

SEQ ID NO: 1486343 - RNA, 17 nt, Pseudomonas aeruginosa PA01
agaggcaacaccaucgg

SEQ ID NO: 1486344 - RNA, 21 nt, Pseudomonas aeruginosa PA01
agaggcaacaccaucggcccc

SEQ ID NO: 1486345 - RNA, 22 nt, Pseudomonas aeruginosa PA01
agaucagcgcggugagcagggu

SEQ ID NO: 1486346 - RNA, 13 nt, Pseudomonas aeruginosa PA01
agaucaccaccac

SEQ ID NO: 1486347 - RNA, 13 nt, Pseudomonas aeruginosa PA01
agauccagcggca

SEQ ID NO: 1486348 - RNA, 12 nt, Pseudomonas aeruginosa PA01
agaucaggccgg

SEQ ID NO: 1486349 - RNA, 16 nt, Pseudomonas aeruginosa PA01
agauacuccagcagcg

SEQ ID NO: 1486350 - RNA, 21 nt, Pseudomonas aeruginosa PA01
agauaucgccuuccucggcga

SEQ ID NO: 1486351 - RNA, 20 nt, Pseudomonas aeruginosa PA01
acuucgaccaguacgucgag

SEQ ID NO: 1486352 - RNA, 20 nt, Pseudomonas aeruginosa PA01
acuucgacgaacucgacgcg

SEQ ID NO: 1486353 - RNA, 13 nt, Pseudomonas aeruginosa PA01
acuuccucggcga

SEQ ID NO: 1486354 - RNA, 18 nt, Pseudomonas aeruginosa PA01
acuuccacuccaggcggc

SEQ ID NO: 1486355 - RNA, 20 nt, Pseudomonas aeruginosa PA01
acuuccacuccaggcggcgg

SEQ ID NO: 1486356 - RNA, 20 nt, Pseudomonas aeruginosa PA01
acuuccagcacgccgauccc

SEQ ID NO: 1486357 - RNA, 14 nt, Pseudomonas aeruginosa PA01
acuuccccucccga

SEQ ID NO: 1486358 - RNA, 14 nt, Pseudomonas aeruginosa PA01
acuuccagcugcca

SEQ ID NO: 1486359 - RNA, 14 nt, Pseudomonas aeruginosa PA01
acuuccaggcgcag

SEQ ID NO: 1486360 - RNA, 16 nt, Pseudomonas aeruginosa PA01
acuuccaggcgcaggc

SEQ ID NO: 1486361 - RNA, 14 nt, Pseudomonas aeruginosa PA01
acuucccggcgcag

SEQ ID NO: 1486362 - RNA, 13 nt, Pseudomonas aeruginosa PA01
acuucccugccgg

SEQ ID NO: 1486363 - RNA, 12 nt, Pseudomonas aeruginosa PA01
acuuccggcccg

SEQ ID NO: 1486364 - RNA, 15 nt, Pseudomonas aeruginosa PA01
acuuccggcccggcc

SEQ ID NO: 1486365 - RNA, 20 nt, Pseudomonas aeruginosa PA01
acuuccggcccggccaggcg

SEQ ID NO: 1486366 - RNA, 20 nt, Pseudomonas aeruginosa PA01
acuuccgggcugcgcucggc

SEQ ID NO: 1486367 - RNA, 13 nt, Pseudomonas aeruginosa PA01
agaaaaggccgcu

SEQ ID NO: 1486368 - RNA, 23 nt, Pseudomonas aeruginosa PA01
agaaaccgaaguagucgccccgg

SEQ ID NO: 1486369 - RNA, 19 nt, Pseudomonas aeruginosa PA01
agaaacgguggaggcgucg

SEQ ID NO: 1486370 - RNA, 20 nt, Pseudomonas aeruginosa PA01
agaaacgguggaggcgucgg

SEQ ID NO: 1486371 - RNA, 21 nt, Pseudomonas aeruginosa PA01
agaaacgcgccuccggcagcg

SEQ ID NO: 1486372 - RNA, 17 nt, Pseudomonas aeruginosa PA01
agaaacuuucuucgcca

SEQ ID NO: 1486373 - RNA, 22 nt, Pseudomonas aeruginosa PA01
agaacagcaaagcgcagguagc

SEQ ID NO: 1486374 - RNA, 14 nt, Pseudomonas aeruginosa PA01
agaacacggcuucg

SEQ ID NO: 1486375 - RNA, 19 nt, Pseudomonas aeruginosa PA01
agaacacggcuucgcagau

SEQ ID NO: 1486376 - RNA, 17 nt, Pseudomonas aeruginosa PA01
agaaauccaccuugccg

SEQ ID NO: 1486377 - RNA, 16 nt, Pseudomonas aeruginosa PA01
agaaauagaaggucac

SEQ ID NO: 1486378 - RNA, 22 nt, Pseudomonas aeruginosa PA01
agaaccccggccaugagccggg

SEQ ID NO: 1486379 - RNA, 22 nt, Pseudomonas aeruginosa PA01
agaaccaccgguuugcugaccg

SEQ ID NO: 1486380 - RNA, 17 nt, Pseudomonas aeruginosa PA01
agaacaucggcgcuccg

SEQ ID NO: 1486381 - RNA, 14 nt, Pseudomonas aeruginosa PA01
agaacagcaggguc

SEQ ID NO: 1486382 - RNA, 20 nt, Pseudomonas aeruginosa PA01
agaacaggcgauagccgacc

SEQ ID NO: 1486383 - RNA, 21 nt, Pseudomonas aeruginosa PA01
agaacaggcgcuucagcucga

SEQ ID NO: 1486384 - RNA, 14 nt, Pseudomonas aeruginosa PA01
agaacaggcugccg

SEQ ID NO: 1486385 - RNA, 20 nt, Pseudomonas aeruginosa PA01
agaacgaaaaaggcgcgccg

SEQ ID NO: 1486386 - RNA, 17 nt, Pseudomonas aeruginosa PA01
agaacgacaugcucauc

SEQ ID NO: 1486387 - RNA, 19 nt, Pseudomonas aeruginosa PA01
agaacgccaggaucggcau

SEQ ID NO: 1486388 - RNA, 17 nt, Pseudomonas aeruginosa PA01
agaacugcucggcgucc

SEQ ID NO: 1486389 - RNA, 16 nt, Pseudomonas aeruginosa PA01
agaacguugcccaccg

SEQ ID NO: 1486390 - RNA, 19 nt, Pseudomonas aeruginosa PA01
agaacugccgggccagcuc

SEQ ID NO: 1486391 - RNA, 12 nt, Pseudomonas aeruginosa PA01
agaagccgaccu

SEQ ID NO: 1486392 - RNA, 14 nt, Pseudomonas aeruginosa PA01
agaagccgcugacc

SEQ ID NO: 1486393 - RNA, 15 nt, Pseudomonas aeruginosa PA01
agaagccgcugaccu

SEQ ID NO: 1486394 - RNA, 20 nt, Pseudomonas aeruginosa PA01
agaagaucgccugcuggccg

SEQ ID NO: 1486395 - RNA, 19 nt, Pseudomonas aeruginosa PA01
agaagcggccgaccaggcc

SEQ ID NO: 1486396 - RNA, 19 nt, Pseudomonas aeruginosa PA01
agaaggggagccgaggcuc

SEQ ID NO: 1486397 - RNA, 21 nt, Pseudomonas aeruginosa PA01
agaaggugcccagcggcgccu

SEQ ID NO: 1486398 - RNA, 20 nt, Pseudomonas aeruginosa PA01
agaaguauuucaaccaggcg

SEQ ID NO: 1486399 - RNA, 13 nt, Pseudomonas aeruginosa PA01
agaagucccagcg

SEQ ID NO: 1486400 - RNA, 22 nt, Pseudomonas aeruginosa PA01
agaaggucaccgcucgccagau

SEQ ID NO: 1486401 - RNA, 18 nt, Pseudomonas aeruginosa PA01
agaaucgccgaggcgucg

SEQ ID NO: 1486402 - RNA, 21 nt, Pseudomonas aeruginosa PA01
acugauaucguuguucagcag

SEQ ID NO: 1486403 - RNA, 23 nt, Pseudomonas aeruginosa PA01
acugauaucguuguucagcaggg

SEQ ID NO: 1486404 - RNA, 20 nt, Pseudomonas aeruginosa PA01
acugcacgcccaucgccacc

SEQ ID NO: 1486405 - RNA, 14 nt, Pseudomonas aeruginosa PA01
acugcaacuggccg

SEQ ID NO: 1486406 - RNA, 15 nt, Pseudomonas aeruginosa PA01
acugcaugaccucca

SEQ ID NO: 1486407 - RNA, 14 nt, Pseudomonas aeruginosa PA01
acugcccagcgccg

SEQ ID NO: 1486408 - RNA, 15 nt, Pseudomonas aeruginosa PA01
acugcccagcgccgc

SEQ ID NO: 1486409 - RNA, 21 nt, Pseudomonas aeruginosa PA01
acugccaggguaccguugcgc

SEQ ID NO: 1486410 - RNA, 16 nt, Pseudomonas aeruginosa PA01
acugccgccucagcga

SEQ ID NO: 1486411 - RNA, 15 nt, Pseudomonas aeruginosa PA01
acugaagacccggcg

SEQ ID NO: 1486412 - RNA, 20 nt, Pseudomonas aeruginosa PA01
acugaagagugggcggggua

SEQ ID NO: 1486413 - RNA, 18 nt, Pseudomonas aeruginosa PA01
acugaacuggaucggccc

SEQ ID NO: 1486414 - RNA, 12 nt, Pseudomonas aeruginosa PA01
acugacggcgga

SEQ ID NO: 1486415 - RNA, 13 nt, Pseudomonas aeruginosa PA01
acugacgguggag

SEQ ID NO: 1486416 - RNA, 21 nt, Pseudomonas aeruginosa PA01
acugaccacgcagagcggcag

SEQ ID NO: 1486417 - RNA, 17 nt, Pseudomonas aeruginosa PA01
acugacgaaggcuggag

SEQ ID NO: 1486418 - RNA, 19 nt, Pseudomonas aeruginosa PA01
acuguuuuccauggcgagu

SEQ ID NO: 1486419 - RNA, 17 nt, Pseudomonas aeruginosa PA01
acugguggcgaacagca

SEQ ID NO: 1486420 - RNA, 18 nt, Pseudomonas aeruginosa PA01
acugguggcgaacagcac

SEQ ID NO: 1486421 - RNA, 18 nt, Pseudomonas aeruginosa PA01
acuggucuugccgauggc

SEQ ID NO: 1486422 - RNA, 18 nt, Pseudomonas aeruginosa PA01
acuggucgccgcaggucc

SEQ ID NO: 1486423 - RNA, 22 nt, Pseudomonas aeruginosa PA01
acuggucgcggcugcgcgccgg

SEQ ID NO: 1486424 - RNA, 18 nt, Pseudomonas aeruginosa PA01
acuggucgcuccagcccc

SEQ ID NO: 1486425 - RNA, 13 nt, Pseudomonas aeruginosa PA01
acuggucgcgcgc

SEQ ID NO: 1486426 - RNA, 14 nt, Pseudomonas aeruginosa PA01
acuggucgcgcgcg

SEQ ID NO: 1486427 - RNA, 19 nt, Pseudomonas aeruginosa PA01
acugguccugcggcggcag

SEQ ID NO: 1486428 - RNA, 14 nt, Pseudomonas aeruginosa PA01
acuggucgcagccg

SEQ ID NO: 1486429 - RNA, 16 nt, Pseudomonas aeruginosa PA01
acuggucgcagccgcg

SEQ ID NO: 1486430 - RNA, 20 nt, Pseudomonas aeruginosa PA01
acugguccggguuggcgcag

SEQ ID NO: 1486431 - RNA, 19 nt, Pseudomonas aeruginosa PA01
acuggccagcaccaguccc

SEQ ID NO: 1486432 - RNA, 22 nt, Pseudomonas aeruginosa PA01
acuggcccucucucgccucggc

SEQ ID NO: 1486433 - RNA, 17 nt, Pseudomonas aeruginosa PA01
acuggcccacggcgccu

SEQ ID NO: 1486434 - RNA, 22 nt, Pseudomonas aeruginosa PA01
acuggcccacggcgccuuccca

SEQ ID NO: 1486435 - RNA, 20 nt, Pseudomonas aeruginosa PA01
acugcguggguagccauggc

SEQ ID NO: 1486436 - RNA, 23 nt, Pseudomonas aeruginosa PA01
acugcguggguagccauggcgga

SEQ ID NO: 1486437 - RNA, 13 nt, Pseudomonas aeruginosa PA01
acuggcgccaggc

SEQ ID NO: 1486438 - RNA, 14 nt, Pseudomonas aeruginosa PA01
acuggcgcugcgcg

SEQ ID NO: 1486439 - RNA, 17 nt, Pseudomonas aeruginosa PA01
acuggcggaccgccucg

SEQ ID NO: 1486440 - RNA, 18 nt, Pseudomonas aeruginosa PA01
acuggcggaccgccucga

SEQ ID NO: 1486441 - RNA, 19 nt, Pseudomonas aeruginosa PA01
acuggcggaccgccucgac

SEQ ID NO: 1486442 - RNA, 22 nt, Pseudomonas aeruginosa PA01
acuggcggaucuucgccuccuu

SEQ ID NO: 1486443 - RNA, 20 nt, Pseudomonas aeruginosa PA01
acugcgguuuuccugccccg

SEQ ID NO: 1486444 - RNA, 14 nt, Pseudomonas aeruginosa PA01
acugcgcgccaguc

SEQ ID NO: 1486445 - RNA, 19 nt, Pseudomonas aeruginosa PA01
acugccgcuaucgcuggcg

SEQ ID NO: 1486446 - RNA, 22 nt, Pseudomonas aeruginosa PA01
acugccgcuaucgcuggcgcag

SEQ ID NO: 1486447 - RNA, 19 nt, Pseudomonas aeruginosa PA01
acugccgggccagcuccag

SEQ ID NO: 1486448 - RNA, 17 nt, Pseudomonas aeruginosa PA01
acugcgcccccagcgcc

SEQ ID NO: 1486449 - RNA, 18 nt, Pseudomonas aeruginosa PA01
acugcgcccccagcgccc

SEQ ID NO: 1486450 - RNA, 20 nt, Pseudomonas aeruginosa PA01
acugcgcccccagcgcccgc

SEQ ID NO: 1486451 - RNA, 12 nt, Pseudomonas aeruginosa PA01
gccagcaggccg

SEQ ID NO: 1486452 - RNA, 13 nt, Pseudomonas aeruginosa PA01
gccagcaggaucg

SEQ ID NO: 1486453 - RNA, 15 nt, Pseudomonas aeruginosa PA01
gccagcaggccgugg

SEQ ID NO: 1486454 - RNA, 13 nt, Pseudomonas aeruginosa PA01
gccagcaggcgau

SEQ ID NO: 1486455 - RNA, 15 nt, Pseudomonas aeruginosa PA01
gccagcaggcgcagc

SEQ ID NO: 1486456 - RNA, 19 nt, Pseudomonas aeruginosa PA01
gccagcaggcgcagcagcg

SEQ ID NO: 1486457 - RNA, 13 nt, Pseudomonas aeruginosa PA01
gccagcaggcgcc

SEQ ID NO: 1486458 - RNA, 16 nt, Pseudomonas aeruginosa PA01
gccagcaggcgccgcg

SEQ ID NO: 1486459 - RNA, 17 nt, Pseudomonas aeruginosa PA01
gccagcaggcgccggcg

SEQ ID NO: 1486460 - RNA, 18 nt, Pseudomonas aeruginosa PA01
gccagcaggcgccggcgg

SEQ ID NO: 1486461 - RNA, 15 nt, Pseudomonas aeruginosa PA01
gccagcaggcgcggg

SEQ ID NO: 1486462 - RNA, 16 nt, Pseudomonas aeruginosa PA01
gccagcaggcgcgggc

SEQ ID NO: 1486463 - RNA, 17 nt, Pseudomonas aeruginosa PA01
gccagcagcagaagggc

SEQ ID NO: 1486464 - RNA, 12 nt, Pseudomonas aeruginosa PA01
gccagcagcacg

SEQ ID NO: 1486465 - RNA, 13 nt, Pseudomonas aeruginosa PA01
gccagcaggcgcu

SEQ ID NO: 1486466 - RNA, 16 nt, Pseudomonas aeruginosa PA01
gccagcaggccgagcc

SEQ ID NO: 1486467 - RNA, 20 nt, Pseudomonas aeruginosa PA01
gccagcaggccgaucagcgg

SEQ ID NO: 1486468 - RNA, 15 nt, Pseudomonas aeruginosa PA01
gccagcaggcguugc

SEQ ID NO: 1486469 - RNA, 16 nt, Pseudomonas aeruginosa PA01
gccagcaggcguugca

SEQ ID NO: 1486470 - RNA, 15 nt, Pseudomonas aeruginosa PA01
gccagcaggcgcucg

SEQ ID NO: 1486471 - RNA, 20 nt, Pseudomonas aeruginosa PA01
gccagcaggcgcucggcgac

SEQ ID NO: 1486472 - RNA, 13 nt, Pseudomonas aeruginosa PA01
gccagcaggcugg

SEQ ID NO: 1486473 - RNA, 16 nt, Pseudomonas aeruginosa PA01
gccagcagggccgccg

SEQ ID NO: 1486474 - RNA, 18 nt, Pseudomonas aeruginosa PA01
gccagcagggccgccgag

SEQ ID NO: 1486475 - RNA, 16 nt, Pseudomonas aeruginosa PA01
gccagcaacaguugcc

SEQ ID NO: 1486476 - RNA, 19 nt, Pseudomonas aeruginosa PA01
gccagcaacaguugccgca

SEQ ID NO: 1486477 - RNA, 21 nt, Pseudomonas aeruginosa PA01
gccacuucguccggccgcccg

SEQ ID NO: 1486478 - RNA, 14 nt, Pseudomonas aeruginosa PA01
gccacuucccggcg

SEQ ID NO: 1486479 - RNA, 16 nt, Pseudomonas aeruginosa PA01
gccacuucccggcgca

SEQ ID NO: 1486480 - RNA, 17 nt, Pseudomonas aeruginosa PA01
gccacuucccggcgcag

SEQ ID NO: 1486481 - RNA, 18 nt, Pseudomonas aeruginosa PA01
gccacuucccggcgcaga

SEQ ID NO: 1486482 - RNA, 15 nt, Pseudomonas aeruginosa PA01
gccagcaaugcccgc

SEQ ID NO: 1486483 - RNA, 16 nt, Pseudomonas aeruginosa PA01
gccagcaagacggucc

SEQ ID NO: 1486484 - RNA, 12 nt, Pseudomonas aeruginosa PA01
gccagcaccagu

SEQ ID NO: 1486485 - RNA, 14 nt, Pseudomonas aeruginosa PA01
gccagcaccagucc

SEQ ID NO: 1486486 - RNA, 16 nt, Pseudomonas aeruginosa PA01
gccagcaccagucccu

SEQ ID NO: 1486487 - RNA, 20 nt, Pseudomonas aeruginosa PA01
gccagcaccagucccuggcc

SEQ ID NO: 1486488 - RNA, 19 nt, Pseudomonas aeruginosa PA01
gccagcaauacccgccgcu

SEQ ID NO: 1486489 - RNA, 13 nt, Pseudomonas aeruginosa PA01
gccagcaccaugc

SEQ ID NO: 1486490 - RNA, 18 nt, Pseudomonas aeruginosa PA01
gccagcaccguggucagc

SEQ ID NO: 1486491 - RNA, 14 nt, Pseudomonas aeruginosa PA01
gccagccgcgaguc

SEQ ID NO: 1486492 - RNA, 21 nt, Pseudomonas aeruginosa PA01
gccagccgccuugcucgaccc

SEQ ID NO: 1486493 - RNA, 23 nt, Pseudomonas aeruginosa PA01
gccagccgccuugcucgacccgg

SEQ ID NO: 1486494 - RNA, 16 nt, Pseudomonas aeruginosa PA01
gccagccgcgccagug

SEQ ID NO: 1486495 - RNA, 17 nt, Pseudomonas aeruginosa PA01
gccagccgcgccagugc

SEQ ID NO: 1486496 - RNA, 14 nt, Pseudomonas aeruginosa PA01
gccagccgucgucg

SEQ ID NO: 1486497 - RNA, 15 nt, Pseudomonas aeruginosa PA01
gccagccgcccuggc

SEQ ID NO: 1486498 - RNA, 17 nt, Pseudomonas aeruginosa PA01
gccagccgcccuggcuc

SEQ ID NO: 1486499 - RNA, 15 nt, Pseudomonas aeruginosa PA01
gccagccgccgaagg

SEQ ID NO: 1486500 - RNA, 12 nt, Pseudomonas aeruginosa PA01
gccagcccuggu

SEQ ID NO: 1486501 - RNA, 22 nt, Pseudomonas aeruginosa PA01
gccagcccuuucagcggcugcc

SEQ ID NO: 1486502 - RNA, 18 nt, Pseudomonas aeruginosa PA01
gccagccgagcaacucgg

SEQ ID NO: 1486503 - RNA, 19 nt, Pseudomonas aeruginosa PA01
gccagccgagcaacucggc

SEQ ID NO: 1486504 - RNA, 22 nt, Pseudomonas aeruginosa PA01
gccagccgagcaacucggcggc

SEQ ID NO: 1486505 - RNA, 18 nt, Pseudomonas aeruginosa PA01
gccagcccucgcccaggu

SEQ ID NO: 1486506 - RNA, 23 nt, Pseudomonas aeruginosa PA01
gccagcccucggggaaggucacc

SEQ ID NO: 1486507 - RNA, 17 nt, Pseudomonas aeruginosa PA01
gccagcgaacccaggcc

SEQ ID NO: 1486508 - RNA, 19 nt, Pseudomonas aeruginosa PA01
gccagcgaacccaggccgc

SEQ ID NO: 1486509 - RNA, 22 nt, Pseudomonas aeruginosa PA01
gccagcgaacccaggccgcgca

SEQ ID NO: 1486510 - RNA, 14 nt, Pseudomonas aeruginosa PA01
gccagcgaacgcac

SEQ ID NO: 1486511 - RNA, 23 nt, Pseudomonas aeruginosa PA01
gccagcgaacgcacuucguccgc

SEQ ID NO: 1486512 - RNA, 17 nt, Pseudomonas aeruginosa PA01
gccagccuucccggcgc

SEQ ID NO: 1486513 - RNA, 19 nt, Pseudomonas aeruginosa PA01
gccagccuucccggcgcuu

SEQ ID NO: 1486514 - RNA, 14 nt, Pseudomonas aeruginosa PA01
gccagccuuccucg

SEQ ID NO: 1486515 - RNA, 23 nt, Pseudomonas aeruginosa PA01
gccagccuggccagcgcuucgcg

SEQ ID NO: 1486516 - RNA, 17 nt, Pseudomonas aeruginosa PA01
gccagcgcccaggccgg

SEQ ID NO: 1486517 - RNA, 16 nt, Pseudomonas aeruginosa PA01
gccagcgccgccgcgu

SEQ ID NO: 1486518 - RNA, 20 nt, Pseudomonas aeruginosa PA01
gccagcgccgccgcgugggc

SEQ ID NO: 1486519 - RNA, 15 nt, Pseudomonas aeruginosa PA01
gccagcgccgccgcu

SEQ ID NO: 1486520 - RNA, 16 nt, Pseudomonas aeruginosa PA01
gccagcgccgccgcug

SEQ ID NO: 1486521 - RNA, 13 nt, Pseudomonas aeruginosa PA01
gccagcgccgcca

SEQ ID NO: 1486522 - RNA, 12 nt, Pseudomonas aeruginosa PA01
gccagcgccgcc

SEQ ID NO: 1486523 - RNA, 13 nt, Pseudomonas aeruginosa PA01
gccagcgccaggg

SEQ ID NO: 1486524 - RNA, 19 nt, Pseudomonas aeruginosa PA01
gccagcgccgccaguucgc

SEQ ID NO: 1486525 - RNA, 20 nt, Pseudomonas aeruginosa PA01
gccagcgccggccauugccg

SEQ ID NO: 1486526 - RNA, 13 nt, Pseudomonas aeruginosa PA01
gccagcgccuggc

SEQ ID NO: 1486527 - RNA, 14 nt, Pseudomonas aeruginosa PA01
gccagcgccuggcg

SEQ ID NO: 1486528 - RNA, 15 nt, Pseudomonas aeruginosa PA01
gccagcgccuggcgc

SEQ ID NO: 1486529 - RNA, 18 nt, Pseudomonas aeruginosa PA01
gccagcgccuggcgcaac

SEQ ID NO: 1486530 - RNA, 14 nt, Pseudomonas aeruginosa PA01
gccagcgcgcgccg

SEQ ID NO: 1486531 - RNA, 15 nt, Pseudomonas aeruginosa PA01
gccagcgcgcgccga

SEQ ID NO: 1486532 - RNA, 19 nt, Pseudomonas aeruginosa PA01
gccagcgcggccgccgccg

SEQ ID NO: 1486533 - RNA, 20 nt, Pseudomonas aeruginosa PA01
gccagcgcggccgccgccga

SEQ ID NO: 1486534 - RNA, 22 nt, Pseudomonas aeruginosa PA01
gccagcgcggccgccgccgaca

SEQ ID NO: 1486535 - RNA, 14 nt, Pseudomonas aeruginosa PA01
gccagcgcggcgcu

SEQ ID NO: 1486536 - RNA, 13 nt, Pseudomonas aeruginosa PA01
gccagcgcggcgg

SEQ ID NO: 1486537 - RNA, 15 nt, Pseudomonas aeruginosa PA01
gccagcgcggcggac

SEQ ID NO: 1486538 - RNA, 16 nt, Pseudomonas aeruginosa PA01
gccagcgcggcggaca

SEQ ID NO: 1486539 - RNA, 15 nt, Pseudomonas aeruginosa PA01
gccagcggcgcuugc

SEQ ID NO: 1486540 - RNA, 20 nt, Pseudomonas aeruginosa PA01
gccagcggcgcuugcgggcg

SEQ ID NO: 1486541 - RNA, 15 nt, Pseudomonas aeruginosa PA01
gccagcggcgaucgc

SEQ ID NO: 1486542 - RNA, 16 nt, Pseudomonas aeruginosa PA01
gccagcggcgaucgcc

SEQ ID NO: 1486543 - RNA, 21 nt, Pseudomonas aeruginosa PA01
gccagcggcgaucgccugguc

SEQ ID NO: 1486544 - RNA, 21 nt, Pseudomonas aeruginosa PA01
gccagcggcguauccucggcc

SEQ ID NO: 1486545 - RNA, 22 nt, Pseudomonas aeruginosa PA01
gccagcggcguauccucggcca

SEQ ID NO: 1486546 - RNA, 15 nt, Pseudomonas aeruginosa PA01
gccagggcggcgccg

SEQ ID NO: 1486547 - RNA, 13 nt, Pseudomonas aeruginosa PA01
gccagggcggcgc

SEQ ID NO: 1486548 - RNA, 13 nt, Pseudomonas aeruginosa PA01
gccagggcgucgg

SEQ ID NO: 1486549 - RNA, 14 nt, Pseudomonas aeruginosa PA01
gccagggcggcggc

SEQ ID NO: 1486550 - RNA, 20 nt, Pseudomonas aeruginosa PA01
gccagggcggugagguugcc

SEQ ID NO: 1486551 - RNA, 19 nt, Pseudomonas aeruginosa PA01
gccaggggcuagucgcgca

SEQ ID NO: 1486552 - RNA, 21 nt, Pseudomonas aeruginosa PA01
gccaggggcuagucgcgcagc

SEQ ID NO: 1486553 - RNA, 22 nt, Pseudomonas aeruginosa PA01
gccaggggcuagucgcgcagcg

SEQ ID NO: 1486554 - RNA, 18 nt, Pseudomonas aeruginosa PA01
gccaggggcugaacagcg

SEQ ID NO: 1486555 - RNA, 20 nt, Pseudomonas aeruginosa PA01
gccaggggcugaacagcgcc

SEQ ID NO: 1486556 - RNA, 22 nt, Pseudomonas aeruginosa PA01
gccagggggaucgcgaagaaca

SEQ ID NO: 1486557 - RNA, 17 nt, Pseudomonas aeruginosa PA01
gccagggggccuggcuc

SEQ ID NO: 1486558 - RNA, 18 nt, Pseudomonas aeruginosa PA01
gccaggggucaggccgau

SEQ ID NO: 1486559 - RNA, 22 nt, Pseudomonas aeruginosa PA01
gccaggggugccuugccaaggu

SEQ ID NO: 1486560 - RNA, 15 nt, Pseudomonas aeruginosa PA01
gccaggggagcgccg

SEQ ID NO: 1486561 - RNA, 16 nt, Pseudomonas aeruginosa PA01
gccaggggagcgccgg

SEQ ID NO: 1486562 - RNA, 18 nt, Pseudomonas aeruginosa PA01
gccaggggagcgccggcg

SEQ ID NO: 1486563 - RNA, 15 nt, Pseudomonas aeruginosa PA01
gccaggggcacgcug

SEQ ID NO: 1486564 - RNA, 16 nt, Pseudomonas aeruginosa PA01
gccaggggcacgcugg

SEQ ID NO: 1486565 - RNA, 18 nt, Pseudomonas aeruginosa PA01
gccagggcuucccaggcc

SEQ ID NO: 1486566 - RNA, 23 nt, Pseudomonas aeruginosa PA01
gccagggcuucccaggccagcgg

SEQ ID NO: 1486567 - RNA, 23 nt, Pseudomonas aeruginosa PA01
gccaggguaccguugcgcaggcg

SEQ ID NO: 1486568 - RNA, 16 nt, Pseudomonas aeruginosa PA01
gccagggccgcgagag

SEQ ID NO: 1486569 - RNA, 14 nt, Pseudomonas aeruginosa PA01
gccagggccgcucg

SEQ ID NO: 1486570 - RNA, 19 nt, Pseudomonas aeruginosa PA01
gccagggccgcucgagggc

SEQ ID NO: 1486571 - RNA, 20 nt, Pseudomonas aeruginosa PA01
gccagggcagggaguccgcc

SEQ ID NO: 1486572 - RNA, 21 nt, Pseudomonas aeruginosa PA01
gccagggcagggaguccgcca

SEQ ID NO: 1486573 - RNA, 23 nt, Pseudomonas aeruginosa PA01
gccagggcagggaguccgccagc

SEQ ID NO: 1486574 - RNA, 22 nt, Pseudomonas aeruginosa PA01
gccagggcaugggucagcgcca

SEQ ID NO: 1486575 - RNA, 23 nt, Pseudomonas aeruginosa PA01
gccagggcaugggucagcgccag

SEQ ID NO: 1486576 - RNA, 20 nt, Pseudomonas aeruginosa PA01
gccagggcaacgccaggcug

SEQ ID NO: 1486577 - RNA, 18 nt, Pseudomonas aeruginosa PA01
gccagggcgaacagcgcc

SEQ ID NO: 1486578 - RNA, 21 nt, Pseudomonas aeruginosa PA01
gccagggcccacagugccagg

SEQ ID NO: 1486579 - RNA, 16 nt, Pseudomonas aeruginosa PA01
gccagggcgaggauca

SEQ ID NO: 1486580 - RNA, 19 nt, Pseudomonas aeruginosa PA01
gccagggcgaggaucacgc

SEQ ID NO: 1486581 - RNA, 16 nt, Pseudomonas aeruginosa PA01
gccagggcgcucaccg

SEQ ID NO: 1486582 - RNA, 14 nt, Pseudomonas aeruginosa PA01
gccaggccgagcgc

SEQ ID NO: 1486583 - RNA, 21 nt, Pseudomonas aeruginosa PA01
gccaggccgagcgcgccgccg

SEQ ID NO: 1486584 - RNA, 17 nt, Pseudomonas aeruginosa PA01
gccaggccgaucagcgc

SEQ ID NO: 1486585 - RNA, 13 nt, Pseudomonas aeruginosa PA01
gccaggccgccca

SEQ ID NO: 1486586 - RNA, 16 nt, Pseudomonas aeruginosa PA01
gccaggccgcccagga

SEQ ID NO: 1486587 - RNA, 14 nt, Pseudomonas aeruginosa PA01
gccaggccgccgaa

SEQ ID NO: 1486588 - RNA, 14 nt, Pseudomonas aeruginosa PA01
gccaggccggcgag

SEQ ID NO: 1486589 - RNA, 18 nt, Pseudomonas aeruginosa PA01
gccaggccggagccgcgu

SEQ ID NO: 1486590 - RNA, 21 nt, Pseudomonas aeruginosa PA01
gccagggagucgcuggccauc

SEQ ID NO: 1486591 - RNA, 13 nt, Pseudomonas aeruginosa PA01
gccagggaaaagc

SEQ ID NO: 1486592 - RNA, 18 nt, Pseudomonas aeruginosa PA01
gccagggaaaagcccagg

SEQ ID NO: 1486593 - RNA, 18 nt, Pseudomonas aeruginosa PA01
gccagggacgcgcagcgg

SEQ ID NO: 1486594 - RNA, 14 nt, Pseudomonas aeruginosa PA01
gccagggagcagga

SEQ ID NO: 1486595 - RNA, 17 nt, Pseudomonas aeruginosa PA01
gccagggagcaggacgc

SEQ ID NO: 1486596 - RNA, 21 nt, Pseudomonas aeruginosa PA01
gccagggagcaggacgccgaa

SEQ ID NO: 1486597 - RNA, 16 nt, Pseudomonas aeruginosa PA01
gccagggaggcgcugg

SEQ ID NO: 1486598 - RNA, 17 nt, Pseudomonas aeruginosa PA01
gccaggcuuuccgccga

SEQ ID NO: 1486599 - RNA, 18 nt, Pseudomonas aeruginosa PA01
gccaggcuuuccgccgag

SEQ ID NO: 1486600 - RNA, 15 nt, Pseudomonas aeruginosa PA01
gccaggcugcgcuug

SEQ ID NO: 1486601 - RNA, 15 nt, Pseudomonas aeruginosa PA01
gccaggcuggccacg

SEQ ID NO: 1486602 - RNA, 16 nt, Pseudomonas aeruginosa PA01
gccaggcuggccacga

SEQ ID NO: 1486603 - RNA, 19 nt, Pseudomonas aeruginosa PA01
gccaggcugucagggcgca

SEQ ID NO: 1486604 - RNA, 20 nt, Pseudomonas aeruginosa PA01
gccaggccggugcagaagac

SEQ ID NO: 1486605 - RNA, 13 nt, Pseudomonas aeruginosa PA01
gccaggccggcga

SEQ ID NO: 1486606 - RNA, 17 nt, Pseudomonas aeruginosa PA01
gccaggccggcgcaucg

SEQ ID NO: 1486607 - RNA, 15 nt, Pseudomonas aeruginosa PA01
gccaggccggcgccu

SEQ ID NO: 1486608 - RNA, 21 nt, Pseudomonas aeruginosa PA01
gccaguccggucagcagcagg

SEQ ID NO: 1486609 - RNA, 19 nt, Pseudomonas aeruginosa PA01
gccagucgagacgccagcc

SEQ ID NO: 1486610 - RNA, 23 nt, Pseudomonas aeruginosa PA01
gccagucgagacgccagccgccc

SEQ ID NO: 1486611 - RNA, 23 nt, Pseudomonas aeruginosa PA01
gccagguucuugaugucagcgua

SEQ ID NO: 1486612 - RNA, 14 nt, Pseudomonas aeruginosa PA01
gccaggucgcgacu

SEQ ID NO: 1486613 - RNA, 15 nt, Pseudomonas aeruginosa PA01
gccaggucgcgcagg

SEQ ID NO: 1486614 - RNA, 18 nt, Pseudomonas aeruginosa PA01
gccaggucgcgcagggcc

SEQ ID NO: 1486615 - RNA, 13 nt, Pseudomonas aeruginosa PA01
gccaggucgcggg

SEQ ID NO: 1486616 - RNA, 14 nt, Pseudomonas aeruginosa PA01
gccaggucgcgggu

SEQ ID NO: 1486617 - RNA, 16 nt, Pseudomonas aeruginosa PA01
gccaggucgcggguga

SEQ ID NO: 1486618 - RNA, 21 nt, Pseudomonas aeruginosa PA01
gccagguugcgcaaccagcgc

SEQ ID NO: 1486619 - RNA, 22 nt, Pseudomonas aeruginosa PA01
gccagguugcguuccaacuggc

SEQ ID NO: 1486620 - RNA, 17 nt, Pseudomonas aeruginosa PA01
gccagguuggcaacugc

SEQ ID NO: 1486621 - RNA, 23 nt, Pseudomonas aeruginosa PA01
gccagguuggcaacugcguccga

SEQ ID NO: 1486622 - RNA, 22 nt, Pseudomonas aeruginosa PA01
gccaggucgauccccaacccgg

SEQ ID NO: 1486623 - RNA, 17 nt, Pseudomonas aeruginosa PA01
gccagguccgccugguc

SEQ ID NO: 1486624 - RNA, 21 nt, Pseudomonas aeruginosa PA01
gccaggucagccaccugcucg

SEQ ID NO: 1486625 - RNA, 14 nt, Pseudomonas aeruginosa PA01
gccaggaucagucc

SEQ ID NO: 1486626 - RNA, 15 nt, Pseudomonas aeruginosa PA01
gccaggaugaccagg

SEQ ID NO: 1486627 - RNA, 14 nt, Pseudomonas aeruginosa PA01
gccaggagcuugcc

SEQ ID NO: 1486628 - RNA, 16 nt, Pseudomonas aeruginosa PA01
gccaggaggcccacgg

SEQ ID NO: 1486629 - RNA, 19 nt, Pseudomonas aeruginosa PA01
gccaggaggcccacgggcg

SEQ ID NO: 1486630 - RNA, 14 nt, Pseudomonas aeruginosa PA01
gccaggaacgccuc

SEQ ID NO: 1486631 - RNA, 22 nt, Pseudomonas aeruginosa PA01
gccaggaucggcauggccacgc

SEQ ID NO: 1486632 - RNA, 15 nt, Pseudomonas aeruginosa PA01
gccaggaucgucggc

SEQ ID NO: 1486633 - RNA, 17 nt, Pseudomonas aeruginosa PA01
gccaggauguucgccga

SEQ ID NO: 1486634 - RNA, 14 nt, Pseudomonas aeruginosa PA01
gccaggcccugggc

SEQ ID NO: 1486635 - RNA, 12 nt, Pseudomonas aeruginosa PA01
gccaggccgagc

SEQ ID NO: 1486636 - RNA, 13 nt, Pseudomonas aeruginosa PA01
gccaggccgagca

SEQ ID NO: 1486637 - RNA, 20 nt, Pseudomonas aeruginosa PA01
gccaggccgagcaauccggc

SEQ ID NO: 1486638 - RNA, 12 nt, Pseudomonas aeruginosa PA01
gccagcuggcga

SEQ ID NO: 1486639 - RNA, 15 nt, Pseudomonas aeruginosa PA01
gccagcuucagccga

SEQ ID NO: 1486640 - RNA, 18 nt, Pseudomonas aeruginosa PA01
gccagcuuccaggcgcgc

SEQ ID NO: 1486641 - RNA, 21 nt, Pseudomonas aeruginosa PA01
gccagcuuccaggcgcgcugg

SEQ ID NO: 1486642 - RNA, 22 nt, Pseudomonas aeruginosa PA01
gccagcuuccaggcgcgcugga

SEQ ID NO: 1486643 - RNA, 17 nt, Pseudomonas aeruginosa PA01
gccaggaaaucgagcgc

SEQ ID NO: 1486644 - RNA, 19 nt, Pseudomonas aeruginosa PA01
gccaggaaaucgagcgcca

SEQ ID NO: 1486645 - RNA, 21 nt, Pseudomonas aeruginosa PA01
gccagcuuguaguagcgcccg

SEQ ID NO: 1486646 - RNA, 13 nt, Pseudomonas aeruginosa PA01
gccagcuuguccg

SEQ ID NO: 1486647 - RNA, 15 nt, Pseudomonas aeruginosa PA01
gccagcuuguccgcc

SEQ ID NO: 1486648 - RNA, 16 nt, Pseudomonas aeruginosa PA01
gccagcuuguccgccg

SEQ ID NO: 1486649 - RNA, 15 nt, Pseudomonas aeruginosa PA01
gccagcuccgccuga

SEQ ID NO: 1486650 - RNA, 16 nt, Pseudomonas aeruginosa PA01
gccagcucgcccgccu

SEQ ID NO: 1486651 - RNA, 14 nt, Pseudomonas aeruginosa PA01
gccagcucgccgcg

SEQ ID NO: 1486652 - RNA, 13 nt, Pseudomonas aeruginosa PA01
gccagcucgaccu

SEQ ID NO: 1486653 - RNA, 20 nt, Pseudomonas aeruginosa PA01
gccagcuccuugcucucgcg

SEQ ID NO: 1486654 - RNA, 21 nt, Pseudomonas aeruginosa PA01
gccagcuccuugcucucgcgc

SEQ ID NO: 1486655 - RNA, 15 nt, Pseudomonas aeruginosa PA01
gccagcucgaacagc

SEQ ID NO: 1486656 - RNA, 18 nt, Pseudomonas aeruginosa PA01
gccagcucgaacagcacc

SEQ ID NO: 1486657 - RNA, 13 nt, Pseudomonas aeruginosa PA01
gccagcucggccg

SEQ ID NO: 1486658 - RNA, 17 nt, Pseudomonas aeruginosa PA01
gccagcucgcuguccag

SEQ ID NO: 1486659 - RNA, 18 nt, Pseudomonas aeruginosa PA01
gccagcucgcuguccagc

SEQ ID NO: 1486660 - RNA, 18 nt, Pseudomonas aeruginosa PA01
gccagcucggacaagggc

SEQ ID NO: 1486661 - RNA, 20 nt, Pseudomonas aeruginosa PA01
gccagcucuggccguccugc

SEQ ID NO: 1486662 - RNA, 15 nt, Pseudomonas aeruginosa PA01
gccagcucuugcccu

SEQ ID NO: 1486663 - RNA, 16 nt, Pseudomonas aeruginosa PA01
gccagcucuugcccug

SEQ ID NO: 1486664 - RNA, 13 nt, Pseudomonas aeruginosa PA01
gccagcucgucgc

SEQ ID NO: 1486665 - RNA, 14 nt, Pseudomonas aeruginosa PA01
gccagcucgucgcc

SEQ ID NO: 1486666 - RNA, 15 nt, Pseudomonas aeruginosa PA01
gccagcucgucgccc

SEQ ID NO: 1486667 - RNA, 19 nt, Pseudomonas aeruginosa PA01
gccagcucgucgcccuuca

SEQ ID NO: 1486668 - RNA, 17 nt, Pseudomonas aeruginosa PA01
gccagcguugcaggucg

SEQ ID NO: 1486669 - RNA, 18 nt, Pseudomonas aeruginosa PA01
gccagcguugcaggucga

SEQ ID NO: 1486670 - RNA, 21 nt, Pseudomonas aeruginosa PA01
gccagcguuucgaagccgccg

SEQ ID NO: 1486671 - RNA, 22 nt, Pseudomonas aeruginosa PA01
gccagcguuucgaagccgccgc

SEQ ID NO: 1486672 - RNA, 15 nt, Pseudomonas aeruginosa PA01
gccagcuccagcgcc

SEQ ID NO: 1486673 - RNA, 14 nt, Pseudomonas aeruginosa PA01
gccagcuccagcac

SEQ ID NO: 1486674 - RNA, 21 nt, Pseudomonas aeruginosa PA01
gccagcuccagcaccggcggc

SEQ ID NO: 1486675 - RNA, 19 nt, Pseudomonas aeruginosa PA01
gccagcgguacccgccggc

SEQ ID NO: 1486676 - RNA, 16 nt, Pseudomonas aeruginosa PA01
gccagcggcuccucgg

SEQ ID NO: 1486677 - RNA, 23 nt, Pseudomonas aeruginosa PA01
gccagcggcuccucggccugggc

SEQ ID NO: 1486678 - RNA, 21 nt, Pseudomonas aeruginosa PA01
gccagcgggcgccgccgccga

SEQ ID NO: 1486679 - RNA, 18 nt, Pseudomonas aeruginosa PA01
gccaacuuccaaucgggg

SEQ ID NO: 1486680 - RNA, 20 nt, Pseudomonas aeruginosa PA01
gccaacugcuucaggcgcgc

SEQ ID NO: 1486681 - RNA, 18 nt, Pseudomonas aeruginosa PA01
gccaacuggcgcaacugc

SEQ ID NO: 1486682 - RNA, 15 nt, Pseudomonas aeruginosa PA01
gcagucgccgcaccg

SEQ ID NO: 1486683 - RNA, 22 nt, Pseudomonas aeruginosa PA01
gcagucgccgccaguucggcca

SEQ ID NO: 1486684 - RNA, 21 nt, Pseudomonas aeruginosa PA01
gcagucgcacagccaggggca

SEQ ID NO: 1486685 - RNA, 18 nt, Pseudomonas aeruginosa PA01
gcaguccuugagcgccag

SEQ ID NO: 1486686 - RNA, 23 nt, Pseudomonas aeruginosa PA01
gcaguccuugagcgccagcaggu

SEQ ID NO: 1486687 - RNA, 19 nt, Pseudomonas aeruginosa PA01
gcagucgaaaaccggcggg

SEQ ID NO: 1486688 - RNA, 14 nt, Pseudomonas aeruginosa PA01
gcagucgcagcucg

SEQ ID NO: 1486689 - RNA, 15 nt, Pseudomonas aeruginosa PA01
gcagucgcuuccgcg

SEQ ID NO: 1486690 - RNA, 15 nt, Pseudomonas aeruginosa PA01
gcagucgggcucaga

SEQ ID NO: 1486691 - RNA, 18 nt, Pseudomonas aeruginosa PA01
gcagucgguagaaauccu

SEQ ID NO: 1486692 - RNA, 17 nt, Pseudomonas aeruginosa PA01
gcagucgucgcagccga

SEQ ID NO: 1486693 - RNA, 14 nt, Pseudomonas aeruginosa PA01
gcagucccgccagg

SEQ ID NO: 1486694 - RNA, 16 nt, Pseudomonas aeruginosa PA01
gcagucccgccaggcg

SEQ ID NO: 1486695 - RNA, 20 nt, Pseudomonas aeruginosa PA01
gcagucccgccaggcgccga

SEQ ID NO: 1486696 - RNA, 13 nt, Pseudomonas aeruginosa PA01
gcaguccaggccg

SEQ ID NO: 1486697 - RNA, 18 nt, Pseudomonas aeruginosa PA01
gcagucccgcgcggcccu

SEQ ID NO: 1486698 - RNA, 19 nt, Pseudomonas aeruginosa PA01
gcagucccugccaggggcu

SEQ ID NO: 1486699 - RNA, 16 nt, Pseudomonas aeruginosa PA01
gcaguccucgccguug

SEQ ID NO: 1486700 - RNA, 20 nt, Pseudomonas aeruginosa PA01
gcaguccucgccguuggcga

SEQ ID NO: 1486701 - RNA, 13 nt, Pseudomonas aeruginosa PA01
gcaguccuggcgg

SEQ ID NO: 1486702 - RNA, 15 nt, Pseudomonas aeruginosa PA01
gcaguccuggcggua

SEQ ID NO: 1486703 - RNA, 22 nt, Pseudomonas aeruginosa PA01
gcaguccuggcgguagcccggc

SEQ ID NO: 1486704 - RNA, 21 nt, Pseudomonas aeruginosa PA01
gccaaugccuuccgacgccgc

SEQ ID NO: 1486705 - RNA, 23 nt, Pseudomonas aeruginosa PA01
gccaaugcguggguccacgccgg

SEQ ID NO: 1486706 - RNA, 17 nt, Pseudomonas aeruginosa PA01
gccaagucggccgccca

SEQ ID NO: 1486707 - RNA, 11 nt, Pseudomonas aeruginosa PA01
gccaaggcggg

SEQ ID NO: 1486708 - RNA, 18 nt, Pseudomonas aeruginosa PA01
gccaagguguggccgagc

SEQ ID NO: 1486709 - RNA, 19 nt, Pseudomonas aeruginosa PA01
gccaagguuccagccccgc

SEQ ID NO: 1486710 - RNA, 16 nt, Pseudomonas aeruginosa PA01
gccaagggcgccgccg

SEQ ID NO: 1486711 - RNA, 17 nt, Pseudomonas aeruginosa PA01
gccaagggcgccgccga

SEQ ID NO: 1486712 - RNA, 19 nt, Pseudomonas aeruginosa PA01
gccacagaggucgcugacc

SEQ ID NO: 1486713 - RNA, 16 nt, Pseudomonas aeruginosa PA01
gccacagaucgccagc

SEQ ID NO: 1486714 - RNA, 15 nt, Pseudomonas aeruginosa PA01
gccaauggccgggcu

SEQ ID NO: 1486715 - RNA, 16 nt, Pseudomonas aeruginosa PA01
gccaauggccgguuuu

SEQ ID NO: 1486716 - RNA, 13 nt, Pseudomonas aeruginosa PA01
gccaccagagcca

SEQ ID NO: 1486717 - RNA, 19 nt, Pseudomonas aeruginosa PA01
gccaccagagccagccgcg

SEQ ID NO: 1486718 - RNA, 15 nt, Pseudomonas aeruginosa PA01
gccaccacgaucagg

SEQ ID NO: 1486719 - RNA, 16 nt, Pseudomonas aeruginosa PA01
gccaccacgaucaggc

SEQ ID NO: 1486720 - RNA, 19 nt, Pseudomonas aeruginosa PA01
gccaccacgaucaggcccu

SEQ ID NO: 1486721 - RNA, 21 nt, Pseudomonas aeruginosa PA01
gccacaggcguuauccgccga

SEQ ID NO: 1486722 - RNA, 14 nt, Pseudomonas aeruginosa PA01
gccaccaccaugcc

SEQ ID NO: 1486723 - RNA, 23 nt, Pseudomonas aeruginosa PA01
gccaccaccaugccuuccaccgg

SEQ ID NO: 1486724 - RNA, 13 nt, Pseudomonas aeruginosa PA01
gccaccaccacga

SEQ ID NO: 1486725 - RNA, 16 nt, Pseudomonas aeruginosa PA01
gccacaggcgccaguc

SEQ ID NO: 1486726 - RNA, 13 nt, Pseudomonas aeruginosa PA01
gccacaggcccug

SEQ ID NO: 1486727 - RNA, 15 nt, Pseudomonas aeruginosa PA01
gccacaggcccugga

SEQ ID NO: 1486728 - RNA, 22 nt, Pseudomonas aeruginosa PA01
gccaccaaccacaaccagccau

SEQ ID NO: 1486729 - RNA, 21 nt, Pseudomonas aeruginosa PA01
gccaccagggccuugccgcga

SEQ ID NO: 1486730 - RNA, 13 nt, Pseudomonas aeruginosa PA01
gccaccaggccgc

SEQ ID NO: 1486731 - RNA, 20 nt, Pseudomonas aeruginosa PA01
gccaccaggccgcugccgcc

SEQ ID NO: 1486732 - RNA, 16 nt, Pseudomonas aeruginosa PA01
gccaccagcagggcca

SEQ ID NO: 1486733 - RNA, 18 nt, Pseudomonas aeruginosa PA01
gccaccagcagggccagg

SEQ ID NO: 1486734 - RNA, 13 nt, Pseudomonas aeruginosa PA01
gccaccagcaccu

SEQ ID NO: 1486735 - RNA, 16 nt, Pseudomonas aeruginosa PA01
gccaccagcaccugcg

SEQ ID NO: 1486736 - RNA, 12 nt, Pseudomonas aeruginosa PA01
gccaccagccga

SEQ ID NO: 1486737 - RNA, 13 nt, Pseudomonas aeruginosa PA01
gccaccccgccgc

SEQ ID NO: 1486738 - RNA, 17 nt, Pseudomonas aeruginosa PA01
gccaccccgccgcgcau

SEQ ID NO: 1486739 - RNA, 15 nt, Pseudomonas aeruginosa PA01
gccaccccgccgcug

SEQ ID NO: 1486740 - RNA, 18 nt, Pseudomonas aeruginosa PA01
gccaccccgccgcuggcg

SEQ ID NO: 1486741 - RNA, 19 nt, Pseudomonas aeruginosa PA01
gccaccccgccgcuggcgg

SEQ ID NO: 1486742 - RNA, 20 nt, Pseudomonas aeruginosa PA01
gccaccccgccgcuggcggc

SEQ ID NO: 1486743 - RNA, 21 nt, Pseudomonas aeruginosa PA01
gccaccccgccgcuggcggca

SEQ ID NO: 1486744 - RNA, 14 nt, Pseudomonas aeruginosa PA01
gccaccccgccggc

SEQ ID NO: 1486745 - RNA, 15 nt, Pseudomonas aeruginosa PA01
gccaccccgccggcg

SEQ ID NO: 1486746 - RNA, 17 nt, Pseudomonas aeruginosa PA01
gccaccaucacgucgcg

SEQ ID NO: 1486747 - RNA, 22 nt, Pseudomonas aeruginosa PA01
gccacgucugugccgaggccgc

SEQ ID NO: 1486748 - RNA, 23 nt, Pseudomonas aeruginosa PA01
gccacgugcggggugcgcuggaa

SEQ ID NO: 1486749 - RNA, 19 nt, Pseudomonas aeruginosa PA01
gccacguucugcaggacga

SEQ ID NO: 1486750 - RNA, 17 nt, Pseudomonas aeruginosa PA01
gccacuucaagcuggcg

SEQ ID NO: 1486751 - RNA, 13 nt, Pseudomonas aeruginosa PA01
gccacuuccagca

SEQ ID NO: 1486752 - RNA, 14 nt, Pseudomonas aeruginosa PA01
gccacuuccagcac

SEQ ID NO: 1486753 - RNA, 17 nt, Pseudomonas aeruginosa PA01
gccacuuccagcacgcc

SEQ ID NO: 1486754 - RNA, 21 nt, Pseudomonas aeruginosa PA01
gccacuuccagcacgccgauc

SEQ ID NO: 1486755 - RNA, 22 nt, Pseudomonas aeruginosa PA01
gccacuuccagcacgccgaucc

SEQ ID NO: 1486756 - RNA, 17 nt, Pseudomonas aeruginosa PA01
gccacuggcggaccgcc

SEQ ID NO: 1486757 - RNA, 20 nt, Pseudomonas aeruginosa PA01
gccacuggcggaccgccucg

SEQ ID NO: 1486758 - RNA, 17 nt, Pseudomonas aeruginosa PA01
gccacugcuuggcgaac

SEQ ID NO: 1486759 - RNA, 18 nt, Pseudomonas aeruginosa PA01
gccacuccgggcuggucg

SEQ ID NO: 1486760 - RNA, 15 nt, Pseudomonas aeruginosa PA01
gccacucccggcccu

SEQ ID NO: 1486761 - RNA, 15 nt, Pseudomonas aeruginosa PA01
gccacguccuuggug

SEQ ID NO: 1486762 - RNA, 12 nt, Pseudomonas aeruginosa PA01
gccacgucgccc

SEQ ID NO: 1486763 - RNA, 16 nt, Pseudomonas aeruginosa PA01
gccacgucgccccagg

SEQ ID NO: 1486764 - RNA, 18 nt, Pseudomonas aeruginosa PA01
gccacgucgccccaggga

SEQ ID NO: 1486765 - RNA, 19 nt, Pseudomonas aeruginosa PA01
gccacgucgccccagggaa

SEQ ID NO: 1486766 - RNA, 20 nt, Pseudomonas aeruginosa PA01
gccacguagggcguggugua

SEQ ID NO: 1486767 - RNA, 16 nt, Pseudomonas aeruginosa PA01
gccacguccagcggca

SEQ ID NO: 1486768 - RNA, 19 nt, Pseudomonas aeruginosa PA01
gccacggauaugcgccgcc

SEQ ID NO: 1486769 - RNA, 21 nt, Pseudomonas aeruginosa PA01
gccacggauaugcgccgccac

SEQ ID NO: 1486770 - RNA, 22 nt, Pseudomonas aeruginosa PA01
gccacgcuugucguggcgggcu

SEQ ID NO: 1486771 - RNA, 13 nt, Pseudomonas aeruginosa PA01
gccacgccgcugu

SEQ ID NO: 1486772 - RNA, 20 nt, Pseudomonas aeruginosa PA01
gccacgccgcugucguccag

SEQ ID NO: 1486773 - RNA, 15 nt, Pseudomonas aeruginosa PA01
gccacgcgaccagcg

SEQ ID NO: 1486774 - RNA, 23 nt, Pseudomonas aeruginosa PA01
gccacgcgaccagcgccaggcgc

SEQ ID NO: 1486775 - RNA, 14 nt, Pseudomonas aeruginosa PA01
gccacgcugcugcc

SEQ ID NO: 1486776 - RNA, 15 nt, Pseudomonas aeruginosa PA01
gccacgcugcugccg

SEQ ID NO: 1486777 - RNA, 17 nt, Pseudomonas aeruginosa PA01
gccacgcugcugccggc

SEQ ID NO: 1486778 - RNA, 18 nt, Pseudomonas aeruginosa PA01
gccacgcugcugccggcc

SEQ ID NO: 1486779 - RNA, 18 nt, Pseudomonas aeruginosa PA01
gccacgcucucgaacagc

SEQ ID NO: 1486780 - RNA, 19 nt, Pseudomonas aeruginosa PA01
gccacgcugaucaucagca

SEQ ID NO: 1486781 - RNA, 20 nt, Pseudomonas aeruginosa PA01
gccacgcugaucaucagcag

SEQ ID NO: 1486782 - RNA, 18 nt, Pseudomonas aeruginosa PA01
gccaccugguucaucgag

SEQ ID NO: 1486783 - RNA, 19 nt, Pseudomonas aeruginosa PA01
gccaccuucgcccgcugcg

SEQ ID NO: 1486784 - RNA, 21 nt, Pseudomonas aeruginosa PA01
gccaccuucgcccgcugcgcu

SEQ ID NO: 1486785 - RNA, 21 nt, Pseudomonas aeruginosa PA01
gccaccuugcgucccugggcc

SEQ ID NO: 1486786 - RNA, 22 nt, Pseudomonas aeruginosa PA01
gccaccuugcgucccugggccu

SEQ ID NO: 1486787 - RNA, 13 nt, Pseudomonas aeruginosa PA01
gccacgccgccgu

SEQ ID NO: 1486788 - RNA, 12 nt, Pseudomonas aeruginosa PA01
gccacgccggcg

SEQ ID NO: 1486789 - RNA, 13 nt, Pseudomonas aeruginosa PA01
gccacgccggcgc

SEQ ID NO: 1486790 - RNA, 18 nt, Pseudomonas aeruginosa PA01
gccaccuguuccacgaga

SEQ ID NO: 1486791 - RNA, 13 nt, Pseudomonas aeruginosa PA01
gccaccugcauca

SEQ ID NO: 1486792 - RNA, 13 nt, Pseudomonas aeruginosa PA01
gccaccugccccg

SEQ ID NO: 1486793 - RNA, 14 nt, Pseudomonas aeruginosa PA01
gccaccugcgggug

SEQ ID NO: 1486794 - RNA, 16 nt, Pseudomonas aeruginosa PA01
gccaccugcuccggcg

SEQ ID NO: 1486795 - RNA, 20 nt, Pseudomonas aeruginosa PA01
gccaccugcucgcugaaccg

SEQ ID NO: 1486796 - RNA, 23 nt, Pseudomonas aeruginosa PA01
gccaccugcucgcugaaccgcgu

SEQ ID NO: 1486797 - RNA, 21 nt, Pseudomonas aeruginosa PA01
gccaccgguacgcucaccacc

SEQ ID NO: 1486798 - RNA, 19 nt, Pseudomonas aeruginosa PA01
gccaccgggugcagguuca

SEQ ID NO: 1486799 - RNA, 21 nt, Pseudomonas aeruginosa PA01
gccaccggcguuauccgccga

SEQ ID NO: 1486800 - RNA, 13 nt, Pseudomonas aeruginosa PA01
gccaccggcugca

SEQ ID NO: 1486801 - RNA, 16 nt, Pseudomonas aeruginosa PA01
gccaccgggaucagcg

SEQ ID NO: 1486802 - RNA, 20 nt, Pseudomonas aeruginosa PA01
gccaccgggaucagcggcgg

SEQ ID NO: 1486803 - RNA, 19 nt, Pseudomonas aeruginosa PA01
gccaccgcguugaccguga

SEQ ID NO: 1486804 - RNA, 17 nt, Pseudomonas aeruginosa PA01
gccaccgccaccgccgg

SEQ ID NO: 1486805 - RNA, 14 nt, Pseudomonas aeruginosa PA01
gccaccgauagcgg

SEQ ID NO: 1486806 - RNA, 17 nt, Pseudomonas aeruginosa PA01
gccaccgauagcggcgc

SEQ ID NO: 1486807 - RNA, 18 nt, Pseudomonas aeruginosa PA01
gccaccgauagcggcgcg

SEQ ID NO: 1486808 - RNA, 20 nt, Pseudomonas aeruginosa PA01
gccaccgauagcggcgcgag

SEQ ID NO: 1486809 - RNA, 21 nt, Pseudomonas aeruginosa PA01
gccaccgauagcggcgcgagg

SEQ ID NO: 1486810 - RNA, 18 nt, Pseudomonas aeruginosa PA01
gccaccgauucgccggcc

SEQ ID NO: 1486811 - RNA, 12 nt, Pseudomonas aeruginosa PA01
gccaccgccgac

SEQ ID NO: 1486812 - RNA, 22 nt, Pseudomonas aeruginosa PA01
gccaccgccuggucgccgggau

SEQ ID NO: 1486813 - RNA, 23 nt, Pseudomonas aeruginosa PA01
gccaccgaaucggacagguuggc

SEQ ID NO: 1486814 - RNA, 18 nt, Pseudomonas aeruginosa PA01
gccaccgacccucggcga

SEQ ID NO: 1486815 - RNA, 12 nt, Pseudomonas aeruginosa PA01
gccacccuugcg

SEQ ID NO: 1486816 - RNA, 19 nt, Pseudomonas aeruginosa PA01
gccacccuugcgcccggcu

SEQ ID NO: 1486817 - RNA, 13 nt, Pseudomonas aeruginosa PA01
gccacccuuggag

SEQ ID NO: 1486818 - RNA, 16 nt, Pseudomonas aeruginosa PA01
gccacccuuggagccg

SEQ ID NO: 1486819 - RNA, 18 nt, Pseudomonas aeruginosa PA01
gccacccguuccuugcgc

SEQ ID NO: 1486820 - RNA, 22 nt, Pseudomonas aeruginosa PA01
gccacccgcaucgaggccgccc

SEQ ID NO: 1486821 - RNA, 15 nt, Pseudomonas aeruginosa PA01
gccacccgcucgacc

SEQ ID NO: 1486822 - RNA, 13 nt, Pseudomonas aeruginosa PA01
gccacccgccucg

SEQ ID NO: 1486823 - RNA, 14 nt, Pseudomonas aeruginosa PA01
gccacccggcgccc

SEQ ID NO: 1486824 - RNA, 16 nt, Pseudomonas aeruginosa PA01
gccacccggcgcccgg

SEQ ID NO: 1486825 - RNA, 17 nt, Pseudomonas aeruginosa PA01
gccacccggcgcccggc

SEQ ID NO: 1486826 - RNA, 20 nt, Pseudomonas aeruginosa PA01
gccacccggcgcccggcgca

SEQ ID NO: 1486827 - RNA, 16 nt, Pseudomonas aeruginosa PA01
gcccaauccgcgccgg

SEQ ID NO: 1486828 - RNA, 17 nt, Pseudomonas aeruginosa PA01
gcccacaaccugccgau

SEQ ID NO: 1486829 - RNA, 21 nt, Pseudomonas aeruginosa PA01
gcccacaaccugccgaucgcc

SEQ ID NO: 1486830 - RNA, 23 nt, Pseudomonas aeruginosa PA01
gcccaauacccacaggguggcgg

SEQ ID NO: 1486831 - RNA, 23 nt, Pseudomonas aeruginosa PA01
gcccaagccgagcggcaaggcca

SEQ ID NO: 1486832 - RNA, 15 nt, Pseudomonas aeruginosa PA01
gcccaagggccuggg

SEQ ID NO: 1486833 - RNA, 16 nt, Pseudomonas aeruginosa PA01
gcccaagggccugggc

SEQ ID NO: 1486834 - RNA, 18 nt, Pseudomonas aeruginosa PA01
gcccaagggccugggcgc

SEQ ID NO: 1486835 - RNA, 23 nt, Pseudomonas aeruginosa PA01
gcccaagggccugggcgccgcca

SEQ ID NO: 1486836 - RNA, 14 nt, Pseudomonas aeruginosa PA01
gcccaacagcggug

SEQ ID NO: 1486837 - RNA, 20 nt, Pseudomonas aeruginosa PA01
gcccaacagcggugugcuca

SEQ ID NO: 1486838 - RNA, 22 nt, Pseudomonas aeruginosa PA01
gcccaacagcggugugcucagg

SEQ ID NO: 1486839 - RNA, 20 nt, Pseudomonas aeruginosa PA01
gcccaacgucuucaggcgcu

SEQ ID NO: 1486840 - RNA, 14 nt, Pseudomonas aeruginosa PA01
gcccaacuccagcu

SEQ ID NO: 1486841 - RNA, 18 nt, Pseudomonas aeruginosa PA01
gcccaacuccagcucgac

SEQ ID NO: 1486842 - RNA, 17 nt, Pseudomonas aeruginosa PA01
gcccacagugccaggcu

SEQ ID NO: 1486843 - RNA, 14 nt, Pseudomonas aeruginosa PA01
gcccaccaccagga

SEQ ID NO: 1486844 - RNA, 15 nt, Pseudomonas aeruginosa PA01
gcccaccaggucgcc

SEQ ID NO: 1486845 - RNA, 11 nt, Pseudomonas aeruginosa PA01
gcccaccagcg

SEQ ID NO: 1486846 - RNA, 16 nt, Pseudomonas aeruginosa PA01
gcccaccagcgucgcc

SEQ ID NO: 1486847 - RNA, 21 nt, Pseudomonas aeruginosa PA01
gcccaccagcgucgccaggcc

SEQ ID NO: 1486848 - RNA, 12 nt, Pseudomonas aeruginosa PA01
gcccaccgcggg

SEQ ID NO: 1486849 - RNA, 17 nt, Pseudomonas aeruginosa PA01
gcccaccgcgggggucg

SEQ ID NO: 1486850 - RNA, 21 nt, Pseudomonas aeruginosa PA01
gcccacccccagcccggccau

SEQ ID NO: 1486851 - RNA, 21 nt, Pseudomonas aeruginosa PA01
gcccacccccggcccggccau

SEQ ID NO: 1486852 - RNA, 14 nt, Pseudomonas aeruginosa PA01
gccaugucccgggu

SEQ ID NO: 1486853 - RNA, 14 nt, Pseudomonas aeruginosa PA01
gccauggccgcuga

SEQ ID NO: 1486854 - RNA, 14 nt, Pseudomonas aeruginosa PA01
gccauggcaucccc

SEQ ID NO: 1486855 - RNA, 12 nt, Pseudomonas aeruginosa PA01
gccaugcuggcg

SEQ ID NO: 1486856 - RNA, 13 nt, Pseudomonas aeruginosa PA01
gccaugcuggcgc

SEQ ID NO: 1486857 - RNA, 21 nt, Pseudomonas aeruginosa PA01
gccauggaucaccagggucgg

SEQ ID NO: 1486858 - RNA, 16 nt, Pseudomonas aeruginosa PA01
gccaugcgcucggggu

SEQ ID NO: 1486859 - RNA, 18 nt, Pseudomonas aeruginosa PA01
gccaugcgcucggggucg

SEQ ID NO: 1486860 - RNA, 20 nt, Pseudomonas aeruginosa PA01
gccaugcaagaacgccgacc

SEQ ID NO: 1486861 - RNA, 13 nt, Pseudomonas aeruginosa PA01
gccaugcucggcc

SEQ ID NO: 1486862 - RNA, 23 nt, Pseudomonas aeruginosa PA01
gccaugcucggccagcucgccga

SEQ ID NO: 1486863 - RNA, 16 nt, Pseudomonas aeruginosa PA01
gccaugcggcaggccu

SEQ ID NO: 1486864 - RNA, 17 nt, Pseudomonas aeruginosa PA01
gccagucggccuggcuc

SEQ ID NO: 1486865 - RNA, 22 nt, Pseudomonas aeruginosa PA01
gccaguccuggacccguugccg

SEQ ID NO: 1486866 - RNA, 16 nt, Pseudomonas aeruginosa PA01
aagaccagggugggga

SEQ ID NO: 1486867 - RNA, 17 nt, Pseudomonas aeruginosa PA01
aagacccccugcggccc

SEQ ID NO: 1486868 - RNA, 11 nt, Pseudomonas aeruginosa PA01
gccaugagguu

SEQ ID NO: 1486869 - RNA, 14 nt, Pseudomonas aeruginosa PA01
gccaugaucaucgc

SEQ ID NO: 1486870 - RNA, 21 nt, Pseudomonas aeruginosa PA01
gccaugaucaucgccugcugg

SEQ ID NO: 1486871 - RNA, 21 nt, Pseudomonas aeruginosa PA01
gccaugauccggugcaggccg

SEQ ID NO: 1486872 - RNA, 19 nt, Pseudomonas aeruginosa PA01
gccaugaugugcgcaggcu

SEQ ID NO: 1486873 - RNA, 21 nt, Pseudomonas aeruginosa PA01
gccaugaugugcgcaggcugg

SEQ ID NO: 1486874 - RNA, 22 nt, Pseudomonas aeruginosa PA01
gccauucaggcggaucaccacg

SEQ ID NO: 1486875 - RNA, 20 nt, Pseudomonas aeruginosa PA01
gccauuccugggccccggcc

SEQ ID NO: 1486876 - RNA, 14 nt, Pseudomonas aeruginosa PA01
gccauuccuuccag

SEQ ID NO: 1486877 - RNA, 23 nt, Pseudomonas aeruginosa PA01
gccauuccuugauuugcccggcg

SEQ ID NO: 1486878 - RNA, 19 nt, Pseudomonas aeruginosa PA01
gccauucgccgcgacgcuc

SEQ ID NO: 1486879 - RNA, 14 nt, Pseudomonas aeruginosa PA01
gccauucgaauggc

SEQ ID NO: 1486880 - RNA, 21 nt, Pseudomonas aeruginosa PA01
gccauucgaauggcgccggcc

SEQ ID NO: 1486881 - RNA, 22 nt, Pseudomonas aeruginosa PA01
gccauucgaauggcgccggcca

SEQ ID NO: 1486882 - RNA, 23 nt, Pseudomonas aeruginosa PA01
gccauucgaauggcgccggccag

SEQ ID NO: 1486883 - RNA, 15 nt, Pseudomonas aeruginosa PA01
gccauucgcuucggc

SEQ ID NO: 1486884 - RNA, 14 nt, Pseudomonas aeruginosa PA01
gccauucggcgacg

SEQ ID NO: 1486885 - RNA, 22 nt, Pseudomonas aeruginosa PA01
gccauucggcgacgggcuucgc

SEQ ID NO: 1486886 - RNA, 23 nt, Pseudomonas aeruginosa PA01
gccauucggcgacgggcuucgcg

SEQ ID NO: 1486887 - RNA, 19 nt, Pseudomonas aeruginosa PA01
gccauucggcuuccugggc

SEQ ID NO: 1486888 - RNA, 21 nt, Pseudomonas aeruginosa PA01
gccauucggcuuccugggcga

SEQ ID NO: 1486889 - RNA, 17 nt, Pseudomonas aeruginosa PA01
gccauugagcgcgccca

SEQ ID NO: 1486890 - RNA, 20 nt, Pseudomonas aeruginosa PA01
gccauugagcgcgcccaggc

SEQ ID NO: 1486891 - RNA, 23 nt, Pseudomonas aeruginosa PA01
gccauugcagguaguccagccag

SEQ ID NO: 1486892 - RNA, 13 nt, Pseudomonas aeruginosa PA01
gccauugccgcca

SEQ ID NO: 1486893 - RNA, 17 nt, Pseudomonas aeruginosa PA01
gccauugccgccaggug

SEQ ID NO: 1486894 - RNA, 21 nt, Pseudomonas aeruginosa PA01
gccauugcccgguggccuccu

SEQ ID NO: 1486895 - RNA, 15 nt, Pseudomonas aeruginosa PA01
gccauuggccgacgc

SEQ ID NO: 1486896 - RNA, 17 nt, Pseudomonas aeruginosa PA01
gccauugcgccaggacc

SEQ ID NO: 1486897 - RNA, 15 nt, Pseudomonas aeruginosa PA01
gccauuucugcugug

SEQ ID NO: 1486898 - RNA, 20 nt, Pseudomonas aeruginosa PA01
gcccaccugaacgcgcccgg

SEQ ID NO: 1486899 - RNA, 16 nt, Pseudomonas aeruginosa PA01
gcccaccuugcgggug

SEQ ID NO: 1486900 - RNA, 22 nt, Pseudomonas aeruginosa PA01
gcccacgccuugcagcaccgcc

SEQ ID NO: 1486901 - RNA, 21 nt, Pseudomonas aeruginosa PA01
gcccacgcucagugcgccggg

SEQ ID NO: 1486902 - RNA, 24 nt, Pseudomonas aeruginosa PA01
gcccacgcucagugcgccgggugc

SEQ ID NO: 1486903 - RNA, 14 nt, Pseudomonas aeruginosa PA01
gcccacgcgccugg

SEQ ID NO: 1486904 - RNA, 15 nt, Pseudomonas aeruginosa PA01
gcccacgcgccuggc

SEQ ID NO: 1486905 - RNA, 15 nt, Pseudomonas aeruginosa PA01
gcccacgccgaaggc

SEQ ID NO: 1486906 - RNA, 14 nt, Pseudomonas aeruginosa PA01
gcccacggccaggc

SEQ ID NO: 1486907 - RNA, 16 nt, Pseudomonas aeruginosa PA01
gcccacggccaggccc

SEQ ID NO: 1486908 - RNA, 17 nt, Pseudomonas aeruginosa PA01
gcccacggccaggccca

SEQ ID NO: 1486909 - RNA, 13 nt, Pseudomonas aeruginosa PA01
gcccacggcgccu

SEQ ID NO: 1486910 - RNA, 14 nt, Pseudomonas aeruginosa PA01
gcccacggcgccuu

SEQ ID NO: 1486911 - RNA, 19 nt, Pseudomonas aeruginosa PA01
gcccagaaaaaagccccgc

SEQ ID NO: 1486912 - RNA, 13 nt, Pseudomonas aeruginosa PA01
gcccagaacagca

SEQ ID NO: 1486913 - RNA, 23 nt, Pseudomonas aeruginosa PA01
gcccagaacagcaaagcgcaggu

SEQ ID NO: 1486914 - RNA, 17 nt, Pseudomonas aeruginosa PA01
gcccagacacgccucaa

SEQ ID NO: 1486915 - RNA, 22 nt, Pseudomonas aeruginosa PA01
gcccagacacgccucaaggcau

SEQ ID NO: 1486916 - RNA, 23 nt, Pseudomonas aeruginosa PA01
gcccacuccagauagugcggcca

SEQ ID NO: 1486917 - RNA, 19 nt, Pseudomonas aeruginosa PA01
gcccacuccuccgccugca

SEQ ID NO: 1486918 - RNA, 21 nt, Pseudomonas aeruginosa PA01
gcccacuccuccgccugcacg

SEQ ID NO: 1486919 - RNA, 13 nt, Pseudomonas aeruginosa PA01
gcccagcaccaca

SEQ ID NO: 1486920 - RNA, 16 nt, Pseudomonas aeruginosa PA01
gcccagcaccacagca

SEQ ID NO: 1486921 - RNA, 21 nt, Pseudomonas aeruginosa PA01
gcccagcaccgagcugaucgc

SEQ ID NO: 1486922 - RNA, 14 nt, Pseudomonas aeruginosa PA01
gcccagacgccgcu

SEQ ID NO: 1486923 - RNA, 16 nt, Pseudomonas aeruginosa PA01
gcccagacgccgcucu

SEQ ID NO: 1486924 - RNA, 16 nt, Pseudomonas aeruginosa PA01
gcccagagcagcacca

SEQ ID NO: 1486925 - RNA, 18 nt, Pseudomonas aeruginosa PA01
gcccagagcagcaccagc

SEQ ID NO: 1486926 - RNA, 18 nt, Pseudomonas aeruginosa PA01
gcccagauccccugcagg

SEQ ID NO: 1486927 - RNA, 20 nt, Pseudomonas aeruginosa PA01
gcccagauauccagggccag

SEQ ID NO: 1486928 - RNA, 16 nt, Pseudomonas aeruginosa PA01
gcccagaugaucaggc

SEQ ID NO: 1486929 - RNA, 17 nt, Pseudomonas aeruginosa PA01
gcccagaugaucaggcc

SEQ ID NO: 1486930 - RNA, 14 nt, Pseudomonas aeruginosa PA01
gcccagcaggucga

SEQ ID NO: 1486931 - RNA, 15 nt, Pseudomonas aeruginosa PA01
gcccagcaggucgau

SEQ ID NO: 1486932 - RNA, 15 nt, Pseudomonas aeruginosa PA01
gcccagccagggccg

SEQ ID NO: 1486933 - RNA, 18 nt, Pseudomonas aeruginosa PA01
gcccagccagggccgcga

SEQ ID NO: 1486934 - RNA, 15 nt, Pseudomonas aeruginosa PA01
gcccagcagcgcuca

SEQ ID NO: 1486935 - RNA, 13 nt, Pseudomonas aeruginosa PA01
gcccagcaggccg

SEQ ID NO: 1486936 - RNA, 15 nt, Pseudomonas aeruginosa PA01
gcccagcaggccggc

SEQ ID NO: 1486937 - RNA, 18 nt, Pseudomonas aeruginosa PA01
gcccagcaggccggccag

SEQ ID NO: 1486938 - RNA, 17 nt, Pseudomonas aeruginosa PA01
gcccagcaggcgcgccc

SEQ ID NO: 1486939 - RNA, 22 nt, Pseudomonas aeruginosa PA01
gcccagcaggcugcugcugcgg

SEQ ID NO: 1486940 - RNA, 13 nt, Pseudomonas aeruginosa PA01
gcccagcagcagg

SEQ ID NO: 1486941 - RNA, 16 nt, Pseudomonas aeruginosa PA01
gcccagcagcaggccg

SEQ ID NO: 1486942 - RNA, 17 nt, Pseudomonas aeruginosa PA01
gcccagcagcaggccgg

SEQ ID NO: 1486943 - RNA, 19 nt, Pseudomonas aeruginosa PA01
gcccagcgcuuccucgggc

SEQ ID NO: 1486944 - RNA, 17 nt, Pseudomonas aeruginosa PA01
gcccagcgcggcgcccc

SEQ ID NO: 1486945 - RNA, 22 nt, Pseudomonas aeruginosa PA01
gcccagcggcagggcggcgaug

SEQ ID NO: 1486946 - RNA, 17 nt, Pseudomonas aeruginosa PA01
gcccagcggcgccucga

SEQ ID NO: 1486947 - RNA, 20 nt, Pseudomonas aeruginosa PA01
gcccagcggcgccucgaagc

SEQ ID NO: 1486948 - RNA, 19 nt, Pseudomonas aeruginosa PA01
gcccagcggcuggcgggcg

SEQ ID NO: 1486949 - RNA, 16 nt, Pseudomonas aeruginosa PA01
gcccagcguggccagc

SEQ ID NO: 1486950 - RNA, 18 nt, Pseudomonas aeruginosa PA01
gcccagcguggccagcga

SEQ ID NO: 1486951 - RNA, 21 nt, Pseudomonas aeruginosa PA01
gcccagcguggccagcgaacc

SEQ ID NO: 1486952 - RNA, 15 nt, Pseudomonas aeruginosa PA01
gcccagcggcgccag

SEQ ID NO: 1486953 - RNA, 16 nt, Pseudomonas aeruginosa PA01
gcccagcguucggcgc

SEQ ID NO: 1486954 - RNA, 17 nt, Pseudomonas aeruginosa PA01
gcccagcguucggcgcu

SEQ ID NO: 1486955 - RNA, 19 nt, Pseudomonas aeruginosa PA01
gcccagcguucggcgcugg

SEQ ID NO: 1486956 - RNA, 20 nt, Pseudomonas aeruginosa PA01
gcccagcucguccaggcaag

SEQ ID NO: 1486957 - RNA, 21 nt, Pseudomonas aeruginosa PA01
gcccagcucguccaggcaagc

SEQ ID NO: 1486958 - RNA, 17 nt, Pseudomonas aeruginosa PA01
gcccagcucgccgcucc

SEQ ID NO: 1486959 - RNA, 19 nt, Pseudomonas aeruginosa PA01
gcccaggcagaucgcgccg

SEQ ID NO: 1486960 - RNA, 17 nt, Pseudomonas aeruginosa PA01
gcccaggcaggcgauga

SEQ ID NO: 1486961 - RNA, 16 nt, Pseudomonas aeruginosa PA01
gcccagcccgccuucc

SEQ ID NO: 1486962 - RNA, 17 nt, Pseudomonas aeruginosa PA01
gcccagccccaccgcca

SEQ ID NO: 1486963 - RNA, 20 nt, Pseudomonas aeruginosa PA01
gcccagccccaccgccaggu

SEQ ID NO: 1486964 - RNA, 22 nt, Pseudomonas aeruginosa PA01
gcccagaucauguagagcaggc

SEQ ID NO: 1486965 - RNA, 11 nt, Pseudomonas aeruginosa PA01
gcccagcccgc

SEQ ID NO: 1486966 - RNA, 12 nt, Pseudomonas aeruginosa PA01
gcccagcccgcc

SEQ ID NO: 1486967 - RNA, 17 nt, Pseudomonas aeruginosa PA01
gcccagccgcggcgcca

SEQ ID NO: 1486968 - RNA, 17 nt, Pseudomonas aeruginosa PA01
gcccagcgagccgauca

SEQ ID NO: 1486969 - RNA, 13 nt, Pseudomonas aeruginosa PA01
gcccagcgcagcc

SEQ ID NO: 1486970 - RNA, 16 nt, Pseudomonas aeruginosa PA01
gcccagcgcagccugc

SEQ ID NO: 1486971 - RNA, 17 nt, Pseudomonas aeruginosa PA01
gcccagcgcagccugcu

SEQ ID NO: 1486972 - RNA, 23 nt, Pseudomonas aeruginosa PA01
gcccagcgcagccugcuggccug

SEQ ID NO: 1486973 - RNA, 13 nt, Pseudomonas aeruginosa PA01
gcccagcgccugc

SEQ ID NO: 1486974 - RNA, 14 nt, Pseudomonas aeruginosa PA01
gcccagcgccugca

SEQ ID NO: 1486975 - RNA, 13 nt, Pseudomonas aeruginosa PA01
gcccagcgccugu

SEQ ID NO: 1486976 - RNA, 14 nt, Pseudomonas aeruginosa PA01
gcccagcgccgccu

SEQ ID NO: 1486977 - RNA, 16 nt, Pseudomonas aeruginosa PA01
gcccagcgccgccugc

SEQ ID NO: 1486978 - RNA, 19 nt, Pseudomonas aeruginosa PA01
gcccagcgccgccugcugg

SEQ ID NO: 1486979 - RNA, 16 nt, Pseudomonas aeruginosa PA01
gcccagcgccccgccu

SEQ ID NO: 1486980 - RNA, 13 nt, Pseudomonas aeruginosa PA01
gcccagcgccgcc

SEQ ID NO: 1486981 - RNA, 17 nt, Pseudomonas aeruginosa PA01
gcccagcgccgccagca

SEQ ID NO: 1486982 - RNA, 18 nt, Pseudomonas aeruginosa PA01
gcccagcgccgccagcag

SEQ ID NO: 1486983 - RNA, 20 nt, Pseudomonas aeruginosa PA01
gccccagguaggcgaaggcg

SEQ ID NO: 1486984 - RNA, 22 nt, Pseudomonas aeruginosa PA01
gccccagguaggcgaaggcgau

SEQ ID NO: 1486985 - RNA, 19 nt, Pseudomonas aeruginosa PA01
gccccagggccggcgcccu

SEQ ID NO: 1486986 - RNA, 13 nt, Pseudomonas aeruginosa PA01
gcccccagcgccc

SEQ ID NO: 1486987 - RNA, 19 nt, Pseudomonas aeruginosa PA01
gcccccagcgcgccgccga

SEQ ID NO: 1486988 - RNA, 20 nt, Pseudomonas aeruginosa PA01
gcccccaugaaaaaggcgcc

SEQ ID NO: 1486989 - RNA, 23 nt, Pseudomonas aeruginosa PA01
gcccccaugaaaaaggcgcccgc

SEQ ID NO: 1486990 - RNA, 16 nt, Pseudomonas aeruginosa PA01
gccccagcgcgagcgu

SEQ ID NO: 1486991 - RNA, 24 nt, Pseudomonas aeruginosa PA01
gccccagcggucgauccgaccugg

SEQ ID NO: 1486992 - RNA, 12 nt, Pseudomonas aeruginosa PA01
gccccaggccga

SEQ ID NO: 1486993 - RNA, 17 nt, Pseudomonas aeruginosa PA01
gccccaggccgccgccu

SEQ ID NO: 1486994 - RNA, 21 nt, Pseudomonas aeruginosa PA01
gccccaggcgggcacgucgcg

SEQ ID NO: 1486995 - RNA, 12 nt, Pseudomonas aeruginosa PA01
gccccaggcgag

SEQ ID NO: 1486996 - RNA, 20 nt, Pseudomonas aeruginosa PA01
gccccaggcgauccacagca

SEQ ID NO: 1486997 - RNA, 16 nt, Pseudomonas aeruginosa PA01
gccccaggcgcccagg

SEQ ID NO: 1486998 - RNA, 21 nt, Pseudomonas aeruginosa PA01
gccccaggcgcccaggcagca

SEQ ID NO: 1486999 - RNA, 23 nt, Pseudomonas aeruginosa PA01
gccccaggcugcccagguagccg

SEQ ID NO: 1487000 - RNA, 16 nt, Pseudomonas aeruginosa PA01
gccccagcaucgccgg

SEQ ID NO: 1487001 - RNA, 17 nt, Pseudomonas aeruginosa PA01
gccccagcaucgccggc

SEQ ID NO: 1487002 - RNA, 18 nt, Pseudomonas aeruginosa PA01
gccccagcaucgccggca

SEQ ID NO: 1487003 - RNA, 16 nt, Pseudomonas aeruginosa PA01
gccccagccuccaccc

SEQ ID NO: 1487004 - RNA, 23 nt, Pseudomonas aeruginosa PA01
gccccagccucggcagggcgccc

SEQ ID NO: 1487005 - RNA, 14 nt, Pseudomonas aeruginosa PA01
gccccagcgccugg

SEQ ID NO: 1487006 - RNA, 16 nt, Pseudomonas aeruginosa PA01
gccccagcgccugggc

SEQ ID NO: 1487007 - RNA, 17 nt, Pseudomonas aeruginosa PA01
gccccagcgccugggcc

SEQ ID NO: 1487008 - RNA, 15 nt, Pseudomonas aeruginosa PA01
gccccagaucgccag

SEQ ID NO: 1487009 - RNA, 15 nt, Pseudomonas aeruginosa PA01
gccccagcacgccga

SEQ ID NO: 1487010 - RNA, 14 nt, Pseudomonas aeruginosa PA01
gccccagagcccgc

SEQ ID NO: 1487011 - RNA, 15 nt, Pseudomonas aeruginosa PA01
gccccagagcccgcc

SEQ ID NO: 1487012 - RNA, 20 nt, Pseudomonas aeruginosa PA01
gccccagagcccgccgaaca

SEQ ID NO: 1487013 - RNA, 15 nt, Pseudomonas aeruginosa PA01
gccccagaagcccca

SEQ ID NO: 1487014 - RNA, 21 nt, Pseudomonas aeruginosa PA01
gccccagaagccccagagccc

SEQ ID NO: 1487015 - RNA, 15 nt, Pseudomonas aeruginosa PA01
gccccagacccaggu

SEQ ID NO: 1487016 - RNA, 16 nt, Pseudomonas aeruginosa PA01
gccccagacccaggug

SEQ ID NO: 1487017 - RNA, 21 nt, Pseudomonas aeruginosa PA01
gccccagacccaggugcgcag

SEQ ID NO: 1487018 - RNA, 21 nt, Pseudomonas aeruginosa PA01
gccccaccccaggguuggcgg

SEQ ID NO: 1487019 - RNA, 16 nt, Pseudomonas aeruginosa PA01
gccccacuuccggccc

SEQ ID NO: 1487020 - RNA, 18 nt, Pseudomonas aeruginosa PA01
gccccacuuccggcccgg

SEQ ID NO: 1487021 - RNA, 22 nt, Pseudomonas aeruginosa PA01
gccccacuuccggcccggccag

SEQ ID NO: 1487022 - RNA, 19 nt, Pseudomonas aeruginosa PA01
gccccacuggaagaaggcg

SEQ ID NO: 1487023 - RNA, 21 nt, Pseudomonas aeruginosa PA01
gccccacuggaagaaggcgau

SEQ ID NO: 1487024 - RNA, 23 nt, Pseudomonas aeruginosa PA01
gccccacuggaagaaggcgauca

SEQ ID NO: 1487025 - RNA, 18 nt, Pseudomonas aeruginosa PA01
gccccaccuggcgacagg

SEQ ID NO: 1487026 - RNA, 19 nt, Pseudomonas aeruginosa PA01
gccccaccuggcgacaggc

SEQ ID NO: 1487027 - RNA, 21 nt, Pseudomonas aeruginosa PA01
gccccaccuggcgacaggcga

SEQ ID NO: 1487028 - RNA, 23 nt, Pseudomonas aeruginosa PA01
gcccaucuucagcaucaggucgg

SEQ ID NO: 1487029 - RNA, 17 nt, Pseudomonas aeruginosa PA01
gcccaucuucaggccgu

SEQ ID NO: 1487030 - RNA, 16 nt, Pseudomonas aeruginosa PA01
gcccaucgccuccacg

SEQ ID NO: 1487031 - RNA, 23 nt, Pseudomonas aeruginosa PA01
gcccauccuggcgaucaggccaa

SEQ ID NO: 1487032 - RNA, 14 nt, Pseudomonas aeruginosa PA01
gcccaucgccaggg

SEQ ID NO: 1487033 - RNA, 16 nt, Pseudomonas aeruginosa PA01
gcccaucgccaccagc

SEQ ID NO: 1487034 - RNA, 17 nt, Pseudomonas aeruginosa PA01
gcccaucgccaccagca

SEQ ID NO: 1487035 - RNA, 18 nt, Pseudomonas aeruginosa PA01
gcccaucgccaccagcag

SEQ ID NO: 1487036 - RNA, 22 nt, Pseudomonas aeruginosa PA01
gcccaugaaaaagccccgccga

SEQ ID NO: 1487037 - RNA, 20 nt, Pseudomonas aeruginosa PA01
gcccaugaaaaagcccggcc

SEQ ID NO: 1487038 - RNA, 21 nt, Pseudomonas aeruginosa PA01
gcccaugaaaaagcccggccu

SEQ ID NO: 1487039 - RNA, 23 nt, Pseudomonas aeruginosa PA01
gcccaugaaaaagcccggccugg

SEQ ID NO: 1487040 - RNA, 20 nt, Pseudomonas aeruginosa PA01
gcccaugaaaaauggccgcu

SEQ ID NO: 1487041 - RNA, 17 nt, Pseudomonas aeruginosa PA01
gccccaccgcacuggug

SEQ ID NO: 1487042 - RNA, 15 nt, Pseudomonas aeruginosa PA01
gccccaccgccaggu

SEQ ID NO: 1487043 - RNA, 12 nt, Pseudomonas aeruginosa PA01
gccccacaggcc

SEQ ID NO: 1487044 - RNA, 13 nt, Pseudomonas aeruginosa PA01
gccccacaggccc

SEQ ID NO: 1487045 - RNA, 14 nt, Pseudomonas aeruginosa PA01
gccccacaggcccu

SEQ ID NO: 1487046 - RNA, 20 nt, Pseudomonas aeruginosa PA01
gccccaccaccaucgccgcg

SEQ ID NO: 1487047 - RNA, 17 nt, Pseudomonas aeruginosa PA01
gcccaguugcgcggcga

SEQ ID NO: 1487048 - RNA, 18 nt, Pseudomonas aeruginosa PA01
gcccaguugcgcggcgag

SEQ ID NO: 1487049 - RNA, 16 nt, Pseudomonas aeruginosa PA01
gcccauccgccgcagg

SEQ ID NO: 1487050 - RNA, 21 nt, Pseudomonas aeruginosa PA01
gcccauccgccgcaggaaggc

SEQ ID NO: 1487051 - RNA, 19 nt, Pseudomonas aeruginosa PA01
gcccauccgcucggcgagu

SEQ ID NO: 1487052 - RNA, 19 nt, Pseudomonas aeruginosa PA01
gcccaucaggcucaggcgu

SEQ ID NO: 1487053 - RNA, 17 nt, Pseudomonas aeruginosa PA01
gccccggcgauccgcgc

SEQ ID NO: 1487054 - RNA, 16 nt, Pseudomonas aeruginosa PA01
gccccggcgucggcgc

SEQ ID NO: 1487055 - RNA, 17 nt, Pseudomonas aeruginosa PA01
gccccggcgucggcgcg

SEQ ID NO: 1487056 - RNA, 13 nt, Pseudomonas aeruginosa PA01
gccccggcggcga

SEQ ID NO: 1487057 - RNA, 21 nt, Pseudomonas aeruginosa PA01
gccccggcgccgaccguggcg

SEQ ID NO: 1487058 - RNA, 16 nt, Pseudomonas aeruginosa PA01
gccccgggcgccgggu

SEQ ID NO: 1487059 - RNA, 17 nt, Pseudomonas aeruginosa PA01
gccccgggcgccggguc

SEQ ID NO: 1487060 - RNA, 15 nt, Pseudomonas aeruginosa PA01
gccccgggaccauca

SEQ ID NO: 1487061 - RNA, 17 nt, Pseudomonas aeruginosa PA01
gccccgggaccaucacc

SEQ ID NO: 1487062 - RNA, 18 nt, Pseudomonas aeruginosa PA01
gccccggucucgcgcagc

SEQ ID NO: 1487063 - RNA, 20 nt, Pseudomonas aeruginosa PA01
gccccggugauguaggccgc

SEQ ID NO: 1487064 - RNA, 14 nt, Pseudomonas aeruginosa PA01
gccccgggucgcug

SEQ ID NO: 1487065 - RNA, 16 nt, Pseudomonas aeruginosa PA01
gccccgggucgcugcu

SEQ ID NO: 1487066 - RNA, 20 nt, Pseudomonas aeruginosa PA01
gccccgggucgcugcucagg

SEQ ID NO: 1487067 - RNA, 23 nt, Pseudomonas aeruginosa PA01
gccccgggucgcugcucagggcc

SEQ ID NO: 1487068 - RNA, 16 nt, Pseudomonas aeruginosa PA01
gccccgggucggcacg

SEQ ID NO: 1487069 - RNA, 20 nt, Pseudomonas aeruginosa PA01
gccccgggucggcacggcca

SEQ ID NO: 1487070 - RNA, 16 nt, Pseudomonas aeruginosa PA01
gccccgucggcccucc

SEQ ID NO: 1487071 - RNA, 19 nt, Pseudomonas aeruginosa PA01
gccccgucuucacgacgaa

SEQ ID NO: 1487072 - RNA, 14 nt, Pseudomonas aeruginosa PA01
gccccguggcgggc

SEQ ID NO: 1487073 - RNA, 20 nt, Pseudomonas aeruginosa PA01
gccccguggcgggccagcag

SEQ ID NO: 1487074 - RNA, 16 nt, Pseudomonas aeruginosa PA01
gccccgugcaccgagg

SEQ ID NO: 1487075 - RNA, 17 nt, Pseudomonas aeruginosa PA01
gccccgugcaccgaggc

SEQ ID NO: 1487076 - RNA, 19 nt, Pseudomonas aeruginosa PA01
gccccgguuacucgccggc

SEQ ID NO: 1487077 - RNA, 20 nt, Pseudomonas aeruginosa PA01
gccccgguuacucgccggca

SEQ ID NO: 1487078 - RNA, 15 nt, Pseudomonas aeruginosa PA01
gccccgucccuacca

SEQ ID NO: 1487079 - RNA, 22 nt, Pseudomonas aeruginosa PA01
gccccgucccuaccagcgcaac

SEQ ID NO: 1487080 - RNA, 18 nt, Pseudomonas aeruginosa PA01
gccccgguuggcgcccca

SEQ ID NO: 1487081 - RNA, 19 nt, Pseudomonas aeruginosa PA01
gccccguuggcgcgggcga

SEQ ID NO: 1487082 - RNA, 23 nt, Pseudomonas aeruginosa PA01
gccccguuggcgcgggcgaaggc

SEQ ID NO: 1487083 - RNA, 19 nt, Pseudomonas aeruginosa PA01
gccccguuaaugccggugg

SEQ ID NO: 1487084 - RNA, 16 nt, Pseudomonas aeruginosa PA01
gccccguuugccgucg

SEQ ID NO: 1487085 - RNA, 12 nt, Pseudomonas aeruginosa PA01
gccccuccaccu

SEQ ID NO: 1487086 - RNA, 19 nt, Pseudomonas aeruginosa PA01
gccccuccaccucgacccu

SEQ ID NO: 1487087 - RNA, 21 nt, Pseudomonas aeruginosa PA01
gccccuccaccucgacccugg

SEQ ID NO: 1487088 - RNA, 14 nt, Pseudomonas aeruginosa PA01
gccccucccagcca

SEQ ID NO: 1487089 - RNA, 20 nt, Pseudomonas aeruginosa PA01
gccccuccuggaaagaccgg

SEQ ID NO: 1487090 - RNA, 23 nt, Pseudomonas aeruginosa PA01
gccccuccuucgagccuggccag

SEQ ID NO: 1487091 - RNA, 22 nt, Pseudomonas aeruginosa PA01
gcccccuccccuguggucaggc

SEQ ID NO: 1487092 - RNA, 18 nt, Pseudomonas aeruginosa PA01
gccccgcgguacccggca

SEQ ID NO: 1487093 - RNA, 22 nt, Pseudomonas aeruginosa PA01
gccccggccucaacgaccgccc

SEQ ID NO: 1487094 - RNA, 12 nt, Pseudomonas aeruginosa PA01
gccccggccggc

SEQ ID NO: 1487095 - RNA, 13 nt, Pseudomonas aeruginosa PA01
gccccggccggca

SEQ ID NO: 1487096 - RNA, 15 nt, Pseudomonas aeruginosa PA01
gccccggccggcagg

SEQ ID NO: 1487097 - RNA, 12 nt, Pseudomonas aeruginosa PA01
gcccccaggcac

SEQ ID NO: 1487098 - RNA, 14 nt, Pseudomonas aeruginosa PA01
gcccccccagcacg

SEQ ID NO: 1487099 - RNA, 20 nt, Pseudomonas aeruginosa PA01
gcccccccagcacggaugcc

SEQ ID NO: 1487100 - RNA, 17 nt, Pseudomonas aeruginosa PA01
gcccccgccggccggga

SEQ ID NO: 1487101 - RNA, 14 nt, Pseudomonas aeruginosa PA01
gcccccgccgcuga

SEQ ID NO: 1487102 - RNA, 23 nt, Pseudomonas aeruginosa PA01
gcccccgccgcugaggcucgccg

SEQ ID NO: 1487103 - RNA, 13 nt, Pseudomonas aeruginosa PA01
gcccccgccggcc

SEQ ID NO: 1487104 - RNA, 14 nt, Pseudomonas aeruginosa PA01
gcccccggcgccac

SEQ ID NO: 1487105 - RNA, 15 nt, Pseudomonas aeruginosa PA01
gcccccggcgccacc

SEQ ID NO: 1487106 - RNA, 13 nt, Pseudomonas aeruginosa PA01
gcccgccggcgcg

SEQ ID NO: 1487107 - RNA, 14 nt, Pseudomonas aeruginosa PA01
gcccgccggcgcgc

SEQ ID NO: 1487108 - RNA, 15 nt, Pseudomonas aeruginosa PA01
gcccgccggcgcgcc

SEQ ID NO: 1487109 - RNA, 22 nt, Pseudomonas aeruginosa PA01
gcccgccggcgcgcccaggccc

SEQ ID NO: 1487110 - RNA, 19 nt, Pseudomonas aeruginosa PA01
gcccgccuugauggcgggc

SEQ ID NO: 1487111 - RNA, 20 nt, Pseudomonas aeruginosa PA01
gcccgccuugauggcgggcu

SEQ ID NO: 1487112 - RNA, 19 nt, Pseudomonas aeruginosa PA01
gcccgccuuguucgccagc

SEQ ID NO: 1487113 - RNA, 20 nt, Pseudomonas aeruginosa PA01
gcccgccuuguucgccagca

SEQ ID NO: 1487114 - RNA, 21 nt, Pseudomonas aeruginosa PA01
gcccgccuuguucgccagcac

SEQ ID NO: 1487115 - RNA, 15 nt, Pseudomonas aeruginosa PA01
gcccgccggcgaacg

SEQ ID NO: 1487116 - RNA, 16 nt, Pseudomonas aeruginosa PA01
gcccgccggcgaugcg

SEQ ID NO: 1487117 - RNA, 12 nt, Pseudomonas aeruginosa PA01
gcccgccggcgc

SEQ ID NO: 1487118 - RNA, 15 nt, Pseudomonas aeruginosa PA01
gcccgccggcgcccu

SEQ ID NO: 1487119 - RNA, 12 nt, Pseudomonas aeruginosa PA01
gcccgccccgca

SEQ ID NO: 1487120 - RNA, 14 nt, Pseudomonas aeruginosa PA01
gcccgccccgcaag

SEQ ID NO: 1487121 - RNA, 13 nt, Pseudomonas aeruginosa PA01
gcccgccccgcac

SEQ ID NO: 1487122 - RNA, 17 nt, Pseudomonas aeruginosa PA01
gcccgccccgcaccagc

SEQ ID NO: 1487123 - RNA, 20 nt, Pseudomonas aeruginosa PA01
gcccgcccaguugcgggccu

SEQ ID NO: 1487124 - RNA, 15 nt, Pseudomonas aeruginosa PA01
gcccgcgcggcaacg

SEQ ID NO: 1487125 - RNA, 18 nt, Pseudomonas aeruginosa PA01
gcccgcgccuccaggcgc

SEQ ID NO: 1487126 - RNA, 21 nt, Pseudomonas aeruginosa PA01
gcccgcgccuccaggcgcgcc

SEQ ID NO: 1487127 - RNA, 14 nt, Pseudomonas aeruginosa PA01
gcccgcgccugggc

SEQ ID NO: 1487128 - RNA, 19 nt, Pseudomonas aeruginosa PA01
gcccgcgccugggccgcga

SEQ ID NO: 1487129 - RNA, 19 nt, Pseudomonas aeruginosa PA01
gcccgcgcgacagcucugg

SEQ ID NO: 1487130 - RNA, 22 nt, Pseudomonas aeruginosa PA01
gcccgcgcgacagcucuggggu

SEQ ID NO: 1487131 - RNA, 16 nt, Pseudomonas aeruginosa PA01
gcccgcgagccgcgca

SEQ ID NO: 1487132 - RNA, 20 nt, Pseudomonas aeruginosa PA01
gcccgcgagccgcgcagcag

SEQ ID NO: 1487133 - RNA, 16 nt, Pseudomonas aeruginosa PA01
gcccgcgagccguccu

SEQ ID NO: 1487134 - RNA, 19 nt, Pseudomonas aeruginosa PA01
gcccgcgagccguccugcg

SEQ ID NO: 1487135 - RNA, 21 nt, Pseudomonas aeruginosa PA01
gcccgcgagccguccugcggc

SEQ ID NO: 1487136 - RNA, 14 nt, Pseudomonas aeruginosa PA01
gcccgcggcggcga

SEQ ID NO: 1487137 - RNA, 12 nt, Pseudomonas aeruginosa PA01
gcccgcgggcag

SEQ ID NO: 1487138 - RNA, 19 nt, Pseudomonas aeruginosa PA01
gcccgcgguauucuccagc

SEQ ID NO: 1487139 - RNA, 20 nt, Pseudomonas aeruginosa PA01
gcccgcgguauucuccagca

SEQ ID NO: 1487140 - RNA, 21 nt, Pseudomonas aeruginosa PA01
gcccgcgguauucuccagcag

SEQ ID NO: 1487141 - RNA, 19 nt, Pseudomonas aeruginosa PA01
gcccgcggucacucggccu

SEQ ID NO: 1487142 - RNA, 20 nt, Pseudomonas aeruginosa PA01
gcccgcggucacucggccuc

SEQ ID NO: 1487143 - RNA, 23 nt, Pseudomonas aeruginosa PA01
gcccgcggucacucggccucggc

SEQ ID NO: 1487144 - RNA, 24 nt, Pseudomonas aeruginosa PA01
gcccgcggucacucggccucggcg

SEQ ID NO: 1487145 - RNA, 14 nt, Pseudomonas aeruginosa PA01
gcccgcgcucggcc

SEQ ID NO: 1487146 - RNA, 20 nt, Pseudomonas aeruginosa PA01
gcccgcgcucggccgccugg

SEQ ID NO: 1487147 - RNA, 13 nt, Pseudomonas aeruginosa PA01
gcccgcggaucgc

SEQ ID NO: 1487148 - RNA, 16 nt, Pseudomonas aeruginosa PA01
gcccgcggaucgcgcc

SEQ ID NO: 1487149 - RNA, 19 nt, Pseudomonas aeruginosa PA01
gcccgcggaucgcgccguc

SEQ ID NO: 1487150 - RNA, 18 nt, Pseudomonas aeruginosa PA01
gcccgcggaccgggcggc

SEQ ID NO: 1487151 - RNA, 21 nt, Pseudomonas aeruginosa PA01
gcccgcggaccgggcggcgcg

SEQ ID NO: 1487152 - RNA, 19 nt, Pseudomonas aeruginosa PA01
gcccgcggcaucggccugg

SEQ ID NO: 1487153 - RNA, 16 nt, Pseudomonas aeruginosa PA01
gcccgcggcagcagcc

SEQ ID NO: 1487154 - RNA, 20 nt, Pseudomonas aeruginosa PA01
gcccgccaacguccucgaug

SEQ ID NO: 1487155 - RNA, 13 nt, Pseudomonas aeruginosa PA01
gcccgccaaggcc

SEQ ID NO: 1487156 - RNA, 21 nt, Pseudomonas aeruginosa PA01
gcccgccaaggcccugcugca

SEQ ID NO: 1487157 - RNA, 16 nt, Pseudomonas aeruginosa PA01
gcccgccaagggcgcc

SEQ ID NO: 1487158 - RNA, 19 nt, Pseudomonas aeruginosa PA01
gcccgccaagggcgccgcc

SEQ ID NO: 1487159 - RNA, 17 nt, Pseudomonas aeruginosa PA01
gcccgccauguuggccu

SEQ ID NO: 1487160 - RNA, 19 nt, Pseudomonas aeruginosa PA01
gcccgcaguuccucgccgc

SEQ ID NO: 1487161 - RNA, 21 nt, Pseudomonas aeruginosa PA01
gcccgcaguuccucgccgcug

SEQ ID NO: 1487162 - RNA, 22 nt, Pseudomonas aeruginosa PA01
gcccgcaucccaguagccgguc

SEQ ID NO: 1487163 - RNA, 16 nt, Pseudomonas aeruginosa PA01
gcccgcaugccagggc

SEQ ID NO: 1487164 - RNA, 23 nt, Pseudomonas aeruginosa PA01
gcccgcacagguagaggucgaaa

SEQ ID NO: 1487165 - RNA, 21 nt, Pseudomonas aeruginosa PA01
gcccgcaugaacgccucgcca

SEQ ID NO: 1487166 - RNA, 13 nt, Pseudomonas aeruginosa PA01
gcccgaugccgcg

SEQ ID NO: 1487167 - RNA, 20 nt, Pseudomonas aeruginosa PA01
gcccgagugccggcgcgucg

SEQ ID NO: 1487168 - RNA, 18 nt, Pseudomonas aeruginosa PA01
gcccgagugcgcccagca

SEQ ID NO: 1487169 - RNA, 19 nt, Pseudomonas aeruginosa PA01
gcccgagugcgcccagcag

SEQ ID NO: 1487170 - RNA, 20 nt, Pseudomonas aeruginosa PA01
gcccgagugcgcccagcagc

SEQ ID NO: 1487171 - RNA, 15 nt, Pseudomonas aeruginosa PA01
gcccgauaggcgccg

SEQ ID NO: 1487172 - RNA, 17 nt, Pseudomonas aeruginosa PA01
gcccgauaggcgccggc

SEQ ID NO: 1487173 - RNA, 19 nt, Pseudomonas aeruginosa PA01
gcccgauaggcgccggcgc

SEQ ID NO: 1487174 - RNA, 13 nt, Pseudomonas aeruginosa PA01
gccccugcgccuc

SEQ ID NO: 1487175 - RNA, 20 nt, Pseudomonas aeruginosa PA01
gccccucuuccacgcgccga

SEQ ID NO: 1487176 - RNA, 13 nt, Pseudomonas aeruginosa PA01
gccccugccgcgg

SEQ ID NO: 1487177 - RNA, 14 nt, Pseudomonas aeruginosa PA01
gccccugccgcgga

SEQ ID NO: 1487178 - RNA, 20 nt, Pseudomonas aeruginosa PA01
gccccugccgcggauacggc

SEQ ID NO: 1487179 - RNA, 20 nt, Pseudomonas aeruginosa PA01
gccccugccguauccgcggc

SEQ ID NO: 1487180 - RNA, 21 nt, Pseudomonas aeruginosa PA01
gccccugccguauccgcggca

SEQ ID NO: 1487181 - RNA, 11 nt, Pseudomonas aeruginosa PA01
gccccugcgcc

SEQ ID NO: 1487182 - RNA, 17 nt, Pseudomonas aeruginosa PA01
gccccugcgcccaggga

SEQ ID NO: 1487183 - RNA, 21 nt, Pseudomonas aeruginosa PA01
gccccuagaccaacugcgccc

SEQ ID NO: 1487184 - RNA, 14 nt, Pseudomonas aeruginosa PA01
gccccucgccguga

SEQ ID NO: 1487185 - RNA, 20 nt, Pseudomonas aeruginosa PA01
gcccgaggcguuauccgccg

SEQ ID NO: 1487186 - RNA, 14 nt, Pseudomonas aeruginosa PA01
gcccgagggcgccg

SEQ ID NO: 1487187 - RNA, 18 nt, Pseudomonas aeruginosa PA01
gccccuucagcuccagca

SEQ ID NO: 1487188 - RNA, 19 nt, Pseudomonas aeruginosa PA01
gccccuucagcuccagcag

SEQ ID NO: 1487189 - RNA, 13 nt, Pseudomonas aeruginosa PA01
gcccgagggcggc

SEQ ID NO: 1487190 - RNA, 15 nt, Pseudomonas aeruginosa PA01
gcccgaggugucgcc

SEQ ID NO: 1487191 - RNA, 19 nt, Pseudomonas aeruginosa PA01
gcccgaggugucgccgcgg

SEQ ID NO: 1487192 - RNA, 20 nt, Pseudomonas aeruginosa PA01
gcccgaggugucgccgcgga

SEQ ID NO: 1487193 - RNA, 20 nt, Pseudomonas aeruginosa PA01
gcccgagucccuugcggcag

SEQ ID NO: 1487194 - RNA, 22 nt, Pseudomonas aeruginosa PA01
gcccgagucccuugcggcagac

SEQ ID NO: 1487195 - RNA, 13 nt, Pseudomonas aeruginosa PA01
gccccugcggacc

SEQ ID NO: 1487196 - RNA, 15 nt, Pseudomonas aeruginosa PA01
gccccugcggcgccg

SEQ ID NO: 1487197 - RNA, 18 nt, Pseudomonas aeruginosa PA01
gccccugcggcgccgguu

SEQ ID NO: 1487198 - RNA, 14 nt, Pseudomonas aeruginosa PA01
gccgcgucgucggc

SEQ ID NO: 1487199 - RNA, 16 nt, Pseudomonas aeruginosa PA01
gccgcgucgucggcga

SEQ ID NO: 1487200 - RNA, 20 nt, Pseudomonas aeruginosa PA01
gccgcgucgucggcgacgcu

SEQ ID NO: 1487201 - RNA, 21 nt, Pseudomonas aeruginosa PA01
gccgcgucgucggcgacgcug

SEQ ID NO: 1487202 - RNA, 19 nt, Pseudomonas aeruginosa PA01
gccgcgucgaagcugucgg

SEQ ID NO: 1487203 - RNA, 20 nt, Pseudomonas aeruginosa PA01
gccgcgucgaagcugucggc

SEQ ID NO: 1487204 - RNA, 15 nt, Pseudomonas aeruginosa PA01
gccgcgucgaagucg

SEQ ID NO: 1487205 - RNA, 20 nt, Pseudomonas aeruginosa PA01
gccgcgucgaagucgaucac

SEQ ID NO: 1487206 - RNA, 13 nt, Pseudomonas aeruginosa PA01
gccgcgucgccca

SEQ ID NO: 1487207 - RNA, 14 nt, Pseudomonas aeruginosa PA01
gccgcgucgcccag

SEQ ID NO: 1487208 - RNA, 15 nt, Pseudomonas aeruginosa PA01
gccgcgucgcccagg

SEQ ID NO: 1487209 - RNA, 16 nt, Pseudomonas aeruginosa PA01
gccgcgucgcccaggc

SEQ ID NO: 1487210 - RNA, 18 nt, Pseudomonas aeruginosa PA01
gccgcgucgcccaggccg

SEQ ID NO: 1487211 - RNA, 20 nt, Pseudomonas aeruginosa PA01
gccgcgucgcccaggccgcu

SEQ ID NO: 1487212 - RNA, 22 nt, Pseudomonas aeruginosa PA01
gccgcgucgcccaggccgcugg

SEQ ID NO: 1487213 - RNA, 15 nt, Pseudomonas aeruginosa PA01
gccgcggugcgggcc

SEQ ID NO: 1487214 - RNA, 14 nt, Pseudomonas aeruginosa PA01
gccgcggugucggc

SEQ ID NO: 1487215 - RNA, 19 nt, Pseudomonas aeruginosa PA01
gccgcggugggcuccagcg

SEQ ID NO: 1487216 - RNA, 14 nt, Pseudomonas aeruginosa PA01
gccgcguaagcggc

SEQ ID NO: 1487217 - RNA, 16 nt, Pseudomonas aeruginosa PA01
gccgcguaagcggccu

SEQ ID NO: 1487218 - RNA, 17 nt, Pseudomonas aeruginosa PA01
gccgcguaagcggccuu

SEQ ID NO: 1487219 - RNA, 14 nt, Pseudomonas aeruginosa PA01
gccgcguagcgcca

SEQ ID NO: 1487220 - RNA, 16 nt, Pseudomonas aeruginosa PA01
gccgcguagcgccagg

SEQ ID NO: 1487221 - RNA, 18 nt, Pseudomonas aeruginosa PA01
gccgcguagcgccaggcc

SEQ ID NO: 1487222 - RNA, 19 nt, Pseudomonas aeruginosa PA01
gccgcgguccaucccuucg

SEQ ID NO: 1487223 - RNA, 19 nt, Pseudomonas aeruginosa PA01
gccgcgggucucgaucagc

SEQ ID NO: 1487224 - RNA, 21 nt, Pseudomonas aeruginosa PA01
gccgcgggucucgaucagcgc

SEQ ID NO: 1487225 - RNA, 23 nt, Pseudomonas aeruginosa PA01
gccgcgggucucgaucagcgccg

SEQ ID NO: 1487226 - RNA, 16 nt, Pseudomonas aeruginosa PA01
gccgcgggucugcucg

SEQ ID NO: 1487227 - RNA, 18 nt, Pseudomonas aeruginosa PA01
gccgcgggucuugcgcag

SEQ ID NO: 1487228 - RNA, 17 nt, Pseudomonas aeruginosa PA01
gccgcggguagcguugg

SEQ ID NO: 1487229 - RNA, 15 nt, Pseudomonas aeruginosa PA01
gccgcgggucaccag

SEQ ID NO: 1487230 - RNA, 17 nt, Pseudomonas aeruginosa PA01
gccgcgggucaccagcg

SEQ ID NO: 1487231 - RNA, 21 nt, Pseudomonas aeruginosa PA01
gccgcgggucaccagcgccgg

SEQ ID NO: 1487232 - RNA, 22 nt, Pseudomonas aeruginosa PA01
gccgcggggaggaagcuccccg

SEQ ID NO: 1487233 - RNA, 16 nt, Pseudomonas aeruginosa PA01
gccgcgggcguugcgc

SEQ ID NO: 1487234 - RNA, 19 nt, Pseudomonas aeruginosa PA01
gccgcgggcguugcgcgcc

SEQ ID NO: 1487235 - RNA, 21 nt, Pseudomonas aeruginosa PA01
gccgcgggcgcuaugcgccgu

SEQ ID NO: 1487236 - RNA, 15 nt, Pseudomonas aeruginosa PA01
gccgcgggccagccg

SEQ ID NO: 1487237 - RNA, 16 nt, Pseudomonas aeruginosa PA01
gccgcgggcgaacggc

SEQ ID NO: 1487238 - RNA, 14 nt, Pseudomonas aeruginosa PA01
gccgcgggacgccg

SEQ ID NO: 1487239 - RNA, 18 nt, Pseudomonas aeruginosa PA01
gccgcgggacgccgcagg

SEQ ID NO: 1487240 - RNA, 14 nt, Pseudomonas aeruginosa PA01
gccgcgggaggccg

SEQ ID NO: 1487241 - RNA, 17 nt, Pseudomonas aeruginosa PA01
gccgcgggaggccgccu

SEQ ID NO: 1487242 - RNA, 20 nt, Pseudomonas aeruginosa PA01
gccgcgggaggccgccucga

SEQ ID NO: 1487243 - RNA, 13 nt, Pseudomonas aeruginosa PA01
gccgcgggccagc

SEQ ID NO: 1487244 - RNA, 13 nt, Pseudomonas aeruginosa PA01
gccgcgggcaacc

SEQ ID NO: 1487245 - RNA, 19 nt, Pseudomonas aeruginosa PA01
gccgcggcguuagccgccu

SEQ ID NO: 1487246 - RNA, 20 nt, Pseudomonas aeruginosa PA01
gccgcggcguuagccgccug

SEQ ID NO: 1487247 - RNA, 23 nt, Pseudomonas aeruginosa PA01
gccgcggcguuagccgccugcgg

SEQ ID NO: 1487248 - RNA, 15 nt, Pseudomonas aeruginosa PA01
gccgcggcguugcgc

SEQ ID NO: 1487249 - RNA, 23 nt, Pseudomonas aeruginosa PA01
gccgcggcguugucggccagcag

SEQ ID NO: 1487250 - RNA, 15 nt, Pseudomonas aeruginosa PA01
gccgcggcuggcagg

SEQ ID NO: 1487251 - RNA, 22 nt, Pseudomonas aeruginosa PA01
gccgcggcuggcaggugccgcu

SEQ ID NO: 1487252 - RNA, 23 nt, Pseudomonas aeruginosa PA01
gccgcggcuggcaggugccgcuc

SEQ ID NO: 1487253 - RNA, 14 nt, Pseudomonas aeruginosa PA01
gccgcggcuggcca

SEQ ID NO: 1487254 - RNA, 13 nt, Pseudomonas aeruginosa PA01
gccgcgugccgcc

SEQ ID NO: 1487255 - RNA, 14 nt, Pseudomonas aeruginosa PA01
gccgcgugccgccg

SEQ ID NO: 1487256 - RNA, 15 nt, Pseudomonas aeruginosa PA01
gccgcgugccgccgg

SEQ ID NO: 1487257 - RNA, 18 nt, Pseudomonas aeruginosa PA01
gccgcgugccgccggacc

SEQ ID NO: 1487258 - RNA, 16 nt, Pseudomonas aeruginosa PA01
gccgcgugcgcgcccu

SEQ ID NO: 1487259 - RNA, 19 nt, Pseudomonas aeruginosa PA01
gccgcgugcgcgcccucgg

SEQ ID NO: 1487260 - RNA, 15 nt, Pseudomonas aeruginosa PA01
gccgcgugcgcgccg

SEQ ID NO: 1487261 - RNA, 21 nt, Pseudomonas aeruginosa PA01
gccgcgugcgcgccgccgggc

SEQ ID NO: 1487262 - RNA, 22 nt, Pseudomonas aeruginosa PA01
gccgcgugcgcgccgccgggcg

SEQ ID NO: 1487263 - RNA, 23 nt, Pseudomonas aeruginosa PA01
gccgcgugcgcgccgccgggcgc

SEQ ID NO: 1487264 - RNA, 18 nt, Pseudomonas aeruginosa PA01
gccgcguucgccgagcug

SEQ ID NO: 1487265 - RNA, 16 nt, Pseudomonas aeruginosa PA01
gccgcguucgccgagg

SEQ ID NO: 1487266 - RNA, 23 nt, Pseudomonas aeruginosa PA01
gccgcguucgccgaggcggcgca

SEQ ID NO: 1487267 - RNA, 22 nt, Pseudomonas aeruginosa PA01
gccgcguuccuugugcacgaac

SEQ ID NO: 1487268 - RNA, 18 nt, Pseudomonas aeruginosa PA01
gccgcguucagucccgcg

SEQ ID NO: 1487269 - RNA, 20 nt, Pseudomonas aeruginosa PA01
gccgcguucagucccgcggc

SEQ ID NO: 1487270 - RNA, 22 nt, Pseudomonas aeruginosa PA01
gccgcuaugggcaccgcgccgg

SEQ ID NO: 1487271 - RNA, 14 nt, Pseudomonas aeruginosa PA01
gccgcuaucgcugg

SEQ ID NO: 1487272 - RNA, 16 nt, Pseudomonas aeruginosa PA01
gccgcuaucgcuggcg

SEQ ID NO: 1487273 - RNA, 18 nt, Pseudomonas aeruginosa PA01
gccgcuaucgcuggcgca

SEQ ID NO: 1487274 - RNA, 20 nt, Pseudomonas aeruginosa PA01
gccgcuaucgcuggcgcagc

SEQ ID NO: 1487275 - RNA, 22 nt, Pseudomonas aeruginosa PA01
gccgcuaucgcuggcgcagccg

SEQ ID NO: 1487276 - RNA, 15 nt, Pseudomonas aeruginosa PA01
gccgcuaucgccgcc

SEQ ID NO: 1487277 - RNA, 16 nt, Pseudomonas aeruginosa PA01
gccgcuaucgccgccg

SEQ ID NO: 1487278 - RNA, 17 nt, Pseudomonas aeruginosa PA01
gccgcuaucgccgccgc

SEQ ID NO: 1487279 - RNA, 15 nt, Pseudomonas aeruginosa PA01
gccgcuacgcggcgg

SEQ ID NO: 1487280 - RNA, 23 nt, Pseudomonas aeruginosa PA01
gccgcuacccagguggucgacca

SEQ ID NO: 1487281 - RNA, 13 nt, Pseudomonas aeruginosa PA01
gccgcuagggcgc

SEQ ID NO: 1487282 - RNA, 23 nt, Pseudomonas aeruginosa PA01
gccgcuagggcgcccucgccaau

SEQ ID NO: 1487283 - RNA, 15 nt, Pseudomonas aeruginosa PA01
gccgcuagcccugcu

SEQ ID NO: 1487284 - RNA, 20 nt, Pseudomonas aeruginosa PA01
gccgcuagcccugcugcucg

SEQ ID NO: 1487285 - RNA, 14 nt, Pseudomonas aeruginosa PA01
gccgcuacugcgcg

SEQ ID NO: 1487286 - RNA, 15 nt, Pseudomonas aeruginosa PA01
gccgcuacugcgcgg

SEQ ID NO: 1487287 - RNA, 18 nt, Pseudomonas aeruginosa PA01
gccgcuacugcgcgggca

SEQ ID NO: 1487288 - RNA, 14 nt, Pseudomonas aeruginosa PA01
gccgcucacccugu

SEQ ID NO: 1487289 - RNA, 14 nt, Pseudomonas aeruginosa PA01
gccgcucaggcugu

SEQ ID NO: 1487290 - RNA, 16 nt, Pseudomonas aeruginosa PA01
gccgcucauccgcugg

SEQ ID NO: 1487291 - RNA, 20 nt, Pseudomonas aeruginosa PA01
gccgcucaucugcaccacgu

SEQ ID NO: 1487292 - RNA, 15 nt, Pseudomonas aeruginosa PA01
gccgcuccacacccg

SEQ ID NO: 1487293 - RNA, 23 nt, Pseudomonas aeruginosa PA01
gccgcuccacacccggucgcgcu

SEQ ID NO: 1487294 - RNA, 16 nt, Pseudomonas aeruginosa PA01
gccgcucccaccgcuu

SEQ ID NO: 1487295 - RNA, 23 nt, Pseudomonas aeruginosa PA01
gccgcucccaccgcuuucagcgc

SEQ ID NO: 1487296 - RNA, 15 nt, Pseudomonas aeruginosa PA01
gccgcuccaggaucg

SEQ ID NO: 1487297 - RNA, 17 nt, Pseudomonas aeruginosa PA01
gccgcuccaggaucgcc

SEQ ID NO: 1487298 - RNA, 16 nt, Pseudomonas aeruginosa PA01
gccgcuccgcgccacg

SEQ ID NO: 1487299 - RNA, 17 nt, Pseudomonas aeruginosa PA01
gccgcuccgcgccacgc

SEQ ID NO: 1487300 - RNA, 21 nt, Pseudomonas aeruginosa PA01
gccgcuccuccucgcucugcg

SEQ ID NO: 1487301 - RNA, 23 nt, Pseudomonas aeruginosa PA01
gccgcuccuccucgcucugcgcc

SEQ ID NO: 1487302 - RNA, 20 nt, Pseudomonas aeruginosa PA01
gccgcuccggcugcgcggag

SEQ ID NO: 1487303 - RNA, 19 nt, Pseudomonas aeruginosa PA01
gccgcugaaguccuggccg

SEQ ID NO: 1487304 - RNA, 23 nt, Pseudomonas aeruginosa PA01
gccgcugaaguccuggccgagca

SEQ ID NO: 1487305 - RNA, 21 nt, Pseudomonas aeruginosa PA01
gccgcugaauaccaccgggcc

SEQ ID NO: 1487306 - RNA, 22 nt, Pseudomonas aeruginosa PA01
gccgcugaauaccaccgggccg

SEQ ID NO: 1487307 - RNA, 23 nt, Pseudomonas aeruginosa PA01
gccgcucuaucagggucuucagg

SEQ ID NO: 1487308 - RNA, 23 nt, Pseudomonas aeruginosa PA01
gccgcucugccagaaggccugcg

SEQ ID NO: 1487309 - RNA, 16 nt, Pseudomonas aeruginosa PA01
gccgcucugcccgacc

SEQ ID NO: 1487310 - RNA, 13 nt, Pseudomonas aeruginosa PA01
gccgcucggcggg

SEQ ID NO: 1487311 - RNA, 13 nt, Pseudomonas aeruginosa PA01
gccgcucggcgua

SEQ ID NO: 1487312 - RNA, 21 nt, Pseudomonas aeruginosa PA01
gccgcucggcguagccggcga

SEQ ID NO: 1487313 - RNA, 13 nt, Pseudomonas aeruginosa PA01
gccgcucguuggc

SEQ ID NO: 1487314 - RNA, 14 nt, Pseudomonas aeruginosa PA01
gccgcuccuggcag

SEQ ID NO: 1487315 - RNA, 20 nt, Pseudomonas aeruginosa PA01
gccgcuccuggcaggcucac

SEQ ID NO: 1487316 - RNA, 17 nt, Pseudomonas aeruginosa PA01
gccgcucgagggcgacc

SEQ ID NO: 1487317 - RNA, 16 nt, Pseudomonas aeruginosa PA01
gccgcucgaugcccgc

SEQ ID NO: 1487318 - RNA, 21 nt, Pseudomonas aeruginosa PA01
gccgcucgaugcccgccagca

SEQ ID NO: 1487319 - RNA, 22 nt, Pseudomonas aeruginosa PA01
gccgcucgaugcccgccagcag

SEQ ID NO: 1487320 - RNA, 15 nt, Pseudomonas aeruginosa PA01
gccgcucgcguccgc

SEQ ID NO: 1487321 - RNA, 18 nt, Pseudomonas aeruginosa PA01
gccgcucgcgcacggcga

SEQ ID NO: 1487322 - RNA, 20 nt, Pseudomonas aeruginosa PA01
gccgcucgcgcacggcgaag

SEQ ID NO: 1487323 - RNA, 22 nt, Pseudomonas aeruginosa PA01
gccgcucggccuugagcgccga

SEQ ID NO: 1487324 - RNA, 17 nt, Pseudomonas aeruginosa PA01
gccgcucggcgagccgc

SEQ ID NO: 1487325 - RNA, 20 nt, Pseudomonas aeruginosa PA01
gccgcucggcgagccgccgg

SEQ ID NO: 1487326 - RNA, 22 nt, Pseudomonas aeruginosa PA01
gccgcucggcgagccgccgggc

SEQ ID NO: 1487327 - RNA, 23 nt, Pseudomonas aeruginosa PA01
gccgcucggcgagccgccgggcg

SEQ ID NO: 1487328 - RNA, 18 nt, Pseudomonas aeruginosa PA01
gccgcggcccggcgcugc

SEQ ID NO: 1487329 - RNA, 15 nt, Pseudomonas aeruginosa PA01
gccgcggcccugcgc

SEQ ID NO: 1487330 - RNA, 16 nt, Pseudomonas aeruginosa PA01
gccgcggccggcgacc

SEQ ID NO: 1487331 - RNA, 14 nt, Pseudomonas aeruginosa PA01
gccgcggccgggga

SEQ ID NO: 1487332 - RNA, 12 nt, Pseudomonas aeruginosa PA01
gccgcggcgacc

SEQ ID NO: 1487333 - RNA, 15 nt, Pseudomonas aeruginosa PA01
gccgcggcgaccagc

SEQ ID NO: 1487334 - RNA, 19 nt, Pseudomonas aeruginosa PA01
gccgcggcgaccagcgcgg

SEQ ID NO: 1487335 - RNA, 14 nt, Pseudomonas aeruginosa PA01
gccgcggcgcggag

SEQ ID NO: 1487336 - RNA, 20 nt, Pseudomonas aeruginosa PA01
gccgcggcgauaggcgcgca

SEQ ID NO: 1487337 - RNA, 15 nt, Pseudomonas aeruginosa PA01
gccgcggcgagcauc

SEQ ID NO: 1487338 - RNA, 22 nt, Pseudomonas aeruginosa PA01
gccgcggcgagcaucucggcca

SEQ ID NO: 1487339 - RNA, 13 nt, Pseudomonas aeruginosa PA01
gccgcggcggcgg

SEQ ID NO: 1487340 - RNA, 13 nt, Pseudomonas aeruginosa PA01
gccgcggcggcgu

SEQ ID NO: 1487341 - RNA, 17 nt, Pseudomonas aeruginosa PA01
gccgcggaaaacgccgc

SEQ ID NO: 1487342 - RNA, 21 nt, Pseudomonas aeruginosa PA01
gccgcggaaaacgccgcgaag

SEQ ID NO: 1487343 - RNA, 18 nt, Pseudomonas aeruginosa PA01
gccgcggaaggcccgcga

SEQ ID NO: 1487344 - RNA, 14 nt, Pseudomonas aeruginosa PA01
gccgcgcugcaggc

SEQ ID NO: 1487345 - RNA, 19 nt, Pseudomonas aeruginosa PA01
gccgcggaagugcgccggu

SEQ ID NO: 1487346 - RNA, 14 nt, Pseudomonas aeruginosa PA01
gccgcggacggcac

SEQ ID NO: 1487347 - RNA, 15 nt, Pseudomonas aeruginosa PA01
gccgcggacggccgg

SEQ ID NO: 1487348 - RNA, 17 nt, Pseudomonas aeruginosa PA01
gccgcggacggccggcu

SEQ ID NO: 1487349 - RNA, 16 nt, Pseudomonas aeruginosa PA01
gccgcggcaaugcggc

SEQ ID NO: 1487350 - RNA, 18 nt, Pseudomonas aeruginosa PA01
gccgcggagcaccgcgcc

SEQ ID NO: 1487351 - RNA, 23 nt, Pseudomonas aeruginosa PA01
gccgcggagcaccgcgccuucca

SEQ ID NO: 1487352 - RNA, 15 nt, Pseudomonas aeruginosa PA01
gccgcggaucaccug

SEQ ID NO: 1487353 - RNA, 17 nt, Pseudomonas aeruginosa PA01
gccgcggaucaccuggc

SEQ ID NO: 1487354 - RNA, 19 nt, Pseudomonas aeruginosa PA01
gccgcggaucaccuggccg

SEQ ID NO: 1487355 - RNA, 19 nt, Pseudomonas aeruginosa PA01
gccgcggaugacgggcgaa

SEQ ID NO: 1487356 - RNA, 17 nt, Pseudomonas aeruginosa PA01
gccgcgcucgacgguca

SEQ ID NO: 1487357 - RNA, 19 nt, Pseudomonas aeruginosa PA01
gccgcgcucgacggucagc

SEQ ID NO: 1487358 - RNA, 13 nt, Pseudomonas aeruginosa PA01
gccgcgcucgcgc

SEQ ID NO: 1487359 - RNA, 14 nt, Pseudomonas aeruginosa PA01
gccgcgcucgcgga

SEQ ID NO: 1487360 - RNA, 15 nt, Pseudomonas aeruginosa PA01
gccgcgcucgcggaa

SEQ ID NO: 1487361 - RNA, 16 nt, Pseudomonas aeruginosa PA01
gccgcgcucgcggaac

SEQ ID NO: 1487362 - RNA, 23 nt, Pseudomonas aeruginosa PA01
gccgcgcucggaucaggcgggcu

SEQ ID NO: 1487363 - RNA, 18 nt, Pseudomonas aeruginosa PA01
gccgcgcugcaagggcac

SEQ ID NO: 1487364 - RNA, 21 nt, Pseudomonas aeruginosa PA01
gccgcgcugcugccauccgcg

SEQ ID NO: 1487365 - RNA, 13 nt, Pseudomonas aeruginosa PA01
gccgcgcugcugg

SEQ ID NO: 1487366 - RNA, 14 nt, Pseudomonas aeruginosa PA01
gccgcgcugcuggu

SEQ ID NO: 1487367 - RNA, 16 nt, Pseudomonas aeruginosa PA01
gccgcgcugcgccagg

SEQ ID NO: 1487368 - RNA, 18 nt, Pseudomonas aeruginosa PA01
gccgcgcugcgccaggcc

SEQ ID NO: 1487369 - RNA, 20 nt, Pseudomonas aeruginosa PA01
gccgcgcugcgccaggccgu

SEQ ID NO: 1487370 - RNA, 16 nt, Pseudomonas aeruginosa PA01
gccgcgcugucggccu

SEQ ID NO: 1487371 - RNA, 17 nt, Pseudomonas aeruginosa PA01
gccgcgcugucggccuc

SEQ ID NO: 1487372 - RNA, 14 nt, Pseudomonas aeruginosa PA01
gccgcgcuucaggc

SEQ ID NO: 1487373 - RNA, 21 nt, Pseudomonas aeruginosa PA01
gccgcgcuucaggcaguccuu

SEQ ID NO: 1487374 - RNA, 15 nt, Pseudomonas aeruginosa PA01
gccgcgcccggcgcc

SEQ ID NO: 1487375 - RNA, 16 nt, Pseudomonas aeruginosa PA01
gccgcgcccggcgcca

SEQ ID NO: 1487376 - RNA, 18 nt, Pseudomonas aeruginosa PA01
gccgcgcccggcgccagg

SEQ ID NO: 1487377 - RNA, 18 nt, Pseudomonas aeruginosa PA01
gccgcgcaucaccccgca

SEQ ID NO: 1487378 - RNA, 14 nt, Pseudomonas aeruginosa PA01
gccgcgccgaaggc

SEQ ID NO: 1487379 - RNA, 22 nt, Pseudomonas aeruginosa PA01
gccgcgccgagauagcggcaac

SEQ ID NO: 1487380 - RNA, 13 nt, Pseudomonas aeruginosa PA01
gccgcgccgagcc

SEQ ID NO: 1487381 - RNA, 16 nt, Pseudomonas aeruginosa PA01
gccgcgccgagccggc

SEQ ID NO: 1487382 - RNA, 17 nt, Pseudomonas aeruginosa PA01
gccgcgccgagccggcu

SEQ ID NO: 1487383 - RNA, 23 nt, Pseudomonas aeruginosa PA01
gccgcgccgagccggcugccgaa

SEQ ID NO: 1487384 - RNA, 16 nt, Pseudomonas aeruginosa PA01
gccgcgccgcaagggc

SEQ ID NO: 1487385 - RNA, 15 nt, Pseudomonas aeruginosa PA01
gccgcgccgacccag

SEQ ID NO: 1487386 - RNA, 21 nt, Pseudomonas aeruginosa PA01
gccgcgccgcccuggccgccc

SEQ ID NO: 1487387 - RNA, 12 nt, Pseudomonas aeruginosa PA01
gccgcgccgccg

SEQ ID NO: 1487388 - RNA, 14 nt, Pseudomonas aeruginosa PA01
gccgcgccgccgag

SEQ ID NO: 1487389 - RNA, 15 nt, Pseudomonas aeruginosa PA01
gccgcgccgccgagg

SEQ ID NO: 1487390 - RNA, 13 nt, Pseudomonas aeruginosa PA01
gccgcgccgccga

SEQ ID NO: 1487391 - RNA, 13 nt, Pseudomonas aeruginosa PA01
gccgcgccgcuca

SEQ ID NO: 1487392 - RNA, 12 nt, Pseudomonas aeruginosa PA01
gccgcgccggcc

SEQ ID NO: 1487393 - RNA, 13 nt, Pseudomonas aeruginosa PA01
gccgcgccggcga

SEQ ID NO: 1487394 - RNA, 19 nt, Pseudomonas aeruginosa PA01
gccgcgccggggcagcagg

SEQ ID NO: 1487395 - RNA, 20 nt, Pseudomonas aeruginosa PA01
gccgcgccuugcucaggucg

SEQ ID NO: 1487396 - RNA, 22 nt, Pseudomonas aeruginosa PA01
gccgcgccuuucgcucaggccu

SEQ ID NO: 1487397 - RNA, 12 nt, Pseudomonas aeruginosa PA01
gccgcgccugcu

SEQ ID NO: 1487398 - RNA, 14 nt, Pseudomonas aeruginosa PA01
gccgcgccugcugc

SEQ ID NO: 1487399 - RNA, 15 nt, Pseudomonas aeruginosa PA01
gccgcgccugcugcg

SEQ ID NO: 1487400 - RNA, 14 nt, Pseudomonas aeruginosa PA01
gccgcgccuucugc

SEQ ID NO: 1487401 - RNA, 16 nt, Pseudomonas aeruginosa PA01
gccgcgccucgucgcg

SEQ ID NO: 1487402 - RNA, 22 nt, Pseudomonas aeruginosa PA01
gccgcgccucgucgcgccaggc

SEQ ID NO: 1487403 - RNA, 15 nt, Pseudomonas aeruginosa PA01
gccgcgcgaccgcgg

SEQ ID NO: 1487404 - RNA, 18 nt, Pseudomonas aeruginosa PA01
gccgcgcgauggccggcg

SEQ ID NO: 1487405 - RNA, 19 nt, Pseudomonas aeruginosa PA01
gccgcgcgauggccggcgg

SEQ ID NO: 1487406 - RNA, 22 nt, Pseudomonas aeruginosa PA01
gccgcgcgcuggauuucgccga

SEQ ID NO: 1487407 - RNA, 14 nt, Pseudomonas aeruginosa PA01
gccgcgcgcgucga

SEQ ID NO: 1487408 - RNA, 17 nt, Pseudomonas aeruginosa PA01
gccgcgcgcgucgagcg

SEQ ID NO: 1487409 - RNA, 14 nt, Pseudomonas aeruginosa PA01
gccgcgcgccuggc

SEQ ID NO: 1487410 - RNA, 20 nt, Pseudomonas aeruginosa PA01
gccgcgcgccuggcuggcca

SEQ ID NO: 1487411 - RNA, 12 nt, Pseudomonas aeruginosa PA01
gccgcgcgccgc

SEQ ID NO: 1487412 - RNA, 15 nt, Pseudomonas aeruginosa PA01
gccgcgcgccgcauc

SEQ ID NO: 1487413 - RNA, 16 nt, Pseudomonas aeruginosa PA01
gccgcgcgccgcaucg

SEQ ID NO: 1487414 - RNA, 18 nt, Pseudomonas aeruginosa PA01
gccgcgcgccgcaucgcu

SEQ ID NO: 1487415 - RNA, 14 nt, Pseudomonas aeruginosa PA01
gccgcgcggcgccc

SEQ ID NO: 1487416 - RNA, 15 nt, Pseudomonas aeruginosa PA01
gccgcgcggcgcccc

SEQ ID NO: 1487417 - RNA, 18 nt, Pseudomonas aeruginosa PA01
gccgcgcggcgccccguc

SEQ ID NO: 1487418 - RNA, 20 nt, Pseudomonas aeruginosa PA01
gccgcgcggcuugccggcgc

SEQ ID NO: 1487419 - RNA, 23 nt, Pseudomonas aeruginosa PA01
gccgcgcggcuugccggcgcgcg

SEQ ID NO: 1487420 - RNA, 17 nt, Pseudomonas aeruginosa PA01
gccgcgcggucgagcuc

SEQ ID NO: 1487421 - RNA, 18 nt, Pseudomonas aeruginosa PA01
gccgcgcggucgagcucg

SEQ ID NO: 1487422 - RNA, 17 nt, Pseudomonas aeruginosa PA01
gccgcgcgggccggcga

SEQ ID NO: 1487423 - RNA, 18 nt, Pseudomonas aeruginosa PA01
gccgcgcgggccggcgau

SEQ ID NO: 1487424 - RNA, 21 nt, Pseudomonas aeruginosa PA01
gccgcgcguaggcuuggucgg

SEQ ID NO: 1487425 - RNA, 18 nt, Pseudomonas aeruginosa PA01
gccgcgcguucgcgcgag

SEQ ID NO: 1487426 - RNA, 23 nt, Pseudomonas aeruginosa PA01
gccgcgcguucgcgcgaggcgcu

SEQ ID NO: 1487427 - RNA, 20 nt, Pseudomonas aeruginosa PA01
gccgcgcguggcuucgucca

SEQ ID NO: 1487428 - RNA, 13 nt, Pseudomonas aeruginosa PA01
gccgcgcuccagu

SEQ ID NO: 1487429 - RNA, 14 nt, Pseudomonas aeruginosa PA01
gccgcgcuccaaca

SEQ ID NO: 1487430 - RNA, 15 nt, Pseudomonas aeruginosa PA01
gccgcgcuccaacag

SEQ ID NO: 1487431 - RNA, 17 nt, Pseudomonas aeruginosa PA01
gccgccgguucgcaggc

SEQ ID NO: 1487432 - RNA, 19 nt, Pseudomonas aeruginosa PA01
gccgccgguucgcaggcca

SEQ ID NO: 1487433 - RNA, 23 nt, Pseudomonas aeruginosa PA01
gccgccgguucgcaggccaggcg

SEQ ID NO: 1487434 - RNA, 14 nt, Pseudomonas aeruginosa PA01
gccgccgucgcggc

SEQ ID NO: 1487435 - RNA, 16 nt, Pseudomonas aeruginosa PA01
gccgccgucgcggcca

SEQ ID NO: 1487436 - RNA, 19 nt, Pseudomonas aeruginosa PA01
gccgccgucgcggccaucg

SEQ ID NO: 1487437 - RNA, 22 nt, Pseudomonas aeruginosa PA01
gccgccgucggacucgacguca

SEQ ID NO: 1487438 - RNA, 21 nt, Pseudomonas aeruginosa PA01
gccgccgucgacuugccgauc

SEQ ID NO: 1487439 - RNA, 15 nt, Pseudomonas aeruginosa PA01
gccgccguuguagcg

SEQ ID NO: 1487440 - RNA, 17 nt, Pseudomonas aeruginosa PA01
gccgccguugacgauca

SEQ ID NO: 1487441 - RNA, 15 nt, Pseudomonas aeruginosa PA01
gccgccgucuccgcc

SEQ ID NO: 1487442 - RNA, 18 nt, Pseudomonas aeruginosa PA01
gccgccgucuugccgcug

SEQ ID NO: 1487443 - RNA, 19 nt, Pseudomonas aeruginosa PA01
gccgccgucuugccgcugc

SEQ ID NO: 1487444 - RNA, 16 nt, Pseudomonas aeruginosa PA01
gccgccgugaucucga

SEQ ID NO: 1487445 - RNA, 21 nt, Pseudomonas aeruginosa PA01
gccgccguguaaugacuccgg

SEQ ID NO: 1487446 - RNA, 22 nt, Pseudomonas aeruginosa PA01
gccgccguguaaugacuccggu

SEQ ID NO: 1487447 - RNA, 13 nt, Pseudomonas aeruginosa PA01
gccgccgguagcc

SEQ ID NO: 1487448 - RNA, 19 nt, Pseudomonas aeruginosa PA01
gccgccggggcgcaggucg

SEQ ID NO: 1487449 - RNA, 21 nt, Pseudomonas aeruginosa PA01
gccgccggggcgcaggucgcu

SEQ ID NO: 1487450 - RNA, 16 nt, Pseudomonas aeruginosa PA01
gccgccggggcgggcc

SEQ ID NO: 1487451 - RNA, 18 nt, Pseudomonas aeruginosa PA01
gccgccggggcgggccgc

SEQ ID NO: 1487452 - RNA, 21 nt, Pseudomonas aeruginosa PA01
gccgccggggcgggccgcgcc

SEQ ID NO: 1487453 - RNA, 20 nt, Pseudomonas aeruginosa PA01
gccgccggggaucagcgaga

SEQ ID NO: 1487454 - RNA, 15 nt, Pseudomonas aeruginosa PA01
gccgccgggcgcgcg

SEQ ID NO: 1487455 - RNA, 18 nt, Pseudomonas aeruginosa PA01
gccgccggggaagcugcc

SEQ ID NO: 1487456 - RNA, 13 nt, Pseudomonas aeruginosa PA01
gccgccggugcac

SEQ ID NO: 1487457 - RNA, 19 nt, Pseudomonas aeruginosa PA01
gccgccggucuucacgccu

SEQ ID NO: 1487458 - RNA, 17 nt, Pseudomonas aeruginosa PA01
gccgccggugcaccagg

SEQ ID NO: 1487459 - RNA, 17 nt, Pseudomonas aeruginosa PA01
gccgccggcuccuugcg

SEQ ID NO: 1487460 - RNA, 20 nt, Pseudomonas aeruginosa PA01
gccgccgggaaucuggccga

SEQ ID NO: 1487461 - RNA, 20 nt, Pseudomonas aeruginosa PA01
gccgccggcguuauccgccg

SEQ ID NO: 1487462 - RNA, 20 nt, Pseudomonas aeruginosa PA01
gccgccgggcaucaugccga

SEQ ID NO: 1487463 - RNA, 23 nt, Pseudomonas aeruginosa PA01
gccgccgggcaucaugccgagca

SEQ ID NO: 1487464 - RNA, 13 nt, Pseudomonas aeruginosa PA01
gccgccggcgccc

SEQ ID NO: 1487465 - RNA, 14 nt, Pseudomonas aeruginosa PA01
gccgccggcgccgc

SEQ ID NO: 1487466 - RNA, 14 nt, Pseudomonas aeruginosa PA01
gccgccggcgcccu

SEQ ID NO: 1487467 - RNA, 18 nt, Pseudomonas aeruginosa PA01
gccgccggccaccagcag

SEQ ID NO: 1487468 - RNA, 12 nt, Pseudomonas aeruginosa PA01
gccgccggccag

SEQ ID NO: 1487469 - RNA, 15 nt, Pseudomonas aeruginosa PA01
gccgccggccagccg

SEQ ID NO: 1487470 - RNA, 19 nt, Pseudomonas aeruginosa PA01
gccgccggccagccgcgcc

SEQ ID NO: 1487471 - RNA, 12 nt, Pseudomonas aeruginosa PA01
gccgccggcgaa

SEQ ID NO: 1487472 - RNA, 13 nt, Pseudomonas aeruginosa PA01
gccgccggcgacc

SEQ ID NO: 1487473 - RNA, 15 nt, Pseudomonas aeruginosa PA01
gccgccggcgaccgc

SEQ ID NO: 1487474 - RNA, 18 nt, Pseudomonas aeruginosa PA01
gccgccggcgaggaucgc

SEQ ID NO: 1487475 - RNA, 16 nt, Pseudomonas aeruginosa PA01
gccgccgcggccagcc

SEQ ID NO: 1487476 - RNA, 12 nt, Pseudomonas aeruginosa PA01
gccgccgcggcc

SEQ ID NO: 1487477 - RNA, 13 nt, Pseudomonas aeruginosa PA01
gccgccgcgggca

SEQ ID NO: 1487478 - RNA, 19 nt, Pseudomonas aeruginosa PA01
gccgccgcgggcaaccgcg

SEQ ID NO: 1487479 - RNA, 14 nt, Pseudomonas aeruginosa PA01
gccgccgcgugggc

SEQ ID NO: 1487480 - RNA, 13 nt, Pseudomonas aeruginosa PA01
gccgccgcgugcc

SEQ ID NO: 1487481 - RNA, 21 nt, Pseudomonas aeruginosa PA01
gccgccgcgggcgaacggcag

SEQ ID NO: 1487482 - RNA, 13 nt, Pseudomonas aeruginosa PA01
gccgccgcuggcc

SEQ ID NO: 1487483 - RNA, 14 nt, Pseudomonas aeruginosa PA01
gccgccgcuggccu

SEQ ID NO: 1487484 - RNA, 15 nt, Pseudomonas aeruginosa PA01
gccgccgcuggccug

SEQ ID NO: 1487485 - RNA, 18 nt, Pseudomonas aeruginosa PA01
gccgccgcuggccuggcc

SEQ ID NO: 1487486 - RNA, 19 nt, Pseudomonas aeruginosa PA01
gccgccgcuggccuggcca

SEQ ID NO: 1487487 - RNA, 14 nt, Pseudomonas aeruginosa PA01
gccgccgcuggcga

SEQ ID NO: 1487488 - RNA, 21 nt, Pseudomonas aeruginosa PA01
gccgccggagagcgaauacac

SEQ ID NO: 1487489 - RNA, 19 nt, Pseudomonas aeruginosa PA01
gccgccgagugugccggcc

SEQ ID NO: 1487490 - RNA, 22 nt, Pseudomonas aeruginosa PA01
gccgccgagugugccggccaug

SEQ ID NO: 1487491 - RNA, 20 nt, Pseudomonas aeruginosa PA01
gccgccgaugcuguucagca

SEQ ID NO: 1487492 - RNA, 15 nt, Pseudomonas aeruginosa PA01
gccgccgccccagca

SEQ ID NO: 1487493 - RNA, 17 nt, Pseudomonas aeruginosa PA01
gccgccgccccagcaac

SEQ ID NO: 1487494 - RNA, 19 nt, Pseudomonas aeruginosa PA01
gccgccgcccagcagcacc

SEQ ID NO: 1487495 - RNA, 15 nt, Pseudomonas aeruginosa PA01
gccgccgccgcccca

SEQ ID NO: 1487496 - RNA, 13 nt, Pseudomonas aeruginosa PA01
gccgccgccgaga

SEQ ID NO: 1487497 - RNA, 11 nt, Pseudomonas aeruginosa PA01
gccgccgccga

SEQ ID NO: 1487498 - RNA, 13 nt, Pseudomonas aeruginosa PA01
gccgccgccugcu

SEQ ID NO: 1487499 - RNA, 21 nt, Pseudomonas aeruginosa PA01
gccgccgccugcucgccgcug

SEQ ID NO: 1487500 - RNA, 17 nt, Pseudomonas aeruginosa PA01
gccgccgcggcaccggc

SEQ ID NO: 1487501 - RNA, 14 nt, Pseudomonas aeruginosa PA01
gccgccgccgccgu

SEQ ID NO: 1487502 - RNA, 17 nt, Pseudomonas aeruginosa PA01
gccgccgccgccgucga

SEQ ID NO: 1487503 - RNA, 16 nt, Pseudomonas aeruginosa PA01
gccgccgccggaggga

SEQ ID NO: 1487504 - RNA, 15 nt, Pseudomonas aeruginosa PA01
gccgccgccgcgccg

SEQ ID NO: 1487505 - RNA, 12 nt, Pseudomonas aeruginosa PA01
gccgccgagggc

SEQ ID NO: 1487506 - RNA, 16 nt, Pseudomonas aeruginosa PA01
gccgccgagggcaccg

SEQ ID NO: 1487507 - RNA, 15 nt, Pseudomonas aeruginosa PA01
gccgccgaucagcgc

SEQ ID NO: 1487508 - RNA, 17 nt, Pseudomonas aeruginosa PA01
gccgccgauccaggaac

SEQ ID NO: 1487509 - RNA, 23 nt, Pseudomonas aeruginosa PA01
gccgccgauccaggaaccggcca

SEQ ID NO: 1487510 - RNA, 15 nt, Pseudomonas aeruginosa PA01
gccgccgaugccgac

SEQ ID NO: 1487511 - RNA, 21 nt, Pseudomonas aeruginosa PA01
gccgccgaggauagcguccag

SEQ ID NO: 1487512 - RNA, 15 nt, Pseudomonas aeruginosa PA01
gccgccgaggcgcgc

SEQ ID NO: 1487513 - RNA, 19 nt, Pseudomonas aeruginosa PA01
gccgccgaggcgcgccacg

SEQ ID NO: 1487514 - RNA, 21 nt, Pseudomonas aeruginosa PA01
gccgccgaggcgcgccacgca

SEQ ID NO: 1487515 - RNA, 14 nt, Pseudomonas aeruginosa PA01
gccgccgaggugcg

SEQ ID NO: 1487516 - RNA, 15 nt, Pseudomonas aeruginosa PA01
gccgccgaggugcgg

SEQ ID NO: 1487517 - RNA, 21 nt, Pseudomonas aeruginosa PA01
gccgccgaggugcggcuugcg

SEQ ID NO: 1487518 - RNA, 18 nt, Pseudomonas aeruginosa PA01
gccgccgaguacacaaug

SEQ ID NO: 1487519 - RNA, 14 nt, Pseudomonas aeruginosa PA01
gccgccacggcggu

SEQ ID NO: 1487520 - RNA, 12 nt, Pseudomonas aeruginosa PA01
gccgccagcaac

SEQ ID NO: 1487521 - RNA, 13 nt, Pseudomonas aeruginosa PA01
gccgccagcaaca

SEQ ID NO: 1487522 - RNA, 14 nt, Pseudomonas aeruginosa PA01
gccgccagcaacgg

SEQ ID NO: 1487523 - RNA, 19 nt, Pseudomonas aeruginosa PA01
gccgccagaguucgagcug

SEQ ID NO: 1487524 - RNA, 23 nt, Pseudomonas aeruginosa PA01
gccgccagaaagccucaggcgcu

SEQ ID NO: 1487525 - RNA, 22 nt, Pseudomonas aeruginosa PA01
gccgcgcagcacuuccugaagg

SEQ ID NO: 1487526 - RNA, 14 nt, Pseudomonas aeruginosa PA01
gccgcgcagcagua

SEQ ID NO: 1487527 - RNA, 22 nt, Pseudomonas aeruginosa PA01
gccgcgcagcaguaccuggcgg

SEQ ID NO: 1487528 - RNA, 23 nt, Pseudomonas aeruginosa PA01
gccgcgcagcaguaccuggcggu

SEQ ID NO: 1487529 - RNA, 22 nt, Pseudomonas aeruginosa PA01
gccgcgcaugaaaaagccgccc

SEQ ID NO: 1487530 - RNA, 15 nt, Pseudomonas aeruginosa PA01
gccgcgcagguucau

SEQ ID NO: 1487531 - RNA, 20 nt, Pseudomonas aeruginosa PA01
gccgcgcagguucaucgccg

SEQ ID NO: 1487532 - RNA, 16 nt, Pseudomonas aeruginosa PA01
gccgcgcagucccgcg

SEQ ID NO: 1487533 - RNA, 22 nt, Pseudomonas aeruginosa PA01
gccgcgccagcaggcgcagcag

SEQ ID NO: 1487534 - RNA, 17 nt, Pseudomonas aeruginosa PA01
gccgcgccaacuggcgc

SEQ ID NO: 1487535 - RNA, 19 nt, Pseudomonas aeruginosa PA01
gccgcgcauccucggcauc

SEQ ID NO: 1487536 - RNA, 14 nt, Pseudomonas aeruginosa PA01
gccgcgccagugcc

SEQ ID NO: 1487537 - RNA, 15 nt, Pseudomonas aeruginosa PA01
gccgcgccagugccu

SEQ ID NO: 1487538 - RNA, 23 nt, Pseudomonas aeruginosa PA01
gccgcgccagugccugcaccacg

SEQ ID NO: 1487539 - RNA, 12 nt, Pseudomonas aeruginosa PA01
gccgcgccaggu

SEQ ID NO: 1487540 - RNA, 13 nt, Pseudomonas aeruginosa PA01
gccgcgccaggcg

SEQ ID NO: 1487541 - RNA, 17 nt, Pseudomonas aeruginosa PA01
gccgcgccccacggcgc

SEQ ID NO: 1487542 - RNA, 16 nt, Pseudomonas aeruginosa PA01
gccgcgccccagcggc

SEQ ID NO: 1487543 - RNA, 13 nt, Pseudomonas aeruginosa PA01
gccgcgcccggcg

SEQ ID NO: 1487544 - RNA, 14 nt, Pseudomonas aeruginosa PA01
gccgcgcccggccu

SEQ ID NO: 1487545 - RNA, 15 nt, Pseudomonas aeruginosa PA01
gccgcgcccggccuc

SEQ ID NO: 1487546 - RNA, 15 nt, Pseudomonas aeruginosa PA01
gccgcgcccggccuu

SEQ ID NO: 1487547 - RNA, 22 nt, Pseudomonas aeruginosa PA01
gccgcgcccggccuucaccgcg

SEQ ID NO: 1487548 - RNA, 15 nt, Pseudomonas aeruginosa PA01
gccgcgcccggccag

SEQ ID NO: 1487549 - RNA, 16 nt, Pseudomonas aeruginosa PA01
gccgcgcccggccagg

SEQ ID NO: 1487550 - RNA, 13 nt, Pseudomonas aeruginosa PA01
gccgcgcaccagc

SEQ ID NO: 1487551 - RNA, 14 nt, Pseudomonas aeruginosa PA01
gccgcgcaccagca

SEQ ID NO: 1487552 - RNA, 20 nt, Pseudomonas aeruginosa PA01
gccgcgcaccucgaccgcgc

SEQ ID NO: 1487553 - RNA, 23 nt, Pseudomonas aeruginosa PA01
gccgcgcaccucgaccgcgccgg

SEQ ID NO: 1487554 - RNA, 17 nt, Pseudomonas aeruginosa PA01
gccgcgcaccugggcgu

SEQ ID NO: 1487555 - RNA, 23 nt, Pseudomonas aeruginosa PA01
gccgcgcaccugggcguuggcca

SEQ ID NO: 1487556 - RNA, 15 nt, Pseudomonas aeruginosa PA01
gccgcgcaccugggc

SEQ ID NO: 1487557 - RNA, 14 nt, Pseudomonas aeruginosa PA01
gccgcgcaccuggg

SEQ ID NO: 1487558 - RNA, 18 nt, Pseudomonas aeruginosa PA01
gccgcgcaagcucgucac

SEQ ID NO: 1487559 - RNA, 22 nt, Pseudomonas aeruginosa PA01
gccgcgcaaggcagcguccgaa

SEQ ID NO: 1487560 - RNA, 14 nt, Pseudomonas aeruginosa PA01
gccgcgauggcucg

SEQ ID NO: 1487561 - RNA, 18 nt, Pseudomonas aeruginosa PA01
gccgcgauggcucgcggc

SEQ ID NO: 1487562 - RNA, 21 nt, Pseudomonas aeruginosa PA01
gccgcgcacaaaaaagcccgc

SEQ ID NO: 1487563 - RNA, 12 nt, Pseudomonas aeruginosa PA01
gccgcgcaaccg

SEQ ID NO: 1487564 - RNA, 22 nt, Pseudomonas aeruginosa PA01
gccgcgcaaccguuccagcgcc

SEQ ID NO: 1487565 - RNA, 23 nt, Pseudomonas aeruginosa PA01
gccgcgcaaccguuccagcgccu

SEQ ID NO: 1487566 - RNA, 15 nt, Pseudomonas aeruginosa PA01
gccgcgagcgccgcc

SEQ ID NO: 1487567 - RNA, 16 nt, Pseudomonas aeruginosa PA01
gccgcgagcgccgccg

SEQ ID NO: 1487568 - RNA, 17 nt, Pseudomonas aeruginosa PA01
gccgcgagcgccgccgg

SEQ ID NO: 1487569 - RNA, 13 nt, Pseudomonas aeruginosa PA01
gccgcgagcgcgg

SEQ ID NO: 1487570 - RNA, 14 nt, Pseudomonas aeruginosa PA01
gccgcgagcgcggc

SEQ ID NO: 1487571 - RNA, 19 nt, Pseudomonas aeruginosa PA01
gccgcgagcgcggccggcc

SEQ ID NO: 1487572 - RNA, 15 nt, Pseudomonas aeruginosa PA01
gccgcgagcuuggcc

SEQ ID NO: 1487573 - RNA, 19 nt, Pseudomonas aeruginosa PA01
gccgcgagcuuggcccugg

SEQ ID NO: 1487574 - RNA, 21 nt, Pseudomonas aeruginosa PA01
gccgcgagcuuggcccuggcc

SEQ ID NO: 1487575 - RNA, 23 nt, Pseudomonas aeruginosa PA01
gccgcgagcuuggcccuggccuu

SEQ ID NO: 1487576 - RNA, 15 nt, Pseudomonas aeruginosa PA01
gccgcgagcaccaug

SEQ ID NO: 1487577 - RNA, 15 nt, Pseudomonas aeruginosa PA01
gccgcgagccagccg

SEQ ID NO: 1487578 - RNA, 19 nt, Pseudomonas aeruginosa PA01
gccgcgagccagccguggc

SEQ ID NO: 1487579 - RNA, 19 nt, Pseudomonas aeruginosa PA01
gccgcgaguccuucggcgc

SEQ ID NO: 1487580 - RNA, 20 nt, Pseudomonas aeruginosa PA01
gccgcgaguccuucggcgca

SEQ ID NO: 1487581 - RNA, 21 nt, Pseudomonas aeruginosa PA01
gccgcgaggggaacauugcca

SEQ ID NO: 1487582 - RNA, 20 nt, Pseudomonas aeruginosa PA01
gccgcgagguccggcuccgg

SEQ ID NO: 1487583 - RNA, 16 nt, Pseudomonas aeruginosa PA01
gccgcgauauucgccc

SEQ ID NO: 1487584 - RNA, 20 nt, Pseudomonas aeruginosa PA01
gccgcgaccgaagccgcgca

SEQ ID NO: 1487585 - RNA, 13 nt, Pseudomonas aeruginosa PA01
gccgcgaccgggc

SEQ ID NO: 1487586 - RNA, 22 nt, Pseudomonas aeruginosa PA01
gccgcgaccgggcaugccgugg

SEQ ID NO: 1487587 - RNA, 13 nt, Pseudomonas aeruginosa PA01
gccgcgaccugcu

SEQ ID NO: 1487588 - RNA, 16 nt, Pseudomonas aeruginosa PA01
gccgcgaccugcucgu

SEQ ID NO: 1487589 - RNA, 17 nt, Pseudomonas aeruginosa PA01
gccgcgaccugcucguc

SEQ ID NO: 1487590 - RNA, 18 nt, Pseudomonas aeruginosa PA01
gccgcgaccugcucgucg

SEQ ID NO: 1487591 - RNA, 20 nt, Pseudomonas aeruginosa PA01
gccgcgaccugcucgucgau

SEQ ID NO: 1487592 - RNA, 21 nt, Pseudomonas aeruginosa PA01
gccgcgacaggauggacagcu

SEQ ID NO: 1487593 - RNA, 14 nt, Pseudomonas aeruginosa PA01
gccgcgacgcgacc

SEQ ID NO: 1487594 - RNA, 21 nt, Pseudomonas aeruginosa PA01
gccgcgacgcgaccuccggcg

SEQ ID NO: 1487595 - RNA, 14 nt, Pseudomonas aeruginosa PA01
gccgcgacgacugc

SEQ ID NO: 1487596 - RNA, 20 nt, Pseudomonas aeruginosa PA01
gccgcgacgacugcggcagc

SEQ ID NO: 1487597 - RNA, 15 nt, Pseudomonas aeruginosa PA01
gccgcgacucggcug

SEQ ID NO: 1487598 - RNA, 16 nt, Pseudomonas aeruginosa PA01
gccgcgacucggcugc

SEQ ID NO: 1487599 - RNA, 19 nt, Pseudomonas aeruginosa PA01
gccgcgacgcuccagcggc

SEQ ID NO: 1487600 - RNA, 22 nt, Pseudomonas aeruginosa PA01
gccgcgacgcuccagcggcagc

SEQ ID NO: 1487601 - RNA, 18 nt, Pseudomonas aeruginosa PA01
gccgcgaagcccagcgcc

SEQ ID NO: 1487602 - RNA, 19 nt, Pseudomonas aeruginosa PA01
gccgcgaacacacccugcg

SEQ ID NO: 1487603 - RNA, 15 nt, Pseudomonas aeruginosa PA01
gccgcgaaccggguc

SEQ ID NO: 1487604 - RNA, 17 nt, Pseudomonas aeruginosa PA01
gccgcgaaccgggucgu

SEQ ID NO: 1487605 - RNA, 16 nt, Pseudomonas aeruginosa PA01
gccgccuugagcggcg

SEQ ID NO: 1487606 - RNA, 20 nt, Pseudomonas aeruginosa PA01
gccgccuugagcggcgcccu

SEQ ID NO: 1487607 - RNA, 18 nt, Pseudomonas aeruginosa PA01
gccgccuugcucgacccg

SEQ ID NO: 1487608 - RNA, 19 nt, Pseudomonas aeruginosa PA01
gccgccuuguuccaggcgu

SEQ ID NO: 1487609 - RNA, 20 nt, Pseudomonas aeruginosa PA01
gccgccuugaccugcugggc

SEQ ID NO: 1487610 - RNA, 19 nt, Pseudomonas aeruginosa PA01
gccgccugcggcuugcccu

SEQ ID NO: 1487611 - RNA, 16 nt, Pseudomonas aeruginosa PA01
gccgccugcgccucgg

SEQ ID NO: 1487612 - RNA, 16 nt, Pseudomonas aeruginosa PA01
gccgccugcucggccu

SEQ ID NO: 1487613 - RNA, 17 nt, Pseudomonas aeruginosa PA01
gccgccugcucggccug

SEQ ID NO: 1487614 - RNA, 18 nt, Pseudomonas aeruginosa PA01
gccgccugcucggccugc

SEQ ID NO: 1487615 - RNA, 19 nt, Pseudomonas aeruginosa PA01
gccgccugcuggcugccca

SEQ ID NO: 1487616 - RNA, 12 nt, Pseudomonas aeruginosa PA01
gccgccuggcgc

SEQ ID NO: 1487617 - RNA, 15 nt, Pseudomonas aeruginosa PA01
gccgccuggccggcc

SEQ ID NO: 1487618 - RNA, 16 nt, Pseudomonas aeruginosa PA01
gccgccuggccggcca

SEQ ID NO: 1487619 - RNA, 17 nt, Pseudomonas aeruginosa PA01
gccgccuggccggccag

SEQ ID NO: 1487620 - RNA, 21 nt, Pseudomonas aeruginosa PA01
gccgccuggccggccagccag

SEQ ID NO: 1487621 - RNA, 15 nt, Pseudomonas aeruginosa PA01
gccgccuggguggcg

SEQ ID NO: 1487622 - RNA, 21 nt, Pseudomonas aeruginosa PA01
gccgccuggguggcgacgaag

SEQ ID NO: 1487623 - RNA, 18 nt, Pseudomonas aeruginosa PA01
gccgccuggcgugccgcc

SEQ ID NO: 1487624 - RNA, 19 nt, Pseudomonas aeruginosa PA01
gccgccuggcgugccgcca

SEQ ID NO: 1487625 - RNA, 21 nt, Pseudomonas aeruginosa PA01
gccgccuggcgugccgccagg

SEQ ID NO: 1487626 - RNA, 16 nt, Pseudomonas aeruginosa PA01
gccgccuucgcgggcc

SEQ ID NO: 1487627 - RNA, 21 nt, Pseudomonas aeruginosa PA01
gccgccuucgcgggccaggcc

SEQ ID NO: 1487628 - RNA, 14 nt, Pseudomonas aeruginosa PA01
gccgccucgaaggc

SEQ ID NO: 1487629 - RNA, 13 nt, Pseudomonas aeruginosa PA01
gccgccuucggca

SEQ ID NO: 1487630 - RNA, 14 nt, Pseudomonas aeruginosa PA01
gccgccuucggcag

SEQ ID NO: 1487631 - RNA, 16 nt, Pseudomonas aeruginosa PA01
gccgccuggucggggc

SEQ ID NO: 1487632 - RNA, 20 nt, Pseudomonas aeruginosa PA01
gccgccuggugcccgaugcc

SEQ ID NO: 1487633 - RNA, 22 nt, Pseudomonas aeruginosa PA01
gccgccuggugcccgaugccgc

SEQ ID NO: 1487634 - RNA, 14 nt, Pseudomonas aeruginosa PA01
gccgccuuccucgg

SEQ ID NO: 1487635 - RNA, 15 nt, Pseudomonas aeruginosa PA01
gccgccuuccucggc

SEQ ID NO: 1487636 - RNA, 16 nt, Pseudomonas aeruginosa PA01
gccgccuuccucggcc

SEQ ID NO: 1487637 - RNA, 18 nt, Pseudomonas aeruginosa PA01
gccgccuuccucggccgc

SEQ ID NO: 1487638 - RNA, 20 nt, Pseudomonas aeruginosa PA01
gccgccuuccucggccgcca

SEQ ID NO: 1487639 - RNA, 23 nt, Pseudomonas aeruginosa PA01
gccgccuuccucggccgccaggc

SEQ ID NO: 1487640 - RNA, 20 nt, Pseudomonas aeruginosa PA01
gccgccuauccacgacgucg

SEQ ID NO: 1487641 - RNA, 21 nt, Pseudomonas aeruginosa PA01
gccgccuauccacgacgucgg

SEQ ID NO: 1487642 - RNA, 21 nt, Pseudomonas aeruginosa PA01
gccgccugccuuccuugacca

SEQ ID NO: 1487643 - RNA, 12 nt, Pseudomonas aeruginosa PA01
gccgccugcgcc

SEQ ID NO: 1487644 - RNA, 21 nt, Pseudomonas aeruginosa PA01
gccgccucuaugaaccggggc

SEQ ID NO: 1487645 - RNA, 19 nt, Pseudomonas aeruginosa PA01
gccgccucgggcagccccu

SEQ ID NO: 1487646 - RNA, 18 nt, Pseudomonas aeruginosa PA01
gccgccucgauggcggca

SEQ ID NO: 1487647 - RNA, 15 nt, Pseudomonas aeruginosa PA01
gccgccucgcugggc

SEQ ID NO: 1487648 - RNA, 23 nt, Pseudomonas aeruginosa PA01
gccgccucgcgcaacgccuugcc

SEQ ID NO: 1487649 - RNA, 18 nt, Pseudomonas aeruginosa PA01
gccgccucgcgccgcgcc

SEQ ID NO: 1487650 - RNA, 19 nt, Pseudomonas aeruginosa PA01
gccgccucgcgccgcgcca

SEQ ID NO: 1487651 - RNA, 21 nt, Pseudomonas aeruginosa PA01
gccgccucgcgccgcgccagc

SEQ ID NO: 1487652 - RNA, 15 nt, Pseudomonas aeruginosa PA01
gcccuuguucgcggc

SEQ ID NO: 1487653 - RNA, 20 nt, Pseudomonas aeruginosa PA01
gcccuuguucgggucgcggc

SEQ ID NO: 1487654 - RNA, 19 nt, Pseudomonas aeruginosa PA01
gcccuuuuccaccggccgc

SEQ ID NO: 1487655 - RNA, 21 nt, Pseudomonas aeruginosa PA01
gcccuuuuccuccagggugcc

SEQ ID NO: 1487656 - RNA, 18 nt, Pseudomonas aeruginosa PA01
gccgaaaaauucagcgca

SEQ ID NO: 1487657 - RNA, 21 nt, Pseudomonas aeruginosa PA01
gccgaaaaauucagcgcagcg

SEQ ID NO: 1487658 - RNA, 16 nt, Pseudomonas aeruginosa PA01
gccgaacagacgcagg

SEQ ID NO: 1487659 - RNA, 19 nt, Pseudomonas aeruginosa PA01
gccgaacagacgcaggcag

SEQ ID NO: 1487660 - RNA, 22 nt, Pseudomonas aeruginosa PA01
gccgaacagacgcaggcagguc

SEQ ID NO: 1487661 - RNA, 21 nt, Pseudomonas aeruginosa PA01
gccgaacagcaacaccgcgca

SEQ ID NO: 1487662 - RNA, 22 nt, Pseudomonas aeruginosa PA01
gccgaacagcaacaccgcgcag

SEQ ID NO: 1487663 - RNA, 23 nt, Pseudomonas aeruginosa PA01
gccgaacagcaacaccgcgcaga

SEQ ID NO: 1487664 - RNA, 13 nt, Pseudomonas aeruginosa PA01
gccgaacaccugc

SEQ ID NO: 1487665 - RNA, 17 nt, Pseudomonas aeruginosa PA01
gccgaacaccugcauca

SEQ ID NO: 1487666 - RNA, 23 nt, Pseudomonas aeruginosa PA01
gccgaacaccugcaucaccaggc

SEQ ID NO: 1487667 - RNA, 15 nt, Pseudomonas aeruginosa PA01
gccgaacagccgccc

SEQ ID NO: 1487668 - RNA, 16 nt, Pseudomonas aeruginosa PA01
gccgaacagccgcccc

SEQ ID NO: 1487669 - RNA, 23 nt, Pseudomonas aeruginosa PA01
gccgaacagccgccccaccacca

SEQ ID NO: 1487670 - RNA, 11 nt, Pseudomonas aeruginosa PA01
gcccuugccgg

SEQ ID NO: 1487671 - RNA, 13 nt, Pseudomonas aeruginosa PA01
gcccuugccggga

SEQ ID NO: 1487672 - RNA, 14 nt, Pseudomonas aeruginosa PA01
gcccuucuccgcca

SEQ ID NO: 1487673 - RNA, 22 nt, Pseudomonas aeruginosa PA01
gcccuugacccgguacagcgcc

SEQ ID NO: 1487674 - RNA, 18 nt, Pseudomonas aeruginosa PA01
gcccuugagggccucggc

SEQ ID NO: 1487675 - RNA, 20 nt, Pseudomonas aeruginosa PA01
gcccuugagggccucggcga

SEQ ID NO: 1487676 - RNA, 20 nt, Pseudomonas aeruginosa PA01
gcccuugacguucaggcugu

SEQ ID NO: 1487677 - RNA, 19 nt, Pseudomonas aeruginosa PA01
gcccuuguccggcccggag

SEQ ID NO: 1487678 - RNA, 18 nt, Pseudomonas aeruginosa PA01
gcccuuguacagcuucag

SEQ ID NO: 1487679 - RNA, 16 nt, Pseudomonas aeruginosa PA01
gcccuuggucaggccg

SEQ ID NO: 1487680 - RNA, 17 nt, Pseudomonas aeruginosa PA01
gcccuuggucaggccga

SEQ ID NO: 1487681 - RNA, 18 nt, Pseudomonas aeruginosa PA01
gcccuuggucaggccgac

SEQ ID NO: 1487682 - RNA, 20 nt, Pseudomonas aeruginosa PA01
gcccuugucgccgcugggca

SEQ ID NO: 1487683 - RNA, 22 nt, Pseudomonas aeruginosa PA01
gcccuugugaaagggcggcagc

SEQ ID NO: 1487684 - RNA, 21 nt, Pseudomonas aeruginosa PA01
gcccuugcggcccgccucggc

SEQ ID NO: 1487685 - RNA, 17 nt, Pseudomonas aeruginosa PA01
gcccuugcgccgcgguu

SEQ ID NO: 1487686 - RNA, 17 nt, Pseudomonas aeruginosa PA01
gcccuugcucgcggcgu

SEQ ID NO: 1487687 - RNA, 13 nt, Pseudomonas aeruginosa PA01
gcccuuggccagc

SEQ ID NO: 1487688 - RNA, 16 nt, Pseudomonas aeruginosa PA01
gcccuuggcggcgcca

SEQ ID NO: 1487689 - RNA, 21 nt, Pseudomonas aeruginosa PA01
gcccuuggcuuccuggcgccg

SEQ ID NO: 1487690 - RNA, 16 nt, Pseudomonas aeruginosa PA01
gcccuugggaccgggc

SEQ ID NO: 1487691 - RNA, 16 nt, Pseudomonas aeruginosa PA01
gccgaaguucuucagc

SEQ ID NO: 1487692 - RNA, 12 nt, Pseudomonas aeruginosa PA01
gccgaagucggc

SEQ ID NO: 1487693 - RNA, 17 nt, Pseudomonas aeruginosa PA01
gccgaagucggcgagcc

SEQ ID NO: 1487694 - RNA, 20 nt, Pseudomonas aeruginosa PA01
gccgaagucggcgagccggc

SEQ ID NO: 1487695 - RNA, 22 nt, Pseudomonas aeruginosa PA01
gccgaagucggcgagccggcgc

SEQ ID NO: 1487696 - RNA, 17 nt, Pseudomonas aeruginosa PA01
gccgaaggucaaugcca

SEQ ID NO: 1487697 - RNA, 17 nt, Pseudomonas aeruginosa PA01
gccgaaggugcaggccg

SEQ ID NO: 1487698 - RNA, 15 nt, Pseudomonas aeruginosa PA01
gccgaaggcgucagu

SEQ ID NO: 1487699 - RNA, 19 nt, Pseudomonas aeruginosa PA01
gccgaaggcgucauccgcc

SEQ ID NO: 1487700 - RNA, 23 nt, Pseudomonas aeruginosa PA01
gccgaaggcgucauccgccaacc

SEQ ID NO: 1487701 - RNA, 23 nt, Pseudomonas aeruginosa PA01
gccgaaggcgugggcgccggcgc

SEQ ID NO: 1487702 - RNA, 21 nt, Pseudomonas aeruginosa PA01
gccgaagggaaacaccaggcc

SEQ ID NO: 1487703 - RNA, 23 nt, Pseudomonas aeruginosa PA01
gccgaagggaaacaccaggccga

SEQ ID NO: 1487704 - RNA, 15 nt, Pseudomonas aeruginosa PA01
gccgaaggacaggcc

SEQ ID NO: 1487705 - RNA, 16 nt, Pseudomonas aeruginosa PA01
gccgaaggacaggccg

SEQ ID NO: 1487706 - RNA, 14 nt, Pseudomonas aeruginosa PA01
gccgaaggccaggc

SEQ ID NO: 1487707 - RNA, 17 nt, Pseudomonas aeruginosa PA01
gccgaaggccaggccgg

SEQ ID NO: 1487708 - RNA, 22 nt, Pseudomonas aeruginosa PA01
gccgaaggccaggccggcgccu

SEQ ID NO: 1487709 - RNA, 15 nt, Pseudomonas aeruginosa PA01
gccgaaggccuggcc

SEQ ID NO: 1487710 - RNA, 17 nt, Pseudomonas aeruginosa PA01
gccgaaggccuggccgu

SEQ ID NO: 1487711 - RNA, 17 nt, Pseudomonas aeruginosa PA01
gccgacacccgcgccgc

SEQ ID NO: 1487712 - RNA, 18 nt, Pseudomonas aeruginosa PA01
gccgacacccgcgccgcc

SEQ ID NO: 1487713 - RNA, 19 nt, Pseudomonas aeruginosa PA01
gccgacacccgcgccgccg

SEQ ID NO: 1487714 - RNA, 18 nt, Pseudomonas aeruginosa PA01
gccgaauccaggccgacg

SEQ ID NO: 1487715 - RNA, 20 nt, Pseudomonas aeruginosa PA01
gccgaacagcagggaggcgc

SEQ ID NO: 1487716 - RNA, 15 nt, Pseudomonas aeruginosa PA01
gccgaacucuggcgg

SEQ ID NO: 1487717 - RNA, 17 nt, Pseudomonas aeruginosa PA01
gccgaacucuggcggcg

SEQ ID NO: 1487718 - RNA, 12 nt, Pseudomonas aeruginosa PA01
gccgaacugcag

SEQ ID NO: 1487719 - RNA, 14 nt, Pseudomonas aeruginosa PA01
gccgaacugcaggg

SEQ ID NO: 1487720 - RNA, 16 nt, Pseudomonas aeruginosa PA01
gccgaacugcagggcg

SEQ ID NO: 1487721 - RNA, 22 nt, Pseudomonas aeruginosa PA01
gccgaacuccggugucaggccg

SEQ ID NO: 1487722 - RNA, 24 nt, Pseudomonas aeruginosa PA01
gccgaacagggcgagcagggcgcu

SEQ ID NO: 1487723 - RNA, 19 nt, Pseudomonas aeruginosa PA01
gccgaacaggguugggcga

SEQ ID NO: 1487724 - RNA, 20 nt, Pseudomonas aeruginosa PA01
gccgaacuccgccagcacca

SEQ ID NO: 1487725 - RNA, 23 nt, Pseudomonas aeruginosa PA01
gccgaagaggcccucggcgccga

SEQ ID NO: 1487726 - RNA, 19 nt, Pseudomonas aeruginosa PA01
gccgaagauacccagcggg

SEQ ID NO: 1487727 - RNA, 12 nt, Pseudomonas aeruginosa PA01
gccgaagacgcc

SEQ ID NO: 1487728 - RNA, 14 nt, Pseudomonas aeruginosa PA01
gccgaagacgccug

SEQ ID NO: 1487729 - RNA, 18 nt, Pseudomonas aeruginosa PA01
gccgaagacgccugucgg

SEQ ID NO: 1487730 - RNA, 21 nt, Pseudomonas aeruginosa PA01
gccgaaaaaaaggggcccgaa

SEQ ID NO: 1487731 - RNA, 19 nt, Pseudomonas aeruginosa PA01
gccgaagaacaccacgcgg

SEQ ID NO: 1487732 - RNA, 15 nt, Pseudomonas aeruginosa PA01
gccgaacuucuccgc

SEQ ID NO: 1487733 - RNA, 16 nt, Pseudomonas aeruginosa PA01
gccgaacuucuccgcc

SEQ ID NO: 1487734 - RNA, 18 nt, Pseudomonas aeruginosa PA01
gccgaccgcgcgccugca

SEQ ID NO: 1487735 - RNA, 16 nt, Pseudomonas aeruginosa PA01
gccgaccuucaccacc

SEQ ID NO: 1487736 - RNA, 17 nt, Pseudomonas aeruginosa PA01
gccgaccuucaccacca

SEQ ID NO: 1487737 - RNA, 18 nt, Pseudomonas aeruginosa PA01
gccgaccuucaccaccag

SEQ ID NO: 1487738 - RNA, 19 nt, Pseudomonas aeruginosa PA01
gccgaccuucaccaccagc

SEQ ID NO: 1487739 - RNA, 14 nt, Pseudomonas aeruginosa PA01
gccgaccggcgccg

SEQ ID NO: 1487740 - RNA, 16 nt, Pseudomonas aeruginosa PA01
gccgaccggcgccggg

SEQ ID NO: 1487741 - RNA, 12 nt, Pseudomonas aeruginosa PA01
gccgaccgggcg

SEQ ID NO: 1487742 - RNA, 18 nt, Pseudomonas aeruginosa PA01
gccgaccuuguccacguc

SEQ ID NO: 1487743 - RNA, 23 nt, Pseudomonas aeruginosa PA01
gccgacgagcagcucgccggcgu

SEQ ID NO: 1487744 - RNA, 12 nt, Pseudomonas aeruginosa PA01
gccgacgaaggc

SEQ ID NO: 1487745 - RNA, 15 nt, Pseudomonas aeruginosa PA01
gccgacgaaggccgc

SEQ ID NO: 1487746 - RNA, 19 nt, Pseudomonas aeruginosa PA01
gccgacgaaggccgcgguc

SEQ ID NO: 1487747 - RNA, 13 nt, Pseudomonas aeruginosa PA01
gccgacgaaggcg

SEQ ID NO: 1487748 - RNA, 15 nt, Pseudomonas aeruginosa PA01
gccgacgaaggcgag

SEQ ID NO: 1487749 - RNA, 16 nt, Pseudomonas aeruginosa PA01
gccgaccuguaccgcu

SEQ ID NO: 1487750 - RNA, 17 nt, Pseudomonas aeruginosa PA01
gccgaccuguaccgcuc

SEQ ID NO: 1487751 - RNA, 14 nt, Pseudomonas aeruginosa PA01
gccgaccuugccgg

SEQ ID NO: 1487752 - RNA, 20 nt, Pseudomonas aeruginosa PA01
gccgaccuugcgucuucgcc

SEQ ID NO: 1487753 - RNA, 22 nt, Pseudomonas aeruginosa PA01
gccgaccuugcgucuucgccga

SEQ ID NO: 1487754 - RNA, 14 nt, Pseudomonas aeruginosa PA01
gccgacgaacagcc

SEQ ID NO: 1487755 - RNA, 16 nt, Pseudomonas aeruginosa PA01
gccgacgaacagccag

SEQ ID NO: 1487756 - RNA, 23 nt, Pseudomonas aeruginosa PA01
gccgacgaagaccuugaacucgc

SEQ ID NO: 1487757 - RNA, 16 nt, Pseudomonas aeruginosa PA01
gccgacgccgagcagc

SEQ ID NO: 1487758 - RNA, 20 nt, Pseudomonas aeruginosa PA01
gccgacgccgagcagcacca

SEQ ID NO: 1487759 - RNA, 22 nt, Pseudomonas aeruginosa PA01
gccgacgccgagcagcaccagg

SEQ ID NO: 1487760 - RNA, 15 nt, Pseudomonas aeruginosa PA01
gccgacgccgcggcc

SEQ ID NO: 1487761 - RNA, 17 nt, Pseudomonas aeruginosa PA01
gccgacgccgcggccgg

SEQ ID NO: 1487762 - RNA, 20 nt, Pseudomonas aeruginosa PA01
gccgacgccgcggccggcga

SEQ ID NO: 1487763 - RNA, 13 nt, Pseudomonas aeruginosa PA01
gccgacgccgcug

SEQ ID NO: 1487764 - RNA, 14 nt, Pseudomonas aeruginosa PA01
gccgacgccgcugg

SEQ ID NO: 1487765 - RNA, 15 nt, Pseudomonas aeruginosa PA01
gccgacgccgcugga

SEQ ID NO: 1487766 - RNA, 16 nt, Pseudomonas aeruginosa PA01
gccgacgcuuccucgc

SEQ ID NO: 1487767 - RNA, 17 nt, Pseudomonas aeruginosa PA01
gccgacgcuuccucgcu

SEQ ID NO: 1487768 - RNA, 16 nt, Pseudomonas aeruginosa PA01
gccgacggacguccuc

SEQ ID NO: 1487769 - RNA, 20 nt, Pseudomonas aeruginosa PA01
gccgacggacguccuccugg

SEQ ID NO: 1487770 - RNA, 12 nt, Pseudomonas aeruginosa PA01
gccgaccaggcc

SEQ ID NO: 1487771 - RNA, 18 nt, Pseudomonas aeruginosa PA01
gccgacccagagcgcgcc

SEQ ID NO: 1487772 - RNA, 22 nt, Pseudomonas aeruginosa PA01
gccgacccagagcgcgcccugc

SEQ ID NO: 1487773 - RNA, 13 nt, Pseudomonas aeruginosa PA01
gccgaccaggccg

SEQ ID NO: 1487774 - RNA, 14 nt, Pseudomonas aeruginosa PA01
gccgaccaggccgu

SEQ ID NO: 1487775 - RNA, 23 nt, Pseudomonas aeruginosa PA01
gccgaccaggccguaggcgaugg

SEQ ID NO: 1487776 - RNA, 19 nt, Pseudomonas aeruginosa PA01
gccgaccaggcggccgucg

SEQ ID NO: 1487777 - RNA, 17 nt, Pseudomonas aeruginosa PA01
gccgacccgcagcggcg

SEQ ID NO: 1487778 - RNA, 19 nt, Pseudomonas aeruginosa PA01
gccgacccgcagcggcgcu

SEQ ID NO: 1487779 - RNA, 16 nt, Pseudomonas aeruginosa PA01
gccgacccgcaggccg

SEQ ID NO: 1487780 - RNA, 20 nt, Pseudomonas aeruginosa PA01
gccgacccgcaggccggcca

SEQ ID NO: 1487781 - RNA, 18 nt, Pseudomonas aeruginosa PA01
gccgaccgcaccgccagc

SEQ ID NO: 1487782 - RNA, 23 nt, Pseudomonas aeruginosa PA01
gccgaccgcaccgccagcgucgc

SEQ ID NO: 1487783 - RNA, 14 nt, Pseudomonas aeruginosa PA01
gccgaccgccaggc

SEQ ID NO: 1487784 - RNA, 15 nt, Pseudomonas aeruginosa PA01
gccgacagcggcugg

SEQ ID NO: 1487785 - RNA, 18 nt, Pseudomonas aeruginosa PA01
gccgacagcggcuggcgc

SEQ ID NO: 1487786 - RNA, 22 nt, Pseudomonas aeruginosa PA01
gccgacagcggcuggcgcuugc

SEQ ID NO: 1487787 - RNA, 15 nt, Pseudomonas aeruginosa PA01
gccgacaggccggug

SEQ ID NO: 1487788 - RNA, 19 nt, Pseudomonas aeruginosa PA01
gccgacaggccggugccgc

SEQ ID NO: 1487789 - RNA, 17 nt, Pseudomonas aeruginosa PA01
gccgacacgggugccgg

SEQ ID NO: 1487790 - RNA, 19 nt, Pseudomonas aeruginosa PA01
gccgacagagcggccggcg

SEQ ID NO: 1487791 - RNA, 13 nt, Pseudomonas aeruginosa PA01
gccgacaccucga

SEQ ID NO: 1487792 - RNA, 17 nt, Pseudomonas aeruginosa PA01
gccgacagcacgauggc

SEQ ID NO: 1487793 - RNA, 19 nt, Pseudomonas aeruginosa PA01
gccgacaggucgcuuucgc

SEQ ID NO: 1487794 - RNA, 22 nt, Pseudomonas aeruginosa PA01
gccgacaggucgcuuucgcgca

SEQ ID NO: 1487795 - RNA, 14 nt, Pseudomonas aeruginosa PA01
gccgacaggucggc

SEQ ID NO: 1487796 - RNA, 17 nt, Pseudomonas aeruginosa PA01
gccgacaggucggccgg

SEQ ID NO: 1487797 - RNA, 19 nt, Pseudomonas aeruginosa PA01
gccgacaggucggccggca

SEQ ID NO: 1487798 - RNA, 12 nt, Pseudomonas aeruginosa PA01
gccgacaucgga

SEQ ID NO: 1487799 - RNA, 14 nt, Pseudomonas aeruginosa PA01
gccgacauccuguc

SEQ ID NO: 1487800 - RNA, 21 nt, Pseudomonas aeruginosa PA01
gcccgcucaugagauccgcca

SEQ ID NO: 1487801 - RNA, 22 nt, Pseudomonas aeruginosa PA01
gcccgcucaugagauccgccag

SEQ ID NO: 1487802 - RNA, 17 nt, Pseudomonas aeruginosa PA01
gcccgcucaagggcugg

SEQ ID NO: 1487803 - RNA, 19 nt, Pseudomonas aeruginosa PA01
gcccgcucaagggcuggca

SEQ ID NO: 1487804 - RNA, 21 nt, Pseudomonas aeruginosa PA01
gcccgcucaagggcuggcagg

SEQ ID NO: 1487805 - RNA, 22 nt, Pseudomonas aeruginosa PA01
gcccgcucaagggcuggcaggu

SEQ ID NO: 1487806 - RNA, 16 nt, Pseudomonas aeruginosa PA01
gcccgcucgacccggu

SEQ ID NO: 1487807 - RNA, 21 nt, Pseudomonas aeruginosa PA01
gcccucgauguaggccucggc

SEQ ID NO: 1487808 - RNA, 23 nt, Pseudomonas aeruginosa PA01
gcccucgauguaggccucggccu

SEQ ID NO: 1487809 - RNA, 13 nt, Pseudomonas aeruginosa PA01
gcccucgcagccg

SEQ ID NO: 1487810 - RNA, 15 nt, Pseudomonas aeruginosa PA01
gcccucgcagccggc

SEQ ID NO: 1487811 - RNA, 17 nt, Pseudomonas aeruginosa PA01
gcccucgcagccggcgg

SEQ ID NO: 1487812 - RNA, 18 nt, Pseudomonas aeruginosa PA01
gcccucgcagccggcggc

SEQ ID NO: 1487813 - RNA, 13 nt, Pseudomonas aeruginosa PA01
gcccucgccaauc

SEQ ID NO: 1487814 - RNA, 21 nt, Pseudomonas aeruginosa PA01
gcccucgaccagguccggcag

SEQ ID NO: 1487815 - RNA, 22 nt, Pseudomonas aeruginosa PA01
gcccgcugcaugugccaggccu

SEQ ID NO: 1487816 - RNA, 13 nt, Pseudomonas aeruginosa PA01
gcccgcugaccgg

SEQ ID NO: 1487817 - RNA, 21 nt, Pseudomonas aeruginosa PA01
gcccgcugaccgggcggaucg

SEQ ID NO: 1487818 - RNA, 22 nt, Pseudomonas aeruginosa PA01
gcccuccugcucgauccagccg

SEQ ID NO: 1487819 - RNA, 23 nt, Pseudomonas aeruginosa PA01
gcccuccugggccugucgggggc

SEQ ID NO: 1487820 - RNA, 13 nt, Pseudomonas aeruginosa PA01
gcccucgaagccc

SEQ ID NO: 1487821 - RNA, 14 nt, Pseudomonas aeruginosa PA01
gcccuccggcgcgu

SEQ ID NO: 1487822 - RNA, 16 nt, Pseudomonas aeruginosa PA01
gcccuccggcgcguug

SEQ ID NO: 1487823 - RNA, 15 nt, Pseudomonas aeruginosa PA01
gcccucggcggcgag

SEQ ID NO: 1487824 - RNA, 14 nt, Pseudomonas aeruginosa PA01
gcccucggcgccga

SEQ ID NO: 1487825 - RNA, 15 nt, Pseudomonas aeruginosa PA01
gcccucggcgccgag

SEQ ID NO: 1487826 - RNA, 17 nt, Pseudomonas aeruginosa PA01
gcccucggcgccgagca

SEQ ID NO: 1487827 - RNA, 17 nt, Pseudomonas aeruginosa PA01
gcccucggcgcuggcca

SEQ ID NO: 1487828 - RNA, 18 nt, Pseudomonas aeruginosa PA01
gcccucggcgcuggccag

SEQ ID NO: 1487829 - RNA, 22 nt, Pseudomonas aeruginosa PA01
gcccucggugauaccgccggcg

SEQ ID NO: 1487830 - RNA, 23 nt, Pseudomonas aeruginosa PA01
gcccucggugauaccgccggcgg

SEQ ID NO: 1487831 - RNA, 16 nt, Pseudomonas aeruginosa PA01
gcccucggccaggcau

SEQ ID NO: 1487832 - RNA, 17 nt, Pseudomonas aeruginosa PA01
gcccucggcccggagcc

SEQ ID NO: 1487833 - RNA, 13 nt, Pseudomonas aeruginosa PA01
gcccucggcgccc

SEQ ID NO: 1487834 - RNA, 14 nt, Pseudomonas aeruginosa PA01
gcccucggcgcccg

SEQ ID NO: 1487835 - RNA, 16 nt, Pseudomonas aeruginosa PA01
gcccucggcgcccgcc

SEQ ID NO: 1487836 - RNA, 17 nt, Pseudomonas aeruginosa PA01
gcccucggcgcccgccu

SEQ ID NO: 1487837 - RNA, 19 nt, Pseudomonas aeruginosa PA01
gcccucggcgcccgccugc

SEQ ID NO: 1487838 - RNA, 20 nt, Pseudomonas aeruginosa PA01
gcccucggcgcccgccugca

SEQ ID NO: 1487839 - RNA, 14 nt, Pseudomonas aeruginosa PA01
gcccucgcgacggc

SEQ ID NO: 1487840 - RNA, 23 nt, Pseudomonas aeruginosa PA01
gcccucgcccaggugcgccgagc

SEQ ID NO: 1487841 - RNA, 14 nt, Pseudomonas aeruginosa PA01
gcccucgcgcccgg

SEQ ID NO: 1487842 - RNA, 15 nt, Pseudomonas aeruginosa PA01
gcccucgcgcuggac

SEQ ID NO: 1487843 - RNA, 11 nt, Pseudomonas aeruginosa PA01
gcccucgcgga

SEQ ID NO: 1487844 - RNA, 12 nt, Pseudomonas aeruginosa PA01
gcccucggccag

SEQ ID NO: 1487845 - RNA, 23 nt, Pseudomonas aeruginosa PA01
gcccucgcuccaacgcaggcgca

SEQ ID NO: 1487846 - RNA, 24 nt, Pseudomonas aeruginosa PA01
gcccucgcuccaacgcaggcgcau

SEQ ID NO: 1487847 - RNA, 18 nt, Pseudomonas aeruginosa PA01
gcccucgcucguuccgcg

SEQ ID NO: 1487848 - RNA, 14 nt, Pseudomonas aeruginosa PA01
gcccucgcugagca

SEQ ID NO: 1487849 - RNA, 23 nt, Pseudomonas aeruginosa PA01
gcccucgcggaucugcuccugca

SEQ ID NO: 1487850 - RNA, 13 nt, Pseudomonas aeruginosa PA01
gcccucgcggcgg

SEQ ID NO: 1487851 - RNA, 15 nt, Pseudomonas aeruginosa PA01
gcccucgcggcggca

SEQ ID NO: 1487852 - RNA, 16 nt, Pseudomonas aeruginosa PA01
gcccucgcggcggcag

SEQ ID NO: 1487853 - RNA, 21 nt, Pseudomonas aeruginosa PA01
gcccucgcggacgcuggcgau

SEQ ID NO: 1487854 - RNA, 12 nt, Pseudomonas aeruginosa PA01
gcccucgcggag

SEQ ID NO: 1487855 - RNA, 16 nt, Pseudomonas aeruginosa PA01
gcccucgcggagcugg

SEQ ID NO: 1487856 - RNA, 22 nt, Pseudomonas aeruginosa PA01
gcccugcaacacguagcgcagg

SEQ ID NO: 1487857 - RNA, 16 nt, Pseudomonas aeruginosa PA01
gcccugcaacaggacc

SEQ ID NO: 1487858 - RNA, 18 nt, Pseudomonas aeruginosa PA01
gcccugcaacaggaccca

SEQ ID NO: 1487859 - RNA, 23 nt, Pseudomonas aeruginosa PA01
gcccugcaacaggacccagccau

SEQ ID NO: 1487860 - RNA, 20 nt, Pseudomonas aeruginosa PA01
gcccucguugauuccgccgg

SEQ ID NO: 1487861 - RNA, 22 nt, Pseudomonas aeruginosa PA01
gcccucggugcgguuggagcgg

SEQ ID NO: 1487862 - RNA, 22 nt, Pseudomonas aeruginosa PA01
gcccucgucgcaccuguuccag

SEQ ID NO: 1487863 - RNA, 20 nt, Pseudomonas aeruginosa PA01
gcccucucaggagcgccgcg

SEQ ID NO: 1487864 - RNA, 16 nt, Pseudomonas aeruginosa PA01
gcccucucucgccucg

SEQ ID NO: 1487865 - RNA, 18 nt, Pseudomonas aeruginosa PA01
gcccucucucgccucggc

SEQ ID NO: 1487866 - RNA, 15 nt, Pseudomonas aeruginosa PA01
gcccucugccggucg

SEQ ID NO: 1487867 - RNA, 14 nt, Pseudomonas aeruginosa PA01
gcccuggccgcugc

SEQ ID NO: 1487868 - RNA, 15 nt, Pseudomonas aeruginosa PA01
gcccuggccgcugcc

SEQ ID NO: 1487869 - RNA, 19 nt, Pseudomonas aeruginosa PA01
gcccuggccgcugccgcuc

SEQ ID NO: 1487870 - RNA, 14 nt, Pseudomonas aeruginosa PA01
gcccuggccgucgg

SEQ ID NO: 1487871 - RNA, 17 nt, Pseudomonas aeruginosa PA01
gcccuggccgucggccu

SEQ ID NO: 1487872 - RNA, 15 nt, Pseudomonas aeruginosa PA01
gcccuggccucggcg

SEQ ID NO: 1487873 - RNA, 16 nt, Pseudomonas aeruginosa PA01
gcccuggcgcgcgccc

SEQ ID NO: 1487874 - RNA, 15 nt, Pseudomonas aeruginosa PA01
gcccuggcgcggcaa

SEQ ID NO: 1487875 - RNA, 19 nt, Pseudomonas aeruginosa PA01
gcccuggccuuggccacga

SEQ ID NO: 1487876 - RNA, 15 nt, Pseudomonas aeruginosa PA01
gcccuggcgccagcg

SEQ ID NO: 1487877 - RNA, 11 nt, Pseudomonas aeruginosa PA01
gcccugggcgg

SEQ ID NO: 1487878 - RNA, 14 nt, Pseudomonas aeruginosa PA01
gcccugggcggcga

SEQ ID NO: 1487879 - RNA, 16 nt, Pseudomonas aeruginosa PA01
gcccugggcgucgacg

SEQ ID NO: 1487880 - RNA, 19 nt, Pseudomonas aeruginosa PA01
gcccugggacaggcguccc

SEQ ID NO: 1487881 - RNA, 19 nt, Pseudomonas aeruginosa PA01
gcccugggguuucugcugg

SEQ ID NO: 1487882 - RNA, 23 nt, Pseudomonas aeruginosa PA01
gcccugggguuucugcuggccac

SEQ ID NO: 1487883 - RNA, 19 nt, Pseudomonas aeruginosa PA01
gcccugggccccggccggc

SEQ ID NO: 1487884 - RNA, 17 nt, Pseudomonas aeruginosa PA01
gcccugggccggcgcca

SEQ ID NO: 1487885 - RNA, 20 nt, Pseudomonas aeruginosa PA01
gcccugggccggcgccagca

SEQ ID NO: 1487886 - RNA, 21 nt, Pseudomonas aeruginosa PA01
gcccugggccggcgccagcag

SEQ ID NO: 1487887 - RNA, 17 nt, Pseudomonas aeruginosa PA01
gcccugggcgaacagca

SEQ ID NO: 1487888 - RNA, 21 nt, Pseudomonas aeruginosa PA01
gcccugggcgaugcggcggaa

SEQ ID NO: 1487889 - RNA, 17 nt, Pseudomonas aeruginosa PA01
gcccugggcgccgccgg

SEQ ID NO: 1487890 - RNA, 19 nt, Pseudomonas aeruginosa PA01
gcccuggcucuugccgcga

SEQ ID NO: 1487891 - RNA, 17 nt, Pseudomonas aeruginosa PA01
gcccuggcguggccggc

SEQ ID NO: 1487892 - RNA, 18 nt, Pseudomonas aeruginosa PA01
gcccuggcguggccggcg

SEQ ID NO: 1487893 - RNA, 19 nt, Pseudomonas aeruginosa PA01
gcccuggcguggccggcga

SEQ ID NO: 1487894 - RNA, 23 nt, Pseudomonas aeruginosa PA01
gcccuucgacaugggccgcgcag

SEQ ID NO: 1487895 - RNA, 12 nt, Pseudomonas aeruginosa PA01
gcccuucgcccu

SEQ ID NO: 1487896 - RNA, 15 nt, Pseudomonas aeruginosa PA01
gcccuucgcccugcg

SEQ ID NO: 1487897 - RNA, 17 nt, Pseudomonas aeruginosa PA01
gcccuggugcacggcga

SEQ ID NO: 1487898 - RNA, 18 nt, Pseudomonas aeruginosa PA01
gcccuggugcacggcgac

SEQ ID NO: 1487899 - RNA, 19 nt, Pseudomonas aeruginosa PA01
gcccugguggugaucagcg

SEQ ID NO: 1487900 - RNA, 22 nt, Pseudomonas aeruginosa PA01
gcccugguggugaucagcggcc

SEQ ID NO: 1487901 - RNA, 23 nt, Pseudomonas aeruginosa PA01
gcccugguggugaucagcggccg

SEQ ID NO: 1487902 - RNA, 17 nt, Pseudomonas aeruginosa PA01
gcccugguacagcgccu

SEQ ID NO: 1487903 - RNA, 18 nt, Pseudomonas aeruginosa PA01
gcccugguacagcgccug

SEQ ID NO: 1487904 - RNA, 21 nt, Pseudomonas aeruginosa PA01
gcccugguaggugcgcuggcg

SEQ ID NO: 1487905 - RNA, 22 nt, Pseudomonas aeruginosa PA01
gcccugguaggugcgcuggcgc

SEQ ID NO: 1487906 - RNA, 23 nt, Pseudomonas aeruginosa PA01
gcccugguaggugcgcuggcgcc

SEQ ID NO: 1487907 - RNA, 20 nt, Pseudomonas aeruginosa PA01
gcccuucaaaaaccaugcgg

SEQ ID NO: 1487908 - RNA, 22 nt, Pseudomonas aeruginosa PA01
gcccuguuucggguccaggcgc

SEQ ID NO: 1487909 - RNA, 13 nt, Pseudomonas aeruginosa PA01
gcccuguucggcg

SEQ ID NO: 1487910 - RNA, 22 nt, Pseudomonas aeruginosa PA01
gcccugcuuggccagcgcggug

SEQ ID NO: 1487911 - RNA, 19 nt, Pseudomonas aeruginosa PA01
gcccuggaaaggccucggc

SEQ ID NO: 1487912 - RNA, 20 nt, Pseudomonas aeruginosa PA01
gcccuggaaaggccucggcg

SEQ ID NO: 1487913 - RNA, 21 nt, Pseudomonas aeruginosa PA01
gcccuggaaaggccucggcga

SEQ ID NO: 1487914 - RNA, 23 nt, Pseudomonas aeruginosa PA01
gcccuggaaaggccucggcgaug

SEQ ID NO: 1487915 - RNA, 13 nt, Pseudomonas aeruginosa PA01
gcccugcucgccg

SEQ ID NO: 1487916 - RNA, 16 nt, Pseudomonas aeruginosa PA01
gcccuggaucaccgcg

SEQ ID NO: 1487917 - RNA, 19 nt, Pseudomonas aeruginosa PA01
gcccuggaugaucucgcag

SEQ ID NO: 1487918 - RNA, 13 nt, Pseudomonas aeruginosa PA01
gcccuggccgacg

SEQ ID NO: 1487919 - RNA, 14 nt, Pseudomonas aeruginosa PA01
gcccuggccgagcg

SEQ ID NO: 1487920 - RNA, 18 nt, Pseudomonas aeruginosa PA01
gcccuggccgagcgggaa

SEQ ID NO: 1487921 - RNA, 13 nt, Pseudomonas aeruginosa PA01
gcccuggccgauc

SEQ ID NO: 1487922 - RNA, 17 nt, Pseudomonas aeruginosa PA01
gcccugcggcaggcgcc

SEQ ID NO: 1487923 - RNA, 21 nt, Pseudomonas aeruginosa PA01
gcccugcuccuccaggcucuu

SEQ ID NO: 1487924 - RNA, 14 nt, Pseudomonas aeruginosa PA01
gcccugcgucgcag

SEQ ID NO: 1487925 - RNA, 20 nt, Pseudomonas aeruginosa PA01
gcccugcguggaaccgcggc

SEQ ID NO: 1487926 - RNA, 20 nt, Pseudomonas aeruginosa PA01
gcccugcucuuccagcgggc

SEQ ID NO: 1487927 - RNA, 23 nt, Pseudomonas aeruginosa PA01
gcccugcucuuccagcgggcgga

SEQ ID NO: 1487928 - RNA, 15 nt, Pseudomonas aeruginosa PA01
gcccugcuggcgcag

SEQ ID NO: 1487929 - RNA, 16 nt, Pseudomonas aeruginosa PA01
gcccugcuggcgcagc

SEQ ID NO: 1487930 - RNA, 20 nt, Pseudomonas aeruginosa PA01
gcccugcuggcgcagccagg

SEQ ID NO: 1487931 - RNA, 21 nt, Pseudomonas aeruginosa PA01
gcccugcuggcgcagccaggc

SEQ ID NO: 1487932 - RNA, 14 nt, Pseudomonas aeruginosa PA01
gcccugcugcaggg

SEQ ID NO: 1487933 - RNA, 21 nt, Pseudomonas aeruginosa PA01
gcccugcugcagggccucgcu

SEQ ID NO: 1487934 - RNA, 18 nt, Pseudomonas aeruginosa PA01
gcccugcugcucgccaug

SEQ ID NO: 1487935 - RNA, 21 nt, Pseudomonas aeruginosa PA01
gcccugcugcucgccaugggc

SEQ ID NO: 1487936 - RNA, 15 nt, Pseudomonas aeruginosa PA01
gcccugcgcgauccc

SEQ ID NO: 1487937 - RNA, 16 nt, Pseudomonas aeruginosa PA01
gcccugcgcgcgcguu

SEQ ID NO: 1487938 - RNA, 23 nt, Pseudomonas aeruginosa PA01
gcccugcgcgcgcguuucagcgc

SEQ ID NO: 1487939 - RNA, 14 nt, Pseudomonas aeruginosa PA01
gcccugcgccgcag

SEQ ID NO: 1487940 - RNA, 16 nt, Pseudomonas aeruginosa PA01
gcccugcgccgcagcg

SEQ ID NO: 1487941 - RNA, 17 nt, Pseudomonas aeruginosa PA01
gcccugcgccgcagcgg

SEQ ID NO: 1487942 - RNA, 20 nt, Pseudomonas aeruginosa PA01
gcccugcgccgcagcggcca

SEQ ID NO: 1487943 - RNA, 14 nt, Pseudomonas aeruginosa PA01
gcccugcgccagca

SEQ ID NO: 1487944 - RNA, 18 nt, Pseudomonas aeruginosa PA01
gcccugcgcagcuaggcg

SEQ ID NO: 1487945 - RNA, 19 nt, Pseudomonas aeruginosa PA01
gcccugcgcagcuaggcga

SEQ ID NO: 1487946 - RNA, 13 nt, Pseudomonas aeruginosa PA01
gcccugcccggug

SEQ ID NO: 1487947 - RNA, 22 nt, Pseudomonas aeruginosa PA01
gcccugcccgguggggcgggcg

SEQ ID NO: 1487948 - RNA, 19 nt, Pseudomonas aeruginosa PA01
gcccugacccgcaccggca

SEQ ID NO: 1487949 - RNA, 23 nt, Pseudomonas aeruginosa PA01
gcccugcaccuugggaucgucga

SEQ ID NO: 1487950 - RNA, 17 nt, Pseudomonas aeruginosa PA01
gcccugcagcgcgcgcu

SEQ ID NO: 1487951 - RNA, 23 nt, Pseudomonas aeruginosa PA01
gcccugcagcgcgcgcuggucgu

SEQ ID NO: 1487952 - RNA, 21 nt, Pseudomonas aeruginosa PA01
gcccugcaggccgaauccgcc

SEQ ID NO: 1487953 - RNA, 22 nt, Pseudomonas aeruginosa PA01
gcccugcaggccgaauccgccg

SEQ ID NO: 1487954 - RNA, 14 nt, Pseudomonas aeruginosa PA01
gcccugcaucgcga

SEQ ID NO: 1487955 - RNA, 19 nt, Pseudomonas aeruginosa PA01
gcccugccacuugcgggug

SEQ ID NO: 1487956 - RNA, 21 nt, Pseudomonas aeruginosa PA01
gcccugccacuugcgggugcg

SEQ ID NO: 1487957 - RNA, 22 nt, Pseudomonas aeruginosa PA01
gcccugccagaggaucggccaa

SEQ ID NO: 1487958 - RNA, 17 nt, Pseudomonas aeruginosa PA01
gcccugccccuucggcu

SEQ ID NO: 1487959 - RNA, 20 nt, Pseudomonas aeruginosa PA01
gcccugccccuucggcugca

SEQ ID NO: 1487960 - RNA, 21 nt, Pseudomonas aeruginosa PA01
gccgcaagcuccccgccgcca

SEQ ID NO: 1487961 - RNA, 23 nt, Pseudomonas aeruginosa PA01
gccgcaagcuccccgccgccagg

SEQ ID NO: 1487962 - RNA, 18 nt, Pseudomonas aeruginosa PA01
gccgcaaguggcggcuga

SEQ ID NO: 1487963 - RNA, 14 nt, Pseudomonas aeruginosa PA01
gccgcaaggccagg

SEQ ID NO: 1487964 - RNA, 20 nt, Pseudomonas aeruginosa PA01
gccgcaaggccagggcggcg

SEQ ID NO: 1487965 - RNA, 23 nt, Pseudomonas aeruginosa PA01
gccgcaaggccagggcggcgccg

SEQ ID NO: 1487966 - RNA, 16 nt, Pseudomonas aeruginosa PA01
gccgcaccggcgaugg

SEQ ID NO: 1487967 - RNA, 19 nt, Pseudomonas aeruginosa PA01
gccgcaccggcgauggccg

SEQ ID NO: 1487968 - RNA, 16 nt, Pseudomonas aeruginosa PA01
gccgcaacgaucucgc

SEQ ID NO: 1487969 - RNA, 20 nt, Pseudomonas aeruginosa PA01
aagcaccgacacgcacucau

SEQ ID NO: 1487970 - RNA, 17 nt, Pseudomonas aeruginosa PA01
aagcaccuugagggccu

SEQ ID NO: 1487971 - RNA, 16 nt, Pseudomonas aeruginosa PA01
aagcacggcucggcga

SEQ ID NO: 1487972 - RNA, 18 nt, Pseudomonas aeruginosa PA01
gccgaugguuucgugcca

SEQ ID NO: 1487973 - RNA, 19 nt, Pseudomonas aeruginosa PA01
gccgauguacggcaccacc

SEQ ID NO: 1487974 - RNA, 20 nt, Pseudomonas aeruginosa PA01
gccgauguccucgaacagcu

SEQ ID NO: 1487975 - RNA, 14 nt, Pseudomonas aeruginosa PA01
gccgaugucgccgg

SEQ ID NO: 1487976 - RNA, 15 nt, Pseudomonas aeruginosa PA01
gccgaugucgccggc

SEQ ID NO: 1487977 - RNA, 21 nt, Pseudomonas aeruginosa PA01
gccgcaaccagcccuggcgca

SEQ ID NO: 1487978 - RNA, 20 nt, Pseudomonas aeruginosa PA01
gccgaugucguagccgcgcg

SEQ ID NO: 1487979 - RNA, 21 nt, Pseudomonas aeruginosa PA01
gccgaugcgguagucgcugcu

SEQ ID NO: 1487980 - RNA, 19 nt, Pseudomonas aeruginosa PA01
gccgaugcuaucgcguggc

SEQ ID NO: 1487981 - RNA, 19 nt, Pseudomonas aeruginosa PA01
gccgaugcucgcgccagcc

SEQ ID NO: 1487982 - RNA, 16 nt, Pseudomonas aeruginosa PA01
gccgauggccccggcg

SEQ ID NO: 1487983 - RNA, 17 nt, Pseudomonas aeruginosa PA01
gccgauggacaggcugg

SEQ ID NO: 1487984 - RNA, 19 nt, Pseudomonas aeruginosa PA01
gccgauggagauguagucg

SEQ ID NO: 1487985 - RNA, 14 nt, Pseudomonas aeruginosa PA01
gccgauggaaaucg

SEQ ID NO: 1487986 - RNA, 20 nt, Pseudomonas aeruginosa PA01
gccgauggaaaucggccacu

SEQ ID NO: 1487987 - RNA, 21 nt, Pseudomonas aeruginosa PA01
gccgaugcuguauuccuugcg

SEQ ID NO: 1487988 - RNA, 18 nt, Pseudomonas aeruginosa PA01
gccgauggcgcaccacug

SEQ ID NO: 1487989 - RNA, 20 nt, Pseudomonas aeruginosa PA01
gccgauggcgcaccacugca

SEQ ID NO: 1487990 - RNA, 14 nt, Pseudomonas aeruginosa PA01
gccgauggcgccgc

SEQ ID NO: 1487991 - RNA, 15 nt, Pseudomonas aeruginosa PA01
gccgauggcgccgcc

SEQ ID NO: 1487992 - RNA, 17 nt, Pseudomonas aeruginosa PA01
gccgauggcgccgccga

SEQ ID NO: 1487993 - RNA, 19 nt, Pseudomonas aeruginosa PA01
gccgauggcgccgccgagg

SEQ ID NO: 1487994 - RNA, 15 nt, Pseudomonas aeruginosa PA01
gccgaugggccuuca

SEQ ID NO: 1487995 - RNA, 18 nt, Pseudomonas aeruginosa PA01
gccgauggcugucggcgc

SEQ ID NO: 1487996 - RNA, 20 nt, Pseudomonas aeruginosa PA01
gccgauggcugucggcgccc

SEQ ID NO: 1487997 - RNA, 24 nt, Pseudomonas aeruginosa PA01
gccgcaucgcgggcgugcuccagc

SEQ ID NO: 1487998 - RNA, 14 nt, Pseudomonas aeruginosa PA01
gccgcaucgaccuu

SEQ ID NO: 1487999 - RNA, 18 nt, Pseudomonas aeruginosa PA01
gccgcaucgaccuugccc

SEQ ID NO: 1488000 - RNA, 22 nt, Pseudomonas aeruginosa PA01
gccgcaucgaccuugcccucgg

SEQ ID NO: 1488001 - RNA, 18 nt, Pseudomonas aeruginosa PA01
gccgcagggugcggcugc

SEQ ID NO: 1488002 - RNA, 15 nt, Pseudomonas aeruginosa PA01
gccgcaggucggcgu

SEQ ID NO: 1488003 - RNA, 14 nt, Pseudomonas aeruginosa PA01
gccgcaggugaagc

SEQ ID NO: 1488004 - RNA, 15 nt, Pseudomonas aeruginosa PA01
gccgcaggcugccgu

SEQ ID NO: 1488005 - RNA, 16 nt, Pseudomonas aeruginosa PA01
gccgcaggcugccguc

SEQ ID NO: 1488006 - RNA, 16 nt, Pseudomonas aeruginosa PA01
gccgcaggcgggcgcc

SEQ ID NO: 1488007 - RNA, 17 nt, Pseudomonas aeruginosa PA01
gccgcaggcgggcgcca

SEQ ID NO: 1488008 - RNA, 22 nt, Pseudomonas aeruginosa PA01
gccgcaggcgggcgccaucgcu

SEQ ID NO: 1488009 - RNA, 13 nt, Pseudomonas aeruginosa PA01
gccgccacgccga

SEQ ID NO: 1488010 - RNA, 14 nt, Pseudomonas aeruginosa PA01
gccgccacgccgau

SEQ ID NO: 1488011 - RNA, 17 nt, Pseudomonas aeruginosa PA01
gccgccacgccgauacc

SEQ ID NO: 1488012 - RNA, 13 nt, Pseudomonas aeruginosa PA01
gccgcagcggcca

SEQ ID NO: 1488013 - RNA, 15 nt, Pseudomonas aeruginosa PA01
gccgcagcggccagg

SEQ ID NO: 1488014 - RNA, 16 nt, Pseudomonas aeruginosa PA01
gccgcagcggccaggg

SEQ ID NO: 1488015 - RNA, 17 nt, Pseudomonas aeruginosa PA01
gccgcagcggccaggga

SEQ ID NO: 1488016 - RNA, 15 nt, Pseudomonas aeruginosa PA01
gccgcagcggcgucu

SEQ ID NO: 1488017 - RNA, 20 nt, Pseudomonas aeruginosa PA01
gccgcagcggcucgugucga

SEQ ID NO: 1488018 - RNA, 18 nt, Pseudomonas aeruginosa PA01
gccgcagcggcuguugcc

SEQ ID NO: 1488019 - RNA, 18 nt, Pseudomonas aeruginosa PA01
gccgcagcggcaugcccu

SEQ ID NO: 1488020 - RNA, 19 nt, Pseudomonas aeruginosa PA01
gccgcagcggcaugcccug

SEQ ID NO: 1488021 - RNA, 12 nt, Pseudomonas aeruginosa PA01
gccgcagcucgg

SEQ ID NO: 1488022 - RNA, 18 nt, Pseudomonas aeruginosa PA01
gccgcagcucggccucga

SEQ ID NO: 1488023 - RNA, 19 nt, Pseudomonas aeruginosa PA01
gccgcagcucggccucgau

SEQ ID NO: 1488024 - RNA, 20 nt, Pseudomonas aeruginosa PA01
gccgcagcucggccucgauc

SEQ ID NO: 1488025 - RNA, 12 nt, Pseudomonas aeruginosa PA01
gccgcagcgccu

SEQ ID NO: 1488026 - RNA, 16 nt, Pseudomonas aeruginosa PA01
gccgcaggccgcggcc

SEQ ID NO: 1488027 - RNA, 17 nt, Pseudomonas aeruginosa PA01
gccgcaggccgcggccg

SEQ ID NO: 1488028 - RNA, 18 nt, Pseudomonas aeruginosa PA01
gccgcaggaaguugaugg

SEQ ID NO: 1488029 - RNA, 15 nt, Pseudomonas aeruginosa PA01
gccgcaggaugccgc

SEQ ID NO: 1488030 - RNA, 17 nt, Pseudomonas aeruginosa PA01
gccgcaggaugccgccu

SEQ ID NO: 1488031 - RNA, 19 nt, Pseudomonas aeruginosa PA01
gccgcaggaugccgccugc

SEQ ID NO: 1488032 - RNA, 21 nt, Pseudomonas aeruginosa PA01
gccgcaggaugccgccugcgu

SEQ ID NO: 1488033 - RNA, 19 nt, Pseudomonas aeruginosa PA01
gccgcaggcaguggcgcca

SEQ ID NO: 1488034 - RNA, 13 nt, Pseudomonas aeruginosa PA01
gccgcacuuccag

SEQ ID NO: 1488035 - RNA, 18 nt, Pseudomonas aeruginosa PA01
gccgcacuuccaggcgcc

SEQ ID NO: 1488036 - RNA, 13 nt, Pseudomonas aeruginosa PA01
gccgcagcgcccc

SEQ ID NO: 1488037 - RNA, 21 nt, Pseudomonas aeruginosa PA01
gccgcagcgccccucccagcc

SEQ ID NO: 1488038 - RNA, 17 nt, Pseudomonas aeruginosa PA01
gccgaucugcuggguca

SEQ ID NO: 1488039 - RNA, 12 nt, Pseudomonas aeruginosa PA01
gccgaucgccgc

SEQ ID NO: 1488040 - RNA, 14 nt, Pseudomonas aeruginosa PA01
gccgaucgccgcgc

SEQ ID NO: 1488041 - RNA, 15 nt, Pseudomonas aeruginosa PA01
gccgaucgccgcgcg

SEQ ID NO: 1488042 - RNA, 14 nt, Pseudomonas aeruginosa PA01
gccgaucgccucgu

SEQ ID NO: 1488043 - RNA, 21 nt, Pseudomonas aeruginosa PA01
gccgaucgccucguucagcag

SEQ ID NO: 1488044 - RNA, 23 nt, Pseudomonas aeruginosa PA01
gccgaucgccucguucagcagca

SEQ ID NO: 1488045 - RNA, 13 nt, Pseudomonas aeruginosa PA01
gccgaugaacgcc

SEQ ID NO: 1488046 - RNA, 23 nt, Pseudomonas aeruginosa PA01
gccgaugaacgccgcgaaauggc

SEQ ID NO: 1488047 - RNA, 18 nt, Pseudomonas aeruginosa PA01
gccgaugaaagagcccgc

SEQ ID NO: 1488048 - RNA, 17 nt, Pseudomonas aeruginosa PA01
gccgaugaaauagccgg

SEQ ID NO: 1488049 - RNA, 14 nt, Pseudomonas aeruginosa PA01
gccgaucuucgccg

SEQ ID NO: 1488050 - RNA, 15 nt, Pseudomonas aeruginosa PA01
gccgaucuucgccga

SEQ ID NO: 1488051 - RNA, 16 nt, Pseudomonas aeruginosa PA01
gccgaucuucgccgac

SEQ ID NO: 1488052 - RNA, 19 nt, Pseudomonas aeruginosa PA01
gccgaucuucagcagcagg

SEQ ID NO: 1488053 - RNA, 21 nt, Pseudomonas aeruginosa PA01
gccgaucuucagcagcaggcg

SEQ ID NO: 1488054 - RNA, 15 nt, Pseudomonas aeruginosa PA01
gccgaugccgccgac

SEQ ID NO: 1488055 - RNA, 23 nt, Pseudomonas aeruginosa PA01
gccgaugccgaccuugccgguua

SEQ ID NO: 1488056 - RNA, 13 nt, Pseudomonas aeruginosa PA01
gccgaugccgacg

SEQ ID NO: 1488057 - RNA, 17 nt, Pseudomonas aeruginosa PA01
gccgaugccggccggca

SEQ ID NO: 1488058 - RNA, 21 nt, Pseudomonas aeruginosa PA01
gccgaugccggccggcagcga

SEQ ID NO: 1488059 - RNA, 14 nt, Pseudomonas aeruginosa PA01
gccgaugccgggca

SEQ ID NO: 1488060 - RNA, 13 nt, Pseudomonas aeruginosa PA01
gccgaugcgccga

SEQ ID NO: 1488061 - RNA, 15 nt, Pseudomonas aeruginosa PA01
gccgaugcgccgacg

SEQ ID NO: 1488062 - RNA, 12 nt, Pseudomonas aeruginosa PA01
gccgaugaucuc

SEQ ID NO: 1488063 - RNA, 20 nt, Pseudomonas aeruginosa PA01
gccgaugaucuccgcgccgg

SEQ ID NO: 1488064 - RNA, 21 nt, Pseudomonas aeruginosa PA01
gccgaugaucuccgcgccggg

SEQ ID NO: 1488065 - RNA, 22 nt, Pseudomonas aeruginosa PA01
gccgaugaucuccgcgccgggc

SEQ ID NO: 1488066 - RNA, 23 nt, Pseudomonas aeruginosa PA01
gccgaugaucuccgcgccgggcu

SEQ ID NO: 1488067 - RNA, 13 nt, Pseudomonas aeruginosa PA01
gccgaugcccagg

SEQ ID NO: 1488068 - RNA, 14 nt, Pseudomonas aeruginosa PA01
gccgaugcccaggc

SEQ ID NO: 1488069 - RNA, 15 nt, Pseudomonas aeruginosa PA01
gccgaugcccaggcc

SEQ ID NO: 1488070 - RNA, 14 nt, Pseudomonas aeruginosa PA01
gccgaucaccagca

SEQ ID NO: 1488071 - RNA, 16 nt, Pseudomonas aeruginosa PA01
gccgaucaccagcaau

SEQ ID NO: 1488072 - RNA, 16 nt, Pseudomonas aeruginosa PA01
gccgaucaccagcgcc

SEQ ID NO: 1488073 - RNA, 18 nt, Pseudomonas aeruginosa PA01
gccgaucaccagcgccag

SEQ ID NO: 1488074 - RNA, 20 nt, Pseudomonas aeruginosa PA01
gccgaucaccagcgccaggc

SEQ ID NO: 1488075 - RNA, 13 nt, Pseudomonas aeruginosa PA01
gccgaucaccagg

SEQ ID NO: 1488076 - RNA, 17 nt, Pseudomonas aeruginosa PA01
gccgaucaccaggaucg

SEQ ID NO: 1488077 - RNA, 20 nt, Pseudomonas aeruginosa PA01
gccgaucaccaggaucgccg

SEQ ID NO: 1488078 - RNA, 16 nt, Pseudomonas aeruginosa PA01
gccgaucgagcggccc

SEQ ID NO: 1488079 - RNA, 14 nt, Pseudomonas aeruginosa PA01
gccgaguccgcgcg

SEQ ID NO: 1488080 - RNA, 20 nt, Pseudomonas aeruginosa PA01
gccgaguccgcgcgcgcgcu

SEQ ID NO: 1488081 - RNA, 20 nt, Pseudomonas aeruginosa PA01
gccgaucaacgcggccagca

SEQ ID NO: 1488082 - RNA, 21 nt, Pseudomonas aeruginosa PA01
gccgaucaacgcggccagcag

SEQ ID NO: 1488083 - RNA, 21 nt, Pseudomonas aeruginosa PA01
gccgaucaaugcguuccuguc

SEQ ID NO: 1488084 - RNA, 13 nt, Pseudomonas aeruginosa PA01
gccgaucaccacc

SEQ ID NO: 1488085 - RNA, 16 nt, Pseudomonas aeruginosa PA01
gccgaucaccaccagc

SEQ ID NO: 1488086 - RNA, 20 nt, Pseudomonas aeruginosa PA01
gccgaucaccaccagcauca

SEQ ID NO: 1488087 - RNA, 23 nt, Pseudomonas aeruginosa PA01
gccgaucaccaccagcgccgcca

SEQ ID NO: 1488088 - RNA, 19 nt, Pseudomonas aeruginosa PA01
gccgagguucuugcccagc

SEQ ID NO: 1488089 - RNA, 23 nt, Pseudomonas aeruginosa PA01
gccgagguucuugcccagcaacg

SEQ ID NO: 1488090 - RNA, 14 nt, Pseudomonas aeruginosa PA01
gccgagggcaaggu

SEQ ID NO: 1488091 - RNA, 14 nt, Pseudomonas aeruginosa PA01
gccgagggcaccga

SEQ ID NO: 1488092 - RNA, 15 nt, Pseudomonas aeruginosa PA01
gccgagggcagccuc

SEQ ID NO: 1488093 - RNA, 16 nt, Pseudomonas aeruginosa PA01
gccgagggcagccuca

SEQ ID NO: 1488094 - RNA, 21 nt, Pseudomonas aeruginosa PA01
gccgagggcgaguucggcgag

SEQ ID NO: 1488095 - RNA, 22 nt, Pseudomonas aeruginosa PA01
gccgagggcgaguucggcgagc

SEQ ID NO: 1488096 - RNA, 14 nt, Pseudomonas aeruginosa PA01
gccgagggcgccag

SEQ ID NO: 1488097 - RNA, 15 nt, Pseudomonas aeruginosa PA01
gccgagggcgccagg

SEQ ID NO: 1488098 - RNA, 16 nt, Pseudomonas aeruginosa PA01
gccgagcggaaaagca

SEQ ID NO: 1488099 - RNA, 14 nt, Pseudomonas aeruginosa PA01
gccgaggaacgccg

SEQ ID NO: 1488100 - RNA, 17 nt, Pseudomonas aeruginosa PA01
gccgaggaacgccgaca

SEQ ID NO: 1488101 - RNA, 13 nt, Pseudomonas aeruginosa PA01
gccgaggaacucg

SEQ ID NO: 1488102 - RNA, 14 nt, Pseudomonas aeruginosa PA01
gccgaggaagccga

SEQ ID NO: 1488103 - RNA, 16 nt, Pseudomonas aeruginosa PA01
gccgaggaagccgacc

SEQ ID NO: 1488104 - RNA, 18 nt, Pseudomonas aeruginosa PA01
gccgaggaagccgaccgg

SEQ ID NO: 1488105 - RNA, 20 nt, Pseudomonas aeruginosa PA01
gccgaggaagccgaccggcg

SEQ ID NO: 1488106 - RNA, 21 nt, Pseudomonas aeruginosa PA01
gccgaggaagccgaccggcgc

SEQ ID NO: 1488107 - RNA, 23 nt, Pseudomonas aeruginosa PA01
gccgaggaagccgaccggcgccg

SEQ ID NO: 1488108 - RNA, 13 nt, Pseudomonas aeruginosa PA01
gccgaggaagucg

SEQ ID NO: 1488109 - RNA, 18 nt, Pseudomonas aeruginosa PA01
gccgaggaagucggcggc

SEQ ID NO: 1488110 - RNA, 19 nt, Pseudomonas aeruginosa PA01
gccgaggaagucggcggcc

SEQ ID NO: 1488111 - RNA, 14 nt, Pseudomonas aeruginosa PA01
gccgagcgcucgcc

SEQ ID NO: 1488112 - RNA, 16 nt, Pseudomonas aeruginosa PA01
gccgagcggcaaggcc

SEQ ID NO: 1488113 - RNA, 15 nt, Pseudomonas aeruginosa PA01
gccgagcgggaagcg

SEQ ID NO: 1488114 - RNA, 20 nt, Pseudomonas aeruginosa PA01
gccgagcgggaagcguuccu

SEQ ID NO: 1488115 - RNA, 22 nt, Pseudomonas aeruginosa PA01
gccgagcgggaagcguuccugg

SEQ ID NO: 1488116 - RNA, 13 nt, Pseudomonas aeruginosa PA01
gccgagcgcgccg

SEQ ID NO: 1488117 - RNA, 14 nt, Pseudomonas aeruginosa PA01
gccgagcgccuggc

SEQ ID NO: 1488118 - RNA, 22 nt, Pseudomonas aeruginosa PA01
gccgagcgcgaucagccgcucc

SEQ ID NO: 1488119 - RNA, 16 nt, Pseudomonas aeruginosa PA01
gccgagcgcgccgccg

SEQ ID NO: 1488120 - RNA, 17 nt, Pseudomonas aeruginosa PA01
gccgagcgcgccgccga

SEQ ID NO: 1488121 - RNA, 18 nt, Pseudomonas aeruginosa PA01
gccgagcgcgccgccgau

SEQ ID NO: 1488122 - RNA, 15 nt, Pseudomonas aeruginosa PA01
gccgagcgcgccgcc

SEQ ID NO: 1488123 - RNA, 15 nt, Pseudomonas aeruginosa PA01
gccgaggcccagcga

SEQ ID NO: 1488124 - RNA, 14 nt, Pseudomonas aeruginosa PA01
gccgaggccgccgc

SEQ ID NO: 1488125 - RNA, 16 nt, Pseudomonas aeruginosa PA01
gccgaggagacgcggc

SEQ ID NO: 1488126 - RNA, 22 nt, Pseudomonas aeruginosa PA01
gccgaggaggaucucgcgcccc

SEQ ID NO: 1488127 - RNA, 17 nt, Pseudomonas aeruginosa PA01
gccgaggaggaugccga

SEQ ID NO: 1488128 - RNA, 19 nt, Pseudomonas aeruginosa PA01
gccgaggaggccagcagca

SEQ ID NO: 1488129 - RNA, 17 nt, Pseudomonas aeruginosa PA01
gccgaggauagcgucca

SEQ ID NO: 1488130 - RNA, 17 nt, Pseudomonas aeruginosa PA01
gccgaggcagccgucgg

SEQ ID NO: 1488131 - RNA, 14 nt, Pseudomonas aeruginosa PA01
gccgaggcgucgaa

SEQ ID NO: 1488132 - RNA, 17 nt, Pseudomonas aeruginosa PA01
gccgaggcugcgggcga

SEQ ID NO: 1488133 - RNA, 17 nt, Pseudomonas aeruginosa PA01
gccgaggcugugggucg

SEQ ID NO: 1488134 - RNA, 19 nt, Pseudomonas aeruginosa PA01
gccgaggcuuuccagcagg

SEQ ID NO: 1488135 - RNA, 16 nt, Pseudomonas aeruginosa PA01
gccgaggcggccgagg

SEQ ID NO: 1488136 - RNA, 15 nt, Pseudomonas aeruginosa PA01
gccgaggcggccgua

SEQ ID NO: 1488137 - RNA, 19 nt, Pseudomonas aeruginosa PA01
gccgaggcggccguagccg

SEQ ID NO: 1488138 - RNA, 23 nt, Pseudomonas aeruginosa PA01
gccgaggcggccguagccgucga

SEQ ID NO: 1488139 - RNA, 13 nt, Pseudomonas aeruginosa PA01
gccgaggcggcgc

SEQ ID NO: 1488140 - RNA, 14 nt, Pseudomonas aeruginosa PA01
gccgaggcggcgca

SEQ ID NO: 1488141 - RNA, 12 nt, Pseudomonas aeruginosa PA01
gccgaggcgcgc

SEQ ID NO: 1488142 - RNA, 14 nt, Pseudomonas aeruginosa PA01
gccgaggcgcgcca

SEQ ID NO: 1488143 - RNA, 17 nt, Pseudomonas aeruginosa PA01
gccgaggcgcgccacgc

SEQ ID NO: 1488144 - RNA, 20 nt, Pseudomonas aeruginosa PA01
gccgaggcgcgccacgcaau

SEQ ID NO: 1488145 - RNA, 15 nt, Pseudomonas aeruginosa PA01
gccgagcaccccgac

SEQ ID NO: 1488146 - RNA, 23 nt, Pseudomonas aeruginosa PA01
gccgagcaccggcaggacgauga

SEQ ID NO: 1488147 - RNA, 17 nt, Pseudomonas aeruginosa PA01
gccgagcacgcacuggu

SEQ ID NO: 1488148 - RNA, 15 nt, Pseudomonas aeruginosa PA01
gccgacggcgugccg

SEQ ID NO: 1488149 - RNA, 17 nt, Pseudomonas aeruginosa PA01
gccgacggcgugccgug

SEQ ID NO: 1488150 - RNA, 18 nt, Pseudomonas aeruginosa PA01
gccgacggcgugccgugg

SEQ ID NO: 1488151 - RNA, 14 nt, Pseudomonas aeruginosa PA01
gccgacggcggcgg

SEQ ID NO: 1488152 - RNA, 20 nt, Pseudomonas aeruginosa PA01
gccgacggcggccggauggc

SEQ ID NO: 1488153 - RNA, 13 nt, Pseudomonas aeruginosa PA01
gccgacggcggcg

SEQ ID NO: 1488154 - RNA, 14 nt, Pseudomonas aeruginosa PA01
gccgacggcgcgcu

SEQ ID NO: 1488155 - RNA, 16 nt, Pseudomonas aeruginosa PA01
gccgacggcgcgcugc

SEQ ID NO: 1488156 - RNA, 20 nt, Pseudomonas aeruginosa PA01
gccgacgcugaggaucacga

SEQ ID NO: 1488157 - RNA, 16 nt, Pseudomonas aeruginosa PA01
gccgacgcugaucauc

SEQ ID NO: 1488158 - RNA, 13 nt, Pseudomonas aeruginosa PA01
gccgacggcccuc

SEQ ID NO: 1488159 - RNA, 19 nt, Pseudomonas aeruginosa PA01
gccgacggcccuccggcgc

SEQ ID NO: 1488160 - RNA, 20 nt, Pseudomonas aeruginosa PA01
gccgacggcccuccggcgcg

SEQ ID NO: 1488161 - RNA, 17 nt, Pseudomonas aeruginosa PA01
gccgagcagcgccagcc

SEQ ID NO: 1488162 - RNA, 18 nt, Pseudomonas aeruginosa PA01
gccgagcagcgccagcca

SEQ ID NO: 1488163 - RNA, 17 nt, Pseudomonas aeruginosa PA01
gccgagcagcaccaggc

SEQ ID NO: 1488164 - RNA, 19 nt, Pseudomonas aeruginosa PA01
gccgagcagcaccaggcug

SEQ ID NO: 1488165 - RNA, 14 nt, Pseudomonas aeruginosa PA01
gccgagcgccgcca

SEQ ID NO: 1488166 - RNA, 16 nt, Pseudomonas aeruginosa PA01
gccgagcgccgccagg

SEQ ID NO: 1488167 - RNA, 18 nt, Pseudomonas aeruginosa PA01
gccgagcgccgccugggc

SEQ ID NO: 1488168 - RNA, 23 nt, Pseudomonas aeruginosa PA01
gccgagcgccgccugggccgccu

SEQ ID NO: 1488169 - RNA, 21 nt, Pseudomonas aeruginosa PA01
gcacaaugaaaaacgccggcg

SEQ ID NO: 1488170 - RNA, 14 nt, Pseudomonas aeruginosa PA01
gcaauugccggcgu

SEQ ID NO: 1488171 - RNA, 18 nt, Pseudomonas aeruginosa PA01
gcaacagcgucgccaacg

SEQ ID NO: 1488172 - RNA, 15 nt, Pseudomonas aeruginosa PA01
gcaacaggacccagc

SEQ ID NO: 1488173 - RNA, 16 nt, Pseudomonas aeruginosa PA01
gcaacaggacccagcc

SEQ ID NO: 1488174 - RNA, 19 nt, Pseudomonas aeruginosa PA01
gcaacaguucugccgcaga

SEQ ID NO: 1488175 - RNA, 21 nt, Pseudomonas aeruginosa PA01
gcaacaguugccgcagcagcg

SEQ ID NO: 1488176 - RNA, 14 nt, Pseudomonas aeruginosa PA01
gcaacaggucgagg

SEQ ID NO: 1488177 - RNA, 11 nt, Pseudomonas aeruginosa PA01
gcacagguaga

SEQ ID NO: 1488178 - RNA, 21 nt, Pseudomonas aeruginosa PA01
gcacagguccagcaaggugcg

SEQ ID NO: 1488179 - RNA, 22 nt, Pseudomonas aeruginosa PA01
gcacaggcggaaggccucggug

SEQ ID NO: 1488180 - RNA, 17 nt, Pseudomonas aeruginosa PA01
gcacaggcguaccagcu

SEQ ID NO: 1488181 - RNA, 19 nt, Pseudomonas aeruginosa PA01
gcacaggcguaccagcuug

SEQ ID NO: 1488182 - RNA, 19 nt, Pseudomonas aeruginosa PA01
gcacaggcggcuguugccg

SEQ ID NO: 1488183 - RNA, 21 nt, Pseudomonas aeruginosa PA01
gcacaggacccuuccagcgug

SEQ ID NO: 1488184 - RNA, 22 nt, Pseudomonas aeruginosa PA01
gcacagcgcccagacacgccuc

SEQ ID NO: 1488185 - RNA, 13 nt, Pseudomonas aeruginosa PA01
gcacagcguggcc

SEQ ID NO: 1488186 - RNA, 21 nt, Pseudomonas aeruginosa PA01
gcacagcguggccagcgccca

SEQ ID NO: 1488187 - RNA, 13 nt, Pseudomonas aeruginosa PA01
gcacaccuggucu

SEQ ID NO: 1488188 - RNA, 22 nt, Pseudomonas aeruginosa PA01
gcacaccuggucuucgguggcg

SEQ ID NO: 1488189 - RNA, 23 nt, Pseudomonas aeruginosa PA01
gcacaccuggucuucgguggcgg

SEQ ID NO: 1488190 - RNA, 17 nt, Pseudomonas aeruginosa PA01
gcacaccuccagcggcu

SEQ ID NO: 1488191 - RNA, 17 nt, Pseudomonas aeruginosa PA01
gcacaguuccuguacca

SEQ ID NO: 1488192 - RNA, 19 nt, Pseudomonas aeruginosa PA01
gcacaguuccuguaccagg

SEQ ID NO: 1488193 - RNA, 19 nt, Pseudomonas aeruginosa PA01
gcacaucaccuucgcccuc

SEQ ID NO: 1488194 - RNA, 16 nt, Pseudomonas aeruginosa PA01
gcaccaccaccgacag

SEQ ID NO: 1488195 - RNA, 23 nt, Pseudomonas aeruginosa PA01
gcaccaccaccgacaggccgacc

SEQ ID NO: 1488196 - RNA, 13 nt, Pseudomonas aeruginosa PA01
gcaccaccaccgg

SEQ ID NO: 1488197 - RNA, 13 nt, Pseudomonas aeruginosa PA01
gcaccaccaccga

SEQ ID NO: 1488198 - RNA, 18 nt, Pseudomonas aeruginosa PA01
gcaccaccucgccaagcu

SEQ ID NO: 1488199 - RNA, 20 nt, Pseudomonas aeruginosa PA01
gcaccaccucgccaagcugg

SEQ ID NO: 1488200 - RNA, 21 nt, Pseudomonas aeruginosa PA01
gcaccaccugcuugggcgccu

SEQ ID NO: 1488201 - RNA, 22 nt, Pseudomonas aeruginosa PA01
gcaccaccugcuugggcgccuc

SEQ ID NO: 1488202 - RNA, 15 nt, Pseudomonas aeruginosa PA01
gcaccaccaggucga

SEQ ID NO: 1488203 - RNA, 18 nt, Pseudomonas aeruginosa PA01
gcaccacccggcgcacgc

SEQ ID NO: 1488204 - RNA, 19 nt, Pseudomonas aeruginosa PA01
gcaccacccggcgcacgcc

SEQ ID NO: 1488205 - RNA, 21 nt, Pseudomonas aeruginosa PA01
gcaccacccggcgcacgccgg

SEQ ID NO: 1488206 - RNA, 15 nt, Pseudomonas aeruginosa PA01
gcaccacccgcugca

SEQ ID NO: 1488207 - RNA, 17 nt, Pseudomonas aeruginosa PA01
gcaccacccggccgcgc

SEQ ID NO: 1488208 - RNA, 14 nt, Pseudomonas aeruginosa PA01
gcaccaccgccgcc

SEQ ID NO: 1488209 - RNA, 15 nt, Pseudomonas aeruginosa PA01
gcaccaccgccgcca

SEQ ID NO: 1488210 - RNA, 16 nt, Pseudomonas aeruginosa PA01
gcaccaccgccgccag

SEQ ID NO: 1488211 - RNA, 19 nt, Pseudomonas aeruginosa PA01
gcaccaccgccgccagcaa

SEQ ID NO: 1488212 - RNA, 19 nt, Pseudomonas aeruginosa PA01
gcaccaccgagagcggcgc

SEQ ID NO: 1488213 - RNA, 23 nt, Pseudomonas aeruginosa PA01
gcaccaccgagagcggcgccagg

SEQ ID NO: 1488214 - RNA, 15 nt, Pseudomonas aeruginosa PA01
gcaccacgccgcugg

SEQ ID NO: 1488215 - RNA, 17 nt, Pseudomonas aeruginosa PA01
gcaccacgccgcuggcg

SEQ ID NO: 1488216 - RNA, 17 nt, Pseudomonas aeruginosa PA01
gcaccacguagccggcg

SEQ ID NO: 1488217 - RNA, 15 nt, Pseudomonas aeruginosa PA01
gcaccacguucggcg

SEQ ID NO: 1488218 - RNA, 16 nt, Pseudomonas aeruginosa PA01
gcaccacguucggcgc

SEQ ID NO: 1488219 - RNA, 19 nt, Pseudomonas aeruginosa PA01
gcaccacguucggcgcggg

SEQ ID NO: 1488220 - RNA, 20 nt, Pseudomonas aeruginosa PA01
gcacccggcuggguucggcg

SEQ ID NO: 1488221 - RNA, 15 nt, Pseudomonas aeruginosa PA01
gcacccgcaccagcc

SEQ ID NO: 1488222 - RNA, 20 nt, Pseudomonas aeruginosa PA01
gcacccgcaccagccggcgc

SEQ ID NO: 1488223 - RNA, 19 nt, Pseudomonas aeruginosa PA01
gcacccggaccuuguccag

SEQ ID NO: 1488224 - RNA, 20 nt, Pseudomonas aeruginosa PA01
gcacccggcccauggcgacg

SEQ ID NO: 1488225 - RNA, 18 nt, Pseudomonas aeruginosa PA01
gcaccgagacgcccugga

SEQ ID NO: 1488226 - RNA, 20 nt, Pseudomonas aeruginosa PA01
gcaccgagacgcccuggaug

SEQ ID NO: 1488227 - RNA, 18 nt, Pseudomonas aeruginosa PA01
gcacccgguagccgauca

SEQ ID NO: 1488228 - RNA, 14 nt, Pseudomonas aeruginosa PA01
gcacccgggcgacc

SEQ ID NO: 1488229 - RNA, 18 nt, Pseudomonas aeruginosa PA01
gcacccgggcgaccugcu

SEQ ID NO: 1488230 - RNA, 15 nt, Pseudomonas aeruginosa PA01
gcaccgagcaggcac

SEQ ID NO: 1488231 - RNA, 19 nt, Pseudomonas aeruginosa PA01
gcaccgagcaggcacccgc

SEQ ID NO: 1488232 - RNA, 18 nt, Pseudomonas aeruginosa PA01
gcaccgaggcgcgccgac

SEQ ID NO: 1488233 - RNA, 20 nt, Pseudomonas aeruginosa PA01
gcaccgagggcauuuccugg

SEQ ID NO: 1488234 - RNA, 21 nt, Pseudomonas aeruginosa PA01
gcaccgauuuccccaaggcac

SEQ ID NO: 1488235 - RNA, 16 nt, Pseudomonas aeruginosa PA01
gcaccgagucggcaac

SEQ ID NO: 1488236 - RNA, 18 nt, Pseudomonas aeruginosa PA01
gcaccgaguugaccagca

SEQ ID NO: 1488237 - RNA, 18 nt, Pseudomonas aeruginosa PA01
gcaccgcgagcaugcuca

SEQ ID NO: 1488238 - RNA, 11 nt, Pseudomonas aeruginosa PA01
gcaccgcgccg

SEQ ID NO: 1488239 - RNA, 21 nt, Pseudomonas aeruginosa PA01
gcaccgccggguacagcgcca

SEQ ID NO: 1488240 - RNA, 23 nt, Pseudomonas aeruginosa PA01
gcaccgccggguacagcgccacg

SEQ ID NO: 1488241 - RNA, 14 nt, Pseudomonas aeruginosa PA01
gcaccgccugcaac

SEQ ID NO: 1488242 - RNA, 15 nt, Pseudomonas aeruginosa PA01
gcaccgccuggcgca

SEQ ID NO: 1488243 - RNA, 18 nt, Pseudomonas aeruginosa PA01
gcaccgccuggcgcaagg

SEQ ID NO: 1488244 - RNA, 15 nt, Pseudomonas aeruginosa PA01
gcaccgcuugccagc

SEQ ID NO: 1488245 - RNA, 22 nt, Pseudomonas aeruginosa PA01
gcaccgcuuucaccagggucgc

SEQ ID NO: 1488246 - RNA, 18 nt, Pseudomonas aeruginosa PA01
gcaccgcggucuucccgu

SEQ ID NO: 1488247 - RNA, 18 nt, Pseudomonas aeruginosa PA01
gcaccagcacggugcugg

SEQ ID NO: 1488248 - RNA, 22 nt, Pseudomonas aeruginosa PA01
gcaccagcacuuccggcgcgga

SEQ ID NO: 1488249 - RNA, 12 nt, Pseudomonas aeruginosa PA01
gcaccagccggc

SEQ ID NO: 1488250 - RNA, 15 nt, Pseudomonas aeruginosa PA01
gcaccagccggccgc

SEQ ID NO: 1488251 - RNA, 16 nt, Pseudomonas aeruginosa PA01
gcaccagccggccgcg

SEQ ID NO: 1488252 - RNA, 13 nt, Pseudomonas aeruginosa PA01
gcaccagccggcg

SEQ ID NO: 1488253 - RNA, 14 nt, Pseudomonas aeruginosa PA01
gcaccagccggcgc

SEQ ID NO: 1488254 - RNA, 16 nt, Pseudomonas aeruginosa PA01
gcaccagccggcgcuc

SEQ ID NO: 1488255 - RNA, 15 nt, Pseudomonas aeruginosa PA01
gcaccagcaggccga

SEQ ID NO: 1488256 - RNA, 22 nt, Pseudomonas aeruginosa PA01
gcaccagcaggccgaucaccag

SEQ ID NO: 1488257 - RNA, 18 nt, Pseudomonas aeruginosa PA01
gcaccagcaggcgcaacc

SEQ ID NO: 1488258 - RNA, 15 nt, Pseudomonas aeruginosa PA01
gcaccagcaggucgg

SEQ ID NO: 1488259 - RNA, 18 nt, Pseudomonas aeruginosa PA01
gcaccagcaggucggcgc

SEQ ID NO: 1488260 - RNA, 20 nt, Pseudomonas aeruginosa PA01
gcaccagcaggucggcgcga

SEQ ID NO: 1488261 - RNA, 21 nt, Pseudomonas aeruginosa PA01
gcaccagcgggucgucgaagc

SEQ ID NO: 1488262 - RNA, 19 nt, Pseudomonas aeruginosa PA01
gcaccagcgguacguagcg

SEQ ID NO: 1488263 - RNA, 18 nt, Pseudomonas aeruginosa PA01
gcaccaggccaggugguc

SEQ ID NO: 1488264 - RNA, 12 nt, Pseudomonas aeruginosa PA01
gcaccaggcccu

SEQ ID NO: 1488265 - RNA, 14 nt, Pseudomonas aeruginosa PA01
gcaccaggccgcca

SEQ ID NO: 1488266 - RNA, 15 nt, Pseudomonas aeruginosa PA01
gcaccaggccgccau

SEQ ID NO: 1488267 - RNA, 21 nt, Pseudomonas aeruginosa PA01
gcaccaggccgccaugcucgg

SEQ ID NO: 1488268 - RNA, 20 nt, Pseudomonas aeruginosa PA01
gcacccagaccuuccagccg

SEQ ID NO: 1488269 - RNA, 13 nt, Pseudomonas aeruginosa PA01
gcaccaggcucgc

SEQ ID NO: 1488270 - RNA, 22 nt, Pseudomonas aeruginosa PA01
gcaccaggcucgccccggcggc

SEQ ID NO: 1488271 - RNA, 15 nt, Pseudomonas aeruginosa PA01
gcaccaggcuggcca

SEQ ID NO: 1488272 - RNA, 16 nt, Pseudomonas aeruginosa PA01
gcaccagggccaggag

SEQ ID NO: 1488273 - RNA, 18 nt, Pseudomonas aeruginosa PA01
gcaccagggccaggagca

SEQ ID NO: 1488274 - RNA, 20 nt, Pseudomonas aeruginosa PA01
gcaccaggguaucgcugucg

SEQ ID NO: 1488275 - RNA, 19 nt, Pseudomonas aeruginosa PA01
gcaccagggucgggccgcg

SEQ ID NO: 1488276 - RNA, 21 nt, Pseudomonas aeruginosa PA01
gcaccagggucgggccgcgcu

SEQ ID NO: 1488277 - RNA, 15 nt, Pseudomonas aeruginosa PA01
gcaccaggucgcgcu

SEQ ID NO: 1488278 - RNA, 18 nt, Pseudomonas aeruginosa PA01
gcaccaggucgcgcuugu

SEQ ID NO: 1488279 - RNA, 17 nt, Pseudomonas aeruginosa PA01
gcaccaugcagcggcau

SEQ ID NO: 1488280 - RNA, 22 nt, Pseudomonas aeruginosa PA01
gcaccaugcagcggcaugguca

SEQ ID NO: 1488281 - RNA, 13 nt, Pseudomonas aeruginosa PA01
gcaccaugccgau

SEQ ID NO: 1488282 - RNA, 18 nt, Pseudomonas aeruginosa PA01
gcaccuguuucagcgggu

SEQ ID NO: 1488283 - RNA, 19 nt, Pseudomonas aeruginosa PA01
gcaccuguuccagcaacgc

SEQ ID NO: 1488284 - RNA, 21 nt, Pseudomonas aeruginosa PA01
gcaccuguuccagcaacgccu

SEQ ID NO: 1488285 - RNA, 21 nt, Pseudomonas aeruginosa PA01
gcaccugguggacacccugcu

SEQ ID NO: 1488286 - RNA, 23 nt, Pseudomonas aeruginosa PA01
gcaccugggcguuggccagcgcc

SEQ ID NO: 1488287 - RNA, 20 nt, Pseudomonas aeruginosa PA01
gcaccuggcggucgccgccg

SEQ ID NO: 1488288 - RNA, 21 nt, Pseudomonas aeruginosa PA01
gcaccuggcggucgccgccgg

SEQ ID NO: 1488289 - RNA, 23 nt, Pseudomonas aeruginosa PA01
gcaccuggcggucgccgccggcg

SEQ ID NO: 1488290 - RNA, 14 nt, Pseudomonas aeruginosa PA01
gcaccuggcgaugc

SEQ ID NO: 1488291 - RNA, 18 nt, Pseudomonas aeruginosa PA01
gcaccuggcgaugcccug

SEQ ID NO: 1488292 - RNA, 23 nt, Pseudomonas aeruginosa PA01
gcaccuggcgaugcccuggccgc

SEQ ID NO: 1488293 - RNA, 19 nt, Pseudomonas aeruginosa PA01
gcaccggccacucgcagcc

SEQ ID NO: 1488294 - RNA, 12 nt, Pseudomonas aeruginosa PA01
gcaccggccagg

SEQ ID NO: 1488295 - RNA, 22 nt, Pseudomonas aeruginosa PA01
gcaccggccaggcgcuggucca

SEQ ID NO: 1488296 - RNA, 22 nt, Pseudomonas aeruginosa PA01
gcaccggcauguagcgcgccga

SEQ ID NO: 1488297 - RNA, 24 nt, Pseudomonas aeruginosa PA01
gcaccggcauguagcgcgccgagg

SEQ ID NO: 1488298 - RNA, 19 nt, Pseudomonas aeruginosa PA01
gcaccugcgggcugcgugc

SEQ ID NO: 1488299 - RNA, 17 nt, Pseudomonas aeruginosa PA01
gcaccuggcagugcgcc

SEQ ID NO: 1488300 - RNA, 20 nt, Pseudomonas aeruginosa PA01
gcaccuggcagugcgccggc

SEQ ID NO: 1488301 - RNA, 21 nt, Pseudomonas aeruginosa PA01
gcaccuggcagugcgccggca

SEQ ID NO: 1488302 - RNA, 20 nt, Pseudomonas aeruginosa PA01
gcacgaauuuccuggcgcgu

SEQ ID NO: 1488303 - RNA, 15 nt, Pseudomonas aeruginosa PA01
gcacgaaccguccgc

SEQ ID NO: 1488304 - RNA, 21 nt, Pseudomonas aeruginosa PA01
gcaccuucaucaccaggucgc

SEQ ID NO: 1488305 - RNA, 22 nt, Pseudomonas aeruginosa PA01
gcaccuucaucaccaggucgcu

SEQ ID NO: 1488306 - RNA, 17 nt, Pseudomonas aeruginosa PA01
gcacgaacccaggcgcu

SEQ ID NO: 1488307 - RNA, 18 nt, Pseudomonas aeruginosa PA01
gcacgaccacaucggcca

SEQ ID NO: 1488308 - RNA, 18 nt, Pseudomonas aeruginosa PA01
gcacgagucgaggcgaug

SEQ ID NO: 1488309 - RNA, 18 nt, Pseudomonas aeruginosa PA01
gcacgaggcgggcuggaa

SEQ ID NO: 1488310 - RNA, 20 nt, Pseudomonas aeruginosa PA01
gcacgccgugcaucaccggc

SEQ ID NO: 1488311 - RNA, 21 nt, Pseudomonas aeruginosa PA01
gcacgccgugcaucaccggca

SEQ ID NO: 1488312 - RNA, 12 nt, Pseudomonas aeruginosa PA01
gcacgccggugg

SEQ ID NO: 1488313 - RNA, 19 nt, Pseudomonas aeruginosa PA01
gcacgccgguggccaggcu

SEQ ID NO: 1488314 - RNA, 20 nt, Pseudomonas aeruginosa PA01
gcacgccgguggccaggcuc

SEQ ID NO: 1488315 - RNA, 21 nt, Pseudomonas aeruginosa PA01
gcacgccgguggccaggcucu

SEQ ID NO: 1488316 - RNA, 22 nt, Pseudomonas aeruginosa PA01
gcacgccccauccgggcggcgg

SEQ ID NO: 1488317 - RNA, 15 nt, Pseudomonas aeruginosa PA01
gcacgaugaggcgug

SEQ ID NO: 1488318 - RNA, 15 nt, Pseudomonas aeruginosa PA01
gcacgcccaucgcca

SEQ ID NO: 1488319 - RNA, 19 nt, Pseudomonas aeruginosa PA01
gcacggcaucgauccgcac

SEQ ID NO: 1488320 - RNA, 13 nt, Pseudomonas aeruginosa PA01
gcacggccaggcc

SEQ ID NO: 1488321 - RNA, 21 nt, Pseudomonas aeruginosa PA01
gcacggccaggccacggccgg

SEQ ID NO: 1488322 - RNA, 23 nt, Pseudomonas aeruginosa PA01
gcacggccaggccacggccggcg

SEQ ID NO: 1488323 - RNA, 18 nt, Pseudomonas aeruginosa PA01
gcacggccagucgcguug

SEQ ID NO: 1488324 - RNA, 18 nt, Pseudomonas aeruginosa PA01
gcacggcgaauucgucgc

SEQ ID NO: 1488325 - RNA, 19 nt, Pseudomonas aeruginosa PA01
gcacggcgaauucgucgcc

SEQ ID NO: 1488326 - RNA, 12 nt, Pseudomonas aeruginosa PA01
gcacggccgucc

SEQ ID NO: 1488327 - RNA, 19 nt, Pseudomonas aeruginosa PA01
gcacggcgauacccaggcc

SEQ ID NO: 1488328 - RNA, 23 nt, Pseudomonas aeruginosa PA01
gcacggcgauacccaggccgucg

SEQ ID NO: 1488329 - RNA, 18 nt, Pseudomonas aeruginosa PA01
gcacggcgacccgcacgu

SEQ ID NO: 1488330 - RNA, 22 nt, Pseudomonas aeruginosa PA01
gcacggcgacccgcacguugag

SEQ ID NO: 1488331 - RNA, 21 nt, Pseudomonas aeruginosa PA01
gcacggcgacgcugucgugga

SEQ ID NO: 1488332 - RNA, 23 nt, Pseudomonas aeruginosa PA01
gcacgcucuguuucgggucgccc

SEQ ID NO: 1488333 - RNA, 18 nt, Pseudomonas aeruginosa PA01
gcacgcugacgccggcac

SEQ ID NO: 1488334 - RNA, 13 nt, Pseudomonas aeruginosa PA01
gcacgcugaagau

SEQ ID NO: 1488335 - RNA, 20 nt, Pseudomonas aeruginosa PA01
gcacgcugaagaucgccacg

SEQ ID NO: 1488336 - RNA, 14 nt, Pseudomonas aeruginosa PA01
gcacgcucaggcgc

SEQ ID NO: 1488337 - RNA, 15 nt, Pseudomonas aeruginosa PA01
gcacgcgccgggucg

SEQ ID NO: 1488338 - RNA, 16 nt, Pseudomonas aeruginosa PA01
gcacgcgccgggucgg

SEQ ID NO: 1488339 - RNA, 16 nt, Pseudomonas aeruginosa PA01
gcacggcaacgucgcg

SEQ ID NO: 1488340 - RNA, 20 nt, Pseudomonas aeruginosa PA01
gcacggcaacgucgcggaug

SEQ ID NO: 1488341 - RNA, 16 nt, Pseudomonas aeruginosa PA01
gcacgcugccgccgau

SEQ ID NO: 1488342 - RNA, 18 nt, Pseudomonas aeruginosa PA01
gcacgcugccgccgaugc

SEQ ID NO: 1488343 - RNA, 15 nt, Pseudomonas aeruginosa PA01
gcacgcugccagcag

SEQ ID NO: 1488344 - RNA, 13 nt, Pseudomonas aeruginosa PA01
gcacgcugcgccg

SEQ ID NO: 1488345 - RNA, 16 nt, Pseudomonas aeruginosa PA01
gcacgcugcgccggcg

SEQ ID NO: 1488346 - RNA, 17 nt, Pseudomonas aeruginosa PA01
gcacgcugcgccggcgc

SEQ ID NO: 1488347 - RNA, 18 nt, Pseudomonas aeruginosa PA01
gcacgcugcgccggcgcu

SEQ ID NO: 1488348 - RNA, 20 nt, Pseudomonas aeruginosa PA01
gcacgcugcgccggcgcugc

SEQ ID NO: 1488349 - RNA, 15 nt, Pseudomonas aeruginosa PA01
gcacgucgcggauca

SEQ ID NO: 1488350 - RNA, 16 nt, Pseudomonas aeruginosa PA01
gcacgucgccuucgcu

SEQ ID NO: 1488351 - RNA, 20 nt, Pseudomonas aeruginosa PA01
gcacgucgccuucgcugaga

SEQ ID NO: 1488352 - RNA, 14 nt, Pseudomonas aeruginosa PA01
gcacguagccgccc

SEQ ID NO: 1488353 - RNA, 15 nt, Pseudomonas aeruginosa PA01
gcacguagccgcccu

SEQ ID NO: 1488354 - RNA, 17 nt, Pseudomonas aeruginosa PA01
gcacggugaaccaggcg

SEQ ID NO: 1488355 - RNA, 18 nt, Pseudomonas aeruginosa PA01
gcacggugaaccaggcgc

SEQ ID NO: 1488356 - RNA, 21 nt, Pseudomonas aeruginosa PA01
gcacggugaaccaggcgccga

SEQ ID NO: 1488357 - RNA, 12 nt, Pseudomonas aeruginosa PA01
gcacgguccgcg

SEQ ID NO: 1488358 - RNA, 17 nt, Pseudomonas aeruginosa PA01
gcacgguccgcgaaccg

SEQ ID NO: 1488359 - RNA, 12 nt, Pseudomonas aeruginosa PA01
gcacggcgcggg

SEQ ID NO: 1488360 - RNA, 14 nt, Pseudomonas aeruginosa PA01
gcacggcgcgggug

SEQ ID NO: 1488361 - RNA, 18 nt, Pseudomonas aeruginosa PA01
gcacggcgaacaccgggc

SEQ ID NO: 1488362 - RNA, 16 nt, Pseudomonas aeruginosa PA01
gcacggggcgccuguc

SEQ ID NO: 1488363 - RNA, 13 nt, Pseudomonas aeruginosa PA01
gcagcaagccgca

SEQ ID NO: 1488364 - RNA, 15 nt, Pseudomonas aeruginosa PA01
gcagcaacuggucgc

SEQ ID NO: 1488365 - RNA, 21 nt, Pseudomonas aeruginosa PA01
gcagcaacggcgcaucgucga

SEQ ID NO: 1488366 - RNA, 16 nt, Pseudomonas aeruginosa PA01
gcagcaacagcgccgc

SEQ ID NO: 1488367 - RNA, 16 nt, Pseudomonas aeruginosa PA01
gcagcaacccggccca

SEQ ID NO: 1488368 - RNA, 20 nt, Pseudomonas aeruginosa PA01
gcagcaacccggcccagcgu

SEQ ID NO: 1488369 - RNA, 16 nt, Pseudomonas aeruginosa PA01
gcagauggucgccgga

SEQ ID NO: 1488370 - RNA, 18 nt, Pseudomonas aeruginosa PA01
gcagaugucguucuugcg

SEQ ID NO: 1488371 - RNA, 15 nt, Pseudomonas aeruginosa PA01
gcagauuccuggacc

SEQ ID NO: 1488372 - RNA, 16 nt, Pseudomonas aeruginosa PA01
gcagauuccuggaccc

SEQ ID NO: 1488373 - RNA, 12 nt, Pseudomonas aeruginosa PA01
gcagacgucgag

SEQ ID NO: 1488374 - RNA, 18 nt, Pseudomonas aeruginosa PA01
gcagacgucgagguaguc

SEQ ID NO: 1488375 - RNA, 19 nt, Pseudomonas aeruginosa PA01
gcagacguggcauucgucg

SEQ ID NO: 1488376 - RNA, 16 nt, Pseudomonas aeruginosa PA01
gcagaccagcagcgca

SEQ ID NO: 1488377 - RNA, 15 nt, Pseudomonas aeruginosa PA01
gcagaccagcgaacc

SEQ ID NO: 1488378 - RNA, 13 nt, Pseudomonas aeruginosa PA01
gcagaccaggccg

SEQ ID NO: 1488379 - RNA, 22 nt, Pseudomonas aeruginosa PA01
gcagacaggccuccagcaacgc

SEQ ID NO: 1488380 - RNA, 16 nt, Pseudomonas aeruginosa PA01
gcagacaccaccaggu

SEQ ID NO: 1488381 - RNA, 15 nt, Pseudomonas aeruginosa PA01
gcagacaucgccgag

SEQ ID NO: 1488382 - RNA, 16 nt, Pseudomonas aeruginosa PA01
gcagacaucgccgagg

SEQ ID NO: 1488383 - RNA, 18 nt, Pseudomonas aeruginosa PA01
gcagagcggcaggccgcc

SEQ ID NO: 1488384 - RNA, 19 nt, Pseudomonas aeruginosa PA01
gcagagcggcaggccgccg

SEQ ID NO: 1488385 - RNA, 21 nt, Pseudomonas aeruginosa PA01
gcagagcggcaggccgccgau

SEQ ID NO: 1488386 - RNA, 18 nt, Pseudomonas aeruginosa PA01
gcagaggcgcuccaccag

SEQ ID NO: 1488387 - RNA, 21 nt, Pseudomonas aeruginosa PA01
gcagaggcgcuccaccagggc

SEQ ID NO: 1488388 - RNA, 14 nt, Pseudomonas aeruginosa PA01
gcagagcgccagcc

SEQ ID NO: 1488389 - RNA, 20 nt, Pseudomonas aeruginosa PA01
gcagagcgccagccagcgcg

SEQ ID NO: 1488390 - RNA, 22 nt, Pseudomonas aeruginosa PA01
gcagagcgccagccagcgcggc

SEQ ID NO: 1488391 - RNA, 19 nt, Pseudomonas aeruginosa PA01
gcagagcgccaugacccgc

SEQ ID NO: 1488392 - RNA, 21 nt, Pseudomonas aeruginosa PA01
aacuuguagggcucguugaug

SEQ ID NO: 1488393 - RNA, 14 nt, Pseudomonas aeruginosa PA01
gcagaaccgccagc

SEQ ID NO: 1488394 - RNA, 16 nt, Pseudomonas aeruginosa PA01
gcacuuguugguaugg

SEQ ID NO: 1488395 - RNA, 20 nt, Pseudomonas aeruginosa PA01
gcacuuguugguauggcagc

SEQ ID NO: 1488396 - RNA, 20 nt, Pseudomonas aeruginosa PA01
gcacuggcccucucucgccu

SEQ ID NO: 1488397 - RNA, 15 nt, Pseudomonas aeruginosa PA01
gcacuggucggccag

SEQ ID NO: 1488398 - RNA, 23 nt, Pseudomonas aeruginosa PA01
gcacuggucggccaguuccuuca

SEQ ID NO: 1488399 - RNA, 22 nt, Pseudomonas aeruginosa PA01
gcacugguggacggucucgccg

SEQ ID NO: 1488400 - RNA, 18 nt, Pseudomonas aeruginosa PA01
gcacugguggcgaacagc

SEQ ID NO: 1488401 - RNA, 19 nt, Pseudomonas aeruginosa PA01
gcacugguggcgaacagca

SEQ ID NO: 1488402 - RNA, 12 nt, Pseudomonas aeruginosa PA01
gcacuucggcgc

SEQ ID NO: 1488403 - RNA, 18 nt, Pseudomonas aeruginosa PA01
gcacuucguccaggccgc

SEQ ID NO: 1488404 - RNA, 20 nt, Pseudomonas aeruginosa PA01
gcacuucguccaggccgccu

SEQ ID NO: 1488405 - RNA, 16 nt, Pseudomonas aeruginosa PA01
gcacuucguccgccac

SEQ ID NO: 1488406 - RNA, 16 nt, Pseudomonas aeruginosa PA01
gcacuucucgaacagc

SEQ ID NO: 1488407 - RNA, 18 nt, Pseudomonas aeruginosa PA01
gcacuuccacuccaggcg

SEQ ID NO: 1488408 - RNA, 22 nt, Pseudomonas aeruginosa PA01
gcacuuccacuccaggcggcgg

SEQ ID NO: 1488409 - RNA, 21 nt, Pseudomonas aeruginosa PA01
gcacuucccaggugcccugga

SEQ ID NO: 1488410 - RNA, 15 nt, Pseudomonas aeruginosa PA01
gcacuuccggcgcgg

SEQ ID NO: 1488411 - RNA, 15 nt, Pseudomonas aeruginosa PA01
gcacuuccucggcga

SEQ ID NO: 1488412 - RNA, 19 nt, Pseudomonas aeruginosa PA01
gcacuuccugaaggcgcgg

SEQ ID NO: 1488413 - RNA, 21 nt, Pseudomonas aeruginosa PA01
gcacgucgguucagcgcggag

SEQ ID NO: 1488414 - RNA, 14 nt, Pseudomonas aeruginosa PA01
gcacgugcagcggc

SEQ ID NO: 1488415 - RNA, 19 nt, Pseudomonas aeruginosa PA01
gcacgucguccagcgccga

SEQ ID NO: 1488416 - RNA, 18 nt, Pseudomonas aeruginosa PA01
gcacgucuugcaggcuca

SEQ ID NO: 1488417 - RNA, 16 nt, Pseudomonas aeruginosa PA01
gcacucauagcucagc

SEQ ID NO: 1488418 - RNA, 23 nt, Pseudomonas aeruginosa PA01
gcacucaggaaaaaacgccgguc

SEQ ID NO: 1488419 - RNA, 14 nt, Pseudomonas aeruginosa PA01
gcacugccaggagc

SEQ ID NO: 1488420 - RNA, 20 nt, Pseudomonas aeruginosa PA01
gcacugccaggagcacgccg

SEQ ID NO: 1488421 - RNA, 22 nt, Pseudomonas aeruginosa PA01
gcacugccaggagcacgccgug

SEQ ID NO: 1488422 - RNA, 18 nt, Pseudomonas aeruginosa PA01
gcacucgcuccuccgggc

SEQ ID NO: 1488423 - RNA, 23 nt, Pseudomonas aeruginosa PA01
gcacucggcgaccacccggcggu

SEQ ID NO: 1488424 - RNA, 18 nt, Pseudomonas aeruginosa PA01
gcacuccggcauaccgcc

SEQ ID NO: 1488425 - RNA, 13 nt, Pseudomonas aeruginosa PA01
gcacucgccgggc

SEQ ID NO: 1488426 - RNA, 23 nt, Pseudomonas aeruginosa PA01
gcacugagggucagccgcaggcc

SEQ ID NO: 1488427 - RNA, 15 nt, Pseudomonas aeruginosa PA01
gcagcuccggcagca

SEQ ID NO: 1488428 - RNA, 16 nt, Pseudomonas aeruginosa PA01
gcagcuccggcgggcg

SEQ ID NO: 1488429 - RNA, 23 nt, Pseudomonas aeruginosa PA01
gcagcuccgggcuggccaccagc

SEQ ID NO: 1488430 - RNA, 18 nt, Pseudomonas aeruginosa PA01
gcagcucccuugccgccg

SEQ ID NO: 1488431 - RNA, 19 nt, Pseudomonas aeruginosa PA01
gcagcucccuugccgccgg

SEQ ID NO: 1488432 - RNA, 22 nt, Pseudomonas aeruginosa PA01
gcagcucccuugccgccgguuc

SEQ ID NO: 1488433 - RNA, 13 nt, Pseudomonas aeruginosa PA01
gcagcuccaccga

SEQ ID NO: 1488434 - RNA, 19 nt, Pseudomonas aeruginosa PA01
gcagcuccaccgauggcgc

SEQ ID NO: 1488435 - RNA, 18 nt, Pseudomonas aeruginosa PA01
gcagcguuccagcgcugg

SEQ ID NO: 1488436 - RNA, 13 nt, Pseudomonas aeruginosa PA01
gcagcucgccgcu

SEQ ID NO: 1488437 - RNA, 14 nt, Pseudomonas aeruginosa PA01
gcagcucgccggcg

SEQ ID NO: 1488438 - RNA, 16 nt, Pseudomonas aeruginosa PA01
gcagcucgccggcguc

SEQ ID NO: 1488439 - RNA, 19 nt, Pseudomonas aeruginosa PA01
gcagcucgccggcguccuc

SEQ ID NO: 1488440 - RNA, 13 nt, Pseudomonas aeruginosa PA01
gcagcucggcacg

SEQ ID NO: 1488441 - RNA, 13 nt, Pseudomonas aeruginosa PA01
gcagcucggccug

SEQ ID NO: 1488442 - RNA, 21 nt, Pseudomonas aeruginosa PA01
gcagcucggccugguccggca

SEQ ID NO: 1488443 - RNA, 24 nt, Pseudomonas aeruginosa PA01
gcagcucggccugguccggcacuu

SEQ ID NO: 1488444 - RNA, 22 nt, Pseudomonas aeruginosa PA01
gcagcucggcgacauagccggc

SEQ ID NO: 1488445 - RNA, 23 nt, Pseudomonas aeruginosa PA01
gcagcggguccuggguggcgacg

SEQ ID NO: 1488446 - RNA, 17 nt, Pseudomonas aeruginosa PA01
gcagcgggcguccggcg

SEQ ID NO: 1488447 - RNA, 21 nt, Pseudomonas aeruginosa PA01
gcagcgggccaggcgguauuc

SEQ ID NO: 1488448 - RNA, 15 nt, Pseudomonas aeruginosa PA01
gcagcggcuggccgu

SEQ ID NO: 1488449 - RNA, 20 nt, Pseudomonas aeruginosa PA01
gcagcggcuggccgucgacc

SEQ ID NO: 1488450 - RNA, 22 nt, Pseudomonas aeruginosa PA01
gcagcggcuggccgucgacccg

SEQ ID NO: 1488451 - RNA, 16 nt, Pseudomonas aeruginosa PA01
gcagcgguacggucga

SEQ ID NO: 1488452 - RNA, 19 nt, Pseudomonas aeruginosa PA01
gcagcggugaagguccgcg

SEQ ID NO: 1488453 - RNA, 22 nt, Pseudomonas aeruginosa PA01
gcagcggugaagguccgcgcca

SEQ ID NO: 1488454 - RNA, 14 nt, Pseudomonas aeruginosa PA01
gcagcggucgccgg

SEQ ID NO: 1488455 - RNA, 15 nt, Pseudomonas aeruginosa PA01
gcagcggucgccggu

SEQ ID NO: 1488456 - RNA, 19 nt, Pseudomonas aeruginosa PA01
gcagcgucucggcugccgc

SEQ ID NO: 1488457 - RNA, 21 nt, Pseudomonas aeruginosa PA01
gcagcgucucggcugccgcca

SEQ ID NO: 1488458 - RNA, 20 nt, Pseudomonas aeruginosa PA01
gcagcgugcucacggcauuc

SEQ ID NO: 1488459 - RNA, 23 nt, Pseudomonas aeruginosa PA01
gcagcguccgaacgcgcugacgg

SEQ ID NO: 1488460 - RNA, 16 nt, Pseudomonas aeruginosa PA01
gcagcgucgccgggcg

SEQ ID NO: 1488461 - RNA, 23 nt, Pseudomonas aeruginosa PA01
gcagcgucguagagcgugcggcc

SEQ ID NO: 1488462 - RNA, 17 nt, Pseudomonas aeruginosa PA01
gcagcguccugcccucc

SEQ ID NO: 1488463 - RNA, 15 nt, Pseudomonas aeruginosa PA01
gcagcgucgacgccg

SEQ ID NO: 1488464 - RNA, 18 nt, Pseudomonas aeruginosa PA01
gcagcgucgacgccgagc

SEQ ID NO: 1488465 - RNA, 20 nt, Pseudomonas aeruginosa PA01
gcagcgucgacgccgagcug

SEQ ID NO: 1488466 - RNA, 21 nt, Pseudomonas aeruginosa PA01
gcagcgucgagcuggcgcagg

SEQ ID NO: 1488467 - RNA, 16 nt, Pseudomonas aeruginosa PA01
gcaggaccgccauggc

SEQ ID NO: 1488468 - RNA, 18 nt, Pseudomonas aeruginosa PA01
gcaggaccgccauggcgc

SEQ ID NO: 1488469 - RNA, 18 nt, Pseudomonas aeruginosa PA01
gcaggaccacgcugguca

SEQ ID NO: 1488470 - RNA, 23 nt, Pseudomonas aeruginosa PA01
gcaggacagcagggucgcgccgu

SEQ ID NO: 1488471 - RNA, 13 nt, Pseudomonas aeruginosa PA01
gcaggaaggcgac

SEQ ID NO: 1488472 - RNA, 19 nt, Pseudomonas aeruginosa PA01
gcaggaaaacgcucaggcc

SEQ ID NO: 1488473 - RNA, 20 nt, Pseudomonas aeruginosa PA01
gcaggaaaacgcucaggcca

SEQ ID NO: 1488474 - RNA, 15 nt, Pseudomonas aeruginosa PA01
gcaggaaauccgccg

SEQ ID NO: 1488475 - RNA, 12 nt, Pseudomonas aeruginosa PA01
gcaggaacagcc

SEQ ID NO: 1488476 - RNA, 22 nt, Pseudomonas aeruginosa PA01
gcaggaacucgaucagcgcggc

SEQ ID NO: 1488477 - RNA, 22 nt, Pseudomonas aeruginosa PA01
gcaggaacuggucgauccgcgc

SEQ ID NO: 1488478 - RNA, 13 nt, Pseudomonas aeruginosa PA01
gcaggaagaagcc

SEQ ID NO: 1488479 - RNA, 14 nt, Pseudomonas aeruginosa PA01
gcaggaagaagccg

SEQ ID NO: 1488480 - RNA, 16 nt, Pseudomonas aeruginosa PA01
gcaggaagaagccgau

SEQ ID NO: 1488481 - RNA, 12 nt, Pseudomonas aeruginosa PA01
gcaggaagccga

SEQ ID NO: 1488482 - RNA, 14 nt, Pseudomonas aeruginosa PA01
gcaggaagcgccgg

SEQ ID NO: 1488483 - RNA, 18 nt, Pseudomonas aeruginosa PA01
gcaggaacgcccgcggca

SEQ ID NO: 1488484 - RNA, 21 nt, Pseudomonas aeruginosa PA01
gcaggaacgcccgcggcagca

SEQ ID NO: 1488485 - RNA, 22 nt, Pseudomonas aeruginosa PA01
gcaggaacgcccgcggcagcag

SEQ ID NO: 1488486 - RNA, 19 nt, Pseudomonas aeruginosa PA01
gcaggacgucgaggucgac

SEQ ID NO: 1488487 - RNA, 21 nt, Pseudomonas aeruginosa PA01
gcaggacgucguagccaggca

SEQ ID NO: 1488488 - RNA, 13 nt, Pseudomonas aeruginosa PA01
gcaggaccuggcc

SEQ ID NO: 1488489 - RNA, 14 nt, Pseudomonas aeruginosa PA01
gcaggaccuggccg

SEQ ID NO: 1488490 - RNA, 14 nt, Pseudomonas aeruginosa PA01
gcaggaccuggcug

SEQ ID NO: 1488491 - RNA, 17 nt, Pseudomonas aeruginosa PA01
gcaggaccuggcugagg

SEQ ID NO: 1488492 - RNA, 18 nt, Pseudomonas aeruginosa PA01
gcaggacgaagucgccgg

SEQ ID NO: 1488493 - RNA, 19 nt, Pseudomonas aeruginosa PA01
gcaggacgaugaucaccag

SEQ ID NO: 1488494 - RNA, 19 nt, Pseudomonas aeruginosa PA01
gcaggacgccgaacccgcc

SEQ ID NO: 1488495 - RNA, 14 nt, Pseudomonas aeruginosa PA01
gcaggagaagcgcc

SEQ ID NO: 1488496 - RNA, 16 nt, Pseudomonas aeruginosa PA01
gcaggacccaucgaug

SEQ ID NO: 1488497 - RNA, 12 nt, Pseudomonas aeruginosa PA01
gcaggacccgcg

SEQ ID NO: 1488498 - RNA, 22 nt, Pseudomonas aeruginosa PA01
gcaggagcgccaucagcgacca

SEQ ID NO: 1488499 - RNA, 22 nt, Pseudomonas aeruginosa PA01
gcaggagcaugucuucgucgcg

SEQ ID NO: 1488500 - RNA, 19 nt, Pseudomonas aeruginosa PA01
gcaggauaucgcccagggc

SEQ ID NO: 1488501 - RNA, 21 nt, Pseudomonas aeruginosa PA01
gcaggauaucgcccagggcca

SEQ ID NO: 1488502 - RNA, 16 nt, Pseudomonas aeruginosa PA01
gcaggaucaggcucga

SEQ ID NO: 1488503 - RNA, 18 nt, Pseudomonas aeruginosa PA01
gcaggaggauacggcgca

SEQ ID NO: 1488504 - RNA, 17 nt, Pseudomonas aeruginosa PA01
gcaggaucggcgcgguc

SEQ ID NO: 1488505 - RNA, 14 nt, Pseudomonas aeruginosa PA01
gcaggaucgacagc

SEQ ID NO: 1488506 - RNA, 16 nt, Pseudomonas aeruginosa PA01
gcaggaucgacagcag

SEQ ID NO: 1488507 - RNA, 18 nt, Pseudomonas aeruginosa PA01
gcaggaucgacagcagcg

SEQ ID NO: 1488508 - RNA, 22 nt, Pseudomonas aeruginosa PA01
gcagcuugugggcaugcucggc

SEQ ID NO: 1488509 - RNA, 14 nt, Pseudomonas aeruginosa PA01
gcagcuuggcgguc

SEQ ID NO: 1488510 - RNA, 23 nt, Pseudomonas aeruginosa PA01
gcagcuuggcgaauagccggcgc

SEQ ID NO: 1488511 - RNA, 14 nt, Pseudomonas aeruginosa PA01
gcagcuuggcgacg

SEQ ID NO: 1488512 - RNA, 20 nt, Pseudomonas aeruginosa PA01
gcagcuugccggcauagccg

SEQ ID NO: 1488513 - RNA, 21 nt, Pseudomonas aeruginosa PA01
gcagcuugccuuccaggcugu

SEQ ID NO: 1488514 - RNA, 14 nt, Pseudomonas aeruginosa PA01
gcagcuugcgcgcc

SEQ ID NO: 1488515 - RNA, 17 nt, Pseudomonas aeruginosa PA01
gcagcuugcgcgccagg

SEQ ID NO: 1488516 - RNA, 20 nt, Pseudomonas aeruginosa PA01
gcagcuucuccagggaaacc

SEQ ID NO: 1488517 - RNA, 21 nt, Pseudomonas aeruginosa PA01
gcagcuucggcgcgacgcuac

SEQ ID NO: 1488518 - RNA, 16 nt, Pseudomonas aeruginosa PA01
gcagcucguucgccca

SEQ ID NO: 1488519 - RNA, 18 nt, Pseudomonas aeruginosa PA01
gcagcucguugcacagcg

SEQ ID NO: 1488520 - RNA, 23 nt, Pseudomonas aeruginosa PA01
gcagcucguugcacagcgcccag

SEQ ID NO: 1488521 - RNA, 21 nt, Pseudomonas aeruginosa PA01
gcagcucggugagcaggcgcc

SEQ ID NO: 1488522 - RNA, 15 nt, Pseudomonas aeruginosa PA01
gcagcucugcgauca

SEQ ID NO: 1488523 - RNA, 16 nt, Pseudomonas aeruginosa PA01
gcagcuggauccgugc

SEQ ID NO: 1488524 - RNA, 12 nt, Pseudomonas aeruginosa PA01
gcagcgccgcga

SEQ ID NO: 1488525 - RNA, 14 nt, Pseudomonas aeruginosa PA01
gcagcgcgcgccga

SEQ ID NO: 1488526 - RNA, 15 nt, Pseudomonas aeruginosa PA01
gcagcgcgcgccgag

SEQ ID NO: 1488527 - RNA, 15 nt, Pseudomonas aeruginosa PA01
gcagcgcgcggccag

SEQ ID NO: 1488528 - RNA, 15 nt, Pseudomonas aeruginosa PA01
gcagcgcgcgucggu

SEQ ID NO: 1488529 - RNA, 15 nt, Pseudomonas aeruginosa PA01
gcagcgcgcggcucg

SEQ ID NO: 1488530 - RNA, 13 nt, Pseudomonas aeruginosa PA01
gcagcgcgcgcug

SEQ ID NO: 1488531 - RNA, 23 nt, Pseudomonas aeruginosa PA01
gcagcgcggucauccgcccugcg

SEQ ID NO: 1488532 - RNA, 15 nt, Pseudomonas aeruginosa PA01
gcagcgcggcgcugg

SEQ ID NO: 1488533 - RNA, 12 nt, Pseudomonas aeruginosa PA01
gcagcgcggcgg

SEQ ID NO: 1488534 - RNA, 13 nt, Pseudomonas aeruginosa PA01
gcagcgcggcggc

SEQ ID NO: 1488535 - RNA, 15 nt, Pseudomonas aeruginosa PA01
gcagcgcggcggcgg

SEQ ID NO: 1488536 - RNA, 23 nt, Pseudomonas aeruginosa PA01
gcagcgcggcggcggccagcagc

SEQ ID NO: 1488537 - RNA, 15 nt, Pseudomonas aeruginosa PA01
gcagcgccgcgccug

SEQ ID NO: 1488538 - RNA, 16 nt, Pseudomonas aeruginosa PA01
gcagcgccgcgccugc

SEQ ID NO: 1488539 - RNA, 13 nt, Pseudomonas aeruginosa PA01
gcagcgccgcgcg

SEQ ID NO: 1488540 - RNA, 14 nt, Pseudomonas aeruginosa PA01
gcagcgccgcccug

SEQ ID NO: 1488541 - RNA, 15 nt, Pseudomonas aeruginosa PA01
gcagcgccgcccugu

SEQ ID NO: 1488542 - RNA, 19 nt, Pseudomonas aeruginosa PA01
gcagcgccgcccuguucgu

SEQ ID NO: 1488543 - RNA, 19 nt, Pseudomonas aeruginosa PA01
gcagcgccgccgcgucguc

SEQ ID NO: 1488544 - RNA, 13 nt, Pseudomonas aeruginosa PA01
gcagcgccgccgg

SEQ ID NO: 1488545 - RNA, 15 nt, Pseudomonas aeruginosa PA01
gcagcgccgccgggc

SEQ ID NO: 1488546 - RNA, 12 nt, Pseudomonas aeruginosa PA01
gcagcgccgccc

SEQ ID NO: 1488547 - RNA, 13 nt, Pseudomonas aeruginosa PA01
gcagcgccgccca

SEQ ID NO: 1488548 - RNA, 13 nt, Pseudomonas aeruginosa PA01
gcagcgccgccag

SEQ ID NO: 1488549 - RNA, 12 nt, Pseudomonas aeruginosa PA01
gcagcgccgagg

SEQ ID NO: 1488550 - RNA, 13 nt, Pseudomonas aeruginosa PA01
gcagcgccgaaca

SEQ ID NO: 1488551 - RNA, 12 nt, Pseudomonas aeruginosa PA01
gcagcgccgggc

SEQ ID NO: 1488552 - RNA, 13 nt, Pseudomonas aeruginosa PA01
gcagcgccgggca

SEQ ID NO: 1488553 - RNA, 18 nt, Pseudomonas aeruginosa PA01
gcagcgccgcgcggcaac

SEQ ID NO: 1488554 - RNA, 19 nt, Pseudomonas aeruginosa PA01
gcagcggcgcuacgaaggc

SEQ ID NO: 1488555 - RNA, 13 nt, Pseudomonas aeruginosa PA01
gcagcggcggaua

SEQ ID NO: 1488556 - RNA, 21 nt, Pseudomonas aeruginosa PA01
gcagcggcggauacaggcgca

SEQ ID NO: 1488557 - RNA, 14 nt, Pseudomonas aeruginosa PA01
gcagcggcggcgcc

SEQ ID NO: 1488558 - RNA, 15 nt, Pseudomonas aeruginosa PA01
gcagcggcggcgccg

SEQ ID NO: 1488559 - RNA, 19 nt, Pseudomonas aeruginosa PA01
gcagcggcggcgccggcag

SEQ ID NO: 1488560 - RNA, 21 nt, Pseudomonas aeruginosa PA01
gcagcggcgugaagccgccgc

SEQ ID NO: 1488561 - RNA, 23 nt, Pseudomonas aeruginosa PA01
gcagcggcucacgccccagcgca

SEQ ID NO: 1488562 - RNA, 20 nt, Pseudomonas aeruginosa PA01
gcagcggcaugcccugccgg

SEQ ID NO: 1488563 - RNA, 12 nt, Pseudomonas aeruginosa PA01
gcagcggcagcc

SEQ ID NO: 1488564 - RNA, 22 nt, Pseudomonas aeruginosa PA01
gcagcggcagccacucggccag

SEQ ID NO: 1488565 - RNA, 14 nt, Pseudomonas aeruginosa PA01
gcagcggccccgag

SEQ ID NO: 1488566 - RNA, 22 nt, Pseudomonas aeruginosa PA01
gcagcggccccgagcgggccga

SEQ ID NO: 1488567 - RNA, 24 nt, Pseudomonas aeruginosa PA01
gcagcggccccgagcgggccgagg

SEQ ID NO: 1488568 - RNA, 13 nt, Pseudomonas aeruginosa PA01
gcagcggcccuug

SEQ ID NO: 1488569 - RNA, 20 nt, Pseudomonas aeruginosa PA01
gcagcggcgacaccgccagc

SEQ ID NO: 1488570 - RNA, 22 nt, Pseudomonas aeruginosa PA01
gcagcgcuucguugcuccugcg

SEQ ID NO: 1488571 - RNA, 21 nt, Pseudomonas aeruginosa PA01
gcagcgcuuguagcagccgca

SEQ ID NO: 1488572 - RNA, 19 nt, Pseudomonas aeruginosa PA01
gcagcggaaaugcucgccg

SEQ ID NO: 1488573 - RNA, 14 nt, Pseudomonas aeruginosa PA01
gcagcggaagcccu

SEQ ID NO: 1488574 - RNA, 21 nt, Pseudomonas aeruginosa PA01
gcagcggaagcccugcuggcg

SEQ ID NO: 1488575 - RNA, 12 nt, Pseudomonas aeruginosa PA01
gcagcgcuggcg

SEQ ID NO: 1488576 - RNA, 13 nt, Pseudomonas aeruginosa PA01
gcagcgcuggcga

SEQ ID NO: 1488577 - RNA, 14 nt, Pseudomonas aeruginosa PA01
gcagcgcuggcgau

SEQ ID NO: 1488578 - RNA, 16 nt, Pseudomonas aeruginosa PA01
gcagcgcuggcgauca

SEQ ID NO: 1488579 - RNA, 17 nt, Pseudomonas aeruginosa PA01
gcagcgcuagcgcaugg

SEQ ID NO: 1488580 - RNA, 23 nt, Pseudomonas aeruginosa PA01
gcagcgcucacgcaccucgucga

SEQ ID NO: 1488581 - RNA, 13 nt, Pseudomonas aeruginosa PA01
gcagcggcaccag

SEQ ID NO: 1488582 - RNA, 15 nt, Pseudomonas aeruginosa PA01
gcagcggcaccagca

SEQ ID NO: 1488583 - RNA, 17 nt, Pseudomonas aeruginosa PA01
gcagcggcaccagcacg

SEQ ID NO: 1488584 - RNA, 20 nt, Pseudomonas aeruginosa PA01
gcagcggcacgcucuggccg

SEQ ID NO: 1488585 - RNA, 15 nt, Pseudomonas aeruginosa PA01
gcagcggcagcgcca

SEQ ID NO: 1488586 - RNA, 16 nt, Pseudomonas aeruginosa PA01
gcagcggcagcgccag

SEQ ID NO: 1488587 - RNA, 18 nt, Pseudomonas aeruginosa PA01
gcagcggcagcgccaggu

SEQ ID NO: 1488588 - RNA, 13 nt, Pseudomonas aeruginosa PA01
gcagcggcagcgg

SEQ ID NO: 1488589 - RNA, 16 nt, Pseudomonas aeruginosa PA01
gcagcggcagcggcuc

SEQ ID NO: 1488590 - RNA, 14 nt, Pseudomonas aeruginosa PA01
gcagcggcaggcca

SEQ ID NO: 1488591 - RNA, 19 nt, Pseudomonas aeruginosa PA01
gcagcggcaggccacggcc

SEQ ID NO: 1488592 - RNA, 20 nt, Pseudomonas aeruginosa PA01
gcagcggacgcagcgggucg

SEQ ID NO: 1488593 - RNA, 20 nt, Pseudomonas aeruginosa PA01
gcagcggcaaaggcccggcg

SEQ ID NO: 1488594 - RNA, 22 nt, Pseudomonas aeruginosa PA01
gcagcggcaaaggcccggcgcg

SEQ ID NO: 1488595 - RNA, 15 nt, Pseudomonas aeruginosa PA01
gcagcggaucggcgg

SEQ ID NO: 1488596 - RNA, 17 nt, Pseudomonas aeruginosa PA01
gcagcggaucggcggug

SEQ ID NO: 1488597 - RNA, 23 nt, Pseudomonas aeruginosa PA01
gcagcggauauucgacgcgcggc

SEQ ID NO: 1488598 - RNA, 22 nt, Pseudomonas aeruginosa PA01
gcagcgcaagucggccugcacc

SEQ ID NO: 1488599 - RNA, 18 nt, Pseudomonas aeruginosa PA01
gcagcgcacgcuucuccu

SEQ ID NO: 1488600 - RNA, 16 nt, Pseudomonas aeruginosa PA01
gcagcgcagccgaucg

SEQ ID NO: 1488601 - RNA, 13 nt, Pseudomonas aeruginosa PA01
gcagcgaccugac

SEQ ID NO: 1488602 - RNA, 17 nt, Pseudomonas aeruginosa PA01
gcagcgaccugacccgc

SEQ ID NO: 1488603 - RNA, 21 nt, Pseudomonas aeruginosa PA01
gcagcgaccugacccgcuccu

SEQ ID NO: 1488604 - RNA, 23 nt, Pseudomonas aeruginosa PA01
gcagcgaccugacccgcuccucg

SEQ ID NO: 1488605 - RNA, 16 nt, Pseudomonas aeruginosa PA01
gcagcgaccaccacca

SEQ ID NO: 1488606 - RNA, 14 nt, Pseudomonas aeruginosa PA01
gcagccuuggccac

SEQ ID NO: 1488607 - RNA, 16 nt, Pseudomonas aeruginosa PA01
gcagccggcgaacagg

SEQ ID NO: 1488608 - RNA, 13 nt, Pseudomonas aeruginosa PA01
gcagccggcggcg

SEQ ID NO: 1488609 - RNA, 18 nt, Pseudomonas aeruginosa PA01
gcagcgacacaacgcugc

SEQ ID NO: 1488610 - RNA, 21 nt, Pseudomonas aeruginosa PA01
gcagcgaacgggcguugccgg

SEQ ID NO: 1488611 - RNA, 23 nt, Pseudomonas aeruginosa PA01
gcagcgaacgggcguugccggca

SEQ ID NO: 1488612 - RNA, 20 nt, Pseudomonas aeruginosa PA01
gcagccggggcucaggccuu

SEQ ID NO: 1488613 - RNA, 22 nt, Pseudomonas aeruginosa PA01
gcagccggggcucaggccuugg

SEQ ID NO: 1488614 - RNA, 16 nt, Pseudomonas aeruginosa PA01
gcagccggaccagccg

SEQ ID NO: 1488615 - RNA, 15 nt, Pseudomonas aeruginosa PA01
gcagcaccgccuggu

SEQ ID NO: 1488616 - RNA, 19 nt, Pseudomonas aeruginosa PA01
gcagccgcgugcgcgccgc

SEQ ID NO: 1488617 - RNA, 20 nt, Pseudomonas aeruginosa PA01
gcagccgcgugcgcgccgcc

SEQ ID NO: 1488618 - RNA, 14 nt, Pseudomonas aeruginosa PA01
gcagccgcgcucgg

SEQ ID NO: 1488619 - RNA, 17 nt, Pseudomonas aeruginosa PA01
gcagccgcgcucggcca

SEQ ID NO: 1488620 - RNA, 21 nt, Pseudomonas aeruginosa PA01
gcagccgcggcuguagccacg

SEQ ID NO: 1488621 - RNA, 18 nt, Pseudomonas aeruginosa PA01
gcagccgcucggccgcca

SEQ ID NO: 1488622 - RNA, 23 nt, Pseudomonas aeruginosa PA01
gcagccccuugcgcucuggcgca

SEQ ID NO: 1488623 - RNA, 14 nt, Pseudomonas aeruginosa PA01
gcagccccgaggcc

SEQ ID NO: 1488624 - RNA, 14 nt, Pseudomonas aeruginosa PA01
gcagccccgccgga

SEQ ID NO: 1488625 - RNA, 15 nt, Pseudomonas aeruginosa PA01
gcagcaccgcgcgcu

SEQ ID NO: 1488626 - RNA, 17 nt, Pseudomonas aeruginosa PA01
gcagcaccgcgagcaug

SEQ ID NO: 1488627 - RNA, 21 nt, Pseudomonas aeruginosa PA01
gcagcaccgcgagcaugcuca

SEQ ID NO: 1488628 - RNA, 14 nt, Pseudomonas aeruginosa PA01
gcagcaccgcgcgc

SEQ ID NO: 1488629 - RNA, 15 nt, Pseudomonas aeruginosa PA01
gcaggcacagggcga

SEQ ID NO: 1488630 - RNA, 15 nt, Pseudomonas aeruginosa PA01
gcaggcacgcugcca

SEQ ID NO: 1488631 - RNA, 16 nt, Pseudomonas aeruginosa PA01
gcaggcacgcugccag

SEQ ID NO: 1488632 - RNA, 18 nt, Pseudomonas aeruginosa PA01
gcaggcacggaagcgcug

SEQ ID NO: 1488633 - RNA, 14 nt, Pseudomonas aeruginosa PA01
gcaggaugccgcug

SEQ ID NO: 1488634 - RNA, 23 nt, Pseudomonas aeruginosa PA01
gcaggauccaggugcgcggcagg

SEQ ID NO: 1488635 - RNA, 22 nt, Pseudomonas aeruginosa PA01
gcaggaucugcugcaacauggc

SEQ ID NO: 1488636 - RNA, 22 nt, Pseudomonas aeruginosa PA01
gcaggaugcagucggcaccgau

SEQ ID NO: 1488637 - RNA, 15 nt, Pseudomonas aeruginosa PA01
gcaggaugccgccug

SEQ ID NO: 1488638 - RNA, 14 nt, Pseudomonas aeruginosa PA01
gcaggaucaccugc

SEQ ID NO: 1488639 - RNA, 13 nt, Pseudomonas aeruginosa PA01
gcaggaugcugca

SEQ ID NO: 1488640 - RNA, 19 nt, Pseudomonas aeruginosa PA01
gcaggaugcugcacagcca

SEQ ID NO: 1488641 - RNA, 20 nt, Pseudomonas aeruginosa PA01
gcaggcagucccagaaggcc

SEQ ID NO: 1488642 - RNA, 17 nt, Pseudomonas aeruginosa PA01
gcaggcagugccgggcg

SEQ ID NO: 1488643 - RNA, 18 nt, Pseudomonas aeruginosa PA01
gcaggcaguggcgccagc

SEQ ID NO: 1488644 - RNA, 16 nt, Pseudomonas aeruginosa PA01
gcaggcagcacaugcc

SEQ ID NO: 1488645 - RNA, 17 nt, Pseudomonas aeruginosa PA01
gcaggcaugcggccccg

SEQ ID NO: 1488646 - RNA, 13 nt, Pseudomonas aeruginosa PA01
gcaggcaggucgc

SEQ ID NO: 1488647 - RNA, 23 nt, Pseudomonas aeruginosa PA01
gcaggccaccggauugucgaugu

SEQ ID NO: 1488648 - RNA, 21 nt, Pseudomonas aeruginosa PA01
gcaggcauuggaagugucggu

SEQ ID NO: 1488649 - RNA, 15 nt, Pseudomonas aeruginosa PA01
gcaggcagcgcgcgu

SEQ ID NO: 1488650 - RNA, 14 nt, Pseudomonas aeruginosa PA01
gcaggccaggcccc

SEQ ID NO: 1488651 - RNA, 17 nt, Pseudomonas aeruginosa PA01
gcaggccaggccccagg

SEQ ID NO: 1488652 - RNA, 14 nt, Pseudomonas aeruginosa PA01
gcaggccaggcgca

SEQ ID NO: 1488653 - RNA, 21 nt, Pseudomonas aeruginosa PA01
gcaggccaugggugucggcga

SEQ ID NO: 1488654 - RNA, 22 nt, Pseudomonas aeruginosa PA01
gcaggccaugggugucggcgau

SEQ ID NO: 1488655 - RNA, 23 nt, Pseudomonas aeruginosa PA01
gcaggccaugggugucggcgauc

SEQ ID NO: 1488656 - RNA, 17 nt, Pseudomonas aeruginosa PA01
gcaggccacggccgcug

SEQ ID NO: 1488657 - RNA, 18 nt, Pseudomonas aeruginosa PA01
gcaggccacggccgcugc

SEQ ID NO: 1488658 - RNA, 17 nt, Pseudomonas aeruginosa PA01
gcaggccagccaacugc

SEQ ID NO: 1488659 - RNA, 18 nt, Pseudomonas aeruginosa PA01
gcaggccacgcaccagcu

SEQ ID NO: 1488660 - RNA, 23 nt, Pseudomonas aeruginosa PA01
gcaggccacgcaccagcucccgg

SEQ ID NO: 1488661 - RNA, 21 nt, Pseudomonas aeruginosa PA01
gcaggccagcuuccaggcgcg

SEQ ID NO: 1488662 - RNA, 14 nt, Pseudomonas aeruginosa PA01
gcaggccagcgcca

SEQ ID NO: 1488663 - RNA, 20 nt, Pseudomonas aeruginosa PA01
gcaggccagcgccagguugg

SEQ ID NO: 1488664 - RNA, 13 nt, Pseudomonas aeruginosa PA01
gcaggccagcgcc

SEQ ID NO: 1488665 - RNA, 12 nt, Pseudomonas aeruginosa PA01
gcaggccagcgc

SEQ ID NO: 1488666 - RNA, 17 nt, Pseudomonas aeruginosa PA01
gcaggccgaggaggacg

SEQ ID NO: 1488667 - RNA, 15 nt, Pseudomonas aeruginosa PA01
gcaggccgaggucgg

SEQ ID NO: 1488668 - RNA, 16 nt, Pseudomonas aeruginosa PA01
gcaggccgaggucggc

SEQ ID NO: 1488669 - RNA, 19 nt, Pseudomonas aeruginosa PA01
gcaggccgaggucggcggc

SEQ ID NO: 1488670 - RNA, 22 nt, Pseudomonas aeruginosa PA01
gcaggccgaucaccagcgccag

SEQ ID NO: 1488671 - RNA, 17 nt, Pseudomonas aeruginosa PA01
gcaggccgaucagcggc

SEQ ID NO: 1488672 - RNA, 22 nt, Pseudomonas aeruginosa PA01
gcaggccgaucucgugggccag

SEQ ID NO: 1488673 - RNA, 17 nt, Pseudomonas aeruginosa PA01
gcaggccgauggccccg

SEQ ID NO: 1488674 - RNA, 23 nt, Pseudomonas aeruginosa PA01
gcaggccgaagcgugggcggccg

SEQ ID NO: 1488675 - RNA, 16 nt, Pseudomonas aeruginosa PA01
gcaggccgaaggccag

SEQ ID NO: 1488676 - RNA, 22 nt, Pseudomonas aeruginosa PA01
gcaggccgaaggccaggaccgc

SEQ ID NO: 1488677 - RNA, 17 nt, Pseudomonas aeruginosa PA01
gcaggccgaauccgccg

SEQ ID NO: 1488678 - RNA, 18 nt, Pseudomonas aeruginosa PA01
gcaggccgaauccgccgg

SEQ ID NO: 1488679 - RNA, 19 nt, Pseudomonas aeruginosa PA01
gcaggccgaauccgccggc

SEQ ID NO: 1488680 - RNA, 21 nt, Pseudomonas aeruginosa PA01
gcaggccgaauccgccggcga

SEQ ID NO: 1488681 - RNA, 24 nt, Pseudomonas aeruginosa PA01
gcaggccgaauccgccggcgaugc

SEQ ID NO: 1488682 - RNA, 15 nt, Pseudomonas aeruginosa PA01
gcaggccgaccucgg

SEQ ID NO: 1488683 - RNA, 22 nt, Pseudomonas aeruginosa PA01
gcaggccgaccucggcggucag

SEQ ID NO: 1488684 - RNA, 13 nt, Pseudomonas aeruginosa PA01
gcaggccgacggc

SEQ ID NO: 1488685 - RNA, 17 nt, Pseudomonas aeruginosa PA01
gcaggccgacggcgcgc

SEQ ID NO: 1488686 - RNA, 22 nt, Pseudomonas aeruginosa PA01
gcaggccgagaagguucucggc

SEQ ID NO: 1488687 - RNA, 24 nt, Pseudomonas aeruginosa PA01
gcaggccgagaagguucucggcca

SEQ ID NO: 1488688 - RNA, 20 nt, Pseudomonas aeruginosa PA01
gcaggcccaguucgcugccg

SEQ ID NO: 1488689 - RNA, 22 nt, Pseudomonas aeruginosa PA01
gcaggcccaugauggucggcac

SEQ ID NO: 1488690 - RNA, 22 nt, Pseudomonas aeruginosa PA01
gcaggcccagccauugcgccag

SEQ ID NO: 1488691 - RNA, 18 nt, Pseudomonas aeruginosa PA01
gcaggcccgagccggacg

SEQ ID NO: 1488692 - RNA, 16 nt, Pseudomonas aeruginosa PA01
gcaggcccggccgccu

SEQ ID NO: 1488693 - RNA, 18 nt, Pseudomonas aeruginosa PA01
gcaggcccggccgccugc

SEQ ID NO: 1488694 - RNA, 21 nt, Pseudomonas aeruginosa PA01
gcaggcccggccgccugccuu

SEQ ID NO: 1488695 - RNA, 15 nt, Pseudomonas aeruginosa PA01
gcaggccgcggccga

SEQ ID NO: 1488696 - RNA, 18 nt, Pseudomonas aeruginosa PA01
gcaggccgccggcggcca

SEQ ID NO: 1488697 - RNA, 15 nt, Pseudomonas aeruginosa PA01
gcaggccgcugccug

SEQ ID NO: 1488698 - RNA, 18 nt, Pseudomonas aeruginosa PA01
gcaggccgcuggcgacgc

SEQ ID NO: 1488699 - RNA, 18 nt, Pseudomonas aeruginosa PA01
gcaggccgaggccggcga

SEQ ID NO: 1488700 - RNA, 12 nt, Pseudomonas aeruginosa PA01
gcaggccgccga

SEQ ID NO: 1488701 - RNA, 14 nt, Pseudomonas aeruginosa PA01
gcaggccgccgcgu

SEQ ID NO: 1488702 - RNA, 14 nt, Pseudomonas aeruginosa PA01
gcaggccgccgagu

SEQ ID NO: 1488703 - RNA, 15 nt, Pseudomonas aeruginosa PA01
gcaggccgccgagug

SEQ ID NO: 1488704 - RNA, 23 nt, Pseudomonas aeruginosa PA01
gcaggccgccgagugugccggcc

SEQ ID NO: 1488705 - RNA, 13 nt, Pseudomonas aeruginosa PA01
gcaggccgccgau

SEQ ID NO: 1488706 - RNA, 16 nt, Pseudomonas aeruginosa PA01
gcaggccgugccagag

SEQ ID NO: 1488707 - RNA, 10 nt, Pseudomonas aeruginosa PA01
gcaggccggc

SEQ ID NO: 1488708 - RNA, 13 nt, Pseudomonas aeruginosa PA01
gcaggccguccuu

SEQ ID NO: 1488709 - RNA, 12 nt, Pseudomonas aeruginosa PA01
gcaggccggugg

SEQ ID NO: 1488710 - RNA, 16 nt, Pseudomonas aeruginosa PA01
gcaggccggccagccu

SEQ ID NO: 1488711 - RNA, 11 nt, Pseudomonas aeruginosa PA01
gcaggccggcg

SEQ ID NO: 1488712 - RNA, 12 nt, Pseudomonas aeruginosa PA01
gcaggccggcga

SEQ ID NO: 1488713 - RNA, 13 nt, Pseudomonas aeruginosa PA01
gcaggccggcgac

SEQ ID NO: 1488714 - RNA, 14 nt, Pseudomonas aeruginosa PA01
gcaggccggcgacc

SEQ ID NO: 1488715 - RNA, 16 nt, Pseudomonas aeruginosa PA01
gcaggccggcgaccag

SEQ ID NO: 1488716 - RNA, 14 nt, Pseudomonas aeruginosa PA01
gcaggccggcgagc

SEQ ID NO: 1488717 - RNA, 15 nt, Pseudomonas aeruginosa PA01
gcaggccggcgagcc

SEQ ID NO: 1488718 - RNA, 16 nt, Pseudomonas aeruginosa PA01
gcaggccggcgagcca

SEQ ID NO: 1488719 - RNA, 17 nt, Pseudomonas aeruginosa PA01
gcaggccggcgagccag

SEQ ID NO: 1488720 - RNA, 14 nt, Pseudomonas aeruginosa PA01
gcaggccgggcgga

SEQ ID NO: 1488721 - RNA, 17 nt, Pseudomonas aeruginosa PA01
gcaggccgggcuggcca

SEQ ID NO: 1488722 - RNA, 14 nt, Pseudomonas aeruginosa PA01
gcagggaaggcgcg

SEQ ID NO: 1488723 - RNA, 20 nt, Pseudomonas aeruginosa PA01
gcaggcuuuccagcccggcg

SEQ ID NO: 1488724 - RNA, 22 nt, Pseudomonas aeruginosa PA01
gcaggcuuggucagggucgagu

SEQ ID NO: 1488725 - RNA, 18 nt, Pseudomonas aeruginosa PA01
gcagggauuccgggucga

SEQ ID NO: 1488726 - RNA, 13 nt, Pseudomonas aeruginosa PA01
gcagggaggcgca

SEQ ID NO: 1488727 - RNA, 18 nt, Pseudomonas aeruginosa PA01
gcagggaguccgccagcc

SEQ ID NO: 1488728 - RNA, 22 nt, Pseudomonas aeruginosa PA01
gcagggaguccgccagccggcu

SEQ ID NO: 1488729 - RNA, 15 nt, Pseudomonas aeruginosa PA01
gcagggcagccgccg

SEQ ID NO: 1488730 - RNA, 14 nt, Pseudomonas aeruginosa PA01
gcagggcagcggcc

SEQ ID NO: 1488731 - RNA, 20 nt, Pseudomonas aeruginosa PA01
gcagggcaucgaugaccuuc

SEQ ID NO: 1488732 - RNA, 22 nt, Pseudomonas aeruginosa PA01
gcagggcaucgaugaccuucga

SEQ ID NO: 1488733 - RNA, 22 nt, Pseudomonas aeruginosa PA01
gcaggcuuucguaggcaggcgc

SEQ ID NO: 1488734 - RNA, 21 nt, Pseudomonas aeruginosa PA01
gcaggcugguaugcagcaacc

SEQ ID NO: 1488735 - RNA, 23 nt, Pseudomonas aeruginosa PA01
gcaggcugugccauuccugggcc

SEQ ID NO: 1488736 - RNA, 15 nt, Pseudomonas aeruginosa PA01
gcaggcuguacagca

SEQ ID NO: 1488737 - RNA, 24 nt, Pseudomonas aeruginosa PA01
gcaggcuguacagcaggagcgcca

SEQ ID NO: 1488738 - RNA, 13 nt, Pseudomonas aeruginosa PA01
gcaggcuggcggc

SEQ ID NO: 1488739 - RNA, 14 nt, Pseudomonas aeruginosa PA01
gcaggcuggcggca

SEQ ID NO: 1488740 - RNA, 12 nt, Pseudomonas aeruginosa PA01
gcaggcugccga

SEQ ID NO: 1488741 - RNA, 14 nt, Pseudomonas aeruginosa PA01
gcaggcugccgaga

SEQ ID NO: 1488742 - RNA, 12 nt, Pseudomonas aeruginosa PA01
gcaggcugccgg

SEQ ID NO: 1488743 - RNA, 14 nt, Pseudomonas aeruginosa PA01
gcaggcugccguug

SEQ ID NO: 1488744 - RNA, 15 nt, Pseudomonas aeruginosa PA01
gcaggcugcgccgcu

SEQ ID NO: 1488745 - RNA, 20 nt, Pseudomonas aeruginosa PA01
gcaggcugcugcugcggcgg

SEQ ID NO: 1488746 - RNA, 20 nt, Pseudomonas aeruginosa PA01
gcaggcuggccgagcgccgc

SEQ ID NO: 1488747 - RNA, 15 nt, Pseudomonas aeruginosa PA01
gcaggcggccguccu

SEQ ID NO: 1488748 - RNA, 14 nt, Pseudomonas aeruginosa PA01
gcaggcggucgccg

SEQ ID NO: 1488749 - RNA, 16 nt, Pseudomonas aeruginosa PA01
gcaggcggucgccgaa

SEQ ID NO: 1488750 - RNA, 15 nt, Pseudomonas aeruginosa PA01
gcaggcggucggcca

SEQ ID NO: 1488751 - RNA, 14 nt, Pseudomonas aeruginosa PA01
gcaggcucagcacc

SEQ ID NO: 1488752 - RNA, 15 nt, Pseudomonas aeruginosa PA01
gcaggcucagcaccu

SEQ ID NO: 1488753 - RNA, 23 nt, Pseudomonas aeruginosa PA01
gcaggcucagcaccuugugcugc

SEQ ID NO: 1488754 - RNA, 16 nt, Pseudomonas aeruginosa PA01
gcaggcgucgguccag

SEQ ID NO: 1488755 - RNA, 20 nt, Pseudomonas aeruginosa PA01
gcaggcguugcagugcgccg

SEQ ID NO: 1488756 - RNA, 23 nt, Pseudomonas aeruginosa PA01
gcaggcguugcagugcgccgcag

SEQ ID NO: 1488757 - RNA, 16 nt, Pseudomonas aeruginosa PA01
gcaggcguuauccgcc

SEQ ID NO: 1488758 - RNA, 20 nt, Pseudomonas aeruginosa PA01
gcaggcguuauccgccgaga

SEQ ID NO: 1488759 - RNA, 16 nt, Pseudomonas aeruginosa PA01
gcaggcucaguucggc

SEQ ID NO: 1488760 - RNA, 19 nt, Pseudomonas aeruginosa PA01
gcaggcucaguucggccag

SEQ ID NO: 1488761 - RNA, 23 nt, Pseudomonas aeruginosa PA01
gcaggcucaguucggccagcggc

SEQ ID NO: 1488762 - RNA, 18 nt, Pseudomonas aeruginosa PA01
gcaggcucaucgcccgcc

SEQ ID NO: 1488763 - RNA, 16 nt, Pseudomonas aeruginosa PA01
gcaggcucaugcccag

SEQ ID NO: 1488764 - RNA, 14 nt, Pseudomonas aeruginosa PA01
gcaggcucagcgca

SEQ ID NO: 1488765 - RNA, 15 nt, Pseudomonas aeruginosa PA01
gcaggcucagcgcau

SEQ ID NO: 1488766 - RNA, 15 nt, Pseudomonas aeruginosa PA01
gcaggcucgacaggu

SEQ ID NO: 1488767 - RNA, 19 nt, Pseudomonas aeruginosa PA01
gcaggcucgacaggucggc

SEQ ID NO: 1488768 - RNA, 20 nt, Pseudomonas aeruginosa PA01
gcaggcucgacaggucggcg

SEQ ID NO: 1488769 - RNA, 20 nt, Pseudomonas aeruginosa PA01
gcaggcucucgcgcagcagg

SEQ ID NO: 1488770 - RNA, 16 nt, Pseudomonas aeruginosa PA01
gcaggcgaugaccgcc

SEQ ID NO: 1488771 - RNA, 16 nt, Pseudomonas aeruginosa PA01
gcaggcgaugccgacg

SEQ ID NO: 1488772 - RNA, 19 nt, Pseudomonas aeruginosa PA01
gcaggcgcaggcgaacugc

SEQ ID NO: 1488773 - RNA, 16 nt, Pseudomonas aeruginosa PA01
gcaggcgcacgcgcag

SEQ ID NO: 1488774 - RNA, 16 nt, Pseudomonas aeruginosa PA01
gcaggcgcagcagcga

SEQ ID NO: 1488775 - RNA, 14 nt, Pseudomonas aeruginosa PA01
gcaggcgacgguca

SEQ ID NO: 1488776 - RNA, 23 nt, Pseudomonas aeruginosa PA01
gcaggcgacggucaggccgagca

SEQ ID NO: 1488777 - RNA, 18 nt, Pseudomonas aeruginosa PA01
gcaggcgcaaccagacca

SEQ ID NO: 1488778 - RNA, 22 nt, Pseudomonas aeruginosa PA01
gcaggcgcaaccagaccagcag

SEQ ID NO: 1488779 - RNA, 24 nt, Pseudomonas aeruginosa PA01
gcaggcgcaaccagaccagcagga

SEQ ID NO: 1488780 - RNA, 13 nt, Pseudomonas aeruginosa PA01
gcaggcgaacagg

SEQ ID NO: 1488781 - RNA, 15 nt, Pseudomonas aeruginosa PA01
gcaggcgaacagggc

SEQ ID NO: 1488782 - RNA, 16 nt, Pseudomonas aeruginosa PA01
gcaggcgaacagggcc

SEQ ID NO: 1488783 - RNA, 20 nt, Pseudomonas aeruginosa PA01
gcaggcgaacagggccauca

SEQ ID NO: 1488784 - RNA, 17 nt, Pseudomonas aeruginosa PA01
gcaggcgaacugccgac

SEQ ID NO: 1488785 - RNA, 18 nt, Pseudomonas aeruginosa PA01
gcaggcgaacugccgacg

SEQ ID NO: 1488786 - RNA, 19 nt, Pseudomonas aeruginosa PA01
gcaggcgaacugccgacgg

SEQ ID NO: 1488787 - RNA, 11 nt, Pseudomonas aeruginosa PA01
gcaggccugga

SEQ ID NO: 1488788 - RNA, 19 nt, Pseudomonas aeruginosa PA01
gcaggccuggaauaccccg

SEQ ID NO: 1488789 - RNA, 13 nt, Pseudomonas aeruginosa PA01
gcaggccuggagc

SEQ ID NO: 1488790 - RNA, 23 nt, Pseudomonas aeruginosa PA01
gcaggccugggcaagcugcacgg

SEQ ID NO: 1488791 - RNA, 23 nt, Pseudomonas aeruginosa PA01
gcaggccugguaggcgucgucga

SEQ ID NO: 1488792 - RNA, 17 nt, Pseudomonas aeruginosa PA01
gcaggccuuccacgccu

SEQ ID NO: 1488793 - RNA, 22 nt, Pseudomonas aeruginosa PA01
gcaggccuucccacuccgucca

SEQ ID NO: 1488794 - RNA, 16 nt, Pseudomonas aeruginosa PA01
gcaggccuucgacuuc

SEQ ID NO: 1488795 - RNA, 15 nt, Pseudomonas aeruginosa PA01
gcaggccuucggcgc

SEQ ID NO: 1488796 - RNA, 16 nt, Pseudomonas aeruginosa PA01
gcaggccuucggcgcc

SEQ ID NO: 1488797 - RNA, 18 nt, Pseudomonas aeruginosa PA01
gcaggccuucggcgccgg

SEQ ID NO: 1488798 - RNA, 17 nt, Pseudomonas aeruginosa PA01
gcaggccuugcagggcc

SEQ ID NO: 1488799 - RNA, 21 nt, Pseudomonas aeruginosa PA01
gcaggccuugcagggccgcca

SEQ ID NO: 1488800 - RNA, 15 nt, Pseudomonas aeruginosa PA01
gcaggcggcccaugc

SEQ ID NO: 1488801 - RNA, 21 nt, Pseudomonas aeruginosa PA01
gcaggcggcccaugcggaucg

SEQ ID NO: 1488802 - RNA, 22 nt, Pseudomonas aeruginosa PA01
gcaggcgcuucagcgccucgac

SEQ ID NO: 1488803 - RNA, 19 nt, Pseudomonas aeruginosa PA01
gcaggcggaaaaagcgcgg

SEQ ID NO: 1488804 - RNA, 22 nt, Pseudomonas aeruginosa PA01
gcaggcggaaauacggcuccgg

SEQ ID NO: 1488805 - RNA, 21 nt, Pseudomonas aeruginosa PA01
gcaggcggacacgcaggcgcc

SEQ ID NO: 1488806 - RNA, 21 nt, Pseudomonas aeruginosa PA01
gcaggcggaguagccggcggc

SEQ ID NO: 1488807 - RNA, 19 nt, Pseudomonas aeruginosa PA01
gcaggcggaucgcccggcg

SEQ ID NO: 1488808 - RNA, 20 nt, Pseudomonas aeruginosa PA01
gcaggcggaucgcccggcgc

SEQ ID NO: 1488809 - RNA, 15 nt, Pseudomonas aeruginosa PA01
gcaggcggaucgccg

SEQ ID NO: 1488810 - RNA, 17 nt, Pseudomonas aeruginosa PA01
gcaggcggaucgccgcc

SEQ ID NO: 1488811 - RNA, 18 nt, Pseudomonas aeruginosa PA01
gcaggcggaucgccgccu

SEQ ID NO: 1488812 - RNA, 17 nt, Pseudomonas aeruginosa PA01
gcaggcgcuccuggugc

SEQ ID NO: 1488813 - RNA, 19 nt, Pseudomonas aeruginosa PA01
gcaggcgcgggcuggccac

SEQ ID NO: 1488814 - RNA, 15 nt, Pseudomonas aeruginosa PA01
gcaggcgcgggucau

SEQ ID NO: 1488815 - RNA, 19 nt, Pseudomonas aeruginosa PA01
gcaggcgcgggucaucggc

SEQ ID NO: 1488816 - RNA, 22 nt, Pseudomonas aeruginosa PA01
gcaggcgcggcauagaugccgg

SEQ ID NO: 1488817 - RNA, 14 nt, Pseudomonas aeruginosa PA01
gcaggcgcuggcgg

SEQ ID NO: 1488818 - RNA, 16 nt, Pseudomonas aeruginosa PA01
gcaggcgcuggcgggc

SEQ ID NO: 1488819 - RNA, 16 nt, Pseudomonas aeruginosa PA01
gcaggcgcucggcgac

SEQ ID NO: 1488820 - RNA, 14 nt, Pseudomonas aeruginosa PA01
gcaggcgcccgguc

SEQ ID NO: 1488821 - RNA, 19 nt, Pseudomonas aeruginosa PA01
gcaggcgcccuggccgucg

SEQ ID NO: 1488822 - RNA, 21 nt, Pseudomonas aeruginosa PA01
gcaggcgcccuggccgucggc

SEQ ID NO: 1488823 - RNA, 23 nt, Pseudomonas aeruginosa PA01
gcaggcgcccuggccgucggccu

SEQ ID NO: 1488824 - RNA, 21 nt, Pseudomonas aeruginosa PA01
gcaggcgccgauggcugucgg

SEQ ID NO: 1488825 - RNA, 13 nt, Pseudomonas aeruginosa PA01
gcaggcgccgcgc

SEQ ID NO: 1488826 - RNA, 14 nt, Pseudomonas aeruginosa PA01
gcaggcgccgcgca

SEQ ID NO: 1488827 - RNA, 15 nt, Pseudomonas aeruginosa PA01
gcaggcgccggacca

SEQ ID NO: 1488828 - RNA, 20 nt, Pseudomonas aeruginosa PA01
gcaggcgccggaccaacugc

SEQ ID NO: 1488829 - RNA, 13 nt, Pseudomonas aeruginosa PA01
gcaggcgccggcc

SEQ ID NO: 1488830 - RNA, 14 nt, Pseudomonas aeruginosa PA01
gcaggcgccggcgg

SEQ ID NO: 1488831 - RNA, 14 nt, Pseudomonas aeruginosa PA01
gcaggcgcgccagg

SEQ ID NO: 1488832 - RNA, 21 nt, Pseudomonas aeruginosa PA01
gcaggcgcgccaggcccacgc

SEQ ID NO: 1488833 - RNA, 19 nt, Pseudomonas aeruginosa PA01
gcaggcgcauguccagcca

SEQ ID NO: 1488834 - RNA, 18 nt, Pseudomonas aeruginosa PA01
gcaggcgccaaccgggca

SEQ ID NO: 1488835 - RNA, 14 nt, Pseudomonas aeruginosa PA01
gcaggcgcaggucg

SEQ ID NO: 1488836 - RNA, 20 nt, Pseudomonas aeruginosa PA01
gcagguuggccccgccgagg

SEQ ID NO: 1488837 - RNA, 20 nt, Pseudomonas aeruginosa PA01
gcagguugugguugggcagg

SEQ ID NO: 1488838 - RNA, 18 nt, Pseudomonas aeruginosa PA01
gcagguuguucgccgcag

SEQ ID NO: 1488839 - RNA, 15 nt, Pseudomonas aeruginosa PA01
gcagguugcuggcga

SEQ ID NO: 1488840 - RNA, 19 nt, Pseudomonas aeruginosa PA01
gcaguaacgccugucgcuc

SEQ ID NO: 1488841 - RNA, 21 nt, Pseudomonas aeruginosa PA01
gcagguucagcaggucgcggc

SEQ ID NO: 1488842 - RNA, 17 nt, Pseudomonas aeruginosa PA01
gcagguugcgcuggcgc

SEQ ID NO: 1488843 - RNA, 20 nt, Pseudomonas aeruginosa PA01
gcagguugcgcuggcgcagc

SEQ ID NO: 1488844 - RNA, 22 nt, Pseudomonas aeruginosa PA01
gcagguugaugugcaguucgac

SEQ ID NO: 1488845 - RNA, 16 nt, Pseudomonas aeruginosa PA01
gcagguugcacggccg

SEQ ID NO: 1488846 - RNA, 13 nt, Pseudomonas aeruginosa PA01
gcagguugacccc

SEQ ID NO: 1488847 - RNA, 20 nt, Pseudomonas aeruginosa PA01
gcaguacagcucggcgcccu

SEQ ID NO: 1488848 - RNA, 20 nt, Pseudomonas aeruginosa PA01
gcaguacgaggggccgccgu

SEQ ID NO: 1488849 - RNA, 19 nt, Pseudomonas aeruginosa PA01
gcaguacucaugaccgccg

SEQ ID NO: 1488850 - RNA, 23 nt, Pseudomonas aeruginosa PA01
gcaguacucaugaccgccgcuca

SEQ ID NO: 1488851 - RNA, 15 nt, Pseudomonas aeruginosa PA01
gcaguacuuggccag

SEQ ID NO: 1488852 - RNA, 18 nt, Pseudomonas aeruginosa PA01
gcaguacuuggccagcag

SEQ ID NO: 1488853 - RNA, 20 nt, Pseudomonas aeruginosa PA01
gcaguacuuggccagcagca

SEQ ID NO: 1488854 - RNA, 14 nt, Pseudomonas aeruginosa PA01
gcaguacgaucagc

SEQ ID NO: 1488855 - RNA, 16 nt, Pseudomonas aeruginosa PA01
gcaguagcucgccgag

SEQ ID NO: 1488856 - RNA, 14 nt, Pseudomonas aeruginosa PA01
gcaguaggcgcugc

SEQ ID NO: 1488857 - RNA, 16 nt, Pseudomonas aeruginosa PA01
gcaguaggcgcugccg

SEQ ID NO: 1488858 - RNA, 13 nt, Pseudomonas aeruginosa PA01
gcaggucgugcug

SEQ ID NO: 1488859 - RNA, 15 nt, Pseudomonas aeruginosa PA01
gcaggucgugcugga

SEQ ID NO: 1488860 - RNA, 13 nt, Pseudomonas aeruginosa PA01
gcaggucguuacg

SEQ ID NO: 1488861 - RNA, 20 nt, Pseudomonas aeruginosa PA01
gcaggucguugacgaucugc

SEQ ID NO: 1488862 - RNA, 21 nt, Pseudomonas aeruginosa PA01
gcaggucucaccgcccugcgc

SEQ ID NO: 1488863 - RNA, 18 nt, Pseudomonas aeruginosa PA01
aagaaggcguccagggcu

SEQ ID NO: 1488864 - RNA, 22 nt, Pseudomonas aeruginosa PA01
aagaacucggcgcugccggcca

SEQ ID NO: 1488865 - RNA, 14 nt, Pseudomonas aeruginosa PA01
aagaacggcccgcu

SEQ ID NO: 1488866 - RNA, 14 nt, Pseudomonas aeruginosa PA01
aagaagccgcgcaa

SEQ ID NO: 1488867 - RNA, 14 nt, Pseudomonas aeruginosa PA01
aagaagccucgcga

SEQ ID NO: 1488868 - RNA, 20 nt, Pseudomonas aeruginosa PA01
aagaagccccgcagccgcgg

SEQ ID NO: 1488869 - RNA, 14 nt, Pseudomonas aeruginosa PA01
gcaggugcccuggc

SEQ ID NO: 1488870 - RNA, 19 nt, Pseudomonas aeruginosa PA01
gcaggugcccuggcagacg

SEQ ID NO: 1488871 - RNA, 17 nt, Pseudomonas aeruginosa PA01
gcaggugcaccgcgcug

SEQ ID NO: 1488872 - RNA, 16 nt, Pseudomonas aeruginosa PA01
gcagguggcgcacugc

SEQ ID NO: 1488873 - RNA, 18 nt, Pseudomonas aeruginosa PA01
gcagguggcgcacugcca

SEQ ID NO: 1488874 - RNA, 17 nt, Pseudomonas aeruginosa PA01
gcagguggacggcauug

SEQ ID NO: 1488875 - RNA, 19 nt, Pseudomonas aeruginosa PA01
gcaggugccgcucguccag

SEQ ID NO: 1488876 - RNA, 20 nt, Pseudomonas aeruginosa PA01
gcaggugguaagcgagcaga

SEQ ID NO: 1488877 - RNA, 16 nt, Pseudomonas aeruginosa PA01
gcagguggucguugcg

SEQ ID NO: 1488878 - RNA, 16 nt, Pseudomonas aeruginosa PA01
gcagguguucggcggc

SEQ ID NO: 1488879 - RNA, 17 nt, Pseudomonas aeruginosa PA01
gcagguguucggcggcg

SEQ ID NO: 1488880 - RNA, 16 nt, Pseudomonas aeruginosa PA01
gcaggucgcugucgcg

SEQ ID NO: 1488881 - RNA, 22 nt, Pseudomonas aeruginosa PA01
gcaggucgcugcccucgaccag

SEQ ID NO: 1488882 - RNA, 24 nt, Pseudomonas aeruginosa PA01
gcaggucgcugcccucgaccaggu

SEQ ID NO: 1488883 - RNA, 17 nt, Pseudomonas aeruginosa PA01
gcaggucgcgcggcgcc

SEQ ID NO: 1488884 - RNA, 20 nt, Pseudomonas aeruginosa PA01
gcaggucgcgcggcgccugc

SEQ ID NO: 1488885 - RNA, 17 nt, Pseudomonas aeruginosa PA01
gcaggucgcgcaguucg

SEQ ID NO: 1488886 - RNA, 13 nt, Pseudomonas aeruginosa PA01
gcaggucggccuc

SEQ ID NO: 1488887 - RNA, 20 nt, Pseudomonas aeruginosa PA01
gcaggucaucaggaucaggu

SEQ ID NO: 1488888 - RNA, 15 nt, Pseudomonas aeruginosa PA01
gcaggucacgcccug

SEQ ID NO: 1488889 - RNA, 20 nt, Pseudomonas aeruginosa PA01
gcagguccggguugucguug

SEQ ID NO: 1488890 - RNA, 22 nt, Pseudomonas aeruginosa PA01
gcagguccggguugucguugcg

SEQ ID NO: 1488891 - RNA, 18 nt, Pseudomonas aeruginosa PA01
gcagguccgcgccucgcg

SEQ ID NO: 1488892 - RNA, 19 nt, Pseudomonas aeruginosa PA01
gcagguccgcgccucgcgc

SEQ ID NO: 1488893 - RNA, 18 nt, Pseudomonas aeruginosa PA01
gcaggucgagggcguccu

SEQ ID NO: 1488894 - RNA, 15 nt, Pseudomonas aeruginosa PA01
gcagguagccgccuu

SEQ ID NO: 1488895 - RNA, 14 nt, Pseudomonas aeruginosa PA01
gcagguagccgcgc

SEQ ID NO: 1488896 - RNA, 19 nt, Pseudomonas aeruginosa PA01
gcagguagccugcggccag

SEQ ID NO: 1488897 - RNA, 23 nt, Pseudomonas aeruginosa PA01
gcagguagccugcggccagcgcc

SEQ ID NO: 1488898 - RNA, 24 nt, Pseudomonas aeruginosa PA01
gcagguagccugcggccagcgcca

SEQ ID NO: 1488899 - RNA, 12 nt, Pseudomonas aeruginosa PA01
gcagguagcgcu

SEQ ID NO: 1488900 - RNA, 13 nt, Pseudomonas aeruginosa PA01
gcagguagcgcug

SEQ ID NO: 1488901 - RNA, 22 nt, Pseudomonas aeruginosa PA01
gcagguagcggcgaagcgcagg

SEQ ID NO: 1488902 - RNA, 21 nt, Pseudomonas aeruginosa PA01
gcagguagaaggugcccagcg

SEQ ID NO: 1488903 - RNA, 17 nt, Pseudomonas aeruginosa PA01
gcagguagaccacgcag

SEQ ID NO: 1488904 - RNA, 20 nt, Pseudomonas aeruginosa PA01
gcagguagaccacgcaggcc

SEQ ID NO: 1488905 - RNA, 14 nt, Pseudomonas aeruginosa PA01
gcagguagaccgcc

SEQ ID NO: 1488906 - RNA, 16 nt, Pseudomonas aeruginosa PA01
gcagguaguccagcca

SEQ ID NO: 1488907 - RNA, 20 nt, Pseudomonas aeruginosa PA01
gcagguaguccagccagugc

SEQ ID NO: 1488908 - RNA, 18 nt, Pseudomonas aeruginosa PA01
gcagguagugcucggcca

SEQ ID NO: 1488909 - RNA, 19 nt, Pseudomonas aeruginosa PA01
gcagguagugcucggccag

SEQ ID NO: 1488910 - RNA, 20 nt, Pseudomonas aeruginosa PA01
gcagguagugcucggccagu

SEQ ID NO: 1488911 - RNA, 18 nt, Pseudomonas aeruginosa PA01
gcagguaguggcccucga

SEQ ID NO: 1488912 - RNA, 21 nt, Pseudomonas aeruginosa PA01
gcagguaguucuccaggccca

SEQ ID NO: 1488913 - RNA, 18 nt, Pseudomonas aeruginosa PA01
gcagguacggcgccgcug

SEQ ID NO: 1488914 - RNA, 19 nt, Pseudomonas aeruginosa PA01
gcagguacggcgccgcugc

SEQ ID NO: 1488915 - RNA, 16 nt, Pseudomonas aeruginosa PA01
gcagguacucgccggc

SEQ ID NO: 1488916 - RNA, 18 nt, Pseudomonas aeruginosa PA01
gcagguacucgccggcga

SEQ ID NO: 1488917 - RNA, 13 nt, Pseudomonas aeruginosa PA01
gcagguaacccgc

SEQ ID NO: 1488918 - RNA, 18 nt, Pseudomonas aeruginosa PA01
gcagguaacccgcggcga

SEQ ID NO: 1488919 - RNA, 20 nt, Pseudomonas aeruginosa PA01
gcagguaacccgcggcgagg

SEQ ID NO: 1488920 - RNA, 12 nt, Pseudomonas aeruginosa PA01
gcagggugucga

SEQ ID NO: 1488921 - RNA, 16 nt, Pseudomonas aeruginosa PA01
gcagggugcgggcgcg

SEQ ID NO: 1488922 - RNA, 16 nt, Pseudomonas aeruginosa PA01
gcagggucgccugggu

SEQ ID NO: 1488923 - RNA, 19 nt, Pseudomonas aeruginosa PA01
gcagggucgcgagcagggc

SEQ ID NO: 1488924 - RNA, 23 nt, Pseudomonas aeruginosa PA01
gcagggucgcuuccucggcacuc

SEQ ID NO: 1488925 - RNA, 13 nt, Pseudomonas aeruginosa PA01
gcagggugaagcu

SEQ ID NO: 1488926 - RNA, 16 nt, Pseudomonas aeruginosa PA01
gcaggggcaccggcgg

SEQ ID NO: 1488927 - RNA, 13 nt, Pseudomonas aeruginosa PA01
gcaggggcugccg

SEQ ID NO: 1488928 - RNA, 17 nt, Pseudomonas aeruginosa PA01
gcagggucagcagcgcc

SEQ ID NO: 1488929 - RNA, 19 nt, Pseudomonas aeruginosa PA01
gcagggucagcagcgccag

SEQ ID NO: 1488930 - RNA, 20 nt, Pseudomonas aeruginosa PA01
gcagggucagcagcgccagu

SEQ ID NO: 1488931 - RNA, 14 nt, Pseudomonas aeruginosa PA01
gcaggguaccgcug

SEQ ID NO: 1488932 - RNA, 17 nt, Pseudomonas aeruginosa PA01
gcaggguagccacgccg

SEQ ID NO: 1488933 - RNA, 18 nt, Pseudomonas aeruginosa PA01
gcaggguauuuuccagca

SEQ ID NO: 1488934 - RNA, 16 nt, Pseudomonas aeruginosa PA01
gcagggucacgccggu

SEQ ID NO: 1488935 - RNA, 18 nt, Pseudomonas aeruginosa PA01
gcagggucacgccgguga

SEQ ID NO: 1488936 - RNA, 15 nt, Pseudomonas aeruginosa PA01
gcagggggucuucga

SEQ ID NO: 1488937 - RNA, 14 nt, Pseudomonas aeruginosa PA01
gcagggucaggccc

SEQ ID NO: 1488938 - RNA, 18 nt, Pseudomonas aeruginosa PA01
gcagggucaggcccuuga

SEQ ID NO: 1488939 - RNA, 19 nt, Pseudomonas aeruginosa PA01
gcaggguccauggaccgag

SEQ ID NO: 1488940 - RNA, 16 nt, Pseudomonas aeruginosa PA01
gcagggcggcgagcug

SEQ ID NO: 1488941 - RNA, 14 nt, Pseudomonas aeruginosa PA01
gcagggcggcgaug

SEQ ID NO: 1488942 - RNA, 18 nt, Pseudomonas aeruginosa PA01
gcagggcggcgaugacca

SEQ ID NO: 1488943 - RNA, 15 nt, Pseudomonas aeruginosa PA01
gcagggcggcgccug

SEQ ID NO: 1488944 - RNA, 17 nt, Pseudomonas aeruginosa PA01
gcagggcggcgccugga

SEQ ID NO: 1488945 - RNA, 21 nt, Pseudomonas aeruginosa PA01
gcagggcguccaguagcgccu

SEQ ID NO: 1488946 - RNA, 21 nt, Pseudomonas aeruginosa PA01
gcagggcgucgaaggcggcgc

SEQ ID NO: 1488947 - RNA, 18 nt, Pseudomonas aeruginosa PA01
gcagggcgucgcccucgg

SEQ ID NO: 1488948 - RNA, 21 nt, Pseudomonas aeruginosa PA01
gcagggcgucgcccucggcgc

SEQ ID NO: 1488949 - RNA, 15 nt, Pseudomonas aeruginosa PA01
gcagggcgucgccgg

SEQ ID NO: 1488950 - RNA, 17 nt, Pseudomonas aeruginosa PA01
gcagggcgucgccggga

SEQ ID NO: 1488951 - RNA, 12 nt, Pseudomonas aeruginosa PA01
gcagggcgcuga

SEQ ID NO: 1488952 - RNA, 22 nt, Pseudomonas aeruginosa PA01
gcagggcuauguauucggcggu

SEQ ID NO: 1488953 - RNA, 23 nt, Pseudomonas aeruginosa PA01
gcagggcugcuguugccagggau

SEQ ID NO: 1488954 - RNA, 17 nt, Pseudomonas aeruginosa PA01
gcagggcuuccuuggcg

SEQ ID NO: 1488955 - RNA, 17 nt, Pseudomonas aeruginosa PA01
gcagggcuugugcagag

SEQ ID NO: 1488956 - RNA, 13 nt, Pseudomonas aeruginosa PA01
gcagggccagcca

SEQ ID NO: 1488957 - RNA, 18 nt, Pseudomonas aeruginosa PA01
gcagggccagcgccuggc

SEQ ID NO: 1488958 - RNA, 12 nt, Pseudomonas aeruginosa PA01
gcagggccgagc

SEQ ID NO: 1488959 - RNA, 14 nt, Pseudomonas aeruginosa PA01
gcagggccgccagc

SEQ ID NO: 1488960 - RNA, 12 nt, Pseudomonas aeruginosa PA01
gcagggccgccg

SEQ ID NO: 1488961 - RNA, 16 nt, Pseudomonas aeruginosa PA01
gcagggccgccgaggu

SEQ ID NO: 1488962 - RNA, 15 nt, Pseudomonas aeruginosa PA01
gcagggccaggccga

SEQ ID NO: 1488963 - RNA, 16 nt, Pseudomonas aeruginosa PA01
gcagggccaggccgag

SEQ ID NO: 1488964 - RNA, 21 nt, Pseudomonas aeruginosa PA01
gcagggccagggcggcggcga

SEQ ID NO: 1488965 - RNA, 14 nt, Pseudomonas aeruginosa PA01
gcagggccgcggcg

SEQ ID NO: 1488966 - RNA, 23 nt, Pseudomonas aeruginosa PA01
gcagggccgcggcggauaacgcc

SEQ ID NO: 1488967 - RNA, 14 nt, Pseudomonas aeruginosa PA01
gcagggccggaugc

SEQ ID NO: 1488968 - RNA, 14 nt, Pseudomonas aeruginosa PA01
gcagggccaggccg

SEQ ID NO: 1488969 - RNA, 15 nt, Pseudomonas aeruginosa PA01
gcagggcgccgauca

SEQ ID NO: 1488970 - RNA, 21 nt, Pseudomonas aeruginosa PA01
gcagggcgccgaucaggcgua

SEQ ID NO: 1488971 - RNA, 11 nt, Pseudomonas aeruginosa PA01
gcagggcgauc

SEQ ID NO: 1488972 - RNA, 17 nt, Pseudomonas aeruginosa PA01
gcagggcgauccagaag

SEQ ID NO: 1488973 - RNA, 21 nt, Pseudomonas aeruginosa PA01
gcagggcgauccagaagauca

SEQ ID NO: 1488974 - RNA, 15 nt, Pseudomonas aeruginosa PA01
gcagggcgauccgcc

SEQ ID NO: 1488975 - RNA, 19 nt, Pseudomonas aeruginosa PA01
gcagggcgaugccgauggc

SEQ ID NO: 1488976 - RNA, 22 nt, Pseudomonas aeruginosa PA01
gcagggcgaugccgauggcgcc

SEQ ID NO: 1488977 - RNA, 15 nt, Pseudomonas aeruginosa PA01
gcagggcgcaaccug

SEQ ID NO: 1488978 - RNA, 20 nt, Pseudomonas aeruginosa PA01
gcagggcgcaaccugguuca

SEQ ID NO: 1488979 - RNA, 17 nt, Pseudomonas aeruginosa PA01
gagggaaugaagaagcc

SEQ ID NO: 1488980 - RNA, 18 nt, Pseudomonas aeruginosa PA01
gagggcugagacgcugcc

SEQ ID NO: 1488981 - RNA, 17 nt, Pseudomonas aeruginosa PA01
gagggcugccgcccggu

SEQ ID NO: 1488982 - RNA, 15 nt, Pseudomonas aeruginosa PA01
gagggcugcugucca

SEQ ID NO: 1488983 - RNA, 16 nt, Pseudomonas aeruginosa PA01
gagggcugggcagcgc

SEQ ID NO: 1488984 - RNA, 19 nt, Pseudomonas aeruginosa PA01
gagggcugggcagcgccgc

SEQ ID NO: 1488985 - RNA, 21 nt, Pseudomonas aeruginosa PA01
gaggcugucgucgaggguggc

SEQ ID NO: 1488986 - RNA, 19 nt, Pseudomonas aeruginosa PA01
gaggcugugccccaggcac

SEQ ID NO: 1488987 - RNA, 17 nt, Pseudomonas aeruginosa PA01
gaggcuuuccagcaggc

SEQ ID NO: 1488988 - RNA, 17 nt, Pseudomonas aeruginosa PA01
gaggcuuuccugcgccu

SEQ ID NO: 1488989 - RNA, 21 nt, Pseudomonas aeruginosa PA01
gagggaacgucuggccagaag

SEQ ID NO: 1488990 - RNA, 22 nt, Pseudomonas aeruginosa PA01
gagggguaaggcaugcccaggc

SEQ ID NO: 1488991 - RNA, 18 nt, Pseudomonas aeruginosa PA01
gagggucagaccagcccu

SEQ ID NO: 1488992 - RNA, 20 nt, Pseudomonas aeruginosa PA01
gagggucagccggccgaucu

SEQ ID NO: 1488993 - RNA, 12 nt, Pseudomonas aeruginosa PA01
gagggucagcga

SEQ ID NO: 1488994 - RNA, 22 nt, Pseudomonas aeruginosa PA01
gaggggaagaucuccgggucca

SEQ ID NO: 1488995 - RNA, 12 nt, Pseudomonas aeruginosa PA01
gaggggcggccg

SEQ ID NO: 1488996 - RNA, 14 nt, Pseudomonas aeruginosa PA01
gaggggcggccgcc

SEQ ID NO: 1488997 - RNA, 21 nt, Pseudomonas aeruginosa PA01
gagggggccucggccagcgcc

SEQ ID NO: 1488998 - RNA, 14 nt, Pseudomonas aeruginosa PA01
gagggucaggccga

SEQ ID NO: 1488999 - RNA, 15 nt, Pseudomonas aeruginosa PA01
gagggucaggccgag

SEQ ID NO: 1489000 - RNA, 12 nt, Pseudomonas aeruginosa PA01
gagggucgccuu

SEQ ID NO: 1489001 - RNA, 17 nt, Pseudomonas aeruginosa PA01
gaggcccguauggcggg

SEQ ID NO: 1489002 - RNA, 20 nt, Pseudomonas aeruginosa PA01
gaggccaggccgagcgccag

SEQ ID NO: 1489003 - RNA, 17 nt, Pseudomonas aeruginosa PA01
gaggcccacgggcggcc

SEQ ID NO: 1489004 - RNA, 19 nt, Pseudomonas aeruginosa PA01
gaggcccacgggcggccga

SEQ ID NO: 1489005 - RNA, 21 nt, Pseudomonas aeruginosa PA01
gaggcccacgggcggccgacg

SEQ ID NO: 1489006 - RNA, 16 nt, Pseudomonas aeruginosa PA01
gaggcccgcgccgccg

SEQ ID NO: 1489007 - RNA, 17 nt, Pseudomonas aeruginosa PA01
gaggcccgcgccgccgg

SEQ ID NO: 1489008 - RNA, 22 nt, Pseudomonas aeruginosa PA01
gaggccaccacuucgcggacca

SEQ ID NO: 1489009 - RNA, 16 nt, Pseudomonas aeruginosa PA01
gaggccagcaggccgu

SEQ ID NO: 1489010 - RNA, 15 nt, Pseudomonas aeruginosa PA01
gaggcuguccagcag

SEQ ID NO: 1489011 - RNA, 17 nt, Pseudomonas aeruginosa PA01
gaggcuguccagcaggc

SEQ ID NO: 1489012 - RNA, 20 nt, Pseudomonas aeruginosa PA01
gaggcuggcgcucugcagug

SEQ ID NO: 1489013 - RNA, 14 nt, Pseudomonas aeruginosa PA01
gaggcuggggacgg

SEQ ID NO: 1489014 - RNA, 16 nt, Pseudomonas aeruginosa PA01
gaggcugaucugccgg

SEQ ID NO: 1489015 - RNA, 15 nt, Pseudomonas aeruginosa PA01
gaggcugcgcuccag

SEQ ID NO: 1489016 - RNA, 13 nt, Pseudomonas aeruginosa PA01
gaggcuggccagc

SEQ ID NO: 1489017 - RNA, 16 nt, Pseudomonas aeruginosa PA01
gaggcuggccagcaau

SEQ ID NO: 1489018 - RNA, 15 nt, Pseudomonas aeruginosa PA01
gaggcucggcggcca

SEQ ID NO: 1489019 - RNA, 16 nt, Pseudomonas aeruginosa PA01
gaggcucggcggccau

SEQ ID NO: 1489020 - RNA, 15 nt, Pseudomonas aeruginosa PA01
gaggcucggucgcgc

SEQ ID NO: 1489021 - RNA, 17 nt, Pseudomonas aeruginosa PA01
gaggcuaacgccgagga

SEQ ID NO: 1489022 - RNA, 15 nt, Pseudomonas aeruginosa PA01
gaggcccucggcgcc

SEQ ID NO: 1489023 - RNA, 17 nt, Pseudomonas aeruginosa PA01
gaggcccucggcggcga

SEQ ID NO: 1489024 - RNA, 19 nt, Pseudomonas aeruginosa PA01
gaggccgaaauggcggugg

SEQ ID NO: 1489025 - RNA, 22 nt, Pseudomonas aeruginosa PA01
gaggccgaaauggcgguggccg

SEQ ID NO: 1489026 - RNA, 18 nt, Pseudomonas aeruginosa PA01
gagguagagcacgccguc

SEQ ID NO: 1489027 - RNA, 19 nt, Pseudomonas aeruginosa PA01
gagguagaacaggcugccg

SEQ ID NO: 1489028 - RNA, 20 nt, Pseudomonas aeruginosa PA01
gagguagaacaggcugccgc

SEQ ID NO: 1489029 - RNA, 23 nt, Pseudomonas aeruginosa PA01
gaggguggcgcccaugccgcccg

SEQ ID NO: 1489030 - RNA, 13 nt, Pseudomonas aeruginosa PA01
gaggguggcgccg

SEQ ID NO: 1489031 - RNA, 17 nt, Pseudomonas aeruginosa PA01
gagggucugcucgacga

SEQ ID NO: 1489032 - RNA, 16 nt, Pseudomonas aeruginosa PA01
gaggguugggcagcgu

SEQ ID NO: 1489033 - RNA, 16 nt, Pseudomonas aeruginosa PA01
gaggguugucaccggc

SEQ ID NO: 1489034 - RNA, 17 nt, Pseudomonas aeruginosa PA01
gaggguugucaccggca

SEQ ID NO: 1489035 - RNA, 15 nt, Pseudomonas aeruginosa PA01
gagguagcugcgccg

SEQ ID NO: 1489036 - RNA, 15 nt, Pseudomonas aeruginosa PA01
gagguccggcuccgg

SEQ ID NO: 1489037 - RNA, 21 nt, Pseudomonas aeruginosa PA01
gagguccggcuccggcugcgu

SEQ ID NO: 1489038 - RNA, 19 nt, Pseudomonas aeruginosa PA01
gagguauugcgcguggcgu

SEQ ID NO: 1489039 - RNA, 20 nt, Pseudomonas aeruginosa PA01
gagguugauucaggcggcga

SEQ ID NO: 1489040 - RNA, 20 nt, Pseudomonas aeruginosa PA01
gagguugcccacggccaggc

SEQ ID NO: 1489041 - RNA, 21 nt, Pseudomonas aeruginosa PA01
gagguucuugcccagcaacgc

SEQ ID NO: 1489042 - RNA, 13 nt, Pseudomonas aeruginosa PA01
gagguugcgcagg

SEQ ID NO: 1489043 - RNA, 13 nt, Pseudomonas aeruginosa PA01
gaggucggcggcg

SEQ ID NO: 1489044 - RNA, 14 nt, Pseudomonas aeruginosa PA01
gaggucggcgcgcc

SEQ ID NO: 1489045 - RNA, 15 nt, Pseudomonas aeruginosa PA01
gaggucguccaccuc

SEQ ID NO: 1489046 - RNA, 23 nt, Pseudomonas aeruginosa PA01
gaggucguccaccuccaccuugc

SEQ ID NO: 1489047 - RNA, 20 nt, Pseudomonas aeruginosa PA01
gaggucggcaaagccgcugu

SEQ ID NO: 1489048 - RNA, 20 nt, Pseudomonas aeruginosa PA01
gaggucgccguccuugucgc

SEQ ID NO: 1489049 - RNA, 20 nt, Pseudomonas aeruginosa PA01
gaggucgcgggccaggcccu

SEQ ID NO: 1489050 - RNA, 15 nt, Pseudomonas aeruginosa PA01
gaggucgaccagcca

SEQ ID NO: 1489051 - RNA, 13 nt, Pseudomonas aeruginosa PA01
gaggucgacggcg

SEQ ID NO: 1489052 - RNA, 15 nt, Pseudomonas aeruginosa PA01
gaggucgccgccagc

SEQ ID NO: 1489053 - RNA, 21 nt, Pseudomonas aeruginosa PA01
gaggucgccgccagcuaccgg

SEQ ID NO: 1489054 - RNA, 22 nt, Pseudomonas aeruginosa PA01
gaggucgccgccagcuaccggc

SEQ ID NO: 1489055 - RNA, 13 nt, Pseudomonas aeruginosa PA01
gaggaggcgccgg

SEQ ID NO: 1489056 - RNA, 16 nt, Pseudomonas aeruginosa PA01
gaggaucagucgcugc

SEQ ID NO: 1489057 - RNA, 19 nt, Pseudomonas aeruginosa PA01
gaggaucacgcagcaggcg

SEQ ID NO: 1489058 - RNA, 22 nt, Pseudomonas aeruginosa PA01
gaggaucagccacgggcgccag

SEQ ID NO: 1489059 - RNA, 17 nt, Pseudomonas aeruginosa PA01
gaggaucagcgaacccg

SEQ ID NO: 1489060 - RNA, 19 nt, Pseudomonas aeruginosa PA01
gaggcauugcacaacgggu

SEQ ID NO: 1489061 - RNA, 13 nt, Pseudomonas aeruginosa PA01
gaggcagguggcg

SEQ ID NO: 1489062 - RNA, 22 nt, Pseudomonas aeruginosa PA01
gaggaucgagccuugcggcgcu

SEQ ID NO: 1489063 - RNA, 14 nt, Pseudomonas aeruginosa PA01
gaggaucgccagca

SEQ ID NO: 1489064 - RNA, 17 nt, Pseudomonas aeruginosa PA01
gaggaucgccaggacgc

SEQ ID NO: 1489065 - RNA, 12 nt, Pseudomonas aeruginosa PA01
gaggaucggcca

SEQ ID NO: 1489066 - RNA, 16 nt, Pseudomonas aeruginosa PA01
gaggaucuccaacugg

SEQ ID NO: 1489067 - RNA, 20 nt, Pseudomonas aeruginosa PA01
gaggaucuccaacuggcggc

SEQ ID NO: 1489068 - RNA, 23 nt, Pseudomonas aeruginosa PA01
gaggaucuccaacuggcggcugg

SEQ ID NO: 1489069 - RNA, 17 nt, Pseudomonas aeruginosa PA01
gaggacgccgggcuggu

SEQ ID NO: 1489070 - RNA, 16 nt, Pseudomonas aeruginosa PA01
gaggacgccgccgguc

SEQ ID NO: 1489071 - RNA, 15 nt, Pseudomonas aeruginosa PA01
gaggacugccagggu

SEQ ID NO: 1489072 - RNA, 17 nt, Pseudomonas aeruginosa PA01
gaggaccgacggcaacu

SEQ ID NO: 1489073 - RNA, 15 nt, Pseudomonas aeruginosa PA01
gaggacgaucagcuc

SEQ ID NO: 1489074 - RNA, 14 nt, Pseudomonas aeruginosa PA01
gaggaccuggccgc

SEQ ID NO: 1489075 - RNA, 14 nt, Pseudomonas aeruginosa PA01
gaggacccggcgga

SEQ ID NO: 1489076 - RNA, 17 nt, Pseudomonas aeruginosa PA01
gagcuuugcgcagccac

SEQ ID NO: 1489077 - RNA, 18 nt, Pseudomonas aeruginosa PA01
gagcuugaugaagcccgc

SEQ ID NO: 1489078 - RNA, 14 nt, Pseudomonas aeruginosa PA01
gagcuugcaauccg

SEQ ID NO: 1489079 - RNA, 19 nt, Pseudomonas aeruginosa PA01
gagcuucccgcauggcacu

SEQ ID NO: 1489080 - RNA, 19 nt, Pseudomonas aeruginosa PA01
gagcuucucgucgccgccg

SEQ ID NO: 1489081 - RNA, 20 nt, Pseudomonas aeruginosa PA01
gagcuucucgucgccgccgu

SEQ ID NO: 1489082 - RNA, 15 nt, Pseudomonas aeruginosa PA01
gagcuucgccgcgca

SEQ ID NO: 1489083 - RNA, 17 nt, Pseudomonas aeruginosa PA01
gagcuguuucagcccac

SEQ ID NO: 1489084 - RNA, 13 nt, Pseudomonas aeruginosa PA01
gagcuggcggccg

SEQ ID NO: 1489085 - RNA, 23 nt, Pseudomonas aeruginosa PA01
gagcuggaaauggcggucgccga

SEQ ID NO: 1489086 - RNA, 17 nt, Pseudomonas aeruginosa PA01
gagcuggaagucgucca

SEQ ID NO: 1489087 - RNA, 23 nt, Pseudomonas aeruginosa PA01
gagcuggaagucguccagcaggu

SEQ ID NO: 1489088 - RNA, 18 nt, Pseudomonas aeruginosa PA01
gagcuggacgacgcuggc

SEQ ID NO: 1489089 - RNA, 20 nt, Pseudomonas aeruginosa PA01
gagcuggacgacgcuggccu

SEQ ID NO: 1489090 - RNA, 16 nt, Pseudomonas aeruginosa PA01
gagcuggcgcaggccu

SEQ ID NO: 1489091 - RNA, 20 nt, Pseudomonas aeruginosa PA01
gagcuggcccaguugcccgg

SEQ ID NO: 1489092 - RNA, 21 nt, Pseudomonas aeruginosa PA01
gagcuggcccaguugcccggc

SEQ ID NO: 1489093 - RNA, 13 nt, Pseudomonas aeruginosa PA01
gagcuggccgagc

SEQ ID NO: 1489094 - RNA, 14 nt, Pseudomonas aeruginosa PA01
gagcuggccgagcg

SEQ ID NO: 1489095 - RNA, 15 nt, Pseudomonas aeruginosa PA01
gagcugaucgcgcag

SEQ ID NO: 1489096 - RNA, 14 nt, Pseudomonas aeruginosa PA01
gagcugaccaccag

SEQ ID NO: 1489097 - RNA, 14 nt, Pseudomonas aeruginosa PA01
gagcugcacguugu

SEQ ID NO: 1489098 - RNA, 21 nt, Pseudomonas aeruginosa PA01
gagcugcacguuguugcccac

SEQ ID NO: 1489099 - RNA, 19 nt, Pseudomonas aeruginosa PA01
gagcugcaugagugucgcc

SEQ ID NO: 1489100 - RNA, 22 nt, Pseudomonas aeruginosa PA01
gagcugcaaggcuucggcgguc

SEQ ID NO: 1489101 - RNA, 16 nt, Pseudomonas aeruginosa PA01
gagcugccgcaccgcc

SEQ ID NO: 1489102 - RNA, 17 nt, Pseudomonas aeruginosa PA01
gagcugccgcaccgccu

SEQ ID NO: 1489103 - RNA, 14 nt, Pseudomonas aeruginosa PA01
gagcugcucgaagc

SEQ ID NO: 1489104 - RNA, 15 nt, Pseudomonas aeruginosa PA01
gagcugcucgaagca

SEQ ID NO: 1489105 - RNA, 16 nt, Pseudomonas aeruginosa PA01
gagcugcucgauggcg

SEQ ID NO: 1489106 - RNA, 19 nt, Pseudomonas aeruginosa PA01
gagcugcucgauggcggcc

SEQ ID NO: 1489107 - RNA, 21 nt, Pseudomonas aeruginosa PA01
gagcugcucgauggcggccug

SEQ ID NO: 1489108 - RNA, 17 nt, Pseudomonas aeruginosa PA01
gagcugcucggcggugg

SEQ ID NO: 1489109 - RNA, 18 nt, Pseudomonas aeruginosa PA01
gagcguucggaucggccc

SEQ ID NO: 1489110 - RNA, 18 nt, Pseudomonas aeruginosa PA01
gagcguuucgcggaaggc

SEQ ID NO: 1489111 - RNA, 13 nt, Pseudomonas aeruginosa PA01
gagcgugcggccg

SEQ ID NO: 1489112 - RNA, 17 nt, Pseudomonas aeruginosa PA01
gagcucccugccgcccu

SEQ ID NO: 1489113 - RNA, 15 nt, Pseudomonas aeruginosa PA01
gagcgggccguuggc

SEQ ID NO: 1489114 - RNA, 21 nt, Pseudomonas aeruginosa PA01
gagcgggcgagggcggcgcgg

SEQ ID NO: 1489115 - RNA, 22 nt, Pseudomonas aeruginosa PA01
gagcgggcgagggcggcgcggg

SEQ ID NO: 1489116 - RNA, 13 nt, Pseudomonas aeruginosa PA01
gagcgggcgccgg

SEQ ID NO: 1489117 - RNA, 21 nt, Pseudomonas aeruginosa PA01
gagcgggcgccggaccagccg

SEQ ID NO: 1489118 - RNA, 17 nt, Pseudomonas aeruginosa PA01
gagcgguuauucgcccu

SEQ ID NO: 1489119 - RNA, 15 nt, Pseudomonas aeruginosa PA01
gagcgggucgauggc

SEQ ID NO: 1489120 - RNA, 17 nt, Pseudomonas aeruginosa PA01
gagcgggucagcagcac

SEQ ID NO: 1489121 - RNA, 16 nt, Pseudomonas aeruginosa PA01
gagcguaucgaugcgc

SEQ ID NO: 1489122 - RNA, 22 nt, Pseudomonas aeruginosa PA01
gagcguccaccagcgcccguag

SEQ ID NO: 1489123 - RNA, 18 nt, Pseudomonas aeruginosa PA01
gagcguccggcagggccu

SEQ ID NO: 1489124 - RNA, 16 nt, Pseudomonas aeruginosa PA01
gagcgucgagucgcgc

SEQ ID NO: 1489125 - RNA, 19 nt, Pseudomonas aeruginosa PA01
aacugccgacggcggcggc

SEQ ID NO: 1489126 - RNA, 13 nt, Pseudomonas aeruginosa PA01
aacugacggcgga

SEQ ID NO: 1489127 - RNA, 20 nt, Pseudomonas aeruginosa PA01
aacugacggcggaaggcggc

SEQ ID NO: 1489128 - RNA, 19 nt, Pseudomonas aeruginosa PA01
aacugcagggcgucgccgg

SEQ ID NO: 1489129 - RNA, 13 nt, Pseudomonas aeruginosa PA01
gagcggccgugca

SEQ ID NO: 1489130 - RNA, 17 nt, Pseudomonas aeruginosa PA01
gagcggccaggucgagg

SEQ ID NO: 1489131 - RNA, 15 nt, Pseudomonas aeruginosa PA01
gagcggaucgucgcg

SEQ ID NO: 1489132 - RNA, 16 nt, Pseudomonas aeruginosa PA01
gagcggaucgucgcgg

SEQ ID NO: 1489133 - RNA, 17 nt, Pseudomonas aeruginosa PA01
gagcggaucgucgcggc

SEQ ID NO: 1489134 - RNA, 18 nt, Pseudomonas aeruginosa PA01
gagcggaucgucgcggcg

SEQ ID NO: 1489135 - RNA, 22 nt, Pseudomonas aeruginosa PA01
gagcggcaccucgauggcggcg

SEQ ID NO: 1489136 - RNA, 14 nt, Pseudomonas aeruginosa PA01
gagcggcugccgag

SEQ ID NO: 1489137 - RNA, 13 nt, Pseudomonas aeruginosa PA01
gagcggcggccgu

SEQ ID NO: 1489138 - RNA, 15 nt, Pseudomonas aeruginosa PA01
gagcggcggccgucg

SEQ ID NO: 1489139 - RNA, 13 nt, Pseudomonas aeruginosa PA01
gagcggcccgcgg

SEQ ID NO: 1489140 - RNA, 13 nt, Pseudomonas aeruginosa PA01
gagcggcgccagg

SEQ ID NO: 1489141 - RNA, 14 nt, Pseudomonas aeruginosa PA01
gagcggcgcccugg

SEQ ID NO: 1489142 - RNA, 12 nt, Pseudomonas aeruginosa PA01
gagcggcgcgaa

SEQ ID NO: 1489143 - RNA, 16 nt, Pseudomonas aeruginosa PA01
aacucgcgggcgcgca

SEQ ID NO: 1489144 - RNA, 15 nt, Pseudomonas aeruginosa PA01
aacucgcggucccgg

SEQ ID NO: 1489145 - RNA, 14 nt, Pseudomonas aeruginosa PA01
gagcggcugguggc

SEQ ID NO: 1489146 - RNA, 17 nt, Pseudomonas aeruginosa PA01
aacucguccggucgcac

SEQ ID NO: 1489147 - RNA, 12 nt, Pseudomonas aeruginosa PA01
aacucggcgccc

SEQ ID NO: 1489148 - RNA, 18 nt, Pseudomonas aeruginosa PA01
aacucggcgcccagggcu

SEQ ID NO: 1489149 - RNA, 18 nt, Pseudomonas aeruginosa PA01
aacucggcgccgaucucc

SEQ ID NO: 1489150 - RNA, 13 nt, Pseudomonas aeruginosa PA01
aacucggcggcga

SEQ ID NO: 1489151 - RNA, 18 nt, Pseudomonas aeruginosa PA01
aacucgucguccagcggc

SEQ ID NO: 1489152 - RNA, 24 nt, Pseudomonas aeruginosa PA01
gagcgccgcgcagcgcggcgcugg

SEQ ID NO: 1489153 - RNA, 12 nt, Pseudomonas aeruginosa PA01
gagcgcccggca

SEQ ID NO: 1489154 - RNA, 13 nt, Pseudomonas aeruginosa PA01
gagcgccgccggu

SEQ ID NO: 1489155 - RNA, 13 nt, Pseudomonas aeruginosa PA01
gagcgccgccugg

SEQ ID NO: 1489156 - RNA, 22 nt, Pseudomonas aeruginosa PA01
gagcgcuucauccugcgcgccu

SEQ ID NO: 1489157 - RNA, 19 nt, Pseudomonas aeruginosa PA01
gagcggaaaagcaggccaa

SEQ ID NO: 1489158 - RNA, 22 nt, Pseudomonas aeruginosa PA01
gagcggaaacccgugguccgcc

SEQ ID NO: 1489159 - RNA, 18 nt, Pseudomonas aeruginosa PA01
gagcgaaaucggcaggcu

SEQ ID NO: 1489160 - RNA, 17 nt, Pseudomonas aeruginosa PA01
gagccuggccaggcgcu

SEQ ID NO: 1489161 - RNA, 19 nt, Pseudomonas aeruginosa PA01
gagccuucagcacggcgcg

SEQ ID NO: 1489162 - RNA, 21 nt, Pseudomonas aeruginosa PA01
gagccuucagcacggcgcggg

SEQ ID NO: 1489163 - RNA, 22 nt, Pseudomonas aeruginosa PA01
gagccuuucacuuucagguccu

SEQ ID NO: 1489164 - RNA, 16 nt, Pseudomonas aeruginosa PA01
gagcgaaacgccccgu

SEQ ID NO: 1489165 - RNA, 22 nt, Pseudomonas aeruginosa PA01
gagcgaaacgccccgucgacgc

SEQ ID NO: 1489166 - RNA, 17 nt, Pseudomonas aeruginosa PA01
gagcgaaacggcgcuga

SEQ ID NO: 1489167 - RNA, 18 nt, Pseudomonas aeruginosa PA01
gagccuucuagcgaaggc

SEQ ID NO: 1489168 - RNA, 13 nt, Pseudomonas aeruginosa PA01
gagcgccacgggu

SEQ ID NO: 1489169 - RNA, 17 nt, Pseudomonas aeruginosa PA01
gagcgccagccagcgcg

SEQ ID NO: 1489170 - RNA, 12 nt, Pseudomonas aeruginosa PA01
gagcgccagcga

SEQ ID NO: 1489171 - RNA, 13 nt, Pseudomonas aeruginosa PA01
gagcgccagcgag

SEQ ID NO: 1489172 - RNA, 15 nt, Pseudomonas aeruginosa PA01
gagcgcagcgccacc

SEQ ID NO: 1489173 - RNA, 22 nt, Pseudomonas aeruginosa PA01
gagcgcccgccgucauggcggg

SEQ ID NO: 1489174 - RNA, 19 nt, Pseudomonas aeruginosa PA01
gagcgccgccaggcaggcc

SEQ ID NO: 1489175 - RNA, 18 nt, Pseudomonas aeruginosa PA01
gagcgccaugacccgcgg

SEQ ID NO: 1489176 - RNA, 20 nt, Pseudomonas aeruginosa PA01
gagcgccaugacccgcggca

SEQ ID NO: 1489177 - RNA, 21 nt, Pseudomonas aeruginosa PA01
gagcgccaugacccgcggcag

SEQ ID NO: 1489178 - RNA, 18 nt, Pseudomonas aeruginosa PA01
gagcgccaucagcgacca

SEQ ID NO: 1489179 - RNA, 21 nt, Pseudomonas aeruginosa PA01
gagccggauagaucaggccgg

SEQ ID NO: 1489180 - RNA, 22 nt, Pseudomonas aeruginosa PA01
gagccggauagaucaggccggc

SEQ ID NO: 1489181 - RNA, 19 nt, Pseudomonas aeruginosa PA01
gagccggcugaugcccggg

SEQ ID NO: 1489182 - RNA, 14 nt, Pseudomonas aeruginosa PA01
gagccggcugccga

SEQ ID NO: 1489183 - RNA, 19 nt, Pseudomonas aeruginosa PA01
gagccgcugcggcucgccg

SEQ ID NO: 1489184 - RNA, 20 nt, Pseudomonas aeruginosa PA01
gagccgcugcggcucgccga

SEQ ID NO: 1489185 - RNA, 14 nt, Pseudomonas aeruginosa PA01
gagccgcugguagc

SEQ ID NO: 1489186 - RNA, 13 nt, Pseudomonas aeruginosa PA01
gagccgcuggucc

SEQ ID NO: 1489187 - RNA, 21 nt, Pseudomonas aeruginosa PA01
gagccgcguucagucccgcgg

SEQ ID NO: 1489188 - RNA, 23 nt, Pseudomonas aeruginosa PA01
gagccgcgcguaggcuuggucgg

SEQ ID NO: 1489189 - RNA, 15 nt, Pseudomonas aeruginosa PA01
gagccgcgcugcugg

SEQ ID NO: 1489190 - RNA, 15 nt, Pseudomonas aeruginosa PA01
gagccgcgcagcagu

SEQ ID NO: 1489191 - RNA, 13 nt, Pseudomonas aeruginosa PA01
gagccgccggacu

SEQ ID NO: 1489192 - RNA, 14 nt, Pseudomonas aeruginosa PA01
gacguaacggcuug

SEQ ID NO: 1489193 - RNA, 22 nt, Pseudomonas aeruginosa PA01
gaucacaccgaagucgcccgcc

SEQ ID NO: 1489194 - RNA, 18 nt, Pseudomonas aeruginosa PA01
gaucacauacaccuugcg

SEQ ID NO: 1489195 - RNA, 23 nt, Pseudomonas aeruginosa PA01
gaucacauacaccuugcgacagg

SEQ ID NO: 1489196 - RNA, 20 nt, Pseudomonas aeruginosa PA01
gaucacaucgcccggcagca

SEQ ID NO: 1489197 - RNA, 15 nt, Pseudomonas aeruginosa PA01
gaucaccaccaccgu

SEQ ID NO: 1489198 - RNA, 22 nt, Pseudomonas aeruginosa PA01
gaucaccaccaccgucuggcgc

SEQ ID NO: 1489199 - RNA, 23 nt, Pseudomonas aeruginosa PA01
gaucaccaccaccgucuggcgca

SEQ ID NO: 1489200 - RNA, 21 nt, Pseudomonas aeruginosa PA01
gaucaccaccagcgccgccac

SEQ ID NO: 1489201 - RNA, 16 nt, Pseudomonas aeruginosa PA01
gaucaccaccggcugg

SEQ ID NO: 1489202 - RNA, 20 nt, Pseudomonas aeruginosa PA01
gaucacgaacagcuugccgu

SEQ ID NO: 1489203 - RNA, 17 nt, Pseudomonas aeruginosa PA01
gaucacgaagcggucgc

SEQ ID NO: 1489204 - RNA, 14 nt, Pseudomonas aeruginosa PA01
gaucaccuggccau

SEQ ID NO: 1489205 - RNA, 16 nt, Pseudomonas aeruginosa PA01
gaucaccuggccgugc

SEQ ID NO: 1489206 - RNA, 17 nt, Pseudomonas aeruginosa PA01
gaucaccuggccgugcu

SEQ ID NO: 1489207 - RNA, 20 nt, Pseudomonas aeruginosa PA01
gaucaccuggccgugcucga

SEQ ID NO: 1489208 - RNA, 23 nt, Pseudomonas aeruginosa PA01
gaucaccggaucgaugcccggcu

SEQ ID NO: 1489209 - RNA, 14 nt, Pseudomonas aeruginosa PA01
gaucaccggaaccg

SEQ ID NO: 1489210 - RNA, 22 nt, Pseudomonas aeruginosa PA01
gaucaccagcaauugccggcgu

SEQ ID NO: 1489211 - RNA, 17 nt, Pseudomonas aeruginosa PA01
gaucaccagcgccaggc

SEQ ID NO: 1489212 - RNA, 22 nt, Pseudomonas aeruginosa PA01
gaucaccagggucggcaccugc

SEQ ID NO: 1489213 - RNA, 14 nt, Pseudomonas aeruginosa PA01
gauauaacgcgagc

SEQ ID NO: 1489214 - RNA, 15 nt, Pseudomonas aeruginosa PA01
gauagcggcgcgagg

SEQ ID NO: 1489215 - RNA, 20 nt, Pseudomonas aeruginosa PA01
gauagcgauaggccuugccu

SEQ ID NO: 1489216 - RNA, 17 nt, Pseudomonas aeruginosa PA01
gauagccgugcagcagc

SEQ ID NO: 1489217 - RNA, 22 nt, Pseudomonas aeruginosa PA01
gauagccgugcagcagcgaccu

SEQ ID NO: 1489218 - RNA, 17 nt, Pseudomonas aeruginosa PA01
gauauucgacgcgcggc

SEQ ID NO: 1489219 - RNA, 14 nt, Pseudomonas aeruginosa PA01
gauauugccgcggg

SEQ ID NO: 1489220 - RNA, 16 nt, Pseudomonas aeruginosa PA01
gauauccagcggcagc

SEQ ID NO: 1489221 - RNA, 17 nt, Pseudomonas aeruginosa PA01
gauauccagcggcagcc

SEQ ID NO: 1489222 - RNA, 12 nt, Pseudomonas aeruginosa PA01
gauauagcccug

SEQ ID NO: 1489223 - RNA, 23 nt, Pseudomonas aeruginosa PA01
gauauagcccugggcgccgccgg

SEQ ID NO: 1489224 - RNA, 14 nt, Pseudomonas aeruginosa PA01
gauagccggggccg

SEQ ID NO: 1489225 - RNA, 22 nt, Pseudomonas aeruginosa PA01
gauacgucuucgauggcggccg

SEQ ID NO: 1489226 - RNA, 16 nt, Pseudomonas aeruginosa PA01
gauacccuggccggcc

SEQ ID NO: 1489227 - RNA, 20 nt, Pseudomonas aeruginosa PA01
gauacccugggagccgccgg

SEQ ID NO: 1489228 - RNA, 22 nt, Pseudomonas aeruginosa PA01
gauacgcuccggugccagggcg

SEQ ID NO: 1489229 - RNA, 14 nt, Pseudomonas aeruginosa PA01
gauacgcucggcca

SEQ ID NO: 1489230 - RNA, 14 nt, Pseudomonas aeruginosa PA01
gauacccaggccgu

SEQ ID NO: 1489231 - RNA, 17 nt, Pseudomonas aeruginosa PA01
gauaccagaucaccacc

SEQ ID NO: 1489232 - RNA, 13 nt, Pseudomonas aeruginosa PA01
gauaccagcgccg

SEQ ID NO: 1489233 - RNA, 21 nt, Pseudomonas aeruginosa PA01
gauacaucguucauguagcgc

SEQ ID NO: 1489234 - RNA, 15 nt, Pseudomonas aeruginosa PA01
gauacaggcgcagca

SEQ ID NO: 1489235 - RNA, 17 nt, Pseudomonas aeruginosa PA01
gauacaggcgcagcagc

SEQ ID NO: 1489236 - RNA, 16 nt, Pseudomonas aeruginosa PA01
gauaccacccgcagcc

SEQ ID NO: 1489237 - RNA, 15 nt, Pseudomonas aeruginosa PA01
gauaacgccgguggc

SEQ ID NO: 1489238 - RNA, 15 nt, Pseudomonas aeruginosa PA01
gagucgcgcagccag

SEQ ID NO: 1489239 - RNA, 17 nt, Pseudomonas aeruginosa PA01
gagucgcucgcgcaggu

SEQ ID NO: 1489240 - RNA, 13 nt, Pseudomonas aeruginosa PA01
gagucgcuggcca

SEQ ID NO: 1489241 - RNA, 13 nt, Pseudomonas aeruginosa PA01
gagucgccggcga

SEQ ID NO: 1489242 - RNA, 15 nt, Pseudomonas aeruginosa PA01
gaguccuucggcgca

SEQ ID NO: 1489243 - RNA, 16 nt, Pseudomonas aeruginosa PA01
gagucgaucaggucgc

SEQ ID NO: 1489244 - RNA, 20 nt, Pseudomonas aeruginosa PA01
gaguacucggcuacgaaccg

SEQ ID NO: 1489245 - RNA, 18 nt, Pseudomonas aeruginosa PA01
gaguccgacccgcuccgg

SEQ ID NO: 1489246 - RNA, 12 nt, Pseudomonas aeruginosa PA01
gaguccgccagc

SEQ ID NO: 1489247 - RNA, 18 nt, Pseudomonas aeruginosa PA01
gaucaggcgggcgucguc

SEQ ID NO: 1489248 - RNA, 20 nt, Pseudomonas aeruginosa PA01
gaucaggcgggcgucgucgg

SEQ ID NO: 1489249 - RNA, 20 nt, Pseudomonas aeruginosa PA01
gaucaggcgcaugcccaggg

SEQ ID NO: 1489250 - RNA, 23 nt, Pseudomonas aeruginosa PA01
gaucaggcgcaugcccagggcca

SEQ ID NO: 1489251 - RNA, 12 nt, Pseudomonas aeruginosa PA01
gaucaggccgag

SEQ ID NO: 1489252 - RNA, 13 nt, Pseudomonas aeruginosa PA01
gaucaggccgagc

SEQ ID NO: 1489253 - RNA, 19 nt, Pseudomonas aeruginosa PA01
gaucaggccgagcaccggc

SEQ ID NO: 1489254 - RNA, 20 nt, Pseudomonas aeruginosa PA01
gaucaggccgaggaugcucg

SEQ ID NO: 1489255 - RNA, 13 nt, Pseudomonas aeruginosa PA01
gaucaggccgaug

SEQ ID NO: 1489256 - RNA, 23 nt, Pseudomonas aeruginosa PA01
gaucagcuuguggucguggcgga

SEQ ID NO: 1489257 - RNA, 17 nt, Pseudomonas aeruginosa PA01
gaucaggaacacccggu

SEQ ID NO: 1489258 - RNA, 22 nt, Pseudomonas aeruginosa PA01
gaucauccgcaccauccgccgc

SEQ ID NO: 1489259 - RNA, 17 nt, Pseudomonas aeruginosa PA01
gaucaguucgugccagg

SEQ ID NO: 1489260 - RNA, 18 nt, Pseudomonas aeruginosa PA01
gaucaggcagcgcgcggc

SEQ ID NO: 1489261 - RNA, 19 nt, Pseudomonas aeruginosa PA01
gaucagggcaccgccgagg

SEQ ID NO: 1489262 - RNA, 14 nt, Pseudomonas aeruginosa PA01
gaucagggccucgc

SEQ ID NO: 1489263 - RNA, 20 nt, Pseudomonas aeruginosa PA01
gaucaguggucgcagcucca

SEQ ID NO: 1489264 - RNA, 14 nt, Pseudomonas aeruginosa PA01
gauccagcagucgc

SEQ ID NO: 1489265 - RNA, 14 nt, Pseudomonas aeruginosa PA01
gauccacuugccgu

SEQ ID NO: 1489266 - RNA, 14 nt, Pseudomonas aeruginosa PA01
gauccagcuggcgc

SEQ ID NO: 1489267 - RNA, 15 nt, Pseudomonas aeruginosa PA01
gauccagcuggcgcg

SEQ ID NO: 1489268 - RNA, 16 nt, Pseudomonas aeruginosa PA01
gauccagcuggcgcgu

SEQ ID NO: 1489269 - RNA, 22 nt, Pseudomonas aeruginosa PA01
gauccagccggcauccagcauc

SEQ ID NO: 1489270 - RNA, 14 nt, Pseudomonas aeruginosa PA01
gaucaucgccugcu

SEQ ID NO: 1489271 - RNA, 19 nt, Pseudomonas aeruginosa PA01
gaucaucgccugcuggugg

SEQ ID NO: 1489272 - RNA, 14 nt, Pseudomonas aeruginosa PA01
gaucaucgccaccg

SEQ ID NO: 1489273 - RNA, 16 nt, Pseudomonas aeruginosa PA01
gaucaucgccaccggu

SEQ ID NO: 1489274 - RNA, 15 nt, Pseudomonas aeruginosa PA01
gaucaucgccagcgg

SEQ ID NO: 1489275 - RNA, 21 nt, Pseudomonas aeruginosa PA01
gaucaggcccauuucguagcc

SEQ ID NO: 1489276 - RNA, 15 nt, Pseudomonas aeruginosa PA01
gaucaucugggccau

SEQ ID NO: 1489277 - RNA, 20 nt, Pseudomonas aeruginosa PA01
gaucaucugggccaucgccg

SEQ ID NO: 1489278 - RNA, 23 nt, Pseudomonas aeruginosa PA01
gaucaucugggccaucgccggcc

SEQ ID NO: 1489279 - RNA, 19 nt, Pseudomonas aeruginosa PA01
gaucaucuucuggacaccg

SEQ ID NO: 1489280 - RNA, 22 nt, Pseudomonas aeruginosa PA01
gaucaucggcuggccgagggcg

SEQ ID NO: 1489281 - RNA, 17 nt, Pseudomonas aeruginosa PA01
gaucaucggcuggucgu

SEQ ID NO: 1489282 - RNA, 22 nt, Pseudomonas aeruginosa PA01
gaucaucggcuggucgucgcgg

SEQ ID NO: 1489283 - RNA, 17 nt, Pseudomonas aeruginosa PA01
gaucagcuccgccucga

SEQ ID NO: 1489284 - RNA, 19 nt, Pseudomonas aeruginosa PA01
gaucagcucguugcccggc

SEQ ID NO: 1489285 - RNA, 22 nt, Pseudomonas aeruginosa PA01
gaucagcucguugcccggcuug

SEQ ID NO: 1489286 - RNA, 14 nt, Pseudomonas aeruginosa PA01
gaucagcuucagcu

SEQ ID NO: 1489287 - RNA, 20 nt, Pseudomonas aeruginosa PA01
gaucagcuucagcuccgagc

SEQ ID NO: 1489288 - RNA, 22 nt, Pseudomonas aeruginosa PA01
gaucagcuucuucagcagcggg

SEQ ID NO: 1489289 - RNA, 16 nt, Pseudomonas aeruginosa PA01
gaucagcggcccgagc

SEQ ID NO: 1489290 - RNA, 19 nt, Pseudomonas aeruginosa PA01
gaucagcggcccgagcagg

SEQ ID NO: 1489291 - RNA, 16 nt, Pseudomonas aeruginosa PA01
gaucagcggcggggcc

SEQ ID NO: 1489292 - RNA, 14 nt, Pseudomonas aeruginosa PA01
gaucagcggcgguc

SEQ ID NO: 1489293 - RNA, 19 nt, Pseudomonas aeruginosa PA01
gaucagcgcccggcacgcu

SEQ ID NO: 1489294 - RNA, 14 nt, Pseudomonas aeruginosa PA01
gaucagcgccucga

SEQ ID NO: 1489295 - RNA, 19 nt, Pseudomonas aeruginosa PA01
gaucagcgccucgaccucg

SEQ ID NO: 1489296 - RNA, 20 nt, Pseudomonas aeruginosa PA01
gaucagcgcgccuucgacgc

SEQ ID NO: 1489297 - RNA, 23 nt, Pseudomonas aeruginosa PA01
gaucagcgcgcguuccaggucgc

SEQ ID NO: 1489298 - RNA, 13 nt, Pseudomonas aeruginosa PA01
gaucagcgcggcc

SEQ ID NO: 1489299 - RNA, 16 nt, Pseudomonas aeruginosa PA01
gaucagccgcuccagg

SEQ ID NO: 1489300 - RNA, 14 nt, Pseudomonas aeruginosa PA01
gaucagccggcgcg

SEQ ID NO: 1489301 - RNA, 19 nt, Pseudomonas aeruginosa PA01
gaucagcgaaauggucacc

SEQ ID NO: 1489302 - RNA, 20 nt, Pseudomonas aeruginosa PA01
gaucagcgagagcuguccgg

SEQ ID NO: 1489303 - RNA, 22 nt, Pseudomonas aeruginosa PA01
gaucagcgagagcuguccggcg

SEQ ID NO: 1489304 - RNA, 17 nt, Pseudomonas aeruginosa PA01
gaucagccgcaggcaga

SEQ ID NO: 1489305 - RNA, 17 nt, Pseudomonas aeruginosa PA01
gaucagcccgccaacgu

SEQ ID NO: 1489306 - RNA, 14 nt, Pseudomonas aeruginosa PA01
gaucagcccgccgg

SEQ ID NO: 1489307 - RNA, 16 nt, Pseudomonas aeruginosa PA01
gaucagcccgccggcg

SEQ ID NO: 1489308 - RNA, 18 nt, Pseudomonas aeruginosa PA01
gaucagcccgcugaccgg

SEQ ID NO: 1489309 - RNA, 22 nt, Pseudomonas aeruginosa PA01
gaucagccggcccauccgccgc

SEQ ID NO: 1489310 - RNA, 19 nt, Pseudomonas aeruginosa PA01
gaucagcaggaugcagucg

SEQ ID NO: 1489311 - RNA, 15 nt, Pseudomonas aeruginosa PA01
gaucagcagcagcgc

SEQ ID NO: 1489312 - RNA, 21 nt, Pseudomonas aeruginosa PA01
gaucagcagcagcgccaugcu

SEQ ID NO: 1489313 - RNA, 14 nt, Pseudomonas aeruginosa PA01
gaucagcagcgcca

SEQ ID NO: 1489314 - RNA, 16 nt, Pseudomonas aeruginosa PA01
gaucagcagcgccacg

SEQ ID NO: 1489315 - RNA, 20 nt, Pseudomonas aeruginosa PA01
gaucagcagcgccacgcuga

SEQ ID NO: 1489316 - RNA, 20 nt, Pseudomonas aeruginosa PA01
gaucagccagggcaacgcca

SEQ ID NO: 1489317 - RNA, 19 nt, Pseudomonas aeruginosa PA01
gaucagccauuggccgacg

SEQ ID NO: 1489318 - RNA, 18 nt, Pseudomonas aeruginosa PA01
gauccgcacccgggcaac

SEQ ID NO: 1489319 - RNA, 14 nt, Pseudomonas aeruginosa PA01
gauccgccagcaga

SEQ ID NO: 1489320 - RNA, 20 nt, Pseudomonas aeruginosa PA01
gauccgccgugaggcgcgcg

SEQ ID NO: 1489321 - RNA, 21 nt, Pseudomonas aeruginosa PA01
gauccgccgugaggcgcgcgc

SEQ ID NO: 1489322 - RNA, 22 nt, Pseudomonas aeruginosa PA01
gauccgccgugaggcgcgcgcc

SEQ ID NO: 1489323 - RNA, 20 nt, Pseudomonas aeruginosa PA01
gauccgcgaauagggcggcg

SEQ ID NO: 1489324 - RNA, 22 nt, Pseudomonas aeruginosa PA01
gauccgcgaauagggcggcgcc

SEQ ID NO: 1489325 - RNA, 23 nt, Pseudomonas aeruginosa PA01
gauccgcgaauagggcggcgcca

SEQ ID NO: 1489326 - RNA, 21 nt, Pseudomonas aeruginosa PA01
gauccgcgacaguucgccgcc

SEQ ID NO: 1489327 - RNA, 20 nt, Pseudomonas aeruginosa PA01
gauccaggucgaucagcagc

SEQ ID NO: 1489328 - RNA, 14 nt, Pseudomonas aeruginosa PA01
gauccaggugcgcg

SEQ ID NO: 1489329 - RNA, 19 nt, Pseudomonas aeruginosa PA01
gauccaggugcgcggcagg

SEQ ID NO: 1489330 - RNA, 18 nt, Pseudomonas aeruginosa PA01
gauccaggaaccggccau

SEQ ID NO: 1489331 - RNA, 12 nt, Pseudomonas aeruginosa PA01
gauccgcacccg

SEQ ID NO: 1489332 - RNA, 20 nt, Pseudomonas aeruginosa PA01
gauccgcacccgcgacucga

SEQ ID NO: 1489333 - RNA, 16 nt, Pseudomonas aeruginosa PA01
gauccgugccaggcgc

SEQ ID NO: 1489334 - RNA, 23 nt, Pseudomonas aeruginosa PA01
gauccggugcaggccgagcugcu

SEQ ID NO: 1489335 - RNA, 12 nt, Pseudomonas aeruginosa PA01
gauccuggccgg

SEQ ID NO: 1489336 - RNA, 13 nt, Pseudomonas aeruginosa PA01
gauccuggccggc

SEQ ID NO: 1489337 - RNA, 20 nt, Pseudomonas aeruginosa PA01
gauccugcucagcggcccag

SEQ ID NO: 1489338 - RNA, 24 nt, Pseudomonas aeruginosa PA01
gauccugcucagcggcccagcgcc

SEQ ID NO: 1489339 - RNA, 16 nt, Pseudomonas aeruginosa PA01
gauccugaccccggcc

SEQ ID NO: 1489340 - RNA, 15 nt, Pseudomonas aeruginosa PA01
gauccguagggcgaa

SEQ ID NO: 1489341 - RNA, 16 nt, Pseudomonas aeruginosa PA01
gauccuccgccagccc

SEQ ID NO: 1489342 - RNA, 18 nt, Pseudomonas aeruginosa PA01
gauccucgccucgcgcca

SEQ ID NO: 1489343 - RNA, 15 nt, Pseudomonas aeruginosa PA01
gaucgagcggcccgc

SEQ ID NO: 1489344 - RNA, 15 nt, Pseudomonas aeruginosa PA01
gaucgagcuguccau

SEQ ID NO: 1489345 - RNA, 19 nt, Pseudomonas aeruginosa PA01
gaucgagcuguccaucucg

SEQ ID NO: 1489346 - RNA, 23 nt, Pseudomonas aeruginosa PA01
gaucgagcuguccaucucgccgc

SEQ ID NO: 1489347 - RNA, 17 nt, Pseudomonas aeruginosa PA01
gaucgaggccuacccgc

SEQ ID NO: 1489348 - RNA, 13 nt, Pseudomonas aeruginosa PA01
gaucgagucgccg

SEQ ID NO: 1489349 - RNA, 14 nt, Pseudomonas aeruginosa PA01
gaucgagucgccga

SEQ ID NO: 1489350 - RNA, 20 nt, Pseudomonas aeruginosa PA01
gaucgcccgccugauggcga

SEQ ID NO: 1489351 - RNA, 14 nt, Pseudomonas aeruginosa PA01
gaucgcccgcgccu

SEQ ID NO: 1489352 - RNA, 14 nt, Pseudomonas aeruginosa PA01
gaucgaucagcagc

SEQ ID NO: 1489353 - RNA, 15 nt, Pseudomonas aeruginosa PA01
gaucgaucagcagca

SEQ ID NO: 1489354 - RNA, 15 nt, Pseudomonas aeruginosa PA01
gaucgcccuggcgcc

SEQ ID NO: 1489355 - RNA, 17 nt, Pseudomonas aeruginosa PA01
gaucgcccuggcgccag

SEQ ID NO: 1489356 - RNA, 18 nt, Pseudomonas aeruginosa PA01
gaucgcccuggcgccagc

SEQ ID NO: 1489357 - RNA, 17 nt, Pseudomonas aeruginosa PA01
gaucgaaguagucggcg

SEQ ID NO: 1489358 - RNA, 22 nt, Pseudomonas aeruginosa PA01
gaucgaaguagucggcguagcg

SEQ ID NO: 1489359 - RNA, 23 nt, Pseudomonas aeruginosa PA01
gaucgaccccgccggggcgugca

SEQ ID NO: 1489360 - RNA, 17 nt, Pseudomonas aeruginosa PA01
gaucgaccucgcgggcg

SEQ ID NO: 1489361 - RNA, 20 nt, Pseudomonas aeruginosa PA01
gaucgaccucgcgggcgacg

SEQ ID NO: 1489362 - RNA, 12 nt, Pseudomonas aeruginosa PA01
gaucgaccugcc

SEQ ID NO: 1489363 - RNA, 14 nt, Pseudomonas aeruginosa PA01
gaucgaccugccgg

SEQ ID NO: 1489364 - RNA, 17 nt, Pseudomonas aeruginosa PA01
gaucgacagcagcgcca

SEQ ID NO: 1489365 - RNA, 18 nt, Pseudomonas aeruginosa PA01
gaucgacagcagcgccag

SEQ ID NO: 1489366 - RNA, 15 nt, Pseudomonas aeruginosa PA01
gaucgacaggccgcc

SEQ ID NO: 1489367 - RNA, 17 nt, Pseudomonas aeruginosa PA01
gaucgacaggccgccgu

SEQ ID NO: 1489368 - RNA, 15 nt, Pseudomonas aeruginosa PA01
gauggccggcgcggc

SEQ ID NO: 1489369 - RNA, 16 nt, Pseudomonas aeruginosa PA01
gauggccggcggagau

SEQ ID NO: 1489370 - RNA, 15 nt, Pseudomonas aeruginosa PA01
gauggccguccaggc

SEQ ID NO: 1489371 - RNA, 17 nt, Pseudomonas aeruginosa PA01
gauggccguccaggcug

SEQ ID NO: 1489372 - RNA, 18 nt, Pseudomonas aeruginosa PA01
gauggccguccaggcugc

SEQ ID NO: 1489373 - RNA, 20 nt, Pseudomonas aeruginosa PA01
gauggccguccaggcugccg

SEQ ID NO: 1489374 - RNA, 21 nt, Pseudomonas aeruginosa PA01
gauggccguccucgucgaggu

SEQ ID NO: 1489375 - RNA, 14 nt, Pseudomonas aeruginosa PA01
gauggccuggucgg

SEQ ID NO: 1489376 - RNA, 19 nt, Pseudomonas aeruginosa PA01
gauggcgcggugggccuug

SEQ ID NO: 1489377 - RNA, 15 nt, Pseudomonas aeruginosa PA01
gauggcgcgguccgc

SEQ ID NO: 1489378 - RNA, 18 nt, Pseudomonas aeruginosa PA01
gauggcgcuggaacagcg

SEQ ID NO: 1489379 - RNA, 21 nt, Pseudomonas aeruginosa PA01
gaugggcacgaucugcgccgc

SEQ ID NO: 1489380 - RNA, 23 nt, Pseudomonas aeruginosa PA01
gaugggcaggauaucgcccaggg

SEQ ID NO: 1489381 - RNA, 17 nt, Pseudomonas aeruginosa PA01
gauggucaggccggcgc

SEQ ID NO: 1489382 - RNA, 16 nt, Pseudomonas aeruginosa PA01
gauggcucgcggcgcu

SEQ ID NO: 1489383 - RNA, 16 nt, Pseudomonas aeruginosa PA01
gauggcugucggcgcc

SEQ ID NO: 1489384 - RNA, 13 nt, Pseudomonas aeruginosa PA01
gauggcuucgagg

SEQ ID NO: 1489385 - RNA, 18 nt, Pseudomonas aeruginosa PA01
gauguacucgcggccgaa

SEQ ID NO: 1489386 - RNA, 21 nt, Pseudomonas aeruginosa PA01
gauguacaggaugggcgaagc

SEQ ID NO: 1489387 - RNA, 14 nt, Pseudomonas aeruginosa PA01
gauguaggacgccu

SEQ ID NO: 1489388 - RNA, 20 nt, Pseudomonas aeruginosa PA01
gauguacggcaccaccaccg

SEQ ID NO: 1489389 - RNA, 17 nt, Pseudomonas aeruginosa PA01
gauggugaacgccaggc

SEQ ID NO: 1489390 - RNA, 17 nt, Pseudomonas aeruginosa PA01
gauggucgagggcgcgu

SEQ ID NO: 1489391 - RNA, 11 nt, Pseudomonas aeruginosa PA01
gauggucgccg

SEQ ID NO: 1489392 - RNA, 22 nt, Pseudomonas aeruginosa PA01
gauggucgccggagucguagcg

SEQ ID NO: 1489393 - RNA, 18 nt, Pseudomonas aeruginosa PA01
gauguaggccgcuuccgg

SEQ ID NO: 1489394 - RNA, 14 nt, Pseudomonas aeruginosa PA01
gauguaggccucgg

SEQ ID NO: 1489395 - RNA, 17 nt, Pseudomonas aeruginosa PA01
gauguaggccucggccu

SEQ ID NO: 1489396 - RNA, 14 nt, Pseudomonas aeruginosa PA01
gaugucgcggcgcu

SEQ ID NO: 1489397 - RNA, 14 nt, Pseudomonas aeruginosa PA01
gaugucgcggcuga

SEQ ID NO: 1489398 - RNA, 15 nt, Pseudomonas aeruginosa PA01
gaugucgcuggccag

SEQ ID NO: 1489399 - RNA, 19 nt, Pseudomonas aeruginosa PA01
gaugucgcggcaggcggcg

SEQ ID NO: 1489400 - RNA, 22 nt, Pseudomonas aeruginosa PA01
gaugcgcuacggcaucaccggc

SEQ ID NO: 1489401 - RNA, 18 nt, Pseudomonas aeruginosa PA01
gaugcggcccgccggcga

SEQ ID NO: 1489402 - RNA, 21 nt, Pseudomonas aeruginosa PA01
gaugcgcgugguaucggcgcu

SEQ ID NO: 1489403 - RNA, 19 nt, Pseudomonas aeruginosa PA01
gaugcgccgguccuugucc

SEQ ID NO: 1489404 - RNA, 15 nt, Pseudomonas aeruginosa PA01
gaugcgccagcggcc

SEQ ID NO: 1489405 - RNA, 18 nt, Pseudomonas aeruginosa PA01
gaugcgccagcggcccgg

SEQ ID NO: 1489406 - RNA, 23 nt, Pseudomonas aeruginosa PA01
gaugcgccagcggcccggcaggc

SEQ ID NO: 1489407 - RNA, 15 nt, Pseudomonas aeruginosa PA01
gaugcgcgucgccga

SEQ ID NO: 1489408 - RNA, 18 nt, Pseudomonas aeruginosa PA01
gaugcgcgucgccgaacg

SEQ ID NO: 1489409 - RNA, 13 nt, Pseudomonas aeruginosa PA01
gaugcgcggcagc

SEQ ID NO: 1489410 - RNA, 23 nt, Pseudomonas aeruginosa PA01
gaugcgcggcagcaggcgggcga

SEQ ID NO: 1489411 - RNA, 16 nt, Pseudomonas aeruginosa PA01
gaugcgcgcggcgagg

SEQ ID NO: 1489412 - RNA, 17 nt, Pseudomonas aeruginosa PA01
gaugcgcgacucgaagc

SEQ ID NO: 1489413 - RNA, 15 nt, Pseudomonas aeruginosa PA01
gaugcgcgcccugac

SEQ ID NO: 1489414 - RNA, 21 nt, Pseudomonas aeruginosa PA01
gaugcgcgcccugacgaugca

SEQ ID NO: 1489415 - RNA, 20 nt, Pseudomonas aeruginosa PA01
gaugcgcgaauaccgcgcgc

SEQ ID NO: 1489416 - RNA, 22 nt, Pseudomonas aeruginosa PA01
gaugcgcgaauaccgcgcgcgc

SEQ ID NO: 1489417 - RNA, 17 nt, Pseudomonas aeruginosa PA01
gaugcgccccagcgccu

SEQ ID NO: 1489418 - RNA, 16 nt, Pseudomonas aeruginosa PA01
gauggcagccuuggcc

SEQ ID NO: 1489419 - RNA, 15 nt, Pseudomonas aeruginosa PA01
gauggccgccgccgc

SEQ ID NO: 1489420 - RNA, 21 nt, Pseudomonas aeruginosa PA01
gauggccgccgccgccgucga

SEQ ID NO: 1489421 - RNA, 12 nt, Pseudomonas aeruginosa PA01
gauggccgccgu

SEQ ID NO: 1489422 - RNA, 12 nt, Pseudomonas aeruginosa PA01
gauggccgccug

SEQ ID NO: 1489423 - RNA, 14 nt, Pseudomonas aeruginosa PA01
gauggccggcacca

SEQ ID NO: 1489424 - RNA, 19 nt, Pseudomonas aeruginosa PA01
gauggccggcaccagcagu

SEQ ID NO: 1489425 - RNA, 20 nt, Pseudomonas aeruginosa PA01
gauggccggcagcagcgcca

SEQ ID NO: 1489426 - RNA, 21 nt, Pseudomonas aeruginosa PA01
gauggccggcagcagcgccag

SEQ ID NO: 1489427 - RNA, 14 nt, Pseudomonas aeruginosa PA01
gaugcugcgggcgc

SEQ ID NO: 1489428 - RNA, 16 nt, Pseudomonas aeruginosa PA01
gauggauacccuucau

SEQ ID NO: 1489429 - RNA, 16 nt, Pseudomonas aeruginosa PA01
gaugcugcacagccau

SEQ ID NO: 1489430 - RNA, 21 nt, Pseudomonas aeruginosa PA01
gaugcucgguugccaggccgg

SEQ ID NO: 1489431 - RNA, 17 nt, Pseudomonas aeruginosa PA01
gaugcugaucacccgcc

SEQ ID NO: 1489432 - RNA, 15 nt, Pseudomonas aeruginosa PA01
gaugcugaucagcac

SEQ ID NO: 1489433 - RNA, 14 nt, Pseudomonas aeruginosa PA01
gaugcuccagggag

SEQ ID NO: 1489434 - RNA, 16 nt, Pseudomonas aeruginosa PA01
gaugcucccgagcaag

SEQ ID NO: 1489435 - RNA, 18 nt, Pseudomonas aeruginosa PA01
gaugcucagcgccggcca

SEQ ID NO: 1489436 - RNA, 14 nt, Pseudomonas aeruginosa PA01
gaugcucaggcgcu

SEQ ID NO: 1489437 - RNA, 16 nt, Pseudomonas aeruginosa PA01
gaugcucaggcgcugc

SEQ ID NO: 1489438 - RNA, 15 nt, Pseudomonas aeruginosa PA01
aacuugccggcgcca

SEQ ID NO: 1489439 - RNA, 22 nt, Pseudomonas aeruginosa PA01
aacuucuccagguacagccgca

SEQ ID NO: 1489440 - RNA, 15 nt, Pseudomonas aeruginosa PA01
gaugcguucgaugga

SEQ ID NO: 1489441 - RNA, 17 nt, Pseudomonas aeruginosa PA01
gaugcguuugucgaccu

SEQ ID NO: 1489442 - RNA, 21 nt, Pseudomonas aeruginosa PA01
gaugcuaucgcguggcugccg

SEQ ID NO: 1489443 - RNA, 15 nt, Pseudomonas aeruginosa PA01
gaugcucaccgcgcu

SEQ ID NO: 1489444 - RNA, 12 nt, Pseudomonas aeruginosa PA01
gcaacaccuggc

SEQ ID NO: 1489445 - RNA, 20 nt, Pseudomonas aeruginosa PA01
gcaacaccuggcgcucgccg

SEQ ID NO: 1489446 - RNA, 19 nt, Pseudomonas aeruginosa PA01
gcaacaccuugcgcaccgc

SEQ ID NO: 1489447 - RNA, 16 nt, Pseudomonas aeruginosa PA01
gcaacagcccgcgccg

SEQ ID NO: 1489448 - RNA, 15 nt, Pseudomonas aeruginosa PA01
gcaacagcaggagaa

SEQ ID NO: 1489449 - RNA, 17 nt, Pseudomonas aeruginosa PA01
gcaacagcaggagaagc

SEQ ID NO: 1489450 - RNA, 13 nt, Pseudomonas aeruginosa PA01
gcaacagcgccgc

SEQ ID NO: 1489451 - RNA, 14 nt, Pseudomonas aeruginosa PA01
gcaacagcgccgcg

SEQ ID NO: 1489452 - RNA, 15 nt, Pseudomonas aeruginosa PA01
gcaacagcgccgcgc

SEQ ID NO: 1489453 - RNA, 21 nt, Pseudomonas aeruginosa PA01
gcaacagcgccgcgcgcuugu

SEQ ID NO: 1489454 - RNA, 19 nt, Pseudomonas aeruginosa PA01
gcaacacgucggacuugcg

SEQ ID NO: 1489455 - RNA, 16 nt, Pseudomonas aeruginosa PA01
gauuucagcaggccga

SEQ ID NO: 1489456 - RNA, 17 nt, Pseudomonas aeruginosa PA01
gauuuucuccggcgccg

SEQ ID NO: 1489457 - RNA, 18 nt, Pseudomonas aeruginosa PA01
gauuuucuccggcgccgg

SEQ ID NO: 1489458 - RNA, 21 nt, Pseudomonas aeruginosa PA01
gauuuucuccggcgccgggcu

SEQ ID NO: 1489459 - RNA, 14 nt, Pseudomonas aeruginosa PA01
gauuuccgcggccg

SEQ ID NO: 1489460 - RNA, 15 nt, Pseudomonas aeruginosa PA01
gauuuccgcggccgg

SEQ ID NO: 1489461 - RNA, 16 nt, Pseudomonas aeruginosa PA01
gauuuccucgcugcgg

SEQ ID NO: 1489462 - RNA, 18 nt, Pseudomonas aeruginosa PA01
gauuuccggcuugccgau

SEQ ID NO: 1489463 - RNA, 13 nt, Pseudomonas aeruginosa PA01
gauuuccaccggc

SEQ ID NO: 1489464 - RNA, 13 nt, Pseudomonas aeruginosa PA01
gauuccacccgcu

SEQ ID NO: 1489465 - RNA, 23 nt, Pseudomonas aeruginosa PA01
gauuccacccgcuccgcggccgg

SEQ ID NO: 1489466 - RNA, 21 nt, Pseudomonas aeruginosa PA01
gauucaucggcggcaggccga

SEQ ID NO: 1489467 - RNA, 21 nt, Pseudomonas aeruginosa PA01
gauucgccggccaccaggcuu

SEQ ID NO: 1489468 - RNA, 21 nt, Pseudomonas aeruginosa PA01
gauugcagguaguucuccagg

SEQ ID NO: 1489469 - RNA, 15 nt, Pseudomonas aeruginosa PA01
gauugcaugaccuuc

SEQ ID NO: 1489470 - RNA, 18 nt, Pseudomonas aeruginosa PA01
gauugaugaagcgcugcu

SEQ ID NO: 1489471 - RNA, 23 nt, Pseudomonas aeruginosa PA01
gauucggguagucuucgaugcgc

SEQ ID NO: 1489472 - RNA, 21 nt, Pseudomonas aeruginosa PA01
gauguggcuauccuccaggcc

SEQ ID NO: 1489473 - RNA, 17 nt, Pseudomonas aeruginosa PA01
gauguggcuggugaugc

SEQ ID NO: 1489474 - RNA, 20 nt, Pseudomonas aeruginosa PA01
gaugugcuugagucgcaggc

SEQ ID NO: 1489475 - RNA, 13 nt, Pseudomonas aeruginosa PA01
gauguggccgucg

SEQ ID NO: 1489476 - RNA, 19 nt, Pseudomonas aeruginosa PA01
gauguugccgccgccgagg

SEQ ID NO: 1489477 - RNA, 23 nt, Pseudomonas aeruginosa PA01
gauguugccgccgccgaggagga

SEQ ID NO: 1489478 - RNA, 15 nt, Pseudomonas aeruginosa PA01
gauguugacgauggc

SEQ ID NO: 1489479 - RNA, 15 nt, Pseudomonas aeruginosa PA01
gauguuccaggcccg

SEQ ID NO: 1489480 - RNA, 23 nt, Pseudomonas aeruginosa PA01
gauguucuccacgucguccggcg

SEQ ID NO: 1489481 - RNA, 16 nt, Pseudomonas aeruginosa PA01
gauguucgaggcgccg

SEQ ID NO: 1489482 - RNA, 17 nt, Pseudomonas aeruginosa PA01
gauguucgaggcgccga

SEQ ID NO: 1489483 - RNA, 14 nt, Pseudomonas aeruginosa PA01
gauucaggcgcgcu

SEQ ID NO: 1489484 - RNA, 17 nt, Pseudomonas aeruginosa PA01
aacuggauacgcuuggc

SEQ ID NO: 1489485 - RNA, 15 nt, Pseudomonas aeruginosa PA01
aacuggaucggcccc

SEQ ID NO: 1489486 - RNA, 22 nt, Pseudomonas aeruginosa PA01
aacuggaugaugguauccaggc

SEQ ID NO: 1489487 - RNA, 22 nt, Pseudomonas aeruginosa PA01
aacuggauuuccuucggcaccc

SEQ ID NO: 1489488 - RNA, 18 nt, Pseudomonas aeruginosa PA01
aacugcuucaggcgcgcg

SEQ ID NO: 1489489 - RNA, 20 nt, Pseudomonas aeruginosa PA01
aacugcuucaggcgcgcggc

SEQ ID NO: 1489490 - RNA, 14 nt, Pseudomonas aeruginosa PA01
gaugaccagcgcau

SEQ ID NO: 1489491 - RNA, 19 nt, Pseudomonas aeruginosa PA01
gaugaccaggguggcggcg

SEQ ID NO: 1489492 - RNA, 14 nt, Pseudomonas aeruginosa PA01
gaugaaugcgcagg

SEQ ID NO: 1489493 - RNA, 13 nt, Pseudomonas aeruginosa PA01
gaugaagcgcugc

SEQ ID NO: 1489494 - RNA, 23 nt, Pseudomonas aeruginosa PA01
gaugaagcgcugcugggcggcga

SEQ ID NO: 1489495 - RNA, 16 nt, Pseudomonas aeruginosa PA01
gaugaagcgccgcagu

SEQ ID NO: 1489496 - RNA, 12 nt, Pseudomonas aeruginosa PA01
gaugaagcgccg

SEQ ID NO: 1489497 - RNA, 17 nt, Pseudomonas aeruginosa PA01
gaugaagccgcgaccgg

SEQ ID NO: 1489498 - RNA, 22 nt, Pseudomonas aeruginosa PA01
gaugaagcacaccuccagcggc

SEQ ID NO: 1489499 - RNA, 13 nt, Pseudomonas aeruginosa PA01
aacugcgcaggcu

SEQ ID NO: 1489500 - RNA, 18 nt, Pseudomonas aeruginosa PA01
aacugcgcccccagcgcc

SEQ ID NO: 1489501 - RNA, 16 nt, Pseudomonas aeruginosa PA01
aacugcgguccggcga

SEQ ID NO: 1489502 - RNA, 20 nt, Pseudomonas aeruginosa PA01
gaugaacagcgacucgaugc

SEQ ID NO: 1489503 - RNA, 22 nt, Pseudomonas aeruginosa PA01
gaugaagaagccauugccgaug

SEQ ID NO: 1489504 - RNA, 17 nt, Pseudomonas aeruginosa PA01
gaugaacgacuccagcu

SEQ ID NO: 1489505 - RNA, 13 nt, Pseudomonas aeruginosa PA01
gaugaacgcgcgg

SEQ ID NO: 1489506 - RNA, 15 nt, Pseudomonas aeruginosa PA01
gaugaaacgggcgau

SEQ ID NO: 1489507 - RNA, 13 nt, Pseudomonas aeruginosa PA01
gaugaaaccggcc

SEQ ID NO: 1489508 - RNA, 17 nt, Pseudomonas aeruginosa PA01
gaugaaauagccggcga

SEQ ID NO: 1489509 - RNA, 20 nt, Pseudomonas aeruginosa PA01
gaugaaauagcucugccgau

SEQ ID NO: 1489510 - RNA, 17 nt, Pseudomonas aeruginosa PA01
gaugaccccggcgaugc

SEQ ID NO: 1489511 - RNA, 18 nt, Pseudomonas aeruginosa PA01
gaugacgauggccgccgc

SEQ ID NO: 1489512 - RNA, 22 nt, Pseudomonas aeruginosa PA01
gaugacccgcaccuugcccugc

SEQ ID NO: 1489513 - RNA, 17 nt, Pseudomonas aeruginosa PA01
gaugacguugcugcccu

SEQ ID NO: 1489514 - RNA, 20 nt, Pseudomonas aeruginosa PA01
gaugacguugcugcccuggc

SEQ ID NO: 1489515 - RNA, 23 nt, Pseudomonas aeruginosa PA01
gaugacguugcugcccuggcgcg

SEQ ID NO: 1489516 - RNA, 15 nt, Pseudomonas aeruginosa PA01
gaugagcuucgccgg

SEQ ID NO: 1489517 - RNA, 17 nt, Pseudomonas aeruginosa PA01
gaugagcaugccgcaga

SEQ ID NO: 1489518 - RNA, 14 nt, Pseudomonas aeruginosa PA01
gaucugguagcggg

SEQ ID NO: 1489519 - RNA, 23 nt, Pseudomonas aeruginosa PA01
gaucugguagcgggccaucaggu

SEQ ID NO: 1489520 - RNA, 23 nt, Pseudomonas aeruginosa PA01
gaucugccgguaggucaccaggu

SEQ ID NO: 1489521 - RNA, 17 nt, Pseudomonas aeruginosa PA01
gaucugguggaacagca

SEQ ID NO: 1489522 - RNA, 18 nt, Pseudomonas aeruginosa PA01
gaucucucaguccaucgu

SEQ ID NO: 1489523 - RNA, 20 nt, Pseudomonas aeruginosa PA01
gaucugcaccgcccagccga

SEQ ID NO: 1489524 - RNA, 13 nt, Pseudomonas aeruginosa PA01
gaucuugcgcccg

SEQ ID NO: 1489525 - RNA, 19 nt, Pseudomonas aeruginosa PA01
gaucuugaucugcaugccg

SEQ ID NO: 1489526 - RNA, 17 nt, Pseudomonas aeruginosa PA01
gaucuucuuccccgcca

SEQ ID NO: 1489527 - RNA, 16 nt, Pseudomonas aeruginosa PA01
gaucuguucgaccagu

SEQ ID NO: 1489528 - RNA, 20 nt, Pseudomonas aeruginosa PA01
gaucuucuccgauuccugcg

SEQ ID NO: 1489529 - RNA, 21 nt, Pseudomonas aeruginosa PA01
gaucuucuccgccgcgugcgc

SEQ ID NO: 1489530 - RNA, 15 nt, Pseudomonas aeruginosa PA01
gaucugugcgagcgc

SEQ ID NO: 1489531 - RNA, 17 nt, Pseudomonas aeruginosa PA01
gaucugucgauaccagc

SEQ ID NO: 1489532 - RNA, 19 nt, Pseudomonas aeruginosa PA01
gaucugucgauaccagcgc

SEQ ID NO: 1489533 - RNA, 21 nt, Pseudomonas aeruginosa PA01
gaucugucgauaccagcgccg

SEQ ID NO: 1489534 - RNA, 22 nt, Pseudomonas aeruginosa PA01
gaucugucgauaccagcgccgc

SEQ ID NO: 1489535 - RNA, 19 nt, Pseudomonas aeruginosa PA01
gaucuguuucaacucccag

SEQ ID NO: 1489536 - RNA, 16 nt, Pseudomonas aeruginosa PA01
gaucuucaggccgaag

SEQ ID NO: 1489537 - RNA, 13 nt, Pseudomonas aeruginosa PA01
gaucgccgcggcg

SEQ ID NO: 1489538 - RNA, 17 nt, Pseudomonas aeruginosa PA01
gaucgccgcguagcgcc

SEQ ID NO: 1489539 - RNA, 16 nt, Pseudomonas aeruginosa PA01
gaucgccgcgaggugg

SEQ ID NO: 1489540 - RNA, 15 nt, Pseudomonas aeruginosa PA01
gaucgccgcgccgcc

SEQ ID NO: 1489541 - RNA, 19 nt, Pseudomonas aeruginosa PA01
gaucgccgcgccgccgagg

SEQ ID NO: 1489542 - RNA, 19 nt, Pseudomonas aeruginosa PA01
gaucgccgcgcggucgagc

SEQ ID NO: 1489543 - RNA, 13 nt, Pseudomonas aeruginosa PA01
gaucgcccggcgc

SEQ ID NO: 1489544 - RNA, 14 nt, Pseudomonas aeruginosa PA01
gaucgcccggcgcu

SEQ ID NO: 1489545 - RNA, 17 nt, Pseudomonas aeruginosa PA01
gaucgcccggcgcucca

SEQ ID NO: 1489546 - RNA, 21 nt, Pseudomonas aeruginosa PA01
gaucgcccggcgcuccaacag

SEQ ID NO: 1489547 - RNA, 15 nt, Pseudomonas aeruginosa PA01
gaucgcccggcugca

SEQ ID NO: 1489548 - RNA, 22 nt, Pseudomonas aeruginosa PA01
gaucgccgccuugcguaccagc

SEQ ID NO: 1489549 - RNA, 19 nt, Pseudomonas aeruginosa PA01
gaucucccguaccagcgcg

SEQ ID NO: 1489550 - RNA, 22 nt, Pseudomonas aeruginosa PA01
gaucuccgccaggcggccgaag

SEQ ID NO: 1489551 - RNA, 19 nt, Pseudomonas aeruginosa PA01
gaucuccgcgccgggcugg

SEQ ID NO: 1489552 - RNA, 23 nt, Pseudomonas aeruginosa PA01
gaucuccgcgccgggcuggccgu

SEQ ID NO: 1489553 - RNA, 14 nt, Pseudomonas aeruginosa PA01
gaucuccaggucgc

SEQ ID NO: 1489554 - RNA, 21 nt, Pseudomonas aeruginosa PA01
gaucuccaacuggcggcuggg

SEQ ID NO: 1489555 - RNA, 19 nt, Pseudomonas aeruginosa PA01
gaucuccacccguucgccg

SEQ ID NO: 1489556 - RNA, 22 nt, Pseudomonas aeruginosa PA01
gaucuccacccguucgccggcc

SEQ ID NO: 1489557 - RNA, 23 nt, Pseudomonas aeruginosa PA01
gaucgccuccaccagcgccggcg

SEQ ID NO: 1489558 - RNA, 15 nt, Pseudomonas aeruginosa PA01
gaucuccucggccaa

SEQ ID NO: 1489559 - RNA, 16 nt, Pseudomonas aeruginosa PA01
gaucuccugggucgac

SEQ ID NO: 1489560 - RNA, 14 nt, Pseudomonas aeruginosa PA01
gaucuccuccgccc

SEQ ID NO: 1489561 - RNA, 17 nt, Pseudomonas aeruginosa PA01
gaucuccuccucggcgg

SEQ ID NO: 1489562 - RNA, 21 nt, Pseudomonas aeruginosa PA01
gaucuccucgacggcgggagc

SEQ ID NO: 1489563 - RNA, 22 nt, Pseudomonas aeruginosa PA01
gaucuccucgacggcgggagcg

SEQ ID NO: 1489564 - RNA, 18 nt, Pseudomonas aeruginosa PA01
gaucuccggguccaucug

SEQ ID NO: 1489565 - RNA, 16 nt, Pseudomonas aeruginosa PA01
gaucucgucguagucg

SEQ ID NO: 1489566 - RNA, 19 nt, Pseudomonas aeruginosa PA01
gaucucuacuaccgccagc

SEQ ID NO: 1489567 - RNA, 23 nt, Pseudomonas aeruginosa PA01
gaucucuacuaccgccagcgcac

SEQ ID NO: 1489568 - RNA, 15 nt, Pseudomonas aeruginosa PA01
gaucucgucggcggg

SEQ ID NO: 1489569 - RNA, 16 nt, Pseudomonas aeruginosa PA01
gaucucgucggcgggg

SEQ ID NO: 1489570 - RNA, 12 nt, Pseudomonas aeruginosa PA01
gaugcagccggg

SEQ ID NO: 1489571 - RNA, 22 nt, Pseudomonas aeruginosa PA01
gaugcagccggggcucaggccu

SEQ ID NO: 1489572 - RNA, 21 nt, Pseudomonas aeruginosa PA01
gaugcacgugcagcucggcac

SEQ ID NO: 1489573 - RNA, 17 nt, Pseudomonas aeruginosa PA01
gaugcagauccagcggc

SEQ ID NO: 1489574 - RNA, 17 nt, Pseudomonas aeruginosa PA01
gaugcaguucguugagc

SEQ ID NO: 1489575 - RNA, 19 nt, Pseudomonas aeruginosa PA01
gaugcaguugagucgcgcg

SEQ ID NO: 1489576 - RNA, 23 nt, Pseudomonas aeruginosa PA01
gaugcaggcagugugcaccgagu

SEQ ID NO: 1489577 - RNA, 23 nt, Pseudomonas aeruginosa PA01
gaugcagucccgccaggcgccga

SEQ ID NO: 1489578 - RNA, 14 nt, Pseudomonas aeruginosa PA01
gaugcagucggcac

SEQ ID NO: 1489579 - RNA, 15 nt, Pseudomonas aeruginosa PA01
gaugcagucggcacc

SEQ ID NO: 1489580 - RNA, 12 nt, Pseudomonas aeruginosa PA01
aacugucggcgg

SEQ ID NO: 1489581 - RNA, 19 nt, Pseudomonas aeruginosa PA01
gaugccacugacgcgcagc

SEQ ID NO: 1489582 - RNA, 19 nt, Pseudomonas aeruginosa PA01
gaugcccagccagggccgc

SEQ ID NO: 1489583 - RNA, 22 nt, Pseudomonas aeruginosa PA01
gaugcccagccagggccgcgag

SEQ ID NO: 1489584 - RNA, 14 nt, Pseudomonas aeruginosa PA01
gaugccaucgaggc

SEQ ID NO: 1489585 - RNA, 22 nt, Pseudomonas aeruginosa PA01
gaugccaucgaggccaggccga

SEQ ID NO: 1489586 - RNA, 16 nt, Pseudomonas aeruginosa PA01
gaugcccagcggcgcc

SEQ ID NO: 1489587 - RNA, 18 nt, Pseudomonas aeruginosa PA01
gaugcccagcggcgccag

SEQ ID NO: 1489588 - RNA, 14 nt, Pseudomonas aeruginosa PA01
gaugcccaggccgc

SEQ ID NO: 1489589 - RNA, 18 nt, Pseudomonas aeruginosa PA01
aacuggucgcagccgcgc

SEQ ID NO: 1489590 - RNA, 20 nt, Pseudomonas aeruginosa PA01
aacuggucgcagccgcgcaa

SEQ ID NO: 1489591 - RNA, 12 nt, Pseudomonas aeruginosa PA01
aacuggucgccg

SEQ ID NO: 1489592 - RNA, 22 nt, Pseudomonas aeruginosa PA01
aacugguuggccgccuggcgca

SEQ ID NO: 1489593 - RNA, 14 nt, Pseudomonas aeruginosa PA01
gaugcacaccagcu

SEQ ID NO: 1489594 - RNA, 23 nt, Pseudomonas aeruginosa PA01
gaugcacaccagcuccccguccc

SEQ ID NO: 1489595 - RNA, 17 nt, Pseudomonas aeruginosa PA01
gaugauggucaacacca

SEQ ID NO: 1489596 - RNA, 21 nt, Pseudomonas aeruginosa PA01
gaugaugccgcggcgauaggc

SEQ ID NO: 1489597 - RNA, 18 nt, Pseudomonas aeruginosa PA01
gaugauccacuugccgcc

SEQ ID NO: 1489598 - RNA, 21 nt, Pseudomonas aeruginosa PA01
gaugauccacuugccgccgcc

SEQ ID NO: 1489599 - RNA, 16 nt, Pseudomonas aeruginosa PA01
gaugaucaccagaccg

SEQ ID NO: 1489600 - RNA, 23 nt, Pseudomonas aeruginosa PA01
gaugaggucgcagcguuccagcg

SEQ ID NO: 1489601 - RNA, 20 nt, Pseudomonas aeruginosa PA01
gaugaucagggcaccgccga

SEQ ID NO: 1489602 - RNA, 14 nt, Pseudomonas aeruginosa PA01
gaugaucaggucgg

SEQ ID NO: 1489603 - RNA, 17 nt, Pseudomonas aeruginosa PA01
gaugaucgccaccgggu

SEQ ID NO: 1489604 - RNA, 12 nt, Pseudomonas aeruginosa PA01
gaugaucgccga

SEQ ID NO: 1489605 - RNA, 15 nt, Pseudomonas aeruginosa PA01
gaugaucgcgugggc

SEQ ID NO: 1489606 - RNA, 18 nt, Pseudomonas aeruginosa PA01
gaugaucgcgugggccac

SEQ ID NO: 1489607 - RNA, 15 nt, Pseudomonas aeruginosa PA01
gaugaucggcagccg

SEQ ID NO: 1489608 - RNA, 19 nt, Pseudomonas aeruginosa PA01
gaugccgauggcgccgccg

SEQ ID NO: 1489609 - RNA, 22 nt, Pseudomonas aeruginosa PA01
gaugccgauggcgccgccgagg

SEQ ID NO: 1489610 - RNA, 16 nt, Pseudomonas aeruginosa PA01
gaugccgaucucgccc

SEQ ID NO: 1489611 - RNA, 14 nt, Pseudomonas aeruginosa PA01
gaugccgcccagca

SEQ ID NO: 1489612 - RNA, 15 nt, Pseudomonas aeruginosa PA01
gaugccgcccagcac

SEQ ID NO: 1489613 - RNA, 20 nt, Pseudomonas aeruginosa PA01
gaugccgcccugcggcaggc

SEQ ID NO: 1489614 - RNA, 13 nt, Pseudomonas aeruginosa PA01
gaugccgccgacc

SEQ ID NO: 1489615 - RNA, 11 nt, Pseudomonas aeruginosa PA01
gaugccgccgg

SEQ ID NO: 1489616 - RNA, 14 nt, Pseudomonas aeruginosa PA01
gaugccgccggcau

SEQ ID NO: 1489617 - RNA, 23 nt, Pseudomonas aeruginosa PA01
gaugccgccgggcaucaugccga

SEQ ID NO: 1489618 - RNA, 18 nt, Pseudomonas aeruginosa PA01
gaugccgccugcgucagc

SEQ ID NO: 1489619 - RNA, 22 nt, Pseudomonas aeruginosa PA01
gaugccgcgagccagccguggc

SEQ ID NO: 1489620 - RNA, 12 nt, Pseudomonas aeruginosa PA01
gaugccggcgau

SEQ ID NO: 1489621 - RNA, 18 nt, Pseudomonas aeruginosa PA01
gaugccggaaagccuggc

SEQ ID NO: 1489622 - RNA, 20 nt, Pseudomonas aeruginosa PA01
gaugccggaaagccuggccg

SEQ ID NO: 1489623 - RNA, 21 nt, Pseudomonas aeruginosa PA01
gaugccggaaagccuggccgg

SEQ ID NO: 1489624 - RNA, 22 nt, Pseudomonas aeruginosa PA01
gaugccggaaagccuggccggc

SEQ ID NO: 1489625 - RNA, 14 nt, Pseudomonas aeruginosa PA01
gaugccgcgccagg

SEQ ID NO: 1489626 - RNA, 15 nt, Pseudomonas aeruginosa PA01
gaugccgcgccaggc

SEQ ID NO: 1489627 - RNA, 18 nt, Pseudomonas aeruginosa PA01
gaugccgcgccaggcgca

SEQ ID NO: 1489628 - RNA, 16 nt, Pseudomonas aeruginosa PA01
gaugccgcgcgccugg

SEQ ID NO: 1489629 - RNA, 23 nt, Pseudomonas aeruginosa PA01
gaugccgcgcgccuggcuggcca

SEQ ID NO: 1489630 - RNA, 19 nt, Pseudomonas aeruginosa PA01
gaugcccuggucggcgguc

SEQ ID NO: 1489631 - RNA, 16 nt, Pseudomonas aeruginosa PA01
gaugcccuuggccagc

SEQ ID NO: 1489632 - RNA, 14 nt, Pseudomonas aeruginosa PA01
gaugccgacgucga

SEQ ID NO: 1489633 - RNA, 23 nt, Pseudomonas aeruginosa PA01
gaugccgaaggcgugggcgccgg

SEQ ID NO: 1489634 - RNA, 12 nt, Pseudomonas aeruginosa PA01
gaugcccggccg

SEQ ID NO: 1489635 - RNA, 13 nt, Pseudomonas aeruginosa PA01
gaugcccggcugg

SEQ ID NO: 1489636 - RNA, 14 nt, Pseudomonas aeruginosa PA01
gaugcccgccagca

SEQ ID NO: 1489637 - RNA, 17 nt, Pseudomonas aeruginosa PA01
gaugcccgccagcaggc

SEQ ID NO: 1489638 - RNA, 19 nt, Pseudomonas aeruginosa PA01
gaugcccgccagcaggcgc

SEQ ID NO: 1489639 - RNA, 22 nt, Pseudomonas aeruginosa PA01
gaugcccgccagcaggcgccgg

SEQ ID NO: 1489640 - RNA, 23 nt, Pseudomonas aeruginosa PA01
gaugcccgccagcaggcgccggc

SEQ ID NO: 1489641 - RNA, 14 nt, Pseudomonas aeruginosa PA01
gaugcccuccuggg

SEQ ID NO: 1489642 - RNA, 14 nt, Pseudomonas aeruginosa PA01
gaugcccgggcguu

SEQ ID NO: 1489643 - RNA, 14 nt, Pseudomonas aeruginosa PA01
gaugcccucgcggc

SEQ ID NO: 1489644 - RNA, 15 nt, Pseudomonas aeruginosa PA01
gaugcccuggccgcu

SEQ ID NO: 1489645 - RNA, 23 nt, Pseudomonas aeruginosa PA01
gaugcccuggcuuuccagggccu

SEQ ID NO: 1489646 - RNA, 15 nt, Pseudomonas aeruginosa PA01
gaugccuucggcggc

SEQ ID NO: 1489647 - RNA, 19 nt, Pseudomonas aeruginosa PA01
gaugccuucggcggccggg

SEQ ID NO: 1489648 - RNA, 18 nt, Pseudomonas aeruginosa PA01
gaugccguucucccgcgc

SEQ ID NO: 1489649 - RNA, 14 nt, Pseudomonas aeruginosa PA01
gaugcgcaggccgg

SEQ ID NO: 1489650 - RNA, 15 nt, Pseudomonas aeruginosa PA01
gaugcgcaggccggg

SEQ ID NO: 1489651 - RNA, 20 nt, Pseudomonas aeruginosa PA01
gaugcgcaacgggcggcggg

SEQ ID NO: 1489652 - RNA, 20 nt, Pseudomonas aeruginosa PA01
gaugccggagagcagcacgg

SEQ ID NO: 1489653 - RNA, 23 nt, Pseudomonas aeruginosa PA01
gaugccggcgcugucucgccagc

SEQ ID NO: 1489654 - RNA, 24 nt, Pseudomonas aeruginosa PA01
gaugccggcgcugucucgccagcc

SEQ ID NO: 1489655 - RNA, 21 nt, Pseudomonas aeruginosa PA01
gaugccgguggcgcccagcca

SEQ ID NO: 1489656 - RNA, 13 nt, Pseudomonas aeruginosa PA01
gaugccuccggcu

SEQ ID NO: 1489657 - RNA, 21 nt, Pseudomonas aeruginosa PA01
gaugccguuguggcaggcgcu

SEQ ID NO: 1489658 - RNA, 23 nt, Pseudomonas aeruginosa PA01
gaugccguuguggcaggcgcugc

SEQ ID NO: 1489659 - RNA, 20 nt, Pseudomonas aeruginosa PA01
gaugccguuaccuuggccac

SEQ ID NO: 1489660 - RNA, 19 nt, Pseudomonas aeruginosa PA01
cguccagcagguucggcgg

SEQ ID NO: 1489661 - RNA, 12 nt, Pseudomonas aeruginosa PA01
cguccagccgcc

SEQ ID NO: 1489662 - RNA, 13 nt, Pseudomonas aeruginosa PA01
cguccagccgccg

SEQ ID NO: 1489663 - RNA, 14 nt, Pseudomonas aeruginosa PA01
cguccagccgccgc

SEQ ID NO: 1489664 - RNA, 17 nt, Pseudomonas aeruginosa PA01
cguccagccgccgcugc

SEQ ID NO: 1489665 - RNA, 16 nt, Pseudomonas aeruginosa PA01
cguccagccggcgcuu

SEQ ID NO: 1489666 - RNA, 14 nt, Pseudomonas aeruginosa PA01
cguccagcgcgccc

SEQ ID NO: 1489667 - RNA, 20 nt, Pseudomonas aeruginosa PA01
cguccagcgcgcccggcgcc

SEQ ID NO: 1489668 - RNA, 17 nt, Pseudomonas aeruginosa PA01
cguccagcgcgccgcgc

SEQ ID NO: 1489669 - RNA, 19 nt, Pseudomonas aeruginosa PA01
cguccagcgcgccgcgcag

SEQ ID NO: 1489670 - RNA, 16 nt, Pseudomonas aeruginosa PA01
cguccagcgagaacuu

SEQ ID NO: 1489671 - RNA, 14 nt, Pseudomonas aeruginosa PA01
cguccagcgaggcg

SEQ ID NO: 1489672 - RNA, 12 nt, Pseudomonas aeruginosa PA01
cguccagcgcca

SEQ ID NO: 1489673 - RNA, 23 nt, Pseudomonas aeruginosa PA01
cguccagcgccgagacgaucagc

SEQ ID NO: 1489674 - RNA, 22 nt, Pseudomonas aeruginosa PA01
cguccagcgcuugaacgcgcgc

SEQ ID NO: 1489675 - RNA, 23 nt, Pseudomonas aeruginosa PA01
cguccagcgcuugaacgcgcgcc

SEQ ID NO: 1489676 - RNA, 17 nt, Pseudomonas aeruginosa PA01
cguccaucgccgcggcg

SEQ ID NO: 1489677 - RNA, 22 nt, Pseudomonas aeruginosa PA01
cguccagcuugagguaggccag

SEQ ID NO: 1489678 - RNA, 14 nt, Pseudomonas aeruginosa PA01
cguccauggcggcg

SEQ ID NO: 1489679 - RNA, 15 nt, Pseudomonas aeruginosa PA01
cguccauggcggcga

SEQ ID NO: 1489680 - RNA, 22 nt, Pseudomonas aeruginosa PA01
cguccaugccguacaggucggc

SEQ ID NO: 1489681 - RNA, 14 nt, Pseudomonas aeruginosa PA01
cguccaggcaagcg

SEQ ID NO: 1489682 - RNA, 15 nt, Pseudomonas aeruginosa PA01
cguccaggcaagcgc

SEQ ID NO: 1489683 - RNA, 15 nt, Pseudomonas aeruginosa PA01
cguccaggccgccua

SEQ ID NO: 1489684 - RNA, 15 nt, Pseudomonas aeruginosa PA01
cguccagcucggcca

SEQ ID NO: 1489685 - RNA, 17 nt, Pseudomonas aeruginosa PA01
cguccagcucggccauc

SEQ ID NO: 1489686 - RNA, 22 nt, Pseudomonas aeruginosa PA01
cguccagcucggccaucagcgc

SEQ ID NO: 1489687 - RNA, 23 nt, Pseudomonas aeruginosa PA01
cguccagcucggccaucagcgcc

SEQ ID NO: 1489688 - RNA, 20 nt, Pseudomonas aeruginosa PA01
cguccagcucgucguggaag

SEQ ID NO: 1489689 - RNA, 14 nt, Pseudomonas aeruginosa PA01
cguccagcuccacc

SEQ ID NO: 1489690 - RNA, 18 nt, Pseudomonas aeruginosa PA01
cguccagcuccaccaggc

SEQ ID NO: 1489691 - RNA, 24 nt, Pseudomonas aeruginosa PA01
cgucaucguccagcucggccauca

SEQ ID NO: 1489692 - RNA, 23 nt, Pseudomonas aeruginosa PA01
cgucaugaccagagccgccgaac

SEQ ID NO: 1489693 - RNA, 19 nt, Pseudomonas aeruginosa PA01
cgucauguuguucgcgcac

SEQ ID NO: 1489694 - RNA, 16 nt, Pseudomonas aeruginosa PA01
cgucauggcgcacgcc

SEQ ID NO: 1489695 - RNA, 15 nt, Pseudomonas aeruginosa PA01
cgucaugccgccguc

SEQ ID NO: 1489696 - RNA, 14 nt, Pseudomonas aeruginosa PA01
cgucacgaacggcg

SEQ ID NO: 1489697 - RNA, 14 nt, Pseudomonas aeruginosa PA01
cgucaccucggcgc

SEQ ID NO: 1489698 - RNA, 14 nt, Pseudomonas aeruginosa PA01
cguccggcagggcc

SEQ ID NO: 1489699 - RNA, 20 nt, Pseudomonas aeruginosa PA01
cguccggagugaugccgaug

SEQ ID NO: 1489700 - RNA, 15 nt, Pseudomonas aeruginosa PA01
cguccggcgccaacu

SEQ ID NO: 1489701 - RNA, 15 nt, Pseudomonas aeruginosa PA01
cguccggccagccug

SEQ ID NO: 1489702 - RNA, 15 nt, Pseudomonas aeruginosa PA01
cguccggccgcccga

SEQ ID NO: 1489703 - RNA, 12 nt, Pseudomonas aeruginosa PA01
cguccggcgaga

SEQ ID NO: 1489704 - RNA, 20 nt, Pseudomonas aeruginosa PA01
cguccgggcgguacaggcgc

SEQ ID NO: 1489705 - RNA, 21 nt, Pseudomonas aeruginosa PA01
cguccgggcgguacaggcgca

SEQ ID NO: 1489706 - RNA, 20 nt, Pseudomonas aeruginosa PA01
cguccucagccucacccugc

SEQ ID NO: 1489707 - RNA, 20 nt, Pseudomonas aeruginosa PA01
cguccuccucgaucacccgc

SEQ ID NO: 1489708 - RNA, 15 nt, Pseudomonas aeruginosa PA01
cguccuccaaagccu

SEQ ID NO: 1489709 - RNA, 21 nt, Pseudomonas aeruginosa PA01
cguccuccaaagccuggagca

SEQ ID NO: 1489710 - RNA, 15 nt, Pseudomonas aeruginosa PA01
cguccuccaccgcuc

SEQ ID NO: 1489711 - RNA, 13 nt, Pseudomonas aeruginosa PA01
cguccuccagcaa

SEQ ID NO: 1489712 - RNA, 15 nt, Pseudomonas aeruginosa PA01
cguccuccagcaagg

SEQ ID NO: 1489713 - RNA, 17 nt, Pseudomonas aeruginosa PA01
cguccuccaggaccagg

SEQ ID NO: 1489714 - RNA, 13 nt, Pseudomonas aeruginosa PA01
cguccgcuggccu

SEQ ID NO: 1489715 - RNA, 21 nt, Pseudomonas aeruginosa PA01
cguccgcuggccugcagcagg

SEQ ID NO: 1489716 - RNA, 15 nt, Pseudomonas aeruginosa PA01
cguccgcgccgcgcg

SEQ ID NO: 1489717 - RNA, 14 nt, Pseudomonas aeruginosa PA01
cguccgcgggcgau

SEQ ID NO: 1489718 - RNA, 19 nt, Pseudomonas aeruginosa PA01
cguccgcgaugcguuccag

SEQ ID NO: 1489719 - RNA, 22 nt, Pseudomonas aeruginosa PA01
cguccgcgaugcguuccagggc

SEQ ID NO: 1489720 - RNA, 22 nt, Pseudomonas aeruginosa PA01
cguccgcgcaggcggucgccga

SEQ ID NO: 1489721 - RNA, 14 nt, Pseudomonas aeruginosa PA01
cguccaucgccgcg

SEQ ID NO: 1489722 - RNA, 16 nt, Pseudomonas aeruginosa PA01
cguccauuuucagcgg

SEQ ID NO: 1489723 - RNA, 15 nt, Pseudomonas aeruginosa PA01
cgucccacaggccgg

SEQ ID NO: 1489724 - RNA, 17 nt, Pseudomonas aeruginosa PA01
cgucgaagcgcagcagg

SEQ ID NO: 1489725 - RNA, 17 nt, Pseudomonas aeruginosa PA01
cgucgaagcucggcgcg

SEQ ID NO: 1489726 - RNA, 18 nt, Pseudomonas aeruginosa PA01
cgucgaagcugucggccc

SEQ ID NO: 1489727 - RNA, 20 nt, Pseudomonas aeruginosa PA01
cgucgaagcugucggcccgc

SEQ ID NO: 1489728 - RNA, 22 nt, Pseudomonas aeruginosa PA01
cgucgaagcugucggcccgcgc

SEQ ID NO: 1489729 - RNA, 18 nt, Pseudomonas aeruginosa PA01
cgucgaagggcacgccgc

SEQ ID NO: 1489730 - RNA, 23 nt, Pseudomonas aeruginosa PA01
cgucgaagggcacgccgcucugc

SEQ ID NO: 1489731 - RNA, 17 nt, Pseudomonas aeruginosa PA01
cgucgaagucgaucacc

SEQ ID NO: 1489732 - RNA, 20 nt, Pseudomonas aeruginosa PA01
cguccucgcgacaccgggcc

SEQ ID NO: 1489733 - RNA, 14 nt, Pseudomonas aeruginosa PA01
cguccucgcgccgc

SEQ ID NO: 1489734 - RNA, 16 nt, Pseudomonas aeruginosa PA01
cguccucgcgccgcuu

SEQ ID NO: 1489735 - RNA, 14 nt, Pseudomonas aeruginosa PA01
cguccucggggaag

SEQ ID NO: 1489736 - RNA, 17 nt, Pseudomonas aeruginosa PA01
cguccucgaaagccgcc

SEQ ID NO: 1489737 - RNA, 19 nt, Pseudomonas aeruginosa PA01
cguccucgaaagccgccgc

SEQ ID NO: 1489738 - RNA, 19 nt, Pseudomonas aeruginosa PA01
cguccucgcccugcuuggc

SEQ ID NO: 1489739 - RNA, 20 nt, Pseudomonas aeruginosa PA01
cguccucgcccugcuuggcc

SEQ ID NO: 1489740 - RNA, 23 nt, Pseudomonas aeruginosa PA01
cguccucgaugcccgccucgcgc

SEQ ID NO: 1489741 - RNA, 24 nt, Pseudomonas aeruginosa PA01
cguccucgaugcccgccucgcgca

SEQ ID NO: 1489742 - RNA, 11 nt, Pseudomonas aeruginosa PA01
cgucgaagcca

SEQ ID NO: 1489743 - RNA, 17 nt, Pseudomonas aeruginosa PA01
cgucgaagccaggcacc

SEQ ID NO: 1489744 - RNA, 13 nt, Pseudomonas aeruginosa PA01
cgucgaagcccag

SEQ ID NO: 1489745 - RNA, 14 nt, Pseudomonas aeruginosa PA01
cgucgaagcccagg

SEQ ID NO: 1489746 - RNA, 17 nt, Pseudomonas aeruginosa PA01
cguccucguggcgcgcc

SEQ ID NO: 1489747 - RNA, 20 nt, Pseudomonas aeruginosa PA01
cgucgaacaccggcgccgcc

SEQ ID NO: 1489748 - RNA, 14 nt, Pseudomonas aeruginosa PA01
cgucgaacagcagc

SEQ ID NO: 1489749 - RNA, 16 nt, Pseudomonas aeruginosa PA01
cgucgaacagcagcuc

SEQ ID NO: 1489750 - RNA, 20 nt, Pseudomonas aeruginosa PA01
cgucgaacagcagcucgccg

SEQ ID NO: 1489751 - RNA, 13 nt, Pseudomonas aeruginosa PA01
cgucgaacgacuc

SEQ ID NO: 1489752 - RNA, 16 nt, Pseudomonas aeruginosa PA01
cgucgaacgacucuuc

SEQ ID NO: 1489753 - RNA, 15 nt, Pseudomonas aeruginosa PA01
cgucgaacagcgagu

SEQ ID NO: 1489754 - RNA, 13 nt, Pseudomonas aeruginosa PA01
cgucgcgcgcggc

SEQ ID NO: 1489755 - RNA, 16 nt, Pseudomonas aeruginosa PA01
cgucgcgccggccauu

SEQ ID NO: 1489756 - RNA, 23 nt, Pseudomonas aeruginosa PA01
cgucgcgccgcccggcucgccgc

SEQ ID NO: 1489757 - RNA, 23 nt, Pseudomonas aeruginosa PA01
cgucgcgcaggcgggcggcgucg

SEQ ID NO: 1489758 - RNA, 14 nt, Pseudomonas aeruginosa PA01
cgucgcgccaggcg

SEQ ID NO: 1489759 - RNA, 13 nt, Pseudomonas aeruginosa PA01
cgucgcgccaggc

SEQ ID NO: 1489760 - RNA, 13 nt, Pseudomonas aeruginosa PA01
cgucgcgccagca

SEQ ID NO: 1489761 - RNA, 18 nt, Pseudomonas aeruginosa PA01
cgucgcggauguucacca

SEQ ID NO: 1489762 - RNA, 20 nt, Pseudomonas aeruginosa PA01
cgucgcggauguucaccagg

SEQ ID NO: 1489763 - RNA, 16 nt, Pseudomonas aeruginosa PA01
cgucgcggaucaacgg

SEQ ID NO: 1489764 - RNA, 15 nt, Pseudomonas aeruginosa PA01
cgucgcgcggccagc

SEQ ID NO: 1489765 - RNA, 16 nt, Pseudomonas aeruginosa PA01
cgucgcgcggccagcg

SEQ ID NO: 1489766 - RNA, 16 nt, Pseudomonas aeruginosa PA01
cgucgcuauagcggau

SEQ ID NO: 1489767 - RNA, 14 nt, Pseudomonas aeruginosa PA01
cgucgcggcgccug

SEQ ID NO: 1489768 - RNA, 16 nt, Pseudomonas aeruginosa PA01
cgucgcucauccgcga

SEQ ID NO: 1489769 - RNA, 14 nt, Pseudomonas aeruginosa PA01
cgucgcuggcgaug

SEQ ID NO: 1489770 - RNA, 22 nt, Pseudomonas aeruginosa PA01
cgucgcugcacgcacgcgccug

SEQ ID NO: 1489771 - RNA, 14 nt, Pseudomonas aeruginosa PA01
cgucgcugcgcggg

SEQ ID NO: 1489772 - RNA, 13 nt, Pseudomonas aeruginosa PA01
cgucgcugccgcc

SEQ ID NO: 1489773 - RNA, 14 nt, Pseudomonas aeruginosa PA01
cgucgcugccgccg

SEQ ID NO: 1489774 - RNA, 20 nt, Pseudomonas aeruginosa PA01
cgucgcugccgccgcgcccg

SEQ ID NO: 1489775 - RNA, 22 nt, Pseudomonas aeruginosa PA01
cgucgccgggaaacagggcgac

SEQ ID NO: 1489776 - RNA, 16 nt, Pseudomonas aeruginosa PA01
cgucgcgcaccuggcg

SEQ ID NO: 1489777 - RNA, 22 nt, Pseudomonas aeruginosa PA01
cgucgcgcaccacccaucugcc

SEQ ID NO: 1489778 - RNA, 16 nt, Pseudomonas aeruginosa PA01
cgucgaucucgagcau

SEQ ID NO: 1489779 - RNA, 20 nt, Pseudomonas aeruginosa PA01
cgucgccauucggcgacggg

SEQ ID NO: 1489780 - RNA, 12 nt, Pseudomonas aeruginosa PA01
cgucgccaggcc

SEQ ID NO: 1489781 - RNA, 22 nt, Pseudomonas aeruginosa PA01
cgucgccaggccguagaccacc

SEQ ID NO: 1489782 - RNA, 23 nt, Pseudomonas aeruginosa PA01
cgucgccaggccguagaccacca

SEQ ID NO: 1489783 - RNA, 14 nt, Pseudomonas aeruginosa PA01
cgucgccacgcccg

SEQ ID NO: 1489784 - RNA, 16 nt, Pseudomonas aeruginosa PA01
cgucgccacgcccgcc

SEQ ID NO: 1489785 - RNA, 17 nt, Pseudomonas aeruginosa PA01
cgucgccacgcccgccg

SEQ ID NO: 1489786 - RNA, 16 nt, Pseudomonas aeruginosa PA01
cgucgccacgcucucc

SEQ ID NO: 1489787 - RNA, 13 nt, Pseudomonas aeruginosa PA01
cgucgaucucgcc

SEQ ID NO: 1489788 - RNA, 21 nt, Pseudomonas aeruginosa PA01
cgucgaucucgccgaaggugc

SEQ ID NO: 1489789 - RNA, 17 nt, Pseudomonas aeruginosa PA01
cgucgaucaggcgggcg

SEQ ID NO: 1489790 - RNA, 19 nt, Pseudomonas aeruginosa PA01
cgucgaucagguaggccgg

SEQ ID NO: 1489791 - RNA, 16 nt, Pseudomonas aeruginosa PA01
cgucgaucagguccug

SEQ ID NO: 1489792 - RNA, 21 nt, Pseudomonas aeruginosa PA01
cgucgaucagguccuggccga

SEQ ID NO: 1489793 - RNA, 20 nt, Pseudomonas aeruginosa PA01
cgucgaucaucugcugcagc

SEQ ID NO: 1489794 - RNA, 23 nt, Pseudomonas aeruginosa PA01
cgucgaucccggauucgccgagg

SEQ ID NO: 1489795 - RNA, 23 nt, Pseudomonas aeruginosa PA01
cgucgaugucgcggcugaaggcc

SEQ ID NO: 1489796 - RNA, 21 nt, Pseudomonas aeruginosa PA01
cgucgaucugcucguccaggc

SEQ ID NO: 1489797 - RNA, 23 nt, Pseudomonas aeruginosa PA01
cgucgaucugcucguccaggccg

SEQ ID NO: 1489798 - RNA, 17 nt, Pseudomonas aeruginosa PA01
cgucgagcugcucggcg

SEQ ID NO: 1489799 - RNA, 21 nt, Pseudomonas aeruginosa PA01
cgucgagcugcucggcggugg

SEQ ID NO: 1489800 - RNA, 17 nt, Pseudomonas aeruginosa PA01
cgucgagcuggcgcagg

SEQ ID NO: 1489801 - RNA, 18 nt, Pseudomonas aeruginosa PA01
cgucgagcuggcgcaggc

SEQ ID NO: 1489802 - RNA, 17 nt, Pseudomonas aeruginosa PA01
cgucgaggaaggccagg

SEQ ID NO: 1489803 - RNA, 16 nt, Pseudomonas aeruginosa PA01
cgucgaggucgacggc

SEQ ID NO: 1489804 - RNA, 17 nt, Pseudomonas aeruginosa PA01
cgucgaggucgacggcg

SEQ ID NO: 1489805 - RNA, 19 nt, Pseudomonas aeruginosa PA01
cgucgaggucgacggcggc

SEQ ID NO: 1489806 - RNA, 20 nt, Pseudomonas aeruginosa PA01
cgucgaggucgacggcggcc

SEQ ID NO: 1489807 - RNA, 22 nt, Pseudomonas aeruginosa PA01
cgucgaggucgacggcggccgc

SEQ ID NO: 1489808 - RNA, 15 nt, Pseudomonas aeruginosa PA01
cgucgagggccuugu

SEQ ID NO: 1489809 - RNA, 19 nt, Pseudomonas aeruginosa PA01
cgucgaggguggcgccgag

SEQ ID NO: 1489810 - RNA, 21 nt, Pseudomonas aeruginosa PA01
cgucgaggguugucaccggca

SEQ ID NO: 1489811 - RNA, 15 nt, Pseudomonas aeruginosa PA01
cgucgaguaccgcug

SEQ ID NO: 1489812 - RNA, 22 nt, Pseudomonas aeruginosa PA01
cgucgaguaccgcugcggccgg

SEQ ID NO: 1489813 - RNA, 23 nt, Pseudomonas aeruginosa PA01
cgucgaguaccgcugcggccggc

SEQ ID NO: 1489814 - RNA, 23 nt, Pseudomonas aeruginosa PA01
cgucgaggugcggcugccggugc

SEQ ID NO: 1489815 - RNA, 15 nt, Pseudomonas aeruginosa PA01
cgucgaggucggcga

SEQ ID NO: 1489816 - RNA, 17 nt, Pseudomonas aeruginosa PA01
cgucgaggucggcgauc

SEQ ID NO: 1489817 - RNA, 19 nt, Pseudomonas aeruginosa PA01
cgucgagcaccagcagguc

SEQ ID NO: 1489818 - RNA, 15 nt, Pseudomonas aeruginosa PA01
cgucgagcaccaggc

SEQ ID NO: 1489819 - RNA, 14 nt, Pseudomonas aeruginosa PA01
cgucgagcacgccg

SEQ ID NO: 1489820 - RNA, 17 nt, Pseudomonas aeruginosa PA01
cgucgagcacgccgucc

SEQ ID NO: 1489821 - RNA, 17 nt, Pseudomonas aeruginosa PA01
cgucgagcagcgcgcgg

SEQ ID NO: 1489822 - RNA, 18 nt, Pseudomonas aeruginosa PA01
cgucgagcagcgcgcggc

SEQ ID NO: 1489823 - RNA, 15 nt, Pseudomonas aeruginosa PA01
cgucgagcaucugcc

SEQ ID NO: 1489824 - RNA, 17 nt, Pseudomonas aeruginosa PA01
cgucgagcaucugccgg

SEQ ID NO: 1489825 - RNA, 15 nt, Pseudomonas aeruginosa PA01
cgucgagcgcagcga

SEQ ID NO: 1489826 - RNA, 19 nt, Pseudomonas aeruginosa PA01
cgucgacuugccgaucaug

SEQ ID NO: 1489827 - RNA, 15 nt, Pseudomonas aeruginosa PA01
cgucgagaccgaccg

SEQ ID NO: 1489828 - RNA, 12 nt, Pseudomonas aeruginosa PA01
cgucgaccugcg

SEQ ID NO: 1489829 - RNA, 14 nt, Pseudomonas aeruginosa PA01
cgucgaccugcggg

SEQ ID NO: 1489830 - RNA, 19 nt, Pseudomonas aeruginosa PA01
cgucgaccugcggggcgga

SEQ ID NO: 1489831 - RNA, 15 nt, Pseudomonas aeruginosa PA01
cgucgaccgccugcc

SEQ ID NO: 1489832 - RNA, 14 nt, Pseudomonas aeruginosa PA01
cgguugccgaagcg

SEQ ID NO: 1489833 - RNA, 16 nt, Pseudomonas aeruginosa PA01
cgguuucgcagcgcuc

SEQ ID NO: 1489834 - RNA, 21 nt, Pseudomonas aeruginosa PA01
cgguuuuuuauugccagcgac

SEQ ID NO: 1489835 - RNA, 16 nt, Pseudomonas aeruginosa PA01
cgguucgcggcgcagc

SEQ ID NO: 1489836 - RNA, 21 nt, Pseudomonas aeruginosa PA01
cgguugagauccuggccggcg

SEQ ID NO: 1489837 - RNA, 16 nt, Pseudomonas aeruginosa PA01
cgguugagcagggcgu

SEQ ID NO: 1489838 - RNA, 20 nt, Pseudomonas aeruginosa PA01
cgguugauagcgcggccuuc

SEQ ID NO: 1489839 - RNA, 23 nt, Pseudomonas aeruginosa PA01
cgguugauagcgcggccuucagc

SEQ ID NO: 1489840 - RNA, 15 nt, Pseudomonas aeruginosa PA01
cgguugaugccgacg

SEQ ID NO: 1489841 - RNA, 22 nt, Pseudomonas aeruginosa PA01
cgguugauuuccgcaccgaggu

SEQ ID NO: 1489842 - RNA, 13 nt, Pseudomonas aeruginosa PA01
cgguugccaggcc

SEQ ID NO: 1489843 - RNA, 15 nt, Pseudomonas aeruginosa PA01
cgguugccaggccgg

SEQ ID NO: 1489844 - RNA, 16 nt, Pseudomonas aeruginosa PA01
cgguugccaggccggc

SEQ ID NO: 1489845 - RNA, 18 nt, Pseudomonas aeruginosa PA01
cgguugccuucgucgcug

SEQ ID NO: 1489846 - RNA, 13 nt, Pseudomonas aeruginosa PA01
cgguugccgcgcc

SEQ ID NO: 1489847 - RNA, 19 nt, Pseudomonas aeruginosa PA01
cgguugccgcgccaaaaag

SEQ ID NO: 1489848 - RNA, 14 nt, Pseudomonas aeruginosa PA01
cgguugccgcugcg

SEQ ID NO: 1489849 - RNA, 16 nt, Pseudomonas aeruginosa PA01
cgguugccgcugcggc

SEQ ID NO: 1489850 - RNA, 15 nt, Pseudomonas aeruginosa PA01
cgguugccggagacg

SEQ ID NO: 1489851 - RNA, 19 nt, Pseudomonas aeruginosa PA01
cgguucgaugaggaugcug

SEQ ID NO: 1489852 - RNA, 16 nt, Pseudomonas aeruginosa PA01
cgguucagcagcggca

SEQ ID NO: 1489853 - RNA, 23 nt, Pseudomonas aeruginosa PA01
cgguucgcccgcgggcagcucga

SEQ ID NO: 1489854 - RNA, 18 nt, Pseudomonas aeruginosa PA01
cgguucgccgagcgccgc

SEQ ID NO: 1489855 - RNA, 19 nt, Pseudomonas aeruginosa PA01
cgguucgccgagcgccgcc

SEQ ID NO: 1489856 - RNA, 14 nt, Pseudomonas aeruginosa PA01
cgguucgcaggcca

SEQ ID NO: 1489857 - RNA, 20 nt, Pseudomonas aeruginosa PA01
cgguucgcaggccaggcgca

SEQ ID NO: 1489858 - RNA, 23 nt, Pseudomonas aeruginosa PA01
cgguucgcccaguaccacgcagc

SEQ ID NO: 1489859 - RNA, 16 nt, Pseudomonas aeruginosa PA01
cgguuauccgccgcug

SEQ ID NO: 1489860 - RNA, 15 nt, Pseudomonas aeruginosa PA01
cgguuauccgccgug

SEQ ID NO: 1489861 - RNA, 16 nt, Pseudomonas aeruginosa PA01
cgguuauucgccccag

SEQ ID NO: 1489862 - RNA, 17 nt, Pseudomonas aeruginosa PA01
cgguuauucgcccuacg

SEQ ID NO: 1489863 - RNA, 19 nt, Pseudomonas aeruginosa PA01
cgguuaucgaggcgucggc

SEQ ID NO: 1489864 - RNA, 14 nt, Pseudomonas aeruginosa PA01
cggucgcaccgcca

SEQ ID NO: 1489865 - RNA, 16 nt, Pseudomonas aeruginosa PA01
cggucgcaccgccagc

SEQ ID NO: 1489866 - RNA, 15 nt, Pseudomonas aeruginosa PA01
cggucgcccucggcc

SEQ ID NO: 1489867 - RNA, 19 nt, Pseudomonas aeruginosa PA01
cggucgcccucggccaggc

SEQ ID NO: 1489868 - RNA, 20 nt, Pseudomonas aeruginosa PA01
cggucgcccucggccaggca

SEQ ID NO: 1489869 - RNA, 18 nt, Pseudomonas aeruginosa PA01
cggucgccgaacagccgc

SEQ ID NO: 1489870 - RNA, 17 nt, Pseudomonas aeruginosa PA01
cgguuacucgccggcau

SEQ ID NO: 1489871 - RNA, 17 nt, Pseudomonas aeruginosa PA01
cgguuagaauaccggcc

SEQ ID NO: 1489872 - RNA, 19 nt, Pseudomonas aeruginosa PA01
cgguuagaauaccggccug

SEQ ID NO: 1489873 - RNA, 13 nt, Pseudomonas aeruginosa PA01
cggucgccgccag

SEQ ID NO: 1489874 - RNA, 15 nt, Pseudomonas aeruginosa PA01
cggucgccgccagca

SEQ ID NO: 1489875 - RNA, 16 nt, Pseudomonas aeruginosa PA01
cggucgccgccagcau

SEQ ID NO: 1489876 - RNA, 12 nt, Pseudomonas aeruginosa PA01
cggucgccgccg

SEQ ID NO: 1489877 - RNA, 15 nt, Pseudomonas aeruginosa PA01
cggucgccgccggcg

SEQ ID NO: 1489878 - RNA, 18 nt, Pseudomonas aeruginosa PA01
cgguuaccggcgaccacc

SEQ ID NO: 1489879 - RNA, 22 nt, Pseudomonas aeruginosa PA01
cgguuaccggcgaccaccgccg

SEQ ID NO: 1489880 - RNA, 13 nt, Pseudomonas aeruginosa PA01
cguaccguuggcg

SEQ ID NO: 1489881 - RNA, 12 nt, Pseudomonas aeruginosa PA01
cguacgcugcca

SEQ ID NO: 1489882 - RNA, 18 nt, Pseudomonas aeruginosa PA01
cguacgcugccagguugg

SEQ ID NO: 1489883 - RNA, 22 nt, Pseudomonas aeruginosa PA01
cguacgcuucagcgguucggca

SEQ ID NO: 1489884 - RNA, 15 nt, Pseudomonas aeruginosa PA01
cguacgcccagcagc

SEQ ID NO: 1489885 - RNA, 22 nt, Pseudomonas aeruginosa PA01
cguacgcccgcagccacggcac

SEQ ID NO: 1489886 - RNA, 15 nt, Pseudomonas aeruginosa PA01
cguaccuucgagcag

SEQ ID NO: 1489887 - RNA, 15 nt, Pseudomonas aeruginosa PA01
cguacuggcgccagg

SEQ ID NO: 1489888 - RNA, 17 nt, Pseudomonas aeruginosa PA01
cguacuggcgccaggcc

SEQ ID NO: 1489889 - RNA, 19 nt, Pseudomonas aeruginosa PA01
cguacuggcgccaggccgc

SEQ ID NO: 1489890 - RNA, 16 nt, Pseudomonas aeruginosa PA01
cguacuugccagggca

SEQ ID NO: 1489891 - RNA, 15 nt, Pseudomonas aeruginosa PA01
cguacuugggcauca

SEQ ID NO: 1489892 - RNA, 17 nt, Pseudomonas aeruginosa PA01
cguacuugggcaucagc

SEQ ID NO: 1489893 - RNA, 15 nt, Pseudomonas aeruginosa PA01
cguagaacagcacgu

SEQ ID NO: 1489894 - RNA, 19 nt, Pseudomonas aeruginosa PA01
cguagaacaccacccggcc

SEQ ID NO: 1489895 - RNA, 15 nt, Pseudomonas aeruginosa PA01
cguacguccagggca

SEQ ID NO: 1489896 - RNA, 14 nt, Pseudomonas aeruginosa PA01
cguacgcaccgcgu

SEQ ID NO: 1489897 - RNA, 16 nt, Pseudomonas aeruginosa PA01
cguacucaggccgggc

SEQ ID NO: 1489898 - RNA, 17 nt, Pseudomonas aeruginosa PA01
cguacucaggccgggcg

SEQ ID NO: 1489899 - RNA, 21 nt, Pseudomonas aeruginosa PA01
cguacucauggccgcagcggc

SEQ ID NO: 1489900 - RNA, 14 nt, Pseudomonas aeruginosa PA01
cguacuccagcaac

SEQ ID NO: 1489901 - RNA, 17 nt, Pseudomonas aeruginosa PA01
cguacaccgcgcggcac

SEQ ID NO: 1489902 - RNA, 20 nt, Pseudomonas aeruginosa PA01
cguaauucgcugacgaggac

SEQ ID NO: 1489903 - RNA, 22 nt, Pseudomonas aeruginosa PA01
cguaacggcuugucggguaggg

SEQ ID NO: 1489904 - RNA, 22 nt, Pseudomonas aeruginosa PA01
cguacaugggaaccucggcagg

SEQ ID NO: 1489905 - RNA, 14 nt, Pseudomonas aeruginosa PA01
cguaccacguccag

SEQ ID NO: 1489906 - RNA, 14 nt, Pseudomonas aeruginosa PA01
cguaccagcgcgau

SEQ ID NO: 1489907 - RNA, 13 nt, Pseudomonas aeruginosa PA01
cguaccagcgcgc

SEQ ID NO: 1489908 - RNA, 16 nt, Pseudomonas aeruginosa PA01
cguaccagcgcgcagc

SEQ ID NO: 1489909 - RNA, 15 nt, Pseudomonas aeruginosa PA01
cguacaggucggcgc

SEQ ID NO: 1489910 - RNA, 17 nt, Pseudomonas aeruginosa PA01
cguacaggucggcgccg

SEQ ID NO: 1489911 - RNA, 16 nt, Pseudomonas aeruginosa PA01
cguacagcccccgccg

SEQ ID NO: 1489912 - RNA, 19 nt, Pseudomonas aeruginosa PA01
cguacagcccccgccggcc

SEQ ID NO: 1489913 - RNA, 17 nt, Pseudomonas aeruginosa PA01
cguacagcaggcaggca

SEQ ID NO: 1489914 - RNA, 15 nt, Pseudomonas aeruginosa PA01
cguacaggccccagg

SEQ ID NO: 1489915 - RNA, 18 nt, Pseudomonas aeruginosa PA01
cguacagcgggccgggga

SEQ ID NO: 1489916 - RNA, 23 nt, Pseudomonas aeruginosa PA01
cguacagcgcgacaucggcgaug

SEQ ID NO: 1489917 - RNA, 12 nt, Pseudomonas aeruginosa PA01
aaccccucggcu

SEQ ID NO: 1489918 - RNA, 20 nt, Pseudomonas aeruginosa PA01
cguagcggucgugcagcagc

SEQ ID NO: 1489919 - RNA, 23 nt, Pseudomonas aeruginosa PA01
cguagcggucgugcagcagcgcc

SEQ ID NO: 1489920 - RNA, 14 nt, Pseudomonas aeruginosa PA01
cguagcgugccgcc

SEQ ID NO: 1489921 - RNA, 16 nt, Pseudomonas aeruginosa PA01
cguagcguagggcgaa

SEQ ID NO: 1489922 - RNA, 21 nt, Pseudomonas aeruginosa PA01
cguagcguugcgcgagcaccg

SEQ ID NO: 1489923 - RNA, 14 nt, Pseudomonas aeruginosa PA01
cguaggcaggcgcg

SEQ ID NO: 1489924 - RNA, 16 nt, Pseudomonas aeruginosa PA01
cguaggcaggcgcggc

SEQ ID NO: 1489925 - RNA, 17 nt, Pseudomonas aeruginosa PA01
cguaggcaggcgcggca

SEQ ID NO: 1489926 - RNA, 13 nt, Pseudomonas aeruginosa PA01
cguaggagccggc

SEQ ID NO: 1489927 - RNA, 17 nt, Pseudomonas aeruginosa PA01
cguaggagccggccagg

SEQ ID NO: 1489928 - RNA, 18 nt, Pseudomonas aeruginosa PA01
cguagcuuuccgcggcgu

SEQ ID NO: 1489929 - RNA, 20 nt, Pseudomonas aeruginosa PA01
cguaggaacgugcggccugc

SEQ ID NO: 1489930 - RNA, 21 nt, Pseudomonas aeruginosa PA01
cguaggaacgugcggccugca

SEQ ID NO: 1489931 - RNA, 18 nt, Pseudomonas aeruginosa PA01
cguagcgcggcagcgcca

SEQ ID NO: 1489932 - RNA, 20 nt, Pseudomonas aeruginosa PA01
cguagcgccccuuggccagc

SEQ ID NO: 1489933 - RNA, 22 nt, Pseudomonas aeruginosa PA01
cguagcgccccuuggccagcac

SEQ ID NO: 1489934 - RNA, 17 nt, Pseudomonas aeruginosa PA01
cguagcgcucgguggca

SEQ ID NO: 1489935 - RNA, 16 nt, Pseudomonas aeruginosa PA01
aacccaggccgcgcag

SEQ ID NO: 1489936 - RNA, 23 nt, Pseudomonas aeruginosa PA01
aacccagguucuggucgccgaca

SEQ ID NO: 1489937 - RNA, 18 nt, Pseudomonas aeruginosa PA01
aaccccggccuggcgccg

SEQ ID NO: 1489938 - RNA, 13 nt, Pseudomonas aeruginosa PA01
aacccccugcgcg

SEQ ID NO: 1489939 - RNA, 16 nt, Pseudomonas aeruginosa PA01
cguagaccuugcggcc

SEQ ID NO: 1489940 - RNA, 12 nt, Pseudomonas aeruginosa PA01
cguagaccacca

SEQ ID NO: 1489941 - RNA, 17 nt, Pseudomonas aeruginosa PA01
cguagaccaccagcagc

SEQ ID NO: 1489942 - RNA, 20 nt, Pseudomonas aeruginosa PA01
cguagaccaccagcagcagc

SEQ ID NO: 1489943 - RNA, 19 nt, Pseudomonas aeruginosa PA01
cguagaccaccucgacggc

SEQ ID NO: 1489944 - RNA, 16 nt, Pseudomonas aeruginosa PA01
cguagaguucgcugag

SEQ ID NO: 1489945 - RNA, 14 nt, Pseudomonas aeruginosa PA01
cguagaugccggug

SEQ ID NO: 1489946 - RNA, 22 nt, Pseudomonas aeruginosa PA01
cguagacguagucggcagucgc

SEQ ID NO: 1489947 - RNA, 19 nt, Pseudomonas aeruginosa PA01
cguagacugugguguagcg

SEQ ID NO: 1489948 - RNA, 17 nt, Pseudomonas aeruginosa PA01
cguagagcgugcggccg

SEQ ID NO: 1489949 - RNA, 23 nt, Pseudomonas aeruginosa PA01
cguagcagcggaaaugcucgccg

SEQ ID NO: 1489950 - RNA, 17 nt, Pseudomonas aeruginosa PA01
cguagcagguccgcgcc

SEQ ID NO: 1489951 - RNA, 23 nt, Pseudomonas aeruginosa PA01
cguagcagguccgcgccucgcgc

SEQ ID NO: 1489952 - RNA, 18 nt, Pseudomonas aeruginosa PA01
cguagcccauggucagcg

SEQ ID NO: 1489953 - RNA, 13 nt, Pseudomonas aeruginosa PA01
cguagcccccgcc

SEQ ID NO: 1489954 - RNA, 18 nt, Pseudomonas aeruginosa PA01
cguagcccccgccgcuga

SEQ ID NO: 1489955 - RNA, 21 nt, Pseudomonas aeruginosa PA01
cguagcccuucuccgccagcc

SEQ ID NO: 1489956 - RNA, 16 nt, Pseudomonas aeruginosa PA01
cguagccccucgcgca

SEQ ID NO: 1489957 - RNA, 14 nt, Pseudomonas aeruginosa PA01
cguagccggccagg

SEQ ID NO: 1489958 - RNA, 17 nt, Pseudomonas aeruginosa PA01
cguagccggcgauccgc

SEQ ID NO: 1489959 - RNA, 20 nt, Pseudomonas aeruginosa PA01
cguagccggcgauccgcugc

SEQ ID NO: 1489960 - RNA, 18 nt, Pseudomonas aeruginosa PA01
cguagccgcgcgccagca

SEQ ID NO: 1489961 - RNA, 19 nt, Pseudomonas aeruginosa PA01
cguagccguagauggucag

SEQ ID NO: 1489962 - RNA, 21 nt, Pseudomonas aeruginosa PA01
cguagccguagauggucagca

SEQ ID NO: 1489963 - RNA, 15 nt, Pseudomonas aeruginosa PA01
cguagcgcagcggca

SEQ ID NO: 1489964 - RNA, 21 nt, Pseudomonas aeruginosa PA01
cguagcgcaguucgccgccga

SEQ ID NO: 1489965 - RNA, 23 nt, Pseudomonas aeruginosa PA01
cguagcgcaguucgccgccgagc

SEQ ID NO: 1489966 - RNA, 17 nt, Pseudomonas aeruginosa PA01
cguagguggcgccgccg

SEQ ID NO: 1489967 - RNA, 19 nt, Pseudomonas aeruginosa PA01
cguagguggcgccgccggc

SEQ ID NO: 1489968 - RNA, 21 nt, Pseudomonas aeruginosa PA01
cguaggcgaacacgucggcgc

SEQ ID NO: 1489969 - RNA, 22 nt, Pseudomonas aeruginosa PA01
cguaggcgaacacgucggcgcg

SEQ ID NO: 1489970 - RNA, 14 nt, Pseudomonas aeruginosa PA01
cguaguaggcgcgg

SEQ ID NO: 1489971 - RNA, 15 nt, Pseudomonas aeruginosa PA01
cguaguccugggccg

SEQ ID NO: 1489972 - RNA, 21 nt, Pseudomonas aeruginosa PA01
cguauccaagagagcgccagc

SEQ ID NO: 1489973 - RNA, 14 nt, Pseudomonas aeruginosa PA01
cguauccucggcca

SEQ ID NO: 1489974 - RNA, 14 nt, Pseudomonas aeruginosa PA01
cguauccgcggggu

SEQ ID NO: 1489975 - RNA, 20 nt, Pseudomonas aeruginosa PA01
aacccgccagcaagacgguc

SEQ ID NO: 1489976 - RNA, 18 nt, Pseudomonas aeruginosa PA01
aacccgcccucguggcgg

SEQ ID NO: 1489977 - RNA, 23 nt, Pseudomonas aeruginosa PA01
aacccgcuccgucgcuucgcccg

SEQ ID NO: 1489978 - RNA, 14 nt, Pseudomonas aeruginosa PA01
aacccgcggcgcgc

SEQ ID NO: 1489979 - RNA, 17 nt, Pseudomonas aeruginosa PA01
aacccgcgucccuugcg

SEQ ID NO: 1489980 - RNA, 12 nt, Pseudomonas aeruginosa PA01
cgucaccgcgcc

SEQ ID NO: 1489981 - RNA, 14 nt, Pseudomonas aeruginosa PA01
cgucaccgcgccga

SEQ ID NO: 1489982 - RNA, 20 nt, Pseudomonas aeruginosa PA01
cgucaccgcgccgaagguca

SEQ ID NO: 1489983 - RNA, 16 nt, Pseudomonas aeruginosa PA01
cgucaccggcgccacc

SEQ ID NO: 1489984 - RNA, 17 nt, Pseudomonas aeruginosa PA01
cgucaccggcgccaccc

SEQ ID NO: 1489985 - RNA, 22 nt, Pseudomonas aeruginosa PA01
cgucacccgcgccugcaggucg

SEQ ID NO: 1489986 - RNA, 23 nt, Pseudomonas aeruginosa PA01
aaccgccggccucgcugccgccg

SEQ ID NO: 1489987 - RNA, 12 nt, Pseudomonas aeruginosa PA01
aaccgcgagcgg

SEQ ID NO: 1489988 - RNA, 17 nt, Pseudomonas aeruginosa PA01
aaccgcgagcgguuauu

SEQ ID NO: 1489989 - RNA, 17 nt, Pseudomonas aeruginosa PA01
cguggaaaccucgccga

SEQ ID NO: 1489990 - RNA, 14 nt, Pseudomonas aeruginosa PA01
aaccgcggccggcu

SEQ ID NO: 1489991 - RNA, 13 nt, Pseudomonas aeruginosa PA01
aaccgcggcgccc

SEQ ID NO: 1489992 - RNA, 21 nt, Pseudomonas aeruginosa PA01
cgugcuuggugucggccgcca

SEQ ID NO: 1489993 - RNA, 23 nt, Pseudomonas aeruginosa PA01
cgugcuuggugucggccgccagg

SEQ ID NO: 1489994 - RNA, 19 nt, Pseudomonas aeruginosa PA01
cguggaaccgauggccagg

SEQ ID NO: 1489995 - RNA, 16 nt, Pseudomonas aeruginosa PA01
cguggaaccgcggcgc

SEQ ID NO: 1489996 - RNA, 21 nt, Pseudomonas aeruginosa PA01
cguggacauacaggcgcgccu

SEQ ID NO: 1489997 - RNA, 22 nt, Pseudomonas aeruginosa PA01
cguggacauacaggcgcgccug

SEQ ID NO: 1489998 - RNA, 14 nt, Pseudomonas aeruginosa PA01
cguggacgccggug

SEQ ID NO: 1489999 - RNA, 14 nt, Pseudomonas aeruginosa PA01
cguggagaggucgc

SEQ ID NO: 1490000 - RNA, 19 nt, Pseudomonas aeruginosa PA01
cguggcgaacgcccggcuu

SEQ ID NO: 1490001 - RNA, 21 nt, Pseudomonas aeruginosa PA01
cguggcgaucaggcagcgcgc

SEQ ID NO: 1490002 - RNA, 22 nt, Pseudomonas aeruginosa PA01
cguggcgacgaugcgccccagc

SEQ ID NO: 1490003 - RNA, 18 nt, Pseudomonas aeruginosa PA01
cguggcgacgcagcacgg

SEQ ID NO: 1490004 - RNA, 14 nt, Pseudomonas aeruginosa PA01
cguggcgccggcgc

SEQ ID NO: 1490005 - RNA, 14 nt, Pseudomonas aeruginosa PA01
cguggcgccgcagg

SEQ ID NO: 1490006 - RNA, 19 nt, Pseudomonas aeruginosa PA01
cguggcgccauccuccagc

SEQ ID NO: 1490007 - RNA, 17 nt, Pseudomonas aeruginosa PA01
cguggcgccccaggcgg

SEQ ID NO: 1490008 - RNA, 20 nt, Pseudomonas aeruginosa PA01
cguggcgccccaggcgggca

SEQ ID NO: 1490009 - RNA, 15 nt, Pseudomonas aeruginosa PA01
cguggcgcuugagca

SEQ ID NO: 1490010 - RNA, 20 nt, Pseudomonas aeruginosa PA01
cguggcgcuacgcucgccga

SEQ ID NO: 1490011 - RNA, 23 nt, Pseudomonas aeruginosa PA01
cguggcgcgcaucggugccggca

SEQ ID NO: 1490012 - RNA, 19 nt, Pseudomonas aeruginosa PA01
cguggcggaagaaucgcag

SEQ ID NO: 1490013 - RNA, 20 nt, Pseudomonas aeruginosa PA01
cguggcggacaacccggcgc

SEQ ID NO: 1490014 - RNA, 22 nt, Pseudomonas aeruginosa PA01
cguggcggacaacccggcgcug

SEQ ID NO: 1490015 - RNA, 23 nt, Pseudomonas aeruginosa PA01
cguggcggacaacccggcgcugg

SEQ ID NO: 1490016 - RNA, 12 nt, Pseudomonas aeruginosa PA01
cguggcggccgc

SEQ ID NO: 1490017 - RNA, 13 nt, Pseudomonas aeruginosa PA01
cguggcggccgcc

SEQ ID NO: 1490018 - RNA, 15 nt, Pseudomonas aeruginosa PA01
cguggcggccgccgc

SEQ ID NO: 1490019 - RNA, 18 nt, Pseudomonas aeruginosa PA01
cguggcggccgccggcgc

SEQ ID NO: 1490020 - RNA, 13 nt, Pseudomonas aeruginosa PA01
cguggcggcgcgc

SEQ ID NO: 1490021 - RNA, 15 nt, Pseudomonas aeruginosa PA01
cguggcgggccagca

SEQ ID NO: 1490022 - RNA, 17 nt, Pseudomonas aeruginosa PA01
cguggcgggccagcagg

SEQ ID NO: 1490023 - RNA, 20 nt, Pseudomonas aeruginosa PA01
cguggcgggccagcaggcgc

SEQ ID NO: 1490024 - RNA, 21 nt, Pseudomonas aeruginosa PA01
cguggcgggccagcaggcgcu

SEQ ID NO: 1490025 - RNA, 23 nt, Pseudomonas aeruginosa PA01
cguggcgggccagcaggcgcucg

SEQ ID NO: 1490026 - RNA, 16 nt, Pseudomonas aeruginosa PA01
cguggcuuggcccugc

SEQ ID NO: 1490027 - RNA, 19 nt, Pseudomonas aeruginosa PA01
cguggcuuggcccugcgcg

SEQ ID NO: 1490028 - RNA, 20 nt, Pseudomonas aeruginosa PA01
cguggcuuggcccugcgcgc

SEQ ID NO: 1490029 - RNA, 16 nt, Pseudomonas aeruginosa PA01
cguggcuucguccagc

SEQ ID NO: 1490030 - RNA, 18 nt, Pseudomonas aeruginosa PA01
cguggcuucguccagcga

SEQ ID NO: 1490031 - RNA, 17 nt, Pseudomonas aeruginosa PA01
cguggcuggggccggcc

SEQ ID NO: 1490032 - RNA, 21 nt, Pseudomonas aeruginosa PA01
cguggcuggggccggccuggg

SEQ ID NO: 1490033 - RNA, 17 nt, Pseudomonas aeruginosa PA01
cguggcugugcuggcca

SEQ ID NO: 1490034 - RNA, 19 nt, Pseudomonas aeruginosa PA01
cguggcugugcuggccacc

SEQ ID NO: 1490035 - RNA, 17 nt, Pseudomonas aeruginosa PA01
cgugggcaacaggccga

SEQ ID NO: 1490036 - RNA, 17 nt, Pseudomonas aeruginosa PA01
cgugggccaccaucagg

SEQ ID NO: 1490037 - RNA, 14 nt, Pseudomonas aeruginosa PA01
cgugggccagcagg

SEQ ID NO: 1490038 - RNA, 15 nt, Pseudomonas aeruginosa PA01
cgugggccagcaggc

SEQ ID NO: 1490039 - RNA, 23 nt, Pseudomonas aeruginosa PA01
cgugggccagcaggccgaucagc

SEQ ID NO: 1490040 - RNA, 13 nt, Pseudomonas aeruginosa PA01
cgugggccagccc

SEQ ID NO: 1490041 - RNA, 17 nt, Pseudomonas aeruginosa PA01
cgugggccagcccagaa

SEQ ID NO: 1490042 - RNA, 15 nt, Pseudomonas aeruginosa PA01
cgugggccgccgaac

SEQ ID NO: 1490043 - RNA, 13 nt, Pseudomonas aeruginosa PA01
cgugggccggcgc

SEQ ID NO: 1490044 - RNA, 15 nt, Pseudomonas aeruginosa PA01
cgugggccggcgcgc

SEQ ID NO: 1490045 - RNA, 17 nt, Pseudomonas aeruginosa PA01
cguggucuccgugcugg

SEQ ID NO: 1490046 - RNA, 18 nt, Pseudomonas aeruginosa PA01
cguggucuccgugcuggc

SEQ ID NO: 1490047 - RNA, 12 nt, Pseudomonas aeruginosa PA01
cguggucggcgg

SEQ ID NO: 1490048 - RNA, 14 nt, Pseudomonas aeruginosa PA01
cguggucgcgcagg

SEQ ID NO: 1490049 - RNA, 22 nt, Pseudomonas aeruginosa PA01
cguggucgcgcaggcgguggag

SEQ ID NO: 1490050 - RNA, 19 nt, Pseudomonas aeruginosa PA01
cgugggccugcuccucggc

SEQ ID NO: 1490051 - RNA, 23 nt, Pseudomonas aeruginosa PA01
cguggucgccgcucauccgcugg

SEQ ID NO: 1490052 - RNA, 19 nt, Pseudomonas aeruginosa PA01
cgugcucuuuucccgcacc

SEQ ID NO: 1490053 - RNA, 17 nt, Pseudomonas aeruginosa PA01
cgugcucggcgaucucg

SEQ ID NO: 1490054 - RNA, 13 nt, Pseudomonas aeruginosa PA01
cgugcgggucgag

SEQ ID NO: 1490055 - RNA, 14 nt, Pseudomonas aeruginosa PA01
cgugcucgcggacc

SEQ ID NO: 1490056 - RNA, 19 nt, Pseudomonas aeruginosa PA01
cgugcucgcggaccagcuc

SEQ ID NO: 1490057 - RNA, 19 nt, Pseudomonas aeruginosa PA01
cgugcgccgcgggucacca

SEQ ID NO: 1490058 - RNA, 16 nt, Pseudomonas aeruginosa PA01
cgugcgccgcucgcgc

SEQ ID NO: 1490059 - RNA, 21 nt, Pseudomonas aeruginosa PA01
cgugcgccgcucgcgcacggc

SEQ ID NO: 1490060 - RNA, 13 nt, Pseudomonas aeruginosa PA01
cgugcgccccagc

SEQ ID NO: 1490061 - RNA, 21 nt, Pseudomonas aeruginosa PA01
cgugcgccccagcucagcagg

SEQ ID NO: 1490062 - RNA, 19 nt, Pseudomonas aeruginosa PA01
cgugcggcguucgccgcgg

SEQ ID NO: 1490063 - RNA, 22 nt, Pseudomonas aeruginosa PA01
cgugcgcgcaacuggucgcggc

SEQ ID NO: 1490064 - RNA, 14 nt, Pseudomonas aeruginosa PA01
cgugcggccgauca

SEQ ID NO: 1490065 - RNA, 15 nt, Pseudomonas aeruginosa PA01
cgugcggccgaucau

SEQ ID NO: 1490066 - RNA, 18 nt, Pseudomonas aeruginosa PA01
cgugcggccugcaacaga

SEQ ID NO: 1490067 - RNA, 18 nt, Pseudomonas aeruginosa PA01
cgugcgaacacaccgacc

SEQ ID NO: 1490068 - RNA, 19 nt, Pseudomonas aeruginosa PA01
cgugcgauucagaugcggu

SEQ ID NO: 1490069 - RNA, 16 nt, Pseudomonas aeruginosa PA01
cgugcgcaugcccgcg

SEQ ID NO: 1490070 - RNA, 22 nt, Pseudomonas aeruginosa PA01
cgugccguggaccaacagccgg

SEQ ID NO: 1490071 - RNA, 19 nt, Pseudomonas aeruginosa PA01
cgugccguggcucggcggc

SEQ ID NO: 1490072 - RNA, 22 nt, Pseudomonas aeruginosa PA01
cgugccguggcucggcggcagg

SEQ ID NO: 1490073 - RNA, 13 nt, Pseudomonas aeruginosa PA01
cgugccucggcgg

SEQ ID NO: 1490074 - RNA, 21 nt, Pseudomonas aeruginosa PA01
cgugccucggcggacagcccg

SEQ ID NO: 1490075 - RNA, 21 nt, Pseudomonas aeruginosa PA01
cgugccuguuccuccgccagg

SEQ ID NO: 1490076 - RNA, 12 nt, Pseudomonas aeruginosa PA01
cgugccgggcag

SEQ ID NO: 1490077 - RNA, 15 nt, Pseudomonas aeruginosa PA01
cgugccgggccggcc

SEQ ID NO: 1490078 - RNA, 16 nt, Pseudomonas aeruginosa PA01
cgugccgccaucgccu

SEQ ID NO: 1490079 - RNA, 18 nt, Pseudomonas aeruginosa PA01
cgugccgccaucgccucg

SEQ ID NO: 1490080 - RNA, 14 nt, Pseudomonas aeruginosa PA01
cgugccgccggggc

SEQ ID NO: 1490081 - RNA, 15 nt, Pseudomonas aeruginosa PA01
cgugccgcuggccga

SEQ ID NO: 1490082 - RNA, 16 nt, Pseudomonas aeruginosa PA01
cgugccgcuggccgac

SEQ ID NO: 1490083 - RNA, 21 nt, Pseudomonas aeruginosa PA01
cgugccgcggaugacgggcga

SEQ ID NO: 1490084 - RNA, 17 nt, Pseudomonas aeruginosa PA01
cguguugaucgccgcgc

SEQ ID NO: 1490085 - RNA, 18 nt, Pseudomonas aeruginosa PA01
cguguugaucgccgcgcc

SEQ ID NO: 1490086 - RNA, 15 nt, Pseudomonas aeruginosa PA01
cguguucgaccgggu

SEQ ID NO: 1490087 - RNA, 18 nt, Pseudomonas aeruginosa PA01
cguguucgcggcucuggc

SEQ ID NO: 1490088 - RNA, 13 nt, Pseudomonas aeruginosa PA01
cguguucggcggc

SEQ ID NO: 1490089 - RNA, 16 nt, Pseudomonas aeruginosa PA01
cguggucuuccucggu

SEQ ID NO: 1490090 - RNA, 23 nt, Pseudomonas aeruginosa PA01
cguggugauguccccccuacgaa

SEQ ID NO: 1490091 - RNA, 15 nt, Pseudomonas aeruginosa PA01
cguggugcauccgcc

SEQ ID NO: 1490092 - RNA, 17 nt, Pseudomonas aeruginosa PA01
cguggugcauccgccgc

SEQ ID NO: 1490093 - RNA, 20 nt, Pseudomonas aeruginosa PA01
cgugguggaugacccgcacc

SEQ ID NO: 1490094 - RNA, 14 nt, Pseudomonas aeruginosa PA01
cgugguggcacccg

SEQ ID NO: 1490095 - RNA, 21 nt, Pseudomonas aeruginosa PA01
cgugguggcggggaacagcau

SEQ ID NO: 1490096 - RNA, 14 nt, Pseudomonas aeruginosa PA01
cgugguugaggcgc

SEQ ID NO: 1490097 - RNA, 18 nt, Pseudomonas aeruginosa PA01
cgugguucucggucgggc

SEQ ID NO: 1490098 - RNA, 17 nt, Pseudomonas aeruginosa PA01
cguucacgccuggcggc

SEQ ID NO: 1490099 - RNA, 21 nt, Pseudomonas aeruginosa PA01
cguucacgccuggcggcuggc

SEQ ID NO: 1490100 - RNA, 13 nt, Pseudomonas aeruginosa PA01
cguucagcgccuc

SEQ ID NO: 1490101 - RNA, 19 nt, Pseudomonas aeruginosa PA01
cguucagucccgcggcgcg

SEQ ID NO: 1490102 - RNA, 22 nt, Pseudomonas aeruginosa PA01
cguucccagcagcgccucggca

SEQ ID NO: 1490103 - RNA, 14 nt, Pseudomonas aeruginosa PA01
cguucaggccggcg

SEQ ID NO: 1490104 - RNA, 17 nt, Pseudomonas aeruginosa PA01
cguucaggccggcgccg

SEQ ID NO: 1490105 - RNA, 20 nt, Pseudomonas aeruginosa PA01
cguucaggccggcgccgccg

SEQ ID NO: 1490106 - RNA, 13 nt, Pseudomonas aeruginosa PA01
cguucaggcgcgg

SEQ ID NO: 1490107 - RNA, 21 nt, Pseudomonas aeruginosa PA01
cguucaggcuguugcccuggg

SEQ ID NO: 1490108 - RNA, 14 nt, Pseudomonas aeruginosa PA01
cguucagcggcacg

SEQ ID NO: 1490109 - RNA, 17 nt, Pseudomonas aeruginosa PA01
cguucagcagcaugccg

SEQ ID NO: 1490110 - RNA, 16 nt, Pseudomonas aeruginosa PA01
cguucacuccacgagg

SEQ ID NO: 1490111 - RNA, 21 nt, Pseudomonas aeruginosa PA01
cguucagcccacccccggccc

SEQ ID NO: 1490112 - RNA, 16 nt, Pseudomonas aeruginosa PA01
cguuauccguccuacg

SEQ ID NO: 1490113 - RNA, 20 nt, Pseudomonas aeruginosa PA01
cguuaugcacguucuugacc

SEQ ID NO: 1490114 - RNA, 21 nt, Pseudomonas aeruginosa PA01
cguucggcuguuucaggccgg

SEQ ID NO: 1490115 - RNA, 14 nt, Pseudomonas aeruginosa PA01
cguucggcgcuggc

SEQ ID NO: 1490116 - RNA, 19 nt, Pseudomonas aeruginosa PA01
cguucgucaccggcgccac

SEQ ID NO: 1490117 - RNA, 15 nt, Pseudomonas aeruginosa PA01
cguucugcucgcugc

SEQ ID NO: 1490118 - RNA, 22 nt, Pseudomonas aeruginosa PA01
cguucuuccccugcaugccggc

SEQ ID NO: 1490119 - RNA, 20 nt, Pseudomonas aeruginosa PA01
cguucuucacccgcagcggc

SEQ ID NO: 1490120 - RNA, 22 nt, Pseudomonas aeruginosa PA01
cguucuucacccgcagcggcag

SEQ ID NO: 1490121 - RNA, 16 nt, Pseudomonas aeruginosa PA01
cguugaaacgcucggc

SEQ ID NO: 1490122 - RNA, 17 nt, Pseudomonas aeruginosa PA01
cguugaaacgcucggcg

SEQ ID NO: 1490123 - RNA, 18 nt, Pseudomonas aeruginosa PA01
cguugaaacgcucggcgu

SEQ ID NO: 1490124 - RNA, 16 nt, Pseudomonas aeruginosa PA01
cguugaacacaucgac

SEQ ID NO: 1490125 - RNA, 18 nt, Pseudomonas aeruginosa PA01
cguucuugaucaccgcgg

SEQ ID NO: 1490126 - RNA, 13 nt, Pseudomonas aeruginosa PA01
cguucuuccugag

SEQ ID NO: 1490127 - RNA, 23 nt, Pseudomonas aeruginosa PA01
cguucagggucagguugccggug

SEQ ID NO: 1490128 - RNA, 22 nt, Pseudomonas aeruginosa PA01
cguucccccuuuuucggcgcgg

SEQ ID NO: 1490129 - RNA, 17 nt, Pseudomonas aeruginosa PA01
cguuccggcucagccgc

SEQ ID NO: 1490130 - RNA, 17 nt, Pseudomonas aeruginosa PA01
cguuccgggcagcggcg

SEQ ID NO: 1490131 - RNA, 15 nt, Pseudomonas aeruginosa PA01
cguucggcgaugccg

SEQ ID NO: 1490132 - RNA, 19 nt, Pseudomonas aeruginosa PA01
cguucggcgaugccgcgcc

SEQ ID NO: 1490133 - RNA, 15 nt, Pseudomonas aeruginosa PA01
cguugcacagcgccc

SEQ ID NO: 1490134 - RNA, 22 nt, Pseudomonas aeruginosa PA01
cguugaugauacgcacgcuggu

SEQ ID NO: 1490135 - RNA, 17 nt, Pseudomonas aeruginosa PA01
cguugcaauugcaggcc

SEQ ID NO: 1490136 - RNA, 21 nt, Pseudomonas aeruginosa PA01
cguugcaauugcaggcccggc

SEQ ID NO: 1490137 - RNA, 15 nt, Pseudomonas aeruginosa PA01
cguugaacucggcgc

SEQ ID NO: 1490138 - RNA, 14 nt, Pseudomonas aeruginosa PA01
cguugaccagcgcg

SEQ ID NO: 1490139 - RNA, 17 nt, Pseudomonas aeruginosa PA01
cguugacgaucaggaag

SEQ ID NO: 1490140 - RNA, 17 nt, Pseudomonas aeruginosa PA01
cguugacgaucgccccg

SEQ ID NO: 1490141 - RNA, 14 nt, Pseudomonas aeruginosa PA01
cgugcaccagcagg

SEQ ID NO: 1490142 - RNA, 18 nt, Pseudomonas aeruginosa PA01
cgugcaccagcaggcgac

SEQ ID NO: 1490143 - RNA, 20 nt, Pseudomonas aeruginosa PA01
cgugaugcccagcggcgcca

SEQ ID NO: 1490144 - RNA, 13 nt, Pseudomonas aeruginosa PA01
cgugaucccgcgc

SEQ ID NO: 1490145 - RNA, 21 nt, Pseudomonas aeruginosa PA01
cgugaucccgcgcgggccgag

SEQ ID NO: 1490146 - RNA, 14 nt, Pseudomonas aeruginosa PA01
cgugacgucggcgg

SEQ ID NO: 1490147 - RNA, 14 nt, Pseudomonas aeruginosa PA01
cgugacugcaaucg

SEQ ID NO: 1490148 - RNA, 14 nt, Pseudomonas aeruginosa PA01
cgugaggcgcaggg

SEQ ID NO: 1490149 - RNA, 17 nt, Pseudomonas aeruginosa PA01
cgugagcagggccgagc

SEQ ID NO: 1490150 - RNA, 18 nt, Pseudomonas aeruginosa PA01
cgugagggucgcgccgac

SEQ ID NO: 1490151 - RNA, 19 nt, Pseudomonas aeruginosa PA01
cgugagggucgcgccgacg

SEQ ID NO: 1490152 - RNA, 14 nt, Pseudomonas aeruginosa PA01
cgugcaccgaggcg

SEQ ID NO: 1490153 - RNA, 14 nt, Pseudomonas aeruginosa PA01
cgugcacgccgugc

SEQ ID NO: 1490154 - RNA, 20 nt, Pseudomonas aeruginosa PA01
cgugcacgccgugcaucacc

SEQ ID NO: 1490155 - RNA, 21 nt, Pseudomonas aeruginosa PA01
cgugcagcagcgaccugaccc

SEQ ID NO: 1490156 - RNA, 15 nt, Pseudomonas aeruginosa PA01
cgugcagcagcgccu

SEQ ID NO: 1490157 - RNA, 14 nt, Pseudomonas aeruginosa PA01
cgugcagaccaggg

SEQ ID NO: 1490158 - RNA, 18 nt, Pseudomonas aeruginosa PA01
cgugcagcaagccgcagc

SEQ ID NO: 1490159 - RNA, 15 nt, Pseudomonas aeruginosa PA01
cgugcaggcgcccug

SEQ ID NO: 1490160 - RNA, 19 nt, Pseudomonas aeruginosa PA01
cgugcaggcgcccuggccg

SEQ ID NO: 1490161 - RNA, 15 nt, Pseudomonas aeruginosa PA01
cgugcaucaccggca

SEQ ID NO: 1490162 - RNA, 17 nt, Pseudomonas aeruginosa PA01
cgugcaucaccggcagc

SEQ ID NO: 1490163 - RNA, 20 nt, Pseudomonas aeruginosa PA01
cgugcaucaccggcagcagc

SEQ ID NO: 1490164 - RNA, 22 nt, Pseudomonas aeruginosa PA01
cgugcaucaccggcagcagcgg

SEQ ID NO: 1490165 - RNA, 19 nt, Pseudomonas aeruginosa PA01
cgugcaucaccuugucgca

SEQ ID NO: 1490166 - RNA, 14 nt, Pseudomonas aeruginosa PA01
cgugcaggccgauc

SEQ ID NO: 1490167 - RNA, 15 nt, Pseudomonas aeruginosa PA01
cgugcaggccgccga

SEQ ID NO: 1490168 - RNA, 17 nt, Pseudomonas aeruginosa PA01
cgugcagguagccgcgc

SEQ ID NO: 1490169 - RNA, 18 nt, Pseudomonas aeruginosa PA01
cgugcagguagccgcgcc

SEQ ID NO: 1490170 - RNA, 22 nt, Pseudomonas aeruginosa PA01
cgugcagguagccgcgccggcc

SEQ ID NO: 1490171 - RNA, 19 nt, Pseudomonas aeruginosa PA01
cgugcagguguucggcggc

SEQ ID NO: 1490172 - RNA, 23 nt, Pseudomonas aeruginosa PA01
cgugcagguguucggcggcgugc

SEQ ID NO: 1490173 - RNA, 19 nt, Pseudomonas aeruginosa PA01
cgugcaguacuuggccagc

SEQ ID NO: 1490174 - RNA, 20 nt, Pseudomonas aeruginosa PA01
cgugcaguacuuggccagca

SEQ ID NO: 1490175 - RNA, 21 nt, Pseudomonas aeruginosa PA01
cgugcaguacuuggccagcag

SEQ ID NO: 1490176 - RNA, 23 nt, Pseudomonas aeruginosa PA01
cgugcaguacuuggccagcagca

SEQ ID NO: 1490177 - RNA, 14 nt, Pseudomonas aeruginosa PA01
cgugcagcuuggcg

SEQ ID NO: 1490178 - RNA, 13 nt, Pseudomonas aeruginosa PA01
cgugcagcucggc

SEQ ID NO: 1490179 - RNA, 16 nt, Pseudomonas aeruginosa PA01
cgugcagcucggcacg

SEQ ID NO: 1490180 - RNA, 20 nt, Pseudomonas aeruginosa PA01
cgugcagcucggcacgcagc

SEQ ID NO: 1490181 - RNA, 14 nt, Pseudomonas aeruginosa PA01
cgugcagcggcagc

SEQ ID NO: 1490182 - RNA, 17 nt, Pseudomonas aeruginosa PA01
cgugcagcggcagcguc

SEQ ID NO: 1490183 - RNA, 17 nt, Pseudomonas aeruginosa PA01
cgugccaggagcuugcc

SEQ ID NO: 1490184 - RNA, 13 nt, Pseudomonas aeruginosa PA01
cgugccaggcgcu

SEQ ID NO: 1490185 - RNA, 15 nt, Pseudomonas aeruginosa PA01
cgugccaggcgcucg

SEQ ID NO: 1490186 - RNA, 15 nt, Pseudomonas aeruginosa PA01
cgugcaugccgacga

SEQ ID NO: 1490187 - RNA, 15 nt, Pseudomonas aeruginosa PA01
cgugccccguggcgg

SEQ ID NO: 1490188 - RNA, 18 nt, Pseudomonas aeruginosa PA01
cgugccccguggcgggcc

SEQ ID NO: 1490189 - RNA, 15 nt, Pseudomonas aeruginosa PA01
cgugccccaggccga

SEQ ID NO: 1490190 - RNA, 24 nt, Pseudomonas aeruginosa PA01
cgugccccgacugucgugccucca

SEQ ID NO: 1490191 - RNA, 13 nt, Pseudomonas aeruginosa PA01
cgugccgccaggc

SEQ ID NO: 1490192 - RNA, 14 nt, Pseudomonas aeruginosa PA01
cgugccgccaggcc

SEQ ID NO: 1490193 - RNA, 21 nt, Pseudomonas aeruginosa PA01
cgugccgcaggccgcggccga

SEQ ID NO: 1490194 - RNA, 20 nt, Pseudomonas aeruginosa PA01
cgugcccuuuuccuccaggg

SEQ ID NO: 1490195 - RNA, 14 nt, Pseudomonas aeruginosa PA01
cgucguucagccca

SEQ ID NO: 1490196 - RNA, 15 nt, Pseudomonas aeruginosa PA01
cgucugcagcuugcg

SEQ ID NO: 1490197 - RNA, 16 nt, Pseudomonas aeruginosa PA01
cgucugcagcuugcgc

SEQ ID NO: 1490198 - RNA, 17 nt, Pseudomonas aeruginosa PA01
cgucugcagcuugcgcg

SEQ ID NO: 1490199 - RNA, 13 nt, Pseudomonas aeruginosa PA01
cgucugccgcugg

SEQ ID NO: 1490200 - RNA, 16 nt, Pseudomonas aeruginosa PA01
cgucugccgcuggcgg

SEQ ID NO: 1490201 - RNA, 20 nt, Pseudomonas aeruginosa PA01
cgucugcucauucggccagc

SEQ ID NO: 1490202 - RNA, 22 nt, Pseudomonas aeruginosa PA01
cgucugcucauucggccagcgc

SEQ ID NO: 1490203 - RNA, 23 nt, Pseudomonas aeruginosa PA01
cgucugcucauucggccagcgcg

SEQ ID NO: 1490204 - RNA, 14 nt, Pseudomonas aeruginosa PA01
cgucgucgcggcgc

SEQ ID NO: 1490205 - RNA, 15 nt, Pseudomonas aeruginosa PA01
cgucgucgcggcgcc

SEQ ID NO: 1490206 - RNA, 16 nt, Pseudomonas aeruginosa PA01
cgucgucgcugcgcgg

SEQ ID NO: 1490207 - RNA, 17 nt, Pseudomonas aeruginosa PA01
cgucgucgcugcgcggg

SEQ ID NO: 1490208 - RNA, 14 nt, Pseudomonas aeruginosa PA01
cgucgugcgccggc

SEQ ID NO: 1490209 - RNA, 16 nt, Pseudomonas aeruginosa PA01
cgucgugcgccggccu

SEQ ID NO: 1490210 - RNA, 12 nt, Pseudomonas aeruginosa PA01
cgucguggcgaa

SEQ ID NO: 1490211 - RNA, 19 nt, Pseudomonas aeruginosa PA01
cgucguggauaggcggcgg

SEQ ID NO: 1490212 - RNA, 20 nt, Pseudomonas aeruginosa PA01
cgucguggauaggcggcgga

SEQ ID NO: 1490213 - RNA, 12 nt, Pseudomonas aeruginosa PA01
cgucguggccau

SEQ ID NO: 1490214 - RNA, 16 nt, Pseudomonas aeruginosa PA01
cgucggcaagcaggcc

SEQ ID NO: 1490215 - RNA, 22 nt, Pseudomonas aeruginosa PA01
cgucggcaagcaggccgcggua

SEQ ID NO: 1490216 - RNA, 21 nt, Pseudomonas aeruginosa PA01
cgucggcaguggugauccgca

SEQ ID NO: 1490217 - RNA, 13 nt, Pseudomonas aeruginosa PA01
cgucggcacgccg

SEQ ID NO: 1490218 - RNA, 14 nt, Pseudomonas aeruginosa PA01
cgucggcacgccga

SEQ ID NO: 1490219 - RNA, 18 nt, Pseudomonas aeruginosa PA01
cgucggcacgccgaaguc

SEQ ID NO: 1490220 - RNA, 19 nt, Pseudomonas aeruginosa PA01
cgucggauggccguccagg

SEQ ID NO: 1490221 - RNA, 13 nt, Pseudomonas aeruginosa PA01
cgucggcauggcu

SEQ ID NO: 1490222 - RNA, 18 nt, Pseudomonas aeruginosa PA01
cgucggcauggcuguagg

SEQ ID NO: 1490223 - RNA, 17 nt, Pseudomonas aeruginosa PA01
cgucgucgaagcugucg

SEQ ID NO: 1490224 - RNA, 14 nt, Pseudomonas aeruginosa PA01
cgucgucgaccucg

SEQ ID NO: 1490225 - RNA, 16 nt, Pseudomonas aeruginosa PA01
cgucuugccgcugcgc

SEQ ID NO: 1490226 - RNA, 15 nt, Pseudomonas aeruginosa PA01
cgucuugcaggcuca

SEQ ID NO: 1490227 - RNA, 16 nt, Pseudomonas aeruginosa PA01
cgugaacgcggcgaga

SEQ ID NO: 1490228 - RNA, 21 nt, Pseudomonas aeruginosa PA01
cgucuucgccgaugcgccgac

SEQ ID NO: 1490229 - RNA, 22 nt, Pseudomonas aeruginosa PA01
cgucuucgauggcggccgccau

SEQ ID NO: 1490230 - RNA, 22 nt, Pseudomonas aeruginosa PA01
cgucuucaggcgcuccuggagg

SEQ ID NO: 1490231 - RNA, 14 nt, Pseudomonas aeruginosa PA01
cgucuuccaccaga

SEQ ID NO: 1490232 - RNA, 16 nt, Pseudomonas aeruginosa PA01
cgucuggcgcauccgc

SEQ ID NO: 1490233 - RNA, 14 nt, Pseudomonas aeruginosa PA01
cgucuggcgccugg

SEQ ID NO: 1490234 - RNA, 19 nt, Pseudomonas aeruginosa PA01
cgucuggggugaggccgag

SEQ ID NO: 1490235 - RNA, 17 nt, Pseudomonas aeruginosa PA01
cgucugugccgaggccg

SEQ ID NO: 1490236 - RNA, 13 nt, Pseudomonas aeruginosa PA01
cgucuguucggcc

SEQ ID NO: 1490237 - RNA, 18 nt, Pseudomonas aeruginosa PA01
aacccugggaauggcgga

SEQ ID NO: 1490238 - RNA, 18 nt, Pseudomonas aeruginosa PA01
aaccgaagguacugccgc

SEQ ID NO: 1490239 - RNA, 16 nt, Pseudomonas aeruginosa PA01
aaccgaucagcaccgc

SEQ ID NO: 1490240 - RNA, 22 nt, Pseudomonas aeruginosa PA01
aaccgaucagcaccgccaccag

SEQ ID NO: 1490241 - RNA, 22 nt, Pseudomonas aeruginosa PA01
aaccgaguuucccggcgcggcc

SEQ ID NO: 1490242 - RNA, 22 nt, Pseudomonas aeruginosa PA01
aaccgauauaggcgacgaucag

SEQ ID NO: 1490243 - RNA, 18 nt, Pseudomonas aeruginosa PA01
aaccgauauggcuggcgc

SEQ ID NO: 1490244 - RNA, 19 nt, Pseudomonas aeruginosa PA01
cgugacccgcgcuuccagg

SEQ ID NO: 1490245 - RNA, 21 nt, Pseudomonas aeruginosa PA01
cgugaagcuggagcagcagcg

SEQ ID NO: 1490246 - RNA, 19 nt, Pseudomonas aeruginosa PA01
cgugaagccccuggcgcug

SEQ ID NO: 1490247 - RNA, 20 nt, Pseudomonas aeruginosa PA01
cgugaagccccuggcgcugg

SEQ ID NO: 1490248 - RNA, 15 nt, Pseudomonas aeruginosa PA01
cgugaagccgccgcc

SEQ ID NO: 1490249 - RNA, 21 nt, Pseudomonas aeruginosa PA01
cgugaccauaggcuugcgccg

SEQ ID NO: 1490250 - RNA, 16 nt, Pseudomonas aeruginosa PA01
cugcagccuggcgucg

SEQ ID NO: 1490251 - RNA, 18 nt, Pseudomonas aeruginosa PA01
cugcagcgacuccagcca

SEQ ID NO: 1490252 - RNA, 11 nt, Pseudomonas aeruginosa PA01
cugcagcgccc

SEQ ID NO: 1490253 - RNA, 18 nt, Pseudomonas aeruginosa PA01
cugcagcgccccagcacc

SEQ ID NO: 1490254 - RNA, 14 nt, Pseudomonas aeruginosa PA01
cugcagcaucaggc

SEQ ID NO: 1490255 - RNA, 15 nt, Pseudomonas aeruginosa PA01
cugcagcaucaggcg

SEQ ID NO: 1490256 - RNA, 23 nt, Pseudomonas aeruginosa PA01
cugcagauaaagcuggaccaccg

SEQ ID NO: 1490257 - RNA, 20 nt, Pseudomonas aeruginosa PA01
cugcagacgguucagcagcg

SEQ ID NO: 1490258 - RNA, 17 nt, Pseudomonas aeruginosa PA01
cugcacggcgacccgca

SEQ ID NO: 1490259 - RNA, 21 nt, Pseudomonas aeruginosa PA01
cugcacguugcugugcugcac

SEQ ID NO: 1490260 - RNA, 23 nt, Pseudomonas aeruginosa PA01
cugcacguugcugugcugcacca

SEQ ID NO: 1490261 - RNA, 18 nt, Pseudomonas aeruginosa PA01
cugcacggcaacgucgcg

SEQ ID NO: 1490262 - RNA, 20 nt, Pseudomonas aeruginosa PA01
cugcacggagugggccgcgu

SEQ ID NO: 1490263 - RNA, 18 nt, Pseudomonas aeruginosa PA01
cugcacggauaccacccg

SEQ ID NO: 1490264 - RNA, 23 nt, Pseudomonas aeruginosa PA01
cugcacgcagacgucgagguagu

SEQ ID NO: 1490265 - RNA, 14 nt, Pseudomonas aeruginosa PA01
cugcacgcccaggc

SEQ ID NO: 1490266 - RNA, 23 nt, Pseudomonas aeruginosa PA01
cugcacgcccaucgccaccagca

SEQ ID NO: 1490267 - RNA, 17 nt, Pseudomonas aeruginosa PA01
cugcacgcugcgccggc

SEQ ID NO: 1490268 - RNA, 19 nt, Pseudomonas aeruginosa PA01
cugcacgcugcgccggcgc

SEQ ID NO: 1490269 - RNA, 23 nt, Pseudomonas aeruginosa PA01
cugcacgcuggugaugucgcggc

SEQ ID NO: 1490270 - RNA, 20 nt, Pseudomonas aeruginosa PA01
cugcaauggggcggccggcg

SEQ ID NO: 1490271 - RNA, 22 nt, Pseudomonas aeruginosa PA01
cugcaauggggcggccggcgcg

SEQ ID NO: 1490272 - RNA, 19 nt, Pseudomonas aeruginosa PA01
cugcaauucgucggccugc

SEQ ID NO: 1490273 - RNA, 23 nt, Pseudomonas aeruginosa PA01
cugcaauucgucggccugcucga

SEQ ID NO: 1490274 - RNA, 22 nt, Pseudomonas aeruginosa PA01
cugcaauuccaccggcuggccg

SEQ ID NO: 1490275 - RNA, 23 nt, Pseudomonas aeruginosa PA01
cugcaauuccaccggcuggccgc

SEQ ID NO: 1490276 - RNA, 23 nt, Pseudomonas aeruginosa PA01
cugcaauucgcagagaucggcgg

SEQ ID NO: 1490277 - RNA, 20 nt, Pseudomonas aeruginosa PA01
cugcacagccauagcgccgg

SEQ ID NO: 1490278 - RNA, 21 nt, Pseudomonas aeruginosa PA01
cugcacagccauagcgccggc

SEQ ID NO: 1490279 - RNA, 20 nt, Pseudomonas aeruginosa PA01
cugcacaucaccuucgcccu

SEQ ID NO: 1490280 - RNA, 21 nt, Pseudomonas aeruginosa PA01
cugcaccacguucggcgcggg

SEQ ID NO: 1490281 - RNA, 13 nt, Pseudomonas aeruginosa PA01
cugcaccagcagg

SEQ ID NO: 1490282 - RNA, 19 nt, Pseudomonas aeruginosa PA01
cugcaccagccaguccggc

SEQ ID NO: 1490283 - RNA, 20 nt, Pseudomonas aeruginosa PA01
cugcaccagccaguccggca

SEQ ID NO: 1490284 - RNA, 18 nt, Pseudomonas aeruginosa PA01
cugcaccgucauggugcg

SEQ ID NO: 1490285 - RNA, 20 nt, Pseudomonas aeruginosa PA01
cugcaccgugcgcgcggccu

SEQ ID NO: 1490286 - RNA, 21 nt, Pseudomonas aeruginosa PA01
cugcaccgcgcggauccccuc

SEQ ID NO: 1490287 - RNA, 14 nt, Pseudomonas aeruginosa PA01
cugcaccgggccga

SEQ ID NO: 1490288 - RNA, 19 nt, Pseudomonas aeruginosa PA01
cugcaccaggcucgccccg

SEQ ID NO: 1490289 - RNA, 14 nt, Pseudomonas aeruginosa PA01
cugcaacugcucga

SEQ ID NO: 1490290 - RNA, 14 nt, Pseudomonas aeruginosa PA01
cugcaacuggccga

SEQ ID NO: 1490291 - RNA, 14 nt, Pseudomonas aeruginosa PA01
cugcaacuuccacu

SEQ ID NO: 1490292 - RNA, 20 nt, Pseudomonas aeruginosa PA01
cugcaacuuccacucgccga

SEQ ID NO: 1490293 - RNA, 17 nt, Pseudomonas aeruginosa PA01
cugcaacucggcgccgu

SEQ ID NO: 1490294 - RNA, 19 nt, Pseudomonas aeruginosa PA01
cugcaacucggcgucgcgc

SEQ ID NO: 1490295 - RNA, 22 nt, Pseudomonas aeruginosa PA01
cugcaacucgucguccagcggc

SEQ ID NO: 1490296 - RNA, 19 nt, Pseudomonas aeruginosa PA01
cugcaacugacggcggaag

SEQ ID NO: 1490297 - RNA, 14 nt, Pseudomonas aeruginosa PA01
cugcaaggcgguga

SEQ ID NO: 1490298 - RNA, 17 nt, Pseudomonas aeruginosa PA01
cugcaaggcggugacca

SEQ ID NO: 1490299 - RNA, 20 nt, Pseudomonas aeruginosa PA01
cugcaaggcggugaccagcg

SEQ ID NO: 1490300 - RNA, 23 nt, Pseudomonas aeruginosa PA01
cugcaaggcggugaccagcggca

SEQ ID NO: 1490301 - RNA, 16 nt, Pseudomonas aeruginosa PA01
cugcaaggcuucggcg

SEQ ID NO: 1490302 - RNA, 16 nt, Pseudomonas aeruginosa PA01
cugcaacgcccgcgag

SEQ ID NO: 1490303 - RNA, 14 nt, Pseudomonas aeruginosa PA01
cugcaacgccgcca

SEQ ID NO: 1490304 - RNA, 20 nt, Pseudomonas aeruginosa PA01
cugcaacguccucgcgccgc

SEQ ID NO: 1490305 - RNA, 22 nt, Pseudomonas aeruginosa PA01
cugcaacgccuggugcaggucg

SEQ ID NO: 1490306 - RNA, 23 nt, Pseudomonas aeruginosa PA01
cugcaacagggcauuggccauca

SEQ ID NO: 1490307 - RNA, 14 nt, Pseudomonas aeruginosa PA01
cugcaacacgucgg

SEQ ID NO: 1490308 - RNA, 14 nt, Pseudomonas aeruginosa PA01
cugcaacagaaguu

SEQ ID NO: 1490309 - RNA, 20 nt, Pseudomonas aeruginosa PA01
cugcaacagaaguugcuggc

SEQ ID NO: 1490310 - RNA, 21 nt, Pseudomonas aeruginosa PA01
cugcaaacgggcaucgucgaa

SEQ ID NO: 1490311 - RNA, 15 nt, Pseudomonas aeruginosa PA01
cugcaaagcggcgac

SEQ ID NO: 1490312 - RNA, 20 nt, Pseudomonas aeruginosa PA01
cugaucgcgaauccggucgg

SEQ ID NO: 1490313 - RNA, 16 nt, Pseudomonas aeruginosa PA01
cugaucggccgccagu

SEQ ID NO: 1490314 - RNA, 17 nt, Pseudomonas aeruginosa PA01
cugaucggcgcgccggc

SEQ ID NO: 1490315 - RNA, 18 nt, Pseudomonas aeruginosa PA01
cugaugaugccgcggcga

SEQ ID NO: 1490316 - RNA, 20 nt, Pseudomonas aeruginosa PA01
cugaugccgcgguaggucag

SEQ ID NO: 1490317 - RNA, 15 nt, Pseudomonas aeruginosa PA01
cugaugccggcgaac

SEQ ID NO: 1490318 - RNA, 17 nt, Pseudomonas aeruginosa PA01
cugaugccggcgucggc

SEQ ID NO: 1490319 - RNA, 22 nt, Pseudomonas aeruginosa PA01
cugaugaaucgccucccuggcg

SEQ ID NO: 1490320 - RNA, 20 nt, Pseudomonas aeruginosa PA01
cugcaucacguacggcgccu

SEQ ID NO: 1490321 - RNA, 16 nt, Pseudomonas aeruginosa PA01
cugcaucaccaggcug

SEQ ID NO: 1490322 - RNA, 23 nt, Pseudomonas aeruginosa PA01
cugcaucaccaggcugccgccgu

SEQ ID NO: 1490323 - RNA, 13 nt, Pseudomonas aeruginosa PA01
cugcaucggcgcg

SEQ ID NO: 1490324 - RNA, 16 nt, Pseudomonas aeruginosa PA01
cugcaucggcgcgccg

SEQ ID NO: 1490325 - RNA, 19 nt, Pseudomonas aeruginosa PA01
cugcaucucuuccucgcug

SEQ ID NO: 1490326 - RNA, 16 nt, Pseudomonas aeruginosa PA01
cugcauguccgccagu

SEQ ID NO: 1490327 - RNA, 17 nt, Pseudomonas aeruginosa PA01
cugcaugggcucgcgcg

SEQ ID NO: 1490328 - RNA, 19 nt, Pseudomonas aeruginosa PA01
cugcaugggcucgcgcggg

SEQ ID NO: 1490329 - RNA, 21 nt, Pseudomonas aeruginosa PA01
cugcaugggcucgcgcggggc

SEQ ID NO: 1490330 - RNA, 21 nt, Pseudomonas aeruginosa PA01
cugcaugccgggguccgccgg

SEQ ID NO: 1490331 - RNA, 23 nt, Pseudomonas aeruginosa PA01
cugcaugccgggguccgccgguc

SEQ ID NO: 1490332 - RNA, 21 nt, Pseudomonas aeruginosa PA01
cugcaugcuuuugaacaccag

SEQ ID NO: 1490333 - RNA, 17 nt, Pseudomonas aeruginosa PA01
cugcaugccggccgucg

SEQ ID NO: 1490334 - RNA, 19 nt, Pseudomonas aeruginosa PA01
cugcaugccggccgucgcg

SEQ ID NO: 1490335 - RNA, 20 nt, Pseudomonas aeruginosa PA01
cugcaugccggccgucgcgc

SEQ ID NO: 1490336 - RNA, 21 nt, Pseudomonas aeruginosa PA01
cugcaugaaaaagcccggccg

SEQ ID NO: 1490337 - RNA, 16 nt, Pseudomonas aeruginosa PA01
cugcaugaccuccagg

SEQ ID NO: 1490338 - RNA, 21 nt, Pseudomonas aeruginosa PA01
cugcaugagugucgccaucag

SEQ ID NO: 1490339 - RNA, 14 nt, Pseudomonas aeruginosa PA01
cugccaaacgccgu

SEQ ID NO: 1490340 - RNA, 14 nt, Pseudomonas aeruginosa PA01
cugccaaccgcgcu

SEQ ID NO: 1490341 - RNA, 15 nt, Pseudomonas aeruginosa PA01
cugccaaccgcgcuc

SEQ ID NO: 1490342 - RNA, 24 nt, Pseudomonas aeruginosa PA01
cugccaaccgcgcucggcggucag

SEQ ID NO: 1490343 - RNA, 17 nt, Pseudomonas aeruginosa PA01
cugcaugugccaggccu

SEQ ID NO: 1490344 - RNA, 16 nt, Pseudomonas aeruginosa PA01
cugccacccggcgccc

SEQ ID NO: 1490345 - RNA, 18 nt, Pseudomonas aeruginosa PA01
cugccacccggcgcccgg

SEQ ID NO: 1490346 - RNA, 15 nt, Pseudomonas aeruginosa PA01
cugccacucggugca

SEQ ID NO: 1490347 - RNA, 18 nt, Pseudomonas aeruginosa PA01
cugccacucggugcagau

SEQ ID NO: 1490348 - RNA, 13 nt, Pseudomonas aeruginosa PA01
cugcagggcaucg

SEQ ID NO: 1490349 - RNA, 19 nt, Pseudomonas aeruginosa PA01
cugcagggcaucgaccaga

SEQ ID NO: 1490350 - RNA, 20 nt, Pseudomonas aeruginosa PA01
cugcagggcaucgaccagac

SEQ ID NO: 1490351 - RNA, 15 nt, Pseudomonas aeruginosa PA01
cugcagggccucgcu

SEQ ID NO: 1490352 - RNA, 16 nt, Pseudomonas aeruginosa PA01
cugcagggccucgcug

SEQ ID NO: 1490353 - RNA, 17 nt, Pseudomonas aeruginosa PA01
cugcagggccucgcugu

SEQ ID NO: 1490354 - RNA, 15 nt, Pseudomonas aeruginosa PA01
cugcagggcggcgcu

SEQ ID NO: 1490355 - RNA, 17 nt, Pseudomonas aeruginosa PA01
cugcagggcgucgccgg

SEQ ID NO: 1490356 - RNA, 18 nt, Pseudomonas aeruginosa PA01
cugcagggcgucgccggg

SEQ ID NO: 1490357 - RNA, 16 nt, Pseudomonas aeruginosa PA01
cugcagguagcgcugc

SEQ ID NO: 1490358 - RNA, 19 nt, Pseudomonas aeruginosa PA01
cugcagguaggcgguggcg

SEQ ID NO: 1490359 - RNA, 21 nt, Pseudomonas aeruginosa PA01
cugcagguaggcgguggcgau

SEQ ID NO: 1490360 - RNA, 20 nt, Pseudomonas aeruginosa PA01
cugcaggacgaagucgccgg

SEQ ID NO: 1490361 - RNA, 13 nt, Pseudomonas aeruginosa PA01
cugcaggcccugc

SEQ ID NO: 1490362 - RNA, 12 nt, Pseudomonas aeruginosa PA01
cugcaggccgaa

SEQ ID NO: 1490363 - RNA, 20 nt, Pseudomonas aeruginosa PA01
cugcaggccgaauccgccgg

SEQ ID NO: 1490364 - RNA, 21 nt, Pseudomonas aeruginosa PA01
cugcaggccgaauccgccggc

SEQ ID NO: 1490365 - RNA, 20 nt, Pseudomonas aeruginosa PA01
cugcaggcgguagcgccgcg

SEQ ID NO: 1490366 - RNA, 16 nt, Pseudomonas aeruginosa PA01
cugcagcucggccugg

SEQ ID NO: 1490367 - RNA, 19 nt, Pseudomonas aeruginosa PA01
cugcagcucggccuggucc

SEQ ID NO: 1490368 - RNA, 23 nt, Pseudomonas aeruginosa PA01
cugcagcucggccugguccggca

SEQ ID NO: 1490369 - RNA, 23 nt, Pseudomonas aeruginosa PA01
cugcagcuugcgcgccagggcgg

SEQ ID NO: 1490370 - RNA, 16 nt, Pseudomonas aeruginosa PA01
cugccauccgcgccga

SEQ ID NO: 1490371 - RNA, 22 nt, Pseudomonas aeruginosa PA01
cugccauccgcgccgaccagcc

SEQ ID NO: 1490372 - RNA, 19 nt, Pseudomonas aeruginosa PA01
cugcccaagggccugggcg

SEQ ID NO: 1490373 - RNA, 16 nt, Pseudomonas aeruginosa PA01
cugccauggcggcgga

SEQ ID NO: 1490374 - RNA, 21 nt, Pseudomonas aeruginosa PA01
cugccaggggcuagucgcgca

SEQ ID NO: 1490375 - RNA, 23 nt, Pseudomonas aeruginosa PA01
cugccaggggcuagucgcgcagc

SEQ ID NO: 1490376 - RNA, 15 nt, Pseudomonas aeruginosa PA01
cugccaggagcacgc

SEQ ID NO: 1490377 - RNA, 16 nt, Pseudomonas aeruginosa PA01
cugccaggagcacgcc

SEQ ID NO: 1490378 - RNA, 20 nt, Pseudomonas aeruginosa PA01
cugccaggagcacgccgugc

SEQ ID NO: 1490379 - RNA, 21 nt, Pseudomonas aeruginosa PA01
cugccaggagcacgccgugca

SEQ ID NO: 1490380 - RNA, 17 nt, Pseudomonas aeruginosa PA01
cugccagcgcgucggca

SEQ ID NO: 1490381 - RNA, 18 nt, Pseudomonas aeruginosa PA01
cugccagcgcgucggcac

SEQ ID NO: 1490382 - RNA, 21 nt, Pseudomonas aeruginosa PA01
cugccagcgcgucggcacgcc

SEQ ID NO: 1490383 - RNA, 15 nt, Pseudomonas aeruginosa PA01
cugccagcgccgccg

SEQ ID NO: 1490384 - RNA, 13 nt, Pseudomonas aeruginosa PA01
cugccagcgggcg

SEQ ID NO: 1490385 - RNA, 17 nt, Pseudomonas aeruginosa PA01
cugccagcgggcgccgc

SEQ ID NO: 1490386 - RNA, 19 nt, Pseudomonas aeruginosa PA01
cugccagcgggcgccgccg

SEQ ID NO: 1490387 - RNA, 17 nt, Pseudomonas aeruginosa PA01
cugccagcgccgccgcg

SEQ ID NO: 1490388 - RNA, 18 nt, Pseudomonas aeruginosa PA01
cugccagcgccgccgcgu

SEQ ID NO: 1490389 - RNA, 12 nt, Pseudomonas aeruginosa PA01
cugccagcgccg

SEQ ID NO: 1490390 - RNA, 13 nt, Pseudomonas aeruginosa PA01
cugccagcgccgc

SEQ ID NO: 1490391 - RNA, 13 nt, Pseudomonas aeruginosa PA01
cugccagagcgcu

SEQ ID NO: 1490392 - RNA, 16 nt, Pseudomonas aeruginosa PA01
cugccagagcgcugcc

SEQ ID NO: 1490393 - RNA, 12 nt, Pseudomonas aeruginosa PA01
cugccagcaggc

SEQ ID NO: 1490394 - RNA, 15 nt, Pseudomonas aeruginosa PA01
cugccagcaggccga

SEQ ID NO: 1490395 - RNA, 16 nt, Pseudomonas aeruginosa PA01
cugccagcaggccgag

SEQ ID NO: 1490396 - RNA, 17 nt, Pseudomonas aeruginosa PA01
cugccagcaggccgagc

SEQ ID NO: 1490397 - RNA, 21 nt, Pseudomonas aeruginosa PA01
cugccagcaggccgagcccga

SEQ ID NO: 1490398 - RNA, 18 nt, Pseudomonas aeruginosa PA01
cugccagaaaacccagcg

SEQ ID NO: 1490399 - RNA, 22 nt, Pseudomonas aeruginosa PA01
cugccagaaggccugcgcuucc

SEQ ID NO: 1490400 - RNA, 15 nt, Pseudomonas aeruginosa PA01
cugccagaccguggc

SEQ ID NO: 1490401 - RNA, 21 nt, Pseudomonas aeruginosa PA01
cugcccaguugcgcggcgagu

SEQ ID NO: 1490402 - RNA, 17 nt, Pseudomonas aeruginosa PA01
cugccccagcaucgccg

SEQ ID NO: 1490403 - RNA, 20 nt, Pseudomonas aeruginosa PA01
cugccccagcaucgccggca

SEQ ID NO: 1490404 - RNA, 16 nt, Pseudomonas aeruginosa PA01
cugccccacaggcccu

SEQ ID NO: 1490405 - RNA, 20 nt, Pseudomonas aeruginosa PA01
cugccccacuuccggcccgg

SEQ ID NO: 1490406 - RNA, 22 nt, Pseudomonas aeruginosa PA01
cugccccacuuccggcccggcc

SEQ ID NO: 1490407 - RNA, 23 nt, Pseudomonas aeruginosa PA01
cugccccacuuccggcccggcca

SEQ ID NO: 1490408 - RNA, 15 nt, Pseudomonas aeruginosa PA01
cugcccaccaccagg

SEQ ID NO: 1490409 - RNA, 12 nt, Pseudomonas aeruginosa PA01
cugcccagcccg

SEQ ID NO: 1490410 - RNA, 15 nt, Pseudomonas aeruginosa PA01
cugcccagcccgccu

SEQ ID NO: 1490411 - RNA, 14 nt, Pseudomonas aeruginosa PA01
cugcccagcgccgc

SEQ ID NO: 1490412 - RNA, 15 nt, Pseudomonas aeruginosa PA01
cugcccagcgccgcc

SEQ ID NO: 1490413 - RNA, 17 nt, Pseudomonas aeruginosa PA01
cugcccagcgccgccag

SEQ ID NO: 1490414 - RNA, 19 nt, Pseudomonas aeruginosa PA01
cugcccagcgccgccagca

SEQ ID NO: 1490415 - RNA, 17 nt, Pseudomonas aeruginosa PA01
cugcccagggcccagag

SEQ ID NO: 1490416 - RNA, 19 nt, Pseudomonas aeruginosa PA01
cugcccagguagccggcga

SEQ ID NO: 1490417 - RNA, 19 nt, Pseudomonas aeruginosa PA01
cugcccagugggccaccgg

SEQ ID NO: 1490418 - RNA, 17 nt, Pseudomonas aeruginosa PA01
cugccccgggcgccggg

SEQ ID NO: 1490419 - RNA, 18 nt, Pseudomonas aeruginosa PA01
cugccccgggcgccgggu

SEQ ID NO: 1490420 - RNA, 19 nt, Pseudomonas aeruginosa PA01
cugccccgugcaccgaggc

SEQ ID NO: 1490421 - RNA, 13 nt, Pseudomonas aeruginosa PA01
cugcccgacgaag

SEQ ID NO: 1490422 - RNA, 17 nt, Pseudomonas aeruginosa PA01
cugccccuggcucaggc

SEQ ID NO: 1490423 - RNA, 12 nt, Pseudomonas aeruginosa PA01
cugcccgcgucc

SEQ ID NO: 1490424 - RNA, 15 nt, Pseudomonas aeruginosa PA01
cugcccgcucggggc

SEQ ID NO: 1490425 - RNA, 24 nt, Pseudomonas aeruginosa PA01
cugcccgcucggggcaucggccau

SEQ ID NO: 1490426 - RNA, 15 nt, Pseudomonas aeruginosa PA01
cugcccggagcggcu

SEQ ID NO: 1490427 - RNA, 22 nt, Pseudomonas aeruginosa PA01
cugcccgccggcgcccugggcg

SEQ ID NO: 1490428 - RNA, 16 nt, Pseudomonas aeruginosa PA01
cugcccggcgcgacgc

SEQ ID NO: 1490429 - RNA, 14 nt, Pseudomonas aeruginosa PA01
cugcccggccaugc

SEQ ID NO: 1490430 - RNA, 19 nt, Pseudomonas aeruginosa PA01
cugcccggccaugccgccg

SEQ ID NO: 1490431 - RNA, 22 nt, Pseudomonas aeruginosa PA01
cugcccggcauaggcgccagcc

SEQ ID NO: 1490432 - RNA, 13 nt, Pseudomonas aeruginosa PA01
cugaacagcuggc

SEQ ID NO: 1490433 - RNA, 19 nt, Pseudomonas aeruginosa PA01
cugaacagcgccaccagca

SEQ ID NO: 1490434 - RNA, 23 nt, Pseudomonas aeruginosa PA01
cugaaaaaaggggaugccauggc

SEQ ID NO: 1490435 - RNA, 19 nt, Pseudomonas aeruginosa PA01
cucuuccagggucggcacc

SEQ ID NO: 1490436 - RNA, 19 nt, Pseudomonas aeruginosa PA01
cucuuucguuucagcgcca

SEQ ID NO: 1490437 - RNA, 17 nt, Pseudomonas aeruginosa PA01
cucuguagggucgcagc

SEQ ID NO: 1490438 - RNA, 22 nt, Pseudomonas aeruginosa PA01
cucuguagggucgcagcaggcc

SEQ ID NO: 1490439 - RNA, 15 nt, Pseudomonas aeruginosa PA01
cucugguagccgcag

SEQ ID NO: 1490440 - RNA, 22 nt, Pseudomonas aeruginosa PA01
cucuggucaugacgggcgguau

SEQ ID NO: 1490441 - RNA, 16 nt, Pseudomonas aeruginosa PA01
cucuggcugcuggcga

SEQ ID NO: 1490442 - RNA, 15 nt, Pseudomonas aeruginosa PA01
cucuggucgaacacu

SEQ ID NO: 1490443 - RNA, 16 nt, Pseudomonas aeruginosa PA01
cucuggcgcauagcgg

SEQ ID NO: 1490444 - RNA, 22 nt, Pseudomonas aeruginosa PA01
cucugggccaugaccucggcca

SEQ ID NO: 1490445 - RNA, 22 nt, Pseudomonas aeruginosa PA01
cucuucacauggugggcgccgc

SEQ ID NO: 1490446 - RNA, 18 nt, Pseudomonas aeruginosa PA01
cucuucagcacgcguccg

SEQ ID NO: 1490447 - RNA, 14 nt, Pseudomonas aeruginosa PA01
cucggcgucgucga

SEQ ID NO: 1490448 - RNA, 16 nt, Pseudomonas aeruginosa PA01
cucggcgucgucgauc

SEQ ID NO: 1490449 - RNA, 16 nt, Pseudomonas aeruginosa PA01
cucggcguccagcagg

SEQ ID NO: 1490450 - RNA, 17 nt, Pseudomonas aeruginosa PA01
cucggcguccagcaggu

SEQ ID NO: 1490451 - RNA, 16 nt, Pseudomonas aeruginosa PA01
cucggcguagccggcc

SEQ ID NO: 1490452 - RNA, 17 nt, Pseudomonas aeruginosa PA01
cucggcguagccggcca

SEQ ID NO: 1490453 - RNA, 17 nt, Pseudomonas aeruginosa PA01
cucggcguagccggcga

SEQ ID NO: 1490454 - RNA, 19 nt, Pseudomonas aeruginosa PA01
cucggcguagccggcgauc

SEQ ID NO: 1490455 - RNA, 16 nt, Pseudomonas aeruginosa PA01
cucggcguagcgcugg

SEQ ID NO: 1490456 - RNA, 18 nt, Pseudomonas aeruginosa PA01
cucuaccgagaucaccuu

SEQ ID NO: 1490457 - RNA, 14 nt, Pseudomonas aeruginosa PA01
cucggcgucgcgcu

SEQ ID NO: 1490458 - RNA, 16 nt, Pseudomonas aeruginosa PA01
cucuacuaccgccagc

SEQ ID NO: 1490459 - RNA, 13 nt, Pseudomonas aeruginosa PA01
cucugcaucucgg

SEQ ID NO: 1490460 - RNA, 11 nt, Pseudomonas aeruginosa PA01
cucugccggug

SEQ ID NO: 1490461 - RNA, 19 nt, Pseudomonas aeruginosa PA01
cucugccgauccuugucga

SEQ ID NO: 1490462 - RNA, 22 nt, Pseudomonas aeruginosa PA01
cucugcuucugucccugggcca

SEQ ID NO: 1490463 - RNA, 15 nt, Pseudomonas aeruginosa PA01
cucugcucggccagc

SEQ ID NO: 1490464 - RNA, 13 nt, Pseudomonas aeruginosa PA01
cucugcuggcugu

SEQ ID NO: 1490465 - RNA, 21 nt, Pseudomonas aeruginosa PA01
cugaacuguucgaucucgcgu

SEQ ID NO: 1490466 - RNA, 21 nt, Pseudomonas aeruginosa PA01
cugaagacccggcguucgccg

SEQ ID NO: 1490467 - RNA, 13 nt, Pseudomonas aeruginosa PA01
cugaacgcgcccg

SEQ ID NO: 1490468 - RNA, 19 nt, Pseudomonas aeruginosa PA01
cugaacgcgcccggccagg

SEQ ID NO: 1490469 - RNA, 13 nt, Pseudomonas aeruginosa PA01
cugaagcggccgc

SEQ ID NO: 1490470 - RNA, 14 nt, Pseudomonas aeruginosa PA01
cugaagcggccgcc

SEQ ID NO: 1490471 - RNA, 19 nt, Pseudomonas aeruginosa PA01
cugaagcggccgccgaaau

SEQ ID NO: 1490472 - RNA, 12 nt, Pseudomonas aeruginosa PA01
cugaaggccgaa

SEQ ID NO: 1490473 - RNA, 17 nt, Pseudomonas aeruginosa PA01
cugaaggucgccgcgcu

SEQ ID NO: 1490474 - RNA, 19 nt, Pseudomonas aeruginosa PA01
cugaaggucgccgcgcuga

SEQ ID NO: 1490475 - RNA, 16 nt, Pseudomonas aeruginosa PA01
cugaaguccuggccga

SEQ ID NO: 1490476 - RNA, 19 nt, Pseudomonas aeruginosa PA01
cugaaguccuggccgagca

SEQ ID NO: 1490477 - RNA, 23 nt, Pseudomonas aeruginosa PA01
cugacauccuuggucagggugcc

SEQ ID NO: 1490478 - RNA, 20 nt, Pseudomonas aeruginosa PA01
cugacauccaccagggucgg

SEQ ID NO: 1490479 - RNA, 15 nt, Pseudomonas aeruginosa PA01
cugaccaccaggaag

SEQ ID NO: 1490480 - RNA, 17 nt, Pseudomonas aeruginosa PA01
cugaccaccagggcgau

SEQ ID NO: 1490481 - RNA, 19 nt, Pseudomonas aeruginosa PA01
cugaccaccagggcgaugg

SEQ ID NO: 1490482 - RNA, 13 nt, Pseudomonas aeruginosa PA01
cugaccaggucgu

SEQ ID NO: 1490483 - RNA, 18 nt, Pseudomonas aeruginosa PA01
cugacccaggcuucggcg

SEQ ID NO: 1490484 - RNA, 20 nt, Pseudomonas aeruginosa PA01
cugacccaggcuucggcgcg

SEQ ID NO: 1490485 - RNA, 15 nt, Pseudomonas aeruginosa PA01
cugaccccggccugg

SEQ ID NO: 1490486 - RNA, 17 nt, Pseudomonas aeruginosa PA01
cugaccccggccuggcu

SEQ ID NO: 1490487 - RNA, 21 nt, Pseudomonas aeruginosa PA01
cugaauaccacguggccggcg

SEQ ID NO: 1490488 - RNA, 20 nt, Pseudomonas aeruginosa PA01
cugacgucgacgcagcgcgc

SEQ ID NO: 1490489 - RNA, 18 nt, Pseudomonas aeruginosa PA01
cugacggcggaaggcggc

SEQ ID NO: 1490490 - RNA, 12 nt, Pseudomonas aeruginosa PA01
cugacggcgugg

SEQ ID NO: 1490491 - RNA, 17 nt, Pseudomonas aeruginosa PA01
cugacggcaaggaccug

SEQ ID NO: 1490492 - RNA, 18 nt, Pseudomonas aeruginosa PA01
cugacggcaaggaccugc

SEQ ID NO: 1490493 - RNA, 19 nt, Pseudomonas aeruginosa PA01
cugagacgcgaauccagca

SEQ ID NO: 1490494 - RNA, 17 nt, Pseudomonas aeruginosa PA01
cugacuuccaucagcuc

SEQ ID NO: 1490495 - RNA, 16 nt, Pseudomonas aeruginosa PA01
cugacccgcaccggca

SEQ ID NO: 1490496 - RNA, 19 nt, Pseudomonas aeruginosa PA01
cugacccgcuguccgccgg

SEQ ID NO: 1490497 - RNA, 15 nt, Pseudomonas aeruginosa PA01
cugaccgcgugggcc

SEQ ID NO: 1490498 - RNA, 22 nt, Pseudomonas aeruginosa PA01
cugaccgcgaauggcagcaggc

SEQ ID NO: 1490499 - RNA, 17 nt, Pseudomonas aeruginosa PA01
cugaccgcgagcgccgc

SEQ ID NO: 1490500 - RNA, 18 nt, Pseudomonas aeruginosa PA01
cugaccgcgagcgccgcc

SEQ ID NO: 1490501 - RNA, 20 nt, Pseudomonas aeruginosa PA01
cugaccguucguccuuuccu

SEQ ID NO: 1490502 - RNA, 19 nt, Pseudomonas aeruginosa PA01
cugaccguccuggcccugc

SEQ ID NO: 1490503 - RNA, 17 nt, Pseudomonas aeruginosa PA01
cugaccggcaucgacca

SEQ ID NO: 1490504 - RNA, 22 nt, Pseudomonas aeruginosa PA01
cugaccggcaucgaccagcagc

SEQ ID NO: 1490505 - RNA, 23 nt, Pseudomonas aeruginosa PA01
cugaccggcaucgaccagcagcg

SEQ ID NO: 1490506 - RNA, 14 nt, Pseudomonas aeruginosa PA01
cugaccgggcggau

SEQ ID NO: 1490507 - RNA, 13 nt, Pseudomonas aeruginosa PA01
cugaccggccgca

SEQ ID NO: 1490508 - RNA, 18 nt, Pseudomonas aeruginosa PA01
cugaccggccgcagcagg

SEQ ID NO: 1490509 - RNA, 23 nt, Pseudomonas aeruginosa PA01
cugacgcaagcgcucggccugcg

SEQ ID NO: 1490510 - RNA, 18 nt, Pseudomonas aeruginosa PA01
cugacgaaggcuggagcg

SEQ ID NO: 1490511 - RNA, 18 nt, Pseudomonas aeruginosa PA01
cugacgaggacgccgccg

SEQ ID NO: 1490512 - RNA, 19 nt, Pseudomonas aeruginosa PA01
cugacgaggacgccgccgg

SEQ ID NO: 1490513 - RNA, 20 nt, Pseudomonas aeruginosa PA01
cugacgaacaucgccagcgc

SEQ ID NO: 1490514 - RNA, 20 nt, Pseudomonas aeruginosa PA01
cugaccuucacuucgcgcgg

SEQ ID NO: 1490515 - RNA, 15 nt, Pseudomonas aeruginosa PA01
cugaccucggugagg

SEQ ID NO: 1490516 - RNA, 16 nt, Pseudomonas aeruginosa PA01
cugaccucgauggcgu

SEQ ID NO: 1490517 - RNA, 24 nt, Pseudomonas aeruginosa PA01
cugaccucgauggcguguucgucg

SEQ ID NO: 1490518 - RNA, 19 nt, Pseudomonas aeruginosa PA01
cugauaccgcuggccaggu

SEQ ID NO: 1490519 - RNA, 19 nt, Pseudomonas aeruginosa PA01
cugagggucagccgcaggc

SEQ ID NO: 1490520 - RNA, 17 nt, Pseudomonas aeruginosa PA01
cugagguucaugccgcg

SEQ ID NO: 1490521 - RNA, 19 nt, Pseudomonas aeruginosa PA01
cugauccgcguuaccgucc

SEQ ID NO: 1490522 - RNA, 14 nt, Pseudomonas aeruginosa PA01
cugaucagccgggc

SEQ ID NO: 1490523 - RNA, 13 nt, Pseudomonas aeruginosa PA01
cugaucaggccga

SEQ ID NO: 1490524 - RNA, 19 nt, Pseudomonas aeruginosa PA01
cugaucaggccgaggaugc

SEQ ID NO: 1490525 - RNA, 21 nt, Pseudomonas aeruginosa PA01
cugaucagguugccggcgugc

SEQ ID NO: 1490526 - RNA, 22 nt, Pseudomonas aeruginosa PA01
cugaucaguaccggcagcgccg

SEQ ID NO: 1490527 - RNA, 23 nt, Pseudomonas aeruginosa PA01
cugaucaguaccggcagcgccga

SEQ ID NO: 1490528 - RNA, 18 nt, Pseudomonas aeruginosa PA01
cugaucacccgcccgccg

SEQ ID NO: 1490529 - RNA, 11 nt, Pseudomonas aeruginosa PA01
cugagccggcc

SEQ ID NO: 1490530 - RNA, 22 nt, Pseudomonas aeruginosa PA01
cugagcagucgccuggcccugg

SEQ ID NO: 1490531 - RNA, 21 nt, Pseudomonas aeruginosa PA01
cugagcaguugcgggcgcagg

SEQ ID NO: 1490532 - RNA, 20 nt, Pseudomonas aeruginosa PA01
cugaggaagagcagcgcggc

SEQ ID NO: 1490533 - RNA, 19 nt, Pseudomonas aeruginosa PA01
cugaggcucagcgcgccga

SEQ ID NO: 1490534 - RNA, 16 nt, Pseudomonas aeruginosa PA01
cugaggcucgccgggu

SEQ ID NO: 1490535 - RNA, 13 nt, Pseudomonas aeruginosa PA01
cugaggcuggcga

SEQ ID NO: 1490536 - RNA, 19 nt, Pseudomonas aeruginosa PA01
cugagggacacggcgaccu

SEQ ID NO: 1490537 - RNA, 13 nt, Pseudomonas aeruginosa PA01
cugaggccgacga

SEQ ID NO: 1490538 - RNA, 22 nt, Pseudomonas aeruginosa PA01
cugaggaucacgauggccggca

SEQ ID NO: 1490539 - RNA, 13 nt, Pseudomonas aeruginosa PA01
cugaggaucagcc

SEQ ID NO: 1490540 - RNA, 17 nt, Pseudomonas aeruginosa PA01
cugagcgccucgaucgc

SEQ ID NO: 1490541 - RNA, 13 nt, Pseudomonas aeruginosa PA01
cucaccaggcccg

SEQ ID NO: 1490542 - RNA, 17 nt, Pseudomonas aeruginosa PA01
cucaccaggcccgccgg

SEQ ID NO: 1490543 - RNA, 16 nt, Pseudomonas aeruginosa PA01
cucaccaccaccgcgc

SEQ ID NO: 1490544 - RNA, 19 nt, Pseudomonas aeruginosa PA01
cucaccaccaccgcgccga

SEQ ID NO: 1490545 - RNA, 22 nt, Pseudomonas aeruginosa PA01
cucaccaccaccgcgccgaugu

SEQ ID NO: 1490546 - RNA, 17 nt, Pseudomonas aeruginosa PA01
cucaccgaggaucggca

SEQ ID NO: 1490547 - RNA, 20 nt, Pseudomonas aeruginosa PA01
cucaccgaggaucggcacga

SEQ ID NO: 1490548 - RNA, 21 nt, Pseudomonas aeruginosa PA01
cucaccgaggcgaacggcagg

SEQ ID NO: 1490549 - RNA, 14 nt, Pseudomonas aeruginosa PA01
cucacccugcuggg

SEQ ID NO: 1490550 - RNA, 19 nt, Pseudomonas aeruginosa PA01
cucacgccccagcgcaucg

SEQ ID NO: 1490551 - RNA, 15 nt, Pseudomonas aeruginosa PA01
cucacguagcccccg

SEQ ID NO: 1490552 - RNA, 23 nt, Pseudomonas aeruginosa PA01
cucacggguguuucggccgcugc

SEQ ID NO: 1490553 - RNA, 17 nt, Pseudomonas aeruginosa PA01
cucacggccgaacagac

SEQ ID NO: 1490554 - RNA, 16 nt, Pseudomonas aeruginosa PA01
cucacggcgcagccgc

SEQ ID NO: 1490555 - RNA, 17 nt, Pseudomonas aeruginosa PA01
cucacggcgcagccgca

SEQ ID NO: 1490556 - RNA, 20 nt, Pseudomonas aeruginosa PA01
cucacggcgcagccgcaagg

SEQ ID NO: 1490557 - RNA, 15 nt, Pseudomonas aeruginosa PA01
cucacgcucgacauu

SEQ ID NO: 1490558 - RNA, 16 nt, Pseudomonas aeruginosa PA01
cucacugcgagcacca

SEQ ID NO: 1490559 - RNA, 16 nt, Pseudomonas aeruginosa PA01
cucacucccguccagc

SEQ ID NO: 1490560 - RNA, 15 nt, Pseudomonas aeruginosa PA01
cucagaccacgcccu

SEQ ID NO: 1490561 - RNA, 17 nt, Pseudomonas aeruginosa PA01
cucagaccacgcccugc

SEQ ID NO: 1490562 - RNA, 23 nt, Pseudomonas aeruginosa PA01
cucagaccacgcccugcgccagc

SEQ ID NO: 1490563 - RNA, 22 nt, Pseudomonas aeruginosa PA01
cucagaaauccaccuugccgcg

SEQ ID NO: 1490564 - RNA, 13 nt, Pseudomonas aeruginosa PA01
cucagccagcggc

SEQ ID NO: 1490565 - RNA, 16 nt, Pseudomonas aeruginosa PA01
cucagcccaggcgccg

SEQ ID NO: 1490566 - RNA, 17 nt, Pseudomonas aeruginosa PA01
cucagcccaggcgccgc

SEQ ID NO: 1490567 - RNA, 18 nt, Pseudomonas aeruginosa PA01
cucagcccaggcgccgcu

SEQ ID NO: 1490568 - RNA, 13 nt, Pseudomonas aeruginosa PA01
cucagccccgauc

SEQ ID NO: 1490569 - RNA, 12 nt, Pseudomonas aeruginosa PA01
cucagcucggcg

SEQ ID NO: 1490570 - RNA, 22 nt, Pseudomonas aeruginosa PA01
cucagcucggcgaugccgccgg

SEQ ID NO: 1490571 - RNA, 13 nt, Pseudomonas aeruginosa PA01
cucagccgaccac

SEQ ID NO: 1490572 - RNA, 20 nt, Pseudomonas aeruginosa PA01
cucagccgaggucgccgcca

SEQ ID NO: 1490573 - RNA, 22 nt, Pseudomonas aeruginosa PA01
cucagaagaacggacgcgacgc

SEQ ID NO: 1490574 - RNA, 15 nt, Pseudomonas aeruginosa PA01
cucagcagcgccgcc

SEQ ID NO: 1490575 - RNA, 16 nt, Pseudomonas aeruginosa PA01
cucagcagcgccgccc

SEQ ID NO: 1490576 - RNA, 12 nt, Pseudomonas aeruginosa PA01
cucagcaggucg

SEQ ID NO: 1490577 - RNA, 13 nt, Pseudomonas aeruginosa PA01
cucagcaggucgc

SEQ ID NO: 1490578 - RNA, 19 nt, Pseudomonas aeruginosa PA01
cuccaaagccuggagcagg

SEQ ID NO: 1490579 - RNA, 21 nt, Pseudomonas aeruginosa PA01
cuccaaagccuggagcagggc

SEQ ID NO: 1490580 - RNA, 19 nt, Pseudomonas aeruginosa PA01
cucauugcgccgccggcuc

SEQ ID NO: 1490581 - RNA, 19 nt, Pseudomonas aeruginosa PA01
cucauucaucucgccgucg

SEQ ID NO: 1490582 - RNA, 23 nt, Pseudomonas aeruginosa PA01
cucaggcgucccgcuccagccgg

SEQ ID NO: 1490583 - RNA, 16 nt, Pseudomonas aeruginosa PA01
cucauguucaguucgg

SEQ ID NO: 1490584 - RNA, 22 nt, Pseudomonas aeruginosa PA01
cucaggaccuuccgccagcagg

SEQ ID NO: 1490585 - RNA, 19 nt, Pseudomonas aeruginosa PA01
cucaggaaaaaacgccggu

SEQ ID NO: 1490586 - RNA, 20 nt, Pseudomonas aeruginosa PA01
cucaggacguccuggccgag

SEQ ID NO: 1490587 - RNA, 14 nt, Pseudomonas aeruginosa PA01
cucaggagcgccgc

SEQ ID NO: 1490588 - RNA, 21 nt, Pseudomonas aeruginosa PA01
cucaggagcgccgcgcagcgc

SEQ ID NO: 1490589 - RNA, 12 nt, Pseudomonas aeruginosa PA01
cucaggcgccag

SEQ ID NO: 1490590 - RNA, 16 nt, Pseudomonas aeruginosa PA01
cuccaaugcaccugcg

SEQ ID NO: 1490591 - RNA, 21 nt, Pseudomonas aeruginosa PA01
cuccaccguuccgacccggcc

SEQ ID NO: 1490592 - RNA, 23 nt, Pseudomonas aeruginosa PA01
cuccaccguuccgacccggccga

SEQ ID NO: 1490593 - RNA, 16 nt, Pseudomonas aeruginosa PA01
cuccacugcuuggcca

SEQ ID NO: 1490594 - RNA, 22 nt, Pseudomonas aeruginosa PA01
cuccacugcuuggccaggcgcu

SEQ ID NO: 1490595 - RNA, 20 nt, Pseudomonas aeruginosa PA01
cuccacgucguccggcgcca

SEQ ID NO: 1490596 - RNA, 15 nt, Pseudomonas aeruginosa PA01
cuccaggggucggca

SEQ ID NO: 1490597 - RNA, 20 nt, Pseudomonas aeruginosa PA01
cuccaggggucggcaucgcg

SEQ ID NO: 1490598 - RNA, 15 nt, Pseudomonas aeruginosa PA01
cuccagggucgcccg

SEQ ID NO: 1490599 - RNA, 17 nt, Pseudomonas aeruginosa PA01
cuccagguacagccgca

SEQ ID NO: 1490600 - RNA, 19 nt, Pseudomonas aeruginosa PA01
cuccagguacagccgcaga

SEQ ID NO: 1490601 - RNA, 20 nt, Pseudomonas aeruginosa PA01
cuccagguucggcgccagcu

SEQ ID NO: 1490602 - RNA, 15 nt, Pseudomonas aeruginosa PA01
cuccaggugcacggc

SEQ ID NO: 1490603 - RNA, 19 nt, Pseudomonas aeruginosa PA01
cuccaggugcacggccagg

SEQ ID NO: 1490604 - RNA, 16 nt, Pseudomonas aeruginosa PA01
cuccaggcgaaggucg

SEQ ID NO: 1490605 - RNA, 21 nt, Pseudomonas aeruginosa PA01
cuccaggcgaaggucgaaggc

SEQ ID NO: 1490606 - RNA, 20 nt, Pseudomonas aeruginosa PA01
cuccaggcgcgccuggauca

SEQ ID NO: 1490607 - RNA, 13 nt, Pseudomonas aeruginosa PA01
cuccaggcggcgg

SEQ ID NO: 1490608 - RNA, 20 nt, Pseudomonas aeruginosa PA01
cuccaggcucuucagcacgc

SEQ ID NO: 1490609 - RNA, 14 nt, Pseudomonas aeruginosa PA01
cuccaggcuggccu

SEQ ID NO: 1490610 - RNA, 22 nt, Pseudomonas aeruginosa PA01
cuccaggcuuugcggcaaggcg

SEQ ID NO: 1490611 - RNA, 23 nt, Pseudomonas aeruginosa PA01
cuccagggaaaccaccuggaacu

SEQ ID NO: 1490612 - RNA, 16 nt, Pseudomonas aeruginosa PA01
cuccagggagcgcucg

SEQ ID NO: 1490613 - RNA, 19 nt, Pseudomonas aeruginosa PA01
cuccagggagcgcucgcgc

SEQ ID NO: 1490614 - RNA, 12 nt, Pseudomonas aeruginosa PA01
cuccagggccag

SEQ ID NO: 1490615 - RNA, 16 nt, Pseudomonas aeruginosa PA01
cuccagggcggcccgg

SEQ ID NO: 1490616 - RNA, 14 nt, Pseudomonas aeruginosa PA01
cuccagggcugcca

SEQ ID NO: 1490617 - RNA, 17 nt, Pseudomonas aeruginosa PA01
cuccaggucggucggcg

SEQ ID NO: 1490618 - RNA, 18 nt, Pseudomonas aeruginosa PA01
cuccaggucggucggcgg

SEQ ID NO: 1490619 - RNA, 21 nt, Pseudomonas aeruginosa PA01
cuccaguucguugaccacgcu

SEQ ID NO: 1490620 - RNA, 22 nt, Pseudomonas aeruginosa PA01
cuccauccagucuucgccggcc

SEQ ID NO: 1490621 - RNA, 12 nt, Pseudomonas aeruginosa PA01
cuccaucagcgc

SEQ ID NO: 1490622 - RNA, 22 nt, Pseudomonas aeruginosa PA01
cuccagucggggcaggcgcagg

SEQ ID NO: 1490623 - RNA, 13 nt, Pseudomonas aeruginosa PA01
cuccagcucggcg

SEQ ID NO: 1490624 - RNA, 14 nt, Pseudomonas aeruginosa PA01
cuccagcucggcga

SEQ ID NO: 1490625 - RNA, 19 nt, Pseudomonas aeruginosa PA01
cuccagcucggcgauccgc

SEQ ID NO: 1490626 - RNA, 19 nt, Pseudomonas aeruginosa PA01
cuccagcgugcccgcugca

SEQ ID NO: 1490627 - RNA, 14 nt, Pseudomonas aeruginosa PA01
cuccaggaucgccu

SEQ ID NO: 1490628 - RNA, 23 nt, Pseudomonas aeruginosa PA01
cuccagcuucuucugcagcucgg

SEQ ID NO: 1490629 - RNA, 14 nt, Pseudomonas aeruginosa PA01
cuccagcuugucgu

SEQ ID NO: 1490630 - RNA, 19 nt, Pseudomonas aeruginosa PA01
cuccagcuugucgucggcc

SEQ ID NO: 1490631 - RNA, 21 nt, Pseudomonas aeruginosa PA01
cuccaggaauccuccgccagc

SEQ ID NO: 1490632 - RNA, 22 nt, Pseudomonas aeruginosa PA01
cuccaggaauccuccgccagcg

SEQ ID NO: 1490633 - RNA, 17 nt, Pseudomonas aeruginosa PA01
cuccaggaccaggaucg

SEQ ID NO: 1490634 - RNA, 13 nt, Pseudomonas aeruginosa PA01
cuccacuuccacu

SEQ ID NO: 1490635 - RNA, 19 nt, Pseudomonas aeruginosa PA01
cuccagaccuccagguagg

SEQ ID NO: 1490636 - RNA, 11 nt, Pseudomonas aeruginosa PA01
cuccagcgccu

SEQ ID NO: 1490637 - RNA, 19 nt, Pseudomonas aeruginosa PA01
cuccagcgccucgccgagc

SEQ ID NO: 1490638 - RNA, 20 nt, Pseudomonas aeruginosa PA01
cuccagcgccucgccgagca

SEQ ID NO: 1490639 - RNA, 14 nt, Pseudomonas aeruginosa PA01
cuccagcggcagcu

SEQ ID NO: 1490640 - RNA, 19 nt, Pseudomonas aeruginosa PA01
cuccagcggcagcucggcg

SEQ ID NO: 1490641 - RNA, 23 nt, Pseudomonas aeruginosa PA01
cuccagcggcuuguccuggcgca

SEQ ID NO: 1490642 - RNA, 18 nt, Pseudomonas aeruginosa PA01
cuccagcgggaaggucgg

SEQ ID NO: 1490643 - RNA, 20 nt, Pseudomonas aeruginosa PA01
cuccagcgggaaggucggca

SEQ ID NO: 1490644 - RNA, 18 nt, Pseudomonas aeruginosa PA01
cuccagcgggguggcgcg

SEQ ID NO: 1490645 - RNA, 15 nt, Pseudomonas aeruginosa PA01
cucaacgggaccguc

SEQ ID NO: 1490646 - RNA, 13 nt, Pseudomonas aeruginosa PA01
cucaacggcgugc

SEQ ID NO: 1490647 - RNA, 15 nt, Pseudomonas aeruginosa PA01
cucaacggcgugccg

SEQ ID NO: 1490648 - RNA, 21 nt, Pseudomonas aeruginosa PA01
cucaacugguuggccgccugg

SEQ ID NO: 1490649 - RNA, 20 nt, Pseudomonas aeruginosa PA01
cucaacugcuuaccuugccg

SEQ ID NO: 1490650 - RNA, 15 nt, Pseudomonas aeruginosa PA01
cucaacgaccgccca

SEQ ID NO: 1490651 - RNA, 15 nt, Pseudomonas aeruginosa PA01
cucaaccggcguccc

SEQ ID NO: 1490652 - RNA, 13 nt, Pseudomonas aeruginosa PA01
cuaugcgccgggc

SEQ ID NO: 1490653 - RNA, 13 nt, Pseudomonas aeruginosa PA01
cuaugcagcaggu

SEQ ID NO: 1490654 - RNA, 21 nt, Pseudomonas aeruginosa PA01
cuauccgccguuacgccgggu

SEQ ID NO: 1490655 - RNA, 16 nt, Pseudomonas aeruginosa PA01
cuaucccgugccgggc

SEQ ID NO: 1490656 - RNA, 19 nt, Pseudomonas aeruginosa PA01
cuaucccgugccgggccag

SEQ ID NO: 1490657 - RNA, 17 nt, Pseudomonas aeruginosa PA01
cuaucgcuggcgcagcc

SEQ ID NO: 1490658 - RNA, 18 nt, Pseudomonas aeruginosa PA01
cuaucgcuggcgcagccg

SEQ ID NO: 1490659 - RNA, 21 nt, Pseudomonas aeruginosa PA01
cuaucgccaacgccaccgcgc

SEQ ID NO: 1490660 - RNA, 13 nt, Pseudomonas aeruginosa PA01
cuaucggcccggg

SEQ ID NO: 1490661 - RNA, 19 nt, Pseudomonas aeruginosa PA01
cuaucgggcagggcagccg

SEQ ID NO: 1490662 - RNA, 23 nt, Pseudomonas aeruginosa PA01
cuaucgggcagggcagccgccgc

SEQ ID NO: 1490663 - RNA, 17 nt, Pseudomonas aeruginosa PA01
cuaucgggccgaucgag

SEQ ID NO: 1490664 - RNA, 12 nt, Pseudomonas aeruginosa PA01
cuacuaccgcca

SEQ ID NO: 1490665 - RNA, 14 nt, Pseudomonas aeruginosa PA01
cuacuaccgccagc

SEQ ID NO: 1490666 - RNA, 21 nt, Pseudomonas aeruginosa PA01
cuacucgacgcugcccagccc

SEQ ID NO: 1490667 - RNA, 19 nt, Pseudomonas aeruginosa PA01
cuacggggcgugucgaggg

SEQ ID NO: 1490668 - RNA, 20 nt, Pseudomonas aeruginosa PA01
cuacgggggcgugucgaggg

SEQ ID NO: 1490669 - RNA, 18 nt, Pseudomonas aeruginosa PA01
cguugccuucgccgucga

SEQ ID NO: 1490670 - RNA, 20 nt, Pseudomonas aeruginosa PA01
cuacggggacaugucgaggg

SEQ ID NO: 1490671 - RNA, 15 nt, Pseudomonas aeruginosa PA01
cguugcgccagacca

SEQ ID NO: 1490672 - RNA, 12 nt, Pseudomonas aeruginosa PA01
cguugcgcaggg

SEQ ID NO: 1490673 - RNA, 13 nt, Pseudomonas aeruginosa PA01
cguugccgucgag

SEQ ID NO: 1490674 - RNA, 16 nt, Pseudomonas aeruginosa PA01
cguugccgucgagcac

SEQ ID NO: 1490675 - RNA, 20 nt, Pseudomonas aeruginosa PA01
cguugccgucgagcaccagc

SEQ ID NO: 1490676 - RNA, 14 nt, Pseudomonas aeruginosa PA01
cguugccggacuuc

SEQ ID NO: 1490677 - RNA, 18 nt, Pseudomonas aeruginosa PA01
cguugccgguacucgccg

SEQ ID NO: 1490678 - RNA, 20 nt, Pseudomonas aeruginosa PA01
cguugccgguacucgccggg

SEQ ID NO: 1490679 - RNA, 12 nt, Pseudomonas aeruginosa PA01
cguugccgaugg

SEQ ID NO: 1490680 - RNA, 12 nt, Pseudomonas aeruginosa PA01
cguugccgcgcg

SEQ ID NO: 1490681 - RNA, 23 nt, Pseudomonas aeruginosa PA01
cguugccgcgcgggccggcgaug

SEQ ID NO: 1490682 - RNA, 13 nt, Pseudomonas aeruginosa PA01
cguugccgcgcuc

SEQ ID NO: 1490683 - RNA, 20 nt, Pseudomonas aeruginosa PA01
cuaucaggcauccccggacc

SEQ ID NO: 1490684 - RNA, 18 nt, Pseudomonas aeruginosa PA01
cuagcccucgaccuggcu

SEQ ID NO: 1490685 - RNA, 17 nt, Pseudomonas aeruginosa PA01
cuagcccugcugcucgc

SEQ ID NO: 1490686 - RNA, 19 nt, Pseudomonas aeruginosa PA01
cuagcccugcugcucgcca

SEQ ID NO: 1490687 - RNA, 16 nt, Pseudomonas aeruginosa PA01
cuccuccagcguggcg

SEQ ID NO: 1490688 - RNA, 16 nt, Pseudomonas aeruginosa PA01
cuccuccaguuccucg

SEQ ID NO: 1490689 - RNA, 17 nt, Pseudomonas aeruginosa PA01
cuccuccaucucguggu

SEQ ID NO: 1490690 - RNA, 14 nt, Pseudomonas aeruginosa PA01
cuccuccagcgccg

SEQ ID NO: 1490691 - RNA, 15 nt, Pseudomonas aeruginosa PA01
cuccuccagcgccgc

SEQ ID NO: 1490692 - RNA, 16 nt, Pseudomonas aeruginosa PA01
cuccuccagcgccgcc

SEQ ID NO: 1490693 - RNA, 19 nt, Pseudomonas aeruginosa PA01
cuccgggucgggcuucagc

SEQ ID NO: 1490694 - RNA, 18 nt, Pseudomonas aeruginosa PA01
cuccgggucgugcccgag

SEQ ID NO: 1490695 - RNA, 16 nt, Pseudomonas aeruginosa PA01
cuccggguugaccgcc

SEQ ID NO: 1490696 - RNA, 18 nt, Pseudomonas aeruginosa PA01
cuccgggcuggccaccag

SEQ ID NO: 1490697 - RNA, 16 nt, Pseudomonas aeruginosa PA01
cuccgggcuccaccag

SEQ ID NO: 1490698 - RNA, 21 nt, Pseudomonas aeruginosa PA01
cuccgggcagaccagcagcgc

SEQ ID NO: 1490699 - RNA, 15 nt, Pseudomonas aeruginosa PA01
cuccgggccgagggc

SEQ ID NO: 1490700 - RNA, 21 nt, Pseudomonas aeruginosa PA01
cuccgggccgagggcugagac

SEQ ID NO: 1490701 - RNA, 15 nt, Pseudomonas aeruginosa PA01
cuccggcagcacccg

SEQ ID NO: 1490702 - RNA, 22 nt, Pseudomonas aeruginosa PA01
cuccggcagcacccgcaccagc

SEQ ID NO: 1490703 - RNA, 16 nt, Pseudomonas aeruginosa PA01
cuccgggaacagcccg

SEQ ID NO: 1490704 - RNA, 19 nt, Pseudomonas aeruginosa PA01
cuccgggaacagcccgucg

SEQ ID NO: 1490705 - RNA, 14 nt, Pseudomonas aeruginosa PA01
cuccugcgccggcu

SEQ ID NO: 1490706 - RNA, 17 nt, Pseudomonas aeruginosa PA01
cuccucgauaaacggcg

SEQ ID NO: 1490707 - RNA, 14 nt, Pseudomonas aeruginosa PA01
cuccugcggucggg

SEQ ID NO: 1490708 - RNA, 17 nt, Pseudomonas aeruginosa PA01
cuccugcucgauccagc

SEQ ID NO: 1490709 - RNA, 21 nt, Pseudomonas aeruginosa PA01
cuccuggagguagcugcgccg

SEQ ID NO: 1490710 - RNA, 13 nt, Pseudomonas aeruginosa PA01
cuccuccucggcg

SEQ ID NO: 1490711 - RNA, 16 nt, Pseudomonas aeruginosa PA01
cuccucgacggcggga

SEQ ID NO: 1490712 - RNA, 17 nt, Pseudomonas aeruginosa PA01
cuccucgacggcgggag

SEQ ID NO: 1490713 - RNA, 17 nt, Pseudomonas aeruginosa PA01
cuccugggccgacgcuu

SEQ ID NO: 1490714 - RNA, 14 nt, Pseudomonas aeruginosa PA01
cuccuggcgcgucg

SEQ ID NO: 1490715 - RNA, 23 nt, Pseudomonas aeruginosa PA01
cuccuggaagaacaggcgcuuca

SEQ ID NO: 1490716 - RNA, 21 nt, Pseudomonas aeruginosa PA01
cuccuggaugcuccgcgccuc

SEQ ID NO: 1490717 - RNA, 20 nt, Pseudomonas aeruginosa PA01
cuccugggucgacugcuggg

SEQ ID NO: 1490718 - RNA, 21 nt, Pseudomonas aeruginosa PA01
cuccuucgagccuggccaggc

SEQ ID NO: 1490719 - RNA, 18 nt, Pseudomonas aeruginosa PA01
cuccuucgguaccugguc

SEQ ID NO: 1490720 - RNA, 15 nt, Pseudomonas aeruginosa PA01
cuccuugccguggcu

SEQ ID NO: 1490721 - RNA, 20 nt, Pseudomonas aeruginosa PA01
cuccuguucgcgcgccucgc

SEQ ID NO: 1490722 - RNA, 16 nt, Pseudomonas aeruginosa PA01
cuccuguucgucgcgu

SEQ ID NO: 1490723 - RNA, 21 nt, Pseudomonas aeruginosa PA01
cuccaugcgggagagcgccgu

SEQ ID NO: 1490724 - RNA, 18 nt, Pseudomonas aeruginosa PA01
cuccauuagcgucgcgcg

SEQ ID NO: 1490725 - RNA, 14 nt, Pseudomonas aeruginosa PA01
cuccaucucgcggc

SEQ ID NO: 1490726 - RNA, 16 nt, Pseudomonas aeruginosa PA01
cuccauccccccgcga

SEQ ID NO: 1490727 - RNA, 19 nt, Pseudomonas aeruginosa PA01
cucccagaagucgcuggcc

SEQ ID NO: 1490728 - RNA, 22 nt, Pseudomonas aeruginosa PA01
cucccagccacagaggucgcug

SEQ ID NO: 1490729 - RNA, 22 nt, Pseudomonas aeruginosa PA01
cucccagugcgagucggcgacg

SEQ ID NO: 1490730 - RNA, 20 nt, Pseudomonas aeruginosa PA01
cucccaugaaaaauggccgc

SEQ ID NO: 1490731 - RNA, 16 nt, Pseudomonas aeruginosa PA01
cucccaccgcgcggca

SEQ ID NO: 1490732 - RNA, 17 nt, Pseudomonas aeruginosa PA01
cucccaggcgucgccga

SEQ ID NO: 1490733 - RNA, 13 nt, Pseudomonas aeruginosa PA01
cuccggcacgcug

SEQ ID NO: 1490734 - RNA, 14 nt, Pseudomonas aeruginosa PA01
cuccggcacgcugc

SEQ ID NO: 1490735 - RNA, 20 nt, Pseudomonas aeruginosa PA01
cuccggcacgcugccgccga

SEQ ID NO: 1490736 - RNA, 21 nt, Pseudomonas aeruginosa PA01
cuccggcacgcugccgccgau

SEQ ID NO: 1490737 - RNA, 15 nt, Pseudomonas aeruginosa PA01
cuccggcaccguggu

SEQ ID NO: 1490738 - RNA, 20 nt, Pseudomonas aeruginosa PA01
cuccggauggcugacccgcu

SEQ ID NO: 1490739 - RNA, 21 nt, Pseudomonas aeruginosa PA01
cuccgggagcaucuggcccgg

SEQ ID NO: 1490740 - RNA, 13 nt, Pseudomonas aeruginosa PA01
cuccggcagcagg

SEQ ID NO: 1490741 - RNA, 18 nt, Pseudomonas aeruginosa PA01
cuccggcugcgugaggau

SEQ ID NO: 1490742 - RNA, 13 nt, Pseudomonas aeruginosa PA01
cuccggaggcgca

SEQ ID NO: 1490743 - RNA, 18 nt, Pseudomonas aeruginosa PA01
cuccggaggcgcacaggc

SEQ ID NO: 1490744 - RNA, 14 nt, Pseudomonas aeruginosa PA01
cuccggacugccga

SEQ ID NO: 1490745 - RNA, 19 nt, Pseudomonas aeruginosa PA01
cuccggagaaccggcggau

SEQ ID NO: 1490746 - RNA, 22 nt, Pseudomonas aeruginosa PA01
cuccggaucgcgcaaugccgcg

SEQ ID NO: 1490747 - RNA, 19 nt, Pseudomonas aeruginosa PA01
cuccggaugcagauccagc

SEQ ID NO: 1490748 - RNA, 23 nt, Pseudomonas aeruginosa PA01
cuccggaugcagauccagcggca

SEQ ID NO: 1490749 - RNA, 22 nt, Pseudomonas aeruginosa PA01
cuccgcucagucgaccgucgcc

SEQ ID NO: 1490750 - RNA, 19 nt, Pseudomonas aeruginosa PA01
cuccgcucugcuggccacc

SEQ ID NO: 1490751 - RNA, 15 nt, Pseudomonas aeruginosa PA01
cucgaccucggccgc

SEQ ID NO: 1490752 - RNA, 21 nt, Pseudomonas aeruginosa PA01
cucgaccgccugcucgcggcu

SEQ ID NO: 1490753 - RNA, 15 nt, Pseudomonas aeruginosa PA01
cucgaccgcgccggc

SEQ ID NO: 1490754 - RNA, 16 nt, Pseudomonas aeruginosa PA01
cucgaccgcgccggcg

SEQ ID NO: 1490755 - RNA, 13 nt, Pseudomonas aeruginosa PA01
cucgacgcugccc

SEQ ID NO: 1490756 - RNA, 15 nt, Pseudomonas aeruginosa PA01
cucgacggcaccagc

SEQ ID NO: 1490757 - RNA, 17 nt, Pseudomonas aeruginosa PA01
cucgacggcaccagcgc

SEQ ID NO: 1490758 - RNA, 16 nt, Pseudomonas aeruginosa PA01
cucgacccacuggcgg

SEQ ID NO: 1490759 - RNA, 17 nt, Pseudomonas aeruginosa PA01
cucgacccacuggcgga

SEQ ID NO: 1490760 - RNA, 14 nt, Pseudomonas aeruginosa PA01
cucgaagcuggcca

SEQ ID NO: 1490761 - RNA, 15 nt, Pseudomonas aeruginosa PA01
cucgacccgcccgcc

SEQ ID NO: 1490762 - RNA, 18 nt, Pseudomonas aeruginosa PA01
cucgacccgcccgccguc

SEQ ID NO: 1490763 - RNA, 21 nt, Pseudomonas aeruginosa PA01
cucgacccgguuaccggcgac

SEQ ID NO: 1490764 - RNA, 15 nt, Pseudomonas aeruginosa PA01
cucgacccuggcgcc

SEQ ID NO: 1490765 - RNA, 17 nt, Pseudomonas aeruginosa PA01
cucgacccuggcgccga

SEQ ID NO: 1490766 - RNA, 18 nt, Pseudomonas aeruginosa PA01
cucgacccuggcgccgac

SEQ ID NO: 1490767 - RNA, 12 nt, Pseudomonas aeruginosa PA01
cucgaaggucgc

SEQ ID NO: 1490768 - RNA, 17 nt, Pseudomonas aeruginosa PA01
cucgaaggccggcaaag

SEQ ID NO: 1490769 - RNA, 13 nt, Pseudomonas aeruginosa PA01
cucgaagccgccg

SEQ ID NO: 1490770 - RNA, 17 nt, Pseudomonas aeruginosa PA01
cucgaagcccagcgccu

SEQ ID NO: 1490771 - RNA, 19 nt, Pseudomonas aeruginosa PA01
cucgaagcccagcgccugc

SEQ ID NO: 1490772 - RNA, 13 nt, Pseudomonas aeruginosa PA01
cucgaagcccugc

SEQ ID NO: 1490773 - RNA, 16 nt, Pseudomonas aeruginosa PA01
cuccuugcgccaggcc

SEQ ID NO: 1490774 - RNA, 18 nt, Pseudomonas aeruginosa PA01
cuccuugcgccaggcccg

SEQ ID NO: 1490775 - RNA, 17 nt, Pseudomonas aeruginosa PA01
cuccuugcgccguugcc

SEQ ID NO: 1490776 - RNA, 20 nt, Pseudomonas aeruginosa PA01
cuccuugcucucgcgcacgc

SEQ ID NO: 1490777 - RNA, 21 nt, Pseudomonas aeruginosa PA01
cucgaagaaaaggcccggcgu

SEQ ID NO: 1490778 - RNA, 23 nt, Pseudomonas aeruginosa PA01
cucgaagaacuccaucucgcggc

SEQ ID NO: 1490779 - RNA, 15 nt, Pseudomonas aeruginosa PA01
cucgaagagcuggcg

SEQ ID NO: 1490780 - RNA, 13 nt, Pseudomonas aeruginosa PA01
cucgaggacgugc

SEQ ID NO: 1490781 - RNA, 13 nt, Pseudomonas aeruginosa PA01
cucgagcuugagg

SEQ ID NO: 1490782 - RNA, 22 nt, Pseudomonas aeruginosa PA01
cucgaggaacaggucgacggcu

SEQ ID NO: 1490783 - RNA, 17 nt, Pseudomonas aeruginosa PA01
cucgacguaggcggcga

SEQ ID NO: 1490784 - RNA, 18 nt, Pseudomonas aeruginosa PA01
cucgacguaggcggcgaa

SEQ ID NO: 1490785 - RNA, 18 nt, Pseudomonas aeruginosa PA01
cucgaucgagucgccgau

SEQ ID NO: 1490786 - RNA, 20 nt, Pseudomonas aeruginosa PA01
cucgaucaucgccagcggcg

SEQ ID NO: 1490787 - RNA, 15 nt, Pseudomonas aeruginosa PA01
cucgaggucggccug

SEQ ID NO: 1490788 - RNA, 12 nt, Pseudomonas aeruginosa PA01
cucgaggccgag

SEQ ID NO: 1490789 - RNA, 17 nt, Pseudomonas aeruginosa PA01
cucgaggccgagccggc

SEQ ID NO: 1490790 - RNA, 18 nt, Pseudomonas aeruginosa PA01
cucgaggccgagccggca

SEQ ID NO: 1490791 - RNA, 17 nt, Pseudomonas aeruginosa PA01
cucgaugaaugcgcagg

SEQ ID NO: 1490792 - RNA, 20 nt, Pseudomonas aeruginosa PA01
cucgagguucucgacccgcu

SEQ ID NO: 1490793 - RNA, 16 nt, Pseudomonas aeruginosa PA01
cucgaugaacagcgcg

SEQ ID NO: 1490794 - RNA, 20 nt, Pseudomonas aeruginosa PA01
cucgaucggcccgggcgcca

SEQ ID NO: 1490795 - RNA, 14 nt, Pseudomonas aeruginosa PA01
cucgcagccgcgcu

SEQ ID NO: 1490796 - RNA, 16 nt, Pseudomonas aeruginosa PA01
cucgcagccgcgcucg

SEQ ID NO: 1490797 - RNA, 19 nt, Pseudomonas aeruginosa PA01
cucgcagccgcgcucggcc

SEQ ID NO: 1490798 - RNA, 13 nt, Pseudomonas aeruginosa PA01
cucgcagccggug

SEQ ID NO: 1490799 - RNA, 14 nt, Pseudomonas aeruginosa PA01
cucgcagagcgcca

SEQ ID NO: 1490800 - RNA, 18 nt, Pseudomonas aeruginosa PA01
cucgcagagcgccagcca

SEQ ID NO: 1490801 - RNA, 15 nt, Pseudomonas aeruginosa PA01
cucgcagagggcgau

SEQ ID NO: 1490802 - RNA, 17 nt, Pseudomonas aeruginosa PA01
cucgaugagcaugccgc

SEQ ID NO: 1490803 - RNA, 12 nt, Pseudomonas aeruginosa PA01
cucgcaccaggc

SEQ ID NO: 1490804 - RNA, 14 nt, Pseudomonas aeruginosa PA01
cucgcaccaggcca

SEQ ID NO: 1490805 - RNA, 22 nt, Pseudomonas aeruginosa PA01
cucgccggcgaucuccgccagg

SEQ ID NO: 1490806 - RNA, 22 nt, Pseudomonas aeruginosa PA01
cucgccggcgcgggcggccucg

SEQ ID NO: 1490807 - RNA, 21 nt, Pseudomonas aeruginosa PA01
cucgccgaugucguagccgcg

SEQ ID NO: 1490808 - RNA, 16 nt, Pseudomonas aeruginosa PA01
cucgccgccgagcagg

SEQ ID NO: 1490809 - RNA, 23 nt, Pseudomonas aeruginosa PA01
cucgccgccgacacccgcgccgc

SEQ ID NO: 1490810 - RNA, 13 nt, Pseudomonas aeruginosa PA01
cucgccgccgacc

SEQ ID NO: 1490811 - RNA, 11 nt, Pseudomonas aeruginosa PA01
cucgccgccgg

SEQ ID NO: 1490812 - RNA, 16 nt, Pseudomonas aeruginosa PA01
cucgccgccgggcgcg

SEQ ID NO: 1490813 - RNA, 17 nt, Pseudomonas aeruginosa PA01
cucgccgccgggcgcgc

SEQ ID NO: 1490814 - RNA, 19 nt, Pseudomonas aeruginosa PA01
cucgccgccgggcgcgcgc

SEQ ID NO: 1490815 - RNA, 13 nt, Pseudomonas aeruginosa PA01
cucgccgccgucc

SEQ ID NO: 1490816 - RNA, 13 nt, Pseudomonas aeruginosa PA01
cucgccgcuccgc

SEQ ID NO: 1490817 - RNA, 23 nt, Pseudomonas aeruginosa PA01
cucgccgcugaaguccuggccga

SEQ ID NO: 1490818 - RNA, 15 nt, Pseudomonas aeruginosa PA01
cucgccgcuggcgcu

SEQ ID NO: 1490819 - RNA, 22 nt, Pseudomonas aeruginosa PA01
cucgccgcuggcgcugaccgcu

SEQ ID NO: 1490820 - RNA, 14 nt, Pseudomonas aeruginosa PA01
cucgccgcgcucca

SEQ ID NO: 1490821 - RNA, 14 nt, Pseudomonas aeruginosa PA01
cucgccgcgcucgc

SEQ ID NO: 1490822 - RNA, 13 nt, Pseudomonas aeruginosa PA01
cucgccgcgcugc

SEQ ID NO: 1490823 - RNA, 15 nt, Pseudomonas aeruginosa PA01
cucgcccucgaagcc

SEQ ID NO: 1490824 - RNA, 12 nt, Pseudomonas aeruginosa PA01
cucgcccgccuc

SEQ ID NO: 1490825 - RNA, 17 nt, Pseudomonas aeruginosa PA01
cucgccccggcggcgau

SEQ ID NO: 1490826 - RNA, 18 nt, Pseudomonas aeruginosa PA01
cucgccccggcggcgauc

SEQ ID NO: 1490827 - RNA, 19 nt, Pseudomonas aeruginosa PA01
cucgcccgaccccacgccg

SEQ ID NO: 1490828 - RNA, 17 nt, Pseudomonas aeruginosa PA01
cucgccaaccaggaagg

SEQ ID NO: 1490829 - RNA, 14 nt, Pseudomonas aeruginosa PA01
cucgcccaguaccg

SEQ ID NO: 1490830 - RNA, 14 nt, Pseudomonas aeruginosa PA01
cucgcccaucgcca

SEQ ID NO: 1490831 - RNA, 15 nt, Pseudomonas aeruginosa PA01
cucgcccaucugcgc

SEQ ID NO: 1490832 - RNA, 13 nt, Pseudomonas aeruginosa PA01
cucgccccgccgg

SEQ ID NO: 1490833 - RNA, 18 nt, Pseudomonas aeruginosa PA01
cucgcaguacagcucggc

SEQ ID NO: 1490834 - RNA, 21 nt, Pseudomonas aeruginosa PA01
cucgcaguacagcucggcgcc

SEQ ID NO: 1490835 - RNA, 14 nt, Pseudomonas aeruginosa PA01
cucgccgaccagcu

SEQ ID NO: 1490836 - RNA, 23 nt, Pseudomonas aeruginosa PA01
cucgcccugcuuggccagcgcgg

SEQ ID NO: 1490837 - RNA, 18 nt, Pseudomonas aeruginosa PA01
cucgcccuugggaccggg

SEQ ID NO: 1490838 - RNA, 16 nt, Pseudomonas aeruginosa PA01
cucgcccuugcgccgc

SEQ ID NO: 1490839 - RNA, 13 nt, Pseudomonas aeruginosa PA01
cucgccgacggcu

SEQ ID NO: 1490840 - RNA, 19 nt, Pseudomonas aeruginosa PA01
cucgccgacuuccaggcgc

SEQ ID NO: 1490841 - RNA, 12 nt, Pseudomonas aeruginosa PA01
cucgccgccagc

SEQ ID NO: 1490842 - RNA, 16 nt, Pseudomonas aeruginosa PA01
cucgccgccagcagga

SEQ ID NO: 1490843 - RNA, 15 nt, Pseudomonas aeruginosa PA01
cucgccgaugcccgg

SEQ ID NO: 1490844 - RNA, 18 nt, Pseudomonas aeruginosa PA01
cucgccgaucuccuccgc

SEQ ID NO: 1490845 - RNA, 21 nt, Pseudomonas aeruginosa PA01
cucgcggcguucggaccuguc

SEQ ID NO: 1490846 - RNA, 15 nt, Pseudomonas aeruginosa PA01
cucgcggcuggccgc

SEQ ID NO: 1490847 - RNA, 14 nt, Pseudomonas aeruginosa PA01
cucgcgccgcgcca

SEQ ID NO: 1490848 - RNA, 17 nt, Pseudomonas aeruginosa PA01
cucgcgccgcgccagca

SEQ ID NO: 1490849 - RNA, 13 nt, Pseudomonas aeruginosa PA01
cucgcggcgcggc

SEQ ID NO: 1490850 - RNA, 19 nt, Pseudomonas aeruginosa PA01
cucgcgcagcggcggauac

SEQ ID NO: 1490851 - RNA, 14 nt, Pseudomonas aeruginosa PA01
cucgcgcagcagga

SEQ ID NO: 1490852 - RNA, 20 nt, Pseudomonas aeruginosa PA01
cucgcgcagccacuggcgga

SEQ ID NO: 1490853 - RNA, 15 nt, Pseudomonas aeruginosa PA01
cucgcgcagccaggc

SEQ ID NO: 1490854 - RNA, 17 nt, Pseudomonas aeruginosa PA01
cucgcgcagccaggcga

SEQ ID NO: 1490855 - RNA, 13 nt, Pseudomonas aeruginosa PA01
cucgcgccagaga

SEQ ID NO: 1490856 - RNA, 18 nt, Pseudomonas aeruginosa PA01
cucgcgccagccccaggc

SEQ ID NO: 1490857 - RNA, 16 nt, Pseudomonas aeruginosa PA01
cucgccguccgcgaug

SEQ ID NO: 1490858 - RNA, 15 nt, Pseudomonas aeruginosa PA01
cucgccgucaucgag

SEQ ID NO: 1490859 - RNA, 17 nt, Pseudomonas aeruginosa PA01
cucgccguuggcgagga

SEQ ID NO: 1490860 - RNA, 18 nt, Pseudomonas aeruginosa PA01
cucgccguuggcgaggac

SEQ ID NO: 1490861 - RNA, 16 nt, Pseudomonas aeruginosa PA01
cucgccuaccggcgcc

SEQ ID NO: 1490862 - RNA, 19 nt, Pseudomonas aeruginosa PA01
cucgccuaccggcgccgcc

SEQ ID NO: 1490863 - RNA, 15 nt, Pseudomonas aeruginosa PA01
cucgccugcggcgcc

SEQ ID NO: 1490864 - RNA, 21 nt, Pseudomonas aeruginosa PA01
cucgccugguaggcggcgacg

SEQ ID NO: 1490865 - RNA, 17 nt, Pseudomonas aeruginosa PA01
cucgccguacagcaggc

SEQ ID NO: 1490866 - RNA, 16 nt, Pseudomonas aeruginosa PA01
cucgccgggucgccgc

SEQ ID NO: 1490867 - RNA, 19 nt, Pseudomonas aeruginosa PA01
cucgccgggucgccgcagc

SEQ ID NO: 1490868 - RNA, 21 nt, Pseudomonas aeruginosa PA01
cucgccggguuguccaggcga

SEQ ID NO: 1490869 - RNA, 20 nt, Pseudomonas aeruginosa PA01
cucgccgggaaucgccagca

SEQ ID NO: 1490870 - RNA, 23 nt, Pseudomonas aeruginosa PA01
cucgccgggaaucgccagcaggc

SEQ ID NO: 1490871 - RNA, 14 nt, Pseudomonas aeruginosa PA01
cucggcggacagcc

SEQ ID NO: 1490872 - RNA, 20 nt, Pseudomonas aeruginosa PA01
cucggcgcuuucgcucuggu

SEQ ID NO: 1490873 - RNA, 16 nt, Pseudomonas aeruginosa PA01
cucggcgcugccggcc

SEQ ID NO: 1490874 - RNA, 18 nt, Pseudomonas aeruginosa PA01
cucggcgcugccggccag

SEQ ID NO: 1490875 - RNA, 13 nt, Pseudomonas aeruginosa PA01
cucggcgcucggc

SEQ ID NO: 1490876 - RNA, 17 nt, Pseudomonas aeruginosa PA01
cucggcgcucggcucca

SEQ ID NO: 1490877 - RNA, 18 nt, Pseudomonas aeruginosa PA01
cucggcgaagucgccguc

SEQ ID NO: 1490878 - RNA, 19 nt, Pseudomonas aeruginosa PA01
cucggccuuguccgcgcgc

SEQ ID NO: 1490879 - RNA, 13 nt, Pseudomonas aeruginosa PA01
cucggccuugcug

SEQ ID NO: 1490880 - RNA, 15 nt, Pseudomonas aeruginosa PA01
cucggccuugcuggc

SEQ ID NO: 1490881 - RNA, 13 nt, Pseudomonas aeruginosa PA01
cucggcggccagg

SEQ ID NO: 1490882 - RNA, 16 nt, Pseudomonas aeruginosa PA01
cucggcggccaggcgg

SEQ ID NO: 1490883 - RNA, 18 nt, Pseudomonas aeruginosa PA01
cucggcggccauugccgc

SEQ ID NO: 1490884 - RNA, 12 nt, Pseudomonas aeruginosa PA01
cucggcggcagg

SEQ ID NO: 1490885 - RNA, 21 nt, Pseudomonas aeruginosa PA01
cucggcggcaggcugcgccgc

SEQ ID NO: 1490886 - RNA, 17 nt, Pseudomonas aeruginosa PA01
cucggccgugugccuga

SEQ ID NO: 1490887 - RNA, 17 nt, Pseudomonas aeruginosa PA01
cucggccucgucgagca

SEQ ID NO: 1490888 - RNA, 14 nt, Pseudomonas aeruginosa PA01
cucggccuggugca

SEQ ID NO: 1490889 - RNA, 21 nt, Pseudomonas aeruginosa PA01
cucggccuggugcaccuggcg

SEQ ID NO: 1490890 - RNA, 19 nt, Pseudomonas aeruginosa PA01
cucggccugggcgcaggcc

SEQ ID NO: 1490891 - RNA, 20 nt, Pseudomonas aeruginosa PA01
cucggccugggcgcaggccg

SEQ ID NO: 1490892 - RNA, 21 nt, Pseudomonas aeruginosa PA01
cucggccugggcgcaggccga

SEQ ID NO: 1490893 - RNA, 22 nt, Pseudomonas aeruginosa PA01
cucggccugaucaucugggcca

SEQ ID NO: 1490894 - RNA, 14 nt, Pseudomonas aeruginosa PA01
cucggccugcgucg

SEQ ID NO: 1490895 - RNA, 20 nt, Pseudomonas aeruginosa PA01
cucggccugcugcgccggca

SEQ ID NO: 1490896 - RNA, 23 nt, Pseudomonas aeruginosa PA01
cucggccugcugcgccggcacgg

SEQ ID NO: 1490897 - RNA, 17 nt, Pseudomonas aeruginosa PA01
cucggccaucagcgcca

SEQ ID NO: 1490898 - RNA, 19 nt, Pseudomonas aeruginosa PA01
cucggccauggucucgcug

SEQ ID NO: 1490899 - RNA, 19 nt, Pseudomonas aeruginosa PA01
cucggccaguucgcggcgc

SEQ ID NO: 1490900 - RNA, 18 nt, Pseudomonas aeruginosa PA01
cucggccauaccuccagc

SEQ ID NO: 1490901 - RNA, 21 nt, Pseudomonas aeruginosa PA01
cucggccauaccuccagccag

SEQ ID NO: 1490902 - RNA, 23 nt, Pseudomonas aeruginosa PA01
cucggcccaugaaaaagcccggc

SEQ ID NO: 1490903 - RNA, 14 nt, Pseudomonas aeruginosa PA01
cucggcccggagcc

SEQ ID NO: 1490904 - RNA, 20 nt, Pseudomonas aeruginosa PA01
cucggcccgggccuggugca

SEQ ID NO: 1490905 - RNA, 19 nt, Pseudomonas aeruginosa PA01
cucggccgagggcagccuc

SEQ ID NO: 1490906 - RNA, 23 nt, Pseudomonas aeruginosa PA01
cucggccgagggcagccucagcg

SEQ ID NO: 1490907 - RNA, 17 nt, Pseudomonas aeruginosa PA01
cucggccgacaggcugg

SEQ ID NO: 1490908 - RNA, 21 nt, Pseudomonas aeruginosa PA01
cucggcacucagccagcggcg

SEQ ID NO: 1490909 - RNA, 17 nt, Pseudomonas aeruginosa PA01
cucggcagcgcuggcga

SEQ ID NO: 1490910 - RNA, 19 nt, Pseudomonas aeruginosa PA01
cucggcagggcgcccgccc

SEQ ID NO: 1490911 - RNA, 20 nt, Pseudomonas aeruginosa PA01
cucggcagggcgcccgcccg

SEQ ID NO: 1490912 - RNA, 18 nt, Pseudomonas aeruginosa PA01
cucggcauccucgccccg

SEQ ID NO: 1490913 - RNA, 20 nt, Pseudomonas aeruginosa PA01
cucggcaucgaccagggccg

SEQ ID NO: 1490914 - RNA, 19 nt, Pseudomonas aeruginosa PA01
cucggcaucgaccaugccg

SEQ ID NO: 1490915 - RNA, 15 nt, Pseudomonas aeruginosa PA01
cucggccagcucgcc

SEQ ID NO: 1490916 - RNA, 16 nt, Pseudomonas aeruginosa PA01
cucggccagcucgccg

SEQ ID NO: 1490917 - RNA, 19 nt, Pseudomonas aeruginosa PA01
cucggccagcucgccgaac

SEQ ID NO: 1490918 - RNA, 20 nt, Pseudomonas aeruginosa PA01
cucggccaggaccagggcgg

SEQ ID NO: 1490919 - RNA, 14 nt, Pseudomonas aeruginosa PA01
cucggccaggcccu

SEQ ID NO: 1490920 - RNA, 17 nt, Pseudomonas aeruginosa PA01
cucggagugaggccgag

SEQ ID NO: 1490921 - RNA, 23 nt, Pseudomonas aeruginosa PA01
cucggaucaggcgggcuccgccg

SEQ ID NO: 1490922 - RNA, 15 nt, Pseudomonas aeruginosa PA01
cucggcaagcgaacc

SEQ ID NO: 1490923 - RNA, 17 nt, Pseudomonas aeruginosa PA01
cucggauuccagcgcgg

SEQ ID NO: 1490924 - RNA, 20 nt, Pseudomonas aeruginosa PA01
cucggcacgcguggcgagug

SEQ ID NO: 1490925 - RNA, 16 nt, Pseudomonas aeruginosa PA01
cucgcgggcgcgcagc

SEQ ID NO: 1490926 - RNA, 17 nt, Pseudomonas aeruginosa PA01
cucgcgggcgacgaagc

SEQ ID NO: 1490927 - RNA, 15 nt, Pseudomonas aeruginosa PA01
cucgcgggccgccug

SEQ ID NO: 1490928 - RNA, 20 nt, Pseudomonas aeruginosa PA01
cucgcgggccgccuggucgg

SEQ ID NO: 1490929 - RNA, 15 nt, Pseudomonas aeruginosa PA01
cucgcuucagcgagc

SEQ ID NO: 1490930 - RNA, 16 nt, Pseudomonas aeruginosa PA01
cucgcgggucaccagc

SEQ ID NO: 1490931 - RNA, 13 nt, Pseudomonas aeruginosa PA01
cucgcugucgccg

SEQ ID NO: 1490932 - RNA, 18 nt, Pseudomonas aeruginosa PA01
cucgcugggcgccggcag

SEQ ID NO: 1490933 - RNA, 19 nt, Pseudomonas aeruginosa PA01
cucgcugggcgccggcagg

SEQ ID NO: 1490934 - RNA, 20 nt, Pseudomonas aeruginosa PA01
cucgcugggcgggcguccgu

SEQ ID NO: 1490935 - RNA, 19 nt, Pseudomonas aeruginosa PA01
cucgcuguaguuguucggc

SEQ ID NO: 1490936 - RNA, 19 nt, Pseudomonas aeruginosa PA01
cucggaaaccucgccgguc

SEQ ID NO: 1490937 - RNA, 21 nt, Pseudomonas aeruginosa PA01
cucggaaaccucgccggucag

SEQ ID NO: 1490938 - RNA, 15 nt, Pseudomonas aeruginosa PA01
cucggacggcucgcg

SEQ ID NO: 1490939 - RNA, 16 nt, Pseudomonas aeruginosa PA01
cucggacggcucgcgc

SEQ ID NO: 1490940 - RNA, 17 nt, Pseudomonas aeruginosa PA01
cucggacggcucgcgca

SEQ ID NO: 1490941 - RNA, 19 nt, Pseudomonas aeruginosa PA01
cucggacggcucgcgcagc

SEQ ID NO: 1490942 - RNA, 22 nt, Pseudomonas aeruginosa PA01
cucggacggcucgcgcagcggc

SEQ ID NO: 1490943 - RNA, 19 nt, Pseudomonas aeruginosa PA01
cucggacugaaaccccacc

SEQ ID NO: 1490944 - RNA, 15 nt, Pseudomonas aeruginosa PA01
cucggagaacagcag

SEQ ID NO: 1490945 - RNA, 17 nt, Pseudomonas aeruginosa PA01
cucggagaacagcagcg

SEQ ID NO: 1490946 - RNA, 22 nt, Pseudomonas aeruginosa PA01
gaccgacacguucaggcguacg

SEQ ID NO: 1490947 - RNA, 14 nt, Pseudomonas aeruginosa PA01
gaccgagcaugcgc

SEQ ID NO: 1490948 - RNA, 15 nt, Pseudomonas aeruginosa PA01
gaccgaucaugcccu

SEQ ID NO: 1490949 - RNA, 18 nt, Pseudomonas aeruginosa PA01
gaccgauccagcagucgc

SEQ ID NO: 1490950 - RNA, 15 nt, Pseudomonas aeruginosa PA01
gaccgccgccugggu

SEQ ID NO: 1490951 - RNA, 19 nt, Pseudomonas aeruginosa PA01
gaccgcgaauggcagcagg

SEQ ID NO: 1490952 - RNA, 20 nt, Pseudomonas aeruginosa PA01
gaccgcgaauggcagcaggc

SEQ ID NO: 1490953 - RNA, 18 nt, Pseudomonas aeruginosa PA01
gaccgcgacaacccuguc

SEQ ID NO: 1490954 - RNA, 16 nt, Pseudomonas aeruginosa PA01
gaccgaucucguucgg

SEQ ID NO: 1490955 - RNA, 16 nt, Pseudomonas aeruginosa PA01
gaccgauggcgccgcg

SEQ ID NO: 1490956 - RNA, 17 nt, Pseudomonas aeruginosa PA01
gaccgauggcgccgcga

SEQ ID NO: 1490957 - RNA, 16 nt, Pseudomonas aeruginosa PA01
gaccgcgaugguaugg

SEQ ID NO: 1490958 - RNA, 22 nt, Pseudomonas aeruginosa PA01
gaccgcgaugguauggcggucg

SEQ ID NO: 1490959 - RNA, 12 nt, Pseudomonas aeruginosa PA01
gaccgcgcccgg

SEQ ID NO: 1490960 - RNA, 18 nt, Pseudomonas aeruginosa PA01
gaccgcgaguucgccggc

SEQ ID NO: 1490961 - RNA, 19 nt, Pseudomonas aeruginosa PA01
gaccgcgaguucgccggcc

SEQ ID NO: 1490962 - RNA, 21 nt, Pseudomonas aeruginosa PA01
gaccgcgaguucgccggccag

SEQ ID NO: 1490963 - RNA, 15 nt, Pseudomonas aeruginosa PA01
gaccgcgagcgccgc

SEQ ID NO: 1490964 - RNA, 16 nt, Pseudomonas aeruginosa PA01
gaccgcgagcgccgcc

SEQ ID NO: 1490965 - RNA, 12 nt, Pseudomonas aeruginosa PA01
gaccgcgccggc

SEQ ID NO: 1490966 - RNA, 15 nt, Pseudomonas aeruginosa PA01
gaccgcgccggcgau

SEQ ID NO: 1490967 - RNA, 12 nt, Pseudomonas aeruginosa PA01
gaccgcgcgcca

SEQ ID NO: 1490968 - RNA, 16 nt, Pseudomonas aeruginosa PA01
gaccgcgcgccauggc

SEQ ID NO: 1490969 - RNA, 17 nt, Pseudomonas aeruginosa PA01
gaccgcgcgccauggcc

SEQ ID NO: 1490970 - RNA, 16 nt, Pseudomonas aeruginosa PA01
gaccgcgcgccugcaa

SEQ ID NO: 1490971 - RNA, 22 nt, Pseudomonas aeruginosa PA01
gaccgcgcgccugcaacgccag

SEQ ID NO: 1490972 - RNA, 16 nt, Pseudomonas aeruginosa PA01
gacccgcuccucgucg

SEQ ID NO: 1490973 - RNA, 12 nt, Pseudomonas aeruginosa PA01
gacccgcggcag

SEQ ID NO: 1490974 - RNA, 13 nt, Pseudomonas aeruginosa PA01
gacccgcggcagg

SEQ ID NO: 1490975 - RNA, 13 nt, Pseudomonas aeruginosa PA01
gacccgcgccggc

SEQ ID NO: 1490976 - RNA, 22 nt, Pseudomonas aeruginosa PA01
gacccgcgccggcagcucggcc

SEQ ID NO: 1490977 - RNA, 16 nt, Pseudomonas aeruginosa PA01
gacccgcugcaccagc

SEQ ID NO: 1490978 - RNA, 16 nt, Pseudomonas aeruginosa PA01
gacccgcucgccggga

SEQ ID NO: 1490979 - RNA, 19 nt, Pseudomonas aeruginosa PA01
gacccgcucggccuuagcg

SEQ ID NO: 1490980 - RNA, 16 nt, Pseudomonas aeruginosa PA01
gacccgcuguccgccg

SEQ ID NO: 1490981 - RNA, 18 nt, Pseudomonas aeruginosa PA01
gacccgcuguccgccggc

SEQ ID NO: 1490982 - RNA, 19 nt, Pseudomonas aeruginosa PA01
gacccgcuguccgccggcc

SEQ ID NO: 1490983 - RNA, 22 nt, Pseudomonas aeruginosa PA01
gacccgcuguccgccggccucg

SEQ ID NO: 1490984 - RNA, 19 nt, Pseudomonas aeruginosa PA01
gacccgcuugagccauucg

SEQ ID NO: 1490985 - RNA, 16 nt, Pseudomonas aeruginosa PA01
gacccggccgaccagg

SEQ ID NO: 1490986 - RNA, 17 nt, Pseudomonas aeruginosa PA01
aacgcgcgcucucgccg

SEQ ID NO: 1490987 - RNA, 22 nt, Pseudomonas aeruginosa PA01
aacgcgcggaccuucgacggca

SEQ ID NO: 1490988 - RNA, 23 nt, Pseudomonas aeruginosa PA01
aacgcgcggaccuucgacggcag

SEQ ID NO: 1490989 - RNA, 20 nt, Pseudomonas aeruginosa PA01
aacgcguaggggaccacccc

SEQ ID NO: 1490990 - RNA, 19 nt, Pseudomonas aeruginosa PA01
aacgcggcuucggucaggu

SEQ ID NO: 1490991 - RNA, 14 nt, Pseudomonas aeruginosa PA01
aacgcggccagcag

SEQ ID NO: 1490992 - RNA, 17 nt, Pseudomonas aeruginosa PA01
aacgcggagcaggcgga

SEQ ID NO: 1490993 - RNA, 19 nt, Pseudomonas aeruginosa PA01
gacccggguuuccugcccg

SEQ ID NO: 1490994 - RNA, 15 nt, Pseudomonas aeruginosa PA01
gacccggucgcugac

SEQ ID NO: 1490995 - RNA, 17 nt, Pseudomonas aeruginosa PA01
gacccggucgcugacca

SEQ ID NO: 1490996 - RNA, 20 nt, Pseudomonas aeruginosa PA01
gacccggucgcugaccagcc

SEQ ID NO: 1490997 - RNA, 14 nt, Pseudomonas aeruginosa PA01
gacccgggugccuu

SEQ ID NO: 1490998 - RNA, 14 nt, Pseudomonas aeruginosa PA01
gacccgggucaggc

SEQ ID NO: 1490999 - RNA, 18 nt, Pseudomonas aeruginosa PA01
gacccgggucaggccgag

SEQ ID NO: 1491000 - RNA, 19 nt, Pseudomonas aeruginosa PA01
gacccgggucaggccgaga

SEQ ID NO: 1491001 - RNA, 12 nt, Pseudomonas aeruginosa PA01
gacccggcugca

SEQ ID NO: 1491002 - RNA, 17 nt, Pseudomonas aeruginosa PA01
gacccggcggaacaugg

SEQ ID NO: 1491003 - RNA, 17 nt, Pseudomonas aeruginosa PA01
aacgcgugaagcuggag

SEQ ID NO: 1491004 - RNA, 13 nt, Pseudomonas aeruginosa PA01
gacccguugccga

SEQ ID NO: 1491005 - RNA, 17 nt, Pseudomonas aeruginosa PA01
gacccguugccgaccga

SEQ ID NO: 1491006 - RNA, 18 nt, Pseudomonas aeruginosa PA01
gacccguugccgaccgag

SEQ ID NO: 1491007 - RNA, 20 nt, Pseudomonas aeruginosa PA01
gacccguugccgaccgagca

SEQ ID NO: 1491008 - RNA, 21 nt, Pseudomonas aeruginosa PA01
gacccguugcgccucgccgcc

SEQ ID NO: 1491009 - RNA, 20 nt, Pseudomonas aeruginosa PA01
aacgcuccuucgguaccugg

SEQ ID NO: 1491010 - RNA, 19 nt, Pseudomonas aeruginosa PA01
gacccuucaacggcgaccg

SEQ ID NO: 1491011 - RNA, 17 nt, Pseudomonas aeruginosa PA01
aacgcuugagccccggc

SEQ ID NO: 1491012 - RNA, 16 nt, Pseudomonas aeruginosa PA01
gacccuggggucgccg

SEQ ID NO: 1491013 - RNA, 19 nt, Pseudomonas aeruginosa PA01
gacccugguaguccagcag

SEQ ID NO: 1491014 - RNA, 20 nt, Pseudomonas aeruginosa PA01
gacccugguaguccagcagg

SEQ ID NO: 1491015 - RNA, 16 nt, Pseudomonas aeruginosa PA01
gacccuggcgccgacc

SEQ ID NO: 1491016 - RNA, 13 nt, Pseudomonas aeruginosa PA01
gacccugcuggcc

SEQ ID NO: 1491017 - RNA, 15 nt, Pseudomonas aeruginosa PA01
gacccugcuggccgg

SEQ ID NO: 1491018 - RNA, 20 nt, Pseudomonas aeruginosa PA01
gacccugcuggccggugccg

SEQ ID NO: 1491019 - RNA, 22 nt, Pseudomonas aeruginosa PA01
gacccugcuggccggugccgcc

SEQ ID NO: 1491020 - RNA, 14 nt, Pseudomonas aeruginosa PA01
gacccagagccgcu

SEQ ID NO: 1491021 - RNA, 16 nt, Pseudomonas aeruginosa PA01
gacccagcgcacgccg

SEQ ID NO: 1491022 - RNA, 16 nt, Pseudomonas aeruginosa PA01
gacccacuccggcagg

SEQ ID NO: 1491023 - RNA, 19 nt, Pseudomonas aeruginosa PA01
gacccacuccggcaggcgc

SEQ ID NO: 1491024 - RNA, 20 nt, Pseudomonas aeruginosa PA01
gacccacuccggcaggcgcu

SEQ ID NO: 1491025 - RNA, 16 nt, Pseudomonas aeruginosa PA01
gacccagacaggccug

SEQ ID NO: 1491026 - RNA, 22 nt, Pseudomonas aeruginosa PA01
gaccaucuuuuccugcuggcga

SEQ ID NO: 1491027 - RNA, 23 nt, Pseudomonas aeruginosa PA01
gaccauggugaugcgcaugcugg

SEQ ID NO: 1491028 - RNA, 19 nt, Pseudomonas aeruginosa PA01
gaccaugguguuggcggcc

SEQ ID NO: 1491029 - RNA, 23 nt, Pseudomonas aeruginosa PA01
gaccaugguguuggcggccuggg

SEQ ID NO: 1491030 - RNA, 14 nt, Pseudomonas aeruginosa PA01
gaccauggccggcg

SEQ ID NO: 1491031 - RNA, 14 nt, Pseudomonas aeruginosa PA01
gaccauuugcgccu

SEQ ID NO: 1491032 - RNA, 18 nt, Pseudomonas aeruginosa PA01
gacccgccguucgcccgc

SEQ ID NO: 1491033 - RNA, 15 nt, Pseudomonas aeruginosa PA01
gacccgccagcggca

SEQ ID NO: 1491034 - RNA, 14 nt, Pseudomonas aeruginosa PA01
gacccgcacggcga

SEQ ID NO: 1491035 - RNA, 13 nt, Pseudomonas aeruginosa PA01
gacccgccccugc

SEQ ID NO: 1491036 - RNA, 16 nt, Pseudomonas aeruginosa PA01
gacccgccccugcucc

SEQ ID NO: 1491037 - RNA, 23 nt, Pseudomonas aeruginosa PA01
gacccgccccugcuccucgccgu

SEQ ID NO: 1491038 - RNA, 20 nt, Pseudomonas aeruginosa PA01
gacccgcccgccguccucca

SEQ ID NO: 1491039 - RNA, 16 nt, Pseudomonas aeruginosa PA01
gacccgccgaccagca

SEQ ID NO: 1491040 - RNA, 14 nt, Pseudomonas aeruginosa PA01
gacccgcaccggca

SEQ ID NO: 1491041 - RNA, 16 nt, Pseudomonas aeruginosa PA01
gacccgcagcggcgcu

SEQ ID NO: 1491042 - RNA, 14 nt, Pseudomonas aeruginosa PA01
gacccgcaggccgg

SEQ ID NO: 1491043 - RNA, 16 nt, Pseudomonas aeruginosa PA01
gacccgcaggccggcc

SEQ ID NO: 1491044 - RNA, 17 nt, Pseudomonas aeruginosa PA01
gacccgcaggccggcca

SEQ ID NO: 1491045 - RNA, 19 nt, Pseudomonas aeruginosa PA01
gacccgcaggccggccagg

SEQ ID NO: 1491046 - RNA, 21 nt, Pseudomonas aeruginosa PA01
gacccgcaggccggccaggga

SEQ ID NO: 1491047 - RNA, 18 nt, Pseudomonas aeruginosa PA01
gacccgcaguuccuuggg

SEQ ID NO: 1491048 - RNA, 22 nt, Pseudomonas aeruginosa PA01
gacccgcaguuccuugggcauc

SEQ ID NO: 1491049 - RNA, 23 nt, Pseudomonas aeruginosa PA01
gacccgcaguuccuugggcaucg

SEQ ID NO: 1491050 - RNA, 20 nt, Pseudomonas aeruginosa PA01
gacccaggccgacagcggcu

SEQ ID NO: 1491051 - RNA, 19 nt, Pseudomonas aeruginosa PA01
gacccaggugcgcaggcgc

SEQ ID NO: 1491052 - RNA, 20 nt, Pseudomonas aeruginosa PA01
gacccaguugggccaggagg

SEQ ID NO: 1491053 - RNA, 14 nt, Pseudomonas aeruginosa PA01
gaccagcgccugcu

SEQ ID NO: 1491054 - RNA, 22 nt, Pseudomonas aeruginosa PA01
gaccagcgcgcucuucgccgcg

SEQ ID NO: 1491055 - RNA, 23 nt, Pseudomonas aeruginosa PA01
gaccagcgcgcucuucgccgcgg

SEQ ID NO: 1491056 - RNA, 23 nt, Pseudomonas aeruginosa PA01
gaccagcgcggucucuucgucgg

SEQ ID NO: 1491057 - RNA, 11 nt, Pseudomonas aeruginosa PA01
gaccagcgccg

SEQ ID NO: 1491058 - RNA, 14 nt, Pseudomonas aeruginosa PA01
gaccagcgaaccgc

SEQ ID NO: 1491059 - RNA, 17 nt, Pseudomonas aeruginosa PA01
gaccagcgaaccgccgg

SEQ ID NO: 1491060 - RNA, 19 nt, Pseudomonas aeruginosa PA01
gaccagcgaaccgccggcc

SEQ ID NO: 1491061 - RNA, 17 nt, Pseudomonas aeruginosa PA01
gaccagccguccgcggg

SEQ ID NO: 1491062 - RNA, 21 nt, Pseudomonas aeruginosa PA01
gaccagccguccgcgggcgau

SEQ ID NO: 1491063 - RNA, 21 nt, Pseudomonas aeruginosa PA01
aacgccucgcagagcgccagc

SEQ ID NO: 1491064 - RNA, 22 nt, Pseudomonas aeruginosa PA01
aacgccucgcagagcgccagcc

SEQ ID NO: 1491065 - RNA, 14 nt, Pseudomonas aeruginosa PA01
gaccagcagggcca

SEQ ID NO: 1491066 - RNA, 21 nt, Pseudomonas aeruginosa PA01
gaccagcagggccagcagcgc

SEQ ID NO: 1491067 - RNA, 19 nt, Pseudomonas aeruginosa PA01
gaccagcagggugcggaug

SEQ ID NO: 1491068 - RNA, 19 nt, Pseudomonas aeruginosa PA01
gaccaucugccagcucuug

SEQ ID NO: 1491069 - RNA, 16 nt, Pseudomonas aeruginosa PA01
gaccaucuggaucagg

SEQ ID NO: 1491070 - RNA, 15 nt, Pseudomonas aeruginosa PA01
gaccaggguggcggc

SEQ ID NO: 1491071 - RNA, 23 nt, Pseudomonas aeruginosa PA01
gaccaucgucgcuuccggcgcca

SEQ ID NO: 1491072 - RNA, 12 nt, Pseudomonas aeruginosa PA01
gaccaggguggc

SEQ ID NO: 1491073 - RNA, 16 nt, Pseudomonas aeruginosa PA01
gaccagggccgggucg

SEQ ID NO: 1491074 - RNA, 21 nt, Pseudomonas aeruginosa PA01
gaccagggcauccagggucgc

SEQ ID NO: 1491075 - RNA, 16 nt, Pseudomonas aeruginosa PA01
gaccagggcgccgggc

SEQ ID NO: 1491076 - RNA, 19 nt, Pseudomonas aeruginosa PA01
gaccagggcgccgggcugc

SEQ ID NO: 1491077 - RNA, 15 nt, Pseudomonas aeruginosa PA01
gaccagggcgggccg

SEQ ID NO: 1491078 - RNA, 22 nt, Pseudomonas aeruginosa PA01
gaccagggcgggccgcucgcgc

SEQ ID NO: 1491079 - RNA, 14 nt, Pseudomonas aeruginosa PA01
gaccaggcggccgg

SEQ ID NO: 1491080 - RNA, 17 nt, Pseudomonas aeruginosa PA01
gaccaggcggccggugc

SEQ ID NO: 1491081 - RNA, 20 nt, Pseudomonas aeruginosa PA01
gaccaggcggccgucggccu

SEQ ID NO: 1491082 - RNA, 19 nt, Pseudomonas aeruginosa PA01
gaccaggcugaucagcccg

SEQ ID NO: 1491083 - RNA, 12 nt, Pseudomonas aeruginosa PA01
gaccaggccgag

SEQ ID NO: 1491084 - RNA, 13 nt, Pseudomonas aeruginosa PA01
gaccaggccgagc

SEQ ID NO: 1491085 - RNA, 16 nt, Pseudomonas aeruginosa PA01
gaccaggccgagcagg

SEQ ID NO: 1491086 - RNA, 19 nt, Pseudomonas aeruginosa PA01
gaccagcgcaucggcgccu

SEQ ID NO: 1491087 - RNA, 23 nt, Pseudomonas aeruginosa PA01
aacgaugccguuguagcugacca

SEQ ID NO: 1491088 - RNA, 13 nt, Pseudomonas aeruginosa PA01
aacgccauccgcc

SEQ ID NO: 1491089 - RNA, 12 nt, Pseudomonas aeruginosa PA01
aacgccaggcug

SEQ ID NO: 1491090 - RNA, 17 nt, Pseudomonas aeruginosa PA01
gaccacucgcgagaugg

SEQ ID NO: 1491091 - RNA, 20 nt, Pseudomonas aeruginosa PA01
gaccacuucggcgguggggc

SEQ ID NO: 1491092 - RNA, 15 nt, Pseudomonas aeruginosa PA01
gaccagagccgccga

SEQ ID NO: 1491093 - RNA, 16 nt, Pseudomonas aeruginosa PA01
gaccagagccgccgaa

SEQ ID NO: 1491094 - RNA, 18 nt, Pseudomonas aeruginosa PA01
gaccagagccgccgaaca

SEQ ID NO: 1491095 - RNA, 19 nt, Pseudomonas aeruginosa PA01
aacgccgcccccagcgcgc

SEQ ID NO: 1491096 - RNA, 21 nt, Pseudomonas aeruginosa PA01
aacgccgcccccagcgcgccg

SEQ ID NO: 1491097 - RNA, 22 nt, Pseudomonas aeruginosa PA01
aacgccgcccccagcgcgccgc

SEQ ID NO: 1491098 - RNA, 20 nt, Pseudomonas aeruginosa PA01
aacgccgcgaagcccagcgc

SEQ ID NO: 1491099 - RNA, 21 nt, Pseudomonas aeruginosa PA01
aacgccgcgcaccucgaccgc

SEQ ID NO: 1491100 - RNA, 11 nt, Pseudomonas aeruginosa PA01
gaccagcaccg

SEQ ID NO: 1491101 - RNA, 15 nt, Pseudomonas aeruginosa PA01
gaccagcaccgccug

SEQ ID NO: 1491102 - RNA, 17 nt, Pseudomonas aeruginosa PA01
gaccagcaccgccugca

SEQ ID NO: 1491103 - RNA, 18 nt, Pseudomonas aeruginosa PA01
gaccagcaccgccugcaa

SEQ ID NO: 1491104 - RNA, 19 nt, Pseudomonas aeruginosa PA01
gaccagcagcgagcaggcg

SEQ ID NO: 1491105 - RNA, 13 nt, Pseudomonas aeruginosa PA01
gaccagcagcggc

SEQ ID NO: 1491106 - RNA, 15 nt, Pseudomonas aeruginosa PA01
gaccagcagcggcag

SEQ ID NO: 1491107 - RNA, 15 nt, Pseudomonas aeruginosa PA01
gaccagcagcggcuc

SEQ ID NO: 1491108 - RNA, 18 nt, Pseudomonas aeruginosa PA01
gacaugcaggccggccuc

SEQ ID NO: 1491109 - RNA, 17 nt, Pseudomonas aeruginosa PA01
gacaucgucucgcgaca

SEQ ID NO: 1491110 - RNA, 15 nt, Pseudomonas aeruginosa PA01
gacaucuccaggccg

SEQ ID NO: 1491111 - RNA, 17 nt, Pseudomonas aeruginosa PA01
gacaucuccaggccgcu

SEQ ID NO: 1491112 - RNA, 13 nt, Pseudomonas aeruginosa PA01
gaccaccgugcgc

SEQ ID NO: 1491113 - RNA, 17 nt, Pseudomonas aeruginosa PA01
gaccaccgugcgcaccu

SEQ ID NO: 1491114 - RNA, 21 nt, Pseudomonas aeruginosa PA01
gaccaccgugcgcaccucgcc

SEQ ID NO: 1491115 - RNA, 14 nt, Pseudomonas aeruginosa PA01
gaccaccguggcgc

SEQ ID NO: 1491116 - RNA, 18 nt, Pseudomonas aeruginosa PA01
gaccaccguggcgccggc

SEQ ID NO: 1491117 - RNA, 19 nt, Pseudomonas aeruginosa PA01
gaccaccguggcgccggcg

SEQ ID NO: 1491118 - RNA, 13 nt, Pseudomonas aeruginosa PA01
gaccacgccugcc

SEQ ID NO: 1491119 - RNA, 14 nt, Pseudomonas aeruginosa PA01
gacaugcaccaggc

SEQ ID NO: 1491120 - RNA, 18 nt, Pseudomonas aeruginosa PA01
gacaugcaccaggccgcc

SEQ ID NO: 1491121 - RNA, 19 nt, Pseudomonas aeruginosa PA01
gacaugcaccaggccgcca

SEQ ID NO: 1491122 - RNA, 15 nt, Pseudomonas aeruginosa PA01
gaccacccggcugca

SEQ ID NO: 1491123 - RNA, 20 nt, Pseudomonas aeruginosa PA01
gaccacccuguccugcuccu

SEQ ID NO: 1491124 - RNA, 23 nt, Pseudomonas aeruginosa PA01
gaccaccgacggcuccggauggc

SEQ ID NO: 1491125 - RNA, 12 nt, Pseudomonas aeruginosa PA01
gaccaccgccag

SEQ ID NO: 1491126 - RNA, 14 nt, Pseudomonas aeruginosa PA01
gaccaccgccaggc

SEQ ID NO: 1491127 - RNA, 22 nt, Pseudomonas aeruginosa PA01
gaccaccgccaggcuggccacg

SEQ ID NO: 1491128 - RNA, 14 nt, Pseudomonas aeruginosa PA01
gaauggacaggcgc

SEQ ID NO: 1491129 - RNA, 15 nt, Pseudomonas aeruginosa PA01
gaauggacaggcgcc

SEQ ID NO: 1491130 - RNA, 17 nt, Pseudomonas aeruginosa PA01
gaauggacaggcgcccc

SEQ ID NO: 1491131 - RNA, 15 nt, Pseudomonas aeruginosa PA01
gaaugcuugccggcg

SEQ ID NO: 1491132 - RNA, 22 nt, Pseudomonas aeruginosa PA01
gaauggaugcgcggcagcaggc

SEQ ID NO: 1491133 - RNA, 15 nt, Pseudomonas aeruginosa PA01
gaauugcgcacgcaa

SEQ ID NO: 1491134 - RNA, 14 nt, Pseudomonas aeruginosa PA01
gaaugcggcgugga

SEQ ID NO: 1491135 - RNA, 20 nt, Pseudomonas aeruginosa PA01
gaaugcucagcacggcgacg

SEQ ID NO: 1491136 - RNA, 22 nt, Pseudomonas aeruginosa PA01
gaaugcugcccggagcggcugc

SEQ ID NO: 1491137 - RNA, 23 nt, Pseudomonas aeruginosa PA01
gaaugcugcccggagcggcugcc

SEQ ID NO: 1491138 - RNA, 15 nt, Pseudomonas aeruginosa PA01
gaaugcgcaggucgc

SEQ ID NO: 1491139 - RNA, 17 nt, Pseudomonas aeruginosa PA01
gaaugccuucaccggcg

SEQ ID NO: 1491140 - RNA, 19 nt, Pseudomonas aeruginosa PA01
gaaugccuucaccggcgga

SEQ ID NO: 1491141 - RNA, 20 nt, Pseudomonas aeruginosa PA01
gaauuuccugcuggcgagcg

SEQ ID NO: 1491142 - RNA, 16 nt, Pseudomonas aeruginosa PA01
gaauuucacgccgaag

SEQ ID NO: 1491143 - RNA, 22 nt, Pseudomonas aeruginosa PA01
gaauugcugacggcguggcgga

SEQ ID NO: 1491144 - RNA, 18 nt, Pseudomonas aeruginosa PA01
gacaauagcgccacacgg

SEQ ID NO: 1491145 - RNA, 15 nt, Pseudomonas aeruginosa PA01
gacaaucagcggcgg

SEQ ID NO: 1491146 - RNA, 14 nt, Pseudomonas aeruginosa PA01
gacaagcgucgccg

SEQ ID NO: 1491147 - RNA, 22 nt, Pseudomonas aeruginosa PA01
gacaagcgucgccggccgcugu

SEQ ID NO: 1491148 - RNA, 23 nt, Pseudomonas aeruginosa PA01
gacaagcauucagcgcgccccgg

SEQ ID NO: 1491149 - RNA, 18 nt, Pseudomonas aeruginosa PA01
gacaagccuccagcgccg

SEQ ID NO: 1491150 - RNA, 19 nt, Pseudomonas aeruginosa PA01
gacaagccuccagcgccgc

SEQ ID NO: 1491151 - RNA, 12 nt, Pseudomonas aeruginosa PA01
gacaacccugac

SEQ ID NO: 1491152 - RNA, 20 nt, Pseudomonas aeruginosa PA01
gacaacgaaaagagccgcgc

SEQ ID NO: 1491153 - RNA, 21 nt, Pseudomonas aeruginosa PA01
gacaacgaaaagagccgcgcc

SEQ ID NO: 1491154 - RNA, 22 nt, Pseudomonas aeruginosa PA01
gacaacgaaaagagccgcgccu

SEQ ID NO: 1491155 - RNA, 16 nt, Pseudomonas aeruginosa PA01
gacaacgacagccccg

SEQ ID NO: 1491156 - RNA, 18 nt, Pseudomonas aeruginosa PA01
gacaacaggccgggcggc

SEQ ID NO: 1491157 - RNA, 23 nt, Pseudomonas aeruginosa PA01
gaacugcucggcguccagcaggu

SEQ ID NO: 1491158 - RNA, 17 nt, Pseudomonas aeruginosa PA01
gaacuggccagcaccag

SEQ ID NO: 1491159 - RNA, 17 nt, Pseudomonas aeruginosa PA01
gaacucgacgcgccagg

SEQ ID NO: 1491160 - RNA, 17 nt, Pseudomonas aeruginosa PA01
gaacucgaucagcgcgg

SEQ ID NO: 1491161 - RNA, 17 nt, Pseudomonas aeruginosa PA01
gaacugcacgcccaucg

SEQ ID NO: 1491162 - RNA, 22 nt, Pseudomonas aeruginosa PA01
gaacugcacgcccaucgccacc

SEQ ID NO: 1491163 - RNA, 23 nt, Pseudomonas aeruginosa PA01
gaacugcaugucgcugagcggcu

SEQ ID NO: 1491164 - RNA, 21 nt, Pseudomonas aeruginosa PA01
gaacugcagggcaucgaccag

SEQ ID NO: 1491165 - RNA, 19 nt, Pseudomonas aeruginosa PA01
gaacugcagggcgucgccg

SEQ ID NO: 1491166 - RNA, 13 nt, Pseudomonas aeruginosa PA01
gaacugcccgcag

SEQ ID NO: 1491167 - RNA, 15 nt, Pseudomonas aeruginosa PA01
gaacugcccgcaggg

SEQ ID NO: 1491168 - RNA, 15 nt, Pseudomonas aeruginosa PA01
gaacugccgacggcg

SEQ ID NO: 1491169 - RNA, 17 nt, Pseudomonas aeruginosa PA01
gaacugccgacggcggc

SEQ ID NO: 1491170 - RNA, 19 nt, Pseudomonas aeruginosa PA01
gaacugccgacggcggcgg

SEQ ID NO: 1491171 - RNA, 23 nt, Pseudomonas aeruginosa PA01
gaacugccgacggcggcggcgga

SEQ ID NO: 1491172 - RNA, 13 nt, Pseudomonas aeruginosa PA01
gaaguugcgcagc

SEQ ID NO: 1491173 - RNA, 15 nt, Pseudomonas aeruginosa PA01
gaaguugccgccagc

SEQ ID NO: 1491174 - RNA, 18 nt, Pseudomonas aeruginosa PA01
gaaguugccgccgcuggc

SEQ ID NO: 1491175 - RNA, 17 nt, Pseudomonas aeruginosa PA01
gaaguugagcaccggca

SEQ ID NO: 1491176 - RNA, 20 nt, Pseudomonas aeruginosa PA01
gaaguucacguaggagccgg

SEQ ID NO: 1491177 - RNA, 18 nt, Pseudomonas aeruginosa PA01
gaaguucccgccgcucug

SEQ ID NO: 1491178 - RNA, 23 nt, Pseudomonas aeruginosa PA01
gaaguucccgccgcucugcuggc

SEQ ID NO: 1491179 - RNA, 11 nt, Pseudomonas aeruginosa PA01
gaaguggcgga

SEQ ID NO: 1491180 - RNA, 14 nt, Pseudomonas aeruginosa PA01
gaaguggccggugu

SEQ ID NO: 1491181 - RNA, 14 nt, Pseudomonas aeruginosa PA01
gaaguggcagcgcc

SEQ ID NO: 1491182 - RNA, 11 nt, Pseudomonas aeruginosa PA01
gaauaaccgca

SEQ ID NO: 1491183 - RNA, 19 nt, Pseudomonas aeruginosa PA01
gaauaaccgcuugcgguua

SEQ ID NO: 1491184 - RNA, 21 nt, Pseudomonas aeruginosa PA01
gaauaggcgaucuccggcagu

SEQ ID NO: 1491185 - RNA, 17 nt, Pseudomonas aeruginosa PA01
gaauagggcggcgccac

SEQ ID NO: 1491186 - RNA, 20 nt, Pseudomonas aeruginosa PA01
gaauauccucgucgauccgc

SEQ ID NO: 1491187 - RNA, 21 nt, Pseudomonas aeruginosa PA01
gaauccggucggacuccgccc

SEQ ID NO: 1491188 - RNA, 17 nt, Pseudomonas aeruginosa PA01
gaauccuccugagugcg

SEQ ID NO: 1491189 - RNA, 17 nt, Pseudomonas aeruginosa PA01
gaaucgccuaccagacc

SEQ ID NO: 1491190 - RNA, 18 nt, Pseudomonas aeruginosa PA01
gaaucgccuaccagaccg

SEQ ID NO: 1491191 - RNA, 20 nt, Pseudomonas aeruginosa PA01
gaauccuucgcggcggcgcg

SEQ ID NO: 1491192 - RNA, 16 nt, Pseudomonas aeruginosa PA01
gaaucgcacuucguca

SEQ ID NO: 1491193 - RNA, 19 nt, Pseudomonas aeruginosa PA01
gacacgaaaaagccggcgc

SEQ ID NO: 1491194 - RNA, 23 nt, Pseudomonas aeruginosa PA01
gacacgcacucauagcucagcug

SEQ ID NO: 1491195 - RNA, 16 nt, Pseudomonas aeruginosa PA01
gacacgcaggcgccga

SEQ ID NO: 1491196 - RNA, 18 nt, Pseudomonas aeruginosa PA01
gacacgcaggcgccgaug

SEQ ID NO: 1491197 - RNA, 19 nt, Pseudomonas aeruginosa PA01
gacacgcucagccccgauc

SEQ ID NO: 1491198 - RNA, 15 nt, Pseudomonas aeruginosa PA01
gacacguucaggcgu

SEQ ID NO: 1491199 - RNA, 16 nt, Pseudomonas aeruginosa PA01
gacaccgcggugucgg

SEQ ID NO: 1491200 - RNA, 18 nt, Pseudomonas aeruginosa PA01
gacaccugcaacgcccgc

SEQ ID NO: 1491201 - RNA, 19 nt, Pseudomonas aeruginosa PA01
gacaccugcaacgcccgcg

SEQ ID NO: 1491202 - RNA, 16 nt, Pseudomonas aeruginosa PA01
gacaccgaugccgaag

SEQ ID NO: 1491203 - RNA, 13 nt, Pseudomonas aeruginosa PA01
gacaccgccagca

SEQ ID NO: 1491204 - RNA, 17 nt, Pseudomonas aeruginosa PA01
gacaccgaucaccuggc

SEQ ID NO: 1491205 - RNA, 18 nt, Pseudomonas aeruginosa PA01
gacaccgaucaccuggcc

SEQ ID NO: 1491206 - RNA, 22 nt, Pseudomonas aeruginosa PA01
gacaccgaucaccuggccggug

SEQ ID NO: 1491207 - RNA, 22 nt, Pseudomonas aeruginosa PA01
gacaccccgucucgcugccgaa

SEQ ID NO: 1491208 - RNA, 12 nt, Pseudomonas aeruginosa PA01
gacacccugccg

SEQ ID NO: 1491209 - RNA, 14 nt, Pseudomonas aeruginosa PA01
gacacccugccgcg

SEQ ID NO: 1491210 - RNA, 20 nt, Pseudomonas aeruginosa PA01
gacacccugccgcgccggau

SEQ ID NO: 1491211 - RNA, 16 nt, Pseudomonas aeruginosa PA01
gacacccugcugcugc

SEQ ID NO: 1491212 - RNA, 17 nt, Pseudomonas aeruginosa PA01
gacacccugcugcugcu

SEQ ID NO: 1491213 - RNA, 14 nt, Pseudomonas aeruginosa PA01
gacacccgcgccgc

SEQ ID NO: 1491214 - RNA, 21 nt, Pseudomonas aeruginosa PA01
gacacccgcgccgccgcggcc

SEQ ID NO: 1491215 - RNA, 17 nt, Pseudomonas aeruginosa PA01
gacaccaugcuccgccu

SEQ ID NO: 1491216 - RNA, 23 nt, Pseudomonas aeruginosa PA01
gacaccaugcuccgccuggcgga

SEQ ID NO: 1491217 - RNA, 12 nt, Pseudomonas aeruginosa PA01
gacaccaccagg

SEQ ID NO: 1491218 - RNA, 13 nt, Pseudomonas aeruginosa PA01
gacacauggucgg

SEQ ID NO: 1491219 - RNA, 19 nt, Pseudomonas aeruginosa PA01
gacacauggucggccaggu

SEQ ID NO: 1491220 - RNA, 23 nt, Pseudomonas aeruginosa PA01
gacaucaccacgcgauauccgcc

SEQ ID NO: 1491221 - RNA, 17 nt, Pseudomonas aeruginosa PA01
gacauagcgcagcaccg

SEQ ID NO: 1491222 - RNA, 13 nt, Pseudomonas aeruginosa PA01
gacauacuccgcc

SEQ ID NO: 1491223 - RNA, 17 nt, Pseudomonas aeruginosa PA01
gacauccggguccagcg

SEQ ID NO: 1491224 - RNA, 20 nt, Pseudomonas aeruginosa PA01
gacauccggguccagcggcc

SEQ ID NO: 1491225 - RNA, 15 nt, Pseudomonas aeruginosa PA01
gacaucgacgcccuc

SEQ ID NO: 1491226 - RNA, 13 nt, Pseudomonas aeruginosa PA01
gacauccaccagg

SEQ ID NO: 1491227 - RNA, 13 nt, Pseudomonas aeruginosa PA01
aacgacgaggccu

SEQ ID NO: 1491228 - RNA, 19 nt, Pseudomonas aeruginosa PA01
aacgaccgcccaggcugcc

SEQ ID NO: 1491229 - RNA, 18 nt, Pseudomonas aeruginosa PA01
gacagcuugccguccagc

SEQ ID NO: 1491230 - RNA, 17 nt, Pseudomonas aeruginosa PA01
gacaggaaaaagcccgc

SEQ ID NO: 1491231 - RNA, 19 nt, Pseudomonas aeruginosa PA01
gacaggaaaaagcccgcgu

SEQ ID NO: 1491232 - RNA, 12 nt, Pseudomonas aeruginosa PA01
gacaggccagcu

SEQ ID NO: 1491233 - RNA, 18 nt, Pseudomonas aeruginosa PA01
gacaggccagcucgcccg

SEQ ID NO: 1491234 - RNA, 18 nt, Pseudomonas aeruginosa PA01
gacaggccauucuucucc

SEQ ID NO: 1491235 - RNA, 22 nt, Pseudomonas aeruginosa PA01
gacaggcccuugaacaggcugg

SEQ ID NO: 1491236 - RNA, 13 nt, Pseudomonas aeruginosa PA01
gacaggccgccgu

SEQ ID NO: 1491237 - RNA, 20 nt, Pseudomonas aeruginosa PA01
gacaggccggugccgccggc

SEQ ID NO: 1491238 - RNA, 21 nt, Pseudomonas aeruginosa PA01
gacaggccggugccgccggcc

SEQ ID NO: 1491239 - RNA, 23 nt, Pseudomonas aeruginosa PA01
gacaggccggugccgccggccac

SEQ ID NO: 1491240 - RNA, 23 nt, Pseudomonas aeruginosa PA01
gacaggccuccagcaacgccgcc

SEQ ID NO: 1491241 - RNA, 16 nt, Pseudomonas aeruginosa PA01
gacauacaggcgcgcc

SEQ ID NO: 1491242 - RNA, 23 nt, Pseudomonas aeruginosa PA01
gacagcgucguaguggcgcaaca

SEQ ID NO: 1491243 - RNA, 16 nt, Pseudomonas aeruginosa PA01
gacagcucguggcugg

SEQ ID NO: 1491244 - RNA, 14 nt, Pseudomonas aeruginosa PA01
gacagcggcuggcg

SEQ ID NO: 1491245 - RNA, 15 nt, Pseudomonas aeruginosa PA01
gacagcggcuggcgc

SEQ ID NO: 1491246 - RNA, 16 nt, Pseudomonas aeruginosa PA01
gacagcggcuggcgcu

SEQ ID NO: 1491247 - RNA, 16 nt, Pseudomonas aeruginosa PA01
gacagcaggcugccga

SEQ ID NO: 1491248 - RNA, 16 nt, Pseudomonas aeruginosa PA01
gacagcagcgccaggg

SEQ ID NO: 1491249 - RNA, 14 nt, Pseudomonas aeruginosa PA01
gacagcacgauggc

SEQ ID NO: 1491250 - RNA, 21 nt, Pseudomonas aeruginosa PA01
gacagcacgcucaggcagcga

SEQ ID NO: 1491251 - RNA, 22 nt, Pseudomonas aeruginosa PA01
gacagagcggccggcgcggcgc

SEQ ID NO: 1491252 - RNA, 18 nt, Pseudomonas aeruginosa PA01
gacacggauauccgggcc

SEQ ID NO: 1491253 - RNA, 14 nt, Pseudomonas aeruginosa PA01
gacgaugaucacca

SEQ ID NO: 1491254 - RNA, 20 nt, Pseudomonas aeruginosa PA01
aacgguugucgaugcgcccg

SEQ ID NO: 1491255 - RNA, 15 nt, Pseudomonas aeruginosa PA01
gacgaucccggcggu

SEQ ID NO: 1491256 - RNA, 23 nt, Pseudomonas aeruginosa PA01
gacgaucagcuuguggucguggc

SEQ ID NO: 1491257 - RNA, 16 nt, Pseudomonas aeruginosa PA01
gacgaucagcggcccg

SEQ ID NO: 1491258 - RNA, 19 nt, Pseudomonas aeruginosa PA01
gacgaucagcggcccgagc

SEQ ID NO: 1491259 - RNA, 20 nt, Pseudomonas aeruginosa PA01
gacgaucagcggcccgagca

SEQ ID NO: 1491260 - RNA, 15 nt, Pseudomonas aeruginosa PA01
gacgaucacccccag

SEQ ID NO: 1491261 - RNA, 19 nt, Pseudomonas aeruginosa PA01
gacgaucacucccugcucg

SEQ ID NO: 1491262 - RNA, 22 nt, Pseudomonas aeruginosa PA01
gacgaucacucccugcucgcgc

SEQ ID NO: 1491263 - RNA, 15 nt, Pseudomonas aeruginosa PA01
gacgaugaagcccca

SEQ ID NO: 1491264 - RNA, 15 nt, Pseudomonas aeruginosa PA01
gacgagacgccgagg

SEQ ID NO: 1491265 - RNA, 16 nt, Pseudomonas aeruginosa PA01
gacgacugcacgcaga

SEQ ID NO: 1491266 - RNA, 16 nt, Pseudomonas aeruginosa PA01
gacgacgcuggccugc

SEQ ID NO: 1491267 - RNA, 20 nt, Pseudomonas aeruginosa PA01
gacgacgcuggccugccgau

SEQ ID NO: 1491268 - RNA, 17 nt, Pseudomonas aeruginosa PA01
gacgaagcggaagccgg

SEQ ID NO: 1491269 - RNA, 20 nt, Pseudomonas aeruginosa PA01
gacgagcagcucgccggcgu

SEQ ID NO: 1491270 - RNA, 18 nt, Pseudomonas aeruginosa PA01
gacgagauugaugaagcg

SEQ ID NO: 1491271 - RNA, 17 nt, Pseudomonas aeruginosa PA01
gacgagccgcgacgcga

SEQ ID NO: 1491272 - RNA, 18 nt, Pseudomonas aeruginosa PA01
gacgagccggacggcggc

SEQ ID NO: 1491273 - RNA, 19 nt, Pseudomonas aeruginosa PA01
gacgagccggacggcggcg

SEQ ID NO: 1491274 - RNA, 20 nt, Pseudomonas aeruginosa PA01
gacgagccggacggcggcgu

SEQ ID NO: 1491275 - RNA, 15 nt, Pseudomonas aeruginosa PA01
gacgagcguccgccg

SEQ ID NO: 1491276 - RNA, 17 nt, Pseudomonas aeruginosa PA01
gacgaggaaggcgcgca

SEQ ID NO: 1491277 - RNA, 21 nt, Pseudomonas aeruginosa PA01
gacgaggaaggcgcgcaccag

SEQ ID NO: 1491278 - RNA, 16 nt, Pseudomonas aeruginosa PA01
gacgaggacgccgccg

SEQ ID NO: 1491279 - RNA, 17 nt, Pseudomonas aeruginosa PA01
gacgaggacgccgccgg

SEQ ID NO: 1491280 - RNA, 19 nt, Pseudomonas aeruginosa PA01
gacgagguugcucugggca

SEQ ID NO: 1491281 - RNA, 15 nt, Pseudomonas aeruginosa PA01
gacgaggcgcggcgg

SEQ ID NO: 1491282 - RNA, 18 nt, Pseudomonas aeruginosa PA01
gacgaggcgcggcggagg

SEQ ID NO: 1491283 - RNA, 16 nt, Pseudomonas aeruginosa PA01
gacgaggggcugcgga

SEQ ID NO: 1491284 - RNA, 18 nt, Pseudomonas aeruginosa PA01
gacgaggauggucaggcc

SEQ ID NO: 1491285 - RNA, 14 nt, Pseudomonas aeruginosa PA01
gaccggcgcgccuu

SEQ ID NO: 1491286 - RNA, 16 nt, Pseudomonas aeruginosa PA01
aacggcaggccagcag

SEQ ID NO: 1491287 - RNA, 16 nt, Pseudomonas aeruginosa PA01
gaccggcgccccugcg

SEQ ID NO: 1491288 - RNA, 21 nt, Pseudomonas aeruginosa PA01
gaccggcgccccugcggcgcc

SEQ ID NO: 1491289 - RNA, 15 nt, Pseudomonas aeruginosa PA01
gaccggcgccgggau

SEQ ID NO: 1491290 - RNA, 19 nt, Pseudomonas aeruginosa PA01
gaccugcaauuccaccggc

SEQ ID NO: 1491291 - RNA, 22 nt, Pseudomonas aeruginosa PA01
gaccugcaauuccaccggcugg

SEQ ID NO: 1491292 - RNA, 24 nt, Pseudomonas aeruginosa PA01
gaccugcaauuccaccggcuggcc

SEQ ID NO: 1491293 - RNA, 14 nt, Pseudomonas aeruginosa PA01
gaccugcagcagga

SEQ ID NO: 1491294 - RNA, 19 nt, Pseudomonas aeruginosa PA01
gaccugcagcgccucgugg

SEQ ID NO: 1491295 - RNA, 14 nt, Pseudomonas aeruginosa PA01
gaccugccgcccgg

SEQ ID NO: 1491296 - RNA, 22 nt, Pseudomonas aeruginosa PA01
gaccugccgcccggccaggcca

SEQ ID NO: 1491297 - RNA, 17 nt, Pseudomonas aeruginosa PA01
gaccugcgaggcgucga

SEQ ID NO: 1491298 - RNA, 14 nt, Pseudomonas aeruginosa PA01
gaccugcggggcgg

SEQ ID NO: 1491299 - RNA, 21 nt, Pseudomonas aeruginosa PA01
gaccugcucgucgaugcugcc

SEQ ID NO: 1491300 - RNA, 22 nt, Pseudomonas aeruginosa PA01
gaccuguucgaaguucuccagc

SEQ ID NO: 1491301 - RNA, 22 nt, Pseudomonas aeruginosa PA01
gaccuguucgcgcccgucgucg

SEQ ID NO: 1491302 - RNA, 19 nt, Pseudomonas aeruginosa PA01
gaccuguugcagagcggcc

SEQ ID NO: 1491303 - RNA, 21 nt, Pseudomonas aeruginosa PA01
gaccuguugcagagcggccag

SEQ ID NO: 1491304 - RNA, 16 nt, Pseudomonas aeruginosa PA01
gaccuggucguugcgc

SEQ ID NO: 1491305 - RNA, 15 nt, Pseudomonas aeruginosa PA01
gaccugguggcgccg

SEQ ID NO: 1491306 - RNA, 17 nt, Pseudomonas aeruginosa PA01
gaccuucagcgggucga

SEQ ID NO: 1491307 - RNA, 23 nt, Pseudomonas aeruginosa PA01
gaccuucgaggugucguccaucg

SEQ ID NO: 1491308 - RNA, 17 nt, Pseudomonas aeruginosa PA01
gaccuuccugccagcgc

SEQ ID NO: 1491309 - RNA, 16 nt, Pseudomonas aeruginosa PA01
gaccuuccgccagcag

SEQ ID NO: 1491310 - RNA, 19 nt, Pseudomonas aeruginosa PA01
gaccuuccgccagcaggcg

SEQ ID NO: 1491311 - RNA, 17 nt, Pseudomonas aeruginosa PA01
gaccuugcccucggcgc

SEQ ID NO: 1491312 - RNA, 19 nt, Pseudomonas aeruginosa PA01
gaccuugcccucggcgccc

SEQ ID NO: 1491313 - RNA, 14 nt, Pseudomonas aeruginosa PA01
gaccuugcccuuga

SEQ ID NO: 1491314 - RNA, 16 nt, Pseudomonas aeruginosa PA01
gaccuugccgacgccg

SEQ ID NO: 1491315 - RNA, 13 nt, Pseudomonas aeruginosa PA01
gaccuugcggccg

SEQ ID NO: 1491316 - RNA, 13 nt, Pseudomonas aeruginosa PA01
gaccuugccgccg

SEQ ID NO: 1491317 - RNA, 20 nt, Pseudomonas aeruginosa PA01
gaccuugcgcaccagggcca

SEQ ID NO: 1491318 - RNA, 17 nt, Pseudomonas aeruginosa PA01
gaccuucuccgaccagg

SEQ ID NO: 1491319 - RNA, 20 nt, Pseudomonas aeruginosa PA01
gaccuugacgaagccggcga

SEQ ID NO: 1491320 - RNA, 19 nt, Pseudomonas aeruginosa PA01
gaccuucugcaccgugcgc

SEQ ID NO: 1491321 - RNA, 13 nt, Pseudomonas aeruginosa PA01
gaccuuggccagc

SEQ ID NO: 1491322 - RNA, 19 nt, Pseudomonas aeruginosa PA01
gaccuugcgucuucgccga

SEQ ID NO: 1491323 - RNA, 14 nt, Pseudomonas aeruginosa PA01
gacgaagucgccgg

SEQ ID NO: 1491324 - RNA, 23 nt, Pseudomonas aeruginosa PA01
gacgaagugaccgcgcgccaugg

SEQ ID NO: 1491325 - RNA, 20 nt, Pseudomonas aeruginosa PA01
gacgaaguuggcggccgacg

SEQ ID NO: 1491326 - RNA, 14 nt, Pseudomonas aeruginosa PA01
gacgaaggccgcgg

SEQ ID NO: 1491327 - RNA, 14 nt, Pseudomonas aeruginosa PA01
gacgaaggccuccu

SEQ ID NO: 1491328 - RNA, 17 nt, Pseudomonas aeruginosa PA01
gacgaagggcucagccc

SEQ ID NO: 1491329 - RNA, 18 nt, Pseudomonas aeruginosa PA01
gacgaagggcucagccca

SEQ ID NO: 1491330 - RNA, 19 nt, Pseudomonas aeruginosa PA01
gacgaagggcucagcccag

SEQ ID NO: 1491331 - RNA, 20 nt, Pseudomonas aeruginosa PA01
gacgaagggcucagcccagg

SEQ ID NO: 1491332 - RNA, 21 nt, Pseudomonas aeruginosa PA01
gacgaagggcucagcccaggc

SEQ ID NO: 1491333 - RNA, 15 nt, Pseudomonas aeruginosa PA01
gacgaaggucggcgg

SEQ ID NO: 1491334 - RNA, 15 nt, Pseudomonas aeruginosa PA01
gaccuuguccaggcg

SEQ ID NO: 1491335 - RNA, 14 nt, Pseudomonas aeruginosa PA01
gacgaacucgacgc

SEQ ID NO: 1491336 - RNA, 17 nt, Pseudomonas aeruginosa PA01
gacgaacucgacgcgcc

SEQ ID NO: 1491337 - RNA, 19 nt, Pseudomonas aeruginosa PA01
gacgaacucgacgcgccag

SEQ ID NO: 1491338 - RNA, 14 nt, Pseudomonas aeruginosa PA01
gacgaagcccaggc

SEQ ID NO: 1491339 - RNA, 15 nt, Pseudomonas aeruginosa PA01
gacgaagcccaggcu

SEQ ID NO: 1491340 - RNA, 12 nt, Pseudomonas aeruginosa PA01
gacgaagcccuc

SEQ ID NO: 1491341 - RNA, 19 nt, Pseudomonas aeruginosa PA01
gacgaagcccucgcgacgg

SEQ ID NO: 1491342 - RNA, 16 nt, Pseudomonas aeruginosa PA01
gacgacgaaagaagcc

SEQ ID NO: 1491343 - RNA, 13 nt, Pseudomonas aeruginosa PA01
gacgacgaaaggc

SEQ ID NO: 1491344 - RNA, 16 nt, Pseudomonas aeruginosa PA01
gacgacgaaaggccgc

SEQ ID NO: 1491345 - RNA, 19 nt, Pseudomonas aeruginosa PA01
gacgacgaaaggccgcgcc

SEQ ID NO: 1491346 - RNA, 20 nt, Pseudomonas aeruginosa PA01
gacgacgaaaggccgcgccg

SEQ ID NO: 1491347 - RNA, 21 nt, Pseudomonas aeruginosa PA01
gacgacgaaaggccgcgccgg

SEQ ID NO: 1491348 - RNA, 13 nt, Pseudomonas aeruginosa PA01
gacgacgaacgcc

SEQ ID NO: 1491349 - RNA, 22 nt, Pseudomonas aeruginosa PA01
gacgacgaagugaccgcgcgcc

SEQ ID NO: 1491350 - RNA, 14 nt, Pseudomonas aeruginosa PA01
gacgcagagcgcca

SEQ ID NO: 1491351 - RNA, 22 nt, Pseudomonas aeruginosa PA01
gacgcagccguuggccagcagg

SEQ ID NO: 1491352 - RNA, 13 nt, Pseudomonas aeruginosa PA01
gacgcaggcaggu

SEQ ID NO: 1491353 - RNA, 13 nt, Pseudomonas aeruginosa PA01
gacgcagcgcgcg

SEQ ID NO: 1491354 - RNA, 15 nt, Pseudomonas aeruginosa PA01
gacgcagcgcgcgcc

SEQ ID NO: 1491355 - RNA, 20 nt, Pseudomonas aeruginosa PA01
gacgcagcgcgcgccgagca

SEQ ID NO: 1491356 - RNA, 19 nt, Pseudomonas aeruginosa PA01
gacgcagcgcgcgucggcg

SEQ ID NO: 1491357 - RNA, 16 nt, Pseudomonas aeruginosa PA01
gacgcagggcggcgcc

SEQ ID NO: 1491358 - RNA, 17 nt, Pseudomonas aeruginosa PA01
gacgcagggcggcgccu

SEQ ID NO: 1491359 - RNA, 18 nt, Pseudomonas aeruginosa PA01
gacgcaggccgaccucgg

SEQ ID NO: 1491360 - RNA, 21 nt, Pseudomonas aeruginosa PA01
gacgcaggccgaccucggcgg

SEQ ID NO: 1491361 - RNA, 23 nt, Pseudomonas aeruginosa PA01
gacgcaggccgaccucggcgguc

SEQ ID NO: 1491362 - RNA, 14 nt, Pseudomonas aeruginosa PA01
gacgcauaaccgcu

SEQ ID NO: 1491363 - RNA, 15 nt, Pseudomonas aeruginosa PA01
gacgccaccagccag

SEQ ID NO: 1491364 - RNA, 17 nt, Pseudomonas aeruginosa PA01
gacgccaccagccaggc

SEQ ID NO: 1491365 - RNA, 20 nt, Pseudomonas aeruginosa PA01
gacgccaccagccaggcggc

SEQ ID NO: 1491366 - RNA, 22 nt, Pseudomonas aeruginosa PA01
gacgccaccagccaggcggcca

SEQ ID NO: 1491367 - RNA, 23 nt, Pseudomonas aeruginosa PA01
gacgccaccagccaggcggccac

SEQ ID NO: 1491368 - RNA, 13 nt, Pseudomonas aeruginosa PA01
gacgccaccaggc

SEQ ID NO: 1491369 - RNA, 15 nt, Pseudomonas aeruginosa PA01
gacgccaccaggccg

SEQ ID NO: 1491370 - RNA, 19 nt, Pseudomonas aeruginosa PA01
gacgccaccaggccgcugc

SEQ ID NO: 1491371 - RNA, 20 nt, Pseudomonas aeruginosa PA01
gacgccauucaggcggauca

SEQ ID NO: 1491372 - RNA, 14 nt, Pseudomonas aeruginosa PA01
gacgccaggcgucc

SEQ ID NO: 1491373 - RNA, 20 nt, Pseudomonas aeruginosa PA01
gacgcccauguagaccacca

SEQ ID NO: 1491374 - RNA, 14 nt, Pseudomonas aeruginosa PA01
gacgcccagcaggg

SEQ ID NO: 1491375 - RNA, 17 nt, Pseudomonas aeruginosa PA01
gacgcccagcagggcca

SEQ ID NO: 1491376 - RNA, 17 nt, Pseudomonas aeruginosa PA01
gacgccagcucggccgg

SEQ ID NO: 1491377 - RNA, 21 nt, Pseudomonas aeruginosa PA01
gacgccagcucggccggcagg

SEQ ID NO: 1491378 - RNA, 17 nt, Pseudomonas aeruginosa PA01
gacgccagcggcgaucg

SEQ ID NO: 1491379 - RNA, 15 nt, Pseudomonas aeruginosa PA01
gacgcaccgagggca

SEQ ID NO: 1491380 - RNA, 16 nt, Pseudomonas aeruginosa PA01
gacgcaccagcaggcc

SEQ ID NO: 1491381 - RNA, 18 nt, Pseudomonas aeruginosa PA01
gacgcaccagcaggccga

SEQ ID NO: 1491382 - RNA, 21 nt, Pseudomonas aeruginosa PA01
gacgcaccagcaggccgauca

SEQ ID NO: 1491383 - RNA, 23 nt, Pseudomonas aeruginosa PA01
gacgcacaccgucgaaccagccg

SEQ ID NO: 1491384 - RNA, 21 nt, Pseudomonas aeruginosa PA01
gacgcaagcgcucggccugcg

SEQ ID NO: 1491385 - RNA, 23 nt, Pseudomonas aeruginosa PA01
gacgauguucgaggcgccgacca

SEQ ID NO: 1491386 - RNA, 19 nt, Pseudomonas aeruginosa PA01
gacgcaaacgccauccgcc

SEQ ID NO: 1491387 - RNA, 21 nt, Pseudomonas aeruginosa PA01
gacgauugaccucccgcgcca

SEQ ID NO: 1491388 - RNA, 23 nt, Pseudomonas aeruginosa PA01
gacgauugaccucccgcgccagc

SEQ ID NO: 1491389 - RNA, 17 nt, Pseudomonas aeruginosa PA01
gacgaugcggcccgccg

SEQ ID NO: 1491390 - RNA, 18 nt, Pseudomonas aeruginosa PA01
gacgaugcggcccgccgg

SEQ ID NO: 1491391 - RNA, 16 nt, Pseudomonas aeruginosa PA01
gacgaugcagggcugc

SEQ ID NO: 1491392 - RNA, 20 nt, Pseudomonas aeruginosa PA01
gacgaugccgaucucgccca

SEQ ID NO: 1491393 - RNA, 23 nt, Pseudomonas aeruginosa PA01
gacgaugccguucucggugacca

SEQ ID NO: 1491394 - RNA, 20 nt, Pseudomonas aeruginosa PA01
gacgauggccagcccggagc

SEQ ID NO: 1491395 - RNA, 13 nt, Pseudomonas aeruginosa PA01
gacgauggcccag

SEQ ID NO: 1491396 - RNA, 15 nt, Pseudomonas aeruginosa PA01
gacgauggcccagau

SEQ ID NO: 1491397 - RNA, 23 nt, Pseudomonas aeruginosa PA01
gacgaugcucgguugccaggccg

SEQ ID NO: 1491398 - RNA, 14 nt, Pseudomonas aeruginosa PA01
gacgauggccgccg

SEQ ID NO: 1491399 - RNA, 13 nt, Pseudomonas aeruginosa PA01
gacgauggccgcc

SEQ ID NO: 1491400 - RNA, 13 nt, Pseudomonas aeruginosa PA01
gacgauggcgacg

SEQ ID NO: 1491401 - RNA, 12 nt, Pseudomonas aeruginosa PA01
gacgauggcgcc

SEQ ID NO: 1491402 - RNA, 14 nt, Pseudomonas aeruginosa PA01
gacgauggcgccau

SEQ ID NO: 1491403 - RNA, 19 nt, Pseudomonas aeruginosa PA01
gacgaugggcacgaucugc

SEQ ID NO: 1491404 - RNA, 15 nt, Pseudomonas aeruginosa PA01
gacgauggccgccgc

SEQ ID NO: 1491405 - RNA, 17 nt, Pseudomonas aeruginosa PA01
gacgauggccgccgccg

SEQ ID NO: 1491406 - RNA, 12 nt, Pseudomonas aeruginosa PA01
gacgauggucgc

SEQ ID NO: 1491407 - RNA, 23 nt, Pseudomonas aeruginosa PA01
gacgauggucgccgcgaccucgu

SEQ ID NO: 1491408 - RNA, 14 nt, Pseudomonas aeruginosa PA01
gacgccauggcgcu

SEQ ID NO: 1491409 - RNA, 16 nt, Pseudomonas aeruginosa PA01
gacgcccuccagcacc

SEQ ID NO: 1491410 - RNA, 17 nt, Pseudomonas aeruginosa PA01
gacgcccuccagcaccg

SEQ ID NO: 1491411 - RNA, 23 nt, Pseudomonas aeruginosa PA01
gacgcccgcuugcgccgccucgc

SEQ ID NO: 1491412 - RNA, 13 nt, Pseudomonas aeruginosa PA01
gacgcccucggcg

SEQ ID NO: 1491413 - RNA, 17 nt, Pseudomonas aeruginosa PA01
gacgcccucggcgacga

SEQ ID NO: 1491414 - RNA, 19 nt, Pseudomonas aeruginosa PA01
gacgccgaaacgccgacgg

SEQ ID NO: 1491415 - RNA, 16 nt, Pseudomonas aeruginosa PA01
gacgcccuggcgcuug

SEQ ID NO: 1491416 - RNA, 13 nt, Pseudomonas aeruginosa PA01
gacgcccugggcg

SEQ ID NO: 1491417 - RNA, 16 nt, Pseudomonas aeruginosa PA01
gacgcccugggcgacg

SEQ ID NO: 1491418 - RNA, 18 nt, Pseudomonas aeruginosa PA01
gacgccgaagccgcuggc

SEQ ID NO: 1491419 - RNA, 19 nt, Pseudomonas aeruginosa PA01
gacgcccuugcggcgcggc

SEQ ID NO: 1491420 - RNA, 16 nt, Pseudomonas aeruginosa PA01
gacgccgaacccgccu

SEQ ID NO: 1491421 - RNA, 16 nt, Pseudomonas aeruginosa PA01
gacgccgaacgcccca

SEQ ID NO: 1491422 - RNA, 15 nt, Pseudomonas aeruginosa PA01
gacgccgccugcgcc

SEQ ID NO: 1491423 - RNA, 16 nt, Pseudomonas aeruginosa PA01
gacgccgccugcgccu

SEQ ID NO: 1491424 - RNA, 14 nt, Pseudomonas aeruginosa PA01
gacgccgcgauggc

SEQ ID NO: 1491425 - RNA, 15 nt, Pseudomonas aeruginosa PA01
gacgccgcggccggc

SEQ ID NO: 1491426 - RNA, 18 nt, Pseudomonas aeruginosa PA01
gacgccgcggccggcgac

SEQ ID NO: 1491427 - RNA, 19 nt, Pseudomonas aeruginosa PA01
gacgccgcggccggcgacc

SEQ ID NO: 1491428 - RNA, 13 nt, Pseudomonas aeruginosa PA01
gacgccgcgcugc

SEQ ID NO: 1491429 - RNA, 14 nt, Pseudomonas aeruginosa PA01
gacgccgcgcugca

SEQ ID NO: 1491430 - RNA, 17 nt, Pseudomonas aeruginosa PA01
gacgccgcgcugcaagg

SEQ ID NO: 1491431 - RNA, 14 nt, Pseudomonas aeruginosa PA01
gacgccgccgagca

SEQ ID NO: 1491432 - RNA, 13 nt, Pseudomonas aeruginosa PA01
gacgccgaugcuc

SEQ ID NO: 1491433 - RNA, 17 nt, Pseudomonas aeruginosa PA01
gacgccgagccagccgc

SEQ ID NO: 1491434 - RNA, 20 nt, Pseudomonas aeruginosa PA01
gacgccgagccagccgcgga

SEQ ID NO: 1491435 - RNA, 21 nt, Pseudomonas aeruginosa PA01
gacgccgagcugaccaccagg

SEQ ID NO: 1491436 - RNA, 22 nt, Pseudomonas aeruginosa PA01
gacgccgagcugaccaccaggg

SEQ ID NO: 1491437 - RNA, 19 nt, Pseudomonas aeruginosa PA01
gacgccgaggagacgcggc

SEQ ID NO: 1491438 - RNA, 16 nt, Pseudomonas aeruginosa PA01
gacgccgagcagcacc

SEQ ID NO: 1491439 - RNA, 17 nt, Pseudomonas aeruginosa PA01
gacgccgagcagcacca

SEQ ID NO: 1491440 - RNA, 14 nt, Pseudomonas aeruginosa PA01
gacgccuucguggc

SEQ ID NO: 1491441 - RNA, 18 nt, Pseudomonas aeruginosa PA01
gacgccuucguggccgcg

SEQ ID NO: 1491442 - RNA, 19 nt, Pseudomonas aeruginosa PA01
gacgccuugcccggcgcgu

SEQ ID NO: 1491443 - RNA, 16 nt, Pseudomonas aeruginosa PA01
gacgccugucggcacg

SEQ ID NO: 1491444 - RNA, 14 nt, Pseudomonas aeruginosa PA01
gacgccuggcgucc

SEQ ID NO: 1491445 - RNA, 18 nt, Pseudomonas aeruginosa PA01
gacgccuggcgucccguu

SEQ ID NO: 1491446 - RNA, 17 nt, Pseudomonas aeruginosa PA01
gacgccucccaccgcgc

SEQ ID NO: 1491447 - RNA, 14 nt, Pseudomonas aeruginosa PA01
gacgccucgucgga

SEQ ID NO: 1491448 - RNA, 15 nt, Pseudomonas aeruginosa PA01
gacgccucggcgcga

SEQ ID NO: 1491449 - RNA, 16 nt, Pseudomonas aeruginosa PA01
gacgccucggcgcgau

SEQ ID NO: 1491450 - RNA, 22 nt, Pseudomonas aeruginosa PA01
gacgccucggcgcgauccuccg

SEQ ID NO: 1491451 - RNA, 16 nt, Pseudomonas aeruginosa PA01
gacgccggugacccac

SEQ ID NO: 1491452 - RNA, 14 nt, Pseudomonas aeruginosa PA01
gacgccguccacca

SEQ ID NO: 1491453 - RNA, 16 nt, Pseudomonas aeruginosa PA01
gacgccguccaccagc

SEQ ID NO: 1491454 - RNA, 20 nt, Pseudomonas aeruginosa PA01
gacgccguccaccagccagc

SEQ ID NO: 1491455 - RNA, 14 nt, Pseudomonas aeruginosa PA01
gacgccgcuggcgg

SEQ ID NO: 1491456 - RNA, 15 nt, Pseudomonas aeruginosa PA01
gacgccgcuggcggc

SEQ ID NO: 1491457 - RNA, 20 nt, Pseudomonas aeruginosa PA01
gacgccgcuggcggcgcuca

SEQ ID NO: 1491458 - RNA, 11 nt, Pseudomonas aeruginosa PA01
gacgccggacg

SEQ ID NO: 1491459 - RNA, 22 nt, Pseudomonas aeruginosa PA01
gacgccggacgcaccagcaggc

SEQ ID NO: 1491460 - RNA, 14 nt, Pseudomonas aeruginosa PA01
gacgccggcuucca

SEQ ID NO: 1491461 - RNA, 18 nt, Pseudomonas aeruginosa PA01
gacggcuugaucacgccg

SEQ ID NO: 1491462 - RNA, 17 nt, Pseudomonas aeruginosa PA01
gacgggaagcgaaccag

SEQ ID NO: 1491463 - RNA, 17 nt, Pseudomonas aeruginosa PA01
gacgggccgcgccgcaa

SEQ ID NO: 1491464 - RNA, 19 nt, Pseudomonas aeruginosa PA01
gacgggcgguaugccggag

SEQ ID NO: 1491465 - RNA, 15 nt, Pseudomonas aeruginosa PA01
gacgggcgaagacga

SEQ ID NO: 1491466 - RNA, 15 nt, Pseudomonas aeruginosa PA01
gacggucagcaggcc

SEQ ID NO: 1491467 - RNA, 19 nt, Pseudomonas aeruginosa PA01
gacggguucuucucgucga

SEQ ID NO: 1491468 - RNA, 13 nt, Pseudomonas aeruginosa PA01
gacggugcggccg

SEQ ID NO: 1491469 - RNA, 14 nt, Pseudomonas aeruginosa PA01
gacgguucagcagc

SEQ ID NO: 1491470 - RNA, 15 nt, Pseudomonas aeruginosa PA01
gacgguucagcagcg

SEQ ID NO: 1491471 - RNA, 17 nt, Pseudomonas aeruginosa PA01
gacgguucagcagcggc

SEQ ID NO: 1491472 - RNA, 16 nt, Pseudomonas aeruginosa PA01
gacgguucccagaaaa

SEQ ID NO: 1491473 - RNA, 14 nt, Pseudomonas aeruginosa PA01
gacgguuucaggcc

SEQ ID NO: 1491474 - RNA, 17 nt, Pseudomonas aeruginosa PA01
gacggucggcagguggg

SEQ ID NO: 1491475 - RNA, 15 nt, Pseudomonas aeruginosa PA01
gacggucugccagcu

SEQ ID NO: 1491476 - RNA, 20 nt, Pseudomonas aeruginosa PA01
gacggucugccagcucuggc

SEQ ID NO: 1491477 - RNA, 14 nt, Pseudomonas aeruginosa PA01
gacggucucgccgc

SEQ ID NO: 1491478 - RNA, 17 nt, Pseudomonas aeruginosa PA01
gacggucucgccgccga

SEQ ID NO: 1491479 - RNA, 19 nt, Pseudomonas aeruginosa PA01
gacggucucgccgccgagc

SEQ ID NO: 1491480 - RNA, 21 nt, Pseudomonas aeruginosa PA01
gacggucaggccgagcagcgc

SEQ ID NO: 1491481 - RNA, 21 nt, Pseudomonas aeruginosa PA01
gacggugaccuugucgcgguu

SEQ ID NO: 1491482 - RNA, 18 nt, Pseudomonas aeruginosa PA01
gacggugcaggccgacgu

SEQ ID NO: 1491483 - RNA, 18 nt, Pseudomonas aeruginosa PA01
gacggugauagagcacgc

SEQ ID NO: 1491484 - RNA, 14 nt, Pseudomonas aeruginosa PA01
gacggugaucgccg

SEQ ID NO: 1491485 - RNA, 14 nt, Pseudomonas aeruginosa PA01
gacggcggccgcca

SEQ ID NO: 1491486 - RNA, 17 nt, Pseudomonas aeruginosa PA01
gacggcggaaggcggcg

SEQ ID NO: 1491487 - RNA, 18 nt, Pseudomonas aeruginosa PA01
gacggcggcggcggaccu

SEQ ID NO: 1491488 - RNA, 18 nt, Pseudomonas aeruginosa PA01
gacggcugcccaacuggc

SEQ ID NO: 1491489 - RNA, 15 nt, Pseudomonas aeruginosa PA01
gacggcugaggcugg

SEQ ID NO: 1491490 - RNA, 16 nt, Pseudomonas aeruginosa PA01
gacggcugaggcuggc

SEQ ID NO: 1491491 - RNA, 18 nt, Pseudomonas aeruginosa PA01
gacggcugaggcuggcga

SEQ ID NO: 1491492 - RNA, 23 nt, Pseudomonas aeruginosa PA01
gacggcugaggcuggcgaccggg

SEQ ID NO: 1491493 - RNA, 21 nt, Pseudomonas aeruginosa PA01
gacggcuucgaccacgacccg

SEQ ID NO: 1491494 - RNA, 22 nt, Pseudomonas aeruginosa PA01
gacggcuucgaccacgacccgg

SEQ ID NO: 1491495 - RNA, 16 nt, Pseudomonas aeruginosa PA01
gacggcucuggaugcg

SEQ ID NO: 1491496 - RNA, 18 nt, Pseudomonas aeruginosa PA01
gacggcucuggaugcggc

SEQ ID NO: 1491497 - RNA, 12 nt, Pseudomonas aeruginosa PA01
gacggcucuucc

SEQ ID NO: 1491498 - RNA, 23 nt, Pseudomonas aeruginosa PA01
gacggcucuuccccuaccggcaa

SEQ ID NO: 1491499 - RNA, 20 nt, Pseudomonas aeruginosa PA01
gacggcucgcgcagcggcgc

SEQ ID NO: 1491500 - RNA, 22 nt, Pseudomonas aeruginosa PA01
gacggcucgcgcagcggcgcgu

SEQ ID NO: 1491501 - RNA, 12 nt, Pseudomonas aeruginosa PA01
gacggcgugcag

SEQ ID NO: 1491502 - RNA, 16 nt, Pseudomonas aeruginosa PA01
gacggcgugccguggc

SEQ ID NO: 1491503 - RNA, 23 nt, Pseudomonas aeruginosa PA01
gacggcguggucgaugcccaccu

SEQ ID NO: 1491504 - RNA, 15 nt, Pseudomonas aeruginosa PA01
gacggcgccgaugcc

SEQ ID NO: 1491505 - RNA, 17 nt, Pseudomonas aeruginosa PA01
gacggcgcaagggcgcc

SEQ ID NO: 1491506 - RNA, 18 nt, Pseudomonas aeruginosa PA01
gacggcgcaagggcgccg

SEQ ID NO: 1491507 - RNA, 16 nt, Pseudomonas aeruginosa PA01
aacgucuucaggcgcu

SEQ ID NO: 1491508 - RNA, 14 nt, Pseudomonas aeruginosa PA01
gacggccugcgccc

SEQ ID NO: 1491509 - RNA, 18 nt, Pseudomonas aeruginosa PA01
aacguccucgaugcccgc

SEQ ID NO: 1491510 - RNA, 15 nt, Pseudomonas aeruginosa PA01
gacggaacgucggcc

SEQ ID NO: 1491511 - RNA, 16 nt, Pseudomonas aeruginosa PA01
gacggaagcauggccg

SEQ ID NO: 1491512 - RNA, 15 nt, Pseudomonas aeruginosa PA01
gacggaagcccucga

SEQ ID NO: 1491513 - RNA, 21 nt, Pseudomonas aeruginosa PA01
gacgcugcucgacggcaccag

SEQ ID NO: 1491514 - RNA, 19 nt, Pseudomonas aeruginosa PA01
gacgcugucguggacgccg

SEQ ID NO: 1491515 - RNA, 16 nt, Pseudomonas aeruginosa PA01
gacgcuggcggugcgg

SEQ ID NO: 1491516 - RNA, 22 nt, Pseudomonas aeruginosa PA01
gacgcugggcugggucggcugg

SEQ ID NO: 1491517 - RNA, 17 nt, Pseudomonas aeruginosa PA01
gacgcugaugaugccgc

SEQ ID NO: 1491518 - RNA, 22 nt, Pseudomonas aeruginosa PA01
gacgcugaugaugccgcggcga

SEQ ID NO: 1491519 - RNA, 14 nt, Pseudomonas aeruginosa PA01
gacgcuccugcgcc

SEQ ID NO: 1491520 - RNA, 17 nt, Pseudomonas aeruginosa PA01
gacgcucugcucggcca

SEQ ID NO: 1491521 - RNA, 18 nt, Pseudomonas aeruginosa PA01
gacgcucugcucggccag

SEQ ID NO: 1491522 - RNA, 17 nt, Pseudomonas aeruginosa PA01
gacgcugcccagcccgc

SEQ ID NO: 1491523 - RNA, 13 nt, Pseudomonas aeruginosa PA01
gacgcugccgagg

SEQ ID NO: 1491524 - RNA, 22 nt, Pseudomonas aeruginosa PA01
gacgcugccgaggaacucgcgg

SEQ ID NO: 1491525 - RNA, 18 nt, Pseudomonas aeruginosa PA01
gacgcugcaugcggaaca

SEQ ID NO: 1491526 - RNA, 17 nt, Pseudomonas aeruginosa PA01
gacgcugaugccggcga

SEQ ID NO: 1491527 - RNA, 20 nt, Pseudomonas aeruginosa PA01
gacgcugaugccggcgaacu

SEQ ID NO: 1491528 - RNA, 16 nt, Pseudomonas aeruginosa PA01
gacgcugcaccgcggc

SEQ ID NO: 1491529 - RNA, 18 nt, Pseudomonas aeruginosa PA01
gacgcugcaccgcggcgc

SEQ ID NO: 1491530 - RNA, 21 nt, Pseudomonas aeruginosa PA01
gacgcugcaccgcggcgcgga

SEQ ID NO: 1491531 - RNA, 19 nt, Pseudomonas aeruginosa PA01
gacgcugcgaccuggcgcc

SEQ ID NO: 1491532 - RNA, 20 nt, Pseudomonas aeruginosa PA01
gacgcugcgaccuggcgccg

SEQ ID NO: 1491533 - RNA, 13 nt, Pseudomonas aeruginosa PA01
gacgcuggcgaag

SEQ ID NO: 1491534 - RNA, 22 nt, Pseudomonas aeruginosa PA01
gacgcuggcgaucaugccuucg

SEQ ID NO: 1491535 - RNA, 16 nt, Pseudomonas aeruginosa PA01
gacggauacgccaggu

SEQ ID NO: 1491536 - RNA, 21 nt, Pseudomonas aeruginosa PA01
gacggaucacggugccauccg

SEQ ID NO: 1491537 - RNA, 19 nt, Pseudomonas aeruginosa PA01
gacggauaacggcagccgc

SEQ ID NO: 1491538 - RNA, 22 nt, Pseudomonas aeruginosa PA01
gacggcaaggaccugcugcccg

SEQ ID NO: 1491539 - RNA, 19 nt, Pseudomonas aeruginosa PA01
gacggcagggucagccgau

SEQ ID NO: 1491540 - RNA, 16 nt, Pseudomonas aeruginosa PA01
gacggcacgacgccgg

SEQ ID NO: 1491541 - RNA, 17 nt, Pseudomonas aeruginosa PA01
gacggcacgacgccggu

SEQ ID NO: 1491542 - RNA, 15 nt, Pseudomonas aeruginosa PA01
gacggcacggggcgc

SEQ ID NO: 1491543 - RNA, 13 nt, Pseudomonas aeruginosa PA01
gacggcagccugg

SEQ ID NO: 1491544 - RNA, 20 nt, Pseudomonas aeruginosa PA01
gacggcauuccugguccagc

SEQ ID NO: 1491545 - RNA, 18 nt, Pseudomonas aeruginosa PA01
gacggcccuccggcgcgu

SEQ ID NO: 1491546 - RNA, 20 nt, Pseudomonas aeruginosa PA01
gacggcccuccggcgcguug

SEQ ID NO: 1491547 - RNA, 19 nt, Pseudomonas aeruginosa PA01
gacgcgcugccccuggcuc

SEQ ID NO: 1491548 - RNA, 18 nt, Pseudomonas aeruginosa PA01
gacgcgcuuguccuccag

SEQ ID NO: 1491549 - RNA, 14 nt, Pseudomonas aeruginosa PA01
gacgcggccugggc

SEQ ID NO: 1491550 - RNA, 15 nt, Pseudomonas aeruginosa PA01
gacgcggccugggcc

SEQ ID NO: 1491551 - RNA, 17 nt, Pseudomonas aeruginosa PA01
gacgcggccugggccga

SEQ ID NO: 1491552 - RNA, 14 nt, Pseudomonas aeruginosa PA01
gacgcgcuggacca

SEQ ID NO: 1491553 - RNA, 21 nt, Pseudomonas aeruginosa PA01
gacgcgcuggaccauggccgg

SEQ ID NO: 1491554 - RNA, 15 nt, Pseudomonas aeruginosa PA01
gacgcggauaccgag

SEQ ID NO: 1491555 - RNA, 16 nt, Pseudomonas aeruginosa PA01
gacgcggauuggccgg

SEQ ID NO: 1491556 - RNA, 17 nt, Pseudomonas aeruginosa PA01
gacgcggauuggccggg

SEQ ID NO: 1491557 - RNA, 18 nt, Pseudomonas aeruginosa PA01
gacgcggauuggccgggc

SEQ ID NO: 1491558 - RNA, 23 nt, Pseudomonas aeruginosa PA01
gacgcggauuggccgggccgaug

SEQ ID NO: 1491559 - RNA, 19 nt, Pseudomonas aeruginosa PA01
gacgcgacugcugcugcgg

SEQ ID NO: 1491560 - RNA, 20 nt, Pseudomonas aeruginosa PA01
gacgcgacugcugcugcggg

SEQ ID NO: 1491561 - RNA, 17 nt, Pseudomonas aeruginosa PA01
gacgcgaccuccggcgc

SEQ ID NO: 1491562 - RNA, 18 nt, Pseudomonas aeruginosa PA01
gacgcgaccuccggcgcc

SEQ ID NO: 1491563 - RNA, 19 nt, Pseudomonas aeruginosa PA01
gacgcgaccuccggcgcca

SEQ ID NO: 1491564 - RNA, 19 nt, Pseudomonas aeruginosa PA01
gacgcgacgccuucagcau

SEQ ID NO: 1491565 - RNA, 20 nt, Pseudomonas aeruginosa PA01
gacgcgcagcgccgccgcgu

SEQ ID NO: 1491566 - RNA, 14 nt, Pseudomonas aeruginosa PA01
gacgcgcagcggcg

SEQ ID NO: 1491567 - RNA, 15 nt, Pseudomonas aeruginosa PA01
gacgcgcagcggcgc

SEQ ID NO: 1491568 - RNA, 16 nt, Pseudomonas aeruginosa PA01
gacgcgcagcggcgcc

SEQ ID NO: 1491569 - RNA, 14 nt, Pseudomonas aeruginosa PA01
gacgcgccacgcag

SEQ ID NO: 1491570 - RNA, 24 nt, Pseudomonas aeruginosa PA01
gacgcgccgcgguuuccgugcgga

SEQ ID NO: 1491571 - RNA, 17 nt, Pseudomonas aeruginosa PA01
gacgcggcuggcgcagg

SEQ ID NO: 1491572 - RNA, 20 nt, Pseudomonas aeruginosa PA01
gacgcggcggcuccggcgcc

SEQ ID NO: 1491573 - RNA, 16 nt, Pseudomonas aeruginosa PA01
gacgcgucguccgagg

SEQ ID NO: 1491574 - RNA, 19 nt, Pseudomonas aeruginosa PA01
gacgcuacguuccagggcc

SEQ ID NO: 1491575 - RNA, 14 nt, Pseudomonas aeruginosa PA01
gacgcucagcaccc

SEQ ID NO: 1491576 - RNA, 18 nt, Pseudomonas aeruginosa PA01
gacgcucagcacccuggc

SEQ ID NO: 1491577 - RNA, 18 nt, Pseudomonas aeruginosa PA01
gacgcucggcuucgcguu

SEQ ID NO: 1491578 - RNA, 12 nt, Pseudomonas aeruginosa PA01
gacgcucggcca

SEQ ID NO: 1491579 - RNA, 13 nt, Pseudomonas aeruginosa PA01
gacgcucggccag

SEQ ID NO: 1491580 - RNA, 14 nt, Pseudomonas aeruginosa PA01
gacgcucggccagc

SEQ ID NO: 1491581 - RNA, 19 nt, Pseudomonas aeruginosa PA01
gacgcucggccagcguccu

SEQ ID NO: 1491582 - RNA, 23 nt, Pseudomonas aeruginosa PA01
cuuccaggcuguagccggcgaug

SEQ ID NO: 1491583 - RNA, 17 nt, Pseudomonas aeruginosa PA01
cuuccagggcggcgcgg

SEQ ID NO: 1491584 - RNA, 17 nt, Pseudomonas aeruginosa PA01
cuuccagggucggcacc

SEQ ID NO: 1491585 - RNA, 19 nt, Pseudomonas aeruginosa PA01
cuuccaggguuuccagcag

SEQ ID NO: 1491586 - RNA, 15 nt, Pseudomonas aeruginosa PA01
cuuccagcuugcgcu

SEQ ID NO: 1491587 - RNA, 13 nt, Pseudomonas aeruginosa PA01
cuuccagcuuggc

SEQ ID NO: 1491588 - RNA, 21 nt, Pseudomonas aeruginosa PA01
cuuccagcuuggcacggccgg

SEQ ID NO: 1491589 - RNA, 18 nt, Pseudomonas aeruginosa PA01
cuuccagcuugguguaga

SEQ ID NO: 1491590 - RNA, 12 nt, Pseudomonas aeruginosa PA01
cuuccagcaggu

SEQ ID NO: 1491591 - RNA, 21 nt, Pseudomonas aeruginosa PA01
cuuccagcgggcggaucagcu

SEQ ID NO: 1491592 - RNA, 23 nt, Pseudomonas aeruginosa PA01
cuuccagcgggcggaucagcucg

SEQ ID NO: 1491593 - RNA, 21 nt, Pseudomonas aeruginosa PA01
cuuccgccagcaggcgcgggc

SEQ ID NO: 1491594 - RNA, 14 nt, Pseudomonas aeruginosa PA01
cuuccgccgccagg

SEQ ID NO: 1491595 - RNA, 15 nt, Pseudomonas aeruginosa PA01
cuuccgccggcgccg

SEQ ID NO: 1491596 - RNA, 17 nt, Pseudomonas aeruginosa PA01
cuuccgccggcgccgcc

SEQ ID NO: 1491597 - RNA, 16 nt, Pseudomonas aeruginosa PA01
cuuccgccucgcgccg

SEQ ID NO: 1491598 - RNA, 16 nt, Pseudomonas aeruginosa PA01
cuuccggcagccagcc

SEQ ID NO: 1491599 - RNA, 18 nt, Pseudomonas aeruginosa PA01
cuuccggcagccagccgc

SEQ ID NO: 1491600 - RNA, 23 nt, Pseudomonas aeruginosa PA01
cuuccggcagccagccgccgaag

SEQ ID NO: 1491601 - RNA, 14 nt, Pseudomonas aeruginosa PA01
cuuccgcgcccagg

SEQ ID NO: 1491602 - RNA, 21 nt, Pseudomonas aeruginosa PA01
cuuccgcgcggcgcccugccg

SEQ ID NO: 1491603 - RNA, 19 nt, Pseudomonas aeruginosa PA01
cuuccggacugcccagcgc

SEQ ID NO: 1491604 - RNA, 22 nt, Pseudomonas aeruginosa PA01
cuuccggacugcccagcgccgc

SEQ ID NO: 1491605 - RNA, 23 nt, Pseudomonas aeruginosa PA01
cuuccggacugcccagcgccgcc

SEQ ID NO: 1491606 - RNA, 15 nt, Pseudomonas aeruginosa PA01
cuucgacaugggccg

SEQ ID NO: 1491607 - RNA, 19 nt, Pseudomonas aeruginosa PA01
cuucgacaugggccgcgca

SEQ ID NO: 1491608 - RNA, 17 nt, Pseudomonas aeruginosa PA01
cuucgaacccgcccucg

SEQ ID NO: 1491609 - RNA, 21 nt, Pseudomonas aeruginosa PA01
cuucgaacccgcccucguggc

SEQ ID NO: 1491610 - RNA, 15 nt, Pseudomonas aeruginosa PA01
cuuccuugucgauca

SEQ ID NO: 1491611 - RNA, 17 nt, Pseudomonas aeruginosa PA01
cuuccuugucgaucagg

SEQ ID NO: 1491612 - RNA, 18 nt, Pseudomonas aeruginosa PA01
cuucgaagacccccugcc

SEQ ID NO: 1491613 - RNA, 19 nt, Pseudomonas aeruginosa PA01
cuucgaagacccccugccg

SEQ ID NO: 1491614 - RNA, 23 nt, Pseudomonas aeruginosa PA01
cuucgaagacccccugccgcccu

SEQ ID NO: 1491615 - RNA, 17 nt, Pseudomonas aeruginosa PA01
cuucgaagccggcacgg

SEQ ID NO: 1491616 - RNA, 13 nt, Pseudomonas aeruginosa PA01
cuuccggcuccag

SEQ ID NO: 1491617 - RNA, 14 nt, Pseudomonas aeruginosa PA01
cuuccggcucgccg

SEQ ID NO: 1491618 - RNA, 13 nt, Pseudomonas aeruginosa PA01
cuuccggcgccaa

SEQ ID NO: 1491619 - RNA, 15 nt, Pseudomonas aeruginosa PA01
cuuccugggaugccg

SEQ ID NO: 1491620 - RNA, 18 nt, Pseudomonas aeruginosa PA01
cuuccugggaugccgggc

SEQ ID NO: 1491621 - RNA, 19 nt, Pseudomonas aeruginosa PA01
cuuccugggaugccgggcc

SEQ ID NO: 1491622 - RNA, 17 nt, Pseudomonas aeruginosa PA01
cuuccgggcugcgcucg

SEQ ID NO: 1491623 - RNA, 23 nt, Pseudomonas aeruginosa PA01
cuuccugugcgaggcuggccucg

SEQ ID NO: 1491624 - RNA, 20 nt, Pseudomonas aeruginosa PA01
cuuccugguggaacagccgc

SEQ ID NO: 1491625 - RNA, 13 nt, Pseudomonas aeruginosa PA01
cuuccuuggcggg

SEQ ID NO: 1491626 - RNA, 14 nt, Pseudomonas aeruginosa PA01
cuuccuugcgcggg

SEQ ID NO: 1491627 - RNA, 23 nt, Pseudomonas aeruginosa PA01
cuuccuugcugaagcccaggcgu

SEQ ID NO: 1491628 - RNA, 16 nt, Pseudomonas aeruginosa PA01
cuuccuugcgaucgag

SEQ ID NO: 1491629 - RNA, 17 nt, Pseudomonas aeruginosa PA01
cuucggucgcgccccgc

SEQ ID NO: 1491630 - RNA, 18 nt, Pseudomonas aeruginosa PA01
cuucggucgcgccccgcc

SEQ ID NO: 1491631 - RNA, 17 nt, Pseudomonas aeruginosa PA01
cuucggucucguccggc

SEQ ID NO: 1491632 - RNA, 20 nt, Pseudomonas aeruginosa PA01
cuucggcgguggggccgccg

SEQ ID NO: 1491633 - RNA, 21 nt, Pseudomonas aeruginosa PA01
cuucggcgugcauggccgggc

SEQ ID NO: 1491634 - RNA, 16 nt, Pseudomonas aeruginosa PA01
cuucgggagagcccgg

SEQ ID NO: 1491635 - RNA, 21 nt, Pseudomonas aeruginosa PA01
cuucgggagagcccgggcgca

SEQ ID NO: 1491636 - RNA, 21 nt, Pseudomonas aeruginosa PA01
cuucgggagucaacgccuggc

SEQ ID NO: 1491637 - RNA, 14 nt, Pseudomonas aeruginosa PA01
cuucggcggcgccg

SEQ ID NO: 1491638 - RNA, 14 nt, Pseudomonas aeruginosa PA01
cuucggcggcgccu

SEQ ID NO: 1491639 - RNA, 17 nt, Pseudomonas aeruginosa PA01
cuucggagaacagcgag

SEQ ID NO: 1491640 - RNA, 17 nt, Pseudomonas aeruginosa PA01
cuucggauacggcaggg

SEQ ID NO: 1491641 - RNA, 19 nt, Pseudomonas aeruginosa PA01
cuucgcuggaccaggcggc

SEQ ID NO: 1491642 - RNA, 20 nt, Pseudomonas aeruginosa PA01
cuucgcgggugaccuggccg

SEQ ID NO: 1491643 - RNA, 17 nt, Pseudomonas aeruginosa PA01
cuucgcguuggcggugc

SEQ ID NO: 1491644 - RNA, 15 nt, Pseudomonas aeruginosa PA01
cuucgcgugggccag

SEQ ID NO: 1491645 - RNA, 18 nt, Pseudomonas aeruginosa PA01
cuucgcgguagacgcagg

SEQ ID NO: 1491646 - RNA, 18 nt, Pseudomonas aeruginosa PA01
cuucgcgggccaggccga

SEQ ID NO: 1491647 - RNA, 19 nt, Pseudomonas aeruginosa PA01
cuucgcgggccaggccgag

SEQ ID NO: 1491648 - RNA, 16 nt, Pseudomonas aeruginosa PA01
cuucgcccuacgcggc

SEQ ID NO: 1491649 - RNA, 17 nt, Pseudomonas aeruginosa PA01
cuucgcccuacgcggca

SEQ ID NO: 1491650 - RNA, 19 nt, Pseudomonas aeruginosa PA01
cuucgcccucagcagcgcc

SEQ ID NO: 1491651 - RNA, 20 nt, Pseudomonas aeruginosa PA01
cuucgcccucagcagcgccg

SEQ ID NO: 1491652 - RNA, 16 nt, Pseudomonas aeruginosa PA01
cuucgcccauggcacg

SEQ ID NO: 1491653 - RNA, 17 nt, Pseudomonas aeruginosa PA01
cuucgcccggcucgacc

SEQ ID NO: 1491654 - RNA, 15 nt, Pseudomonas aeruginosa PA01
cuucgccagcggcca

SEQ ID NO: 1491655 - RNA, 24 nt, Pseudomonas aeruginosa PA01
cuucgccagcggccagggcgaggc

SEQ ID NO: 1491656 - RNA, 19 nt, Pseudomonas aeruginosa PA01
cuucgcaggagucgacgaa

SEQ ID NO: 1491657 - RNA, 15 nt, Pseudomonas aeruginosa PA01
cuucgcaccagccgg

SEQ ID NO: 1491658 - RNA, 15 nt, Pseudomonas aeruginosa PA01
cuucaucuuggccca

SEQ ID NO: 1491659 - RNA, 22 nt, Pseudomonas aeruginosa PA01
cuucaugaacacauagaccagc

SEQ ID NO: 1491660 - RNA, 16 nt, Pseudomonas aeruginosa PA01
cuuccaccguggcgac

SEQ ID NO: 1491661 - RNA, 14 nt, Pseudomonas aeruginosa PA01
cuuccagccgcccu

SEQ ID NO: 1491662 - RNA, 16 nt, Pseudomonas aeruginosa PA01
cuuccagccagcccuc

SEQ ID NO: 1491663 - RNA, 13 nt, Pseudomonas aeruginosa PA01
cuuccagcaccuc

SEQ ID NO: 1491664 - RNA, 14 nt, Pseudomonas aeruginosa PA01
cuuccagcacgccg

SEQ ID NO: 1491665 - RNA, 15 nt, Pseudomonas aeruginosa PA01
cuuccagcacgccga

SEQ ID NO: 1491666 - RNA, 20 nt, Pseudomonas aeruginosa PA01
cuuccacuucgaagccgagc

SEQ ID NO: 1491667 - RNA, 18 nt, Pseudomonas aeruginosa PA01
cuuccacuugcgccggcu

SEQ ID NO: 1491668 - RNA, 13 nt, Pseudomonas aeruginosa PA01
cuuccacgccuuc

SEQ ID NO: 1491669 - RNA, 16 nt, Pseudomonas aeruginosa PA01
cuuccacgccuucgcg

SEQ ID NO: 1491670 - RNA, 18 nt, Pseudomonas aeruginosa PA01
cuuccacgccuucgcggc

SEQ ID NO: 1491671 - RNA, 22 nt, Pseudomonas aeruginosa PA01
cuuccacgccuucgcggccgag

SEQ ID NO: 1491672 - RNA, 23 nt, Pseudomonas aeruginosa PA01
cuuccacgcugaggcucagcgcg

SEQ ID NO: 1491673 - RNA, 16 nt, Pseudomonas aeruginosa PA01
cuuccacuccaggcgg

SEQ ID NO: 1491674 - RNA, 18 nt, Pseudomonas aeruginosa PA01
cuuccacucgccgaccag

SEQ ID NO: 1491675 - RNA, 19 nt, Pseudomonas aeruginosa PA01
cuucagugcacguuccagc

SEQ ID NO: 1491676 - RNA, 22 nt, Pseudomonas aeruginosa PA01
cuucagguaggcgcgggcguag

SEQ ID NO: 1491677 - RNA, 19 nt, Pseudomonas aeruginosa PA01
cuucagguaaggcaccacc

SEQ ID NO: 1491678 - RNA, 22 nt, Pseudomonas aeruginosa PA01
cuucaguaggccagcggcuccu

SEQ ID NO: 1491679 - RNA, 16 nt, Pseudomonas aeruginosa PA01
cuucaggcgcgcggcc

SEQ ID NO: 1491680 - RNA, 15 nt, Pseudomonas aeruginosa PA01
cuucaggcgugggcc

SEQ ID NO: 1491681 - RNA, 19 nt, Pseudomonas aeruginosa PA01
cuucaggcgugggccagcc

SEQ ID NO: 1491682 - RNA, 16 nt, Pseudomonas aeruginosa PA01
cuucaggcucggccug

SEQ ID NO: 1491683 - RNA, 20 nt, Pseudomonas aeruginosa PA01
cuucaggcugcgcgcaucga

SEQ ID NO: 1491684 - RNA, 14 nt, Pseudomonas aeruginosa PA01
cuucaggcugucgg

SEQ ID NO: 1491685 - RNA, 17 nt, Pseudomonas aeruginosa PA01
cuucaguucgggguggg

SEQ ID NO: 1491686 - RNA, 16 nt, Pseudomonas aeruginosa PA01
cuucaguucguugggc

SEQ ID NO: 1491687 - RNA, 16 nt, Pseudomonas aeruginosa PA01
cuucaucaggcggcac

SEQ ID NO: 1491688 - RNA, 15 nt, Pseudomonas aeruginosa PA01
cuucagccccagcac

SEQ ID NO: 1491689 - RNA, 19 nt, Pseudomonas aeruginosa PA01
cuucagccagaccggcagc

SEQ ID NO: 1491690 - RNA, 23 nt, Pseudomonas aeruginosa PA01
cuucagccagaccggcagcgccg

SEQ ID NO: 1491691 - RNA, 21 nt, Pseudomonas aeruginosa PA01
cuucagcccggcaccaggccg

SEQ ID NO: 1491692 - RNA, 19 nt, Pseudomonas aeruginosa PA01
cuucagccgaccguccgcc

SEQ ID NO: 1491693 - RNA, 20 nt, Pseudomonas aeruginosa PA01
cuucagcgagcggucggcca

SEQ ID NO: 1491694 - RNA, 22 nt, Pseudomonas aeruginosa PA01
cuucagcgagcggucggccaug

SEQ ID NO: 1491695 - RNA, 17 nt, Pseudomonas aeruginosa PA01
cuucagcgccagcaggc

SEQ ID NO: 1491696 - RNA, 19 nt, Pseudomonas aeruginosa PA01
cuucagcgccaggccgauc

SEQ ID NO: 1491697 - RNA, 21 nt, Pseudomonas aeruginosa PA01
cuucagcgccaggccgaucag

SEQ ID NO: 1491698 - RNA, 16 nt, Pseudomonas aeruginosa PA01
cuucagcgccgccagg

SEQ ID NO: 1491699 - RNA, 16 nt, Pseudomonas aeruginosa PA01
cuucagcgccucgacc

SEQ ID NO: 1491700 - RNA, 16 nt, Pseudomonas aeruginosa PA01
cuucagcgcgccgagc

SEQ ID NO: 1491701 - RNA, 16 nt, Pseudomonas aeruginosa PA01
cuucaggccggcgccg

SEQ ID NO: 1491702 - RNA, 19 nt, Pseudomonas aeruginosa PA01
cuucaggccguucaggcgg

SEQ ID NO: 1491703 - RNA, 14 nt, Pseudomonas aeruginosa PA01
cuucaggccgaagc

SEQ ID NO: 1491704 - RNA, 13 nt, Pseudomonas aeruginosa PA01
cuucagcuccagc

SEQ ID NO: 1491705 - RNA, 14 nt, Pseudomonas aeruginosa PA01
cuucagcuccagca

SEQ ID NO: 1491706 - RNA, 21 nt, Pseudomonas aeruginosa PA01
cuguaccuacuguucggucgg

SEQ ID NO: 1491707 - RNA, 16 nt, Pseudomonas aeruginosa PA01
cuggucgacauagcgc

SEQ ID NO: 1491708 - RNA, 19 nt, Pseudomonas aeruginosa PA01
cuggucgacauagcgcagc

SEQ ID NO: 1491709 - RNA, 23 nt, Pseudomonas aeruginosa PA01
cuggucgacauagcgcagcaccg

SEQ ID NO: 1491710 - RNA, 19 nt, Pseudomonas aeruginosa PA01
cugguccagcuggcgcagc

SEQ ID NO: 1491711 - RNA, 14 nt, Pseudomonas aeruginosa PA01
cugguccaccagcc

SEQ ID NO: 1491712 - RNA, 19 nt, Pseudomonas aeruginosa PA01
cugguccaccagcccgcag

SEQ ID NO: 1491713 - RNA, 22 nt, Pseudomonas aeruginosa PA01
cugguccggguuggcgcaggcc

SEQ ID NO: 1491714 - RNA, 21 nt, Pseudomonas aeruginosa PA01
cuggucgaaagccugccgggc

SEQ ID NO: 1491715 - RNA, 22 nt, Pseudomonas aeruginosa PA01
cuggucgaacacuugaccgucg

SEQ ID NO: 1491716 - RNA, 13 nt, Pseudomonas aeruginosa PA01
cugguccagcacg

SEQ ID NO: 1491717 - RNA, 17 nt, Pseudomonas aeruginosa PA01
cugguccugcggcggca

SEQ ID NO: 1491718 - RNA, 19 nt, Pseudomonas aeruginosa PA01
cugguccugcggcggcagg

SEQ ID NO: 1491719 - RNA, 17 nt, Pseudomonas aeruginosa PA01
cuguagugcuccggggc

SEQ ID NO: 1491720 - RNA, 20 nt, Pseudomonas aeruginosa PA01
cuguagugcuccggggcgcu

SEQ ID NO: 1491721 - RNA, 19 nt, Pseudomonas aeruginosa PA01
cuguaguugacgucgccga

SEQ ID NO: 1491722 - RNA, 22 nt, Pseudomonas aeruginosa PA01
cuguaguugacgucgccgaugc

SEQ ID NO: 1491723 - RNA, 22 nt, Pseudomonas aeruginosa PA01
cuguaggacagguucaggucga

SEQ ID NO: 1491724 - RNA, 17 nt, Pseudomonas aeruginosa PA01
cuguaggcgagcagcgg

SEQ ID NO: 1491725 - RNA, 19 nt, Pseudomonas aeruginosa PA01
cuguaggcgagcagcggca

SEQ ID NO: 1491726 - RNA, 22 nt, Pseudomonas aeruginosa PA01
cuguagcagggugcgggcgcgg

SEQ ID NO: 1491727 - RNA, 12 nt, Pseudomonas aeruginosa PA01
cuguagccggcg

SEQ ID NO: 1491728 - RNA, 19 nt, Pseudomonas aeruginosa PA01
cuguagccggcgccgucga

SEQ ID NO: 1491729 - RNA, 16 nt, Pseudomonas aeruginosa PA01
cuguagccucccgccg

SEQ ID NO: 1491730 - RNA, 18 nt, Pseudomonas aeruginosa PA01
cuguagccucccgccgcg

SEQ ID NO: 1491731 - RNA, 20 nt, Pseudomonas aeruginosa PA01
cuguagccucccgccgcggc

SEQ ID NO: 1491732 - RNA, 18 nt, Pseudomonas aeruginosa PA01
cugugcggugccgcgcag

SEQ ID NO: 1491733 - RNA, 19 nt, Pseudomonas aeruginosa PA01
cugugcggugccgcgcagc

SEQ ID NO: 1491734 - RNA, 13 nt, Pseudomonas aeruginosa PA01
cugugcggcagca

SEQ ID NO: 1491735 - RNA, 16 nt, Pseudomonas aeruginosa PA01
cugugcggcagcaggc

SEQ ID NO: 1491736 - RNA, 22 nt, Pseudomonas aeruginosa PA01
cugugcgauuucgcugcgcagu

SEQ ID NO: 1491737 - RNA, 18 nt, Pseudomonas aeruginosa PA01
cugugccgaggccgccgc

SEQ ID NO: 1491738 - RNA, 17 nt, Pseudomonas aeruginosa PA01
cugugccauuccugggc

SEQ ID NO: 1491739 - RNA, 18 nt, Pseudomonas aeruginosa PA01
cugugcaggaaggcgacg

SEQ ID NO: 1491740 - RNA, 19 nt, Pseudomonas aeruginosa PA01
cugugcacccagaccuucc

SEQ ID NO: 1491741 - RNA, 19 nt, Pseudomonas aeruginosa PA01
cugucgggggcugcgcauc

SEQ ID NO: 1491742 - RNA, 20 nt, Pseudomonas aeruginosa PA01
cugucgcucagcgggccgau

SEQ ID NO: 1491743 - RNA, 18 nt, Pseudomonas aeruginosa PA01
cugucgcggacccgcgcc

SEQ ID NO: 1491744 - RNA, 21 nt, Pseudomonas aeruginosa PA01
cugucggagagggagcgccug

SEQ ID NO: 1491745 - RNA, 14 nt, Pseudomonas aeruginosa PA01
cugucggccagccc

SEQ ID NO: 1491746 - RNA, 18 nt, Pseudomonas aeruginosa PA01
cugucggccucgacgagg

SEQ ID NO: 1491747 - RNA, 12 nt, Pseudomonas aeruginosa PA01
cugucggcggau

SEQ ID NO: 1491748 - RNA, 20 nt, Pseudomonas aeruginosa PA01
cugucggcggauugccagca

SEQ ID NO: 1491749 - RNA, 17 nt, Pseudomonas aeruginosa PA01
cugucagggcuugcgcg

SEQ ID NO: 1491750 - RNA, 18 nt, Pseudomonas aeruginosa PA01
cugucagggcuugcgcgc

SEQ ID NO: 1491751 - RNA, 23 nt, Pseudomonas aeruginosa PA01
cugucagggcuugcgcgccacca

SEQ ID NO: 1491752 - RNA, 20 nt, Pseudomonas aeruginosa PA01
cugucgccgagcaccccgac

SEQ ID NO: 1491753 - RNA, 14 nt, Pseudomonas aeruginosa PA01
cugucgccggucag

SEQ ID NO: 1491754 - RNA, 22 nt, Pseudomonas aeruginosa PA01
cugucgccggucaggcugcggc

SEQ ID NO: 1491755 - RNA, 17 nt, Pseudomonas aeruginosa PA01
cuguuugcggcgcaggc

SEQ ID NO: 1491756 - RNA, 15 nt, Pseudomonas aeruginosa PA01
cugugcucgacgggc

SEQ ID NO: 1491757 - RNA, 18 nt, Pseudomonas aeruginosa PA01
cugugcucgacgggcgcu

SEQ ID NO: 1491758 - RNA, 13 nt, Pseudomonas aeruginosa PA01
cugugcucgagga

SEQ ID NO: 1491759 - RNA, 16 nt, Pseudomonas aeruginosa PA01
cugugcugcaccagca

SEQ ID NO: 1491760 - RNA, 15 nt, Pseudomonas aeruginosa PA01
cugugcugcgcgccg

SEQ ID NO: 1491761 - RNA, 17 nt, Pseudomonas aeruginosa PA01
cugugcuuaauacggcg

SEQ ID NO: 1491762 - RNA, 23 nt, Pseudomonas aeruginosa PA01
cuguggaauguccugccgcaggc

SEQ ID NO: 1491763 - RNA, 15 nt, Pseudomonas aeruginosa PA01
cuguggagccggugc

SEQ ID NO: 1491764 - RNA, 13 nt, Pseudomonas aeruginosa PA01
cuguggcgcggcu

SEQ ID NO: 1491765 - RNA, 16 nt, Pseudomonas aeruginosa PA01
cuguggguggugcgau

SEQ ID NO: 1491766 - RNA, 17 nt, Pseudomonas aeruginosa PA01
cuguggucaggcgccag

SEQ ID NO: 1491767 - RNA, 20 nt, Pseudomonas aeruginosa PA01
cuguggcguuauucgcccua

SEQ ID NO: 1491768 - RNA, 14 nt, Pseudomonas aeruginosa PA01
aaccggcguccggg

SEQ ID NO: 1491769 - RNA, 20 nt, Pseudomonas aeruginosa PA01
aaccggcgaugcucagcgcc

SEQ ID NO: 1491770 - RNA, 21 nt, Pseudomonas aeruginosa PA01
aaccggcgaugcucagcgccg

SEQ ID NO: 1491771 - RNA, 15 nt, Pseudomonas aeruginosa PA01
aaccggccagcgcgg

SEQ ID NO: 1491772 - RNA, 20 nt, Pseudomonas aeruginosa PA01
aaccggccauuacgccgagc

SEQ ID NO: 1491773 - RNA, 17 nt, Pseudomonas aeruginosa PA01
aaccgggcaucgccgac

SEQ ID NO: 1491774 - RNA, 19 nt, Pseudomonas aeruginosa PA01
aaccgggaugaagaucauc

SEQ ID NO: 1491775 - RNA, 19 nt, Pseudomonas aeruginosa PA01
aaccgggcgggacucgccg

SEQ ID NO: 1491776 - RNA, 22 nt, Pseudomonas aeruginosa PA01
cuggcggccgaguucgcgcagg

SEQ ID NO: 1491777 - RNA, 23 nt, Pseudomonas aeruginosa PA01
cuggcggccgaguucgcgcaggc

SEQ ID NO: 1491778 - RNA, 21 nt, Pseudomonas aeruginosa PA01
cuggcggauguaguccagcgc

SEQ ID NO: 1491779 - RNA, 22 nt, Pseudomonas aeruginosa PA01
cuggcggauguaguccagcgcc

SEQ ID NO: 1491780 - RNA, 21 nt, Pseudomonas aeruginosa PA01
cuggcggauaucgcgugguga

SEQ ID NO: 1491781 - RNA, 16 nt, Pseudomonas aeruginosa PA01
cuggcggaucaccggc

SEQ ID NO: 1491782 - RNA, 16 nt, Pseudomonas aeruginosa PA01
cuggcggcaucggcgc

SEQ ID NO: 1491783 - RNA, 18 nt, Pseudomonas aeruginosa PA01
cuggcggcaucggcgccg

SEQ ID NO: 1491784 - RNA, 19 nt, Pseudomonas aeruginosa PA01
cuggcggcaucggcgccgc

SEQ ID NO: 1491785 - RNA, 12 nt, Pseudomonas aeruginosa PA01
cuggcggccagg

SEQ ID NO: 1491786 - RNA, 17 nt, Pseudomonas aeruginosa PA01
cuggcggggucgcgccg

SEQ ID NO: 1491787 - RNA, 17 nt, Pseudomonas aeruginosa PA01
cuggcggucgccgccgg

SEQ ID NO: 1491788 - RNA, 20 nt, Pseudomonas aeruginosa PA01
cuggcggucgccgccggcga

SEQ ID NO: 1491789 - RNA, 15 nt, Pseudomonas aeruginosa PA01
cuggcggcucggcug

SEQ ID NO: 1491790 - RNA, 21 nt, Pseudomonas aeruginosa PA01
cuggcgggcuuuuucauuucc

SEQ ID NO: 1491791 - RNA, 20 nt, Pseudomonas aeruginosa PA01
cuggcgcuugggcgcggaga

SEQ ID NO: 1491792 - RNA, 19 nt, Pseudomonas aeruginosa PA01
cuggcggaaggugccuucg

SEQ ID NO: 1491793 - RNA, 16 nt, Pseudomonas aeruginosa PA01
cuggcggaccgccucg

SEQ ID NO: 1491794 - RNA, 15 nt, Pseudomonas aeruginosa PA01
cuggcggaaaagccc

SEQ ID NO: 1491795 - RNA, 13 nt, Pseudomonas aeruginosa PA01
cuggcgcugcgcg

SEQ ID NO: 1491796 - RNA, 15 nt, Pseudomonas aeruginosa PA01
cuggcgcugcgcggc

SEQ ID NO: 1491797 - RNA, 17 nt, Pseudomonas aeruginosa PA01
cuggcgcugggccuuga

SEQ ID NO: 1491798 - RNA, 23 nt, Pseudomonas aeruginosa PA01
cuggcgcugggccuugagcaggc

SEQ ID NO: 1491799 - RNA, 19 nt, Pseudomonas aeruginosa PA01
cuggcgcugucgcccgggc

SEQ ID NO: 1491800 - RNA, 21 nt, Pseudomonas aeruginosa PA01
cuggcgcugucgcccgggcgc

SEQ ID NO: 1491801 - RNA, 21 nt, Pseudomonas aeruginosa PA01
cuggcgcuugccgcgcccggc

SEQ ID NO: 1491802 - RNA, 22 nt, Pseudomonas aeruginosa PA01
cuggcgcuugccgcgcccggcc

SEQ ID NO: 1491803 - RNA, 15 nt, Pseudomonas aeruginosa PA01
cuggcgcgcugcggc

SEQ ID NO: 1491804 - RNA, 18 nt, Pseudomonas aeruginosa PA01
cuggcgcgcugcggcagg

SEQ ID NO: 1491805 - RNA, 19 nt, Pseudomonas aeruginosa PA01
cuggcgcgcugcggcaggg

SEQ ID NO: 1491806 - RNA, 17 nt, Pseudomonas aeruginosa PA01
cuggcgcgucaugccgc

SEQ ID NO: 1491807 - RNA, 22 nt, Pseudomonas aeruginosa PA01
cuggcgcgucgcugccgccgcg

SEQ ID NO: 1491808 - RNA, 24 nt, Pseudomonas aeruginosa PA01
cuggcgcgucgcugccgccgcgcc

SEQ ID NO: 1491809 - RNA, 13 nt, Pseudomonas aeruginosa PA01
cuggcgcgucggc

SEQ ID NO: 1491810 - RNA, 16 nt, Pseudomonas aeruginosa PA01
cuggcgcgucggccgc

SEQ ID NO: 1491811 - RNA, 13 nt, Pseudomonas aeruginosa PA01
cuggcgcggcaaa

SEQ ID NO: 1491812 - RNA, 16 nt, Pseudomonas aeruginosa PA01
cuggcgcucagcgccg

SEQ ID NO: 1491813 - RNA, 17 nt, Pseudomonas aeruginosa PA01
cuggcgcucagcgccgc

SEQ ID NO: 1491814 - RNA, 22 nt, Pseudomonas aeruginosa PA01
cuggcgcucucgaacaccaggc

SEQ ID NO: 1491815 - RNA, 13 nt, Pseudomonas aeruginosa PA01
cuggcgcugaaca

SEQ ID NO: 1491816 - RNA, 18 nt, Pseudomonas aeruginosa PA01
cuggcgcugaacaagccc

SEQ ID NO: 1491817 - RNA, 21 nt, Pseudomonas aeruginosa PA01
cuggcgcuaccgcgcauggcg

SEQ ID NO: 1491818 - RNA, 13 nt, Pseudomonas aeruginosa PA01
cuggcgcguacgc

SEQ ID NO: 1491819 - RNA, 18 nt, Pseudomonas aeruginosa PA01
cuggcgcguacgcccgca

SEQ ID NO: 1491820 - RNA, 16 nt, Pseudomonas aeruginosa PA01
cuggcguucucggcca

SEQ ID NO: 1491821 - RNA, 18 nt, Pseudomonas aeruginosa PA01
cuggcguucucggccagg

SEQ ID NO: 1491822 - RNA, 23 nt, Pseudomonas aeruginosa PA01
cuggcguuauucgcccuacccga

SEQ ID NO: 1491823 - RNA, 16 nt, Pseudomonas aeruginosa PA01
cuggcguggccggcga

SEQ ID NO: 1491824 - RNA, 18 nt, Pseudomonas aeruginosa PA01
cuggcguuuuucauuucc

SEQ ID NO: 1491825 - RNA, 23 nt, Pseudomonas aeruginosa PA01
cuggcucuguuccucggcggcgg

SEQ ID NO: 1491826 - RNA, 13 nt, Pseudomonas aeruginosa PA01
cuggcgucgccuu

SEQ ID NO: 1491827 - RNA, 19 nt, Pseudomonas aeruginosa PA01
cuggcgucgccuuccacca

SEQ ID NO: 1491828 - RNA, 22 nt, Pseudomonas aeruginosa PA01
cuggcgucgccuuccaccacca

SEQ ID NO: 1491829 - RNA, 20 nt, Pseudomonas aeruginosa PA01
cuggcgucgaugccgaaucc

SEQ ID NO: 1491830 - RNA, 16 nt, Pseudomonas aeruginosa PA01
cuggcgugccgccagg

SEQ ID NO: 1491831 - RNA, 17 nt, Pseudomonas aeruginosa PA01
cuggcgugccgccaggc

SEQ ID NO: 1491832 - RNA, 19 nt, Pseudomonas aeruginosa PA01
cuggcguagcguugcgcga

SEQ ID NO: 1491833 - RNA, 15 nt, Pseudomonas aeruginosa PA01
cuggcguagggcgaa

SEQ ID NO: 1491834 - RNA, 23 nt, Pseudomonas aeruginosa PA01
cuggcguacuugggcaucagcuc

SEQ ID NO: 1491835 - RNA, 18 nt, Pseudomonas aeruginosa PA01
cuggcguccccaugcccg

SEQ ID NO: 1491836 - RNA, 22 nt, Pseudomonas aeruginosa PA01
cuggcguccccaugcccggccu

SEQ ID NO: 1491837 - RNA, 21 nt, Pseudomonas aeruginosa PA01
cuggcgucccggguucugcuc

SEQ ID NO: 1491838 - RNA, 18 nt, Pseudomonas aeruginosa PA01
cuggcgucgaaugcggcg

SEQ ID NO: 1491839 - RNA, 15 nt, Pseudomonas aeruginosa PA01
cuggcgucgaccgcc

SEQ ID NO: 1491840 - RNA, 16 nt, Pseudomonas aeruginosa PA01
cuggcgucgaccgccu

SEQ ID NO: 1491841 - RNA, 19 nt, Pseudomonas aeruginosa PA01
cuggcgucgaccgccugcc

SEQ ID NO: 1491842 - RNA, 13 nt, Pseudomonas aeruginosa PA01
cuggcgucgacgc

SEQ ID NO: 1491843 - RNA, 15 nt, Pseudomonas aeruginosa PA01
cugggugcggugggc

SEQ ID NO: 1491844 - RNA, 14 nt, Pseudomonas aeruginosa PA01
cuggguggcgacga

SEQ ID NO: 1491845 - RNA, 18 nt, Pseudomonas aeruginosa PA01
cuggguggcgacgaagac

SEQ ID NO: 1491846 - RNA, 21 nt, Pseudomonas aeruginosa PA01
cugguaugcagcaacccggcc

SEQ ID NO: 1491847 - RNA, 12 nt, Pseudomonas aeruginosa PA01
cuggucaggcug

SEQ ID NO: 1491848 - RNA, 15 nt, Pseudomonas aeruginosa PA01
cuggucaggcugauc

SEQ ID NO: 1491849 - RNA, 17 nt, Pseudomonas aeruginosa PA01
cuggucaauaccacccu

SEQ ID NO: 1491850 - RNA, 14 nt, Pseudomonas aeruginosa PA01
cugggugccgcgaa

SEQ ID NO: 1491851 - RNA, 15 nt, Pseudomonas aeruginosa PA01
cugggugccgcgaau

SEQ ID NO: 1491852 - RNA, 13 nt, Pseudomonas aeruginosa PA01
cugggucaccagc

SEQ ID NO: 1491853 - RNA, 14 nt, Pseudomonas aeruginosa PA01
cugggucaccagca

SEQ ID NO: 1491854 - RNA, 16 nt, Pseudomonas aeruginosa PA01
cugggucaccagcacc

SEQ ID NO: 1491855 - RNA, 22 nt, Pseudomonas aeruginosa PA01
cuggggauggccggcgcggcgu

SEQ ID NO: 1491856 - RNA, 13 nt, Pseudomonas aeruginosa PA01
cugggucuggcga

SEQ ID NO: 1491857 - RNA, 17 nt, Pseudomonas aeruginosa PA01
cugggugaacagcggcc

SEQ ID NO: 1491858 - RNA, 17 nt, Pseudomonas aeruginosa PA01
cugggucaucgaggcca

SEQ ID NO: 1491859 - RNA, 19 nt, Pseudomonas aeruginosa PA01
cugggucaucgaggccauc

SEQ ID NO: 1491860 - RNA, 20 nt, Pseudomonas aeruginosa PA01
cugggcgugcuuggcgaggc

SEQ ID NO: 1491861 - RNA, 17 nt, Pseudomonas aeruginosa PA01
cugggcguggcggccgc

SEQ ID NO: 1491862 - RNA, 20 nt, Pseudomonas aeruginosa PA01
cugggcguggcggccgccgg

SEQ ID NO: 1491863 - RNA, 19 nt, Pseudomonas aeruginosa PA01
cuggggaaauucgcgcugg

SEQ ID NO: 1491864 - RNA, 21 nt, Pseudomonas aeruginosa PA01
cugggcuacaucgucugcgcg

SEQ ID NO: 1491865 - RNA, 14 nt, Pseudomonas aeruginosa PA01
cugggagccgccgg

SEQ ID NO: 1491866 - RNA, 21 nt, Pseudomonas aeruginosa PA01
cugggacggaacgucggccug

SEQ ID NO: 1491867 - RNA, 13 nt, Pseudomonas aeruginosa PA01
cugggacggcggc

SEQ ID NO: 1491868 - RNA, 16 nt, Pseudomonas aeruginosa PA01
cugggacggcggcugg

SEQ ID NO: 1491869 - RNA, 23 nt, Pseudomonas aeruginosa PA01
cugggacggcugcccaacuggcg

SEQ ID NO: 1491870 - RNA, 15 nt, Pseudomonas aeruginosa PA01
cugggacaggcgucc

SEQ ID NO: 1491871 - RNA, 20 nt, Pseudomonas aeruginosa PA01
cugggaacccuugcgcaggu

SEQ ID NO: 1491872 - RNA, 15 nt, Pseudomonas aeruginosa PA01
cugggaauggcggau

SEQ ID NO: 1491873 - RNA, 22 nt, Pseudomonas aeruginosa PA01
cugggaauggcggauagccgca

SEQ ID NO: 1491874 - RNA, 17 nt, Pseudomonas aeruginosa PA01
cugggaauugcgcacgc

SEQ ID NO: 1491875 - RNA, 17 nt, Pseudomonas aeruginosa PA01
cugggaaagaccgaaca

SEQ ID NO: 1491876 - RNA, 23 nt, Pseudomonas aeruginosa PA01
cugggaaagaccgaacaucagca

SEQ ID NO: 1491877 - RNA, 20 nt, Pseudomonas aeruginosa PA01
cuggcuggccucagggcgcg

SEQ ID NO: 1491878 - RNA, 18 nt, Pseudomonas aeruginosa PA01
cuggcugguaacgggcga

SEQ ID NO: 1491879 - RNA, 21 nt, Pseudomonas aeruginosa PA01
cuggcugguaacgggcgaacc

SEQ ID NO: 1491880 - RNA, 21 nt, Pseudomonas aeruginosa PA01
cuggcuguaggugcccggcgg

SEQ ID NO: 1491881 - RNA, 14 nt, Pseudomonas aeruginosa PA01
cuggcugucgagcg

SEQ ID NO: 1491882 - RNA, 19 nt, Pseudomonas aeruginosa PA01
cuggcugucgagcgaagcg

SEQ ID NO: 1491883 - RNA, 23 nt, Pseudomonas aeruginosa PA01
cuggcugcccaguugcgcggcga

SEQ ID NO: 1491884 - RNA, 17 nt, Pseudomonas aeruginosa PA01
cuggcugcccucgacga

SEQ ID NO: 1491885 - RNA, 13 nt, Pseudomonas aeruginosa PA01
cuggcugcgcgcc

SEQ ID NO: 1491886 - RNA, 14 nt, Pseudomonas aeruginosa PA01
cuggcugcgcgcca

SEQ ID NO: 1491887 - RNA, 17 nt, Pseudomonas aeruginosa PA01
cuggcugcgcgccacca

SEQ ID NO: 1491888 - RNA, 18 nt, Pseudomonas aeruginosa PA01
cuggcuggaguagcugaa

SEQ ID NO: 1491889 - RNA, 17 nt, Pseudomonas aeruginosa PA01
cuggcuggccagcaggc

SEQ ID NO: 1491890 - RNA, 12 nt, Pseudomonas aeruginosa PA01
cuggcugcgcgc

SEQ ID NO: 1491891 - RNA, 14 nt, Pseudomonas aeruginosa PA01
cuggcugcuggcga

SEQ ID NO: 1491892 - RNA, 17 nt, Pseudomonas aeruginosa PA01
cuggcugcuggcgaagc

SEQ ID NO: 1491893 - RNA, 16 nt, Pseudomonas aeruginosa PA01
cugggccggcgccagc

SEQ ID NO: 1491894 - RNA, 17 nt, Pseudomonas aeruginosa PA01
cugggccggcgccagca

SEQ ID NO: 1491895 - RNA, 13 nt, Pseudomonas aeruginosa PA01
cugggccggcuuc

SEQ ID NO: 1491896 - RNA, 23 nt, Pseudomonas aeruginosa PA01
cugggccugucgggggcugcgca

SEQ ID NO: 1491897 - RNA, 13 nt, Pseudomonas aeruginosa PA01
cugggccuugagg

SEQ ID NO: 1491898 - RNA, 22 nt, Pseudomonas aeruginosa PA01
cugggccuugaucaccaccacg

SEQ ID NO: 1491899 - RNA, 23 nt, Pseudomonas aeruginosa PA01
cugggccuugaucaccaccacgc

SEQ ID NO: 1491900 - RNA, 21 nt, Pseudomonas aeruginosa PA01
cugggcgaacagcacccagga

SEQ ID NO: 1491901 - RNA, 14 nt, Pseudomonas aeruginosa PA01
cugggcgaccuuca

SEQ ID NO: 1491902 - RNA, 19 nt, Pseudomonas aeruginosa PA01
cugggcgacgcggacagcc

SEQ ID NO: 1491903 - RNA, 17 nt, Pseudomonas aeruginosa PA01
cugggcgaucacgccgc

SEQ ID NO: 1491904 - RNA, 14 nt, Pseudomonas aeruginosa PA01
cugggcgucgacga

SEQ ID NO: 1491905 - RNA, 21 nt, Pseudomonas aeruginosa PA01
cugggcgucgacgaacggauc

SEQ ID NO: 1491906 - RNA, 16 nt, Pseudomonas aeruginosa PA01
cugggcguacaggccc

SEQ ID NO: 1491907 - RNA, 23 nt, Pseudomonas aeruginosa PA01
cugggcguacaggccccaggcga

SEQ ID NO: 1491908 - RNA, 18 nt, Pseudomonas aeruginosa PA01
cugggcgcccuucagcgc

SEQ ID NO: 1491909 - RNA, 13 nt, Pseudomonas aeruginosa PA01
cugggcgccgcca

SEQ ID NO: 1491910 - RNA, 15 nt, Pseudomonas aeruginosa PA01
cugggcgccgccagc

SEQ ID NO: 1491911 - RNA, 16 nt, Pseudomonas aeruginosa PA01
cugggcgccgccagcc

SEQ ID NO: 1491912 - RNA, 17 nt, Pseudomonas aeruginosa PA01
cugggcgccgccagcca

SEQ ID NO: 1491913 - RNA, 20 nt, Pseudomonas aeruginosa PA01
cugggcgauuuccaccggca

SEQ ID NO: 1491914 - RNA, 15 nt, Pseudomonas aeruginosa PA01
cugggcgcaggccga

SEQ ID NO: 1491915 - RNA, 18 nt, Pseudomonas aeruginosa PA01
cugggcgcaggggcgcgc

SEQ ID NO: 1491916 - RNA, 22 nt, Pseudomonas aeruginosa PA01
cugggcgcaggggcgcgccggc

SEQ ID NO: 1491917 - RNA, 14 nt, Pseudomonas aeruginosa PA01
cuggauaucaccuc

SEQ ID NO: 1491918 - RNA, 19 nt, Pseudomonas aeruginosa PA01
cuggauaucugggccaucg

SEQ ID NO: 1491919 - RNA, 14 nt, Pseudomonas aeruginosa PA01
cuggaucagcgccu

SEQ ID NO: 1491920 - RNA, 15 nt, Pseudomonas aeruginosa PA01
cuggaucagcgccuc

SEQ ID NO: 1491921 - RNA, 20 nt, Pseudomonas aeruginosa PA01
cuggaucagcgccucgaccu

SEQ ID NO: 1491922 - RNA, 19 nt, Pseudomonas aeruginosa PA01
cuggauccgugccaggcgc

SEQ ID NO: 1491923 - RNA, 22 nt, Pseudomonas aeruginosa PA01
cuggauccgugccaggcgcucg

SEQ ID NO: 1491924 - RNA, 14 nt, Pseudomonas aeruginosa PA01
cuggcaaccgucga

SEQ ID NO: 1491925 - RNA, 15 nt, Pseudomonas aeruginosa PA01
cuggcaacggcgggc

SEQ ID NO: 1491926 - RNA, 15 nt, Pseudomonas aeruginosa PA01
cuggcaacaaggcau

SEQ ID NO: 1491927 - RNA, 15 nt, Pseudomonas aeruginosa PA01
cuggaguaucgcccu

SEQ ID NO: 1491928 - RNA, 13 nt, Pseudomonas aeruginosa PA01
cuggaguagcuga

SEQ ID NO: 1491929 - RNA, 16 nt, Pseudomonas aeruginosa PA01
cuggauaagccgcgcc

SEQ ID NO: 1491930 - RNA, 17 nt, Pseudomonas aeruginosa PA01
cuggagcugcgcgcgau

SEQ ID NO: 1491931 - RNA, 17 nt, Pseudomonas aeruginosa PA01
cuggagcuugccggcga

SEQ ID NO: 1491932 - RNA, 20 nt, Pseudomonas aeruginosa PA01
cugccgaagggaaacaccag

SEQ ID NO: 1491933 - RNA, 21 nt, Pseudomonas aeruginosa PA01
cugccgaauugggucugcugg

SEQ ID NO: 1491934 - RNA, 17 nt, Pseudomonas aeruginosa PA01
cugccgaaccgccucag

SEQ ID NO: 1491935 - RNA, 13 nt, Pseudomonas aeruginosa PA01
cugccgaacagca

SEQ ID NO: 1491936 - RNA, 21 nt, Pseudomonas aeruginosa PA01
cugccgaacagcagggaggcg

SEQ ID NO: 1491937 - RNA, 15 nt, Pseudomonas aeruginosa PA01
cugccgacggcggcg

SEQ ID NO: 1491938 - RNA, 13 nt, Pseudomonas aeruginosa PA01
cugcccuggcgcg

SEQ ID NO: 1491939 - RNA, 13 nt, Pseudomonas aeruginosa PA01
cugcccggcuucg

SEQ ID NO: 1491940 - RNA, 13 nt, Pseudomonas aeruginosa PA01
cugcccucgacga

SEQ ID NO: 1491941 - RNA, 14 nt, Pseudomonas aeruginosa PA01
cugcccguggcgcg

SEQ ID NO: 1491942 - RNA, 15 nt, Pseudomonas aeruginosa PA01
cugcccguggcgcgg

SEQ ID NO: 1491943 - RNA, 21 nt, Pseudomonas aeruginosa PA01
cuggccaccgccaggaccucg

SEQ ID NO: 1491944 - RNA, 17 nt, Pseudomonas aeruginosa PA01
cuggccaccgucggaug

SEQ ID NO: 1491945 - RNA, 20 nt, Pseudomonas aeruginosa PA01
cuggccaccgggaucagcgg

SEQ ID NO: 1491946 - RNA, 21 nt, Pseudomonas aeruginosa PA01
cuggccaccgggaucagcggc

SEQ ID NO: 1491947 - RNA, 13 nt, Pseudomonas aeruginosa PA01
cuggccacgccau

SEQ ID NO: 1491948 - RNA, 18 nt, Pseudomonas aeruginosa PA01
cuggccacgaacaggcug

SEQ ID NO: 1491949 - RNA, 12 nt, Pseudomonas aeruginosa PA01
cuggccaccagc

SEQ ID NO: 1491950 - RNA, 17 nt, Pseudomonas aeruginosa PA01
cuggccaccagcaccug

SEQ ID NO: 1491951 - RNA, 15 nt, Pseudomonas aeruginosa PA01
cuggcaccggccagg

SEQ ID NO: 1491952 - RNA, 16 nt, Pseudomonas aeruginosa PA01
cuggccagcaccaguc

SEQ ID NO: 1491953 - RNA, 23 nt, Pseudomonas aeruginosa PA01
cuggccagaaggucggggagagg

SEQ ID NO: 1491954 - RNA, 18 nt, Pseudomonas aeruginosa PA01
cuggccagaauuccagca

SEQ ID NO: 1491955 - RNA, 19 nt, Pseudomonas aeruginosa PA01
cuggcccaguugcccggcc

SEQ ID NO: 1491956 - RNA, 22 nt, Pseudomonas aeruginosa PA01
cuggcccucggcguucaccgcg

SEQ ID NO: 1491957 - RNA, 23 nt, Pseudomonas aeruginosa PA01
cuggcccucucucgccucggcgg

SEQ ID NO: 1491958 - RNA, 14 nt, Pseudomonas aeruginosa PA01
cuggcccugcaaca

SEQ ID NO: 1491959 - RNA, 22 nt, Pseudomonas aeruginosa PA01
cuggccgaaauugaccagguac

SEQ ID NO: 1491960 - RNA, 21 nt, Pseudomonas aeruginosa PA01
cuggccgccucgcgccgcgcc

SEQ ID NO: 1491961 - RNA, 19 nt, Pseudomonas aeruginosa PA01
cuggcccuccauccagucu

SEQ ID NO: 1491962 - RNA, 16 nt, Pseudomonas aeruginosa PA01
cuggcccuggaccucg

SEQ ID NO: 1491963 - RNA, 22 nt, Pseudomonas aeruginosa PA01
cuggcccuggauaucugggcca

SEQ ID NO: 1491964 - RNA, 22 nt, Pseudomonas aeruginosa PA01
cuggcccggcgcacugcguggg

SEQ ID NO: 1491965 - RNA, 14 nt, Pseudomonas aeruginosa PA01
cuggcccuggcgca

SEQ ID NO: 1491966 - RNA, 17 nt, Pseudomonas aeruginosa PA01
cuggcccuggcgcaggc

SEQ ID NO: 1491967 - RNA, 20 nt, Pseudomonas aeruginosa PA01
cuggcccugguacagcgccu

SEQ ID NO: 1491968 - RNA, 15 nt, Pseudomonas aeruginosa PA01
cuggccuuggccacg

SEQ ID NO: 1491969 - RNA, 23 nt, Pseudomonas aeruginosa PA01
cuggccucagggcgcgaaguagc

SEQ ID NO: 1491970 - RNA, 14 nt, Pseudomonas aeruginosa PA01
cuggccugggguag

SEQ ID NO: 1491971 - RNA, 19 nt, Pseudomonas aeruginosa PA01
cuggcgaaccaguccagca

SEQ ID NO: 1491972 - RNA, 22 nt, Pseudomonas aeruginosa PA01
cuggcgaaccaguccagcacgg

SEQ ID NO: 1491973 - RNA, 15 nt, Pseudomonas aeruginosa PA01
cuggcgaacggcugg

SEQ ID NO: 1491974 - RNA, 20 nt, Pseudomonas aeruginosa PA01
cuggcgaacggcuggucggc

SEQ ID NO: 1491975 - RNA, 22 nt, Pseudomonas aeruginosa PA01
cuggcgaauuuccugcuggcga

SEQ ID NO: 1491976 - RNA, 15 nt, Pseudomonas aeruginosa PA01
cuggcgacaggcgau

SEQ ID NO: 1491977 - RNA, 23 nt, Pseudomonas aeruginosa PA01
cuggcgacgcuuuccgaaaccag

SEQ ID NO: 1491978 - RNA, 15 nt, Pseudomonas aeruginosa PA01
cuggcgagaauggcg

SEQ ID NO: 1491979 - RNA, 17 nt, Pseudomonas aeruginosa PA01
cuggcgaggacgccggg

SEQ ID NO: 1491980 - RNA, 18 nt, Pseudomonas aeruginosa PA01
cuggcgaggacgccgggc

SEQ ID NO: 1491981 - RNA, 19 nt, Pseudomonas aeruginosa PA01
cuggcgaggacgccgggcu

SEQ ID NO: 1491982 - RNA, 21 nt, Pseudomonas aeruginosa PA01
cuggcgaggacgccgggcugg

SEQ ID NO: 1491983 - RNA, 21 nt, Pseudomonas aeruginosa PA01
cuggcgaggauuuccucgcgc

SEQ ID NO: 1491984 - RNA, 15 nt, Pseudomonas aeruginosa PA01
cuggcgaguggcgaa

SEQ ID NO: 1491985 - RNA, 18 nt, Pseudomonas aeruginosa PA01
cuggcgaguggcgaagcc

SEQ ID NO: 1491986 - RNA, 22 nt, Pseudomonas aeruginosa PA01
cuggccgcugccgcucuggcug

SEQ ID NO: 1491987 - RNA, 16 nt, Pseudomonas aeruginosa PA01
cuggccgcuguggaag

SEQ ID NO: 1491988 - RNA, 20 nt, Pseudomonas aeruginosa PA01
cuggccgcuguggaaguacg

SEQ ID NO: 1491989 - RNA, 19 nt, Pseudomonas aeruginosa PA01
cuggccgcgcgaccgcggc

SEQ ID NO: 1491990 - RNA, 22 nt, Pseudomonas aeruginosa PA01
cuggccgcgcgaccgcggcgcu

SEQ ID NO: 1491991 - RNA, 13 nt, Pseudomonas aeruginosa PA01
cuggccgcgcucc

SEQ ID NO: 1491992 - RNA, 20 nt, Pseudomonas aeruginosa PA01
cuggccgcgcuccaacaggc

SEQ ID NO: 1491993 - RNA, 17 nt, Pseudomonas aeruginosa PA01
cuggccggccagccagg

SEQ ID NO: 1491994 - RNA, 18 nt, Pseudomonas aeruginosa PA01
cuggccggccagccaggc

SEQ ID NO: 1491995 - RNA, 14 nt, Pseudomonas aeruginosa PA01
cuggccgcgcagga

SEQ ID NO: 1491996 - RNA, 14 nt, Pseudomonas aeruginosa PA01
cuggccgccuggcc

SEQ ID NO: 1491997 - RNA, 21 nt, Pseudomonas aeruginosa PA01
cuggccgcggugggcuccagc

SEQ ID NO: 1491998 - RNA, 15 nt, Pseudomonas aeruginosa PA01
cuggccgcguucgcc

SEQ ID NO: 1491999 - RNA, 20 nt, Pseudomonas aeruginosa PA01
cuggccgcguucgccgaggc

SEQ ID NO: 1492000 - RNA, 13 nt, Pseudomonas aeruginosa PA01
cuggccggcagca

SEQ ID NO: 1492001 - RNA, 16 nt, Pseudomonas aeruginosa PA01
cuggccggcagcagcg

SEQ ID NO: 1492002 - RNA, 13 nt, Pseudomonas aeruginosa PA01
cuggccggcgauc

SEQ ID NO: 1492003 - RNA, 13 nt, Pseudomonas aeruginosa PA01
cuggccggcggcg

SEQ ID NO: 1492004 - RNA, 17 nt, Pseudomonas aeruginosa PA01
cuggccgggaaccagca

SEQ ID NO: 1492005 - RNA, 19 nt, Pseudomonas aeruginosa PA01
cuggccgggaaccagcaug

SEQ ID NO: 1492006 - RNA, 15 nt, Pseudomonas aeruginosa PA01
cuggccucggcgauc

SEQ ID NO: 1492007 - RNA, 16 nt, Pseudomonas aeruginosa PA01
cuggccugcagcaggu

SEQ ID NO: 1492008 - RNA, 18 nt, Pseudomonas aeruginosa PA01
cuggccugccgaugggcc

SEQ ID NO: 1492009 - RNA, 20 nt, Pseudomonas aeruginosa PA01
cuggccuggaacuggucggg

SEQ ID NO: 1492010 - RNA, 17 nt, Pseudomonas aeruginosa PA01
cuggcgagcgucgaguc

SEQ ID NO: 1492011 - RNA, 21 nt, Pseudomonas aeruginosa PA01
cuggcgaggaacacccagaag

SEQ ID NO: 1492012 - RNA, 22 nt, Pseudomonas aeruginosa PA01
cuggcgaucaugccuucgaucu

SEQ ID NO: 1492013 - RNA, 16 nt, Pseudomonas aeruginosa PA01
cuggcgaucgaccugc

SEQ ID NO: 1492014 - RNA, 17 nt, Pseudomonas aeruginosa PA01
cuggcgaucgaccugcc

SEQ ID NO: 1492015 - RNA, 18 nt, Pseudomonas aeruginosa PA01
cuggcgaugcccuggccg

SEQ ID NO: 1492016 - RNA, 20 nt, Pseudomonas aeruginosa PA01
cuggcgaugcccuggccgcu

SEQ ID NO: 1492017 - RNA, 20 nt, Pseudomonas aeruginosa PA01
cuggcgauggaugacccgcu

SEQ ID NO: 1492018 - RNA, 17 nt, Pseudomonas aeruginosa PA01
cuggcgaucucggcgcg

SEQ ID NO: 1492019 - RNA, 15 nt, Pseudomonas aeruginosa PA01
cuggcgaucaggcca

SEQ ID NO: 1492020 - RNA, 19 nt, Pseudomonas aeruginosa PA01
cuggcgaucaggccaagcu

SEQ ID NO: 1492021 - RNA, 21 nt, Pseudomonas aeruginosa PA01
cuggcgauguagcugccggcg

SEQ ID NO: 1492022 - RNA, 13 nt, Pseudomonas aeruginosa PA01
cuggcgcaacagg

SEQ ID NO: 1492023 - RNA, 14 nt, Pseudomonas aeruginosa PA01
cuggcgcaacgccg

SEQ ID NO: 1492024 - RNA, 16 nt, Pseudomonas aeruginosa PA01
cuggcgcaacgccggc

SEQ ID NO: 1492025 - RNA, 17 nt, Pseudomonas aeruginosa PA01
cuggcgcaacgccggca

SEQ ID NO: 1492026 - RNA, 16 nt, Pseudomonas aeruginosa PA01
cuggcgcagcggcagc

SEQ ID NO: 1492027 - RNA, 18 nt, Pseudomonas aeruginosa PA01
cuggcgcagcggcagcgc

SEQ ID NO: 1492028 - RNA, 16 nt, Pseudomonas aeruginosa PA01
cuggcgcacggccugc

SEQ ID NO: 1492029 - RNA, 19 nt, Pseudomonas aeruginosa PA01
cuggcgcagacaggccucc

SEQ ID NO: 1492030 - RNA, 14 nt, Pseudomonas aeruginosa PA01
cuggcgcagccagg

SEQ ID NO: 1492031 - RNA, 15 nt, Pseudomonas aeruginosa PA01
cuggcgcagccaggc

SEQ ID NO: 1492032 - RNA, 13 nt, Pseudomonas aeruginosa PA01
cuggcgcagccgc

SEQ ID NO: 1492033 - RNA, 14 nt, Pseudomonas aeruginosa PA01
cuggcgcagccgcu

SEQ ID NO: 1492034 - RNA, 18 nt, Pseudomonas aeruginosa PA01
cuggcgcacacggucgag

SEQ ID NO: 1492035 - RNA, 17 nt, Pseudomonas aeruginosa PA01
cuggcgcaacugcgcca

SEQ ID NO: 1492036 - RNA, 19 nt, Pseudomonas aeruginosa PA01
cuggcgcaacugcgccagc

SEQ ID NO: 1492037 - RNA, 20 nt, Pseudomonas aeruginosa PA01
cuggcgcaauacaccgcugc

SEQ ID NO: 1492038 - RNA, 21 nt, Pseudomonas aeruginosa PA01
cuggcgcaauacaccgcugcg

SEQ ID NO: 1492039 - RNA, 22 nt, Pseudomonas aeruginosa PA01
cuggcgccagcguugcaggucg

SEQ ID NO: 1492040 - RNA, 15 nt, Pseudomonas aeruginosa PA01
cuggcgccaggccgc

SEQ ID NO: 1492041 - RNA, 20 nt, Pseudomonas aeruginosa PA01
cuggcgccaguaauggggau

SEQ ID NO: 1492042 - RNA, 16 nt, Pseudomonas aeruginosa PA01
cuggcgcaugucgcga

SEQ ID NO: 1492043 - RNA, 17 nt, Pseudomonas aeruginosa PA01
cuggcgcaugucgcgau

SEQ ID NO: 1492044 - RNA, 14 nt, Pseudomonas aeruginosa PA01
cuggcgcaggaccg

SEQ ID NO: 1492045 - RNA, 17 nt, Pseudomonas aeruginosa PA01
cuggcgcaggaccgcca

SEQ ID NO: 1492046 - RNA, 18 nt, Pseudomonas aeruginosa PA01
cuggcgcaggaccgccau

SEQ ID NO: 1492047 - RNA, 15 nt, Pseudomonas aeruginosa PA01
cuggcgcauccgccc

SEQ ID NO: 1492048 - RNA, 17 nt, Pseudomonas aeruginosa PA01
cuggcgcauccgcccga

SEQ ID NO: 1492049 - RNA, 19 nt, Pseudomonas aeruginosa PA01
cuggcgcauccgcccgauc

SEQ ID NO: 1492050 - RNA, 13 nt, Pseudomonas aeruginosa PA01
cuggcgcaggcgg

SEQ ID NO: 1492051 - RNA, 15 nt, Pseudomonas aeruginosa PA01
cuggcgcaggcggcg

SEQ ID NO: 1492052 - RNA, 23 nt, Pseudomonas aeruginosa PA01
cuggcgcgcgcgccaggucgaga

SEQ ID NO: 1492053 - RNA, 16 nt, Pseudomonas aeruginosa PA01
cuggcgcgcggccgcg

SEQ ID NO: 1492054 - RNA, 21 nt, Pseudomonas aeruginosa PA01
cuggcgcgacgaggcgcggcg

SEQ ID NO: 1492055 - RNA, 23 nt, Pseudomonas aeruginosa PA01
cuggcgcgacgaggcgcggcgga

SEQ ID NO: 1492056 - RNA, 22 nt, Pseudomonas aeruginosa PA01
cuggcgcgagaagccagccagg

SEQ ID NO: 1492057 - RNA, 12 nt, Pseudomonas aeruginosa PA01
cuggcgccggua

SEQ ID NO: 1492058 - RNA, 14 nt, Pseudomonas aeruginosa PA01
cuggcgccgguaau

SEQ ID NO: 1492059 - RNA, 13 nt, Pseudomonas aeruginosa PA01
cuggcgccgucau

SEQ ID NO: 1492060 - RNA, 15 nt, Pseudomonas aeruginosa PA01
cuugucguucggccc

SEQ ID NO: 1492061 - RNA, 14 nt, Pseudomonas aeruginosa PA01
cuugucgccgguga

SEQ ID NO: 1492062 - RNA, 16 nt, Pseudomonas aeruginosa PA01
cuugucgccggugagg

SEQ ID NO: 1492063 - RNA, 19 nt, Pseudomonas aeruginosa PA01
cuugucgaugagccagccu

SEQ ID NO: 1492064 - RNA, 14 nt, Pseudomonas aeruginosa PA01
cuugucgcaccagc

SEQ ID NO: 1492065 - RNA, 12 nt, Pseudomonas aeruginosa PA01
cuugucgccgcu

SEQ ID NO: 1492066 - RNA, 19 nt, Pseudomonas aeruginosa PA01
cuugucgccgcugggcagc

SEQ ID NO: 1492067 - RNA, 17 nt, Pseudomonas aeruginosa PA01
cuuguccuccagcugcg

SEQ ID NO: 1492068 - RNA, 23 nt, Pseudomonas aeruginosa PA01
cuuguccuccagcugcgccugca

SEQ ID NO: 1492069 - RNA, 20 nt, Pseudomonas aeruginosa PA01
cuuguccuggauaagccgcg

SEQ ID NO: 1492070 - RNA, 22 nt, Pseudomonas aeruginosa PA01
cuuguccuggauaagccgcgcc

SEQ ID NO: 1492071 - RNA, 17 nt, Pseudomonas aeruginosa PA01
cuuguccuucggccagu

SEQ ID NO: 1492072 - RNA, 14 nt, Pseudomonas aeruginosa PA01
cuugucgaccagcg

SEQ ID NO: 1492073 - RNA, 17 nt, Pseudomonas aeruginosa PA01
cuugucgaccagcggcg

SEQ ID NO: 1492074 - RNA, 16 nt, Pseudomonas aeruginosa PA01
cuuggucagggucgag

SEQ ID NO: 1492075 - RNA, 17 nt, Pseudomonas aeruginosa PA01
cuuguccacgucguagg

SEQ ID NO: 1492076 - RNA, 13 nt, Pseudomonas aeruginosa PA01
cuuguccaggcgc

SEQ ID NO: 1492077 - RNA, 23 nt, Pseudomonas aeruginosa PA01
cuuguccggguaguccagcgagu

SEQ ID NO: 1492078 - RNA, 18 nt, Pseudomonas aeruginosa PA01
cuuucagcgccgcucggc

SEQ ID NO: 1492079 - RNA, 13 nt, Pseudomonas aeruginosa PA01
aaccguuccagcg

SEQ ID NO: 1492080 - RNA, 17 nt, Pseudomonas aeruginosa PA01
aaccguuccagcgccuc

SEQ ID NO: 1492081 - RNA, 18 nt, Pseudomonas aeruginosa PA01
cuucgguggauucgaagg

SEQ ID NO: 1492082 - RNA, 17 nt, Pseudomonas aeruginosa PA01
cuucgguggcgaccagg

SEQ ID NO: 1492083 - RNA, 14 nt, Pseudomonas aeruginosa PA01
cuucguccaggccg

SEQ ID NO: 1492084 - RNA, 13 nt, Pseudomonas aeruginosa PA01
cuucguccucgug

SEQ ID NO: 1492085 - RNA, 15 nt, Pseudomonas aeruginosa PA01
cuucguccucguggc

SEQ ID NO: 1492086 - RNA, 20 nt, Pseudomonas aeruginosa PA01
cuucguccggccgcccgagc

SEQ ID NO: 1492087 - RNA, 19 nt, Pseudomonas aeruginosa PA01
cuucguccugcugcuggcc

SEQ ID NO: 1492088 - RNA, 15 nt, Pseudomonas aeruginosa PA01
cuucgucgcgcaggc

SEQ ID NO: 1492089 - RNA, 23 nt, Pseudomonas aeruginosa PA01
cuugcgucccuuggcgucgcggc

SEQ ID NO: 1492090 - RNA, 16 nt, Pseudomonas aeruginosa PA01
cuucgugcuggcggau

SEQ ID NO: 1492091 - RNA, 14 nt, Pseudomonas aeruginosa PA01
cuugcucucgcgca

SEQ ID NO: 1492092 - RNA, 12 nt, Pseudomonas aeruginosa PA01
cuugcucgcggc

SEQ ID NO: 1492093 - RNA, 17 nt, Pseudomonas aeruginosa PA01
cuuggagcgggcgccgg

SEQ ID NO: 1492094 - RNA, 13 nt, Pseudomonas aeruginosa PA01
cuuggacagcguc

SEQ ID NO: 1492095 - RNA, 19 nt, Pseudomonas aeruginosa PA01
cuugcuggugcccugggcg

SEQ ID NO: 1492096 - RNA, 18 nt, Pseudomonas aeruginosa PA01
cuugcuggcgcgauccgc

SEQ ID NO: 1492097 - RNA, 21 nt, Pseudomonas aeruginosa PA01
cuugcuggcgcgauccgcgcg

SEQ ID NO: 1492098 - RNA, 22 nt, Pseudomonas aeruginosa PA01
cuugcuggcguucucggccagg

SEQ ID NO: 1492099 - RNA, 15 nt, Pseudomonas aeruginosa PA01
cuugcuguugccgcu

SEQ ID NO: 1492100 - RNA, 17 nt, Pseudomonas aeruginosa PA01
cuugcuguugccgcugc

SEQ ID NO: 1492101 - RNA, 21 nt, Pseudomonas aeruginosa PA01
cuuggcggucagcgacuggcc

SEQ ID NO: 1492102 - RNA, 16 nt, Pseudomonas aeruginosa PA01
cuuggcggcgaucgcc

SEQ ID NO: 1492103 - RNA, 19 nt, Pseudomonas aeruginosa PA01
cuuggcgcgacugucgagc

SEQ ID NO: 1492104 - RNA, 13 nt, Pseudomonas aeruginosa PA01
cuuggcgcgcagg

SEQ ID NO: 1492105 - RNA, 15 nt, Pseudomonas aeruginosa PA01
cuuggcgcgcagggc

SEQ ID NO: 1492106 - RNA, 19 nt, Pseudomonas aeruginosa PA01
cuuggcgcgcagggcaucg

SEQ ID NO: 1492107 - RNA, 22 nt, Pseudomonas aeruginosa PA01
cuuggcgcgcagggcaucgaug

SEQ ID NO: 1492108 - RNA, 12 nt, Pseudomonas aeruginosa PA01
cuuggcgcaggu

SEQ ID NO: 1492109 - RNA, 15 nt, Pseudomonas aeruginosa PA01
cuuggcgcagguagu

SEQ ID NO: 1492110 - RNA, 13 nt, Pseudomonas aeruginosa PA01
cuuggcgcgcugg

SEQ ID NO: 1492111 - RNA, 14 nt, Pseudomonas aeruginosa PA01
cuuggcgcgcuggc

SEQ ID NO: 1492112 - RNA, 15 nt, Pseudomonas aeruginosa PA01
cuuggcgcgcuggca

SEQ ID NO: 1492113 - RNA, 19 nt, Pseudomonas aeruginosa PA01
cuuggcacggccggcggug

SEQ ID NO: 1492114 - RNA, 15 nt, Pseudomonas aeruginosa PA01
cuuggcaucgccgcc

SEQ ID NO: 1492115 - RNA, 17 nt, Pseudomonas aeruginosa PA01
cuuggccacgacccugc

SEQ ID NO: 1492116 - RNA, 17 nt, Pseudomonas aeruginosa PA01
cuuggccagcagcaucg

SEQ ID NO: 1492117 - RNA, 12 nt, Pseudomonas aeruginosa PA01
cuuggccagccg

SEQ ID NO: 1492118 - RNA, 13 nt, Pseudomonas aeruginosa PA01
cuuggccagcagg

SEQ ID NO: 1492119 - RNA, 19 nt, Pseudomonas aeruginosa PA01
cuuggccagcaggccgagc

SEQ ID NO: 1492120 - RNA, 19 nt, Pseudomonas aeruginosa PA01
cuuggcaccgcgcagcguc

SEQ ID NO: 1492121 - RNA, 16 nt, Pseudomonas aeruginosa PA01
cuugggcgccucgccg

SEQ ID NO: 1492122 - RNA, 15 nt, Pseudomonas aeruginosa PA01
cuugggauggccagc

SEQ ID NO: 1492123 - RNA, 17 nt, Pseudomonas aeruginosa PA01
cuuggcuuccuggcgcc

SEQ ID NO: 1492124 - RNA, 14 nt, Pseudomonas aeruginosa PA01
cuuggcucggcagc

SEQ ID NO: 1492125 - RNA, 15 nt, Pseudomonas aeruginosa PA01
cuuggucaggccgac

SEQ ID NO: 1492126 - RNA, 23 nt, Pseudomonas aeruginosa PA01
cuuggucaggccgaccagcgccg

SEQ ID NO: 1492127 - RNA, 21 nt, Pseudomonas aeruginosa PA01
cuugggcgccucgccgcggca

SEQ ID NO: 1492128 - RNA, 13 nt, Pseudomonas aeruginosa PA01
cuuucugcccggc

SEQ ID NO: 1492129 - RNA, 22 nt, Pseudomonas aeruginosa PA01
cuuucgaucuggcugcccaggc

SEQ ID NO: 1492130 - RNA, 19 nt, Pseudomonas aeruginosa PA01
cuuucgaugguugccggug

SEQ ID NO: 1492131 - RNA, 19 nt, Pseudomonas aeruginosa PA01
cuuucgagaaagcgcagga

SEQ ID NO: 1492132 - RNA, 21 nt, Pseudomonas aeruginosa PA01
cuuucguaggcaggcgcggca

SEQ ID NO: 1492133 - RNA, 13 nt, Pseudomonas aeruginosa PA01
cuuuccgccgagc

SEQ ID NO: 1492134 - RNA, 20 nt, Pseudomonas aeruginosa PA01
cuuuccggcuugaccgccgc

SEQ ID NO: 1492135 - RNA, 20 nt, Pseudomonas aeruginosa PA01
cuuuccgucucaggcgccag

SEQ ID NO: 1492136 - RNA, 23 nt, Pseudomonas aeruginosa PA01
cuuuccgucucaggcgccaggcc

SEQ ID NO: 1492137 - RNA, 21 nt, Pseudomonas aeruginosa PA01
cuuuccucggccaugccggcc

SEQ ID NO: 1492138 - RNA, 15 nt, Pseudomonas aeruginosa PA01
cuuuccugcgccucg

SEQ ID NO: 1492139 - RNA, 18 nt, Pseudomonas aeruginosa PA01
cuuuccuggccgacccgc

SEQ ID NO: 1492140 - RNA, 23 nt, Pseudomonas aeruginosa PA01
cuuuccuuucacaugcaccaggc

SEQ ID NO: 1492141 - RNA, 15 nt, Pseudomonas aeruginosa PA01
cuuuccagcccggcg

SEQ ID NO: 1492142 - RNA, 17 nt, Pseudomonas aeruginosa PA01
cuuuccagggccuggcg

SEQ ID NO: 1492143 - RNA, 19 nt, Pseudomonas aeruginosa PA01
cuuugcgcagccacccgcu

SEQ ID NO: 1492144 - RNA, 12 nt, Pseudomonas aeruginosa PA01
cuuugcggcaag

SEQ ID NO: 1492145 - RNA, 21 nt, Pseudomonas aeruginosa PA01
cuuugcggcaaggcgaucccg

SEQ ID NO: 1492146 - RNA, 22 nt, Pseudomonas aeruginosa PA01
cuuucuucgccuggcgcgacga

SEQ ID NO: 1492147 - RNA, 21 nt, Pseudomonas aeruginosa PA01
cuuugcccgucuagcgcaggc

SEQ ID NO: 1492148 - RNA, 20 nt, Pseudomonas aeruginosa PA01
cuuugagggucagaccagcc

SEQ ID NO: 1492149 - RNA, 17 nt, Pseudomonas aeruginosa PA01
cuuuuccaccggccgcg

SEQ ID NO: 1492150 - RNA, 19 nt, Pseudomonas aeruginosa PA01
cuuuuccaccggccgcgcc

SEQ ID NO: 1492151 - RNA, 15 nt, Pseudomonas aeruginosa PA01
cuuuuccagcgcacc

SEQ ID NO: 1492152 - RNA, 20 nt, Pseudomonas aeruginosa PA01
cuuuuccucgaucaggccuu

SEQ ID NO: 1492153 - RNA, 15 nt, Pseudomonas aeruginosa PA01
cuuuucgcuuugcgc

SEQ ID NO: 1492154 - RNA, 22 nt, Pseudomonas aeruginosa PA01
cuuuuucauggcuggcccucag

SEQ ID NO: 1492155 - RNA, 17 nt, Pseudomonas aeruginosa PA01
cuuuucugccacccggc

SEQ ID NO: 1492156 - RNA, 15 nt, Pseudomonas aeruginosa PA01
cuuuucggcggccag

SEQ ID NO: 1492157 - RNA, 12 nt, Pseudomonas aeruginosa PA01
gaaaacgcccgg

SEQ ID NO: 1492158 - RNA, 16 nt, Pseudomonas aeruginosa PA01
gaaaacgcccggcaga

SEQ ID NO: 1492159 - RNA, 14 nt, Pseudomonas aeruginosa PA01
gaaaaaggcgccuu

SEQ ID NO: 1492160 - RNA, 22 nt, Pseudomonas aeruginosa PA01
gaaaaagcccggccgcugccgg

SEQ ID NO: 1492161 - RNA, 22 nt, Pseudomonas aeruginosa PA01
cuuuuucacuacaggaccuuca

SEQ ID NO: 1492162 - RNA, 17 nt, Pseudomonas aeruginosa PA01
cuuuuucgucgccagcc

SEQ ID NO: 1492163 - RNA, 15 nt, Pseudomonas aeruginosa PA01
gaaaaacccaugcgg

SEQ ID NO: 1492164 - RNA, 13 nt, Pseudomonas aeruginosa PA01
gaaaaaaggggau

SEQ ID NO: 1492165 - RNA, 18 nt, Pseudomonas aeruginosa PA01
gaacgaguugggcgaccu

SEQ ID NO: 1492166 - RNA, 20 nt, Pseudomonas aeruginosa PA01
gaacgaguugggcgaccugc

SEQ ID NO: 1492167 - RNA, 22 nt, Pseudomonas aeruginosa PA01
gaacgaguugggcgaccugcuc

SEQ ID NO: 1492168 - RNA, 21 nt, Pseudomonas aeruginosa PA01
gaacgccucgcagagcgccag

SEQ ID NO: 1492169 - RNA, 23 nt, Pseudomonas aeruginosa PA01
gaacgccucgcagagcgccagcc

SEQ ID NO: 1492170 - RNA, 16 nt, Pseudomonas aeruginosa PA01
gaacgaggcgacccgg

SEQ ID NO: 1492171 - RNA, 13 nt, Pseudomonas aeruginosa PA01
gaacgacucuucg

SEQ ID NO: 1492172 - RNA, 12 nt, Pseudomonas aeruginosa PA01
gaacgcgccacg

SEQ ID NO: 1492173 - RNA, 12 nt, Pseudomonas aeruginosa PA01
gaacgcgcccgg

SEQ ID NO: 1492174 - RNA, 14 nt, Pseudomonas aeruginosa PA01
gaacgcgcccggcc

SEQ ID NO: 1492175 - RNA, 16 nt, Pseudomonas aeruginosa PA01
gaacgcgcccggccag

SEQ ID NO: 1492176 - RNA, 17 nt, Pseudomonas aeruginosa PA01
gaacgcgcccggccagg

SEQ ID NO: 1492177 - RNA, 20 nt, Pseudomonas aeruginosa PA01
gaacgcgcccggccaggccg

SEQ ID NO: 1492178 - RNA, 17 nt, Pseudomonas aeruginosa PA01
gaacgcuugagccccgg

SEQ ID NO: 1492179 - RNA, 15 nt, Pseudomonas aeruginosa PA01
gaacgcuucgaagcu

SEQ ID NO: 1492180 - RNA, 19 nt, Pseudomonas aeruginosa PA01
gaacgcucccagccgacgu

SEQ ID NO: 1492181 - RNA, 20 nt, Pseudomonas aeruginosa PA01
gaacgcgugaagcuggagca

SEQ ID NO: 1492182 - RNA, 14 nt, Pseudomonas aeruginosa PA01
gaacgucucggcga

SEQ ID NO: 1492183 - RNA, 14 nt, Pseudomonas aeruginosa PA01
gaacgucggccugg

SEQ ID NO: 1492184 - RNA, 23 nt, Pseudomonas aeruginosa PA01
gaacgucuggccagaaggucggg

SEQ ID NO: 1492185 - RNA, 13 nt, Pseudomonas aeruginosa PA01
gaacgguugucga

SEQ ID NO: 1492186 - RNA, 21 nt, Pseudomonas aeruginosa PA01
gaacgggcguugccggcauug

SEQ ID NO: 1492187 - RNA, 21 nt, Pseudomonas aeruginosa PA01
gaacggguugaucagguucgg

SEQ ID NO: 1492188 - RNA, 18 nt, Pseudomonas aeruginosa PA01
gaacgugcgcgcaacugg

SEQ ID NO: 1492189 - RNA, 14 nt, Pseudomonas aeruginosa PA01
gaacgugcggccug

SEQ ID NO: 1492190 - RNA, 15 nt, Pseudomonas aeruginosa PA01
gaacgugcggccugc

SEQ ID NO: 1492191 - RNA, 17 nt, Pseudomonas aeruginosa PA01
gaacgugcggccugcaa

SEQ ID NO: 1492192 - RNA, 21 nt, Pseudomonas aeruginosa PA01
gaacuccgccagcaccacccg

SEQ ID NO: 1492193 - RNA, 14 nt, Pseudomonas aeruginosa PA01
gaacuccuugccgu

SEQ ID NO: 1492194 - RNA, 19 nt, Pseudomonas aeruginosa PA01
gaacucgaaggccagcucg

SEQ ID NO: 1492195 - RNA, 23 nt, Pseudomonas aeruginosa PA01
gaacucgaaggccagcucgucgc

SEQ ID NO: 1492196 - RNA, 24 nt, Pseudomonas aeruginosa PA01
gaacucgaaggccagcucgucgcc

SEQ ID NO: 1492197 - RNA, 18 nt, Pseudomonas aeruginosa PA01
gaacucauucaucucgcc

SEQ ID NO: 1492198 - RNA, 20 nt, Pseudomonas aeruginosa PA01
gaacucacggaugccgggcg

SEQ ID NO: 1492199 - RNA, 20 nt, Pseudomonas aeruginosa PA01
gaacccaggccgcgcagcaa

SEQ ID NO: 1492200 - RNA, 21 nt, Pseudomonas aeruginosa PA01
gaacccagguucuggucgccg

SEQ ID NO: 1492201 - RNA, 18 nt, Pseudomonas aeruginosa PA01
gaacccauggcgcgaugc

SEQ ID NO: 1492202 - RNA, 21 nt, Pseudomonas aeruginosa PA01
gaaccagugcgcgguccgcgu

SEQ ID NO: 1492203 - RNA, 16 nt, Pseudomonas aeruginosa PA01
gaaccaguugccgagc

SEQ ID NO: 1492204 - RNA, 16 nt, Pseudomonas aeruginosa PA01
gaaccaggcggccgaa

SEQ ID NO: 1492205 - RNA, 21 nt, Pseudomonas aeruginosa PA01
gaaccaggcggugucgcgguu

SEQ ID NO: 1492206 - RNA, 17 nt, Pseudomonas aeruginosa PA01
gaaccagggacgcccgg

SEQ ID NO: 1492207 - RNA, 19 nt, Pseudomonas aeruginosa PA01
gaaccagggacgcccggag

SEQ ID NO: 1492208 - RNA, 18 nt, Pseudomonas aeruginosa PA01
gaaccauccggaguucgc

SEQ ID NO: 1492209 - RNA, 23 nt, Pseudomonas aeruginosa PA01
gaaccauccggaguucgcccgcc

SEQ ID NO: 1492210 - RNA, 23 nt, Pseudomonas aeruginosa PA01
gaaccagcucagcuccaggccgc

SEQ ID NO: 1492211 - RNA, 15 nt, Pseudomonas aeruginosa PA01
gaaccagccgcguug

SEQ ID NO: 1492212 - RNA, 19 nt, Pseudomonas aeruginosa PA01
gaaccaggcaauggccggc

SEQ ID NO: 1492213 - RNA, 20 nt, Pseudomonas aeruginosa PA01
gaaccaggcaauggccggcg

SEQ ID NO: 1492214 - RNA, 17 nt, Pseudomonas aeruginosa PA01
gaaccaggcgccgaugc

SEQ ID NO: 1492215 - RNA, 18 nt, Pseudomonas aeruginosa PA01
gaaccagcauguccugca

SEQ ID NO: 1492216 - RNA, 22 nt, Pseudomonas aeruginosa PA01
gaaccacgaagaacggcgcggu

SEQ ID NO: 1492217 - RNA, 16 nt, Pseudomonas aeruginosa PA01
gaacagcgagaccucg

SEQ ID NO: 1492218 - RNA, 14 nt, Pseudomonas aeruginosa PA01
gaacagcgccacca

SEQ ID NO: 1492219 - RNA, 15 nt, Pseudomonas aeruginosa PA01
gaacagcgccaccag

SEQ ID NO: 1492220 - RNA, 18 nt, Pseudomonas aeruginosa PA01
gaacagcgccaccagcau

SEQ ID NO: 1492221 - RNA, 14 nt, Pseudomonas aeruginosa PA01
gaacagcgccagcg

SEQ ID NO: 1492222 - RNA, 15 nt, Pseudomonas aeruginosa PA01
gaacagcgccagcgg

SEQ ID NO: 1492223 - RNA, 19 nt, Pseudomonas aeruginosa PA01
gaacagcgccagcggcagc

SEQ ID NO: 1492224 - RNA, 17 nt, Pseudomonas aeruginosa PA01
gaacagcgccgcggcug

SEQ ID NO: 1492225 - RNA, 20 nt, Pseudomonas aeruginosa PA01
gaacagcgccgcggcuggcc

SEQ ID NO: 1492226 - RNA, 22 nt, Pseudomonas aeruginosa PA01
gaacagcgccgcggcuggccau

SEQ ID NO: 1492227 - RNA, 19 nt, Pseudomonas aeruginosa PA01
gaacagcgacucgaugcgc

SEQ ID NO: 1492228 - RNA, 19 nt, Pseudomonas aeruginosa PA01
gaacagcgcuuccugggaa

SEQ ID NO: 1492229 - RNA, 13 nt, Pseudomonas aeruginosa PA01
gaacagcgcgcca

SEQ ID NO: 1492230 - RNA, 23 nt, Pseudomonas aeruginosa PA01
gaacagcggcccgagggucgccu

SEQ ID NO: 1492231 - RNA, 21 nt, Pseudomonas aeruginosa PA01
gaacagcuccuccagccgcgg

SEQ ID NO: 1492232 - RNA, 11 nt, Pseudomonas aeruginosa PA01
gaacagcggcu

SEQ ID NO: 1492233 - RNA, 15 nt, Pseudomonas aeruginosa PA01
gaacagcggcuggcc

SEQ ID NO: 1492234 - RNA, 17 nt, Pseudomonas aeruginosa PA01
gaacagcggcuggcccu

SEQ ID NO: 1492235 - RNA, 24 nt, Pseudomonas aeruginosa PA01
gaacagcggcuggcccucggcguu

SEQ ID NO: 1492236 - RNA, 12 nt, Pseudomonas aeruginosa PA01
gaacccgcccuc

SEQ ID NO: 1492237 - RNA, 15 nt, Pseudomonas aeruginosa PA01
gaaccccgggccgcg

SEQ ID NO: 1492238 - RNA, 16 nt, Pseudomonas aeruginosa PA01
gaaccccuggcgcucg

SEQ ID NO: 1492239 - RNA, 19 nt, Pseudomonas aeruginosa PA01
gaacccgcccucguggcgg

SEQ ID NO: 1492240 - RNA, 21 nt, Pseudomonas aeruginosa PA01
gaacccgcuucgucggucgcg

SEQ ID NO: 1492241 - RNA, 21 nt, Pseudomonas aeruginosa PA01
gaacccggcgcggcgcagcca

SEQ ID NO: 1492242 - RNA, 20 nt, Pseudomonas aeruginosa PA01
gaacccucggugcggccgag

SEQ ID NO: 1492243 - RNA, 18 nt, Pseudomonas aeruginosa PA01
gaaccgagacccuggcgc

SEQ ID NO: 1492244 - RNA, 23 nt, Pseudomonas aeruginosa PA01
gaaccgagacccuggcgcugucg

SEQ ID NO: 1492245 - RNA, 15 nt, Pseudomonas aeruginosa PA01
gaaccgagcggucgg

SEQ ID NO: 1492246 - RNA, 18 nt, Pseudomonas aeruginosa PA01
gaaccgaguuucccggcg

SEQ ID NO: 1492247 - RNA, 19 nt, Pseudomonas aeruginosa PA01
gaaccgaguuucccggcgc

SEQ ID NO: 1492248 - RNA, 22 nt, Pseudomonas aeruginosa PA01
gaaccgaguuucccggcgcggc

SEQ ID NO: 1492249 - RNA, 21 nt, Pseudomonas aeruginosa PA01
gaaccggccauuacgccgagc

SEQ ID NO: 1492250 - RNA, 22 nt, Pseudomonas aeruginosa PA01
gaaccggccauuacgccgagca

SEQ ID NO: 1492251 - RNA, 14 nt, Pseudomonas aeruginosa PA01
gaacgacagcacca

SEQ ID NO: 1492252 - RNA, 17 nt, Pseudomonas aeruginosa PA01
gaacgacagcaccaugc

SEQ ID NO: 1492253 - RNA, 16 nt, Pseudomonas aeruginosa PA01
gaaccggggcguuaca

SEQ ID NO: 1492254 - RNA, 14 nt, Pseudomonas aeruginosa PA01
gaacgacaugcuca

SEQ ID NO: 1492255 - RNA, 14 nt, Pseudomonas aeruginosa PA01
gaacgaccacgccu

SEQ ID NO: 1492256 - RNA, 15 nt, Pseudomonas aeruginosa PA01
aaccugccugcgcag

SEQ ID NO: 1492257 - RNA, 13 nt, Pseudomonas aeruginosa PA01
gaaaaggaucgcc

SEQ ID NO: 1492258 - RNA, 15 nt, Pseudomonas aeruginosa PA01
gaaaacugucggcgg

SEQ ID NO: 1492259 - RNA, 23 nt, Pseudomonas aeruginosa PA01
gaaaagaagccccgcagccgcgg

SEQ ID NO: 1492260 - RNA, 21 nt, Pseudomonas aeruginosa PA01
gaaaagcccagguggcaggcc

SEQ ID NO: 1492261 - RNA, 15 nt, Pseudomonas aeruginosa PA01
aaccuucgguggcga

SEQ ID NO: 1492262 - RNA, 17 nt, Pseudomonas aeruginosa PA01
aaccuucucccuucagg

SEQ ID NO: 1492263 - RNA, 16 nt, Pseudomonas aeruginosa PA01
aaccugugcugcgcgc

SEQ ID NO: 1492264 - RNA, 20 nt, Pseudomonas aeruginosa PA01
aaccugugcugcgcgccgca

SEQ ID NO: 1492265 - RNA, 18 nt, Pseudomonas aeruginosa PA01
aacgaaaaaggcgcgccg

SEQ ID NO: 1492266 - RNA, 14 nt, Pseudomonas aeruginosa PA01
gaaaaucggcagua

SEQ ID NO: 1492267 - RNA, 15 nt, Pseudomonas aeruginosa PA01
gaaacaccaggccga

SEQ ID NO: 1492268 - RNA, 15 nt, Pseudomonas aeruginosa PA01
gaaacagggcgacca

SEQ ID NO: 1492269 - RNA, 13 nt, Pseudomonas aeruginosa PA01
gaaaccaccugga

SEQ ID NO: 1492270 - RNA, 22 nt, Pseudomonas aeruginosa PA01
gaaaucaggaaggucucgccgc

SEQ ID NO: 1492271 - RNA, 16 nt, Pseudomonas aeruginosa PA01
gaaauccaccagcacg

SEQ ID NO: 1492272 - RNA, 18 nt, Pseudomonas aeruginosa PA01
gaaaucaucggcccuggg

SEQ ID NO: 1492273 - RNA, 21 nt, Pseudomonas aeruginosa PA01
gaaaugcaggccgguggucgg

SEQ ID NO: 1492274 - RNA, 19 nt, Pseudomonas aeruginosa PA01
gaaauacucgucgacggcc

SEQ ID NO: 1492275 - RNA, 14 nt, Pseudomonas aeruginosa PA01
gaaacgcgccuccg

SEQ ID NO: 1492276 - RNA, 21 nt, Pseudomonas aeruginosa PA01
gaaacgcgcgcucucgccggc

SEQ ID NO: 1492277 - RNA, 17 nt, Pseudomonas aeruginosa PA01
gaaaccgaucagcaccg

SEQ ID NO: 1492278 - RNA, 18 nt, Pseudomonas aeruginosa PA01
gaaacccucaggucggcg

SEQ ID NO: 1492279 - RNA, 20 nt, Pseudomonas aeruginosa PA01
gaaacccuuccagccgcccu

SEQ ID NO: 1492280 - RNA, 13 nt, Pseudomonas aeruginosa PA01
gaaaccgcggccg

SEQ ID NO: 1492281 - RNA, 18 nt, Pseudomonas aeruginosa PA01
gaaaccccggccuggcgc

SEQ ID NO: 1492282 - RNA, 20 nt, Pseudomonas aeruginosa PA01
gaaaccccggccuggcgccg

SEQ ID NO: 1492283 - RNA, 20 nt, Pseudomonas aeruginosa PA01
gaaacccgugguccgccagc

SEQ ID NO: 1492284 - RNA, 22 nt, Pseudomonas aeruginosa PA01
gaaacccgugguccgccagcag

SEQ ID NO: 1492285 - RNA, 15 nt, Pseudomonas aeruginosa PA01
gaaacgguccaccag

SEQ ID NO: 1492286 - RNA, 17 nt, Pseudomonas aeruginosa PA01
gaaacgguggaggcguc

SEQ ID NO: 1492287 - RNA, 14 nt, Pseudomonas aeruginosa PA01
gaaacgggcgcucu

SEQ ID NO: 1492288 - RNA, 22 nt, Pseudomonas aeruginosa PA01
gaaacgggcgcucuggccgcgc

SEQ ID NO: 1492289 - RNA, 16 nt, Pseudomonas aeruginosa PA01
gaaacgcuuggcgauc

SEQ ID NO: 1492290 - RNA, 16 nt, Pseudomonas aeruginosa PA01
gaaacgcuggcggccg

SEQ ID NO: 1492291 - RNA, 16 nt, Pseudomonas aeruginosa PA01
gaaacggaucacgauc

SEQ ID NO: 1492292 - RNA, 16 nt, Pseudomonas aeruginosa PA01
gaacacgucggcgcgc

SEQ ID NO: 1492293 - RNA, 20 nt, Pseudomonas aeruginosa PA01
gaacaccugcguggcgaacg

SEQ ID NO: 1492294 - RNA, 21 nt, Pseudomonas aeruginosa PA01
gaacaccguguugaucgccgc

SEQ ID NO: 1492295 - RNA, 21 nt, Pseudomonas aeruginosa PA01
gaacacgccccagaagcccca

SEQ ID NO: 1492296 - RNA, 23 nt, Pseudomonas aeruginosa PA01
gaacaacuggacgaaggccuccu

SEQ ID NO: 1492297 - RNA, 14 nt, Pseudomonas aeruginosa PA01
gaacaagccgccuu

SEQ ID NO: 1492298 - RNA, 17 nt, Pseudomonas aeruginosa PA01
gaacaagugcucgaugg

SEQ ID NO: 1492299 - RNA, 14 nt, Pseudomonas aeruginosa PA01
gaacacacccugcg

SEQ ID NO: 1492300 - RNA, 23 nt, Pseudomonas aeruginosa PA01
gaacacacgcuucugcuggccgc

SEQ ID NO: 1492301 - RNA, 16 nt, Pseudomonas aeruginosa PA01
gaacaaucggucgccc

SEQ ID NO: 1492302 - RNA, 21 nt, Pseudomonas aeruginosa PA01
gaacaccugcaucaccaggcu

SEQ ID NO: 1492303 - RNA, 17 nt, Pseudomonas aeruginosa PA01
gaacacauagaccagca

SEQ ID NO: 1492304 - RNA, 15 nt, Pseudomonas aeruginosa PA01
gaacaacccgccagc

SEQ ID NO: 1492305 - RNA, 16 nt, Pseudomonas aeruginosa PA01
gaacaaccgcucgcgg

SEQ ID NO: 1492306 - RNA, 15 nt, Pseudomonas aeruginosa PA01
gaacaaccgcuugcg

SEQ ID NO: 1492307 - RNA, 22 nt, Pseudomonas aeruginosa PA01
gaacaaccgcuugucgccuucc

SEQ ID NO: 1492308 - RNA, 16 nt, Pseudomonas aeruginosa PA01
gaaaugccgcacccca

SEQ ID NO: 1492309 - RNA, 20 nt, Pseudomonas aeruginosa PA01
gaaaugcucgugcagguagc

SEQ ID NO: 1492310 - RNA, 20 nt, Pseudomonas aeruginosa PA01
gaaauggcaacccagggcgc

SEQ ID NO: 1492311 - RNA, 19 nt, Pseudomonas aeruginosa PA01
gaaauggguucccagcagc

SEQ ID NO: 1492312 - RNA, 16 nt, Pseudomonas aeruginosa PA01
gcgcggguggcgucga

SEQ ID NO: 1492313 - RNA, 16 nt, Pseudomonas aeruginosa PA01
gcgcggguguccucga

SEQ ID NO: 1492314 - RNA, 20 nt, Pseudomonas aeruginosa PA01
gcgcggguguccucgaucau

SEQ ID NO: 1492315 - RNA, 19 nt, Pseudomonas aeruginosa PA01
gcgcggguucgugccaggc

SEQ ID NO: 1492316 - RNA, 18 nt, Pseudomonas aeruginosa PA01
gcgcggguuuccgugcgc

SEQ ID NO: 1492317 - RNA, 18 nt, Pseudomonas aeruginosa PA01
gcgcgggguggccgugca

SEQ ID NO: 1492318 - RNA, 18 nt, Pseudomonas aeruginosa PA01
gcgcgggucuugccgguc

SEQ ID NO: 1492319 - RNA, 20 nt, Pseudomonas aeruginosa PA01
gcgcggucucuucgucgguc

SEQ ID NO: 1492320 - RNA, 21 nt, Pseudomonas aeruginosa PA01
gcgcggucucuucgucgguca

SEQ ID NO: 1492321 - RNA, 19 nt, Pseudomonas aeruginosa PA01
gcgcggucggguccgggcc

SEQ ID NO: 1492322 - RNA, 17 nt, Pseudomonas aeruginosa PA01
gcgcggucaccaggguc

SEQ ID NO: 1492323 - RNA, 19 nt, Pseudomonas aeruginosa PA01
gcgcgguccgcgguagcug

SEQ ID NO: 1492324 - RNA, 12 nt, Pseudomonas aeruginosa PA01
gcgcggucgagc

SEQ ID NO: 1492325 - RNA, 20 nt, Pseudomonas aeruginosa PA01
gcgcggucgagcagcgccgc

SEQ ID NO: 1492326 - RNA, 22 nt, Pseudomonas aeruginosa PA01
gcgcggucgagcagcgccgcgg

SEQ ID NO: 1492327 - RNA, 17 nt, Pseudomonas aeruginosa PA01
gcgcgggucugcucgcg

SEQ ID NO: 1492328 - RNA, 23 nt, Pseudomonas aeruginosa PA01
gcgcgggucguacaccgcgcggc

SEQ ID NO: 1492329 - RNA, 24 nt, Pseudomonas aeruginosa PA01
gcgcgggucguacaccgcgcggca

SEQ ID NO: 1492330 - RNA, 14 nt, Pseudomonas aeruginosa PA01
gcgcgggucgucga

SEQ ID NO: 1492331 - RNA, 15 nt, Pseudomonas aeruginosa PA01
gcgcgggucgucgau

SEQ ID NO: 1492332 - RNA, 13 nt, Pseudomonas aeruginosa PA01
gcgcgggucaucg

SEQ ID NO: 1492333 - RNA, 13 nt, Pseudomonas aeruginosa PA01
gcgcggggcgagg

SEQ ID NO: 1492334 - RNA, 22 nt, Pseudomonas aeruginosa PA01
gcgcgggguagggguggccagg

SEQ ID NO: 1492335 - RNA, 23 nt, Pseudomonas aeruginosa PA01
gcgcgggguagggguggccaggc

SEQ ID NO: 1492336 - RNA, 23 nt, Pseudomonas aeruginosa PA01
gcgcggggucuggccggcgauca

SEQ ID NO: 1492337 - RNA, 18 nt, Pseudomonas aeruginosa PA01
gcgcggggcccggcucca

SEQ ID NO: 1492338 - RNA, 18 nt, Pseudomonas aeruginosa PA01
gcgcgggggcucggucga

SEQ ID NO: 1492339 - RNA, 14 nt, Pseudomonas aeruginosa PA01
gcgcgggcuggcca

SEQ ID NO: 1492340 - RNA, 15 nt, Pseudomonas aeruginosa PA01
gcgcgggcggccucg

SEQ ID NO: 1492341 - RNA, 16 nt, Pseudomonas aeruginosa PA01
gcgcgggcggccucga

SEQ ID NO: 1492342 - RNA, 13 nt, Pseudomonas aeruginosa PA01
gcgcggugagcag

SEQ ID NO: 1492343 - RNA, 15 nt, Pseudomonas aeruginosa PA01
gcgcgguuucgcagc

SEQ ID NO: 1492344 - RNA, 13 nt, Pseudomonas aeruginosa PA01
gcgcggugggccu

SEQ ID NO: 1492345 - RNA, 16 nt, Pseudomonas aeruginosa PA01
gcgcggugggccuuga

SEQ ID NO: 1492346 - RNA, 16 nt, Pseudomonas aeruginosa PA01
gcgcgguugccgcugc

SEQ ID NO: 1492347 - RNA, 17 nt, Pseudomonas aeruginosa PA01
gcgcgguugccgcugcg

SEQ ID NO: 1492348 - RNA, 18 nt, Pseudomonas aeruginosa PA01
gcgcguagaggaugccgg

SEQ ID NO: 1492349 - RNA, 13 nt, Pseudomonas aeruginosa PA01
gcgcguagcgguc

SEQ ID NO: 1492350 - RNA, 19 nt, Pseudomonas aeruginosa PA01
gcgcguagcuuuccgcggc

SEQ ID NO: 1492351 - RNA, 20 nt, Pseudomonas aeruginosa PA01
gcgcguagcuuuccgcggcg

SEQ ID NO: 1492352 - RNA, 21 nt, Pseudomonas aeruginosa PA01
gcgcguaggcgaacacgucgg

SEQ ID NO: 1492353 - RNA, 19 nt, Pseudomonas aeruginosa PA01
gcgcguacucaggccgggc

SEQ ID NO: 1492354 - RNA, 14 nt, Pseudomonas aeruginosa PA01
gcgcguacuugcca

SEQ ID NO: 1492355 - RNA, 19 nt, Pseudomonas aeruginosa PA01
gcgcguacuugccagggca

SEQ ID NO: 1492356 - RNA, 21 nt, Pseudomonas aeruginosa PA01
gcgcguacuugccagggcagg

SEQ ID NO: 1492357 - RNA, 15 nt, Pseudomonas aeruginosa PA01
gcgcguacgcccgca

SEQ ID NO: 1492358 - RNA, 20 nt, Pseudomonas aeruginosa PA01
gcgcguacgcccgcagccac

SEQ ID NO: 1492359 - RNA, 21 nt, Pseudomonas aeruginosa PA01
gcgcgguuucuucgccuugcc

SEQ ID NO: 1492360 - RNA, 12 nt, Pseudomonas aeruginosa PA01
gcgcguccaccu

SEQ ID NO: 1492361 - RNA, 15 nt, Pseudomonas aeruginosa PA01
gcgcguccaccuggc

SEQ ID NO: 1492362 - RNA, 14 nt, Pseudomonas aeruginosa PA01
gcgcgucaucaggc

SEQ ID NO: 1492363 - RNA, 23 nt, Pseudomonas aeruginosa PA01
gcgcgucaucaggcucaggccgg

SEQ ID NO: 1492364 - RNA, 13 nt, Pseudomonas aeruginosa PA01
gcgcgucaugccg

SEQ ID NO: 1492365 - RNA, 16 nt, Pseudomonas aeruginosa PA01
gcgcgucaugccgccg

SEQ ID NO: 1492366 - RNA, 13 nt, Pseudomonas aeruginosa PA01
gcgcggcucggcg

SEQ ID NO: 1492367 - RNA, 21 nt, Pseudomonas aeruginosa PA01
gcgcggcucggcgggcugccg

SEQ ID NO: 1492368 - RNA, 14 nt, Pseudomonas aeruginosa PA01
gcgcggcucgggga

SEQ ID NO: 1492369 - RNA, 19 nt, Pseudomonas aeruginosa PA01
gcgcggcugaucggccgcc

SEQ ID NO: 1492370 - RNA, 15 nt, Pseudomonas aeruginosa PA01
gcgcggcuucagagc

SEQ ID NO: 1492371 - RNA, 15 nt, Pseudomonas aeruginosa PA01
gcgcggcuugccggc

SEQ ID NO: 1492372 - RNA, 18 nt, Pseudomonas aeruginosa PA01
gcgcggcugcuugccgcu

SEQ ID NO: 1492373 - RNA, 23 nt, Pseudomonas aeruginosa PA01
gcgcggcugcuugccgcucaggc

SEQ ID NO: 1492374 - RNA, 14 nt, Pseudomonas aeruginosa PA01
gcgcgggccgacgg

SEQ ID NO: 1492375 - RNA, 16 nt, Pseudomonas aeruginosa PA01
gcgcgggccggcgaug

SEQ ID NO: 1492376 - RNA, 21 nt, Pseudomonas aeruginosa PA01
gcgcgggccuucaggcugcgc

SEQ ID NO: 1492377 - RNA, 15 nt, Pseudomonas aeruginosa PA01
gcgcgggccuucgcc

SEQ ID NO: 1492378 - RNA, 18 nt, Pseudomonas aeruginosa PA01
gcgcgggcgaagcgcagc

SEQ ID NO: 1492379 - RNA, 18 nt, Pseudomonas aeruginosa PA01
gcgcgggcgcgcgccacc

SEQ ID NO: 1492380 - RNA, 13 nt, Pseudomonas aeruginosa PA01
gcgcgggcgccga

SEQ ID NO: 1492381 - RNA, 17 nt, Pseudomonas aeruginosa PA01
gcgcggcggccgccucg

SEQ ID NO: 1492382 - RNA, 15 nt, Pseudomonas aeruginosa PA01
gcgcggcggcggccg

SEQ ID NO: 1492383 - RNA, 12 nt, Pseudomonas aeruginosa PA01
gcgcggcggcgg

SEQ ID NO: 1492384 - RNA, 23 nt, Pseudomonas aeruginosa PA01
gcgcggcgucgaccacggccuuc

SEQ ID NO: 1492385 - RNA, 15 nt, Pseudomonas aeruginosa PA01
gcgcggcggugcaga

SEQ ID NO: 1492386 - RNA, 13 nt, Pseudomonas aeruginosa PA01
gcgcggcgucggg

SEQ ID NO: 1492387 - RNA, 13 nt, Pseudomonas aeruginosa PA01
gcgcggccggcgc

SEQ ID NO: 1492388 - RNA, 16 nt, Pseudomonas aeruginosa PA01
gcgcggccggcgccgc

SEQ ID NO: 1492389 - RNA, 12 nt, Pseudomonas aeruginosa PA01
gcgcggccucgg

SEQ ID NO: 1492390 - RNA, 13 nt, Pseudomonas aeruginosa PA01
gcgcggccggcca

SEQ ID NO: 1492391 - RNA, 14 nt, Pseudomonas aeruginosa PA01
gcgcggcgacgauc

SEQ ID NO: 1492392 - RNA, 16 nt, Pseudomonas aeruginosa PA01
gcgcggcgagccgcga

SEQ ID NO: 1492393 - RNA, 16 nt, Pseudomonas aeruginosa PA01
gcgcggcgcccugccg

SEQ ID NO: 1492394 - RNA, 17 nt, Pseudomonas aeruginosa PA01
gcgcggcgccuucagcg

SEQ ID NO: 1492395 - RNA, 21 nt, Pseudomonas aeruginosa PA01
gcgcggcgccuucagcgccgc

SEQ ID NO: 1492396 - RNA, 22 nt, Pseudomonas aeruginosa PA01
gcgcggcgccuucagcgccgcc

SEQ ID NO: 1492397 - RNA, 12 nt, Pseudomonas aeruginosa PA01
gcgcggcggaag

SEQ ID NO: 1492398 - RNA, 12 nt, Pseudomonas aeruginosa PA01
gcgcggcgcucc

SEQ ID NO: 1492399 - RNA, 13 nt, Pseudomonas aeruginosa PA01
gcgcggcgcucca

SEQ ID NO: 1492400 - RNA, 16 nt, Pseudomonas aeruginosa PA01
gcgcggcgcuccaggc

SEQ ID NO: 1492401 - RNA, 14 nt, Pseudomonas aeruginosa PA01
gcgcggcgccagcg

SEQ ID NO: 1492402 - RNA, 22 nt, Pseudomonas aeruginosa PA01
gcgcggcgccagcgccccacca

SEQ ID NO: 1492403 - RNA, 21 nt, Pseudomonas aeruginosa PA01
gcgcggcgccccaggcgccca

SEQ ID NO: 1492404 - RNA, 18 nt, Pseudomonas aeruginosa PA01
gcgcggcgcagcggcgaa

SEQ ID NO: 1492405 - RNA, 13 nt, Pseudomonas aeruginosa PA01
gcgcggcgcaauc

SEQ ID NO: 1492406 - RNA, 13 nt, Pseudomonas aeruginosa PA01
gcgcgucggucag

SEQ ID NO: 1492407 - RNA, 16 nt, Pseudomonas aeruginosa PA01
gcgcgucgguggcagg

SEQ ID NO: 1492408 - RNA, 12 nt, Pseudomonas aeruginosa PA01
gcgcgucggccg

SEQ ID NO: 1492409 - RNA, 13 nt, Pseudomonas aeruginosa PA01
gcgcgucggcggc

SEQ ID NO: 1492410 - RNA, 17 nt, Pseudomonas aeruginosa PA01
gcgcgucguccagggcg

SEQ ID NO: 1492411 - RNA, 17 nt, Pseudomonas aeruginosa PA01
gcgcgucuccagcucgg

SEQ ID NO: 1492412 - RNA, 13 nt, Pseudomonas aeruginosa PA01
gcgcgucgccgaa

SEQ ID NO: 1492413 - RNA, 14 nt, Pseudomonas aeruginosa PA01
gcgcgucgccgaac

SEQ ID NO: 1492414 - RNA, 13 nt, Pseudomonas aeruginosa PA01
gcgcgucgcgguc

SEQ ID NO: 1492415 - RNA, 22 nt, Pseudomonas aeruginosa PA01
gcgcgucgcggucuuccgccga

SEQ ID NO: 1492416 - RNA, 14 nt, Pseudomonas aeruginosa PA01
gcgcgucgcggccu

SEQ ID NO: 1492417 - RNA, 16 nt, Pseudomonas aeruginosa PA01
gcgcgucggcacgccg

SEQ ID NO: 1492418 - RNA, 20 nt, Pseudomonas aeruginosa PA01
gcgcgucgcugccgccgcgc

SEQ ID NO: 1492419 - RNA, 16 nt, Pseudomonas aeruginosa PA01
gcgcgucccugggcgc

SEQ ID NO: 1492420 - RNA, 16 nt, Pseudomonas aeruginosa PA01
gcgcguccagccggua

SEQ ID NO: 1492421 - RNA, 15 nt, Pseudomonas aeruginosa PA01
gcgcguucaccccgc

SEQ ID NO: 1492422 - RNA, 21 nt, Pseudomonas aeruginosa PA01
gcgcguucagccacggacgcg

SEQ ID NO: 1492423 - RNA, 20 nt, Pseudomonas aeruginosa PA01
gcgcguuccaggucgcugcu

SEQ ID NO: 1492424 - RNA, 23 nt, Pseudomonas aeruginosa PA01
gcgcguuccgggucgcugcccau

SEQ ID NO: 1492425 - RNA, 16 nt, Pseudomonas aeruginosa PA01
gcgcguugcagcgccu

SEQ ID NO: 1492426 - RNA, 16 nt, Pseudomonas aeruginosa PA01
gcgcguugcccagccc

SEQ ID NO: 1492427 - RNA, 17 nt, Pseudomonas aeruginosa PA01
gcgcguugcccagcccc

SEQ ID NO: 1492428 - RNA, 18 nt, Pseudomonas aeruginosa PA01
gcgcguugcccagcccca

SEQ ID NO: 1492429 - RNA, 22 nt, Pseudomonas aeruginosa PA01
gcgcguugcccagccccaccgc

SEQ ID NO: 1492430 - RNA, 15 nt, Pseudomonas aeruginosa PA01
gcgcguuggcuggcg

SEQ ID NO: 1492431 - RNA, 16 nt, Pseudomonas aeruginosa PA01
gcgcguuggcuggcgg

SEQ ID NO: 1492432 - RNA, 16 nt, Pseudomonas aeruginosa PA01
gcgcguuucagcgcuu

SEQ ID NO: 1492433 - RNA, 19 nt, Pseudomonas aeruginosa PA01
gcgcguuucucagcgccgu

SEQ ID NO: 1492434 - RNA, 18 nt, Pseudomonas aeruginosa PA01
gcgcguugcuuccaggca

SEQ ID NO: 1492435 - RNA, 20 nt, Pseudomonas aeruginosa PA01
gcgcguugcuuccaggcacc

SEQ ID NO: 1492436 - RNA, 12 nt, Pseudomonas aeruginosa PA01
gcgcguggcacg

SEQ ID NO: 1492437 - RNA, 21 nt, Pseudomonas aeruginosa PA01
gcgcguguacccccaccgggc

SEQ ID NO: 1492438 - RNA, 17 nt, Pseudomonas aeruginosa PA01
gcgcguguugcgccgca

SEQ ID NO: 1492439 - RNA, 22 nt, Pseudomonas aeruginosa PA01
gcgcguguugcgccgcaccacg

SEQ ID NO: 1492440 - RNA, 14 nt, Pseudomonas aeruginosa PA01
gcgcgugcuggugc

SEQ ID NO: 1492441 - RNA, 15 nt, Pseudomonas aeruginosa PA01
gcgcgugcuggugcc

SEQ ID NO: 1492442 - RNA, 18 nt, Pseudomonas aeruginosa PA01
gcgcgugcuggugccgau

SEQ ID NO: 1492443 - RNA, 14 nt, Pseudomonas aeruginosa PA01
gcgcguggcgucgg

SEQ ID NO: 1492444 - RNA, 16 nt, Pseudomonas aeruginosa PA01
gcgcguggcuucgucc

SEQ ID NO: 1492445 - RNA, 14 nt, Pseudomonas aeruginosa PA01
gcgcgugccccgug

SEQ ID NO: 1492446 - RNA, 22 nt, Pseudomonas aeruginosa PA01
gcgcgugccccguggcgggcca

SEQ ID NO: 1492447 - RNA, 22 nt, Pseudomonas aeruginosa PA01
gcgcucagcgcuucucggcagc

SEQ ID NO: 1492448 - RNA, 12 nt, Pseudomonas aeruginosa PA01
gcgcucagcgcc

SEQ ID NO: 1492449 - RNA, 13 nt, Pseudomonas aeruginosa PA01
gcgcucagcgcga

SEQ ID NO: 1492450 - RNA, 22 nt, Pseudomonas aeruginosa PA01
gcgcucagcgcgagggggccuc

SEQ ID NO: 1492451 - RNA, 13 nt, Pseudomonas aeruginosa PA01
gcgcucagcgccg

SEQ ID NO: 1492452 - RNA, 21 nt, Pseudomonas aeruginosa PA01
gcgcucagcgccgcuucuucc

SEQ ID NO: 1492453 - RNA, 14 nt, Pseudomonas aeruginosa PA01
gcgcucaggcgcag

SEQ ID NO: 1492454 - RNA, 15 nt, Pseudomonas aeruginosa PA01
gcgcucaggcgcagc

SEQ ID NO: 1492455 - RNA, 19 nt, Pseudomonas aeruginosa PA01
gcgcuccacccaggcgccg

SEQ ID NO: 1492456 - RNA, 20 nt, Pseudomonas aeruginosa PA01
gcgcuccacccaggcgccga

SEQ ID NO: 1492457 - RNA, 23 nt, Pseudomonas aeruginosa PA01
gcgcuccaccgcccccggcgcca

SEQ ID NO: 1492458 - RNA, 19 nt, Pseudomonas aeruginosa PA01
gcgcucccauucgcugucg

SEQ ID NO: 1492459 - RNA, 16 nt, Pseudomonas aeruginosa PA01
gcgcuccaggcccggc

SEQ ID NO: 1492460 - RNA, 18 nt, Pseudomonas aeruginosa PA01
gcgcuccaggcccggcag

SEQ ID NO: 1492461 - RNA, 11 nt, Pseudomonas aeruginosa PA01
gcgcuccaggg

SEQ ID NO: 1492462 - RNA, 23 nt, Pseudomonas aeruginosa PA01
gcgcuccaguucguugaccacgc

SEQ ID NO: 1492463 - RNA, 21 nt, Pseudomonas aeruginosa PA01
gcgcuccggcgcgccauggcg

SEQ ID NO: 1492464 - RNA, 20 nt, Pseudomonas aeruginosa PA01
gcgcuccuccagcgccgcca

SEQ ID NO: 1492465 - RNA, 22 nt, Pseudomonas aeruginosa PA01
gcgcuccuccagcgccgccagg

SEQ ID NO: 1492466 - RNA, 20 nt, Pseudomonas aeruginosa PA01
gcgcuccgccaggccgcgca

SEQ ID NO: 1492467 - RNA, 16 nt, Pseudomonas aeruginosa PA01
gcgcuccucgcgcugc

SEQ ID NO: 1492468 - RNA, 17 nt, Pseudomonas aeruginosa PA01
gcgcuccucgcgcugcc

SEQ ID NO: 1492469 - RNA, 21 nt, Pseudomonas aeruginosa PA01
gcgcuccuggagguucggcag

SEQ ID NO: 1492470 - RNA, 22 nt, Pseudomonas aeruginosa PA01
gcgcuccuggagguucggcagg

SEQ ID NO: 1492471 - RNA, 14 nt, Pseudomonas aeruginosa PA01
gcgcuccuugcgcc

SEQ ID NO: 1492472 - RNA, 17 nt, Pseudomonas aeruginosa PA01
gcgcuccuugcgccagg

SEQ ID NO: 1492473 - RNA, 13 nt, Pseudomonas aeruginosa PA01
gcgcuccuuggcu

SEQ ID NO: 1492474 - RNA, 19 nt, Pseudomonas aeruginosa PA01
gcgcuccuuggcuggccag

SEQ ID NO: 1492475 - RNA, 23 nt, Pseudomonas aeruginosa PA01
gcgcuccuuggcuggccagcccu

SEQ ID NO: 1492476 - RNA, 20 nt, Pseudomonas aeruginosa PA01
gcgcucagccgaggucgccg

SEQ ID NO: 1492477 - RNA, 23 nt, Pseudomonas aeruginosa PA01
gcgcucaccgcauagucgcgaug

SEQ ID NO: 1492478 - RNA, 15 nt, Pseudomonas aeruginosa PA01
gcgcucacccacaug

SEQ ID NO: 1492479 - RNA, 20 nt, Pseudomonas aeruginosa PA01
gcgcucacccacauggcggu

SEQ ID NO: 1492480 - RNA, 13 nt, Pseudomonas aeruginosa PA01
gcgcucacgcucg

SEQ ID NO: 1492481 - RNA, 16 nt, Pseudomonas aeruginosa PA01
gcgcucaccgaggcga

SEQ ID NO: 1492482 - RNA, 17 nt, Pseudomonas aeruginosa PA01
gcgcucaccgaggcgaa

SEQ ID NO: 1492483 - RNA, 23 nt, Pseudomonas aeruginosa PA01
gcgcuacucaggugauggcgauc

SEQ ID NO: 1492484 - RNA, 20 nt, Pseudomonas aeruginosa PA01
gcgcuaccgcgcauggcggc

SEQ ID NO: 1492485 - RNA, 16 nt, Pseudomonas aeruginosa PA01
gcgcuacgcaggcccu

SEQ ID NO: 1492486 - RNA, 15 nt, Pseudomonas aeruginosa PA01
gcgcuacgcucgccg

SEQ ID NO: 1492487 - RNA, 18 nt, Pseudomonas aeruginosa PA01
gcgcuacgcucgccgacg

SEQ ID NO: 1492488 - RNA, 11 nt, Pseudomonas aeruginosa PA01
gcgcgcgccgg

SEQ ID NO: 1492489 - RNA, 13 nt, Pseudomonas aeruginosa PA01
gcgcgcgccgaca

SEQ ID NO: 1492490 - RNA, 12 nt, Pseudomonas aeruginosa PA01
gcgcgcgccggg

SEQ ID NO: 1492491 - RNA, 14 nt, Pseudomonas aeruginosa PA01
gcgcgcgccgggcu

SEQ ID NO: 1492492 - RNA, 13 nt, Pseudomonas aeruginosa PA01
gcgcgcgcuggcg

SEQ ID NO: 1492493 - RNA, 15 nt, Pseudomonas aeruginosa PA01
gcgcgcgcuggucgu

SEQ ID NO: 1492494 - RNA, 13 nt, Pseudomonas aeruginosa PA01
gcgcgcggcagca

SEQ ID NO: 1492495 - RNA, 23 nt, Pseudomonas aeruginosa PA01
gcgcgcggccagcucgccgguca

SEQ ID NO: 1492496 - RNA, 13 nt, Pseudomonas aeruginosa PA01
gcgcgcggccagu

SEQ ID NO: 1492497 - RNA, 12 nt, Pseudomonas aeruginosa PA01
gcgcgcggccag

SEQ ID NO: 1492498 - RNA, 16 nt, Pseudomonas aeruginosa PA01
gcgcgcgucggcggca

SEQ ID NO: 1492499 - RNA, 17 nt, Pseudomonas aeruginosa PA01
gcgcgcguuucagcgcu

SEQ ID NO: 1492500 - RNA, 21 nt, Pseudomonas aeruginosa PA01
gcgcgcggucgagcagcgccg

SEQ ID NO: 1492501 - RNA, 23 nt, Pseudomonas aeruginosa PA01
gcgcgcggggucuggccggcgau

SEQ ID NO: 1492502 - RNA, 16 nt, Pseudomonas aeruginosa PA01
gcgcgcguagcgugcc

SEQ ID NO: 1492503 - RNA, 23 nt, Pseudomonas aeruginosa PA01
gcgcgcgguuucuucgccuugcc

SEQ ID NO: 1492504 - RNA, 23 nt, Pseudomonas aeruginosa PA01
gcgcgcggcucggcgggcugccg

SEQ ID NO: 1492505 - RNA, 13 nt, Pseudomonas aeruginosa PA01
gcgcgcggcgagc

SEQ ID NO: 1492506 - RNA, 15 nt, Pseudomonas aeruginosa PA01
gcgcgcggcggguag

SEQ ID NO: 1492507 - RNA, 19 nt, Pseudomonas aeruginosa PA01
gcgcgcggcgucgaccacg

SEQ ID NO: 1492508 - RNA, 22 nt, Pseudomonas aeruginosa PA01
gcgcgcgacacauggucggcca

SEQ ID NO: 1492509 - RNA, 17 nt, Pseudomonas aeruginosa PA01
gcgcgcgacagauagca

SEQ ID NO: 1492510 - RNA, 15 nt, Pseudomonas aeruginosa PA01
gcgcgccuucagccc

SEQ ID NO: 1492511 - RNA, 20 nt, Pseudomonas aeruginosa PA01
gcgcgccuucagccccagca

SEQ ID NO: 1492512 - RNA, 21 nt, Pseudomonas aeruginosa PA01
gcgcgccuucagccccagcac

SEQ ID NO: 1492513 - RNA, 21 nt, Pseudomonas aeruginosa PA01
gcgcgccuggcccuggcgguu

SEQ ID NO: 1492514 - RNA, 20 nt, Pseudomonas aeruginosa PA01
gcgcgccuggcuggccagca

SEQ ID NO: 1492515 - RNA, 12 nt, Pseudomonas aeruginosa PA01
gcgcgcgcaagg

SEQ ID NO: 1492516 - RNA, 13 nt, Pseudomonas aeruginosa PA01
gcgcgcgcaaggc

SEQ ID NO: 1492517 - RNA, 14 nt, Pseudomonas aeruginosa PA01
gcgcgcgcaaggcc

SEQ ID NO: 1492518 - RNA, 20 nt, Pseudomonas aeruginosa PA01
gcgcgcgauaccgacaagca

SEQ ID NO: 1492519 - RNA, 22 nt, Pseudomonas aeruginosa PA01
gcgcgcgcagauaaggcgugca

SEQ ID NO: 1492520 - RNA, 20 nt, Pseudomonas aeruginosa PA01
gcgcgcgccaccgccugguc

SEQ ID NO: 1492521 - RNA, 13 nt, Pseudomonas aeruginosa PA01
gcgcgcgccaguc

SEQ ID NO: 1492522 - RNA, 17 nt, Pseudomonas aeruginosa PA01
gcgcgcgccagucccgc

SEQ ID NO: 1492523 - RNA, 12 nt, Pseudomonas aeruginosa PA01
gcgcgccgggcu

SEQ ID NO: 1492524 - RNA, 20 nt, Pseudomonas aeruginosa PA01
gcgcgccgggucgacaugca

SEQ ID NO: 1492525 - RNA, 12 nt, Pseudomonas aeruginosa PA01
gcgcgccgguga

SEQ ID NO: 1492526 - RNA, 23 nt, Pseudomonas aeruginosa PA01
gcgcgccggugaucgagccgccg

SEQ ID NO: 1492527 - RNA, 17 nt, Pseudomonas aeruginosa PA01
gcgcgccuccugcggau

SEQ ID NO: 1492528 - RNA, 16 nt, Pseudomonas aeruginosa PA01
gcgcgccucgcggcgu

SEQ ID NO: 1492529 - RNA, 16 nt, Pseudomonas aeruginosa PA01
gcgcgccucagcggcu

SEQ ID NO: 1492530 - RNA, 23 nt, Pseudomonas aeruginosa PA01
gcgcgccugcucuucggcggcca

SEQ ID NO: 1492531 - RNA, 21 nt, Pseudomonas aeruginosa PA01
gcgcgccuggaucagcgccuc

SEQ ID NO: 1492532 - RNA, 23 nt, Pseudomonas aeruginosa PA01
gcgcggccacuucguccggccgc

SEQ ID NO: 1492533 - RNA, 21 nt, Pseudomonas aeruginosa PA01
gcgcggccagcgcggccgccg

SEQ ID NO: 1492534 - RNA, 14 nt, Pseudomonas aeruginosa PA01
gcgcggccagcgug

SEQ ID NO: 1492535 - RNA, 12 nt, Pseudomonas aeruginosa PA01
gcgcggccagcu

SEQ ID NO: 1492536 - RNA, 19 nt, Pseudomonas aeruginosa PA01
gcgcggccagcucgccggu

SEQ ID NO: 1492537 - RNA, 22 nt, Pseudomonas aeruginosa PA01
gcgcggccagcuucuccagcag

SEQ ID NO: 1492538 - RNA, 16 nt, Pseudomonas aeruginosa PA01
gcgcggcccuucgacg

SEQ ID NO: 1492539 - RNA, 21 nt, Pseudomonas aeruginosa PA01
gcgcggccgaacucuggcggc

SEQ ID NO: 1492540 - RNA, 16 nt, Pseudomonas aeruginosa PA01
gcgcggccgccgccga

SEQ ID NO: 1492541 - RNA, 19 nt, Pseudomonas aeruginosa PA01
gcgcggcccguccgcgcca

SEQ ID NO: 1492542 - RNA, 22 nt, Pseudomonas aeruginosa PA01
gcgcggcaccccuugcagccag

SEQ ID NO: 1492543 - RNA, 19 nt, Pseudomonas aeruginosa PA01
gcgcggcaaagugcggucg

SEQ ID NO: 1492544 - RNA, 21 nt, Pseudomonas aeruginosa PA01
gcgcggcacagcguggccagc

SEQ ID NO: 1492545 - RNA, 17 nt, Pseudomonas aeruginosa PA01
gcgcggcacaggcggcu

SEQ ID NO: 1492546 - RNA, 16 nt, Pseudomonas aeruginosa PA01
gcgcggcaggccgucc

SEQ ID NO: 1492547 - RNA, 20 nt, Pseudomonas aeruginosa PA01
gcgcggcagguggcuggcca

SEQ ID NO: 1492548 - RNA, 19 nt, Pseudomonas aeruginosa PA01
gcgcggcauagaugccggc

SEQ ID NO: 1492549 - RNA, 23 nt, Pseudomonas aeruginosa PA01
gcgcggcauagcgcagccgcucg

SEQ ID NO: 1492550 - RNA, 19 nt, Pseudomonas aeruginosa PA01
gcgcggcagcaccaggcca

SEQ ID NO: 1492551 - RNA, 20 nt, Pseudomonas aeruginosa PA01
gcgcggcagcaccaggccau

SEQ ID NO: 1492552 - RNA, 13 nt, Pseudomonas aeruginosa PA01
gcgcggcagcagg

SEQ ID NO: 1492553 - RNA, 14 nt, Pseudomonas aeruginosa PA01
gcgcggcagcaggc

SEQ ID NO: 1492554 - RNA, 18 nt, Pseudomonas aeruginosa PA01
gcgcgcugugcacggucu

SEQ ID NO: 1492555 - RNA, 13 nt, Pseudomonas aeruginosa PA01
gcgcgcuggucga

SEQ ID NO: 1492556 - RNA, 21 nt, Pseudomonas aeruginosa PA01
gcgcgcuggucguucucgcgc

SEQ ID NO: 1492557 - RNA, 14 nt, Pseudomonas aeruginosa PA01
gcgcgcuuccaggc

SEQ ID NO: 1492558 - RNA, 12 nt, Pseudomonas aeruginosa PA01
gcgcgcuugccg

SEQ ID NO: 1492559 - RNA, 19 nt, Pseudomonas aeruginosa PA01
gcgcgcuguagccggcgcc

SEQ ID NO: 1492560 - RNA, 16 nt, Pseudomonas aeruginosa PA01
gcgcgcuuuccggcgc

SEQ ID NO: 1492561 - RNA, 22 nt, Pseudomonas aeruginosa PA01
gcgcgcuuuccggcgcggccug

SEQ ID NO: 1492562 - RNA, 20 nt, Pseudomonas aeruginosa PA01
gcgcgcuuuuccggcgccgg

SEQ ID NO: 1492563 - RNA, 16 nt, Pseudomonas aeruginosa PA01
gcgcggaacaucgccc

SEQ ID NO: 1492564 - RNA, 17 nt, Pseudomonas aeruginosa PA01
gcgcggaacaucgcccg

SEQ ID NO: 1492565 - RNA, 21 nt, Pseudomonas aeruginosa PA01
gcgcggaacaucgcccggcgc

SEQ ID NO: 1492566 - RNA, 19 nt, Pseudomonas aeruginosa PA01
gcgcggauccccucccgcg

SEQ ID NO: 1492567 - RNA, 20 nt, Pseudomonas aeruginosa PA01
gcgcggauccccucccgcgc

SEQ ID NO: 1492568 - RNA, 23 nt, Pseudomonas aeruginosa PA01
gcgcggauccccucccgcgccag

SEQ ID NO: 1492569 - RNA, 19 nt, Pseudomonas aeruginosa PA01
gcgcggaccuucgacggca

SEQ ID NO: 1492570 - RNA, 24 nt, Pseudomonas aeruginosa PA01
gcgcggacgauggucgccgcgacc

SEQ ID NO: 1492571 - RNA, 22 nt, Pseudomonas aeruginosa PA01
gcgcggaccgcaaccgguccuc

SEQ ID NO: 1492572 - RNA, 14 nt, Pseudomonas aeruginosa PA01
gcgcggagcgucca

SEQ ID NO: 1492573 - RNA, 17 nt, Pseudomonas aeruginosa PA01
gcgcggagcguccacca

SEQ ID NO: 1492574 - RNA, 19 nt, Pseudomonas aeruginosa PA01
gcgcggagcguccaccagc

SEQ ID NO: 1492575 - RNA, 22 nt, Pseudomonas aeruginosa PA01
gcgcggagcguccaccagcgcc

SEQ ID NO: 1492576 - RNA, 14 nt, Pseudomonas aeruginosa PA01
gcgcgcugcggcag

SEQ ID NO: 1492577 - RNA, 16 nt, Pseudomonas aeruginosa PA01
gcgcgcugcgggucau

SEQ ID NO: 1492578 - RNA, 20 nt, Pseudomonas aeruginosa PA01
gcgcgcuggauuucgccgag

SEQ ID NO: 1492579 - RNA, 21 nt, Pseudomonas aeruginosa PA01
gcgcgcuggauuucgccgagu

SEQ ID NO: 1492580 - RNA, 14 nt, Pseudomonas aeruginosa PA01
gcgcgcuggcgcag

SEQ ID NO: 1492581 - RNA, 16 nt, Pseudomonas aeruginosa PA01
gcgcgcuggcgcagcg

SEQ ID NO: 1492582 - RNA, 20 nt, Pseudomonas aeruginosa PA01
gcgcgcuggcgcagcggguc

SEQ ID NO: 1492583 - RNA, 16 nt, Pseudomonas aeruginosa PA01
gcgcgcucuucgccgc

SEQ ID NO: 1492584 - RNA, 19 nt, Pseudomonas aeruginosa PA01
gcgcgcucuucgccgcggc

SEQ ID NO: 1492585 - RNA, 15 nt, Pseudomonas aeruginosa PA01
gcgcgcugccugcga

SEQ ID NO: 1492586 - RNA, 18 nt, Pseudomonas aeruginosa PA01
gcgcgcugccugcgaugg

SEQ ID NO: 1492587 - RNA, 20 nt, Pseudomonas aeruginosa PA01
gcgcgcugccugcgauggaa

SEQ ID NO: 1492588 - RNA, 15 nt, Pseudomonas aeruginosa PA01
gcgcgcucggccugg

SEQ ID NO: 1492589 - RNA, 16 nt, Pseudomonas aeruginosa PA01
gcgcgcucgcugucgc

SEQ ID NO: 1492590 - RNA, 20 nt, Pseudomonas aeruginosa PA01
gcgcgcucgggaucgccucg

SEQ ID NO: 1492591 - RNA, 15 nt, Pseudomonas aeruginosa PA01
gcgcgcuccucgauc

SEQ ID NO: 1492592 - RNA, 17 nt, Pseudomonas aeruginosa PA01
gcgcgcuccucgauccg

SEQ ID NO: 1492593 - RNA, 22 nt, Pseudomonas aeruginosa PA01
gcgcgcucagcgcuucucggca

SEQ ID NO: 1492594 - RNA, 17 nt, Pseudomonas aeruginosa PA01
gcgcgccaaggccgcca

SEQ ID NO: 1492595 - RNA, 18 nt, Pseudomonas aeruginosa PA01
gcgcgccaaggccgccag

SEQ ID NO: 1492596 - RNA, 19 nt, Pseudomonas aeruginosa PA01
gcgcgccaaggccgccagg

SEQ ID NO: 1492597 - RNA, 21 nt, Pseudomonas aeruginosa PA01
gcgcgccaaggccgccaggcc

SEQ ID NO: 1492598 - RNA, 22 nt, Pseudomonas aeruginosa PA01
gcgcgccaaggccgccaggccu

SEQ ID NO: 1492599 - RNA, 14 nt, Pseudomonas aeruginosa PA01
gcgcgccaccgccu

SEQ ID NO: 1492600 - RNA, 16 nt, Pseudomonas aeruginosa PA01
gcgcgccaccgccugg

SEQ ID NO: 1492601 - RNA, 13 nt, Pseudomonas aeruginosa PA01
gcgcgccaccugg

SEQ ID NO: 1492602 - RNA, 13 nt, Pseudomonas aeruginosa PA01
gcgcgccaccagc

SEQ ID NO: 1492603 - RNA, 14 nt, Pseudomonas aeruginosa PA01
gcgcgccaccagcg

SEQ ID NO: 1492604 - RNA, 17 nt, Pseudomonas aeruginosa PA01
gcgcgccaccagcgugg

SEQ ID NO: 1492605 - RNA, 21 nt, Pseudomonas aeruginosa PA01
gcgcgccagaagcggccgacc

SEQ ID NO: 1492606 - RNA, 22 nt, Pseudomonas aeruginosa PA01
gcgcgccagcaacgccuucugc

SEQ ID NO: 1492607 - RNA, 13 nt, Pseudomonas aeruginosa PA01
gcgcgccagcacg

SEQ ID NO: 1492608 - RNA, 16 nt, Pseudomonas aeruginosa PA01
gcgcgccagcgccacg

SEQ ID NO: 1492609 - RNA, 14 nt, Pseudomonas aeruginosa PA01
gcgcgccagcgcca

SEQ ID NO: 1492610 - RNA, 13 nt, Pseudomonas aeruginosa PA01
gcgcgccagcgcc

SEQ ID NO: 1492611 - RNA, 13 nt, Pseudomonas aeruginosa PA01
gcgcgccauggcc

SEQ ID NO: 1492612 - RNA, 12 nt, Pseudomonas aeruginosa PA01
gcgcgcccaggc

SEQ ID NO: 1492613 - RNA, 13 nt, Pseudomonas aeruginosa PA01
gcgcgcccaggca

SEQ ID NO: 1492614 - RNA, 13 nt, Pseudomonas aeruginosa PA01
gcgcgcccaggcc

SEQ ID NO: 1492615 - RNA, 15 nt, Pseudomonas aeruginosa PA01
gcgcgccagggcggg

SEQ ID NO: 1492616 - RNA, 17 nt, Pseudomonas aeruginosa PA01
gcgcgcccaggcccagc

SEQ ID NO: 1492617 - RNA, 16 nt, Pseudomonas aeruginosa PA01
gcgcgccccggcgagc

SEQ ID NO: 1492618 - RNA, 22 nt, Pseudomonas aeruginosa PA01
gcgcgccccggcgagcgagcgg

SEQ ID NO: 1492619 - RNA, 19 nt, Pseudomonas aeruginosa PA01
gcgcgccgcaucgcugacc

SEQ ID NO: 1492620 - RNA, 14 nt, Pseudomonas aeruginosa PA01
gcgcgccgccgggc

SEQ ID NO: 1492621 - RNA, 12 nt, Pseudomonas aeruginosa PA01
gcgcgccccugc

SEQ ID NO: 1492622 - RNA, 15 nt, Pseudomonas aeruginosa PA01
gcgcgccccugcgcc

SEQ ID NO: 1492623 - RNA, 13 nt, Pseudomonas aeruginosa PA01
gcgcgcccgccag

SEQ ID NO: 1492624 - RNA, 15 nt, Pseudomonas aeruginosa PA01
gcgcgcccgccaggu

SEQ ID NO: 1492625 - RNA, 23 nt, Pseudomonas aeruginosa PA01
gcgcgcccgccaggucgagggca

SEQ ID NO: 1492626 - RNA, 16 nt, Pseudomonas aeruginosa PA01
gcgcgcccggcgcaga

SEQ ID NO: 1492627 - RNA, 17 nt, Pseudomonas aeruginosa PA01
gcgcgcccggcgcagaa

SEQ ID NO: 1492628 - RNA, 14 nt, Pseudomonas aeruginosa PA01
gcgcgccgaguugg

SEQ ID NO: 1492629 - RNA, 14 nt, Pseudomonas aeruginosa PA01
gcgcgccgacagca

SEQ ID NO: 1492630 - RNA, 12 nt, Pseudomonas aeruginosa PA01
gcgcgccgagcc

SEQ ID NO: 1492631 - RNA, 14 nt, Pseudomonas aeruginosa PA01
gcgcgccgagcaac

SEQ ID NO: 1492632 - RNA, 15 nt, Pseudomonas aeruginosa PA01
gcgcgaauggcauuc

SEQ ID NO: 1492633 - RNA, 20 nt, Pseudomonas aeruginosa PA01
gcgcgacacauggucggcca

SEQ ID NO: 1492634 - RNA, 21 nt, Pseudomonas aeruginosa PA01
gcgcgacacauggucggccag

SEQ ID NO: 1492635 - RNA, 22 nt, Pseudomonas aeruginosa PA01
gcgcgacacauggucggccagg

SEQ ID NO: 1492636 - RNA, 23 nt, Pseudomonas aeruginosa PA01
gcgcgacacauggucggccaggu

SEQ ID NO: 1492637 - RNA, 19 nt, Pseudomonas aeruginosa PA01
gcgcgacgaggcgcggcgg

SEQ ID NO: 1492638 - RNA, 16 nt, Pseudomonas aeruginosa PA01
gcgcgacgcuccaggu

SEQ ID NO: 1492639 - RNA, 22 nt, Pseudomonas aeruginosa PA01
gcgcgacggaacaagccgccuu

SEQ ID NO: 1492640 - RNA, 23 nt, Pseudomonas aeruginosa PA01
gcgcgacggaacaagccgccuuc

SEQ ID NO: 1492641 - RNA, 22 nt, Pseudomonas aeruginosa PA01
gcgcgacucgguaaagcccagg

SEQ ID NO: 1492642 - RNA, 23 nt, Pseudomonas aeruginosa PA01
gcgcgacucgguaaagcccaggu

SEQ ID NO: 1492643 - RNA, 15 nt, Pseudomonas aeruginosa PA01
gcgcgacugucgagc

SEQ ID NO: 1492644 - RNA, 18 nt, Pseudomonas aeruginosa PA01
gcgcgacugucgagcagg

SEQ ID NO: 1492645 - RNA, 19 nt, Pseudomonas aeruginosa PA01
gcgcgacugucgagcaggg

SEQ ID NO: 1492646 - RNA, 17 nt, Pseudomonas aeruginosa PA01
gcgcgacuuggacagcg

SEQ ID NO: 1492647 - RNA, 13 nt, Pseudomonas aeruginosa PA01
gcgcgagaaaaac

SEQ ID NO: 1492648 - RNA, 19 nt, Pseudomonas aeruginosa PA01
gcgcgauccgcgcggcaac

SEQ ID NO: 1492649 - RNA, 20 nt, Pseudomonas aeruginosa PA01
gcgcgauccgcgcggcaacc

SEQ ID NO: 1492650 - RNA, 13 nt, Pseudomonas aeruginosa PA01
gcgcgaucccccg

SEQ ID NO: 1492651 - RNA, 17 nt, Pseudomonas aeruginosa PA01
gcgcgauccuccgccag

SEQ ID NO: 1492652 - RNA, 22 nt, Pseudomonas aeruginosa PA01
gcgcgauccuccgccagcccca

SEQ ID NO: 1492653 - RNA, 16 nt, Pseudomonas aeruginosa PA01
gcgcgauccuggcggc

SEQ ID NO: 1492654 - RNA, 17 nt, Pseudomonas aeruginosa PA01
gcgcgauccuggcggca

SEQ ID NO: 1492655 - RNA, 20 nt, Pseudomonas aeruginosa PA01
gcgcgauccuggcggcacuc

SEQ ID NO: 1492656 - RNA, 22 nt, Pseudomonas aeruginosa PA01
gcgcgaucgaggccuacccgcg

SEQ ID NO: 1492657 - RNA, 12 nt, Pseudomonas aeruginosa PA01
gcgcgaucagcc

SEQ ID NO: 1492658 - RNA, 16 nt, Pseudomonas aeruginosa PA01
gcgcgaucagccgcuc

SEQ ID NO: 1492659 - RNA, 13 nt, Pseudomonas aeruginosa PA01
gcgcgagcggcag

SEQ ID NO: 1492660 - RNA, 14 nt, Pseudomonas aeruginosa PA01
gcgcgagcggcaga

SEQ ID NO: 1492661 - RNA, 15 nt, Pseudomonas aeruginosa PA01
gcgcgagaagccagc

SEQ ID NO: 1492662 - RNA, 18 nt, Pseudomonas aeruginosa PA01
gcgcgagaugaagcgccg

SEQ ID NO: 1492663 - RNA, 18 nt, Pseudomonas aeruginosa PA01
gcgcgagcaccgcgcaga

SEQ ID NO: 1492664 - RNA, 20 nt, Pseudomonas aeruginosa PA01
gcgcgagcaccgcgcagacc

SEQ ID NO: 1492665 - RNA, 20 nt, Pseudomonas aeruginosa PA01
gcgcgcaaaaaaaggggaug

SEQ ID NO: 1492666 - RNA, 12 nt, Pseudomonas aeruginosa PA01
gcgcgaucgcgu

SEQ ID NO: 1492667 - RNA, 13 nt, Pseudomonas aeruginosa PA01
gcgcgcaaggccg

SEQ ID NO: 1492668 - RNA, 15 nt, Pseudomonas aeruginosa PA01
gcgcgcaaggccgaa

SEQ ID NO: 1492669 - RNA, 16 nt, Pseudomonas aeruginosa PA01
gcgcgcaaggccgaag

SEQ ID NO: 1492670 - RNA, 20 nt, Pseudomonas aeruginosa PA01
gcgcgcaacgcuuccagcac

SEQ ID NO: 1492671 - RNA, 15 nt, Pseudomonas aeruginosa PA01
gcgcgcaccaggccu

SEQ ID NO: 1492672 - RNA, 22 nt, Pseudomonas aeruginosa PA01
gcgcgcaucuggugcgcgucca

SEQ ID NO: 1492673 - RNA, 21 nt, Pseudomonas aeruginosa PA01
gcgcgcaugaaaaagcccggc

SEQ ID NO: 1492674 - RNA, 15 nt, Pseudomonas aeruginosa PA01
gcgccauuccgcggc

SEQ ID NO: 1492675 - RNA, 16 nt, Pseudomonas aeruginosa PA01
gcgccauuccgcggca

SEQ ID NO: 1492676 - RNA, 16 nt, Pseudomonas aeruginosa PA01
gcgccauugccgccag

SEQ ID NO: 1492677 - RNA, 20 nt, Pseudomonas aeruginosa PA01
gcgccauugugcgcgcgcag

SEQ ID NO: 1492678 - RNA, 20 nt, Pseudomonas aeruginosa PA01
gcgcccacaaccugccgauc

SEQ ID NO: 1492679 - RNA, 19 nt, Pseudomonas aeruginosa PA01
gcgcccaaugcaucggccg

SEQ ID NO: 1492680 - RNA, 12 nt, Pseudomonas aeruginosa PA01
gcgcccaggcag

SEQ ID NO: 1492681 - RNA, 15 nt, Pseudomonas aeruginosa PA01
gcgcccaggcagcag

SEQ ID NO: 1492682 - RNA, 23 nt, Pseudomonas aeruginosa PA01
gcgcccaggcagcagagcgccac

SEQ ID NO: 1492683 - RNA, 15 nt, Pseudomonas aeruginosa PA01
gcgcccaggcaggcg

SEQ ID NO: 1492684 - RNA, 12 nt, Pseudomonas aeruginosa PA01
gcgcccaggccc

SEQ ID NO: 1492685 - RNA, 17 nt, Pseudomonas aeruginosa PA01
gcgcccaggcugccggc

SEQ ID NO: 1492686 - RNA, 21 nt, Pseudomonas aeruginosa PA01
gcgcccaggcugccggccagg

SEQ ID NO: 1492687 - RNA, 20 nt, Pseudomonas aeruginosa PA01
gcgcccagggacgcgccggc

SEQ ID NO: 1492688 - RNA, 13 nt, Pseudomonas aeruginosa PA01
gcgcccaggccgg

SEQ ID NO: 1492689 - RNA, 14 nt, Pseudomonas aeruginosa PA01
gcgcccaggccggg

SEQ ID NO: 1492690 - RNA, 15 nt, Pseudomonas aeruginosa PA01
gcgcccaggccgggu

SEQ ID NO: 1492691 - RNA, 13 nt, Pseudomonas aeruginosa PA01
gcgcccaggcgca

SEQ ID NO: 1492692 - RNA, 19 nt, Pseudomonas aeruginosa PA01
gcgcccgauaggcgccggc

SEQ ID NO: 1492693 - RNA, 20 nt, Pseudomonas aeruginosa PA01
gcgcccgauaggcgccggcg

SEQ ID NO: 1492694 - RNA, 21 nt, Pseudomonas aeruginosa PA01
gcgcccgauaggcgccggcgc

SEQ ID NO: 1492695 - RNA, 22 nt, Pseudomonas aeruginosa PA01
gcgcccgauaggcgccggcgcg

SEQ ID NO: 1492696 - RNA, 18 nt, Pseudomonas aeruginosa PA01
gcgccccuuggccagcac

SEQ ID NO: 1492697 - RNA, 14 nt, Pseudomonas aeruginosa PA01
gcgccccugcgccc

SEQ ID NO: 1492698 - RNA, 14 nt, Pseudomonas aeruginosa PA01
gcgccccgccuacc

SEQ ID NO: 1492699 - RNA, 20 nt, Pseudomonas aeruginosa PA01
gcgccccgccuaccggggcg

SEQ ID NO: 1492700 - RNA, 14 nt, Pseudomonas aeruginosa PA01
gcgccccggccgcg

SEQ ID NO: 1492701 - RNA, 22 nt, Pseudomonas aeruginosa PA01
gcgccccggccgcgccagccac

SEQ ID NO: 1492702 - RNA, 13 nt, Pseudomonas aeruginosa PA01
gcgcccagguagg

SEQ ID NO: 1492703 - RNA, 14 nt, Pseudomonas aeruginosa PA01
gcgcccagguccgg

SEQ ID NO: 1492704 - RNA, 22 nt, Pseudomonas aeruginosa PA01
gcgcccaguggaauucgaugaa

SEQ ID NO: 1492705 - RNA, 20 nt, Pseudomonas aeruginosa PA01
gcgccaucgcuuuccuggcc

SEQ ID NO: 1492706 - RNA, 18 nt, Pseudomonas aeruginosa PA01
gcgccauccuccagcgcc

SEQ ID NO: 1492707 - RNA, 21 nt, Pseudomonas aeruginosa PA01
gcgccauccuccagcgccgca

SEQ ID NO: 1492708 - RNA, 15 nt, Pseudomonas aeruginosa PA01
gcgccauaggccagc

SEQ ID NO: 1492709 - RNA, 19 nt, Pseudomonas aeruginosa PA01
gcgccauaggccagcaccu

SEQ ID NO: 1492710 - RNA, 14 nt, Pseudomonas aeruginosa PA01
gcgccauagggcac

SEQ ID NO: 1492711 - RNA, 24 nt, Pseudomonas aeruginosa PA01
gcgccauaccggcaaggcggccuc

SEQ ID NO: 1492712 - RNA, 13 nt, Pseudomonas aeruginosa PA01
gcgccaucagcga

SEQ ID NO: 1492713 - RNA, 13 nt, Pseudomonas aeruginosa PA01
gcgccaucaggcc

SEQ ID NO: 1492714 - RNA, 14 nt, Pseudomonas aeruginosa PA01
gcgccaucaggccc

SEQ ID NO: 1492715 - RNA, 18 nt, Pseudomonas aeruginosa PA01
gcgccaucaguuccucgc

SEQ ID NO: 1492716 - RNA, 18 nt, Pseudomonas aeruginosa PA01
gcgccaguuggacgcggc

SEQ ID NO: 1492717 - RNA, 20 nt, Pseudomonas aeruginosa PA01
gcgccaguuggacgcggccu

SEQ ID NO: 1492718 - RNA, 22 nt, Pseudomonas aeruginosa PA01
gcgccaguuggacgcggccugg

SEQ ID NO: 1492719 - RNA, 17 nt, Pseudomonas aeruginosa PA01
gcgccagugccugcacc

SEQ ID NO: 1492720 - RNA, 12 nt, Pseudomonas aeruginosa PA01
gcgccagucccg

SEQ ID NO: 1492721 - RNA, 13 nt, Pseudomonas aeruginosa PA01
gcgccaguccacg

SEQ ID NO: 1492722 - RNA, 19 nt, Pseudomonas aeruginosa PA01
gcgccaguccacgacgaac

SEQ ID NO: 1492723 - RNA, 20 nt, Pseudomonas aeruginosa PA01
gcgccaguuccuucgccgaa

SEQ ID NO: 1492724 - RNA, 16 nt, Pseudomonas aeruginosa PA01
gcgccaguucgccggu

SEQ ID NO: 1492725 - RNA, 20 nt, Pseudomonas aeruginosa PA01
gcgccaguucgccggugacg

SEQ ID NO: 1492726 - RNA, 21 nt, Pseudomonas aeruginosa PA01
gcgccaguucgccggugacgc

SEQ ID NO: 1492727 - RNA, 21 nt, Pseudomonas aeruginosa PA01
gcgccaguacuccgagggccg

SEQ ID NO: 1492728 - RNA, 22 nt, Pseudomonas aeruginosa PA01
gcgccaguacuccgagggccgc

SEQ ID NO: 1492729 - RNA, 14 nt, Pseudomonas aeruginosa PA01
gcgccagagcaggc

SEQ ID NO: 1492730 - RNA, 14 nt, Pseudomonas aeruginosa PA01
gcgccagagcgcgc

SEQ ID NO: 1492731 - RNA, 18 nt, Pseudomonas aeruginosa PA01
gcgccagaagguaucggc

SEQ ID NO: 1492732 - RNA, 23 nt, Pseudomonas aeruginosa PA01
gcgccagaagguaucggccaugg

SEQ ID NO: 1492733 - RNA, 22 nt, Pseudomonas aeruginosa PA01
gcgccagaacggcuuguucagc

SEQ ID NO: 1492734 - RNA, 14 nt, Pseudomonas aeruginosa PA01
gcgccacucggcgu

SEQ ID NO: 1492735 - RNA, 13 nt, Pseudomonas aeruginosa PA01
gcgccgcaccacg

SEQ ID NO: 1492736 - RNA, 17 nt, Pseudomonas aeruginosa PA01
gcgccgcagcggccagg

SEQ ID NO: 1492737 - RNA, 14 nt, Pseudomonas aeruginosa PA01
gcgccgcagcaagu

SEQ ID NO: 1492738 - RNA, 20 nt, Pseudomonas aeruginosa PA01
gcgccgaucaggcguaggcc

SEQ ID NO: 1492739 - RNA, 22 nt, Pseudomonas aeruginosa PA01
gcgccgaucaggcguaggccgu

SEQ ID NO: 1492740 - RNA, 19 nt, Pseudomonas aeruginosa PA01
gcgccgaggucuuggccag

SEQ ID NO: 1492741 - RNA, 21 nt, Pseudomonas aeruginosa PA01
gcgccgagggguacagggcau

SEQ ID NO: 1492742 - RNA, 20 nt, Pseudomonas aeruginosa PA01
gcgccgaccgcaccgccagc

SEQ ID NO: 1492743 - RNA, 15 nt, Pseudomonas aeruginosa PA01
gcgccgacgccacca

SEQ ID NO: 1492744 - RNA, 17 nt, Pseudomonas aeruginosa PA01
gcgccgacgccaccagc

SEQ ID NO: 1492745 - RNA, 18 nt, Pseudomonas aeruginosa PA01
gcgccgacgccaccagcc

SEQ ID NO: 1492746 - RNA, 22 nt, Pseudomonas aeruginosa PA01
gcgccgacccagagcgcgcccu

SEQ ID NO: 1492747 - RNA, 17 nt, Pseudomonas aeruginosa PA01
gcgccgaccgcgcgccu

SEQ ID NO: 1492748 - RNA, 22 nt, Pseudomonas aeruginosa PA01
gcgccgaccgcgcgccugcaac

SEQ ID NO: 1492749 - RNA, 15 nt, Pseudomonas aeruginosa PA01
gcgccgaccagcaac

SEQ ID NO: 1492750 - RNA, 13 nt, Pseudomonas aeruginosa PA01
gcgccgaccagcc

SEQ ID NO: 1492751 - RNA, 15 nt, Pseudomonas aeruginosa PA01
gcgccgaccagccgc

SEQ ID NO: 1492752 - RNA, 19 nt, Pseudomonas aeruginosa PA01
gcgccgaccagccgcaggc

SEQ ID NO: 1492753 - RNA, 20 nt, Pseudomonas aeruginosa PA01
gcgccgaccagccgcaggcu

SEQ ID NO: 1492754 - RNA, 22 nt, Pseudomonas aeruginosa PA01
gcgccgaccagccgcaggcugc

SEQ ID NO: 1492755 - RNA, 16 nt, Pseudomonas aeruginosa PA01
gcgcccuucagcgccu

SEQ ID NO: 1492756 - RNA, 19 nt, Pseudomonas aeruginosa PA01
gcgcccuucagcgccucga

SEQ ID NO: 1492757 - RNA, 12 nt, Pseudomonas aeruginosa PA01
gcgcccggccuu

SEQ ID NO: 1492758 - RNA, 18 nt, Pseudomonas aeruginosa PA01
gcgcccggccuucaccgc

SEQ ID NO: 1492759 - RNA, 21 nt, Pseudomonas aeruginosa PA01
gcgcccggccuucaccgcgcc

SEQ ID NO: 1492760 - RNA, 14 nt, Pseudomonas aeruginosa PA01
gcgcccggcgaaca

SEQ ID NO: 1492761 - RNA, 19 nt, Pseudomonas aeruginosa PA01
gcgcccggcgaacagcgcu

SEQ ID NO: 1492762 - RNA, 20 nt, Pseudomonas aeruginosa PA01
gcgcccggcgaacagcgcuu

SEQ ID NO: 1492763 - RNA, 19 nt, Pseudomonas aeruginosa PA01
gcgcccggcgcaugccgca

SEQ ID NO: 1492764 - RNA, 14 nt, Pseudomonas aeruginosa PA01
gcgcccggcgccac

SEQ ID NO: 1492765 - RNA, 15 nt, Pseudomonas aeruginosa PA01
gcgcccggcgccacc

SEQ ID NO: 1492766 - RNA, 15 nt, Pseudomonas aeruginosa PA01
gcgcccggcgccagg

SEQ ID NO: 1492767 - RNA, 17 nt, Pseudomonas aeruginosa PA01
gcgcccggcgccaggcu

SEQ ID NO: 1492768 - RNA, 18 nt, Pseudomonas aeruginosa PA01
gcgcccggcgccaggcug

SEQ ID NO: 1492769 - RNA, 13 nt, Pseudomonas aeruginosa PA01
gcgcccggcgccc

SEQ ID NO: 1492770 - RNA, 15 nt, Pseudomonas aeruginosa PA01
gcgcccggccaggcc

SEQ ID NO: 1492771 - RNA, 13 nt, Pseudomonas aeruginosa PA01
gcgcccggcgcag

SEQ ID NO: 1492772 - RNA, 20 nt, Pseudomonas aeruginosa PA01
gcgcccuucgguuucgcgcc

SEQ ID NO: 1492773 - RNA, 23 nt, Pseudomonas aeruginosa PA01
gcgcccuucgguuucgcgccaug

SEQ ID NO: 1492774 - RNA, 24 nt, Pseudomonas aeruginosa PA01
gcgcccuucgguuucgcgccaugg

SEQ ID NO: 1492775 - RNA, 16 nt, Pseudomonas aeruginosa PA01
gcgcccuugacguuca

SEQ ID NO: 1492776 - RNA, 21 nt, Pseudomonas aeruginosa PA01
gcgcccuugacguucaggcug

SEQ ID NO: 1492777 - RNA, 16 nt, Pseudomonas aeruginosa PA01
gcgcccuugagcacgu

SEQ ID NO: 1492778 - RNA, 18 nt, Pseudomonas aeruginosa PA01
gcgcccgauugggcgcgu

SEQ ID NO: 1492779 - RNA, 19 nt, Pseudomonas aeruginosa PA01
gcgcccgccaaggcccugc

SEQ ID NO: 1492780 - RNA, 20 nt, Pseudomonas aeruginosa PA01
gcgcccgccaagggcgccgc

SEQ ID NO: 1492781 - RNA, 13 nt, Pseudomonas aeruginosa PA01
gcgcccgccaggu

SEQ ID NO: 1492782 - RNA, 15 nt, Pseudomonas aeruginosa PA01
gcgcccgccaggucg

SEQ ID NO: 1492783 - RNA, 16 nt, Pseudomonas aeruginosa PA01
gcgcccgccaggucga

SEQ ID NO: 1492784 - RNA, 20 nt, Pseudomonas aeruginosa PA01
gcgcccggcaaucaggcgcg

SEQ ID NO: 1492785 - RNA, 12 nt, Pseudomonas aeruginosa PA01
gcgcccggccag

SEQ ID NO: 1492786 - RNA, 23 nt, Pseudomonas aeruginosa PA01
gcgcccggagcuuugcagggcga

SEQ ID NO: 1492787 - RNA, 18 nt, Pseudomonas aeruginosa PA01
gcgcccgccgcgagcgcc

SEQ ID NO: 1492788 - RNA, 20 nt, Pseudomonas aeruginosa PA01
gcgcccgcccggcaccaccg

SEQ ID NO: 1492789 - RNA, 13 nt, Pseudomonas aeruginosa PA01
gcgccggaccaga

SEQ ID NO: 1492790 - RNA, 14 nt, Pseudomonas aeruginosa PA01
gcgccggaccagau

SEQ ID NO: 1492791 - RNA, 21 nt, Pseudomonas aeruginosa PA01
gcgccggaccagaucggcgcg

SEQ ID NO: 1492792 - RNA, 15 nt, Pseudomonas aeruginosa PA01
gcgccggaccagccg

SEQ ID NO: 1492793 - RNA, 19 nt, Pseudomonas aeruginosa PA01
gcgccggagccaccgggau

SEQ ID NO: 1492794 - RNA, 21 nt, Pseudomonas aeruginosa PA01
gcgccggaucgaaguagucgg

SEQ ID NO: 1492795 - RNA, 15 nt, Pseudomonas aeruginosa PA01
gcgccggaucggcug

SEQ ID NO: 1492796 - RNA, 15 nt, Pseudomonas aeruginosa PA01
gcgccggcacggcau

SEQ ID NO: 1492797 - RNA, 12 nt, Pseudomonas aeruginosa PA01
gcgccggcgcgu

SEQ ID NO: 1492798 - RNA, 14 nt, Pseudomonas aeruginosa PA01
gcgccggcgcugcg

SEQ ID NO: 1492799 - RNA, 15 nt, Pseudomonas aeruginosa PA01
gcgccggcgcugcga

SEQ ID NO: 1492800 - RNA, 15 nt, Pseudomonas aeruginosa PA01
gcgccggaugggcga

SEQ ID NO: 1492801 - RNA, 15 nt, Pseudomonas aeruginosa PA01
gcgccggcaccgagg

SEQ ID NO: 1492802 - RNA, 15 nt, Pseudomonas aeruginosa PA01
gcgccggcaacagca

SEQ ID NO: 1492803 - RNA, 19 nt, Pseudomonas aeruginosa PA01
gcgccggcggaucagcccg

SEQ ID NO: 1492804 - RNA, 15 nt, Pseudomonas aeruginosa PA01
gcgccggcggccugc

SEQ ID NO: 1492805 - RNA, 19 nt, Pseudomonas aeruginosa PA01
gcgccggcggccggcgcag

SEQ ID NO: 1492806 - RNA, 14 nt, Pseudomonas aeruginosa PA01
gcgccgggcugccg

SEQ ID NO: 1492807 - RNA, 16 nt, Pseudomonas aeruginosa PA01
gcgccgggcugccgaa

SEQ ID NO: 1492808 - RNA, 14 nt, Pseudomonas aeruginosa PA01
gcgccgggcuggcc

SEQ ID NO: 1492809 - RNA, 16 nt, Pseudomonas aeruginosa PA01
gcgccgggcuggccgu

SEQ ID NO: 1492810 - RNA, 14 nt, Pseudomonas aeruginosa PA01
gcgccgggcucagc

SEQ ID NO: 1492811 - RNA, 17 nt, Pseudomonas aeruginosa PA01
gcgccgggcucagcgcg

SEQ ID NO: 1492812 - RNA, 20 nt, Pseudomonas aeruginosa PA01
gcgccggggaucaggucgcc

SEQ ID NO: 1492813 - RNA, 17 nt, Pseudomonas aeruginosa PA01
gcgccguacgcaccgcg

SEQ ID NO: 1492814 - RNA, 18 nt, Pseudomonas aeruginosa PA01
gcgccguacgcaccgcgu

SEQ ID NO: 1492815 - RNA, 20 nt, Pseudomonas aeruginosa PA01
gcgccguacgcaccgcguag

SEQ ID NO: 1492816 - RNA, 15 nt, Pseudomonas aeruginosa PA01
gcgccgucaccagca

SEQ ID NO: 1492817 - RNA, 16 nt, Pseudomonas aeruginosa PA01
gcgccgucaccagcag

SEQ ID NO: 1492818 - RNA, 17 nt, Pseudomonas aeruginosa PA01
gcgccgucaccagcagc

SEQ ID NO: 1492819 - RNA, 14 nt, Pseudomonas aeruginosa PA01
gcgccgucgggggc

SEQ ID NO: 1492820 - RNA, 15 nt, Pseudomonas aeruginosa PA01
gcgccgucaucgcug

SEQ ID NO: 1492821 - RNA, 18 nt, Pseudomonas aeruginosa PA01
gcgccgucgggggcgcgu

SEQ ID NO: 1492822 - RNA, 17 nt, Pseudomonas aeruginosa PA01
gcgccgguggccaggac

SEQ ID NO: 1492823 - RNA, 20 nt, Pseudomonas aeruginosa PA01
gcgccgguggccaggacgcu

SEQ ID NO: 1492824 - RNA, 21 nt, Pseudomonas aeruginosa PA01
gcgccgguggccaggacgcug

SEQ ID NO: 1492825 - RNA, 19 nt, Pseudomonas aeruginosa PA01
gcgccgguuucgaccggcg

SEQ ID NO: 1492826 - RNA, 22 nt, Pseudomonas aeruginosa PA01
gcgccgguuucgaccggcgcgc

SEQ ID NO: 1492827 - RNA, 21 nt, Pseudomonas aeruginosa PA01
gcgccggugcaugaaggcgcu

SEQ ID NO: 1492828 - RNA, 18 nt, Pseudomonas aeruginosa PA01
gcgccggugaggcgcagc

SEQ ID NO: 1492829 - RNA, 19 nt, Pseudomonas aeruginosa PA01
gcgccggugaggcgcagca

SEQ ID NO: 1492830 - RNA, 20 nt, Pseudomonas aeruginosa PA01
gcgccggugaggcgcagcag

SEQ ID NO: 1492831 - RNA, 22 nt, Pseudomonas aeruginosa PA01
gcgccggugaggcgcagcagcg

SEQ ID NO: 1492832 - RNA, 14 nt, Pseudomonas aeruginosa PA01
gcgccggguagcgu

SEQ ID NO: 1492833 - RNA, 13 nt, Pseudomonas aeruginosa PA01
gcgccgggucgga

SEQ ID NO: 1492834 - RNA, 16 nt, Pseudomonas aeruginosa PA01
gcgccgggugaccgug

SEQ ID NO: 1492835 - RNA, 18 nt, Pseudomonas aeruginosa PA01
gcgccgggugaccgugcg

SEQ ID NO: 1492836 - RNA, 19 nt, Pseudomonas aeruginosa PA01
gcgccgggucgaccuugcc

SEQ ID NO: 1492837 - RNA, 22 nt, Pseudomonas aeruginosa PA01
gcgccgggucgaccuugccgac

SEQ ID NO: 1492838 - RNA, 13 nt, Pseudomonas aeruginosa PA01
gcgccgcccggcu

SEQ ID NO: 1492839 - RNA, 19 nt, Pseudomonas aeruginosa PA01
gcgccgcccggcucgccgc

SEQ ID NO: 1492840 - RNA, 20 nt, Pseudomonas aeruginosa PA01
gcgccgccgagggcaccgac

SEQ ID NO: 1492841 - RNA, 22 nt, Pseudomonas aeruginosa PA01
gcgccgccgagggcaccgacga

SEQ ID NO: 1492842 - RNA, 21 nt, Pseudomonas aeruginosa PA01
gcgccgccgagguugcgcagg

SEQ ID NO: 1492843 - RNA, 16 nt, Pseudomonas aeruginosa PA01
gcgccgccgcuggcga

SEQ ID NO: 1492844 - RNA, 13 nt, Pseudomonas aeruginosa PA01
gcgccgccggcga

SEQ ID NO: 1492845 - RNA, 19 nt, Pseudomonas aeruginosa PA01
gcgccgccggcgaacggca

SEQ ID NO: 1492846 - RNA, 12 nt, Pseudomonas aeruginosa PA01
gcgccgccggcu

SEQ ID NO: 1492847 - RNA, 13 nt, Pseudomonas aeruginosa PA01
gcgccgccgcggc

SEQ ID NO: 1492848 - RNA, 16 nt, Pseudomonas aeruginosa PA01
gcgccgccgcggccag

SEQ ID NO: 1492849 - RNA, 20 nt, Pseudomonas aeruginosa PA01
gcgccgccgcggccagcccc

SEQ ID NO: 1492850 - RNA, 16 nt, Pseudomonas aeruginosa PA01
gcgccgccgccgcggu

SEQ ID NO: 1492851 - RNA, 21 nt, Pseudomonas aeruginosa PA01
gcgccgccccguuggcgcggg

SEQ ID NO: 1492852 - RNA, 14 nt, Pseudomonas aeruginosa PA01
gcgccgcccccggc

SEQ ID NO: 1492853 - RNA, 18 nt, Pseudomonas aeruginosa PA01
gcgccgccaguucgcgca

SEQ ID NO: 1492854 - RNA, 16 nt, Pseudomonas aeruginosa PA01
gcgccgccaggcgcgu

SEQ ID NO: 1492855 - RNA, 15 nt, Pseudomonas aeruginosa PA01
gcgccgcagggugcg

SEQ ID NO: 1492856 - RNA, 21 nt, Pseudomonas aeruginosa PA01
gcgccgcagggugcggcugcu

SEQ ID NO: 1492857 - RNA, 14 nt, Pseudomonas aeruginosa PA01
gcgccgcaggcgcu

SEQ ID NO: 1492858 - RNA, 14 nt, Pseudomonas aeruginosa PA01
gcgccgcagggccc

SEQ ID NO: 1492859 - RNA, 12 nt, Pseudomonas aeruginosa PA01
gcgccgcgcugc

SEQ ID NO: 1492860 - RNA, 13 nt, Pseudomonas aeruginosa PA01
gcgccgcgcggca

SEQ ID NO: 1492861 - RNA, 21 nt, Pseudomonas aeruginosa PA01
gcgccgcgcguucgcgcgagg

SEQ ID NO: 1492862 - RNA, 14 nt, Pseudomonas aeruginosa PA01
gcgccgcgccaacu

SEQ ID NO: 1492863 - RNA, 15 nt, Pseudomonas aeruginosa PA01
gcgccgcgccaacug

SEQ ID NO: 1492864 - RNA, 14 nt, Pseudomonas aeruginosa PA01
gcgccgcgccugcu

SEQ ID NO: 1492865 - RNA, 13 nt, Pseudomonas aeruginosa PA01
gcgccgcgccuuc

SEQ ID NO: 1492866 - RNA, 15 nt, Pseudomonas aeruginosa PA01
gcgccgcggcgacca

SEQ ID NO: 1492867 - RNA, 16 nt, Pseudomonas aeruginosa PA01
gcgccgcggcccggcg

SEQ ID NO: 1492868 - RNA, 17 nt, Pseudomonas aeruginosa PA01
gcgccgcggcccggcgc

SEQ ID NO: 1492869 - RNA, 19 nt, Pseudomonas aeruginosa PA01
gcgccgcggcccggcgcug

SEQ ID NO: 1492870 - RNA, 16 nt, Pseudomonas aeruginosa PA01
gcgccgcggcggcgga

SEQ ID NO: 1492871 - RNA, 15 nt, Pseudomonas aeruginosa PA01
gcgccgcggcggcgu

SEQ ID NO: 1492872 - RNA, 16 nt, Pseudomonas aeruginosa PA01
gcgccgcggcuggcca

SEQ ID NO: 1492873 - RNA, 14 nt, Pseudomonas aeruginosa PA01
gcgccgccggugaa

SEQ ID NO: 1492874 - RNA, 19 nt, Pseudomonas aeruginosa PA01
gcgccgccggugaacaggu

SEQ ID NO: 1492875 - RNA, 16 nt, Pseudomonas aeruginosa PA01
gcgccgccgggcgccc

SEQ ID NO: 1492876 - RNA, 19 nt, Pseudomonas aeruginosa PA01
gcgccgccggggaucagcg

SEQ ID NO: 1492877 - RNA, 19 nt, Pseudomonas aeruginosa PA01
gcgccgccgguaucccggc

SEQ ID NO: 1492878 - RNA, 21 nt, Pseudomonas aeruginosa PA01
gcgccgccucgaaggccggca

SEQ ID NO: 1492879 - RNA, 18 nt, Pseudomonas aeruginosa PA01
gcgccgccucgauggcgg

SEQ ID NO: 1492880 - RNA, 20 nt, Pseudomonas aeruginosa PA01
gcgccgccucgauggcggca

SEQ ID NO: 1492881 - RNA, 14 nt, Pseudomonas aeruginosa PA01
gcgccgccucgcgc

SEQ ID NO: 1492882 - RNA, 15 nt, Pseudomonas aeruginosa PA01
gcgccgccucgcgca

SEQ ID NO: 1492883 - RNA, 16 nt, Pseudomonas aeruginosa PA01
gcgccgccucgggcag

SEQ ID NO: 1492884 - RNA, 19 nt, Pseudomonas aeruginosa PA01
gcgccgccuugagcggcgc

SEQ ID NO: 1492885 - RNA, 20 nt, Pseudomonas aeruginosa PA01
gcgccgccuugagcggcgcc

SEQ ID NO: 1492886 - RNA, 18 nt, Pseudomonas aeruginosa PA01
gcgccgccuggccgguga

SEQ ID NO: 1492887 - RNA, 14 nt, Pseudomonas aeruginosa PA01
gcgccgccugggcc

SEQ ID NO: 1492888 - RNA, 13 nt, Pseudomonas aeruginosa PA01
gcgccgccuggcc

SEQ ID NO: 1492889 - RNA, 12 nt, Pseudomonas aeruginosa PA01
gcgccgcgcagc

SEQ ID NO: 1492890 - RNA, 13 nt, Pseudomonas aeruginosa PA01
gcgccgcgcaucc

SEQ ID NO: 1492891 - RNA, 21 nt, Pseudomonas aeruginosa PA01
gcgccgcgcauccucggcauc

SEQ ID NO: 1492892 - RNA, 12 nt, Pseudomonas aeruginosa PA01
gcgccgcgccag

SEQ ID NO: 1492893 - RNA, 13 nt, Pseudomonas aeruginosa PA01
gcgccgcgccagc

SEQ ID NO: 1492894 - RNA, 15 nt, Pseudomonas aeruginosa PA01
gcgccgcgccagcag

SEQ ID NO: 1492895 - RNA, 14 nt, Pseudomonas aeruginosa PA01
gcgccgcgccaggu

SEQ ID NO: 1492896 - RNA, 19 nt, Pseudomonas aeruginosa PA01
gcgcaggcgaggauggccg

SEQ ID NO: 1492897 - RNA, 19 nt, Pseudomonas aeruginosa PA01
gcgcaggcgaugaucagcc

SEQ ID NO: 1492898 - RNA, 20 nt, Pseudomonas aeruginosa PA01
gcgcaggcgaugaucagccc

SEQ ID NO: 1492899 - RNA, 13 nt, Pseudomonas aeruginosa PA01
gcgcaggccgggc

SEQ ID NO: 1492900 - RNA, 16 nt, Pseudomonas aeruginosa PA01
gcgcaggccgggcgga

SEQ ID NO: 1492901 - RNA, 23 nt, Pseudomonas aeruginosa PA01
gcgcaggccgggcggacgcuggg

SEQ ID NO: 1492902 - RNA, 14 nt, Pseudomonas aeruginosa PA01
gcgcaggccgguga

SEQ ID NO: 1492903 - RNA, 16 nt, Pseudomonas aeruginosa PA01
gcgcaggccggugauc

SEQ ID NO: 1492904 - RNA, 21 nt, Pseudomonas aeruginosa PA01
gcgcaggccggugaucucgcg

SEQ ID NO: 1492905 - RNA, 15 nt, Pseudomonas aeruginosa PA01
gcgcaggcgcuggcg

SEQ ID NO: 1492906 - RNA, 16 nt, Pseudomonas aeruginosa PA01
gcgcaggcgcuggcgg

SEQ ID NO: 1492907 - RNA, 17 nt, Pseudomonas aeruginosa PA01
gcgcaggcgcuggcggg

SEQ ID NO: 1492908 - RNA, 20 nt, Pseudomonas aeruginosa PA01
gcgcaggcgcuggcgggcgc

SEQ ID NO: 1492909 - RNA, 14 nt, Pseudomonas aeruginosa PA01
gcgcaggcggaucg

SEQ ID NO: 1492910 - RNA, 17 nt, Pseudomonas aeruginosa PA01
gcgcaggcggaucgccc

SEQ ID NO: 1492911 - RNA, 20 nt, Pseudomonas aeruginosa PA01
gcgcaggcguuccucgacga

SEQ ID NO: 1492912 - RNA, 22 nt, Pseudomonas aeruginosa PA01
gcgcaggcguuccucgacgaaa

SEQ ID NO: 1492913 - RNA, 14 nt, Pseudomonas aeruginosa PA01
gcgcagggcagcgc

SEQ ID NO: 1492914 - RNA, 15 nt, Pseudomonas aeruginosa PA01
gcgcagggcagcgcg

SEQ ID NO: 1492915 - RNA, 18 nt, Pseudomonas aeruginosa PA01
gcgcagggcaucgacgau

SEQ ID NO: 1492916 - RNA, 13 nt, Pseudomonas aeruginosa PA01
gcgcaggcuggcc

SEQ ID NO: 1492917 - RNA, 14 nt, Pseudomonas aeruginosa PA01
gcgcaggcuggccg

SEQ ID NO: 1492918 - RNA, 21 nt, Pseudomonas aeruginosa PA01
gcgcaggcuggccgagcgccg

SEQ ID NO: 1492919 - RNA, 21 nt, Pseudomonas aeruginosa PA01
gcgcaggcugucggccagccc

SEQ ID NO: 1492920 - RNA, 23 nt, Pseudomonas aeruginosa PA01
gcgcaggcugucggccagccccu

SEQ ID NO: 1492921 - RNA, 17 nt, Pseudomonas aeruginosa PA01
gcgcaggcggcuggcgc

SEQ ID NO: 1492922 - RNA, 16 nt, Pseudomonas aeruginosa PA01
gcgcaggcgcucgcgg

SEQ ID NO: 1492923 - RNA, 17 nt, Pseudomonas aeruginosa PA01
gcgcaggcgcucgcggg

SEQ ID NO: 1492924 - RNA, 20 nt, Pseudomonas aeruginosa PA01
gcgcaggcgcucgcgggccg

SEQ ID NO: 1492925 - RNA, 21 nt, Pseudomonas aeruginosa PA01
gcgcaggcgcucgcgggccgc

SEQ ID NO: 1492926 - RNA, 18 nt, Pseudomonas aeruginosa PA01
gcgcaggcgggcggcguc

SEQ ID NO: 1492927 - RNA, 12 nt, Pseudomonas aeruginosa PA01
gcgcaggcggua

SEQ ID NO: 1492928 - RNA, 16 nt, Pseudomonas aeruginosa PA01
gcgcaggcgguaggug

SEQ ID NO: 1492929 - RNA, 23 nt, Pseudomonas aeruginosa PA01
gcgcaggcgguaggugagcgacc

SEQ ID NO: 1492930 - RNA, 14 nt, Pseudomonas aeruginosa PA01
gcgcaggcggucgg

SEQ ID NO: 1492931 - RNA, 17 nt, Pseudomonas aeruginosa PA01
gcgcaggcgguggagca

SEQ ID NO: 1492932 - RNA, 16 nt, Pseudomonas aeruginosa PA01
gcgcaggggcgcgccg

SEQ ID NO: 1492933 - RNA, 17 nt, Pseudomonas aeruginosa PA01
gcgcaggggcgcgccgg

SEQ ID NO: 1492934 - RNA, 18 nt, Pseudomonas aeruginosa PA01
gcgcaggggcgcgccggc

SEQ ID NO: 1492935 - RNA, 19 nt, Pseudomonas aeruginosa PA01
gcgcaggggcgcgccggcu

SEQ ID NO: 1492936 - RNA, 18 nt, Pseudomonas aeruginosa PA01
gcgcaggggcgcggcgcg

SEQ ID NO: 1492937 - RNA, 14 nt, Pseudomonas aeruginosa PA01
gcgcagggucaggc

SEQ ID NO: 1492938 - RNA, 15 nt, Pseudomonas aeruginosa PA01
gcgcagggucaggcc

SEQ ID NO: 1492939 - RNA, 16 nt, Pseudomonas aeruginosa PA01
gcgcagggugagcaug

SEQ ID NO: 1492940 - RNA, 17 nt, Pseudomonas aeruginosa PA01
gcgcagggugagcaugg

SEQ ID NO: 1492941 - RNA, 16 nt, Pseudomonas aeruginosa PA01
gcgcagggugcccucg

SEQ ID NO: 1492942 - RNA, 17 nt, Pseudomonas aeruginosa PA01
gcgcagggcgccgucgg

SEQ ID NO: 1492943 - RNA, 19 nt, Pseudomonas aeruginosa PA01
gcgcagggcggcgagcugg

SEQ ID NO: 1492944 - RNA, 18 nt, Pseudomonas aeruginosa PA01
gcgcagggcgucgaaggc

SEQ ID NO: 1492945 - RNA, 21 nt, Pseudomonas aeruginosa PA01
gcgcagggcgucgaaggcggc

SEQ ID NO: 1492946 - RNA, 18 nt, Pseudomonas aeruginosa PA01
gcgcagggccagggcggc

SEQ ID NO: 1492947 - RNA, 15 nt, Pseudomonas aeruginosa PA01
gcgcagggccgcggc

SEQ ID NO: 1492948 - RNA, 16 nt, Pseudomonas aeruginosa PA01
gcgcagggccgcggcg

SEQ ID NO: 1492949 - RNA, 13 nt, Pseudomonas aeruginosa PA01
gcgcagggccagc

SEQ ID NO: 1492950 - RNA, 16 nt, Pseudomonas aeruginosa PA01
gcgcagggccagcaac

SEQ ID NO: 1492951 - RNA, 17 nt, Pseudomonas aeruginosa PA01
gcgcagggccagcaaca

SEQ ID NO: 1492952 - RNA, 20 nt, Pseudomonas aeruginosa PA01
gcgcagggccagcaacaggc

SEQ ID NO: 1492953 - RNA, 20 nt, Pseudomonas aeruginosa PA01
gcgcagucgucaagcgcgga

SEQ ID NO: 1492954 - RNA, 15 nt, Pseudomonas aeruginosa PA01
gcgcaggucgcuggc

SEQ ID NO: 1492955 - RNA, 20 nt, Pseudomonas aeruginosa PA01
gcgcaggucgcuggcgucga

SEQ ID NO: 1492956 - RNA, 22 nt, Pseudomonas aeruginosa PA01
gcgcaggucgcuggcgucgacc

SEQ ID NO: 1492957 - RNA, 23 nt, Pseudomonas aeruginosa PA01
gcgcaggucgcuggcgucgaccg

SEQ ID NO: 1492958 - RNA, 18 nt, Pseudomonas aeruginosa PA01
gcgcagguacucgccggc

SEQ ID NO: 1492959 - RNA, 20 nt, Pseudomonas aeruginosa PA01
gcgcagguacucgccggcga

SEQ ID NO: 1492960 - RNA, 22 nt, Pseudomonas aeruginosa PA01
gcgcagguacucgccggcgauc

SEQ ID NO: 1492961 - RNA, 22 nt, Pseudomonas aeruginosa PA01
gcgcagguagaaggugcccagc

SEQ ID NO: 1492962 - RNA, 17 nt, Pseudomonas aeruginosa PA01
gcgcagguagucgcuca

SEQ ID NO: 1492963 - RNA, 20 nt, Pseudomonas aeruginosa PA01
gcgcaggaagaaggcgucca

SEQ ID NO: 1492964 - RNA, 23 nt, Pseudomonas aeruginosa PA01
gcgcagcugguaggagccgucgc

SEQ ID NO: 1492965 - RNA, 19 nt, Pseudomonas aeruginosa PA01
gcgcagcuucuccaccgga

SEQ ID NO: 1492966 - RNA, 17 nt, Pseudomonas aeruginosa PA01
gcgcagcuucugcaggg

SEQ ID NO: 1492967 - RNA, 21 nt, Pseudomonas aeruginosa PA01
gcgcagcuucugcagggcggc

SEQ ID NO: 1492968 - RNA, 13 nt, Pseudomonas aeruginosa PA01
gcgcagcuugccu

SEQ ID NO: 1492969 - RNA, 17 nt, Pseudomonas aeruginosa PA01
gcgcagcuugccuucca

SEQ ID NO: 1492970 - RNA, 22 nt, Pseudomonas aeruginosa PA01
gcgcagcuugccuuccaggcug

SEQ ID NO: 1492971 - RNA, 14 nt, Pseudomonas aeruginosa PA01
gcgcagcuccggca

SEQ ID NO: 1492972 - RNA, 17 nt, Pseudomonas aeruginosa PA01
gcgcagcuccggcagca

SEQ ID NO: 1492973 - RNA, 13 nt, Pseudomonas aeruginosa PA01
gcgcaggccgaga

SEQ ID NO: 1492974 - RNA, 13 nt, Pseudomonas aeruginosa PA01
gcgcaggccgagg

SEQ ID NO: 1492975 - RNA, 12 nt, Pseudomonas aeruginosa PA01
gcgcaggccgau

SEQ ID NO: 1492976 - RNA, 16 nt, Pseudomonas aeruginosa PA01
gcgcaggccgccggcg

SEQ ID NO: 1492977 - RNA, 18 nt, Pseudomonas aeruginosa PA01
gcgcaggccgccggcggc

SEQ ID NO: 1492978 - RNA, 22 nt, Pseudomonas aeruginosa PA01
gcgcaggccgccggcggccagg

SEQ ID NO: 1492979 - RNA, 19 nt, Pseudomonas aeruginosa PA01
gcgcaggagugugggacag

SEQ ID NO: 1492980 - RNA, 20 nt, Pseudomonas aeruginosa PA01
gcgcaggagugugggacagg

SEQ ID NO: 1492981 - RNA, 18 nt, Pseudomonas aeruginosa PA01
gcgcaggaccagacgcgg

SEQ ID NO: 1492982 - RNA, 19 nt, Pseudomonas aeruginosa PA01
gcgcaggaccagacgcgga

SEQ ID NO: 1492983 - RNA, 17 nt, Pseudomonas aeruginosa PA01
gcgcaggaccgccaugg

SEQ ID NO: 1492984 - RNA, 23 nt, Pseudomonas aeruginosa PA01
gcgcaggaccgccauggcgcuga

SEQ ID NO: 1492985 - RNA, 22 nt, Pseudomonas aeruginosa PA01
gcgcaggacgaggaaggcgcgc

SEQ ID NO: 1492986 - RNA, 21 nt, Pseudomonas aeruginosa PA01
gcgcaggacggauaacggcag

SEQ ID NO: 1492987 - RNA, 14 nt, Pseudomonas aeruginosa PA01
gcgcagcuaggcga

SEQ ID NO: 1492988 - RNA, 14 nt, Pseudomonas aeruginosa PA01
gcgcagcguccugc

SEQ ID NO: 1492989 - RNA, 17 nt, Pseudomonas aeruginosa PA01
gcgcagcguccugcccu

SEQ ID NO: 1492990 - RNA, 14 nt, Pseudomonas aeruginosa PA01
gcgcagcggcuccc

SEQ ID NO: 1492991 - RNA, 19 nt, Pseudomonas aeruginosa PA01
gcgcagcgguacaggcgga

SEQ ID NO: 1492992 - RNA, 20 nt, Pseudomonas aeruginosa PA01
gcgcagcgucaccgcgucgg

SEQ ID NO: 1492993 - RNA, 15 nt, Pseudomonas aeruginosa PA01
gcgcagcgccgccgc

SEQ ID NO: 1492994 - RNA, 17 nt, Pseudomonas aeruginosa PA01
gcgcagcgccgccgcgu

SEQ ID NO: 1492995 - RNA, 12 nt, Pseudomonas aeruginosa PA01
gcgcagcgccuc

SEQ ID NO: 1492996 - RNA, 14 nt, Pseudomonas aeruginosa PA01
gcgcagcgccucca

SEQ ID NO: 1492997 - RNA, 18 nt, Pseudomonas aeruginosa PA01
gcgcagcgccuccagcgu

SEQ ID NO: 1492998 - RNA, 21 nt, Pseudomonas aeruginosa PA01
gcgcagcgccuccagcgucug

SEQ ID NO: 1492999 - RNA, 24 nt, Pseudomonas aeruginosa PA01
gcgcagcgccuccagcgucugccg

SEQ ID NO: 1493000 - RNA, 12 nt, Pseudomonas aeruginosa PA01
gcgcagcggcag

SEQ ID NO: 1493001 - RNA, 19 nt, Pseudomonas aeruginosa PA01
gcgcagcggcagcgccagg

SEQ ID NO: 1493002 - RNA, 16 nt, Pseudomonas aeruginosa PA01
gcgcagcggcaggcca

SEQ ID NO: 1493003 - RNA, 17 nt, Pseudomonas aeruginosa PA01
gcgcagcggcaggccac

SEQ ID NO: 1493004 - RNA, 19 nt, Pseudomonas aeruginosa PA01
gcgcagcggcgaacccucg

SEQ ID NO: 1493005 - RNA, 18 nt, Pseudomonas aeruginosa PA01
gcgcagcggcgccgaggg

SEQ ID NO: 1493006 - RNA, 19 nt, Pseudomonas aeruginosa PA01
gcgcagcggcgccgagggc

SEQ ID NO: 1493007 - RNA, 13 nt, Pseudomonas aeruginosa PA01
gcgcagcggcgcg

SEQ ID NO: 1493008 - RNA, 15 nt, Pseudomonas aeruginosa PA01
gcgcagcggcgcguc

SEQ ID NO: 1493009 - RNA, 16 nt, Pseudomonas aeruginosa PA01
gcgcagcggcgcgucg

SEQ ID NO: 1493010 - RNA, 12 nt, Pseudomonas aeruginosa PA01
gcgccacccucg

SEQ ID NO: 1493011 - RNA, 14 nt, Pseudomonas aeruginosa PA01
gcgccacccucggc

SEQ ID NO: 1493012 - RNA, 14 nt, Pseudomonas aeruginosa PA01
gcgccaccccgccg

SEQ ID NO: 1493013 - RNA, 17 nt, Pseudomonas aeruginosa PA01
gcgccaccccgccgcgc

SEQ ID NO: 1493014 - RNA, 17 nt, Pseudomonas aeruginosa PA01
gcgccaccgauucgccg

SEQ ID NO: 1493015 - RNA, 22 nt, Pseudomonas aeruginosa PA01
gcgccaccgauucgccggccac

SEQ ID NO: 1493016 - RNA, 20 nt, Pseudomonas aeruginosa PA01
gcgccaccgcguugaccgug

SEQ ID NO: 1493017 - RNA, 13 nt, Pseudomonas aeruginosa PA01
gcgccacgggcag

SEQ ID NO: 1493018 - RNA, 13 nt, Pseudomonas aeruginosa PA01
gcgccacuuccag

SEQ ID NO: 1493019 - RNA, 13 nt, Pseudomonas aeruginosa PA01
gcgccaccagcag

SEQ ID NO: 1493020 - RNA, 14 nt, Pseudomonas aeruginosa PA01
gcgccaccagcagg

SEQ ID NO: 1493021 - RNA, 19 nt, Pseudomonas aeruginosa PA01
gcgccaccagcagggccag

SEQ ID NO: 1493022 - RNA, 22 nt, Pseudomonas aeruginosa PA01
gcgccaccagcagggccaggcc

SEQ ID NO: 1493023 - RNA, 23 nt, Pseudomonas aeruginosa PA01
gcgccaccagcaugcccagcgug

SEQ ID NO: 1493024 - RNA, 12 nt, Pseudomonas aeruginosa PA01
gcgccaccagca

SEQ ID NO: 1493025 - RNA, 20 nt, Pseudomonas aeruginosa PA01
gcgccaccagcguggcgcgc

SEQ ID NO: 1493026 - RNA, 20 nt, Pseudomonas aeruginosa PA01
gcgccaccaggaaaucgccg

SEQ ID NO: 1493027 - RNA, 20 nt, Pseudomonas aeruginosa PA01
gcgccaaaaagcaggacggc

SEQ ID NO: 1493028 - RNA, 21 nt, Pseudomonas aeruginosa PA01
gcgccaaaaagcaggacggcg

SEQ ID NO: 1493029 - RNA, 17 nt, Pseudomonas aeruginosa PA01
gcgcauuugcacgucgg

SEQ ID NO: 1493030 - RNA, 22 nt, Pseudomonas aeruginosa PA01
gcgcauuuucauugccucgagc

SEQ ID NO: 1493031 - RNA, 17 nt, Pseudomonas aeruginosa PA01
gcgcauuuugccggaga

SEQ ID NO: 1493032 - RNA, 22 nt, Pseudomonas aeruginosa PA01
gcgcaucgucgaaacgcuggcg

SEQ ID NO: 1493033 - RNA, 17 nt, Pseudomonas aeruginosa PA01
gcgcaucgugcagccag

SEQ ID NO: 1493034 - RNA, 12 nt, Pseudomonas aeruginosa PA01
gcgcaucgucga

SEQ ID NO: 1493035 - RNA, 15 nt, Pseudomonas aeruginosa PA01
gcgcaucggcgccuc

SEQ ID NO: 1493036 - RNA, 16 nt, Pseudomonas aeruginosa PA01
gcgcauguccagccag

SEQ ID NO: 1493037 - RNA, 20 nt, Pseudomonas aeruginosa PA01
gcgcaugaccuucagcaccu

SEQ ID NO: 1493038 - RNA, 16 nt, Pseudomonas aeruginosa PA01
gcgcaguucgucgccc

SEQ ID NO: 1493039 - RNA, 18 nt, Pseudomonas aeruginosa PA01
gcgcaguucgucgcccau

SEQ ID NO: 1493040 - RNA, 16 nt, Pseudomonas aeruginosa PA01
gcgcaguucagggcgu

SEQ ID NO: 1493041 - RNA, 18 nt, Pseudomonas aeruginosa PA01
gcgcaguucgccgccgag

SEQ ID NO: 1493042 - RNA, 12 nt, Pseudomonas aeruginosa PA01
gcgcaguugcca

SEQ ID NO: 1493043 - RNA, 19 nt, Pseudomonas aeruginosa PA01
gcgcauaaccgcucgcggu

SEQ ID NO: 1493044 - RNA, 19 nt, Pseudomonas aeruginosa PA01
gcgcauaaccgcuugcggu

SEQ ID NO: 1493045 - RNA, 16 nt, Pseudomonas aeruginosa PA01
gcgcaucgccugggcc

SEQ ID NO: 1493046 - RNA, 17 nt, Pseudomonas aeruginosa PA01
gcgcaucgccugggccg

SEQ ID NO: 1493047 - RNA, 21 nt, Pseudomonas aeruginosa PA01
gcgcaucgccugggccggcgu

SEQ ID NO: 1493048 - RNA, 15 nt, Pseudomonas aeruginosa PA01
gcgcagcgaacgggc

SEQ ID NO: 1493049 - RNA, 16 nt, Pseudomonas aeruginosa PA01
gcgcagccgcucggcc

SEQ ID NO: 1493050 - RNA, 14 nt, Pseudomonas aeruginosa PA01
gcgcagccucgcgc

SEQ ID NO: 1493051 - RNA, 23 nt, Pseudomonas aeruginosa PA01
gcgcagccucgcgcucggcggcc

SEQ ID NO: 1493052 - RNA, 24 nt, Pseudomonas aeruginosa PA01
gcgcagccucgcgcucggcggccu

SEQ ID NO: 1493053 - RNA, 17 nt, Pseudomonas aeruginosa PA01
gcgcagccugcuggccu

SEQ ID NO: 1493054 - RNA, 13 nt, Pseudomonas aeruginosa PA01
gcgcagcgcccga

SEQ ID NO: 1493055 - RNA, 12 nt, Pseudomonas aeruginosa PA01
gcgcagccgcaa

SEQ ID NO: 1493056 - RNA, 15 nt, Pseudomonas aeruginosa PA01
gcgcagccgcaaggc

SEQ ID NO: 1493057 - RNA, 19 nt, Pseudomonas aeruginosa PA01
gcgcagccgcaaggccagg

SEQ ID NO: 1493058 - RNA, 14 nt, Pseudomonas aeruginosa PA01
gcgcagccaggcga

SEQ ID NO: 1493059 - RNA, 17 nt, Pseudomonas aeruginosa PA01
gcgcagccaggcgagga

SEQ ID NO: 1493060 - RNA, 23 nt, Pseudomonas aeruginosa PA01
gcgcagccaggcgaggaacagcg

SEQ ID NO: 1493061 - RNA, 17 nt, Pseudomonas aeruginosa PA01
gcgcagccaggcgaugg

SEQ ID NO: 1493062 - RNA, 18 nt, Pseudomonas aeruginosa PA01
gcgcagccauucgccgcg

SEQ ID NO: 1493063 - RNA, 19 nt, Pseudomonas aeruginosa PA01
gcgcagccauucgccgcga

SEQ ID NO: 1493064 - RNA, 14 nt, Pseudomonas aeruginosa PA01
gcgcagccagagcu

SEQ ID NO: 1493065 - RNA, 13 nt, Pseudomonas aeruginosa PA01
gcgcagccagcac

SEQ ID NO: 1493066 - RNA, 20 nt, Pseudomonas aeruginosa PA01
gcgcagccagcacaugcggu

SEQ ID NO: 1493067 - RNA, 21 nt, Pseudomonas aeruginosa PA01
gcgcagccagcacaugcggug

SEQ ID NO: 1493068 - RNA, 22 nt, Pseudomonas aeruginosa PA01
gcgcagcccagccgcucgcguc

SEQ ID NO: 1493069 - RNA, 16 nt, Pseudomonas aeruginosa PA01
gcgcagccacuggcgg

SEQ ID NO: 1493070 - RNA, 13 nt, Pseudomonas aeruginosa PA01
gcgcagccacccg

SEQ ID NO: 1493071 - RNA, 15 nt, Pseudomonas aeruginosa PA01
gcgcagccacccgcu

SEQ ID NO: 1493072 - RNA, 21 nt, Pseudomonas aeruginosa PA01
gcgcagccacccgcucgaccu

SEQ ID NO: 1493073 - RNA, 21 nt, Pseudomonas aeruginosa PA01
gcgcagcaggucuuccaccgc

SEQ ID NO: 1493074 - RNA, 21 nt, Pseudomonas aeruginosa PA01
gcgcagcaguaccuggcggua

SEQ ID NO: 1493075 - RNA, 14 nt, Pseudomonas aeruginosa PA01
gcgcagcagggcgu

SEQ ID NO: 1493076 - RNA, 15 nt, Pseudomonas aeruginosa PA01
gcgcagcagggcguc

SEQ ID NO: 1493077 - RNA, 14 nt, Pseudomonas aeruginosa PA01
gcgcagcaccggcu

SEQ ID NO: 1493078 - RNA, 17 nt, Pseudomonas aeruginosa PA01
gcgcagcaacuggucgc

SEQ ID NO: 1493079 - RNA, 18 nt, Pseudomonas aeruginosa PA01
gcgcagcaacuggucgcc

SEQ ID NO: 1493080 - RNA, 21 nt, Pseudomonas aeruginosa PA01
gcgcagcaacuggucgccgca

SEQ ID NO: 1493081 - RNA, 17 nt, Pseudomonas aeruginosa PA01
gcgcagcaacuguccga

SEQ ID NO: 1493082 - RNA, 24 nt, Pseudomonas aeruginosa PA01
gcgcagcacuuccugaaggcgcgg

SEQ ID NO: 1493083 - RNA, 19 nt, Pseudomonas aeruginosa PA01
gcgcagcacgaugcacagg

SEQ ID NO: 1493084 - RNA, 15 nt, Pseudomonas aeruginosa PA01
gcgcagcagcgccag

SEQ ID NO: 1493085 - RNA, 14 nt, Pseudomonas aeruginosa PA01
gcgcagcagcgcca

SEQ ID NO: 1493086 - RNA, 20 nt, Pseudomonas aeruginosa PA01
gcgcagcagcgucgcgucgg

SEQ ID NO: 1493087 - RNA, 16 nt, Pseudomonas aeruginosa PA01
gcgcagaugcggggcg

SEQ ID NO: 1493088 - RNA, 20 nt, Pseudomonas aeruginosa PA01
gcgcagaugcggggcgacca

SEQ ID NO: 1493089 - RNA, 19 nt, Pseudomonas aeruginosa PA01
gcgcagcaacgcgacgauc

SEQ ID NO: 1493090 - RNA, 17 nt, Pseudomonas aeruginosa PA01
gcgcagcaacggcgcau

SEQ ID NO: 1493091 - RNA, 16 nt, Pseudomonas aeruginosa PA01
gcgcagaucgccgcgu

SEQ ID NO: 1493092 - RNA, 21 nt, Pseudomonas aeruginosa PA01
gcgcagaucgccgcguagcgc

SEQ ID NO: 1493093 - RNA, 12 nt, Pseudomonas aeruginosa PA01
gcgcagaucgcg

SEQ ID NO: 1493094 - RNA, 20 nt, Pseudomonas aeruginosa PA01
gcgcagaucgcggcgcaggc

SEQ ID NO: 1493095 - RNA, 21 nt, Pseudomonas aeruginosa PA01
gcgcagaucgcggcgcaggcu

SEQ ID NO: 1493096 - RNA, 22 nt, Pseudomonas aeruginosa PA01
gcgcagaucgcggcgcaggcug

SEQ ID NO: 1493097 - RNA, 20 nt, Pseudomonas aeruginosa PA01
gcgcagaacugccgggccag

SEQ ID NO: 1493098 - RNA, 22 nt, Pseudomonas aeruginosa PA01
gcgcagaacugccgggccagcu

SEQ ID NO: 1493099 - RNA, 13 nt, Pseudomonas aeruginosa PA01
gcgcagacaggcc

SEQ ID NO: 1493100 - RNA, 22 nt, Pseudomonas aeruginosa PA01
gcgcagacaggccuccagcaac

SEQ ID NO: 1493101 - RNA, 15 nt, Pseudomonas aeruginosa PA01
gcgcagaggcgcucc

SEQ ID NO: 1493102 - RNA, 21 nt, Pseudomonas aeruginosa PA01
gcgcagaggcgcuccaccagg

SEQ ID NO: 1493103 - RNA, 21 nt, Pseudomonas aeruginosa PA01
gcgcagacgauugaccucccg

SEQ ID NO: 1493104 - RNA, 19 nt, Pseudomonas aeruginosa PA01
gcgcagacgggugcugaag

SEQ ID NO: 1493105 - RNA, 19 nt, Pseudomonas aeruginosa PA01
gcgcacgcuucuccucggc

SEQ ID NO: 1493106 - RNA, 22 nt, Pseudomonas aeruginosa PA01
gcgcacgcuucuccucggccga

SEQ ID NO: 1493107 - RNA, 16 nt, Pseudomonas aeruginosa PA01
gcgcacggaggcgcuc

SEQ ID NO: 1493108 - RNA, 19 nt, Pseudomonas aeruginosa PA01
gcgcacggaggcgcucagg

SEQ ID NO: 1493109 - RNA, 13 nt, Pseudomonas aeruginosa PA01
gcgcacggaucgc

SEQ ID NO: 1493110 - RNA, 15 nt, Pseudomonas aeruginosa PA01
gcgcacggaucgcgc

SEQ ID NO: 1493111 - RNA, 17 nt, Pseudomonas aeruginosa PA01
gcgcacggaucgcgcug

SEQ ID NO: 1493112 - RNA, 14 nt, Pseudomonas aeruginosa PA01
gcgcaccuggcggu

SEQ ID NO: 1493113 - RNA, 21 nt, Pseudomonas aeruginosa PA01
gcgcaccuggcgguaggcguu

SEQ ID NO: 1493114 - RNA, 15 nt, Pseudomonas aeruginosa PA01
gcgcaccuggcgguc

SEQ ID NO: 1493115 - RNA, 16 nt, Pseudomonas aeruginosa PA01
gcgcaccuggcggucg

SEQ ID NO: 1493116 - RNA, 18 nt, Pseudomonas aeruginosa PA01
gcgcaccuggcggucgcc

SEQ ID NO: 1493117 - RNA, 22 nt, Pseudomonas aeruginosa PA01
gcgcaccuccucgggcggaucg

SEQ ID NO: 1493118 - RNA, 20 nt, Pseudomonas aeruginosa PA01
gcgcaccucgaccgcgccgg

SEQ ID NO: 1493119 - RNA, 21 nt, Pseudomonas aeruginosa PA01
gcgcaccucgaccgcgccggc

SEQ ID NO: 1493120 - RNA, 13 nt, Pseudomonas aeruginosa PA01
gcgcaccucgccc

SEQ ID NO: 1493121 - RNA, 14 nt, Pseudomonas aeruginosa PA01
gcgcaccucgcccu

SEQ ID NO: 1493122 - RNA, 21 nt, Pseudomonas aeruginosa PA01
gcgcaccauagcgagccgcgc

SEQ ID NO: 1493123 - RNA, 15 nt, Pseudomonas aeruginosa PA01
gcgcaccgacgccgc

SEQ ID NO: 1493124 - RNA, 19 nt, Pseudomonas aeruginosa PA01
gcgcaccgacgccgccugc

SEQ ID NO: 1493125 - RNA, 17 nt, Pseudomonas aeruginosa PA01
gcgcacccgcucggccu

SEQ ID NO: 1493126 - RNA, 19 nt, Pseudomonas aeruginosa PA01
gcgcacccgcucggccuug

SEQ ID NO: 1493127 - RNA, 21 nt, Pseudomonas aeruginosa PA01
gcgaguugaucggcguggcgg

SEQ ID NO: 1493128 - RNA, 17 nt, Pseudomonas aeruginosa PA01
gcgaguugcgcgaggcg

SEQ ID NO: 1493129 - RNA, 14 nt, Pseudomonas aeruginosa PA01
gcgaguucggcgag

SEQ ID NO: 1493130 - RNA, 19 nt, Pseudomonas aeruginosa PA01
gcgaguucggcgagcaggu

SEQ ID NO: 1493131 - RNA, 14 nt, Pseudomonas aeruginosa PA01
gcgauagacgccgg

SEQ ID NO: 1493132 - RNA, 18 nt, Pseudomonas aeruginosa PA01
gcgauagacgccggcgac

SEQ ID NO: 1493133 - RNA, 22 nt, Pseudomonas aeruginosa PA01
gcgauagaccaggaaggccggg

SEQ ID NO: 1493134 - RNA, 13 nt, Pseudomonas aeruginosa PA01
gcgauagaccgcu

SEQ ID NO: 1493135 - RNA, 18 nt, Pseudomonas aeruginosa PA01
gcgaguuuguugcgcgag

SEQ ID NO: 1493136 - RNA, 19 nt, Pseudomonas aeruginosa PA01
gcgaguuuguugcgcgagg

SEQ ID NO: 1493137 - RNA, 16 nt, Pseudomonas aeruginosa PA01
gcgcacaugccgagcg

SEQ ID NO: 1493138 - RNA, 18 nt, Pseudomonas aeruginosa PA01
gcgcaccauccucguagg

SEQ ID NO: 1493139 - RNA, 15 nt, Pseudomonas aeruginosa PA01
gcgcaccaugcccgc

SEQ ID NO: 1493140 - RNA, 16 nt, Pseudomonas aeruginosa PA01
gcgcaccaugcccgcu

SEQ ID NO: 1493141 - RNA, 13 nt, Pseudomonas aeruginosa PA01
gcgcaccagggcc

SEQ ID NO: 1493142 - RNA, 16 nt, Pseudomonas aeruginosa PA01
gcgcaccagggucggg

SEQ ID NO: 1493143 - RNA, 22 nt, Pseudomonas aeruginosa PA01
gcgcaccagggucgggccgcgc

SEQ ID NO: 1493144 - RNA, 19 nt, Pseudomonas aeruginosa PA01
gcgcaccaggucgcgcuug

SEQ ID NO: 1493145 - RNA, 18 nt, Pseudomonas aeruginosa PA01
gcgcacacggucgagacc

SEQ ID NO: 1493146 - RNA, 18 nt, Pseudomonas aeruginosa PA01
gcgcacaaaaaagcccgc

SEQ ID NO: 1493147 - RNA, 22 nt, Pseudomonas aeruginosa PA01
gccguuucgacgaugcucgguu

SEQ ID NO: 1493148 - RNA, 14 nt, Pseudomonas aeruginosa PA01
gccguuguggcagg

SEQ ID NO: 1493149 - RNA, 19 nt, Pseudomonas aeruginosa PA01
gccguuuuacucgucgcca

SEQ ID NO: 1493150 - RNA, 21 nt, Pseudomonas aeruginosa PA01
gccuacugggcguggcggccg

SEQ ID NO: 1493151 - RNA, 22 nt, Pseudomonas aeruginosa PA01
gccuacugggcguggcggccgc

SEQ ID NO: 1493152 - RNA, 16 nt, Pseudomonas aeruginosa PA01
gccuacuucucgacga

SEQ ID NO: 1493153 - RNA, 23 nt, Pseudomonas aeruginosa PA01
gccguuuuuuaugccgaggcgua

SEQ ID NO: 1493154 - RNA, 15 nt, Pseudomonas aeruginosa PA01
gccguuccagcggca

SEQ ID NO: 1493155 - RNA, 16 nt, Pseudomonas aeruginosa PA01
gccguuccagcggcac

SEQ ID NO: 1493156 - RNA, 13 nt, Pseudomonas aeruginosa PA01
gccguuccaggcg

SEQ ID NO: 1493157 - RNA, 15 nt, Pseudomonas aeruginosa PA01
gccguuccaggcggg

SEQ ID NO: 1493158 - RNA, 12 nt, Pseudomonas aeruginosa PA01
gccguucagcgu

SEQ ID NO: 1493159 - RNA, 14 nt, Pseudomonas aeruginosa PA01
gccguucaggccgg

SEQ ID NO: 1493160 - RNA, 18 nt, Pseudomonas aeruginosa PA01
gccguucaggccggcgcc

SEQ ID NO: 1493161 - RNA, 19 nt, Pseudomonas aeruginosa PA01
gccguucaggccggcgccg

SEQ ID NO: 1493162 - RNA, 23 nt, Pseudomonas aeruginosa PA01
gccguucaggccggcgccgccga

SEQ ID NO: 1493163 - RNA, 22 nt, Pseudomonas aeruginosa PA01
gccguucagggacaugucgagg

SEQ ID NO: 1493164 - RNA, 19 nt, Pseudomonas aeruginosa PA01
gccguucagggucagguug

SEQ ID NO: 1493165 - RNA, 23 nt, Pseudomonas aeruginosa PA01
gccguuguagaucggcagcauca

SEQ ID NO: 1493166 - RNA, 19 nt, Pseudomonas aeruginosa PA01
gccguuguagcugaccacg

SEQ ID NO: 1493167 - RNA, 22 nt, Pseudomonas aeruginosa PA01
gccguucucauugcgccgccgg

SEQ ID NO: 1493168 - RNA, 20 nt, Pseudomonas aeruginosa PA01
gccguucuccgggucgggcu

SEQ ID NO: 1493169 - RNA, 19 nt, Pseudomonas aeruginosa PA01
gccguuccuccucgccgcc

SEQ ID NO: 1493170 - RNA, 23 nt, Pseudomonas aeruginosa PA01
gccguuccuccucgccgccgacc

SEQ ID NO: 1493171 - RNA, 15 nt, Pseudomonas aeruginosa PA01
gccguucgcccgcgg

SEQ ID NO: 1493172 - RNA, 15 nt, Pseudomonas aeruginosa PA01
gccgugugccugagc

SEQ ID NO: 1493173 - RNA, 19 nt, Pseudomonas aeruginosa PA01
gccguguugaugccgauca

SEQ ID NO: 1493174 - RNA, 19 nt, Pseudomonas aeruginosa PA01
gccguucacgccuggcggc

SEQ ID NO: 1493175 - RNA, 22 nt, Pseudomonas aeruginosa PA01
gccguucacgccuggcggcugg

SEQ ID NO: 1493176 - RNA, 23 nt, Pseudomonas aeruginosa PA01
gccguucacgccuggcggcuggc

SEQ ID NO: 1493177 - RNA, 17 nt, Pseudomonas aeruginosa PA01
gccguucacguugaccu

SEQ ID NO: 1493178 - RNA, 19 nt, Pseudomonas aeruginosa PA01
gccguuaccuuggccacga

SEQ ID NO: 1493179 - RNA, 23 nt, Pseudomonas aeruginosa PA01
gccguuacgacaucgacgcccuc

SEQ ID NO: 1493180 - RNA, 13 nt, Pseudomonas aeruginosa PA01
gccguggcgcccc

SEQ ID NO: 1493181 - RNA, 17 nt, Pseudomonas aeruginosa PA01
gccguggcgccccaggc

SEQ ID NO: 1493182 - RNA, 18 nt, Pseudomonas aeruginosa PA01
gccguggcgccccaggcg

SEQ ID NO: 1493183 - RNA, 13 nt, Pseudomonas aeruginosa PA01
gccguggcgcgaa

SEQ ID NO: 1493184 - RNA, 14 nt, Pseudomonas aeruginosa PA01
gccguggcggcgcg

SEQ ID NO: 1493185 - RNA, 15 nt, Pseudomonas aeruginosa PA01
gccguggcggcgcgc

SEQ ID NO: 1493186 - RNA, 20 nt, Pseudomonas aeruginosa PA01
gccguggcgguacuccgggu

SEQ ID NO: 1493187 - RNA, 17 nt, Pseudomonas aeruginosa PA01
gccgugcaucaccggca

SEQ ID NO: 1493188 - RNA, 19 nt, Pseudomonas aeruginosa PA01
gccgugccagagcuugagg

SEQ ID NO: 1493189 - RNA, 14 nt, Pseudomonas aeruginosa PA01
gccgugcaugccga

SEQ ID NO: 1493190 - RNA, 15 nt, Pseudomonas aeruginosa PA01
gccgugcaugccgac

SEQ ID NO: 1493191 - RNA, 16 nt, Pseudomonas aeruginosa PA01
gccgugcaugccgacg

SEQ ID NO: 1493192 - RNA, 20 nt, Pseudomonas aeruginosa PA01
gccgugcaugccgacgagca

SEQ ID NO: 1493193 - RNA, 19 nt, Pseudomonas aeruginosa PA01
gccgucggccugcuugcag

SEQ ID NO: 1493194 - RNA, 13 nt, Pseudomonas aeruginosa PA01
gccgucggcgauc

SEQ ID NO: 1493195 - RNA, 17 nt, Pseudomonas aeruginosa PA01
gccgucggcgaucgcca

SEQ ID NO: 1493196 - RNA, 13 nt, Pseudomonas aeruginosa PA01
gccgucggccugg

SEQ ID NO: 1493197 - RNA, 12 nt, Pseudomonas aeruginosa PA01
gccgucggcgau

SEQ ID NO: 1493198 - RNA, 16 nt, Pseudomonas aeruginosa PA01
gccgucuccaggcgcg

SEQ ID NO: 1493199 - RNA, 18 nt, Pseudomonas aeruginosa PA01
gccgucuccaggcgcgcc

SEQ ID NO: 1493200 - RNA, 20 nt, Pseudomonas aeruginosa PA01
gccgucuccaggcgcgccgu

SEQ ID NO: 1493201 - RNA, 21 nt, Pseudomonas aeruginosa PA01
gccgucuccaggcgcgccgug

SEQ ID NO: 1493202 - RNA, 23 nt, Pseudomonas aeruginosa PA01
gccgucuccaggcgcgccgugcg

SEQ ID NO: 1493203 - RNA, 20 nt, Pseudomonas aeruginosa PA01
gccgugaggcgcgcgccgaa

SEQ ID NO: 1493204 - RNA, 14 nt, Pseudomonas aeruginosa PA01
gccgucgccggcga

SEQ ID NO: 1493205 - RNA, 13 nt, Pseudomonas aeruginosa PA01
gccgucgcgccgc

SEQ ID NO: 1493206 - RNA, 16 nt, Pseudomonas aeruginosa PA01
gccgucgcgccgcgga

SEQ ID NO: 1493207 - RNA, 17 nt, Pseudomonas aeruginosa PA01
gccgucggacucgacgu

SEQ ID NO: 1493208 - RNA, 14 nt, Pseudomonas aeruginosa PA01
gccgucgcuggcga

SEQ ID NO: 1493209 - RNA, 17 nt, Pseudomonas aeruginosa PA01
gccgucgcuggcuuccu

SEQ ID NO: 1493210 - RNA, 14 nt, Pseudomonas aeruginosa PA01
gccgucgcugccga

SEQ ID NO: 1493211 - RNA, 15 nt, Pseudomonas aeruginosa PA01
gccgucgcugccgag

SEQ ID NO: 1493212 - RNA, 16 nt, Pseudomonas aeruginosa PA01
gccgucgcugccgagc

SEQ ID NO: 1493213 - RNA, 19 nt, Pseudomonas aeruginosa PA01
gccgucgacuugccgauca

SEQ ID NO: 1493214 - RNA, 14 nt, Pseudomonas aeruginosa PA01
gccgucgagcacca

SEQ ID NO: 1493215 - RNA, 14 nt, Pseudomonas aeruginosa PA01
gccgucgagggcaa

SEQ ID NO: 1493216 - RNA, 18 nt, Pseudomonas aeruginosa PA01
gccgucgagggcaaaggc

SEQ ID NO: 1493217 - RNA, 18 nt, Pseudomonas aeruginosa PA01
gccgucgaggucggcgau

SEQ ID NO: 1493218 - RNA, 19 nt, Pseudomonas aeruginosa PA01
gccgucgaggucggcgauc

SEQ ID NO: 1493219 - RNA, 15 nt, Pseudomonas aeruginosa PA01
gccgucacggccucc

SEQ ID NO: 1493220 - RNA, 22 nt, Pseudomonas aeruginosa PA01
gccgucaccgcguucugcggac

SEQ ID NO: 1493221 - RNA, 23 nt, Pseudomonas aeruginosa PA01
gccucuaugaaccggggcggccg

SEQ ID NO: 1493222 - RNA, 17 nt, Pseudomonas aeruginosa PA01
gccucugaccgcgcccg

SEQ ID NO: 1493223 - RNA, 16 nt, Pseudomonas aeruginosa PA01
gccucugagacgcgaa

SEQ ID NO: 1493224 - RNA, 18 nt, Pseudomonas aeruginosa PA01
gccucugccucgacgcuc

SEQ ID NO: 1493225 - RNA, 12 nt, Pseudomonas aeruginosa PA01
gccucugcgcug

SEQ ID NO: 1493226 - RNA, 12 nt, Pseudomonas aeruginosa PA01
gccucuuccugg

SEQ ID NO: 1493227 - RNA, 15 nt, Pseudomonas aeruginosa PA01
gccucuuccuggacc

SEQ ID NO: 1493228 - RNA, 17 nt, Pseudomonas aeruginosa PA01
gccucuuccuggaccuc

SEQ ID NO: 1493229 - RNA, 14 nt, Pseudomonas aeruginosa PA01
gccucuucgucggc

SEQ ID NO: 1493230 - RNA, 16 nt, Pseudomonas aeruginosa PA01
gccucuucgucggcga

SEQ ID NO: 1493231 - RNA, 19 nt, Pseudomonas aeruginosa PA01
gccucuugaaaacugucgg

SEQ ID NO: 1493232 - RNA, 20 nt, Pseudomonas aeruginosa PA01
gccucuugaaaacugucggc

SEQ ID NO: 1493233 - RNA, 22 nt, Pseudomonas aeruginosa PA01
gccugaaacugcggaugucacg

SEQ ID NO: 1493234 - RNA, 13 nt, Pseudomonas aeruginosa PA01
gccugaaggcggg

SEQ ID NO: 1493235 - RNA, 15 nt, Pseudomonas aeruginosa PA01
gccugcaccagccag

SEQ ID NO: 1493236 - RNA, 23 nt, Pseudomonas aeruginosa PA01
gccugcaccagccaguccggcag

SEQ ID NO: 1493237 - RNA, 19 nt, Pseudomonas aeruginosa PA01
gccugcaccacgcaggcgc

SEQ ID NO: 1493238 - RNA, 22 nt, Pseudomonas aeruginosa PA01
gccugcaccacgcaggcgcguu

SEQ ID NO: 1493239 - RNA, 18 nt, Pseudomonas aeruginosa PA01
gccugaucaucugggcca

SEQ ID NO: 1493240 - RNA, 19 nt, Pseudomonas aeruginosa PA01
gccugaucaucugggccau

SEQ ID NO: 1493241 - RNA, 19 nt, Pseudomonas aeruginosa PA01
gccucgcaaaggucggcga

SEQ ID NO: 1493242 - RNA, 14 nt, Pseudomonas aeruginosa PA01
gccucgauggcggc

SEQ ID NO: 1493243 - RNA, 19 nt, Pseudomonas aeruginosa PA01
gccucgaucuucuuccccg

SEQ ID NO: 1493244 - RNA, 21 nt, Pseudomonas aeruginosa PA01
gccucgaucuucuuccccgcc

SEQ ID NO: 1493245 - RNA, 14 nt, Pseudomonas aeruginosa PA01
gccucgaugauggu

SEQ ID NO: 1493246 - RNA, 11 nt, Pseudomonas aeruginosa PA01
gccucgauggc

SEQ ID NO: 1493247 - RNA, 15 nt, Pseudomonas aeruginosa PA01
gccucgccccagacc

SEQ ID NO: 1493248 - RNA, 24 nt, Pseudomonas aeruginosa PA01
gccucgccccagacccaggugcgc

SEQ ID NO: 1493249 - RNA, 20 nt, Pseudomonas aeruginosa PA01
gccucgcagagcgccagcca

SEQ ID NO: 1493250 - RNA, 19 nt, Pseudomonas aeruginosa PA01
gccucgggcgagcgcagac

SEQ ID NO: 1493251 - RNA, 24 nt, Pseudomonas aeruginosa PA01
gccucgggcgggaucuccgcgcca

SEQ ID NO: 1493252 - RNA, 13 nt, Pseudomonas aeruginosa PA01
gccucgccgagca

SEQ ID NO: 1493253 - RNA, 18 nt, Pseudomonas aeruginosa PA01
gccucgccgagcauccag

SEQ ID NO: 1493254 - RNA, 12 nt, Pseudomonas aeruginosa PA01
gccucgccgagg

SEQ ID NO: 1493255 - RNA, 15 nt, Pseudomonas aeruginosa PA01
gccucgccgaugucg

SEQ ID NO: 1493256 - RNA, 15 nt, Pseudomonas aeruginosa PA01
gccucggggccgucc

SEQ ID NO: 1493257 - RNA, 13 nt, Pseudomonas aeruginosa PA01
gccucggucaggu

SEQ ID NO: 1493258 - RNA, 22 nt, Pseudomonas aeruginosa PA01
gccucggucagguauucgccgg

SEQ ID NO: 1493259 - RNA, 19 nt, Pseudomonas aeruginosa PA01
gccucgucgacgcccuggc

SEQ ID NO: 1493260 - RNA, 19 nt, Pseudomonas aeruginosa PA01
gccucgucgaucucgccga

SEQ ID NO: 1493261 - RNA, 16 nt, Pseudomonas aeruginosa PA01
gccucgucgaaacgga

SEQ ID NO: 1493262 - RNA, 18 nt, Pseudomonas aeruginosa PA01
gccucgguuuccggccag

SEQ ID NO: 1493263 - RNA, 20 nt, Pseudomonas aeruginosa PA01
gccucgguuuccggccaggc

SEQ ID NO: 1493264 - RNA, 16 nt, Pseudomonas aeruginosa PA01
gccucguaggcggcgc

SEQ ID NO: 1493265 - RNA, 14 nt, Pseudomonas aeruginosa PA01
gccucggucaggcg

SEQ ID NO: 1493266 - RNA, 16 nt, Pseudomonas aeruginosa PA01
gccucggucaggcgcu

SEQ ID NO: 1493267 - RNA, 15 nt, Pseudomonas aeruginosa PA01
gccucgucgccaugc

SEQ ID NO: 1493268 - RNA, 14 nt, Pseudomonas aeruginosa PA01
gccucgucgcgcca

SEQ ID NO: 1493269 - RNA, 17 nt, Pseudomonas aeruginosa PA01
gccucgucgcgccaggc

SEQ ID NO: 1493270 - RNA, 18 nt, Pseudomonas aeruginosa PA01
gccucgucgcgccaggcg

SEQ ID NO: 1493271 - RNA, 19 nt, Pseudomonas aeruginosa PA01
gccucgucgcgccaggcga

SEQ ID NO: 1493272 - RNA, 18 nt, Pseudomonas aeruginosa PA01
gccucgucguucagccca

SEQ ID NO: 1493273 - RNA, 19 nt, Pseudomonas aeruginosa PA01
gccucgugcagcaagccgc

SEQ ID NO: 1493274 - RNA, 14 nt, Pseudomonas aeruginosa PA01
gccucguucagcag

SEQ ID NO: 1493275 - RNA, 15 nt, Pseudomonas aeruginosa PA01
gccucguucagcagc

SEQ ID NO: 1493276 - RNA, 16 nt, Pseudomonas aeruginosa PA01
gccucguggaacagcg

SEQ ID NO: 1493277 - RNA, 20 nt, Pseudomonas aeruginosa PA01
gccucguggaacagcgcguc

SEQ ID NO: 1493278 - RNA, 19 nt, Pseudomonas aeruginosa PA01
gccucguucgucgccgacu

SEQ ID NO: 1493279 - RNA, 16 nt, Pseudomonas aeruginosa PA01
gccuccucggcggccu

SEQ ID NO: 1493280 - RNA, 19 nt, Pseudomonas aeruginosa PA01
gccuccucuaccaggcggu

SEQ ID NO: 1493281 - RNA, 18 nt, Pseudomonas aeruginosa PA01
gccucgaaggucagcccg

SEQ ID NO: 1493282 - RNA, 13 nt, Pseudomonas aeruginosa PA01
gccuccuggcggc

SEQ ID NO: 1493283 - RNA, 19 nt, Pseudomonas aeruginosa PA01
gccucgaucucguccucgg

SEQ ID NO: 1493284 - RNA, 20 nt, Pseudomonas aeruginosa PA01
gccucgaagaaaaggcccgg

SEQ ID NO: 1493285 - RNA, 22 nt, Pseudomonas aeruginosa PA01
gccucgaagaaaaggcccggcg

SEQ ID NO: 1493286 - RNA, 21 nt, Pseudomonas aeruginosa PA01
gccucgaagaacuccaucucg

SEQ ID NO: 1493287 - RNA, 14 nt, Pseudomonas aeruginosa PA01
gccucgaacauggc

SEQ ID NO: 1493288 - RNA, 19 nt, Pseudomonas aeruginosa PA01
gccuccgcucugcuggcca

SEQ ID NO: 1493289 - RNA, 17 nt, Pseudomonas aeruginosa PA01
gccucccagccgugggc

SEQ ID NO: 1493290 - RNA, 22 nt, Pseudomonas aeruginosa PA01
gccuccaggaauccuccgccag

SEQ ID NO: 1493291 - RNA, 15 nt, Pseudomonas aeruginosa PA01
gccuccagcgggccu

SEQ ID NO: 1493292 - RNA, 21 nt, Pseudomonas aeruginosa PA01
gccuccagcgggccuucgcca

SEQ ID NO: 1493293 - RNA, 21 nt, Pseudomonas aeruginosa PA01
gccuccagcgucugccgcugg

SEQ ID NO: 1493294 - RNA, 22 nt, Pseudomonas aeruginosa PA01
gccucccgccaaauggcucgcu

SEQ ID NO: 1493295 - RNA, 14 nt, Pseudomonas aeruginosa PA01
gccucccgccgcgg

SEQ ID NO: 1493296 - RNA, 23 nt, Pseudomonas aeruginosa PA01
gccuccgccgcgccucgucgcgc

SEQ ID NO: 1493297 - RNA, 13 nt, Pseudomonas aeruginosa PA01
gccuccacccgcg

SEQ ID NO: 1493298 - RNA, 14 nt, Pseudomonas aeruginosa PA01
gccuccacggcggc

SEQ ID NO: 1493299 - RNA, 15 nt, Pseudomonas aeruginosa PA01
gccuccaccagcgcc

SEQ ID NO: 1493300 - RNA, 16 nt, Pseudomonas aeruginosa PA01
gccuccaccagcgccg

SEQ ID NO: 1493301 - RNA, 20 nt, Pseudomonas aeruginosa PA01
gccuccaccagcgccggcgg

SEQ ID NO: 1493302 - RNA, 13 nt, Pseudomonas aeruginosa PA01
gccuccagcagcu

SEQ ID NO: 1493303 - RNA, 21 nt, Pseudomonas aeruginosa PA01
gccucaggcgcugcgcggccu

SEQ ID NO: 1493304 - RNA, 23 nt, Pseudomonas aeruginosa PA01
gccucagcgaaacucgugcucca

SEQ ID NO: 1493305 - RNA, 23 nt, Pseudomonas aeruginosa PA01
gccucagcggaacuugcgccgac

SEQ ID NO: 1493306 - RNA, 13 nt, Pseudomonas aeruginosa PA01
gccucaggccggg

SEQ ID NO: 1493307 - RNA, 16 nt, Pseudomonas aeruginosa PA01
gccucaggccuggcgc

SEQ ID NO: 1493308 - RNA, 15 nt, Pseudomonas aeruginosa PA01
gccucagcggccuuc

SEQ ID NO: 1493309 - RNA, 14 nt, Pseudomonas aeruginosa PA01
gccucagcggcugg

SEQ ID NO: 1493310 - RNA, 17 nt, Pseudomonas aeruginosa PA01
gccucaaggcaucgcga

SEQ ID NO: 1493311 - RNA, 16 nt, Pseudomonas aeruginosa PA01
gccucaacgaccgccc

SEQ ID NO: 1493312 - RNA, 17 nt, Pseudomonas aeruginosa PA01
gccucaacgaccgccca

SEQ ID NO: 1493313 - RNA, 16 nt, Pseudomonas aeruginosa PA01
gccucagaacugcucg

SEQ ID NO: 1493314 - RNA, 22 nt, Pseudomonas aeruginosa PA01
gccucagagucgcaccgggagg

SEQ ID NO: 1493315 - RNA, 19 nt, Pseudomonas aeruginosa PA01
gccucacggucgcaggggc

SEQ ID NO: 1493316 - RNA, 15 nt, Pseudomonas aeruginosa PA01
gccucacccugcugg

SEQ ID NO: 1493317 - RNA, 19 nt, Pseudomonas aeruginosa PA01
gccucacccugcugggcgg

SEQ ID NO: 1493318 - RNA, 22 nt, Pseudomonas aeruginosa PA01
gccuauccacgacgucggcggc

SEQ ID NO: 1493319 - RNA, 18 nt, Pseudomonas aeruginosa PA01
gccuauccgugacgucgg

SEQ ID NO: 1493320 - RNA, 20 nt, Pseudomonas aeruginosa PA01
gccuauggcguuauucgccc

SEQ ID NO: 1493321 - RNA, 14 nt, Pseudomonas aeruginosa PA01
gccgggcuccagca

SEQ ID NO: 1493322 - RNA, 23 nt, Pseudomonas aeruginosa PA01
gccgggcuccagcaucaccuugc

SEQ ID NO: 1493323 - RNA, 21 nt, Pseudomonas aeruginosa PA01
gccgggcucacucccguccag

SEQ ID NO: 1493324 - RNA, 16 nt, Pseudomonas aeruginosa PA01
gccgggcucagcgcgc

SEQ ID NO: 1493325 - RNA, 22 nt, Pseudomonas aeruginosa PA01
gccgggcucagcgcgcguagcg

SEQ ID NO: 1493326 - RNA, 17 nt, Pseudomonas aeruginosa PA01
gccgggcuccgccgcga

SEQ ID NO: 1493327 - RNA, 19 nt, Pseudomonas aeruginosa PA01
gccgggcuccgccgcgagc

SEQ ID NO: 1493328 - RNA, 20 nt, Pseudomonas aeruginosa PA01
gccgggcuccgccgcgagcg

SEQ ID NO: 1493329 - RNA, 21 nt, Pseudomonas aeruginosa PA01
gccgggcggcgucgcggagaa

SEQ ID NO: 1493330 - RNA, 24 nt, Pseudomonas aeruginosa PA01
gccgggcguuuucguugccgcgcu

SEQ ID NO: 1493331 - RNA, 12 nt, Pseudomonas aeruginosa PA01
gccgggcggcgg

SEQ ID NO: 1493332 - RNA, 18 nt, Pseudomonas aeruginosa PA01
gccgggcggacgcugggc

SEQ ID NO: 1493333 - RNA, 21 nt, Pseudomonas aeruginosa PA01
gccgggcggaugaccugucca

SEQ ID NO: 1493334 - RNA, 14 nt, Pseudomonas aeruginosa PA01
gccgggcugccgaa

SEQ ID NO: 1493335 - RNA, 16 nt, Pseudomonas aeruginosa PA01
gccgggcugccgaaca

SEQ ID NO: 1493336 - RNA, 22 nt, Pseudomonas aeruginosa PA01
gccgggcugccgaacaggcguc

SEQ ID NO: 1493337 - RNA, 19 nt, Pseudomonas aeruginosa PA01
gccgggcuggccaccgcca

SEQ ID NO: 1493338 - RNA, 16 nt, Pseudomonas aeruginosa PA01
gccgggcuggccgucg

SEQ ID NO: 1493339 - RNA, 20 nt, Pseudomonas aeruginosa PA01
gccgggcuguagugcuccgg

SEQ ID NO: 1493340 - RNA, 16 nt, Pseudomonas aeruginosa PA01
gccgggcuuccuggcc

SEQ ID NO: 1493341 - RNA, 19 nt, Pseudomonas aeruginosa PA01
gccgggcuuccuggccggg

SEQ ID NO: 1493342 - RNA, 14 nt, Pseudomonas aeruginosa PA01
gccgggcuucggug

SEQ ID NO: 1493343 - RNA, 23 nt, Pseudomonas aeruginosa PA01
gccgggcuucgguguaucggcgg

SEQ ID NO: 1493344 - RNA, 15 nt, Pseudomonas aeruginosa PA01
gccggggaacagguu

SEQ ID NO: 1493345 - RNA, 19 nt, Pseudomonas aeruginosa PA01
gccggggaaccacaccugc

SEQ ID NO: 1493346 - RNA, 20 nt, Pseudomonas aeruginosa PA01
gccggggaaccacaccugca

SEQ ID NO: 1493347 - RNA, 22 nt, Pseudomonas aeruginosa PA01
gccgggcuuuuucauggcuggc

SEQ ID NO: 1493348 - RNA, 21 nt, Pseudomonas aeruginosa PA01
gccgggcuuuuucaugggcgc

SEQ ID NO: 1493349 - RNA, 20 nt, Pseudomonas aeruginosa PA01
gccgggcuuuuucucgucgc

SEQ ID NO: 1493350 - RNA, 21 nt, Pseudomonas aeruginosa PA01
gccgggcuuuuucucgucgcg

SEQ ID NO: 1493351 - RNA, 17 nt, Pseudomonas aeruginosa PA01
gccgggcucuucggagg

SEQ ID NO: 1493352 - RNA, 19 nt, Pseudomonas aeruginosa PA01
gccggggaagauguucgcc

SEQ ID NO: 1493353 - RNA, 22 nt, Pseudomonas aeruginosa PA01
gccggggaagauguucgccgcc

SEQ ID NO: 1493354 - RNA, 14 nt, Pseudomonas aeruginosa PA01
gccggggaucaggu

SEQ ID NO: 1493355 - RNA, 17 nt, Pseudomonas aeruginosa PA01
gccggggaucaggucgc

SEQ ID NO: 1493356 - RNA, 21 nt, Pseudomonas aeruginosa PA01
gccggggaucaggucgccgcu

SEQ ID NO: 1493357 - RNA, 12 nt, Pseudomonas aeruginosa PA01
gccggggaucgg

SEQ ID NO: 1493358 - RNA, 15 nt, Pseudomonas aeruginosa PA01
gccggggaucggcau

SEQ ID NO: 1493359 - RNA, 16 nt, Pseudomonas aeruginosa PA01
gccggggaucggcauc

SEQ ID NO: 1493360 - RNA, 13 nt, Pseudomonas aeruginosa PA01
gccgggccggcca

SEQ ID NO: 1493361 - RNA, 14 nt, Pseudomonas aeruginosa PA01
gccgggccggccag

SEQ ID NO: 1493362 - RNA, 14 nt, Pseudomonas aeruginosa PA01
gccgggcgcgcugg

SEQ ID NO: 1493363 - RNA, 17 nt, Pseudomonas aeruginosa PA01
gccgggcgcgcuggucg

SEQ ID NO: 1493364 - RNA, 15 nt, Pseudomonas aeruginosa PA01
gccgggcgcgcgccu

SEQ ID NO: 1493365 - RNA, 12 nt, Pseudomonas aeruginosa PA01
gccgggcgcgcu

SEQ ID NO: 1493366 - RNA, 18 nt, Pseudomonas aeruginosa PA01
gccgggcgagucgaucag

SEQ ID NO: 1493367 - RNA, 23 nt, Pseudomonas aeruginosa PA01
gccgggcgagucgaucaggucgc

SEQ ID NO: 1493368 - RNA, 12 nt, Pseudomonas aeruginosa PA01
gccgggcgcccg

SEQ ID NO: 1493369 - RNA, 15 nt, Pseudomonas aeruginosa PA01
gccgggcgcccggcc

SEQ ID NO: 1493370 - RNA, 15 nt, Pseudomonas aeruginosa PA01
gccgggcgcgaugcc

SEQ ID NO: 1493371 - RNA, 21 nt, Pseudomonas aeruginosa PA01
gccgggcgcgaugccgaugcc

SEQ ID NO: 1493372 - RNA, 13 nt, Pseudomonas aeruginosa PA01
gccgggccagcuc

SEQ ID NO: 1493373 - RNA, 15 nt, Pseudomonas aeruginosa PA01
gccgggccagcucca

SEQ ID NO: 1493374 - RNA, 18 nt, Pseudomonas aeruginosa PA01
gccgggccagcuccagca

SEQ ID NO: 1493375 - RNA, 18 nt, Pseudomonas aeruginosa PA01
gccgggcccugggccccg

SEQ ID NO: 1493376 - RNA, 19 nt, Pseudomonas aeruginosa PA01
gccgggcccugggccccgg

SEQ ID NO: 1493377 - RNA, 20 nt, Pseudomonas aeruginosa PA01
gccgggcccugggccccggc

SEQ ID NO: 1493378 - RNA, 12 nt, Pseudomonas aeruginosa PA01
gccgggccgagg

SEQ ID NO: 1493379 - RNA, 22 nt, Pseudomonas aeruginosa PA01
gccgggccgaucaccaccugga

SEQ ID NO: 1493380 - RNA, 19 nt, Pseudomonas aeruginosa PA01
gccgggccgaucuucgccg

SEQ ID NO: 1493381 - RNA, 22 nt, Pseudomonas aeruginosa PA01
gccgggccgaucuucgccgaca

SEQ ID NO: 1493382 - RNA, 14 nt, Pseudomonas aeruginosa PA01
gccgggccgaugcg

SEQ ID NO: 1493383 - RNA, 15 nt, Pseudomonas aeruginosa PA01
gccgggccgaugcgc

SEQ ID NO: 1493384 - RNA, 21 nt, Pseudomonas aeruginosa PA01
gccgggccgcagcgcagccga

SEQ ID NO: 1493385 - RNA, 14 nt, Pseudomonas aeruginosa PA01
gccgggcagugcgc

SEQ ID NO: 1493386 - RNA, 15 nt, Pseudomonas aeruginosa PA01
gccgggcagugcgcc

SEQ ID NO: 1493387 - RNA, 23 nt, Pseudomonas aeruginosa PA01
gccgggcagugcgcccucgaacg

SEQ ID NO: 1493388 - RNA, 16 nt, Pseudomonas aeruginosa PA01
gccgggcauucgcagc

SEQ ID NO: 1493389 - RNA, 14 nt, Pseudomonas aeruginosa PA01
gccgggaagccgcu

SEQ ID NO: 1493390 - RNA, 16 nt, Pseudomonas aeruginosa PA01
gccgggaagccgcucg

SEQ ID NO: 1493391 - RNA, 15 nt, Pseudomonas aeruginosa PA01
gccgggaagcgcagg

SEQ ID NO: 1493392 - RNA, 17 nt, Pseudomonas aeruginosa PA01
gccgggaaacagggcga

SEQ ID NO: 1493393 - RNA, 21 nt, Pseudomonas aeruginosa PA01
gccgggaaacagggcgacgcc

SEQ ID NO: 1493394 - RNA, 22 nt, Pseudomonas aeruginosa PA01
gccgggaaacagggcgacgccg

SEQ ID NO: 1493395 - RNA, 12 nt, Pseudomonas aeruginosa PA01
gccgggaaccag

SEQ ID NO: 1493396 - RNA, 16 nt, Pseudomonas aeruginosa PA01
gccgggaaccagcaug

SEQ ID NO: 1493397 - RNA, 17 nt, Pseudomonas aeruginosa PA01
gccggcuucuacgccuu

SEQ ID NO: 1493398 - RNA, 19 nt, Pseudomonas aeruginosa PA01
gccggcuucuacgccuugc

SEQ ID NO: 1493399 - RNA, 23 nt, Pseudomonas aeruginosa PA01
gccggcuucuacgccuugcggcg

SEQ ID NO: 1493400 - RNA, 13 nt, Pseudomonas aeruginosa PA01
gccggcuucagca

SEQ ID NO: 1493401 - RNA, 18 nt, Pseudomonas aeruginosa PA01
gccggcuuccaccagacg

SEQ ID NO: 1493402 - RNA, 20 nt, Pseudomonas aeruginosa PA01
gccggcuuccaccagacgca

SEQ ID NO: 1493403 - RNA, 21 nt, Pseudomonas aeruginosa PA01
gccggcugugcagggcagcgg

SEQ ID NO: 1493404 - RNA, 17 nt, Pseudomonas aeruginosa PA01
gccggcuuccucgcccu

SEQ ID NO: 1493405 - RNA, 16 nt, Pseudomonas aeruginosa PA01
gccgggagcggccgug

SEQ ID NO: 1493406 - RNA, 16 nt, Pseudomonas aeruginosa PA01
gccgggauacagcagc

SEQ ID NO: 1493407 - RNA, 14 nt, Pseudomonas aeruginosa PA01
gccgggaaucgcca

SEQ ID NO: 1493408 - RNA, 16 nt, Pseudomonas aeruginosa PA01
gccgggaaucgccagc

SEQ ID NO: 1493409 - RNA, 22 nt, Pseudomonas aeruginosa PA01
gccgggaccacgcucaggucgg

SEQ ID NO: 1493410 - RNA, 15 nt, Pseudomonas aeruginosa PA01
gccgggacccuggua

SEQ ID NO: 1493411 - RNA, 18 nt, Pseudomonas aeruginosa PA01
gccgggcagacuucgccg

SEQ ID NO: 1493412 - RNA, 24 nt, Pseudomonas aeruginosa PA01
gccgggcaccccgagcggcgcgaa

SEQ ID NO: 1493413 - RNA, 13 nt, Pseudomonas aeruginosa PA01
gccgggcagccgu

SEQ ID NO: 1493414 - RNA, 16 nt, Pseudomonas aeruginosa PA01
gccgggcaggccgagg

SEQ ID NO: 1493415 - RNA, 18 nt, Pseudomonas aeruginosa PA01
gccgggcaggccgaggcc

SEQ ID NO: 1493416 - RNA, 21 nt, Pseudomonas aeruginosa PA01
gccgggcaggccgaggccggc

SEQ ID NO: 1493417 - RNA, 18 nt, Pseudomonas aeruginosa PA01
gccggcguccaggaggga

SEQ ID NO: 1493418 - RNA, 13 nt, Pseudomonas aeruginosa PA01
gccggcguccgcc

SEQ ID NO: 1493419 - RNA, 14 nt, Pseudomonas aeruginosa PA01
gccggcguccgccg

SEQ ID NO: 1493420 - RNA, 15 nt, Pseudomonas aeruginosa PA01
gccggcguccuugcc

SEQ ID NO: 1493421 - RNA, 17 nt, Pseudomonas aeruginosa PA01
gccggcguccuugccga

SEQ ID NO: 1493422 - RNA, 20 nt, Pseudomonas aeruginosa PA01
gccggcguccuugccgagga

SEQ ID NO: 1493423 - RNA, 16 nt, Pseudomonas aeruginosa PA01
gccggcguucgacgcc

SEQ ID NO: 1493424 - RNA, 22 nt, Pseudomonas aeruginosa PA01
gccggcguucgacgccuugccc

SEQ ID NO: 1493425 - RNA, 19 nt, Pseudomonas aeruginosa PA01
gccggcguuggcgucgcug

SEQ ID NO: 1493426 - RNA, 21 nt, Pseudomonas aeruginosa PA01
gccggcucagaaauccaccuu

SEQ ID NO: 1493427 - RNA, 17 nt, Pseudomonas aeruginosa PA01
gccgcucugcuggccgc

SEQ ID NO: 1493428 - RNA, 20 nt, Pseudomonas aeruginosa PA01
gccgcucuggcugcuggcga

SEQ ID NO: 1493429 - RNA, 21 nt, Pseudomonas aeruginosa PA01
gccgcucuucugguaggccag

SEQ ID NO: 1493430 - RNA, 21 nt, Pseudomonas aeruginosa PA01
gccgcugacggucugccagcu

SEQ ID NO: 1493431 - RNA, 21 nt, Pseudomonas aeruginosa PA01
gccgcugaucaguaccggcag

SEQ ID NO: 1493432 - RNA, 19 nt, Pseudomonas aeruginosa PA01
gccgcugaugcgcuggucg

SEQ ID NO: 1493433 - RNA, 16 nt, Pseudomonas aeruginosa PA01
gccgcugagcagcagg

SEQ ID NO: 1493434 - RNA, 20 nt, Pseudomonas aeruginosa PA01
gccgcugaggcucgccgggu

SEQ ID NO: 1493435 - RNA, 14 nt, Pseudomonas aeruginosa PA01
gccgcugaccucgg

SEQ ID NO: 1493436 - RNA, 14 nt, Pseudomonas aeruginosa PA01
gccgcugcacgccu

SEQ ID NO: 1493437 - RNA, 15 nt, Pseudomonas aeruginosa PA01
gccgcugcacgccuu

SEQ ID NO: 1493438 - RNA, 21 nt, Pseudomonas aeruginosa PA01
gccgcugcacgccuuccgggu

SEQ ID NO: 1493439 - RNA, 12 nt, Pseudomonas aeruginosa PA01
gccgcugcaggc

SEQ ID NO: 1493440 - RNA, 13 nt, Pseudomonas aeruginosa PA01
gccgcugcaggcc

SEQ ID NO: 1493441 - RNA, 19 nt, Pseudomonas aeruginosa PA01
gccgguucguugaccgucc

SEQ ID NO: 1493442 - RNA, 19 nt, Pseudomonas aeruginosa PA01
gccgguucgcaggccaggc

SEQ ID NO: 1493443 - RNA, 21 nt, Pseudomonas aeruginosa PA01
gccgguucgcaggccaggcgc

SEQ ID NO: 1493444 - RNA, 14 nt, Pseudomonas aeruginosa PA01
gccgguugcggcgc

SEQ ID NO: 1493445 - RNA, 16 nt, Pseudomonas aeruginosa PA01
gccgguugcggcgccg

SEQ ID NO: 1493446 - RNA, 19 nt, Pseudomonas aeruginosa PA01
gccgguugcggcgccgguu

SEQ ID NO: 1493447 - RNA, 19 nt, Pseudomonas aeruginosa PA01
gccgguugcgucucagcgg

SEQ ID NO: 1493448 - RNA, 20 nt, Pseudomonas aeruginosa PA01
gccgguugcugcugcggggc

SEQ ID NO: 1493449 - RNA, 19 nt, Pseudomonas aeruginosa PA01
gccgguugcugcuggguga

SEQ ID NO: 1493450 - RNA, 17 nt, Pseudomonas aeruginosa PA01
gccgguugcugcuugcg

SEQ ID NO: 1493451 - RNA, 21 nt, Pseudomonas aeruginosa PA01
gccgguuuuuuauugccagcg

SEQ ID NO: 1493452 - RNA, 15 nt, Pseudomonas aeruginosa PA01
gccguaaccaacagc

SEQ ID NO: 1493453 - RNA, 18 nt, Pseudomonas aeruginosa PA01
gccguagcgcaguucgcc

SEQ ID NO: 1493454 - RNA, 22 nt, Pseudomonas aeruginosa PA01
gccguagcgcaguucgccgccg

SEQ ID NO: 1493455 - RNA, 18 nt, Pseudomonas aeruginosa PA01
gccguagccggugccgau

SEQ ID NO: 1493456 - RNA, 13 nt, Pseudomonas aeruginosa PA01
gccguagccgucg

SEQ ID NO: 1493457 - RNA, 14 nt, Pseudomonas aeruginosa PA01
gccguagccgucga

SEQ ID NO: 1493458 - RNA, 19 nt, Pseudomonas aeruginosa PA01
gccguagccgucgaacagc

SEQ ID NO: 1493459 - RNA, 20 nt, Pseudomonas aeruginosa PA01
gccguacagcccccgccggc

SEQ ID NO: 1493460 - RNA, 21 nt, Pseudomonas aeruginosa PA01
gccguacagcccccgccggcc

SEQ ID NO: 1493461 - RNA, 14 nt, Pseudomonas aeruginosa PA01
gccguacagcaggc

SEQ ID NO: 1493462 - RNA, 13 nt, Pseudomonas aeruginosa PA01
gccguacaggcca

SEQ ID NO: 1493463 - RNA, 15 nt, Pseudomonas aeruginosa PA01
gccguacaggucggc

SEQ ID NO: 1493464 - RNA, 17 nt, Pseudomonas aeruginosa PA01
gccguacaggucggcgc

SEQ ID NO: 1493465 - RNA, 19 nt, Pseudomonas aeruginosa PA01
gccguacaggucggcgccg

SEQ ID NO: 1493466 - RNA, 20 nt, Pseudomonas aeruginosa PA01
gccguacaggucggcgccgg

SEQ ID NO: 1493467 - RNA, 20 nt, Pseudomonas aeruginosa PA01
gccguaggugaccgcccagg

SEQ ID NO: 1493468 - RNA, 16 nt, Pseudomonas aeruginosa PA01
gccguaggcgauggcc

SEQ ID NO: 1493469 - RNA, 18 nt, Pseudomonas aeruginosa PA01
gccguaggcgauggccug

SEQ ID NO: 1493470 - RNA, 20 nt, Pseudomonas aeruginosa PA01
gccguagcgaugcgguuccu

SEQ ID NO: 1493471 - RNA, 23 nt, Pseudomonas aeruginosa PA01
gccguaggccacuucccggcgca

SEQ ID NO: 1493472 - RNA, 23 nt, Pseudomonas aeruginosa PA01
gccguagcgcuucaucaggcugc

SEQ ID NO: 1493473 - RNA, 20 nt, Pseudomonas aeruginosa PA01
gccguagcggccucguucgg

SEQ ID NO: 1493474 - RNA, 14 nt, Pseudomonas aeruginosa PA01
gccggucugcugcg

SEQ ID NO: 1493475 - RNA, 16 nt, Pseudomonas aeruginosa PA01
gccggucugcugcgcg

SEQ ID NO: 1493476 - RNA, 19 nt, Pseudomonas aeruginosa PA01
gccggucguucgcccuuca

SEQ ID NO: 1493477 - RNA, 12 nt, Pseudomonas aeruginosa PA01
gccggucgggca

SEQ ID NO: 1493478 - RNA, 17 nt, Pseudomonas aeruginosa PA01
gccggugccggcggcgg

SEQ ID NO: 1493479 - RNA, 21 nt, Pseudomonas aeruginosa PA01
gccggugccggcggcggacgc

SEQ ID NO: 1493480 - RNA, 13 nt, Pseudomonas aeruginosa PA01
gccggugccggcg

SEQ ID NO: 1493481 - RNA, 21 nt, Pseudomonas aeruginosa PA01
gccggugccgaucucguaggc

SEQ ID NO: 1493482 - RNA, 14 nt, Pseudomonas aeruginosa PA01
gccggugccgccgg

SEQ ID NO: 1493483 - RNA, 17 nt, Pseudomonas aeruginosa PA01
gccggugccgccggcca

SEQ ID NO: 1493484 - RNA, 19 nt, Pseudomonas aeruginosa PA01
gccggugccgccggccacc

SEQ ID NO: 1493485 - RNA, 15 nt, Pseudomonas aeruginosa PA01
gccggugugccguca

SEQ ID NO: 1493486 - RNA, 14 nt, Pseudomonas aeruginosa PA01
gccggugcgcgauc

SEQ ID NO: 1493487 - RNA, 21 nt, Pseudomonas aeruginosa PA01
gccggugccuucggcggcgcc

SEQ ID NO: 1493488 - RNA, 15 nt, Pseudomonas aeruginosa PA01
gccggugugacggcc

SEQ ID NO: 1493489 - RNA, 17 nt, Pseudomonas aeruginosa PA01
gccggugugacggccgg

SEQ ID NO: 1493490 - RNA, 13 nt, Pseudomonas aeruginosa PA01
gccgguucccgca

SEQ ID NO: 1493491 - RNA, 19 nt, Pseudomonas aeruginosa PA01
gccgguucccgcagcgauc

SEQ ID NO: 1493492 - RNA, 22 nt, Pseudomonas aeruginosa PA01
gccgguucccgcagcgaucagc

SEQ ID NO: 1493493 - RNA, 19 nt, Pseudomonas aeruginosa PA01
gccgguuccgaaucgccua

SEQ ID NO: 1493494 - RNA, 20 nt, Pseudomonas aeruginosa PA01
gccgguucaguucagccggu

SEQ ID NO: 1493495 - RNA, 21 nt, Pseudomonas aeruginosa PA01
gccgguuaucgaggcgucggc

SEQ ID NO: 1493496 - RNA, 22 nt, Pseudomonas aeruginosa PA01
gccgguuaucgaggcgucggcg

SEQ ID NO: 1493497 - RNA, 12 nt, Pseudomonas aeruginosa PA01
gccggucaggcu

SEQ ID NO: 1493498 - RNA, 13 nt, Pseudomonas aeruginosa PA01
gccggucaggcug

SEQ ID NO: 1493499 - RNA, 14 nt, Pseudomonas aeruginosa PA01
gccggucaggcugc

SEQ ID NO: 1493500 - RNA, 15 nt, Pseudomonas aeruginosa PA01
gccggucaggcugcg

SEQ ID NO: 1493501 - RNA, 20 nt, Pseudomonas aeruginosa PA01
gccggucaggcuggugccgc

SEQ ID NO: 1493502 - RNA, 13 nt, Pseudomonas aeruginosa PA01
gccggucaggcgc

SEQ ID NO: 1493503 - RNA, 14 nt, Pseudomonas aeruginosa PA01
gccggucaggcgcc

SEQ ID NO: 1493504 - RNA, 15 nt, Pseudomonas aeruginosa PA01
gccggucaggcgccc

SEQ ID NO: 1493505 - RNA, 20 nt, Pseudomonas aeruginosa PA01
gccggucgcgcucaggcgca

SEQ ID NO: 1493506 - RNA, 14 nt, Pseudomonas aeruginosa PA01
gccgguagcggcgc

SEQ ID NO: 1493507 - RNA, 15 nt, Pseudomonas aeruginosa PA01
gccgguagcggcgca

SEQ ID NO: 1493508 - RNA, 16 nt, Pseudomonas aeruginosa PA01
gccgguagcggcgcac

SEQ ID NO: 1493509 - RNA, 17 nt, Pseudomonas aeruginosa PA01
gccgguagcggcgcacc

SEQ ID NO: 1493510 - RNA, 19 nt, Pseudomonas aeruginosa PA01
gccgguagcuggccaugcg

SEQ ID NO: 1493511 - RNA, 18 nt, Pseudomonas aeruginosa PA01
gccgguacucgccgggcg

SEQ ID NO: 1493512 - RNA, 19 nt, Pseudomonas aeruginosa PA01
gccgguacucgccgggcgu

SEQ ID NO: 1493513 - RNA, 15 nt, Pseudomonas aeruginosa PA01
gccgguagccggcga

SEQ ID NO: 1493514 - RNA, 20 nt, Pseudomonas aeruginosa PA01
gccgguagccggcgaucagc

SEQ ID NO: 1493515 - RNA, 15 nt, Pseudomonas aeruginosa PA01
gccgguacgcaccag

SEQ ID NO: 1493516 - RNA, 17 nt, Pseudomonas aeruginosa PA01
gccgggucguacaccag

SEQ ID NO: 1493517 - RNA, 12 nt, Pseudomonas aeruginosa PA01
gccgggugccgg

SEQ ID NO: 1493518 - RNA, 14 nt, Pseudomonas aeruginosa PA01
gccgggugccggug

SEQ ID NO: 1493519 - RNA, 18 nt, Pseudomonas aeruginosa PA01
gccgguaauuggccaggc

SEQ ID NO: 1493520 - RNA, 19 nt, Pseudomonas aeruginosa PA01
gccgguaauuggccaggcu

SEQ ID NO: 1493521 - RNA, 19 nt, Pseudomonas aeruginosa PA01
gccgggugcuaugcgccgg

SEQ ID NO: 1493522 - RNA, 16 nt, Pseudomonas aeruginosa PA01
gccgggggucgcgggu

SEQ ID NO: 1493523 - RNA, 17 nt, Pseudomonas aeruginosa PA01
gccgggggucgcggguu

SEQ ID NO: 1493524 - RNA, 14 nt, Pseudomonas aeruginosa PA01
gccgggggcggcga

SEQ ID NO: 1493525 - RNA, 15 nt, Pseudomonas aeruginosa PA01
gccgggggcggcgaa

SEQ ID NO: 1493526 - RNA, 23 nt, Pseudomonas aeruginosa PA01
gccgggggcggcgaacggaccga

SEQ ID NO: 1493527 - RNA, 18 nt, Pseudomonas aeruginosa PA01
gccgggggcggcgccugg

SEQ ID NO: 1493528 - RNA, 20 nt, Pseudomonas aeruginosa PA01
gccggggcgugcaggccgcc

SEQ ID NO: 1493529 - RNA, 22 nt, Pseudomonas aeruginosa PA01
gccggggcgugcaggccgccga

SEQ ID NO: 1493530 - RNA, 14 nt, Pseudomonas aeruginosa PA01
gccggggcagcagg

SEQ ID NO: 1493531 - RNA, 16 nt, Pseudomonas aeruginosa PA01
gccggggccggcaccc

SEQ ID NO: 1493532 - RNA, 18 nt, Pseudomonas aeruginosa PA01
gccggggccuacugcugg

SEQ ID NO: 1493533 - RNA, 23 nt, Pseudomonas aeruginosa PA01
gccggggcggauucaggcgcgcu

SEQ ID NO: 1493534 - RNA, 21 nt, Pseudomonas aeruginosa PA01
gccggggcgcgcccgccaggu

SEQ ID NO: 1493535 - RNA, 12 nt, Pseudomonas aeruginosa PA01
gccgggucgaca

SEQ ID NO: 1493536 - RNA, 19 nt, Pseudomonas aeruginosa PA01
gccgggucgacaugcaggc

SEQ ID NO: 1493537 - RNA, 23 nt, Pseudomonas aeruginosa PA01
gccgggucgaugggccguaggug

SEQ ID NO: 1493538 - RNA, 16 nt, Pseudomonas aeruginosa PA01
gccgggucgcagccgg

SEQ ID NO: 1493539 - RNA, 22 nt, Pseudomonas aeruginosa PA01
gccgggucgacuucgcaccagc

SEQ ID NO: 1493540 - RNA, 19 nt, Pseudomonas aeruginosa PA01
gccgggguggaguaccagg

SEQ ID NO: 1493541 - RNA, 16 nt, Pseudomonas aeruginosa PA01
gccgggucagacugag

SEQ ID NO: 1493542 - RNA, 19 nt, Pseudomonas aeruginosa PA01
gccggguccaccgcggccu

SEQ ID NO: 1493543 - RNA, 15 nt, Pseudomonas aeruginosa PA01
gccggguacagcgcc

SEQ ID NO: 1493544 - RNA, 16 nt, Pseudomonas aeruginosa PA01
gccggguacagcgcca

SEQ ID NO: 1493545 - RNA, 21 nt, Pseudomonas aeruginosa PA01
gccggguacagcgccacggcc

SEQ ID NO: 1493546 - RNA, 22 nt, Pseudomonas aeruginosa PA01
gccggguacagcgccacggcca

SEQ ID NO: 1493547 - RNA, 23 nt, Pseudomonas aeruginosa PA01
gccggguagcguuaucgccgguc

SEQ ID NO: 1493548 - RNA, 19 nt, Pseudomonas aeruginosa PA01
gcgacgcccuguucggcgg

SEQ ID NO: 1493549 - RNA, 21 nt, Pseudomonas aeruginosa PA01
gcgacgcccuugcggcgcggc

SEQ ID NO: 1493550 - RNA, 12 nt, Pseudomonas aeruginosa PA01
gcgacgccgcga

SEQ ID NO: 1493551 - RNA, 13 nt, Pseudomonas aeruginosa PA01
gcgacgccgcgau

SEQ ID NO: 1493552 - RNA, 21 nt, Pseudomonas aeruginosa PA01
gcgacgaucacccccagcgag

SEQ ID NO: 1493553 - RNA, 13 nt, Pseudomonas aeruginosa PA01
gcgacgcccgagg

SEQ ID NO: 1493554 - RNA, 14 nt, Pseudomonas aeruginosa PA01
gcgacgccgcgcug

SEQ ID NO: 1493555 - RNA, 15 nt, Pseudomonas aeruginosa PA01
gcgacgccgcgcugc

SEQ ID NO: 1493556 - RNA, 13 nt, Pseudomonas aeruginosa PA01
gcgacgccgcgcu

SEQ ID NO: 1493557 - RNA, 19 nt, Pseudomonas aeruginosa PA01
gcgacgaggcgcggcggag

SEQ ID NO: 1493558 - RNA, 13 nt, Pseudomonas aeruginosa PA01
gcgacgaucagcc

SEQ ID NO: 1493559 - RNA, 14 nt, Pseudomonas aeruginosa PA01
gcgacgaucagccc

SEQ ID NO: 1493560 - RNA, 18 nt, Pseudomonas aeruginosa PA01
gcgacgaucagcccgccg

SEQ ID NO: 1493561 - RNA, 21 nt, Pseudomonas aeruginosa PA01
gcgacgaucagcccgccggcg

SEQ ID NO: 1493562 - RNA, 22 nt, Pseudomonas aeruginosa PA01
gcgacgaucagcccgccggcga

SEQ ID NO: 1493563 - RNA, 12 nt, Pseudomonas aeruginosa PA01
gcgacgagccgg

SEQ ID NO: 1493564 - RNA, 15 nt, Pseudomonas aeruginosa PA01
gcgacgacuugccca

SEQ ID NO: 1493565 - RNA, 18 nt, Pseudomonas aeruginosa PA01
gcgacgagaaaaagcccg

SEQ ID NO: 1493566 - RNA, 18 nt, Pseudomonas aeruginosa PA01
gcgacgacgaucccggcg

SEQ ID NO: 1493567 - RNA, 20 nt, Pseudomonas aeruginosa PA01
gcgacgacgggagcgcgagg

SEQ ID NO: 1493568 - RNA, 15 nt, Pseudomonas aeruginosa PA01
gcgacgacugcggca

SEQ ID NO: 1493569 - RNA, 16 nt, Pseudomonas aeruginosa PA01
gcgacgacugcggcag

SEQ ID NO: 1493570 - RNA, 17 nt, Pseudomonas aeruginosa PA01
gcgaccugguggcgccg

SEQ ID NO: 1493571 - RNA, 18 nt, Pseudomonas aeruginosa PA01
gcgaccugguggcgccgg

SEQ ID NO: 1493572 - RNA, 19 nt, Pseudomonas aeruginosa PA01
gcgaccugguggcgccggc

SEQ ID NO: 1493573 - RNA, 20 nt, Pseudomonas aeruginosa PA01
gcgaccugguggcgccggcu

SEQ ID NO: 1493574 - RNA, 16 nt, Pseudomonas aeruginosa PA01
gcgaccugggcgucgc

SEQ ID NO: 1493575 - RNA, 16 nt, Pseudomonas aeruginosa PA01
gcgaccgucggccggg

SEQ ID NO: 1493576 - RNA, 15 nt, Pseudomonas aeruginosa PA01
gcgaccgguuccgcg

SEQ ID NO: 1493577 - RNA, 21 nt, Pseudomonas aeruginosa PA01
gcgaccgguuccgcgucgccu

SEQ ID NO: 1493578 - RNA, 20 nt, Pseudomonas aeruginosa PA01
gcgaccgucgaaccagggac

SEQ ID NO: 1493579 - RNA, 13 nt, Pseudomonas aeruginosa PA01
gcgaccugcucgc

SEQ ID NO: 1493580 - RNA, 14 nt, Pseudomonas aeruginosa PA01
gcgaccugcucgcg

SEQ ID NO: 1493581 - RNA, 14 nt, Pseudomonas aeruginosa PA01
gcgaccuggcgccg

SEQ ID NO: 1493582 - RNA, 15 nt, Pseudomonas aeruginosa PA01
gcgaccuggcgccga

SEQ ID NO: 1493583 - RNA, 14 nt, Pseudomonas aeruginosa PA01
gcgacgacgaacgc

SEQ ID NO: 1493584 - RNA, 15 nt, Pseudomonas aeruginosa PA01
gcgacgacgaacgcc

SEQ ID NO: 1493585 - RNA, 18 nt, Pseudomonas aeruginosa PA01
gcgaccuugcgcaccagg

SEQ ID NO: 1493586 - RNA, 21 nt, Pseudomonas aeruginosa PA01
gcgaccuugacgaagccggcg

SEQ ID NO: 1493587 - RNA, 22 nt, Pseudomonas aeruginosa PA01
gcgaccuugacgaagccggcga

SEQ ID NO: 1493588 - RNA, 13 nt, Pseudomonas aeruginosa PA01
gcgaccuguucga

SEQ ID NO: 1493589 - RNA, 15 nt, Pseudomonas aeruginosa PA01
gcgacgaaacggcuc

SEQ ID NO: 1493590 - RNA, 19 nt, Pseudomonas aeruginosa PA01
gcgaccuuguccaggcgcu

SEQ ID NO: 1493591 - RNA, 22 nt, Pseudomonas aeruginosa PA01
gcgaccuuguccugcggccggg

SEQ ID NO: 1493592 - RNA, 18 nt, Pseudomonas aeruginosa PA01
gcgaccuugucgaugguc

SEQ ID NO: 1493593 - RNA, 17 nt, Pseudomonas aeruginosa PA01
aagcccucgcgacggca

SEQ ID NO: 1493594 - RNA, 14 nt, Pseudomonas aeruginosa PA01
aagcccgugucgcc

SEQ ID NO: 1493595 - RNA, 22 nt, Pseudomonas aeruginosa PA01
gcgaccagcucgaagccgccgu

SEQ ID NO: 1493596 - RNA, 19 nt, Pseudomonas aeruginosa PA01
gcgaccagguccggagggc

SEQ ID NO: 1493597 - RNA, 15 nt, Pseudomonas aeruginosa PA01
gcgaccaggacagca

SEQ ID NO: 1493598 - RNA, 18 nt, Pseudomonas aeruginosa PA01
gcgacccgccguucgccc

SEQ ID NO: 1493599 - RNA, 16 nt, Pseudomonas aeruginosa PA01
gcgaccauccagccug

SEQ ID NO: 1493600 - RNA, 20 nt, Pseudomonas aeruginosa PA01
gcgaccauccagccugcgcu

SEQ ID NO: 1493601 - RNA, 14 nt, Pseudomonas aeruginosa PA01
gcgacccgggucag

SEQ ID NO: 1493602 - RNA, 16 nt, Pseudomonas aeruginosa PA01
gcgacccgggucaggc

SEQ ID NO: 1493603 - RNA, 19 nt, Pseudomonas aeruginosa PA01
gcgacccgggucaggccga

SEQ ID NO: 1493604 - RNA, 21 nt, Pseudomonas aeruginosa PA01
gcgacccgggucaggccgaga

SEQ ID NO: 1493605 - RNA, 17 nt, Pseudomonas aeruginosa PA01
gcgaccgaacagcgcgc

SEQ ID NO: 1493606 - RNA, 14 nt, Pseudomonas aeruginosa PA01
gcgaccgaagccgc

SEQ ID NO: 1493607 - RNA, 15 nt, Pseudomonas aeruginosa PA01
gcgaccgaagccgcg

SEQ ID NO: 1493608 - RNA, 19 nt, Pseudomonas aeruginosa PA01
gcgaccgaagccgcgcagc

SEQ ID NO: 1493609 - RNA, 18 nt, Pseudomonas aeruginosa PA01
gcgacccucagucgcccc

SEQ ID NO: 1493610 - RNA, 13 nt, Pseudomonas aeruginosa PA01
gcgacccuggccg

SEQ ID NO: 1493611 - RNA, 17 nt, Pseudomonas aeruginosa PA01
gcgacccuggccgcgcg

SEQ ID NO: 1493612 - RNA, 18 nt, Pseudomonas aeruginosa PA01
gcgacccuggccgcgcgg

SEQ ID NO: 1493613 - RNA, 23 nt, Pseudomonas aeruginosa PA01
gcgacccuggccgcgcggcuugc

SEQ ID NO: 1493614 - RNA, 18 nt, Pseudomonas aeruginosa PA01
gcgacccuggggucgccg

SEQ ID NO: 1493615 - RNA, 14 nt, Pseudomonas aeruginosa PA01
gcgacccuucaacg

SEQ ID NO: 1493616 - RNA, 17 nt, Pseudomonas aeruginosa PA01
gcgacccuucaacggcg

SEQ ID NO: 1493617 - RNA, 20 nt, Pseudomonas aeruginosa PA01
gcgacccuucaacggcgacc

SEQ ID NO: 1493618 - RNA, 22 nt, Pseudomonas aeruginosa PA01
gcgacccuucaacggcgaccgc

SEQ ID NO: 1493619 - RNA, 13 nt, Pseudomonas aeruginosa PA01
gcgaccggauggc

SEQ ID NO: 1493620 - RNA, 13 nt, Pseudomonas aeruginosa PA01
gcgaccgcuggac

SEQ ID NO: 1493621 - RNA, 14 nt, Pseudomonas aeruginosa PA01
gcgaccgcggcgcu

SEQ ID NO: 1493622 - RNA, 16 nt, Pseudomonas aeruginosa PA01
gcgaccgggcaugccg

SEQ ID NO: 1493623 - RNA, 18 nt, Pseudomonas aeruginosa PA01
gcgaccgggcaugccgug

SEQ ID NO: 1493624 - RNA, 22 nt, Pseudomonas aeruginosa PA01
gcgaaucgucgaugaggucgca

SEQ ID NO: 1493625 - RNA, 15 nt, Pseudomonas aeruginosa PA01
gcgaaucgucgccgg

SEQ ID NO: 1493626 - RNA, 16 nt, Pseudomonas aeruginosa PA01
gcgaaucgucgccgga

SEQ ID NO: 1493627 - RNA, 20 nt, Pseudomonas aeruginosa PA01
gcgaaucuucggcgcgccgg

SEQ ID NO: 1493628 - RNA, 19 nt, Pseudomonas aeruginosa PA01
gcgaauccuguccguccga

SEQ ID NO: 1493629 - RNA, 15 nt, Pseudomonas aeruginosa PA01
gcgaauccgcggccc

SEQ ID NO: 1493630 - RNA, 24 nt, Pseudomonas aeruginosa PA01
gcgaauccgcggcccugcucgccg

SEQ ID NO: 1493631 - RNA, 19 nt, Pseudomonas aeruginosa PA01
gcgaauggacaggcgcccc

SEQ ID NO: 1493632 - RNA, 17 nt, Pseudomonas aeruginosa PA01
gcgaauggagggaucgc

SEQ ID NO: 1493633 - RNA, 21 nt, Pseudomonas aeruginosa PA01
gcgaauggagggaucgcgcgg

SEQ ID NO: 1493634 - RNA, 17 nt, Pseudomonas aeruginosa PA01
gcgaaugcccggcagcg

SEQ ID NO: 1493635 - RNA, 23 nt, Pseudomonas aeruginosa PA01
gcgaaugcccggcagcgccgggc

SEQ ID NO: 1493636 - RNA, 14 nt, Pseudomonas aeruginosa PA01
gcgaaugccgggcu

SEQ ID NO: 1493637 - RNA, 14 nt, Pseudomonas aeruginosa PA01
gcgaaugccuucga

SEQ ID NO: 1493638 - RNA, 14 nt, Pseudomonas aeruginosa PA01
gcgacaacccuguc

SEQ ID NO: 1493639 - RNA, 16 nt, Pseudomonas aeruginosa PA01
gcgacaacccuguccc

SEQ ID NO: 1493640 - RNA, 13 nt, Pseudomonas aeruginosa PA01
gcgacaacggccg

SEQ ID NO: 1493641 - RNA, 15 nt, Pseudomonas aeruginosa PA01
gcgacaacggccguc

SEQ ID NO: 1493642 - RNA, 21 nt, Pseudomonas aeruginosa PA01
gcgacaaggcugaggccgacg

SEQ ID NO: 1493643 - RNA, 22 nt, Pseudomonas aeruginosa PA01
gcgacaaggcugaggccgacga

SEQ ID NO: 1493644 - RNA, 19 nt, Pseudomonas aeruginosa PA01
gcgaauuuccugcuggcga

SEQ ID NO: 1493645 - RNA, 22 nt, Pseudomonas aeruginosa PA01
gcgaauuuccugcuggcgagcg

SEQ ID NO: 1493646 - RNA, 19 nt, Pseudomonas aeruginosa PA01
gcgaauucgucgccgccga

SEQ ID NO: 1493647 - RNA, 22 nt, Pseudomonas aeruginosa PA01
gcgaauucgucgccgccgaggc

SEQ ID NO: 1493648 - RNA, 18 nt, Pseudomonas aeruginosa PA01
aagccccggcaucgccgg

SEQ ID NO: 1493649 - RNA, 14 nt, Pseudomonas aeruginosa PA01
aagccccgcgaacg

SEQ ID NO: 1493650 - RNA, 21 nt, Pseudomonas aeruginosa PA01
aagcccggcaauagccgggcu

SEQ ID NO: 1493651 - RNA, 18 nt, Pseudomonas aeruginosa PA01
aagcccggcauucgccgg

SEQ ID NO: 1493652 - RNA, 21 nt, Pseudomonas aeruginosa PA01
aagcccggcauucgccgggcu

SEQ ID NO: 1493653 - RNA, 15 nt, Pseudomonas aeruginosa PA01
aagcccggccgcugc

SEQ ID NO: 1493654 - RNA, 14 nt, Pseudomonas aeruginosa PA01
aagcccggcgaaug

SEQ ID NO: 1493655 - RNA, 21 nt, Pseudomonas aeruginosa PA01
aagcccggcgagagcguccgg

SEQ ID NO: 1493656 - RNA, 20 nt, Pseudomonas aeruginosa PA01
gcgacaugccgguucccgca

SEQ ID NO: 1493657 - RNA, 22 nt, Pseudomonas aeruginosa PA01
gcgacaugccgguucccgcagc

SEQ ID NO: 1493658 - RNA, 12 nt, Pseudomonas aeruginosa PA01
aagccccagccc

SEQ ID NO: 1493659 - RNA, 14 nt, Pseudomonas aeruginosa PA01
aagccccaguccuc

SEQ ID NO: 1493660 - RNA, 19 nt, Pseudomonas aeruginosa PA01
gcgaccaccuucuacaccg

SEQ ID NO: 1493661 - RNA, 18 nt, Pseudomonas aeruginosa PA01
gcgacacgugccccaggc

SEQ ID NO: 1493662 - RNA, 22 nt, Pseudomonas aeruginosa PA01
gcgacagauagcaggucacgcc

SEQ ID NO: 1493663 - RNA, 23 nt, Pseudomonas aeruginosa PA01
gcgacagcauggccuugccggca

SEQ ID NO: 1493664 - RNA, 16 nt, Pseudomonas aeruginosa PA01
gcgacaucuccaggcc

SEQ ID NO: 1493665 - RNA, 17 nt, Pseudomonas aeruginosa PA01
gcgacaucuccaggccg

SEQ ID NO: 1493666 - RNA, 18 nt, Pseudomonas aeruginosa PA01
gcgacaucuccaggccgc

SEQ ID NO: 1493667 - RNA, 19 nt, Pseudomonas aeruginosa PA01
gcgacaucuccaggccgcu

SEQ ID NO: 1493668 - RNA, 21 nt, Pseudomonas aeruginosa PA01
gcgacaucuccaggccgcuca

SEQ ID NO: 1493669 - RNA, 13 nt, Pseudomonas aeruginosa PA01
gcgacaucggcga

SEQ ID NO: 1493670 - RNA, 18 nt, Pseudomonas aeruginosa PA01
gcgagaaagucgaucagc

SEQ ID NO: 1493671 - RNA, 22 nt, Pseudomonas aeruginosa PA01
gcgagaaagucgaucagcgcgc

SEQ ID NO: 1493672 - RNA, 14 nt, Pseudomonas aeruginosa PA01
gcgagaacagcucc

SEQ ID NO: 1493673 - RNA, 19 nt, Pseudomonas aeruginosa PA01
gcgagaucuucaggccgaa

SEQ ID NO: 1493674 - RNA, 22 nt, Pseudomonas aeruginosa PA01
gcgagaucuucaggccgaagcu

SEQ ID NO: 1493675 - RNA, 17 nt, Pseudomonas aeruginosa PA01
gcgagaacuugccggcg

SEQ ID NO: 1493676 - RNA, 16 nt, Pseudomonas aeruginosa PA01
gcgagaagccagccag

SEQ ID NO: 1493677 - RNA, 21 nt, Pseudomonas aeruginosa PA01
gcgagaagccagccaggucgg

SEQ ID NO: 1493678 - RNA, 14 nt, Pseudomonas aeruginosa PA01
gcgacguccacugc

SEQ ID NO: 1493679 - RNA, 13 nt, Pseudomonas aeruginosa PA01
gcgacguccugcg

SEQ ID NO: 1493680 - RNA, 15 nt, Pseudomonas aeruginosa PA01
gcgacgucgccguga

SEQ ID NO: 1493681 - RNA, 22 nt, Pseudomonas aeruginosa PA01
gcgacuccgccaguuccggggu

SEQ ID NO: 1493682 - RNA, 14 nt, Pseudomonas aeruginosa PA01
gcgacuccagccag

SEQ ID NO: 1493683 - RNA, 19 nt, Pseudomonas aeruginosa PA01
gcgacuccagccaggcgau

SEQ ID NO: 1493684 - RNA, 13 nt, Pseudomonas aeruginosa PA01
gcgacucgaugcg

SEQ ID NO: 1493685 - RNA, 16 nt, Pseudomonas aeruginosa PA01
gcgacucgcugggcgc

SEQ ID NO: 1493686 - RNA, 13 nt, Pseudomonas aeruginosa PA01
gcgacucggcugc

SEQ ID NO: 1493687 - RNA, 14 nt, Pseudomonas aeruginosa PA01
gcgacucggcugca

SEQ ID NO: 1493688 - RNA, 18 nt, Pseudomonas aeruginosa PA01
gcgacucggcugcaacgc

SEQ ID NO: 1493689 - RNA, 23 nt, Pseudomonas aeruginosa PA01
gcgacucggcugcaacgccgcgg

SEQ ID NO: 1493690 - RNA, 22 nt, Pseudomonas aeruginosa PA01
gcgacucguagggguagggguc

SEQ ID NO: 1493691 - RNA, 20 nt, Pseudomonas aeruginosa PA01
gcgacucguugcacgcaggc

SEQ ID NO: 1493692 - RNA, 24 nt, Pseudomonas aeruginosa PA01
gcgacucguugcacgcaggccgcu

SEQ ID NO: 1493693 - RNA, 14 nt, Pseudomonas aeruginosa PA01
gcgacugaccacgc

SEQ ID NO: 1493694 - RNA, 19 nt, Pseudomonas aeruginosa PA01
gcgacggucagcaggcccg

SEQ ID NO: 1493695 - RNA, 12 nt, Pseudomonas aeruginosa PA01
gcgacggucagg

SEQ ID NO: 1493696 - RNA, 13 nt, Pseudomonas aeruginosa PA01
gcgacggucaggc

SEQ ID NO: 1493697 - RNA, 16 nt, Pseudomonas aeruginosa PA01
gcgacggcugcuccgg

SEQ ID NO: 1493698 - RNA, 22 nt, Pseudomonas aeruginosa PA01
gcgacggcugcuccggaucgcg

SEQ ID NO: 1493699 - RNA, 21 nt, Pseudomonas aeruginosa PA01
gcgacgggaagcgaaccaggc

SEQ ID NO: 1493700 - RNA, 23 nt, Pseudomonas aeruginosa PA01
gcgacgggaagcgaaccaggcaa

SEQ ID NO: 1493701 - RNA, 14 nt, Pseudomonas aeruginosa PA01
gcgacggugccggu

SEQ ID NO: 1493702 - RNA, 15 nt, Pseudomonas aeruginosa PA01
gcgacggugccgguc

SEQ ID NO: 1493703 - RNA, 22 nt, Pseudomonas aeruginosa PA01
gcgacgguugauagcgcggccu

SEQ ID NO: 1493704 - RNA, 13 nt, Pseudomonas aeruginosa PA01
gcgacggugaagu

SEQ ID NO: 1493705 - RNA, 14 nt, Pseudomonas aeruginosa PA01
gcgacgcuccagcg

SEQ ID NO: 1493706 - RNA, 17 nt, Pseudomonas aeruginosa PA01
gcgacgcuccagcggca

SEQ ID NO: 1493707 - RNA, 13 nt, Pseudomonas aeruginosa PA01
gcgacgcuccagg

SEQ ID NO: 1493708 - RNA, 16 nt, Pseudomonas aeruginosa PA01
gcgacgcuacguucca

SEQ ID NO: 1493709 - RNA, 20 nt, Pseudomonas aeruginosa PA01
gcgacgcuacguuccagggc

SEQ ID NO: 1493710 - RNA, 16 nt, Pseudomonas aeruginosa PA01
gcgacgcucuucagcg

SEQ ID NO: 1493711 - RNA, 13 nt, Pseudomonas aeruginosa PA01
gcgacgcuggcgg

SEQ ID NO: 1493712 - RNA, 17 nt, Pseudomonas aeruginosa PA01
gcgacgcuggcggugcg

SEQ ID NO: 1493713 - RNA, 23 nt, Pseudomonas aeruginosa PA01
gcgacgcugaugaugccgcggcg

SEQ ID NO: 1493714 - RNA, 20 nt, Pseudomonas aeruginosa PA01
gcgacgcugaugccggcgaa

SEQ ID NO: 1493715 - RNA, 20 nt, Pseudomonas aeruginosa PA01
gcgacgcgaccuccggcgcc

SEQ ID NO: 1493716 - RNA, 12 nt, Pseudomonas aeruginosa PA01
gcgacgcgcagg

SEQ ID NO: 1493717 - RNA, 16 nt, Pseudomonas aeruginosa PA01
gcgacgcgcaggccgg

SEQ ID NO: 1493718 - RNA, 16 nt, Pseudomonas aeruginosa PA01
gcgacgcgcuggacca

SEQ ID NO: 1493719 - RNA, 19 nt, Pseudomonas aeruginosa PA01
gcgacgcgcuggaccaugg

SEQ ID NO: 1493720 - RNA, 16 nt, Pseudomonas aeruginosa PA01
gcgaguucgccggcca

SEQ ID NO: 1493721 - RNA, 13 nt, Pseudomonas aeruginosa PA01
gcgagucgucgga

SEQ ID NO: 1493722 - RNA, 20 nt, Pseudomonas aeruginosa PA01
gcgagugcagcgagucgccg

SEQ ID NO: 1493723 - RNA, 21 nt, Pseudomonas aeruginosa PA01
gcgagugcagcgagucgccgu

SEQ ID NO: 1493724 - RNA, 14 nt, Pseudomonas aeruginosa PA01
gcgagugcugaaca

SEQ ID NO: 1493725 - RNA, 23 nt, Pseudomonas aeruginosa PA01
gcgaguaguaggucgguucgccc

SEQ ID NO: 1493726 - RNA, 20 nt, Pseudomonas aeruginosa PA01
gcgaguccgacccgcuccgg

SEQ ID NO: 1493727 - RNA, 23 nt, Pseudomonas aeruginosa PA01
gcgagucaccccgaccagcgcgc

SEQ ID NO: 1493728 - RNA, 17 nt, Pseudomonas aeruginosa PA01
gcgaguccuucggcgca

SEQ ID NO: 1493729 - RNA, 17 nt, Pseudomonas aeruginosa PA01
gcgagucgacccaggcc

SEQ ID NO: 1493730 - RNA, 14 nt, Pseudomonas aeruginosa PA01
gcgagggcaccacg

SEQ ID NO: 1493731 - RNA, 16 nt, Pseudomonas aeruginosa PA01
gcgaggcuggccucgu

SEQ ID NO: 1493732 - RNA, 17 nt, Pseudomonas aeruginosa PA01
gcgaggcguuccaggug

SEQ ID NO: 1493733 - RNA, 19 nt, Pseudomonas aeruginosa PA01
gcgagggauguuccaggcc

SEQ ID NO: 1493734 - RNA, 21 nt, Pseudomonas aeruginosa PA01
gcgagggauguuccaggcccg

SEQ ID NO: 1493735 - RNA, 13 nt, Pseudomonas aeruginosa PA01
gcgagggcggcgg

SEQ ID NO: 1493736 - RNA, 16 nt, Pseudomonas aeruginosa PA01
gcgagggcggcggcuc

SEQ ID NO: 1493737 - RNA, 13 nt, Pseudomonas aeruginosa PA01
gcgagggcgccgg

SEQ ID NO: 1493738 - RNA, 19 nt, Pseudomonas aeruginosa PA01
gcgagggcgucccgcugcg

SEQ ID NO: 1493739 - RNA, 22 nt, Pseudomonas aeruginosa PA01
gcgaguaccaccgugcccgccg

SEQ ID NO: 1493740 - RNA, 13 nt, Pseudomonas aeruginosa PA01
gcgaggcgggcgc

SEQ ID NO: 1493741 - RNA, 16 nt, Pseudomonas aeruginosa PA01
gcgaggcgggcgcgga

SEQ ID NO: 1493742 - RNA, 22 nt, Pseudomonas aeruginosa PA01
gcgaggcgcucgacgaucaggu

SEQ ID NO: 1493743 - RNA, 12 nt, Pseudomonas aeruginosa PA01
gcgaggcgcgcc

SEQ ID NO: 1493744 - RNA, 14 nt, Pseudomonas aeruginosa PA01
gcgaggcgcgccug

SEQ ID NO: 1493745 - RNA, 15 nt, Pseudomonas aeruginosa PA01
gcgaggcgcgccugg

SEQ ID NO: 1493746 - RNA, 20 nt, Pseudomonas aeruginosa PA01
gcgaggcccguauggcgggc

SEQ ID NO: 1493747 - RNA, 12 nt, Pseudomonas aeruginosa PA01
gcgaggccgacc

SEQ ID NO: 1493748 - RNA, 12 nt, Pseudomonas aeruginosa PA01
gcgaggccgcuc

SEQ ID NO: 1493749 - RNA, 13 nt, Pseudomonas aeruginosa PA01
gcgaggccgcucu

SEQ ID NO: 1493750 - RNA, 20 nt, Pseudomonas aeruginosa PA01
gcgaggccguaccagucgcc

SEQ ID NO: 1493751 - RNA, 21 nt, Pseudomonas aeruginosa PA01
gcgaggccguaccagucgccc

SEQ ID NO: 1493752 - RNA, 12 nt, Pseudomonas aeruginosa PA01
gcgaggcgcccg

SEQ ID NO: 1493753 - RNA, 20 nt, Pseudomonas aeruginosa PA01
gcgagcugccccucguggcg

SEQ ID NO: 1493754 - RNA, 19 nt, Pseudomonas aeruginosa PA01
gcgagcuggaucggcaggc

SEQ ID NO: 1493755 - RNA, 22 nt, Pseudomonas aeruginosa PA01
gcgagcuggaucggcaggcugg

SEQ ID NO: 1493756 - RNA, 12 nt, Pseudomonas aeruginosa PA01
gcgagcuggcgc

SEQ ID NO: 1493757 - RNA, 15 nt, Pseudomonas aeruginosa PA01
gcgagcuggcgccgu

SEQ ID NO: 1493758 - RNA, 16 nt, Pseudomonas aeruginosa PA01
gcgagcuggcgccguc

SEQ ID NO: 1493759 - RNA, 15 nt, Pseudomonas aeruginosa PA01
gcgagcggcagaucc

SEQ ID NO: 1493760 - RNA, 14 nt, Pseudomonas aeruginosa PA01
gcgagcgggcgagg

SEQ ID NO: 1493761 - RNA, 21 nt, Pseudomonas aeruginosa PA01
gcgagcgggcgagggcggcgc

SEQ ID NO: 1493762 - RNA, 14 nt, Pseudomonas aeruginosa PA01
gcgagcgggucagc

SEQ ID NO: 1493763 - RNA, 20 nt, Pseudomonas aeruginosa PA01
gcgagcgggucagcagcacc

SEQ ID NO: 1493764 - RNA, 14 nt, Pseudomonas aeruginosa PA01
gcgagcggucggcc

SEQ ID NO: 1493765 - RNA, 15 nt, Pseudomonas aeruginosa PA01
gcgagcgucgagucg

SEQ ID NO: 1493766 - RNA, 23 nt, Pseudomonas aeruginosa PA01
gcgagcgcagacgggugcugaag

SEQ ID NO: 1493767 - RNA, 15 nt, Pseudomonas aeruginosa PA01
gcgagcgcccgccgu

SEQ ID NO: 1493768 - RNA, 12 nt, Pseudomonas aeruginosa PA01
gcgagcgccugg

SEQ ID NO: 1493769 - RNA, 13 nt, Pseudomonas aeruginosa PA01
gcgagcgccgccg

SEQ ID NO: 1493770 - RNA, 13 nt, Pseudomonas aeruginosa PA01
gcgagcgcggccg

SEQ ID NO: 1493771 - RNA, 15 nt, Pseudomonas aeruginosa PA01
gcgagcgcggccggc

SEQ ID NO: 1493772 - RNA, 16 nt, Pseudomonas aeruginosa PA01
gcgagcgcggccggcc

SEQ ID NO: 1493773 - RNA, 17 nt, Pseudomonas aeruginosa PA01
gcgagcgcggccggcca

SEQ ID NO: 1493774 - RNA, 21 nt, Pseudomonas aeruginosa PA01
gcgagcaaugaaaaaggcgau

SEQ ID NO: 1493775 - RNA, 22 nt, Pseudomonas aeruginosa PA01
gcgagcaaugaaaaaggcgauc

SEQ ID NO: 1493776 - RNA, 23 nt, Pseudomonas aeruginosa PA01
gcgagcaaugaaaaaggcgaucg

SEQ ID NO: 1493777 - RNA, 14 nt, Pseudomonas aeruginosa PA01
gcgagcaccaugca

SEQ ID NO: 1493778 - RNA, 18 nt, Pseudomonas aeruginosa PA01
gcgagcaccaugccgaug

SEQ ID NO: 1493779 - RNA, 23 nt, Pseudomonas aeruginosa PA01
gcgagcacggcgaacaccgggcc

SEQ ID NO: 1493780 - RNA, 14 nt, Pseudomonas aeruginosa PA01
gcgagcaccgcgca

SEQ ID NO: 1493781 - RNA, 15 nt, Pseudomonas aeruginosa PA01
gcgaacuggccaccg

SEQ ID NO: 1493782 - RNA, 15 nt, Pseudomonas aeruginosa PA01
gcgaacugccgacgg

SEQ ID NO: 1493783 - RNA, 19 nt, Pseudomonas aeruginosa PA01
gcgaacugccgacggcggc

SEQ ID NO: 1493784 - RNA, 18 nt, Pseudomonas aeruginosa PA01
gcgaagaacagcgggucg

SEQ ID NO: 1493785 - RNA, 19 nt, Pseudomonas aeruginosa PA01
gcgaacuucaggccggcgc

SEQ ID NO: 1493786 - RNA, 22 nt, Pseudomonas aeruginosa PA01
gcgaacuucaggccggcgccga

SEQ ID NO: 1493787 - RNA, 15 nt, Pseudomonas aeruginosa PA01
gcgaacgguccugcg

SEQ ID NO: 1493788 - RNA, 14 nt, Pseudomonas aeruginosa PA01
gcgaacucggcgcc

SEQ ID NO: 1493789 - RNA, 15 nt, Pseudomonas aeruginosa PA01
gcgaacucggcgccg

SEQ ID NO: 1493790 - RNA, 22 nt, Pseudomonas aeruginosa PA01
gcgaacucggcgccgaucuccg

SEQ ID NO: 1493791 - RNA, 23 nt, Pseudomonas aeruginosa PA01
gcgaacucguagacgaauaccgg

SEQ ID NO: 1493792 - RNA, 16 nt, Pseudomonas aeruginosa PA01
gcgaagaucucgccau

SEQ ID NO: 1493793 - RNA, 19 nt, Pseudomonas aeruginosa PA01
gcgaagaucucgccauggc

SEQ ID NO: 1493794 - RNA, 16 nt, Pseudomonas aeruginosa PA01
gcgaagccaggaagcg

SEQ ID NO: 1493795 - RNA, 16 nt, Pseudomonas aeruginosa PA01
gcgaagccgcgcccgg

SEQ ID NO: 1493796 - RNA, 20 nt, Pseudomonas aeruginosa PA01
gcgaagccggcggcgcggca

SEQ ID NO: 1493797 - RNA, 12 nt, Pseudomonas aeruginosa PA01
gcgaagcccagc

SEQ ID NO: 1493798 - RNA, 16 nt, Pseudomonas aeruginosa PA01
gcgaagcccagcgccg

SEQ ID NO: 1493799 - RNA, 23 nt, Pseudomonas aeruginosa PA01
gcgaagccguuguagaucggcag

SEQ ID NO: 1493800 - RNA, 14 nt, Pseudomonas aeruginosa PA01
gcgaagccugcucc

SEQ ID NO: 1493801 - RNA, 13 nt, Pseudomonas aeruginosa PA01
gcgaagcgacggc

SEQ ID NO: 1493802 - RNA, 21 nt, Pseudomonas aeruginosa PA01
gcgaagcggcccuugucgccg

SEQ ID NO: 1493803 - RNA, 13 nt, Pseudomonas aeruginosa PA01
gcgaagcggcugg

SEQ ID NO: 1493804 - RNA, 20 nt, Pseudomonas aeruginosa PA01
gcgaagcgguuagccggcga

SEQ ID NO: 1493805 - RNA, 22 nt, Pseudomonas aeruginosa PA01
gcgaagcgguuagccggcgauc

SEQ ID NO: 1493806 - RNA, 23 nt, Pseudomonas aeruginosa PA01
gcgaagcgguuagccggcgauca

SEQ ID NO: 1493807 - RNA, 19 nt, Pseudomonas aeruginosa PA01
gcgaagcggaagcgcagcc

SEQ ID NO: 1493808 - RNA, 21 nt, Pseudomonas aeruginosa PA01
gcgaaguccaccaggcgccgg

SEQ ID NO: 1493809 - RNA, 23 nt, Pseudomonas aeruginosa PA01
gcgaaguccaccaggcgccgggu

SEQ ID NO: 1493810 - RNA, 20 nt, Pseudomonas aeruginosa PA01
gcgaagucugccuguccgcu

SEQ ID NO: 1493811 - RNA, 19 nt, Pseudomonas aeruginosa PA01
gcgaagucgccgucguccg

SEQ ID NO: 1493812 - RNA, 14 nt, Pseudomonas aeruginosa PA01
gcgaagucggcgcg

SEQ ID NO: 1493813 - RNA, 18 nt, Pseudomonas aeruginosa PA01
gcgaagucggcgcgccag

SEQ ID NO: 1493814 - RNA, 13 nt, Pseudomonas aeruginosa PA01
gcgaaguagaagc

SEQ ID NO: 1493815 - RNA, 16 nt, Pseudomonas aeruginosa PA01
gcgaaggucugccccg

SEQ ID NO: 1493816 - RNA, 15 nt, Pseudomonas aeruginosa PA01
gcgaagggcaggccg

SEQ ID NO: 1493817 - RNA, 11 nt, Pseudomonas aeruginosa PA01
gcgaaggcgau

SEQ ID NO: 1493818 - RNA, 20 nt, Pseudomonas aeruginosa PA01
gcgaagcguugcagcgucug

SEQ ID NO: 1493819 - RNA, 13 nt, Pseudomonas aeruginosa PA01
gcgaagcuggcgc

SEQ ID NO: 1493820 - RNA, 14 nt, Pseudomonas aeruginosa PA01
gcgaagcuggcgca

SEQ ID NO: 1493821 - RNA, 16 nt, Pseudomonas aeruginosa PA01
gcgaagcuggcgcaac

SEQ ID NO: 1493822 - RNA, 19 nt, Pseudomonas aeruginosa PA01
gcgaaggcgccuuccaggc

SEQ ID NO: 1493823 - RNA, 20 nt, Pseudomonas aeruginosa PA01
gcgaaggccaccaucgcggc

SEQ ID NO: 1493824 - RNA, 18 nt, Pseudomonas aeruginosa PA01
gcgaaggcaaugccgccc

SEQ ID NO: 1493825 - RNA, 23 nt, Pseudomonas aeruginosa PA01
gcgaauauccucgucgauccgcg

SEQ ID NO: 1493826 - RNA, 14 nt, Pseudomonas aeruginosa PA01
gcgaauagggcggc

SEQ ID NO: 1493827 - RNA, 18 nt, Pseudomonas aeruginosa PA01
gcgaauagggcggcgcca

SEQ ID NO: 1493828 - RNA, 15 nt, Pseudomonas aeruginosa PA01
gcgaaguucccgccg

SEQ ID NO: 1493829 - RNA, 19 nt, Pseudomonas aeruginosa PA01
gcgaaguucccgccgcucu

SEQ ID NO: 1493830 - RNA, 20 nt, Pseudomonas aeruginosa PA01
gcgaaguugaaacggcggaa

SEQ ID NO: 1493831 - RNA, 17 nt, Pseudomonas aeruginosa PA01
gcgaauaaccgcaucgc

SEQ ID NO: 1493832 - RNA, 15 nt, Pseudomonas aeruginosa PA01
gcgaauaaccgcugc

SEQ ID NO: 1493833 - RNA, 20 nt, Pseudomonas aeruginosa PA01
gcgaauaaccgcugcgcggu

SEQ ID NO: 1493834 - RNA, 14 nt, Pseudomonas aeruginosa PA01
gcgaauaacgccac

SEQ ID NO: 1493835 - RNA, 14 nt, Pseudomonas aeruginosa PA01
gcgaauaacgccgc

SEQ ID NO: 1493836 - RNA, 14 nt, Pseudomonas aeruginosa PA01
gcgaauaccagugc

SEQ ID NO: 1493837 - RNA, 21 nt, Pseudomonas aeruginosa PA01
gcgaauaccagugccgcggug

SEQ ID NO: 1493838 - RNA, 22 nt, Pseudomonas aeruginosa PA01
gcgaacaugaagccgcgcgccg

SEQ ID NO: 1493839 - RNA, 23 nt, Pseudomonas aeruginosa PA01
gcgaacaugaagccgcgcgccga

SEQ ID NO: 1493840 - RNA, 21 nt, Pseudomonas aeruginosa PA01
gcgaaccacaccaggucgccg

SEQ ID NO: 1493841 - RNA, 22 nt, Pseudomonas aeruginosa PA01
gcgaaccacaccaggucgccgc

SEQ ID NO: 1493842 - RNA, 23 nt, Pseudomonas aeruginosa PA01
gcgaaccaggcaauggccggcgg

SEQ ID NO: 1493843 - RNA, 16 nt, Pseudomonas aeruginosa PA01
gcgaaccacucggcgc

SEQ ID NO: 1493844 - RNA, 19 nt, Pseudomonas aeruginosa PA01
gcgaaccagugcaccgccg

SEQ ID NO: 1493845 - RNA, 20 nt, Pseudomonas aeruginosa PA01
gcgaaccagugcaccgccgg

SEQ ID NO: 1493846 - RNA, 12 nt, Pseudomonas aeruginosa PA01
gcgaacccaggc

SEQ ID NO: 1493847 - RNA, 14 nt, Pseudomonas aeruginosa PA01
gcgaacccaggccg

SEQ ID NO: 1493848 - RNA, 16 nt, Pseudomonas aeruginosa PA01
gcgaacccaggccgcg

SEQ ID NO: 1493849 - RNA, 17 nt, Pseudomonas aeruginosa PA01
gcgaacccaggccgcgc

SEQ ID NO: 1493850 - RNA, 21 nt, Pseudomonas aeruginosa PA01
gcgaacccucggugcggccga

SEQ ID NO: 1493851 - RNA, 14 nt, Pseudomonas aeruginosa PA01
gcgaaccgccggcc

SEQ ID NO: 1493852 - RNA, 19 nt, Pseudomonas aeruginosa PA01
gcgaaccgccggccucgcu

SEQ ID NO: 1493853 - RNA, 22 nt, Pseudomonas aeruginosa PA01
gcgaaccgccggccucgcugcc

SEQ ID NO: 1493854 - RNA, 17 nt, Pseudomonas aeruginosa PA01
gcgaacgcucccagccg

SEQ ID NO: 1493855 - RNA, 19 nt, Pseudomonas aeruginosa PA01
gcgaacgcucccagccgac

SEQ ID NO: 1493856 - RNA, 21 nt, Pseudomonas aeruginosa PA01
gcgaacgcucccagccgacgu

SEQ ID NO: 1493857 - RNA, 15 nt, Pseudomonas aeruginosa PA01
gcgaacggaccgacg

SEQ ID NO: 1493858 - RNA, 19 nt, Pseudomonas aeruginosa PA01
gcgaacgggcguugccggc

SEQ ID NO: 1493859 - RNA, 13 nt, Pseudomonas aeruginosa PA01
gcgaacggcuggu

SEQ ID NO: 1493860 - RNA, 22 nt, Pseudomonas aeruginosa PA01
gcgaacgaugguggucggcagc

SEQ ID NO: 1493861 - RNA, 23 nt, Pseudomonas aeruginosa PA01
gcgaacgaugguggucggcagcu

SEQ ID NO: 1493862 - RNA, 14 nt, Pseudomonas aeruginosa PA01
gcgaacgcccggcu

SEQ ID NO: 1493863 - RNA, 13 nt, Pseudomonas aeruginosa PA01
gcgaacgcccggc

SEQ ID NO: 1493864 - RNA, 22 nt, Pseudomonas aeruginosa PA01
gcgaaccgugguucucggucgg

SEQ ID NO: 1493865 - RNA, 15 nt, Pseudomonas aeruginosa PA01
gcgaacgacagcacc

SEQ ID NO: 1493866 - RNA, 22 nt, Pseudomonas aeruginosa PA01
gcgaacgacagcaccaugcccu

SEQ ID NO: 1493867 - RNA, 19 nt, Pseudomonas aeruginosa PA01
gcgaacgacagcgaaugcu

SEQ ID NO: 1493868 - RNA, 21 nt, Pseudomonas aeruginosa PA01
gcgaaagcgucagcgcgccag

SEQ ID NO: 1493869 - RNA, 22 nt, Pseudomonas aeruginosa PA01
gcgaaagcgucagcgcgccagc

SEQ ID NO: 1493870 - RNA, 16 nt, Pseudomonas aeruginosa PA01
gcgaaauccucgcgca

SEQ ID NO: 1493871 - RNA, 13 nt, Pseudomonas aeruginosa PA01
gcgaaaucggcag

SEQ ID NO: 1493872 - RNA, 16 nt, Pseudomonas aeruginosa PA01
gcgaaauggcagaaca

SEQ ID NO: 1493873 - RNA, 22 nt, Pseudomonas aeruginosa PA01
gcgaaauggguucccagcagca

SEQ ID NO: 1493874 - RNA, 14 nt, Pseudomonas aeruginosa PA01
gcgaacaacgccgc

SEQ ID NO: 1493875 - RNA, 17 nt, Pseudomonas aeruginosa PA01
gcgaacaacgccgccgg

SEQ ID NO: 1493876 - RNA, 20 nt, Pseudomonas aeruginosa PA01
gcgaacaacgccgccggcgu

SEQ ID NO: 1493877 - RNA, 13 nt, Pseudomonas aeruginosa PA01
gcgaacaaccgcu

SEQ ID NO: 1493878 - RNA, 15 nt, Pseudomonas aeruginosa PA01
gcgaaauugccuccg

SEQ ID NO: 1493879 - RNA, 15 nt, Pseudomonas aeruginosa PA01
gcgaacaggcagcgg

SEQ ID NO: 1493880 - RNA, 23 nt, Pseudomonas aeruginosa PA01
gcgaacagcagcgguaggcgcgu

SEQ ID NO: 1493881 - RNA, 21 nt, Pseudomonas aeruginosa PA01
gcgaacagggccaucagggcg

SEQ ID NO: 1493882 - RNA, 18 nt, Pseudomonas aeruginosa PA01
gcgaacaguuccgacugc

SEQ ID NO: 1493883 - RNA, 22 nt, Pseudomonas aeruginosa PA01
gcgaacaguuccgacugcgagc

SEQ ID NO: 1493884 - RNA, 18 nt, Pseudomonas aeruginosa PA01
gcgaacagcgcuuccugg

SEQ ID NO: 1493885 - RNA, 21 nt, Pseudomonas aeruginosa PA01
gcgaacacacccugcgcaagg

SEQ ID NO: 1493886 - RNA, 17 nt, Pseudomonas aeruginosa PA01
gcgaacaaucggucgcc

SEQ ID NO: 1493887 - RNA, 18 nt, Pseudomonas aeruginosa PA01
gcgaacaaucggucgccc

SEQ ID NO: 1493888 - RNA, 19 nt, Pseudomonas aeruginosa PA01
gcgaacaccgggccgccgg

SEQ ID NO: 1493889 - RNA, 16 nt, Pseudomonas aeruginosa PA01
gcgaacacgucggcgc

SEQ ID NO: 1493890 - RNA, 21 nt, Pseudomonas aeruginosa PA01
gccuucagagcagggugaagc

SEQ ID NO: 1493891 - RNA, 22 nt, Pseudomonas aeruginosa PA01
gccuucagccccagcacgccga

SEQ ID NO: 1493892 - RNA, 20 nt, Pseudomonas aeruginosa PA01
gccuucagcgccagcaggcg

SEQ ID NO: 1493893 - RNA, 16 nt, Pseudomonas aeruginosa PA01
gccuucagcgccgcca

SEQ ID NO: 1493894 - RNA, 19 nt, Pseudomonas aeruginosa PA01
gccuucagcgccgccaggc

SEQ ID NO: 1493895 - RNA, 20 nt, Pseudomonas aeruginosa PA01
gccuucagcgccgccaggcc

SEQ ID NO: 1493896 - RNA, 19 nt, Pseudomonas aeruginosa PA01
gccuucagacgcaccgagg

SEQ ID NO: 1493897 - RNA, 20 nt, Pseudomonas aeruginosa PA01
gccuucaccgcgccgcgcuu

SEQ ID NO: 1493898 - RNA, 19 nt, Pseudomonas aeruginosa PA01
gccuucaccggcggaugac

SEQ ID NO: 1493899 - RNA, 15 nt, Pseudomonas aeruginosa PA01
gccuucaggcgcucc

SEQ ID NO: 1493900 - RNA, 17 nt, Pseudomonas aeruginosa PA01
gccuucgggcgaugcgg

SEQ ID NO: 1493901 - RNA, 13 nt, Pseudomonas aeruginosa PA01
gccuucggcggcg

SEQ ID NO: 1493902 - RNA, 23 nt, Pseudomonas aeruginosa PA01
gccuucccagacguccagcgcca

SEQ ID NO: 1493903 - RNA, 24 nt, Pseudomonas aeruginosa PA01
gccuucccagacguccagcgccac

SEQ ID NO: 1493904 - RNA, 22 nt, Pseudomonas aeruginosa PA01
gccuuccaggcuguagccggcg

SEQ ID NO: 1493905 - RNA, 23 nt, Pseudomonas aeruginosa PA01
gccuuccaggcuguagccggcga

SEQ ID NO: 1493906 - RNA, 18 nt, Pseudomonas aeruginosa PA01
gccuuccaccggcgucca

SEQ ID NO: 1493907 - RNA, 20 nt, Pseudomonas aeruginosa PA01
gccuuccacgccuucgcggc

SEQ ID NO: 1493908 - RNA, 16 nt, Pseudomonas aeruginosa PA01
gccuuccaccaccagg

SEQ ID NO: 1493909 - RNA, 18 nt, Pseudomonas aeruginosa PA01
gccuucucgucgccgccc

SEQ ID NO: 1493910 - RNA, 19 nt, Pseudomonas aeruginosa PA01
gccuucucgucgccgcccg

SEQ ID NO: 1493911 - RNA, 19 nt, Pseudomonas aeruginosa PA01
gccuucuugcugccggcgu

SEQ ID NO: 1493912 - RNA, 22 nt, Pseudomonas aeruginosa PA01
gccuucuugcugccggcguccu

SEQ ID NO: 1493913 - RNA, 20 nt, Pseudomonas aeruginosa PA01
gccuugagcggcgcccuggc

SEQ ID NO: 1493914 - RNA, 14 nt, Pseudomonas aeruginosa PA01
gccuugagcaggcg

SEQ ID NO: 1493915 - RNA, 15 nt, Pseudomonas aeruginosa PA01
gccuugagcaggcgg

SEQ ID NO: 1493916 - RNA, 18 nt, Pseudomonas aeruginosa PA01
gccuugagcaggcggccg

SEQ ID NO: 1493917 - RNA, 16 nt, Pseudomonas aeruginosa PA01
gccuugaccucgacgc

SEQ ID NO: 1493918 - RNA, 20 nt, Pseudomonas aeruginosa PA01
gccuugaccaccgccaggcu

SEQ ID NO: 1493919 - RNA, 16 nt, Pseudomonas aeruginosa PA01
gccuugaaaccggcga

SEQ ID NO: 1493920 - RNA, 13 nt, Pseudomonas aeruginosa PA01
gccugcagggcgu

SEQ ID NO: 1493921 - RNA, 21 nt, Pseudomonas aeruginosa PA01
gccugcagguagcgcugcgcc

SEQ ID NO: 1493922 - RNA, 23 nt, Pseudomonas aeruginosa PA01
gccugcagguagcgcugcgcccg

SEQ ID NO: 1493923 - RNA, 15 nt, Pseudomonas aeruginosa PA01
gccugcagguccggg

SEQ ID NO: 1493924 - RNA, 18 nt, Pseudomonas aeruginosa PA01
gccugcaggucgaggcgc

SEQ ID NO: 1493925 - RNA, 15 nt, Pseudomonas aeruginosa PA01
gccugcaccugcucg

SEQ ID NO: 1493926 - RNA, 19 nt, Pseudomonas aeruginosa PA01
gccugcaccugcucggggc

SEQ ID NO: 1493927 - RNA, 15 nt, Pseudomonas aeruginosa PA01
gccugcaccgggccg

SEQ ID NO: 1493928 - RNA, 22 nt, Pseudomonas aeruginosa PA01
gccugcaccgggccgaccugcc

SEQ ID NO: 1493929 - RNA, 13 nt, Pseudomonas aeruginosa PA01
gccugcagccugg

SEQ ID NO: 1493930 - RNA, 17 nt, Pseudomonas aeruginosa PA01
gccugcagcaccaccuc

SEQ ID NO: 1493931 - RNA, 20 nt, Pseudomonas aeruginosa PA01
gccugcagcaccaccucgcc

SEQ ID NO: 1493932 - RNA, 21 nt, Pseudomonas aeruginosa PA01
gccugcagcaccaccucgcca

SEQ ID NO: 1493933 - RNA, 16 nt, Pseudomonas aeruginosa PA01
gccugcagcaggucga

SEQ ID NO: 1493934 - RNA, 13 nt, Pseudomonas aeruginosa PA01
gccugucggcacg

SEQ ID NO: 1493935 - RNA, 16 nt, Pseudomonas aeruginosa PA01
gccuguuccagggccu

SEQ ID NO: 1493936 - RNA, 19 nt, Pseudomonas aeruginosa PA01
gccuguuccagggccugcu

SEQ ID NO: 1493937 - RNA, 13 nt, Pseudomonas aeruginosa PA01
gccuguuccuccg

SEQ ID NO: 1493938 - RNA, 12 nt, Pseudomonas aeruginosa PA01
gccuguucgccc

SEQ ID NO: 1493939 - RNA, 18 nt, Pseudomonas aeruginosa PA01
gccuguucgcccaaggcc

SEQ ID NO: 1493940 - RNA, 13 nt, Pseudomonas aeruginosa PA01
gccuguucggccu

SEQ ID NO: 1493941 - RNA, 16 nt, Pseudomonas aeruginosa PA01
gccuuguacagggcgc

SEQ ID NO: 1493942 - RNA, 21 nt, Pseudomonas aeruginosa PA01
gccuuggucucgaucagcgag

SEQ ID NO: 1493943 - RNA, 19 nt, Pseudomonas aeruginosa PA01
gccuuggucucgcgggcga

SEQ ID NO: 1493944 - RNA, 20 nt, Pseudomonas aeruginosa PA01
gccuugcugaucagguugcc

SEQ ID NO: 1493945 - RNA, 23 nt, Pseudomonas aeruginosa PA01
gccuugcguaccagcgcgcagcg

SEQ ID NO: 1493946 - RNA, 18 nt, Pseudomonas aeruginosa PA01
gccuuggccuccacccgc

SEQ ID NO: 1493947 - RNA, 17 nt, Pseudomonas aeruginosa PA01
gccuuggccacgacccu

SEQ ID NO: 1493948 - RNA, 18 nt, Pseudomonas aeruginosa PA01
gccuuggcaucgccgccc

SEQ ID NO: 1493949 - RNA, 17 nt, Pseudomonas aeruginosa PA01
gccuugcgaccaggucc

SEQ ID NO: 1493950 - RNA, 22 nt, Pseudomonas aeruginosa PA01
gccuugccguccagccggcgcu

SEQ ID NO: 1493951 - RNA, 13 nt, Pseudomonas aeruginosa PA01
gccuugcccuggc

SEQ ID NO: 1493952 - RNA, 19 nt, Pseudomonas aeruginosa PA01
gccuugcggggcggcgcau

SEQ ID NO: 1493953 - RNA, 16 nt, Pseudomonas aeruginosa PA01
gccuugcgcggcgccg

SEQ ID NO: 1493954 - RNA, 19 nt, Pseudomonas aeruginosa PA01
gccuugcgcggcgccgguu

SEQ ID NO: 1493955 - RNA, 17 nt, Pseudomonas aeruginosa PA01
gccuugcagggccgcca

SEQ ID NO: 1493956 - RNA, 21 nt, Pseudomonas aeruginosa PA01
gccuugcagggccgccagccg

SEQ ID NO: 1493957 - RNA, 14 nt, Pseudomonas aeruginosa PA01
gccuugcagcgcca

SEQ ID NO: 1493958 - RNA, 13 nt, Pseudomonas aeruginosa PA01
gccuugcccggcg

SEQ ID NO: 1493959 - RNA, 20 nt, Pseudomonas aeruginosa PA01
gccuugaggaugucgcggcu

SEQ ID NO: 1493960 - RNA, 14 nt, Pseudomonas aeruginosa PA01
gccuugaggcgggc

SEQ ID NO: 1493961 - RNA, 18 nt, Pseudomonas aeruginosa PA01
gccuugcagcaccgccug

SEQ ID NO: 1493962 - RNA, 23 nt, Pseudomonas aeruginosa PA01
gccuugcagcaccgccuggucga

SEQ ID NO: 1493963 - RNA, 15 nt, Pseudomonas aeruginosa PA01
gccuugaugccggcg

SEQ ID NO: 1493964 - RNA, 16 nt, Pseudomonas aeruginosa PA01
gccuugaugccggcga

SEQ ID NO: 1493965 - RNA, 15 nt, Pseudomonas aeruginosa PA01
gccuugauggcgggc

SEQ ID NO: 1493966 - RNA, 17 nt, Pseudomonas aeruginosa PA01
gccuuuucuuuggcgac

SEQ ID NO: 1493967 - RNA, 19 nt, Pseudomonas aeruginosa PA01
gccuuucuucugcugugcg

SEQ ID NO: 1493968 - RNA, 17 nt, Pseudomonas aeruginosa PA01
gccuuucggggugcagg

SEQ ID NO: 1493969 - RNA, 18 nt, Pseudomonas aeruginosa PA01
gccuuucgcucaggccuc

SEQ ID NO: 1493970 - RNA, 15 nt, Pseudomonas aeruginosa PA01
gccuuguuccaggcg

SEQ ID NO: 1493971 - RNA, 19 nt, Pseudomonas aeruginosa PA01
gccuugugacuaucgucga

SEQ ID NO: 1493972 - RNA, 22 nt, Pseudomonas aeruginosa PA01
gccuugugacuaucgucgaggg

SEQ ID NO: 1493973 - RNA, 19 nt, Pseudomonas aeruginosa PA01
gccuugugcgccagcucgg

SEQ ID NO: 1493974 - RNA, 22 nt, Pseudomonas aeruginosa PA01
gccuugugcgccagcucggccu

SEQ ID NO: 1493975 - RNA, 21 nt, Pseudomonas aeruginosa PA01
gcgaaaaauacuccgcgacgu

SEQ ID NO: 1493976 - RNA, 19 nt, Pseudomonas aeruginosa PA01
gcgaaacgccccgucgacg

SEQ ID NO: 1493977 - RNA, 15 nt, Pseudomonas aeruginosa PA01
gcgaaaagcccgcca

SEQ ID NO: 1493978 - RNA, 22 nt, Pseudomonas aeruginosa PA01
gcgaaaagcccgccaccuggcg

SEQ ID NO: 1493979 - RNA, 15 nt, Pseudomonas aeruginosa PA01
gcgaaaacggcgacc

SEQ ID NO: 1493980 - RNA, 20 nt, Pseudomonas aeruginosa PA01
gccuuuuucauggccuggcg

SEQ ID NO: 1493981 - RNA, 22 nt, Pseudomonas aeruginosa PA01
aagcgcucgacauacuccgccg

SEQ ID NO: 1493982 - RNA, 16 nt, Pseudomonas aeruginosa PA01
aagcgcucggucagcu

SEQ ID NO: 1493983 - RNA, 17 nt, Pseudomonas aeruginosa PA01
aagcgcucggucagcuc

SEQ ID NO: 1493984 - RNA, 19 nt, Pseudomonas aeruginosa PA01
aagcgcugcugggcggcga

SEQ ID NO: 1493985 - RNA, 19 nt, Pseudomonas aeruginosa PA01
gcggccccaaggggccgcg

SEQ ID NO: 1493986 - RNA, 13 nt, Pseudomonas aeruginosa PA01
gcggccccagcac

SEQ ID NO: 1493987 - RNA, 16 nt, Pseudomonas aeruginosa PA01
gcggcccagcggcagg

SEQ ID NO: 1493988 - RNA, 15 nt, Pseudomonas aeruginosa PA01
gcggcccaccaccac

SEQ ID NO: 1493989 - RNA, 13 nt, Pseudomonas aeruginosa PA01
gcggcccagcgcc

SEQ ID NO: 1493990 - RNA, 14 nt, Pseudomonas aeruginosa PA01
gcggcccagcgccc

SEQ ID NO: 1493991 - RNA, 18 nt, Pseudomonas aeruginosa PA01
gcggcccagcgccccgcc

SEQ ID NO: 1493992 - RNA, 15 nt, Pseudomonas aeruginosa PA01
gcggccaucaggcgc

SEQ ID NO: 1493993 - RNA, 21 nt, Pseudomonas aeruginosa PA01
gcggccaguuguuccggcugg

SEQ ID NO: 1493994 - RNA, 21 nt, Pseudomonas aeruginosa PA01
gcggccaguucggggucggcc

SEQ ID NO: 1493995 - RNA, 21 nt, Pseudomonas aeruginosa PA01
gcggccauugcccgguggccu

SEQ ID NO: 1493996 - RNA, 16 nt, Pseudomonas aeruginosa PA01
gcggccauugucggcc

SEQ ID NO: 1493997 - RNA, 19 nt, Pseudomonas aeruginosa PA01
gcggccauugucggccucg

SEQ ID NO: 1493998 - RNA, 21 nt, Pseudomonas aeruginosa PA01
gcggccauugucggccucgau

SEQ ID NO: 1493999 - RNA, 17 nt, Pseudomonas aeruginosa PA01
aagcggccgaccaggcc

SEQ ID NO: 1494000 - RNA, 18 nt, Pseudomonas aeruginosa PA01
aagcggaucucgucgccg

SEQ ID NO: 1494001 - RNA, 16 nt, Pseudomonas aeruginosa PA01
aagcgggccucggcgg

SEQ ID NO: 1494002 - RNA, 14 nt, Pseudomonas aeruginosa PA01
gcggccccggcgcu

SEQ ID NO: 1494003 - RNA, 16 nt, Pseudomonas aeruginosa PA01
gcggcccgagcaggcu

SEQ ID NO: 1494004 - RNA, 18 nt, Pseudomonas aeruginosa PA01
gcggcccgagcaggcugc

SEQ ID NO: 1494005 - RNA, 19 nt, Pseudomonas aeruginosa PA01
gcggcccgagcaggcugcc

SEQ ID NO: 1494006 - RNA, 21 nt, Pseudomonas aeruginosa PA01
gcggcccgagcaggcugccga

SEQ ID NO: 1494007 - RNA, 17 nt, Pseudomonas aeruginosa PA01
gcggcccgagggcggca

SEQ ID NO: 1494008 - RNA, 18 nt, Pseudomonas aeruginosa PA01
gcggcccgagggcggcag

SEQ ID NO: 1494009 - RNA, 17 nt, Pseudomonas aeruginosa PA01
gcggcccgccucggcgg

SEQ ID NO: 1494010 - RNA, 18 nt, Pseudomonas aeruginosa PA01
gcggcccgccucggcggc

SEQ ID NO: 1494011 - RNA, 19 nt, Pseudomonas aeruginosa PA01
gcggcccgccgccggggcg

SEQ ID NO: 1494012 - RNA, 17 nt, Pseudomonas aeruginosa PA01
gcggcccgccggcgaac

SEQ ID NO: 1494013 - RNA, 17 nt, Pseudomonas aeruginosa PA01
gcggcccggcaggcgca

SEQ ID NO: 1494014 - RNA, 18 nt, Pseudomonas aeruginosa PA01
gcggcccggcaggcgcac

SEQ ID NO: 1494015 - RNA, 23 nt, Pseudomonas aeruginosa PA01
gcggcccggcguaaucgaagguc

SEQ ID NO: 1494016 - RNA, 13 nt, Pseudomonas aeruginosa PA01
gcggccgcgagcg

SEQ ID NO: 1494017 - RNA, 17 nt, Pseudomonas aeruginosa PA01
gcggccgcgagcgcggc

SEQ ID NO: 1494018 - RNA, 19 nt, Pseudomonas aeruginosa PA01
gcggccgcgagcgcggccg

SEQ ID NO: 1494019 - RNA, 18 nt, Pseudomonas aeruginosa PA01
gcggccgagauccugcag

SEQ ID NO: 1494020 - RNA, 20 nt, Pseudomonas aeruginosa PA01
gcggccgagcaccacgcgca

SEQ ID NO: 1494021 - RNA, 16 nt, Pseudomonas aeruginosa PA01
gcggccgagcaggcgc

SEQ ID NO: 1494022 - RNA, 13 nt, Pseudomonas aeruginosa PA01
gcggccgaccagg

SEQ ID NO: 1494023 - RNA, 19 nt, Pseudomonas aeruginosa PA01
gcggccgaccaggccguag

SEQ ID NO: 1494024 - RNA, 17 nt, Pseudomonas aeruginosa PA01
gcggcccuugucgccgc

SEQ ID NO: 1494025 - RNA, 15 nt, Pseudomonas aeruginosa PA01
gcggcccuuguucgc

SEQ ID NO: 1494026 - RNA, 20 nt, Pseudomonas aeruginosa PA01
gcggcccuuguucgcggcga

SEQ ID NO: 1494027 - RNA, 18 nt, Pseudomonas aeruginosa PA01
gcggccgaacucuggcgg

SEQ ID NO: 1494028 - RNA, 19 nt, Pseudomonas aeruginosa PA01
gcggccgaacucuggcggc

SEQ ID NO: 1494029 - RNA, 13 nt, Pseudomonas aeruginosa PA01
gcggccgaacugg

SEQ ID NO: 1494030 - RNA, 19 nt, Pseudomonas aeruginosa PA01
gcggccgaauccuccagcc

SEQ ID NO: 1494031 - RNA, 13 nt, Pseudomonas aeruginosa PA01
gcggcccugcucg

SEQ ID NO: 1494032 - RNA, 19 nt, Pseudomonas aeruginosa PA01
gcggcccugcucgccggcg

SEQ ID NO: 1494033 - RNA, 20 nt, Pseudomonas aeruginosa PA01
gcggcccugcucgccggcgc

SEQ ID NO: 1494034 - RNA, 14 nt, Pseudomonas aeruginosa PA01
gcggcccugcgccg

SEQ ID NO: 1494035 - RNA, 22 nt, Pseudomonas aeruginosa PA01
gcggcccuucgacgacaccugc

SEQ ID NO: 1494036 - RNA, 13 nt, Pseudomonas aeruginosa PA01
gcggcccuugccc

SEQ ID NO: 1494037 - RNA, 16 nt, Pseudomonas aeruginosa PA01
gcggccgcguccgaga

SEQ ID NO: 1494038 - RNA, 13 nt, Pseudomonas aeruginosa PA01
gcggccggcgccg

SEQ ID NO: 1494039 - RNA, 14 nt, Pseudomonas aeruginosa PA01
gcggccggcgcggc

SEQ ID NO: 1494040 - RNA, 18 nt, Pseudomonas aeruginosa PA01
gcggccggcgcggcgcgu

SEQ ID NO: 1494041 - RNA, 12 nt, Pseudomonas aeruginosa PA01
gcggccggcgca

SEQ ID NO: 1494042 - RNA, 14 nt, Pseudomonas aeruginosa PA01
gcggccguucaggg

SEQ ID NO: 1494043 - RNA, 13 nt, Pseudomonas aeruginosa PA01
gcggccguucucc

SEQ ID NO: 1494044 - RNA, 23 nt, Pseudomonas aeruginosa PA01
gcggccguucuccgggucgggcu

SEQ ID NO: 1494045 - RNA, 14 nt, Pseudomonas aeruginosa PA01
gcggccucaggccu

SEQ ID NO: 1494046 - RNA, 15 nt, Pseudomonas aeruginosa PA01
gcggccggcuucagc

SEQ ID NO: 1494047 - RNA, 17 nt, Pseudomonas aeruginosa PA01
gcggccgugcaugccga

SEQ ID NO: 1494048 - RNA, 20 nt, Pseudomonas aeruginosa PA01
gcggccgugcaugccgacga

SEQ ID NO: 1494049 - RNA, 23 nt, Pseudomonas aeruginosa PA01
gcggccgugcaugccgacgagca

SEQ ID NO: 1494050 - RNA, 18 nt, Pseudomonas aeruginosa PA01
gcggccugcucgcgcagc

SEQ ID NO: 1494051 - RNA, 22 nt, Pseudomonas aeruginosa PA01
gcggccugcucgcgcagccagg

SEQ ID NO: 1494052 - RNA, 17 nt, Pseudomonas aeruginosa PA01
gcggccuguucggccuu

SEQ ID NO: 1494053 - RNA, 19 nt, Pseudomonas aeruginosa PA01
gcggccuucucgucgccgc

SEQ ID NO: 1494054 - RNA, 21 nt, Pseudomonas aeruginosa PA01
gcggccuucuugcugccggcg

SEQ ID NO: 1494055 - RNA, 14 nt, Pseudomonas aeruginosa PA01
gcggcauccaguuc

SEQ ID NO: 1494056 - RNA, 16 nt, Pseudomonas aeruginosa PA01
gcggcauagcgcagcc

SEQ ID NO: 1494057 - RNA, 19 nt, Pseudomonas aeruginosa PA01
gcggcauagaugccggccu

SEQ ID NO: 1494058 - RNA, 20 nt, Pseudomonas aeruginosa PA01
gcggcauagaugccggccuc

SEQ ID NO: 1494059 - RNA, 22 nt, Pseudomonas aeruginosa PA01
gcggcagugcucgaucaggcug

SEQ ID NO: 1494060 - RNA, 12 nt, Pseudomonas aeruginosa PA01
gcggcaggcgca

SEQ ID NO: 1494061 - RNA, 13 nt, Pseudomonas aeruginosa PA01
gcggcagcucggc

SEQ ID NO: 1494062 - RNA, 18 nt, Pseudomonas aeruginosa PA01
gcggcaggccacggccgc

SEQ ID NO: 1494063 - RNA, 13 nt, Pseudomonas aeruginosa PA01
gcggcaggccagc

SEQ ID NO: 1494064 - RNA, 12 nt, Pseudomonas aeruginosa PA01
gcggcaggccga

SEQ ID NO: 1494065 - RNA, 15 nt, Pseudomonas aeruginosa PA01
gcggcagcuuggcga

SEQ ID NO: 1494066 - RNA, 13 nt, Pseudomonas aeruginosa PA01
gcggcaggcgccg

SEQ ID NO: 1494067 - RNA, 14 nt, Pseudomonas aeruginosa PA01
gcggcaggcgccgg

SEQ ID NO: 1494068 - RNA, 15 nt, Pseudomonas aeruginosa PA01
gcggcaggcgccggc

SEQ ID NO: 1494069 - RNA, 21 nt, Pseudomonas aeruginosa PA01
gcggcaggcgccggccgggcu

SEQ ID NO: 1494070 - RNA, 12 nt, Pseudomonas aeruginosa PA01
gcggcaggcggc

SEQ ID NO: 1494071 - RNA, 14 nt, Pseudomonas aeruginosa PA01
gcggcaggcggcgg

SEQ ID NO: 1494072 - RNA, 17 nt, Pseudomonas aeruginosa PA01
gcggcaggcugcgccgc

SEQ ID NO: 1494073 - RNA, 20 nt, Pseudomonas aeruginosa PA01
gcggcaggcugcgccgcugc

SEQ ID NO: 1494074 - RNA, 13 nt, Pseudomonas aeruginosa PA01
gcggcaggccgcc

SEQ ID NO: 1494075 - RNA, 15 nt, Pseudomonas aeruginosa PA01
gcggcaggccgccga

SEQ ID NO: 1494076 - RNA, 22 nt, Pseudomonas aeruginosa PA01
aagcgaguccgacccgcuccgg

SEQ ID NO: 1494077 - RNA, 15 nt, Pseudomonas aeruginosa PA01
gcggcaggcacgcug

SEQ ID NO: 1494078 - RNA, 16 nt, Pseudomonas aeruginosa PA01
gcggcaggcacgcugc

SEQ ID NO: 1494079 - RNA, 22 nt, Pseudomonas aeruginosa PA01
gcggcaggcacgcugccagcag

SEQ ID NO: 1494080 - RNA, 15 nt, Pseudomonas aeruginosa PA01
gcggcaggacccaga

SEQ ID NO: 1494081 - RNA, 18 nt, Pseudomonas aeruginosa PA01
gcggcaggacccagaaac

SEQ ID NO: 1494082 - RNA, 15 nt, Pseudomonas aeruginosa PA01
gcggcaggagcauga

SEQ ID NO: 1494083 - RNA, 23 nt, Pseudomonas aeruginosa PA01
gcggcaggaucaggcucgagccg

SEQ ID NO: 1494084 - RNA, 18 nt, Pseudomonas aeruginosa PA01
gcggcagccacucggcca

SEQ ID NO: 1494085 - RNA, 19 nt, Pseudomonas aeruginosa PA01
gcggcagccacucggccag

SEQ ID NO: 1494086 - RNA, 20 nt, Pseudomonas aeruginosa PA01
gcggcagccacucggccagg

SEQ ID NO: 1494087 - RNA, 22 nt, Pseudomonas aeruginosa PA01
gcggcagccacucggccaggcg

SEQ ID NO: 1494088 - RNA, 18 nt, Pseudomonas aeruginosa PA01
gcggcagcugcggcggca

SEQ ID NO: 1494089 - RNA, 21 nt, Pseudomonas aeruginosa PA01
gcggcagcugcggcggcacca

SEQ ID NO: 1494090 - RNA, 12 nt, Pseudomonas aeruginosa PA01
gcgcucgccguc

SEQ ID NO: 1494091 - RNA, 13 nt, Pseudomonas aeruginosa PA01
gcggcacgcucug

SEQ ID NO: 1494092 - RNA, 18 nt, Pseudomonas aeruginosa PA01
gcggcacgcucuggccgu

SEQ ID NO: 1494093 - RNA, 19 nt, Pseudomonas aeruginosa PA01
gcgcucgcccuugcgccgc

SEQ ID NO: 1494094 - RNA, 17 nt, Pseudomonas aeruginosa PA01
gcggcacggucauggcc

SEQ ID NO: 1494095 - RNA, 21 nt, Pseudomonas aeruginosa PA01
gcggcacggucauggccagcu

SEQ ID NO: 1494096 - RNA, 21 nt, Pseudomonas aeruginosa PA01
gcggcacgcugcuugcgcacc

SEQ ID NO: 1494097 - RNA, 19 nt, Pseudomonas aeruginosa PA01
gcgcuccggaacgccugca

SEQ ID NO: 1494098 - RNA, 17 nt, Pseudomonas aeruginosa PA01
gcgcucgagccggcuga

SEQ ID NO: 1494099 - RNA, 20 nt, Pseudomonas aeruginosa PA01
gcgcucgagcuugaggucgg

SEQ ID NO: 1494100 - RNA, 23 nt, Pseudomonas aeruginosa PA01
gcgcucgagcuugaggucggccu

SEQ ID NO: 1494101 - RNA, 18 nt, Pseudomonas aeruginosa PA01
gcgcucgaggggcgacgg

SEQ ID NO: 1494102 - RNA, 17 nt, Pseudomonas aeruginosa PA01
gcgcucgauagcgucca

SEQ ID NO: 1494103 - RNA, 17 nt, Pseudomonas aeruginosa PA01
gcgcucgacgaucaggu

SEQ ID NO: 1494104 - RNA, 19 nt, Pseudomonas aeruginosa PA01
gcgcucgacgaugcugaac

SEQ ID NO: 1494105 - RNA, 16 nt, Pseudomonas aeruginosa PA01
gcgcucgacggucagc

SEQ ID NO: 1494106 - RNA, 20 nt, Pseudomonas aeruginosa PA01
gcgcuccuggugcggcacca

SEQ ID NO: 1494107 - RNA, 23 nt, Pseudomonas aeruginosa PA01
gcgcuccuggugcggcaccagcc

SEQ ID NO: 1494108 - RNA, 19 nt, Pseudomonas aeruginosa PA01
gcgcuccuguucgucgcgu

SEQ ID NO: 1494109 - RNA, 19 nt, Pseudomonas aeruginosa PA01
gcggcacuucccgcccccu

SEQ ID NO: 1494110 - RNA, 17 nt, Pseudomonas aeruginosa PA01
gcggcacucggcgacca

SEQ ID NO: 1494111 - RNA, 21 nt, Pseudomonas aeruginosa PA01
gcggcacucggcgaccacccg

SEQ ID NO: 1494112 - RNA, 14 nt, Pseudomonas aeruginosa PA01
gcggcacgguggac

SEQ ID NO: 1494113 - RNA, 15 nt, Pseudomonas aeruginosa PA01
aagcgagcgcccgcc

SEQ ID NO: 1494114 - RNA, 22 nt, Pseudomonas aeruginosa PA01
aagcgacgccgcgauggcucgc

SEQ ID NO: 1494115 - RNA, 14 nt, Pseudomonas aeruginosa PA01
gcggccacccgaag

SEQ ID NO: 1494116 - RNA, 18 nt, Pseudomonas aeruginosa PA01
gcggccacuucguccggc

SEQ ID NO: 1494117 - RNA, 19 nt, Pseudomonas aeruginosa PA01
gcggccacuucguccggcc

SEQ ID NO: 1494118 - RNA, 23 nt, Pseudomonas aeruginosa PA01
gcggccacuucguccggccgccc

SEQ ID NO: 1494119 - RNA, 14 nt, Pseudomonas aeruginosa PA01
aagcgcgcgucggc

SEQ ID NO: 1494120 - RNA, 23 nt, Pseudomonas aeruginosa PA01
aagcgcagcuccggcagcagggu

SEQ ID NO: 1494121 - RNA, 22 nt, Pseudomonas aeruginosa PA01
aagcgcaggccgccggcggcca

SEQ ID NO: 1494122 - RNA, 18 nt, Pseudomonas aeruginosa PA01
aagcgcaggcugcgggcg

SEQ ID NO: 1494123 - RNA, 18 nt, Pseudomonas aeruginosa PA01
aagcgcagguagcggcga

SEQ ID NO: 1494124 - RNA, 17 nt, Pseudomonas aeruginosa PA01
aagcgcaggugcaccgc

SEQ ID NO: 1494125 - RNA, 19 nt, Pseudomonas aeruginosa PA01
aagcgcaggugcaccgcgc

SEQ ID NO: 1494126 - RNA, 20 nt, Pseudomonas aeruginosa PA01
aagcgccggcggccugcccc

SEQ ID NO: 1494127 - RNA, 21 nt, Pseudomonas aeruginosa PA01
aagcgccggcggccugccccg

SEQ ID NO: 1494128 - RNA, 13 nt, Pseudomonas aeruginosa PA01
aagcgccucgccu

SEQ ID NO: 1494129 - RNA, 18 nt, Pseudomonas aeruginosa PA01
aagcgcgcccgauugggc

SEQ ID NO: 1494130 - RNA, 17 nt, Pseudomonas aeruginosa PA01
aagcgcccucgcugagc

SEQ ID NO: 1494131 - RNA, 16 nt, Pseudomonas aeruginosa PA01
gcggccagcucgccgg

SEQ ID NO: 1494132 - RNA, 11 nt, Pseudomonas aeruginosa PA01
gcggccaggcg

SEQ ID NO: 1494133 - RNA, 21 nt, Pseudomonas aeruginosa PA01
gcggccagcuucuccagcagg

SEQ ID NO: 1494134 - RNA, 22 nt, Pseudomonas aeruginosa PA01
gcggccagggcgaggccgcucu

SEQ ID NO: 1494135 - RNA, 14 nt, Pseudomonas aeruginosa PA01
gcggccaggcgcuc

SEQ ID NO: 1494136 - RNA, 22 nt, Pseudomonas aeruginosa PA01
gcggccagggcaugggucagcg

SEQ ID NO: 1494137 - RNA, 12 nt, Pseudomonas aeruginosa PA01
gcggccagcgcc

SEQ ID NO: 1494138 - RNA, 13 nt, Pseudomonas aeruginosa PA01
gcggccagcgcca

SEQ ID NO: 1494139 - RNA, 14 nt, Pseudomonas aeruginosa PA01
gcggccagcgccag

SEQ ID NO: 1494140 - RNA, 16 nt, Pseudomonas aeruginosa PA01
gcggccagcgccagga

SEQ ID NO: 1494141 - RNA, 19 nt, Pseudomonas aeruginosa PA01
gcggccagcgccaggagca

SEQ ID NO: 1494142 - RNA, 13 nt, Pseudomonas aeruginosa PA01
gcggccagcgcgg

SEQ ID NO: 1494143 - RNA, 20 nt, Pseudomonas aeruginosa PA01
gcggccagcgcggccgccgc

SEQ ID NO: 1494144 - RNA, 24 nt, Pseudomonas aeruginosa PA01
gcggccagcgcggccgccgccgac

SEQ ID NO: 1494145 - RNA, 19 nt, Pseudomonas aeruginosa PA01
gcggccagcauuuugcgga

SEQ ID NO: 1494146 - RNA, 16 nt, Pseudomonas aeruginosa PA01
gcggccagcagcacgc

SEQ ID NO: 1494147 - RNA, 21 nt, Pseudomonas aeruginosa PA01
gcggccagcagcacgcccugg

SEQ ID NO: 1494148 - RNA, 17 nt, Pseudomonas aeruginosa PA01
gcggccagcagcacggc

SEQ ID NO: 1494149 - RNA, 22 nt, Pseudomonas aeruginosa PA01
gcggccagcagcacggcgacga

SEQ ID NO: 1494150 - RNA, 13 nt, Pseudomonas aeruginosa PA01
gcggccagcagca

SEQ ID NO: 1494151 - RNA, 14 nt, Pseudomonas aeruginosa PA01
gcggccagcccccu

SEQ ID NO: 1494152 - RNA, 14 nt, Pseudomonas aeruginosa PA01
gcggccagccgcua

SEQ ID NO: 1494153 - RNA, 15 nt, Pseudomonas aeruginosa PA01
gcggcggaugccggc

SEQ ID NO: 1494154 - RNA, 17 nt, Pseudomonas aeruginosa PA01
gcggcggaugccggcgc

SEQ ID NO: 1494155 - RNA, 18 nt, Pseudomonas aeruginosa PA01
gcggcggcaggccagcuu

SEQ ID NO: 1494156 - RNA, 15 nt, Pseudomonas aeruginosa PA01
gcggcggcaggucgg

SEQ ID NO: 1494157 - RNA, 11 nt, Pseudomonas aeruginosa PA01
gcggcggcgcg

SEQ ID NO: 1494158 - RNA, 12 nt, Pseudomonas aeruginosa PA01
gcggcggcgccg

SEQ ID NO: 1494159 - RNA, 13 nt, Pseudomonas aeruginosa PA01
gcggcggcgccgg

SEQ ID NO: 1494160 - RNA, 14 nt, Pseudomonas aeruginosa PA01
gcggcggcgccggc

SEQ ID NO: 1494161 - RNA, 15 nt, Pseudomonas aeruginosa PA01
gcggcggcgccggca

SEQ ID NO: 1494162 - RNA, 17 nt, Pseudomonas aeruginosa PA01
gcggcggcgcgucggug

SEQ ID NO: 1494163 - RNA, 23 nt, Pseudomonas aeruginosa PA01
gcggcggguaguguuugcgcagg

SEQ ID NO: 1494164 - RNA, 15 nt, Pseudomonas aeruginosa PA01
gcggcgggucacgcc

SEQ ID NO: 1494165 - RNA, 22 nt, Pseudomonas aeruginosa PA01
gcggcggguagagucgcucgcg

SEQ ID NO: 1494166 - RNA, 18 nt, Pseudomonas aeruginosa PA01
gcggcgguacauggccuu

SEQ ID NO: 1494167 - RNA, 21 nt, Pseudomonas aeruginosa PA01
gcggcgguagccgaggcggcc

SEQ ID NO: 1494168 - RNA, 22 nt, Pseudomonas aeruginosa PA01
gcggcgguagccgaggcggccg

SEQ ID NO: 1494169 - RNA, 23 nt, Pseudomonas aeruginosa PA01
gcggcgguagccgaggcggccga

SEQ ID NO: 1494170 - RNA, 18 nt, Pseudomonas aeruginosa PA01
gcggcgguagcuccaggc

SEQ ID NO: 1494171 - RNA, 21 nt, Pseudomonas aeruginosa PA01
gcggcgguagcuccaggccga

SEQ ID NO: 1494172 - RNA, 15 nt, Pseudomonas aeruginosa PA01
gcggcgguggccgcg

SEQ ID NO: 1494173 - RNA, 17 nt, Pseudomonas aeruginosa PA01
gcggcggugcgccggcg

SEQ ID NO: 1494174 - RNA, 19 nt, Pseudomonas aeruginosa PA01
gcggcggggaaggcgucgg

SEQ ID NO: 1494175 - RNA, 12 nt, Pseudomonas aeruginosa PA01
gcggcggggcca

SEQ ID NO: 1494176 - RNA, 16 nt, Pseudomonas aeruginosa PA01
gcggcggggccaucag

SEQ ID NO: 1494177 - RNA, 14 nt, Pseudomonas aeruginosa PA01
gcggcggcggccag

SEQ ID NO: 1494178 - RNA, 15 nt, Pseudomonas aeruginosa PA01
gcggcggcggccagc

SEQ ID NO: 1494179 - RNA, 13 nt, Pseudomonas aeruginosa PA01
gcggcggcggccg

SEQ ID NO: 1494180 - RNA, 13 nt, Pseudomonas aeruginosa PA01
gcggcgggcgccc

SEQ ID NO: 1494181 - RNA, 19 nt, Pseudomonas aeruginosa PA01
gcggcgggcgcccgccaag

SEQ ID NO: 1494182 - RNA, 21 nt, Pseudomonas aeruginosa PA01
gcggcgggcgcccgccaaggc

SEQ ID NO: 1494183 - RNA, 18 nt, Pseudomonas aeruginosa PA01
gcggcgugaagccgccgc

SEQ ID NO: 1494184 - RNA, 16 nt, Pseudomonas aeruginosa PA01
gcggcgugcaggccga

SEQ ID NO: 1494185 - RNA, 17 nt, Pseudomonas aeruginosa PA01
gcggcgugcaggccgau

SEQ ID NO: 1494186 - RNA, 14 nt, Pseudomonas aeruginosa PA01
gcggcgugcagggu

SEQ ID NO: 1494187 - RNA, 15 nt, Pseudomonas aeruginosa PA01
gcggcguggcgauca

SEQ ID NO: 1494188 - RNA, 23 nt, Pseudomonas aeruginosa PA01
gcggcguggcgaucaggcagcgc

SEQ ID NO: 1494189 - RNA, 16 nt, Pseudomonas aeruginosa PA01
gcggcgguucgccgag

SEQ ID NO: 1494190 - RNA, 16 nt, Pseudomonas aeruginosa PA01
gcggcguaggcggugc

SEQ ID NO: 1494191 - RNA, 18 nt, Pseudomonas aeruginosa PA01
gcggcguaccuucgagca

SEQ ID NO: 1494192 - RNA, 12 nt, Pseudomonas aeruginosa PA01
gcggcguaggcc

SEQ ID NO: 1494193 - RNA, 14 nt, Pseudomonas aeruginosa PA01
gcggcguaggccuc

SEQ ID NO: 1494194 - RNA, 15 nt, Pseudomonas aeruginosa PA01
gcggcguaugcgccu

SEQ ID NO: 1494195 - RNA, 15 nt, Pseudomonas aeruginosa PA01
gcggcguauucgccg

SEQ ID NO: 1494196 - RNA, 16 nt, Pseudomonas aeruginosa PA01
gcggcguauucgccga

SEQ ID NO: 1494197 - RNA, 23 nt, Pseudomonas aeruginosa PA01
gcggcguauucgccgaagauccg

SEQ ID NO: 1494198 - RNA, 20 nt, Pseudomonas aeruginosa PA01
gcggcgaaauggguucccag

SEQ ID NO: 1494199 - RNA, 13 nt, Pseudomonas aeruginosa PA01
gcggcgacgauca

SEQ ID NO: 1494200 - RNA, 19 nt, Pseudomonas aeruginosa PA01
gcggcgacgaagcccaggc

SEQ ID NO: 1494201 - RNA, 21 nt, Pseudomonas aeruginosa PA01
gcggcgacgaaggucggcggc

SEQ ID NO: 1494202 - RNA, 22 nt, Pseudomonas aeruginosa PA01
gcggcgacgaaggucggcggca

SEQ ID NO: 1494203 - RNA, 13 nt, Pseudomonas aeruginosa PA01
gcggcgacgccac

SEQ ID NO: 1494204 - RNA, 16 nt, Pseudomonas aeruginosa PA01
gcggcgacgccacccg

SEQ ID NO: 1494205 - RNA, 13 nt, Pseudomonas aeruginosa PA01
gcggcgacgcugg

SEQ ID NO: 1494206 - RNA, 16 nt, Pseudomonas aeruginosa PA01
gcggcgacgcuggcgg

SEQ ID NO: 1494207 - RNA, 16 nt, Pseudomonas aeruginosa PA01
gcggcgccaccgcgac

SEQ ID NO: 1494208 - RNA, 14 nt, Pseudomonas aeruginosa PA01
gcggcgacggcucu

SEQ ID NO: 1494209 - RNA, 21 nt, Pseudomonas aeruginosa PA01
gcggcgccauagggcacccgg

SEQ ID NO: 1494210 - RNA, 23 nt, Pseudomonas aeruginosa PA01
gcggcgccagcgccccaccaggc

SEQ ID NO: 1494211 - RNA, 13 nt, Pseudomonas aeruginosa PA01
gcggcgccaggcc

SEQ ID NO: 1494212 - RNA, 14 nt, Pseudomonas aeruginosa PA01
gcggcgccaggccg

SEQ ID NO: 1494213 - RNA, 15 nt, Pseudomonas aeruginosa PA01
gcggcgccaggccgg

SEQ ID NO: 1494214 - RNA, 18 nt, Pseudomonas aeruginosa PA01
gcggcgccaggccggcga

SEQ ID NO: 1494215 - RNA, 12 nt, Pseudomonas aeruginosa PA01
gcggcgccagcu

SEQ ID NO: 1494216 - RNA, 20 nt, Pseudomonas aeruginosa PA01
gcggcgccagcuccagcgcc

SEQ ID NO: 1494217 - RNA, 17 nt, Pseudomonas aeruginosa PA01
gcggcgccccaggcgcc

SEQ ID NO: 1494218 - RNA, 22 nt, Pseudomonas aeruginosa PA01
gcggcgccccaggcgcccaggc

SEQ ID NO: 1494219 - RNA, 20 nt, Pseudomonas aeruginosa PA01
gcggcgccggugaggcgcag

SEQ ID NO: 1494220 - RNA, 22 nt, Pseudomonas aeruginosa PA01
gcggcgccgguugcugcugcgg

SEQ ID NO: 1494221 - RNA, 15 nt, Pseudomonas aeruginosa PA01
gcggcgccugcugcg

SEQ ID NO: 1494222 - RNA, 12 nt, Pseudomonas aeruginosa PA01
gcggcgccuggc

SEQ ID NO: 1494223 - RNA, 15 nt, Pseudomonas aeruginosa PA01
gcggcgccuggcgua

SEQ ID NO: 1494224 - RNA, 22 nt, Pseudomonas aeruginosa PA01
gcggcgccuagacccugggcca

SEQ ID NO: 1494225 - RNA, 20 nt, Pseudomonas aeruginosa PA01
gcggcgccucgaagcggauc

SEQ ID NO: 1494226 - RNA, 17 nt, Pseudomonas aeruginosa PA01
gcggcgcgagaugaagc

SEQ ID NO: 1494227 - RNA, 19 nt, Pseudomonas aeruginosa PA01
aagcggguucccugcgccu

SEQ ID NO: 1494228 - RNA, 19 nt, Pseudomonas aeruginosa PA01
gcggcgcggagauccccuc

SEQ ID NO: 1494229 - RNA, 17 nt, Pseudomonas aeruginosa PA01
aagcggucguagcccau

SEQ ID NO: 1494230 - RNA, 21 nt, Pseudomonas aeruginosa PA01
gcggcgccuucagcgccgcca

SEQ ID NO: 1494231 - RNA, 22 nt, Pseudomonas aeruginosa PA01
gcggcgccuucagcgccgccag

SEQ ID NO: 1494232 - RNA, 17 nt, Pseudomonas aeruginosa PA01
gcggcgccuucgccgga

SEQ ID NO: 1494233 - RNA, 20 nt, Pseudomonas aeruginosa PA01
gcggcgccuugcgguccagc

SEQ ID NO: 1494234 - RNA, 23 nt, Pseudomonas aeruginosa PA01
gcggcgccuugcgguccagcgag

SEQ ID NO: 1494235 - RNA, 12 nt, Pseudomonas aeruginosa PA01
gcggcgcgaacc

SEQ ID NO: 1494236 - RNA, 19 nt, Pseudomonas aeruginosa PA01
gcggcgcgaaccagcagca

SEQ ID NO: 1494237 - RNA, 20 nt, Pseudomonas aeruginosa PA01
aagcgguucucguccagguc

SEQ ID NO: 1494238 - RNA, 16 nt, Pseudomonas aeruginosa PA01
aagcgguuagccggcg

SEQ ID NO: 1494239 - RNA, 18 nt, Pseudomonas aeruginosa PA01
aagcgguuagccggcgau

SEQ ID NO: 1494240 - RNA, 16 nt, Pseudomonas aeruginosa PA01
aagcgguuucgccacc

SEQ ID NO: 1494241 - RNA, 17 nt, Pseudomonas aeruginosa PA01
aagcgguuucgccaccu

SEQ ID NO: 1494242 - RNA, 14 nt, Pseudomonas aeruginosa PA01
aagcgucgugcgcc

SEQ ID NO: 1494243 - RNA, 16 nt, Pseudomonas aeruginosa PA01
aagcgucgugcgccgg

SEQ ID NO: 1494244 - RNA, 17 nt, Pseudomonas aeruginosa PA01
aagcgucgugcgccggc

SEQ ID NO: 1494245 - RNA, 14 nt, Pseudomonas aeruginosa PA01
aagcgucagcgcgc

SEQ ID NO: 1494246 - RNA, 16 nt, Pseudomonas aeruginosa PA01
aagcgucagcgcgcca

SEQ ID NO: 1494247 - RNA, 12 nt, Pseudomonas aeruginosa PA01
gcggcgcucggc

SEQ ID NO: 1494248 - RNA, 14 nt, Pseudomonas aeruginosa PA01
gcggcgcucgggau

SEQ ID NO: 1494249 - RNA, 23 nt, Pseudomonas aeruginosa PA01
gcggcgcuacgaaggcgugccgc

SEQ ID NO: 1494250 - RNA, 16 nt, Pseudomonas aeruginosa PA01
gcggcgcuauccgccg

SEQ ID NO: 1494251 - RNA, 20 nt, Pseudomonas aeruginosa PA01
gcggcgcucacccacauggc

SEQ ID NO: 1494252 - RNA, 22 nt, Pseudomonas aeruginosa PA01
gcggcgcucacccacauggcgg

SEQ ID NO: 1494253 - RNA, 17 nt, Pseudomonas aeruginosa PA01
gcggcgcguuccacguc

SEQ ID NO: 1494254 - RNA, 21 nt, Pseudomonas aeruginosa PA01
gcggcgcguccaccuggcggc

SEQ ID NO: 1494255 - RNA, 22 nt, Pseudomonas aeruginosa PA01
gcggcggacgcaggccgaccuc

SEQ ID NO: 1494256 - RNA, 16 nt, Pseudomonas aeruginosa PA01
gcggcggaccuccgcc

SEQ ID NO: 1494257 - RNA, 17 nt, Pseudomonas aeruginosa PA01
gcggcggaccuccgcca

SEQ ID NO: 1494258 - RNA, 18 nt, Pseudomonas aeruginosa PA01
gcggcggaccuccgccag

SEQ ID NO: 1494259 - RNA, 14 nt, Pseudomonas aeruginosa PA01
gcggcggacgacga

SEQ ID NO: 1494260 - RNA, 16 nt, Pseudomonas aeruginosa PA01
gcggcggauaaccgcg

SEQ ID NO: 1494261 - RNA, 20 nt, Pseudomonas aeruginosa PA01
gcggcggauaaccgcgagcg

SEQ ID NO: 1494262 - RNA, 21 nt, Pseudomonas aeruginosa PA01
gcggcggauaacgcccgcggc

SEQ ID NO: 1494263 - RNA, 17 nt, Pseudomonas aeruginosa PA01
gcggcggauacaggcgc

SEQ ID NO: 1494264 - RNA, 21 nt, Pseudomonas aeruginosa PA01
gcggcggauacaggcgcagca

SEQ ID NO: 1494265 - RNA, 16 nt, Pseudomonas aeruginosa PA01
gcggcgcugaggauca

SEQ ID NO: 1494266 - RNA, 18 nt, Pseudomonas aeruginosa PA01
gcggcgcugaggaucagc

SEQ ID NO: 1494267 - RNA, 21 nt, Pseudomonas aeruginosa PA01
gcggcgcugaggaucagccag

SEQ ID NO: 1494268 - RNA, 16 nt, Pseudomonas aeruginosa PA01
gcgggccagcagcucc

SEQ ID NO: 1494269 - RNA, 18 nt, Pseudomonas aeruginosa PA01
gcgggccagcagcuccgg

SEQ ID NO: 1494270 - RNA, 16 nt, Pseudomonas aeruginosa PA01
gcgggccagcaggcgc

SEQ ID NO: 1494271 - RNA, 17 nt, Pseudomonas aeruginosa PA01
gcgggccagcaggcgcu

SEQ ID NO: 1494272 - RNA, 18 nt, Pseudomonas aeruginosa PA01
gcgggccagcaggcgcuc

SEQ ID NO: 1494273 - RNA, 22 nt, Pseudomonas aeruginosa PA01
gcgggccagcaggcgcucggcg

SEQ ID NO: 1494274 - RNA, 21 nt, Pseudomonas aeruginosa PA01
gcgggccagcaggguggccag

SEQ ID NO: 1494275 - RNA, 22 nt, Pseudomonas aeruginosa PA01
gcgggccagcaggguggccagg

SEQ ID NO: 1494276 - RNA, 23 nt, Pseudomonas aeruginosa PA01
gcgggccagcaggguggccaggg

SEQ ID NO: 1494277 - RNA, 15 nt, Pseudomonas aeruginosa PA01
gcgggcaugcaccua

SEQ ID NO: 1494278 - RNA, 18 nt, Pseudomonas aeruginosa PA01
gcgggcaugcaccuacca

SEQ ID NO: 1494279 - RNA, 17 nt, Pseudomonas aeruginosa PA01
gcgggcaugcugcucgg

SEQ ID NO: 1494280 - RNA, 15 nt, Pseudomonas aeruginosa PA01
gcgggcauggaucuc

SEQ ID NO: 1494281 - RNA, 13 nt, Pseudomonas aeruginosa PA01
gcgggccgagguc

SEQ ID NO: 1494282 - RNA, 12 nt, Pseudomonas aeruginosa PA01
gcgggccgcggc

SEQ ID NO: 1494283 - RNA, 17 nt, Pseudomonas aeruginosa PA01
gcgggccgcggcgacca

SEQ ID NO: 1494284 - RNA, 22 nt, Pseudomonas aeruginosa PA01
gcgggccgcucaggaugcgaug

SEQ ID NO: 1494285 - RNA, 19 nt, Pseudomonas aeruginosa PA01
gcgggccgcucgcgcggca

SEQ ID NO: 1494286 - RNA, 16 nt, Pseudomonas aeruginosa PA01
gcgggccgccuggucg

SEQ ID NO: 1494287 - RNA, 16 nt, Pseudomonas aeruginosa PA01
gcgggccggcguccag

SEQ ID NO: 1494288 - RNA, 16 nt, Pseudomonas aeruginosa PA01
gcgggccggcgauggc

SEQ ID NO: 1494289 - RNA, 15 nt, Pseudomonas aeruginosa PA01
gcgggccggggaucg

SEQ ID NO: 1494290 - RNA, 14 nt, Pseudomonas aeruginosa PA01
gcgggccucggcgg

SEQ ID NO: 1494291 - RNA, 18 nt, Pseudomonas aeruginosa PA01
gcgggccuggugagcgga

SEQ ID NO: 1494292 - RNA, 12 nt, Pseudomonas aeruginosa PA01
gcgggcgaacgg

SEQ ID NO: 1494293 - RNA, 15 nt, Pseudomonas aeruginosa PA01
gcgggcgaacggcag

SEQ ID NO: 1494294 - RNA, 18 nt, Pseudomonas aeruginosa PA01
gcgggcgaacggcagcgu

SEQ ID NO: 1494295 - RNA, 14 nt, Pseudomonas aeruginosa PA01
gcgggcgaaggccu

SEQ ID NO: 1494296 - RNA, 22 nt, Pseudomonas aeruginosa PA01
gcgggcgaaguagaagcgcgcg

SEQ ID NO: 1494297 - RNA, 17 nt, Pseudomonas aeruginosa PA01
gcgggccuugcgaccag

SEQ ID NO: 1494298 - RNA, 18 nt, Pseudomonas aeruginosa PA01
gcgggccuugcgaccagg

SEQ ID NO: 1494299 - RNA, 19 nt, Pseudomonas aeruginosa PA01
gcgggccuugcgaccaggu

SEQ ID NO: 1494300 - RNA, 18 nt, Pseudomonas aeruginosa PA01
gcgggccuugaccaccgc

SEQ ID NO: 1494301 - RNA, 20 nt, Pseudomonas aeruginosa PA01
gcgggccuugaccaccgcca

SEQ ID NO: 1494302 - RNA, 21 nt, Pseudomonas aeruginosa PA01
gcgggccuugaccaccgccag

SEQ ID NO: 1494303 - RNA, 22 nt, Pseudomonas aeruginosa PA01
gcgggccuugaccaccgccagg

SEQ ID NO: 1494304 - RNA, 16 nt, Pseudomonas aeruginosa PA01
gcgggcaaccgcggcg

SEQ ID NO: 1494305 - RNA, 20 nt, Pseudomonas aeruginosa PA01
gcgggcaaccgcggcggccu

SEQ ID NO: 1494306 - RNA, 15 nt, Pseudomonas aeruginosa PA01
gcgggauugucgccg

SEQ ID NO: 1494307 - RNA, 18 nt, Pseudomonas aeruginosa PA01
gcgggauugucgccgccg

SEQ ID NO: 1494308 - RNA, 18 nt, Pseudomonas aeruginosa PA01
gcgggaugugcaccagca

SEQ ID NO: 1494309 - RNA, 20 nt, Pseudomonas aeruginosa PA01
gcgggaugugcaccagcaac

SEQ ID NO: 1494310 - RNA, 23 nt, Pseudomonas aeruginosa PA01
gcgggaucuccgcgccacgcgca

SEQ ID NO: 1494311 - RNA, 20 nt, Pseudomonas aeruginosa PA01
gcgggaucuucuaccuggcg

SEQ ID NO: 1494312 - RNA, 22 nt, Pseudomonas aeruginosa PA01
gcgggaucuucuaccuggcgcu

SEQ ID NO: 1494313 - RNA, 21 nt, Pseudomonas aeruginosa PA01
gcgggaagcguuccuggaagc

SEQ ID NO: 1494314 - RNA, 13 nt, Pseudomonas aeruginosa PA01
gcgggaaggucgg

SEQ ID NO: 1494315 - RNA, 14 nt, Pseudomonas aeruginosa PA01
gcgggaaggucggc

SEQ ID NO: 1494316 - RNA, 16 nt, Pseudomonas aeruginosa PA01
gcgggaaggucggcag

SEQ ID NO: 1494317 - RNA, 17 nt, Pseudomonas aeruginosa PA01
gcgggaaggucggcagc

SEQ ID NO: 1494318 - RNA, 18 nt, Pseudomonas aeruginosa PA01
gcgggaaggucggcagca

SEQ ID NO: 1494319 - RNA, 20 nt, Pseudomonas aeruginosa PA01
gcgggaaggucggcagcagc

SEQ ID NO: 1494320 - RNA, 14 nt, Pseudomonas aeruginosa PA01
gcggcuucggucag

SEQ ID NO: 1494321 - RNA, 16 nt, Pseudomonas aeruginosa PA01
gcggcuucagagcugg

SEQ ID NO: 1494322 - RNA, 18 nt, Pseudomonas aeruginosa PA01
gcggcuucagagcuggac

SEQ ID NO: 1494323 - RNA, 19 nt, Pseudomonas aeruginosa PA01
gcggcuucagagcuggacg

SEQ ID NO: 1494324 - RNA, 14 nt, Pseudomonas aeruginosa PA01
gcggcuucagccag

SEQ ID NO: 1494325 - RNA, 22 nt, Pseudomonas aeruginosa PA01
gcggcuucagccagaccggcag

SEQ ID NO: 1494326 - RNA, 16 nt, Pseudomonas aeruginosa PA01
gcgggaaacgcagcga

SEQ ID NO: 1494327 - RNA, 22 nt, Pseudomonas aeruginosa PA01
gcggcuuuuuucauggcgguca

SEQ ID NO: 1494328 - RNA, 23 nt, Pseudomonas aeruginosa PA01
gcggcuuuuuucauggcggucag

SEQ ID NO: 1494329 - RNA, 23 nt, Pseudomonas aeruginosa PA01
gcggcuuuuuucguugcgccugc

SEQ ID NO: 1494330 - RNA, 19 nt, Pseudomonas aeruginosa PA01
gcgggaacggcguaccagg

SEQ ID NO: 1494331 - RNA, 19 nt, Pseudomonas aeruginosa PA01
gcggcuggcaggugccgcu

SEQ ID NO: 1494332 - RNA, 23 nt, Pseudomonas aeruginosa PA01
gcggcugcugucguuccggcuca

SEQ ID NO: 1494333 - RNA, 18 nt, Pseudomonas aeruginosa PA01
gcggcugcuugccgcuca

SEQ ID NO: 1494334 - RNA, 12 nt, Pseudomonas aeruginosa PA01
gcggcuggccgc

SEQ ID NO: 1494335 - RNA, 13 nt, Pseudomonas aeruginosa PA01
gcggcuggccgcc

SEQ ID NO: 1494336 - RNA, 14 nt, Pseudomonas aeruginosa PA01
gcggcuggccgccu

SEQ ID NO: 1494337 - RNA, 21 nt, Pseudomonas aeruginosa PA01
gcggcuggccgccuggccggc

SEQ ID NO: 1494338 - RNA, 23 nt, Pseudomonas aeruginosa PA01
gcggcuggccgccuggccggcca

SEQ ID NO: 1494339 - RNA, 12 nt, Pseudomonas aeruginosa PA01
gcggcugcugcg

SEQ ID NO: 1494340 - RNA, 17 nt, Pseudomonas aeruginosa PA01
gcggcugcugcgccugg

SEQ ID NO: 1494341 - RNA, 13 nt, Pseudomonas aeruginosa PA01
gcggcugccgagg

SEQ ID NO: 1494342 - RNA, 14 nt, Pseudomonas aeruginosa PA01
gcggcugccggugc

SEQ ID NO: 1494343 - RNA, 15 nt, Pseudomonas aeruginosa PA01
gcggcugccggugcc

SEQ ID NO: 1494344 - RNA, 20 nt, Pseudomonas aeruginosa PA01
gcggcugagcuguuucagcc

SEQ ID NO: 1494345 - RNA, 16 nt, Pseudomonas aeruginosa PA01
gcggcucuuuccgggu

SEQ ID NO: 1494346 - RNA, 19 nt, Pseudomonas aeruginosa PA01
gcggcucuuuccgggucau

SEQ ID NO: 1494347 - RNA, 22 nt, Pseudomonas aeruginosa PA01
gcggcucuuuccgggucauugg

SEQ ID NO: 1494348 - RNA, 17 nt, Pseudomonas aeruginosa PA01
gcggcugcagggccagg

SEQ ID NO: 1494349 - RNA, 18 nt, Pseudomonas aeruginosa PA01
gcggcugcagggccaggg

SEQ ID NO: 1494350 - RNA, 19 nt, Pseudomonas aeruginosa PA01
gcggcugcagggccaggga

SEQ ID NO: 1494351 - RNA, 18 nt, Pseudomonas aeruginosa PA01
gcggcugaucggccgcca

SEQ ID NO: 1494352 - RNA, 22 nt, Pseudomonas aeruginosa PA01
gcggcugaucggccgccagugc

SEQ ID NO: 1494353 - RNA, 20 nt, Pseudomonas aeruginosa PA01
gcggcuguagccacggcgag

SEQ ID NO: 1494354 - RNA, 22 nt, Pseudomonas aeruginosa PA01
gcggcugguucugguccaccag

SEQ ID NO: 1494355 - RNA, 16 nt, Pseudomonas aeruginosa PA01
gcggcuguugccguuc

SEQ ID NO: 1494356 - RNA, 23 nt, Pseudomonas aeruginosa PA01
gcggcuguagcggaucaggccca

SEQ ID NO: 1494357 - RNA, 15 nt, Pseudomonas aeruginosa PA01
gcggcugggcugcgg

SEQ ID NO: 1494358 - RNA, 24 nt, Pseudomonas aeruginosa PA01
gcggcugggucgauuccugucucc

SEQ ID NO: 1494359 - RNA, 14 nt, Pseudomonas aeruginosa PA01
gcggcugggugucg

SEQ ID NO: 1494360 - RNA, 18 nt, Pseudomonas aeruginosa PA01
gcggcugggugucgaccu

SEQ ID NO: 1494361 - RNA, 22 nt, Pseudomonas aeruginosa PA01
gcggcugggugucgaccuccgc

SEQ ID NO: 1494362 - RNA, 17 nt, Pseudomonas aeruginosa PA01
gcggcuggcugaagccg

SEQ ID NO: 1494363 - RNA, 15 nt, Pseudomonas aeruginosa PA01
gcggcuggccgagga

SEQ ID NO: 1494364 - RNA, 15 nt, Pseudomonas aeruginosa PA01
gcggcuggccgucga

SEQ ID NO: 1494365 - RNA, 21 nt, Pseudomonas aeruginosa PA01
gcggcuggcgaaccaguccag

SEQ ID NO: 1494366 - RNA, 16 nt, Pseudomonas aeruginosa PA01
gcggcuggcgcgaucg

SEQ ID NO: 1494367 - RNA, 14 nt, Pseudomonas aeruginosa PA01
gcggcuggcgcuug

SEQ ID NO: 1494368 - RNA, 13 nt, Pseudomonas aeruginosa PA01
gcggcuggcgggc

SEQ ID NO: 1494369 - RNA, 15 nt, Pseudomonas aeruginosa PA01
gcggcuggcgggcga

SEQ ID NO: 1494370 - RNA, 17 nt, Pseudomonas aeruginosa PA01
gcggcguuggccgagga

SEQ ID NO: 1494371 - RNA, 22 nt, Pseudomonas aeruginosa PA01
gcggcguuggccgaggaggcca

SEQ ID NO: 1494372 - RNA, 18 nt, Pseudomonas aeruginosa PA01
gcggcguugcgcggaauc

SEQ ID NO: 1494373 - RNA, 15 nt, Pseudomonas aeruginosa PA01
gcggcuccagccgcu

SEQ ID NO: 1494374 - RNA, 16 nt, Pseudomonas aeruginosa PA01
gcggcguucgcccugc

SEQ ID NO: 1494375 - RNA, 17 nt, Pseudomonas aeruginosa PA01
gcggcguucgccgagca

SEQ ID NO: 1494376 - RNA, 14 nt, Pseudomonas aeruginosa PA01
gcggcguucgccgc

SEQ ID NO: 1494377 - RNA, 15 nt, Pseudomonas aeruginosa PA01
gcggcguggcaccgc

SEQ ID NO: 1494378 - RNA, 15 nt, Pseudomonas aeruginosa PA01
gcggcguuauccgcc

SEQ ID NO: 1494379 - RNA, 16 nt, Pseudomonas aeruginosa PA01
gcggcuccucggccug

SEQ ID NO: 1494380 - RNA, 20 nt, Pseudomonas aeruginosa PA01
gcggcuccuggaugcuccgc

SEQ ID NO: 1494381 - RNA, 15 nt, Pseudomonas aeruginosa PA01
gcggcuccggcgcca

SEQ ID NO: 1494382 - RNA, 20 nt, Pseudomonas aeruginosa PA01
gcggcuccggcgccaggccg

SEQ ID NO: 1494383 - RNA, 23 nt, Pseudomonas aeruginosa PA01
gcggcuccggcgccaggccggag

SEQ ID NO: 1494384 - RNA, 13 nt, Pseudomonas aeruginosa PA01
gcggcucgccgaa

SEQ ID NO: 1494385 - RNA, 14 nt, Pseudomonas aeruginosa PA01
gcggcucgccgaaa

SEQ ID NO: 1494386 - RNA, 13 nt, Pseudomonas aeruginosa PA01
gcggcucgccgau

SEQ ID NO: 1494387 - RNA, 13 nt, Pseudomonas aeruginosa PA01
gcggcucggcggg

SEQ ID NO: 1494388 - RNA, 19 nt, Pseudomonas aeruginosa PA01
gcggcucggcgggcugccg

SEQ ID NO: 1494389 - RNA, 16 nt, Pseudomonas aeruginosa PA01
gcggcucggcuccagg

SEQ ID NO: 1494390 - RNA, 21 nt, Pseudomonas aeruginosa PA01
gcggcucggcugcuugccggu

SEQ ID NO: 1494391 - RNA, 15 nt, Pseudomonas aeruginosa PA01
gcggcucgggcggca

SEQ ID NO: 1494392 - RNA, 21 nt, Pseudomonas aeruginosa PA01
gcggcugaagaagcugcccca

SEQ ID NO: 1494393 - RNA, 23 nt, Pseudomonas aeruginosa PA01
gcggcugaagaagcugccccaca

SEQ ID NO: 1494394 - RNA, 14 nt, Pseudomonas aeruginosa PA01
gcggcugaaggccg

SEQ ID NO: 1494395 - RNA, 15 nt, Pseudomonas aeruginosa PA01
gcggcugaaggccga

SEQ ID NO: 1494396 - RNA, 18 nt, Pseudomonas aeruginosa PA01
gcggcugaaggccgaacg

SEQ ID NO: 1494397 - RNA, 14 nt, Pseudomonas aeruginosa PA01
gcggcucuggcgca

SEQ ID NO: 1494398 - RNA, 18 nt, Pseudomonas aeruginosa PA01
gcggcucgucaucgucca

SEQ ID NO: 1494399 - RNA, 19 nt, Pseudomonas aeruginosa PA01
gcggcucgucaucguccag

SEQ ID NO: 1494400 - RNA, 20 nt, Pseudomonas aeruginosa PA01
gcggcucgucaucguccagc

SEQ ID NO: 1494401 - RNA, 14 nt, Pseudomonas aeruginosa PA01
gcggcucggccagg

SEQ ID NO: 1494402 - RNA, 15 nt, Pseudomonas aeruginosa PA01
gcggcucggccaggg

SEQ ID NO: 1494403 - RNA, 22 nt, Pseudomonas aeruginosa PA01
gcggcucggccagggccgcucg

SEQ ID NO: 1494404 - RNA, 17 nt, Pseudomonas aeruginosa PA01
gcgucaacgaagucgcg

SEQ ID NO: 1494405 - RNA, 18 nt, Pseudomonas aeruginosa PA01
gcgucaacgaagucgcga

SEQ ID NO: 1494406 - RNA, 18 nt, Pseudomonas aeruginosa PA01
gcguaguugagccccagg

SEQ ID NO: 1494407 - RNA, 14 nt, Pseudomonas aeruginosa PA01
gcguauaaccgcuc

SEQ ID NO: 1494408 - RNA, 18 nt, Pseudomonas aeruginosa PA01
gcguagugcaucagccug

SEQ ID NO: 1494409 - RNA, 22 nt, Pseudomonas aeruginosa PA01
gcguagugcaucagccuggcca

SEQ ID NO: 1494410 - RNA, 12 nt, Pseudomonas aeruginosa PA01
gcgucaacggug

SEQ ID NO: 1494411 - RNA, 20 nt, Pseudomonas aeruginosa PA01
gcguagguggcgccgccggc

SEQ ID NO: 1494412 - RNA, 21 nt, Pseudomonas aeruginosa PA01
gcguaguaggcacaggacccu

SEQ ID NO: 1494413 - RNA, 17 nt, Pseudomonas aeruginosa PA01
gcguagccccucgcgca

SEQ ID NO: 1494414 - RNA, 17 nt, Pseudomonas aeruginosa PA01
gcguagaggcucggcgg

SEQ ID NO: 1494415 - RNA, 16 nt, Pseudomonas aeruginosa PA01
gcguagaccaucgccg

SEQ ID NO: 1494416 - RNA, 18 nt, Pseudomonas aeruginosa PA01
gcguagaccaucgccggc

SEQ ID NO: 1494417 - RNA, 22 nt, Pseudomonas aeruginosa PA01
gcguagaccaucgccggcgagc

SEQ ID NO: 1494418 - RNA, 23 nt, Pseudomonas aeruginosa PA01
gcguagaccaucgccggcgagcc

SEQ ID NO: 1494419 - RNA, 17 nt, Pseudomonas aeruginosa PA01
gcguagaccuucucguc

SEQ ID NO: 1494420 - RNA, 23 nt, Pseudomonas aeruginosa PA01
gcguagaccaccucgacggcgau

SEQ ID NO: 1494421 - RNA, 13 nt, Pseudomonas aeruginosa PA01
gcguacuuggccc

SEQ ID NO: 1494422 - RNA, 19 nt, Pseudomonas aeruginosa PA01
gcguagaaacgcgccuccg

SEQ ID NO: 1494423 - RNA, 21 nt, Pseudomonas aeruginosa PA01
gcguccauggcggcgauggac

SEQ ID NO: 1494424 - RNA, 18 nt, Pseudomonas aeruginosa PA01
gcgucccauggcgccacg

SEQ ID NO: 1494425 - RNA, 19 nt, Pseudomonas aeruginosa PA01
gcgucccauggcgccacgc

SEQ ID NO: 1494426 - RNA, 18 nt, Pseudomonas aeruginosa PA01
gcgucccggcgccgcccu

SEQ ID NO: 1494427 - RNA, 15 nt, Pseudomonas aeruginosa PA01
gcgucccgcuccagc

SEQ ID NO: 1494428 - RNA, 13 nt, Pseudomonas aeruginosa PA01
gcgucccgcagua

SEQ ID NO: 1494429 - RNA, 18 nt, Pseudomonas aeruginosa PA01
gcgucccguuccggcgca

SEQ ID NO: 1494430 - RNA, 19 nt, Pseudomonas aeruginosa PA01
gcgucccguuccggcgcag

SEQ ID NO: 1494431 - RNA, 20 nt, Pseudomonas aeruginosa PA01
gcgucccguuccggcgcagc

SEQ ID NO: 1494432 - RNA, 17 nt, Pseudomonas aeruginosa PA01
gcguccaggugcggcug

SEQ ID NO: 1494433 - RNA, 18 nt, Pseudomonas aeruginosa PA01
gcguccaggugcggcugg

SEQ ID NO: 1494434 - RNA, 19 nt, Pseudomonas aeruginosa PA01
gcguccauccccgccucga

SEQ ID NO: 1494435 - RNA, 13 nt, Pseudomonas aeruginosa PA01
gcguccaggugcg

SEQ ID NO: 1494436 - RNA, 17 nt, Pseudomonas aeruginosa PA01
gcguccaguagcgccug

SEQ ID NO: 1494437 - RNA, 18 nt, Pseudomonas aeruginosa PA01
gcguccaguagcgccugg

SEQ ID NO: 1494438 - RNA, 13 nt, Pseudomonas aeruginosa PA01
gcguccagcucca

SEQ ID NO: 1494439 - RNA, 19 nt, Pseudomonas aeruginosa PA01
gcguccagcuccaccaggc

SEQ ID NO: 1494440 - RNA, 20 nt, Pseudomonas aeruginosa PA01
gcguccagcuccaccaggcc

SEQ ID NO: 1494441 - RNA, 19 nt, Pseudomonas aeruginosa PA01
gcguccagcucgucgugga

SEQ ID NO: 1494442 - RNA, 18 nt, Pseudomonas aeruginosa PA01
gcgucagcgaggcgggcg

SEQ ID NO: 1494443 - RNA, 22 nt, Pseudomonas aeruginosa PA01
gcgucagcgaggcgggcgcgga

SEQ ID NO: 1494444 - RNA, 16 nt, Pseudomonas aeruginosa PA01
gcgucagcgcgccagc

SEQ ID NO: 1494445 - RNA, 14 nt, Pseudomonas aeruginosa PA01
gcgucagccgcggc

SEQ ID NO: 1494446 - RNA, 17 nt, Pseudomonas aeruginosa PA01
gcgucagccgcggccgg

SEQ ID NO: 1494447 - RNA, 18 nt, Pseudomonas aeruginosa PA01
gcgucagccgcggccggg

SEQ ID NO: 1494448 - RNA, 14 nt, Pseudomonas aeruginosa PA01
gcgucgaccgccug

SEQ ID NO: 1494449 - RNA, 18 nt, Pseudomonas aeruginosa PA01
gcgucgaccgccugccag

SEQ ID NO: 1494450 - RNA, 18 nt, Pseudomonas aeruginosa PA01
gcgucgcaggcgaugccg

SEQ ID NO: 1494451 - RNA, 20 nt, Pseudomonas aeruginosa PA01
gcgucgcaggcgaugccgac

SEQ ID NO: 1494452 - RNA, 16 nt, Pseudomonas aeruginosa PA01
gcgucgcacugcugcu

SEQ ID NO: 1494453 - RNA, 14 nt, Pseudomonas aeruginosa PA01
gcgucgcaccaggu

SEQ ID NO: 1494454 - RNA, 14 nt, Pseudomonas aeruginosa PA01
gcgucgcacccggc

SEQ ID NO: 1494455 - RNA, 21 nt, Pseudomonas aeruginosa PA01
gcguccucagccucacccugc

SEQ ID NO: 1494456 - RNA, 22 nt, Pseudomonas aeruginosa PA01
gcguccucagccucacccugcu

SEQ ID NO: 1494457 - RNA, 18 nt, Pseudomonas aeruginosa PA01
gcguccugccucggaggc

SEQ ID NO: 1494458 - RNA, 19 nt, Pseudomonas aeruginosa PA01
gcguccugcucccuggcgg

SEQ ID NO: 1494459 - RNA, 20 nt, Pseudomonas aeruginosa PA01
gcguccguaaugcaacccgc

SEQ ID NO: 1494460 - RNA, 22 nt, Pseudomonas aeruginosa PA01
gcguccguaaugcaacccgccg

SEQ ID NO: 1494461 - RNA, 20 nt, Pseudomonas aeruginosa PA01
gcguccgggugccccaggcg

SEQ ID NO: 1494462 - RNA, 21 nt, Pseudomonas aeruginosa PA01
gcguccgggugccccaggcga

SEQ ID NO: 1494463 - RNA, 24 nt, Pseudomonas aeruginosa PA01
gcguccgggugccccaggcgaguc

SEQ ID NO: 1494464 - RNA, 23 nt, Pseudomonas aeruginosa PA01
gcguccgguaugccgaucaugcu

SEQ ID NO: 1494465 - RNA, 19 nt, Pseudomonas aeruginosa PA01
gcguccgagagcagggccu

SEQ ID NO: 1494466 - RNA, 20 nt, Pseudomonas aeruginosa PA01
gcguccgagagcagggccug

SEQ ID NO: 1494467 - RNA, 14 nt, Pseudomonas aeruginosa PA01
gcgucccuggagca

SEQ ID NO: 1494468 - RNA, 20 nt, Pseudomonas aeruginosa PA01
gcgucccuggagcagggcga

SEQ ID NO: 1494469 - RNA, 13 nt, Pseudomonas aeruginosa PA01
gcgucccuuggcg

SEQ ID NO: 1494470 - RNA, 19 nt, Pseudomonas aeruginosa PA01
gcgucccuuggcgucgcgg

SEQ ID NO: 1494471 - RNA, 20 nt, Pseudomonas aeruginosa PA01
gcgucccuuggcgucgcggc

SEQ ID NO: 1494472 - RNA, 21 nt, Pseudomonas aeruginosa PA01
gcgucccuuguuuuccuggcc

SEQ ID NO: 1494473 - RNA, 22 nt, Pseudomonas aeruginosa PA01
gcgucccuuguuuuccuggccc

SEQ ID NO: 1494474 - RNA, 23 nt, Pseudomonas aeruginosa PA01
gcgucccuuguuuuccuggcccu

SEQ ID NO: 1494475 - RNA, 13 nt, Pseudomonas aeruginosa PA01
gcgucgcugcgca

SEQ ID NO: 1494476 - RNA, 20 nt, Pseudomonas aeruginosa PA01
gcgucgcugccgccgcgccc

SEQ ID NO: 1494477 - RNA, 15 nt, Pseudomonas aeruginosa PA01
gcgucgcugccgcug

SEQ ID NO: 1494478 - RNA, 15 nt, Pseudomonas aeruginosa PA01
gcgucgcgucggccu

SEQ ID NO: 1494479 - RNA, 20 nt, Pseudomonas aeruginosa PA01
gcgucgcggccucuucgucg

SEQ ID NO: 1494480 - RNA, 23 nt, Pseudomonas aeruginosa PA01
gcgucgcggccucuucgucggcg

SEQ ID NO: 1494481 - RNA, 20 nt, Pseudomonas aeruginosa PA01
gcgucgcggucuuccgccga

SEQ ID NO: 1494482 - RNA, 15 nt, Pseudomonas aeruginosa PA01
gcgucgcgcggccag

SEQ ID NO: 1494483 - RNA, 13 nt, Pseudomonas aeruginosa PA01
gcgucgcgccagc

SEQ ID NO: 1494484 - RNA, 14 nt, Pseudomonas aeruginosa PA01
gcgucgcgccagca

SEQ ID NO: 1494485 - RNA, 15 nt, Pseudomonas aeruginosa PA01
gcgucgcgccagcac

SEQ ID NO: 1494486 - RNA, 17 nt, Pseudomonas aeruginosa PA01
gcgucgcgccagcaccg

SEQ ID NO: 1494487 - RNA, 22 nt, Pseudomonas aeruginosa PA01
gcgucgcgccagcaccgugguc

SEQ ID NO: 1494488 - RNA, 16 nt, Pseudomonas aeruginosa PA01
gcgucgcgcguccagc

SEQ ID NO: 1494489 - RNA, 12 nt, Pseudomonas aeruginosa PA01
gcgucgcgcagg

SEQ ID NO: 1494490 - RNA, 17 nt, Pseudomonas aeruginosa PA01
gcgucgcgcuugccuuc

SEQ ID NO: 1494491 - RNA, 22 nt, Pseudomonas aeruginosa PA01
gcgucgcggagaauccgcucgg

SEQ ID NO: 1494492 - RNA, 13 nt, Pseudomonas aeruginosa PA01
gcgucgcccaggc

SEQ ID NO: 1494493 - RNA, 14 nt, Pseudomonas aeruginosa PA01
gcgucgcccaggcc

SEQ ID NO: 1494494 - RNA, 20 nt, Pseudomonas aeruginosa PA01
gcgucgcccaggccgcuggc

SEQ ID NO: 1494495 - RNA, 21 nt, Pseudomonas aeruginosa PA01
gcgucgcccaggccgcuggcg

SEQ ID NO: 1494496 - RNA, 13 nt, Pseudomonas aeruginosa PA01
gcgucgccaggcc

SEQ ID NO: 1494497 - RNA, 15 nt, Pseudomonas aeruginosa PA01
gcgucgccaggccgu

SEQ ID NO: 1494498 - RNA, 18 nt, Pseudomonas aeruginosa PA01
gcgucgccaacgcgccgu

SEQ ID NO: 1494499 - RNA, 20 nt, Pseudomonas aeruginosa PA01
gcgucgccaacgcgccgucg

SEQ ID NO: 1494500 - RNA, 15 nt, Pseudomonas aeruginosa PA01
gcgucggcugcgcug

SEQ ID NO: 1494501 - RNA, 16 nt, Pseudomonas aeruginosa PA01
gcgucggcugcgcugg

SEQ ID NO: 1494502 - RNA, 11 nt, Pseudomonas aeruginosa PA01
gcgucggcggg

SEQ ID NO: 1494503 - RNA, 19 nt, Pseudomonas aeruginosa PA01
gcgucggcgcuuugcugca

SEQ ID NO: 1494504 - RNA, 17 nt, Pseudomonas aeruginosa PA01
gcgucggcgucggcugc

SEQ ID NO: 1494505 - RNA, 20 nt, Pseudomonas aeruginosa PA01
gcgucggcgucggcugcgcu

SEQ ID NO: 1494506 - RNA, 16 nt, Pseudomonas aeruginosa PA01
gcgucgggcagggcau

SEQ ID NO: 1494507 - RNA, 20 nt, Pseudomonas aeruginosa PA01
gcgucgggcgaaacggcagg

SEQ ID NO: 1494508 - RNA, 22 nt, Pseudomonas aeruginosa PA01
gcgucgggcuucuucaccaggc

SEQ ID NO: 1494509 - RNA, 19 nt, Pseudomonas aeruginosa PA01
gcgugcuccagcaccgugg

SEQ ID NO: 1494510 - RNA, 21 nt, Pseudomonas aeruginosa PA01
gcgugcucgcgcaugaucgcc

SEQ ID NO: 1494511 - RNA, 23 nt, Pseudomonas aeruginosa PA01
gcgugcucgcgcaugaucgccuc

SEQ ID NO: 1494512 - RNA, 21 nt, Pseudomonas aeruginosa PA01
gcgugcucuuuucccgcaccg

SEQ ID NO: 1494513 - RNA, 17 nt, Pseudomonas aeruginosa PA01
gcgugcuggugccgauc

SEQ ID NO: 1494514 - RNA, 18 nt, Pseudomonas aeruginosa PA01
gcgugcuggugccgauca

SEQ ID NO: 1494515 - RNA, 16 nt, Pseudomonas aeruginosa PA01
gcguggacccacgcau

SEQ ID NO: 1494516 - RNA, 15 nt, Pseudomonas aeruginosa PA01
gcguggaaccgcggc

SEQ ID NO: 1494517 - RNA, 21 nt, Pseudomonas aeruginosa PA01
gcguggcaaaaaugcccuugg

SEQ ID NO: 1494518 - RNA, 13 nt, Pseudomonas aeruginosa PA01
gcguucaccgcgc

SEQ ID NO: 1494519 - RNA, 12 nt, Pseudomonas aeruginosa PA01
gcguuauucgcc

SEQ ID NO: 1494520 - RNA, 23 nt, Pseudomonas aeruginosa PA01
gcguuauucgcccuaccccaggg

SEQ ID NO: 1494521 - RNA, 22 nt, Pseudomonas aeruginosa PA01
gcguuauucgcccuacgccagu

SEQ ID NO: 1494522 - RNA, 23 nt, Pseudomonas aeruginosa PA01
gcguuauccgccccaccccaggg

SEQ ID NO: 1494523 - RNA, 21 nt, Pseudomonas aeruginosa PA01
gcguuauccgcccugcgcagc

SEQ ID NO: 1494524 - RNA, 13 nt, Pseudomonas aeruginosa PA01
gcguuauccgccg

SEQ ID NO: 1494525 - RNA, 15 nt, Pseudomonas aeruginosa PA01
gcguuauccgccgau

SEQ ID NO: 1494526 - RNA, 18 nt, Pseudomonas aeruginosa PA01
gcguuauccgccgauacc

SEQ ID NO: 1494527 - RNA, 16 nt, Pseudomonas aeruginosa PA01
gcguuauccgccgccg

SEQ ID NO: 1494528 - RNA, 19 nt, Pseudomonas aeruginosa PA01
gcguuauccgccgcucacc

SEQ ID NO: 1494529 - RNA, 18 nt, Pseudomonas aeruginosa PA01
gcguggcuuggcccugcg

SEQ ID NO: 1494530 - RNA, 18 nt, Pseudomonas aeruginosa PA01
gcgugggcaacaggccga

SEQ ID NO: 1494531 - RNA, 14 nt, Pseudomonas aeruginosa PA01
gcgugggcgccggc

SEQ ID NO: 1494532 - RNA, 15 nt, Pseudomonas aeruginosa PA01
gcgugggcgccggcg

SEQ ID NO: 1494533 - RNA, 12 nt, Pseudomonas aeruginosa PA01
gcguggcgugcu

SEQ ID NO: 1494534 - RNA, 18 nt, Pseudomonas aeruginosa PA01
gcguggcgugcucggcga

SEQ ID NO: 1494535 - RNA, 15 nt, Pseudomonas aeruginosa PA01
gcguggcgucggcgc

SEQ ID NO: 1494536 - RNA, 16 nt, Pseudomonas aeruginosa PA01
gcguggcgucggcgcu

SEQ ID NO: 1494537 - RNA, 19 nt, Pseudomonas aeruginosa PA01
gcguggccagcgcccaggc

SEQ ID NO: 1494538 - RNA, 17 nt, Pseudomonas aeruginosa PA01
gcgugggccagcccaga

SEQ ID NO: 1494539 - RNA, 16 nt, Pseudomonas aeruginosa PA01
gcgugggcggccggcc

SEQ ID NO: 1494540 - RNA, 18 nt, Pseudomonas aeruginosa PA01
gcgugggcggccggccag

SEQ ID NO: 1494541 - RNA, 21 nt, Pseudomonas aeruginosa PA01
gcgugggcggucggcgagggc

SEQ ID NO: 1494542 - RNA, 16 nt, Pseudomonas aeruginosa PA01
gcgugggcuucgccgc

SEQ ID NO: 1494543 - RNA, 18 nt, Pseudomonas aeruginosa PA01
gcgugggguagccgagaa

SEQ ID NO: 1494544 - RNA, 13 nt, Pseudomonas aeruginosa PA01
gcguggguagccg

SEQ ID NO: 1494545 - RNA, 17 nt, Pseudomonas aeruginosa PA01
gcguggguagccgccca

SEQ ID NO: 1494546 - RNA, 21 nt, Pseudomonas aeruginosa PA01
gcguggguagccgcccaccgc

SEQ ID NO: 1494547 - RNA, 14 nt, Pseudomonas aeruginosa PA01
gcguggguccacgc

SEQ ID NO: 1494548 - RNA, 19 nt, Pseudomonas aeruginosa PA01
gcguggguccacgccgggc

SEQ ID NO: 1494549 - RNA, 20 nt, Pseudomonas aeruginosa PA01
gcguggguccacgccgggca

SEQ ID NO: 1494550 - RNA, 19 nt, Pseudomonas aeruginosa PA01
gcguguucauagaaacgca

SEQ ID NO: 1494551 - RNA, 15 nt, Pseudomonas aeruginosa PA01
aaggaccugcugccc

SEQ ID NO: 1494552 - RNA, 16 nt, Pseudomonas aeruginosa PA01
aaggaccugcugcccg

SEQ ID NO: 1494553 - RNA, 19 nt, Pseudomonas aeruginosa PA01
aaggaccugcugcccggca

SEQ ID NO: 1494554 - RNA, 23 nt, Pseudomonas aeruginosa PA01
gcgugaaaacaagaagccccgcu

SEQ ID NO: 1494555 - RNA, 15 nt, Pseudomonas aeruginosa PA01
gcgucuugucgaagc

SEQ ID NO: 1494556 - RNA, 12 nt, Pseudomonas aeruginosa PA01
gcgucuucgccg

SEQ ID NO: 1494557 - RNA, 22 nt, Pseudomonas aeruginosa PA01
gcgugagcagggccgagcgcag

SEQ ID NO: 1494558 - RNA, 23 nt, Pseudomonas aeruginosa PA01
gcgugagcagggccgagcgcagc

SEQ ID NO: 1494559 - RNA, 19 nt, Pseudomonas aeruginosa PA01
gcgugaguaucaucgcgau

SEQ ID NO: 1494560 - RNA, 18 nt, Pseudomonas aeruginosa PA01
gcgugagggucgcgccga

SEQ ID NO: 1494561 - RNA, 18 nt, Pseudomonas aeruginosa PA01
gcgugauccgcagguagc

SEQ ID NO: 1494562 - RNA, 17 nt, Pseudomonas aeruginosa PA01
gcgugauacagcucgcu

SEQ ID NO: 1494563 - RNA, 23 nt, Pseudomonas aeruginosa PA01
gcgucguagagcgugcggccgau

SEQ ID NO: 1494564 - RNA, 13 nt, Pseudomonas aeruginosa PA01
gcgucguccucga

SEQ ID NO: 1494565 - RNA, 16 nt, Pseudomonas aeruginosa PA01
gcgucguccugcgcgg

SEQ ID NO: 1494566 - RNA, 17 nt, Pseudomonas aeruginosa PA01
gcgucguccugcgcggc

SEQ ID NO: 1494567 - RNA, 22 nt, Pseudomonas aeruginosa PA01
gcgucguccugcgcggcgacga

SEQ ID NO: 1494568 - RNA, 20 nt, Pseudomonas aeruginosa PA01
gcgucguagagguugccgug

SEQ ID NO: 1494569 - RNA, 17 nt, Pseudomonas aeruginosa PA01
gcgucguccagggcgcu

SEQ ID NO: 1494570 - RNA, 16 nt, Pseudomonas aeruginosa PA01
gcgucguauaggcgcu

SEQ ID NO: 1494571 - RNA, 14 nt, Pseudomonas aeruginosa PA01
gcgucggugccgcc

SEQ ID NO: 1494572 - RNA, 18 nt, Pseudomonas aeruginosa PA01
gcgucggugccgcccggc

SEQ ID NO: 1494573 - RNA, 17 nt, Pseudomonas aeruginosa PA01
gcgucgguggcaggaaa

SEQ ID NO: 1494574 - RNA, 16 nt, Pseudomonas aeruginosa PA01
gcgucgguccagcucc

SEQ ID NO: 1494575 - RNA, 22 nt, Pseudomonas aeruginosa PA01
gcgucgguccagcuccuugcgc

SEQ ID NO: 1494576 - RNA, 12 nt, Pseudomonas aeruginosa PA01
gcgucggugccg

SEQ ID NO: 1494577 - RNA, 21 nt, Pseudomonas aeruginosa PA01
gcgucuuccggcucgccgcgc

SEQ ID NO: 1494578 - RNA, 17 nt, Pseudomonas aeruginosa PA01
gcgucuucgccgaugcg

SEQ ID NO: 1494579 - RNA, 18 nt, Pseudomonas aeruginosa PA01
gcgucuucggcggcgccg

SEQ ID NO: 1494580 - RNA, 20 nt, Pseudomonas aeruginosa PA01
gcgucugggacggcagccug

SEQ ID NO: 1494581 - RNA, 21 nt, Pseudomonas aeruginosa PA01
gcgucugggacggcagccugg

SEQ ID NO: 1494582 - RNA, 17 nt, Pseudomonas aeruginosa PA01
gcgucuggggugaggcc

SEQ ID NO: 1494583 - RNA, 22 nt, Pseudomonas aeruginosa PA01
gcgucuggggugaggccgagcc

SEQ ID NO: 1494584 - RNA, 12 nt, Pseudomonas aeruginosa PA01
gcguaagcggcc

SEQ ID NO: 1494585 - RNA, 13 nt, Pseudomonas aeruginosa PA01
gcguaagcggccu

SEQ ID NO: 1494586 - RNA, 12 nt, Pseudomonas aeruginosa PA01
gcguaacggcuc

SEQ ID NO: 1494587 - RNA, 18 nt, Pseudomonas aeruginosa PA01
gcguaacggcucgccggg

SEQ ID NO: 1494588 - RNA, 12 nt, Pseudomonas aeruginosa PA01
gcguaacggcuu

SEQ ID NO: 1494589 - RNA, 22 nt, Pseudomonas aeruginosa PA01
gcguaacggcuugccgguaggg

SEQ ID NO: 1494590 - RNA, 20 nt, Pseudomonas aeruginosa PA01
gcguaauaggcgaagcggcu

SEQ ID NO: 1494591 - RNA, 17 nt, Pseudomonas aeruginosa PA01
gcguacagcgggccggg

SEQ ID NO: 1494592 - RNA, 18 nt, Pseudomonas aeruginosa PA01
gcguaccagcuugucgcc

SEQ ID NO: 1494593 - RNA, 16 nt, Pseudomonas aeruginosa PA01
gcguaccaggaugccc

SEQ ID NO: 1494594 - RNA, 19 nt, Pseudomonas aeruginosa PA01
gcguaccaggaugcccugc

SEQ ID NO: 1494595 - RNA, 14 nt, Pseudomonas aeruginosa PA01
gcguaccagcgcgc

SEQ ID NO: 1494596 - RNA, 20 nt, Pseudomonas aeruginosa PA01
gcguacggucaugccgaacu

SEQ ID NO: 1494597 - RNA, 20 nt, Pseudomonas aeruginosa PA01
gcguacgcccagcagcggca

SEQ ID NO: 1494598 - RNA, 21 nt, Pseudomonas aeruginosa PA01
gcguacgcccgcagccacggc

SEQ ID NO: 1494599 - RNA, 17 nt, Pseudomonas aeruginosa PA01
gcguaccucgccaggcu

SEQ ID NO: 1494600 - RNA, 14 nt, Pseudomonas aeruginosa PA01
gcgguugcgcugcu

SEQ ID NO: 1494601 - RNA, 16 nt, Pseudomonas aeruginosa PA01
gcgguugcgggucagc

SEQ ID NO: 1494602 - RNA, 21 nt, Pseudomonas aeruginosa PA01
gcgguugcgggucagcagugc

SEQ ID NO: 1494603 - RNA, 13 nt, Pseudomonas aeruginosa PA01
gcgguugccgaag

SEQ ID NO: 1494604 - RNA, 15 nt, Pseudomonas aeruginosa PA01
gcgguugccgaagcg

SEQ ID NO: 1494605 - RNA, 15 nt, Pseudomonas aeruginosa PA01
gcgguugccgcugcg

SEQ ID NO: 1494606 - RNA, 21 nt, Pseudomonas aeruginosa PA01
gcgguugccggagacgauggc

SEQ ID NO: 1494607 - RNA, 15 nt, Pseudomonas aeruginosa PA01
gcgguugagcagggc

SEQ ID NO: 1494608 - RNA, 14 nt, Pseudomonas aeruginosa PA01
gcgguugaaacugc

SEQ ID NO: 1494609 - RNA, 17 nt, Pseudomonas aeruginosa PA01
gcgguugaaacugcgca

SEQ ID NO: 1494610 - RNA, 18 nt, Pseudomonas aeruginosa PA01
gcgguucgccgagcgccg

SEQ ID NO: 1494611 - RNA, 15 nt, Pseudomonas aeruginosa PA01
gcgguucgccuuccc

SEQ ID NO: 1494612 - RNA, 17 nt, Pseudomonas aeruginosa PA01
gcgguucucguccaggu

SEQ ID NO: 1494613 - RNA, 21 nt, Pseudomonas aeruginosa PA01
gcgguucucgucgaugucgcg

SEQ ID NO: 1494614 - RNA, 23 nt, Pseudomonas aeruginosa PA01
gcgguuguugaugcccaccaacg

SEQ ID NO: 1494615 - RNA, 15 nt, Pseudomonas aeruginosa PA01
gcgguuggcgccucg

SEQ ID NO: 1494616 - RNA, 18 nt, Pseudomonas aeruginosa PA01
gcgguuggcccgcgccgu

SEQ ID NO: 1494617 - RNA, 13 nt, Pseudomonas aeruginosa PA01
gcgguuucgcagc

SEQ ID NO: 1494618 - RNA, 15 nt, Pseudomonas aeruginosa PA01
gcgguuucgccaccu

SEQ ID NO: 1494619 - RNA, 15 nt, Pseudomonas aeruginosa PA01
gcgguuucgccgagg

SEQ ID NO: 1494620 - RNA, 23 nt, Pseudomonas aeruginosa PA01
gcgguuuccaguucaucgagcag

SEQ ID NO: 1494621 - RNA, 14 nt, Pseudomonas aeruginosa PA01
gcgguucaggucga

SEQ ID NO: 1494622 - RNA, 20 nt, Pseudomonas aeruginosa PA01
gcgguucaggucgaggccgc

SEQ ID NO: 1494623 - RNA, 13 nt, Pseudomonas aeruginosa PA01
gcgguuauucgcc

SEQ ID NO: 1494624 - RNA, 19 nt, Pseudomonas aeruginosa PA01
gcgguuauucgcccuaccc

SEQ ID NO: 1494625 - RNA, 20 nt, Pseudomonas aeruginosa PA01
gcgguuauucgcccuacggc

SEQ ID NO: 1494626 - RNA, 13 nt, Pseudomonas aeruginosa PA01
gcgguuagccggc

SEQ ID NO: 1494627 - RNA, 14 nt, Pseudomonas aeruginosa PA01
gcgguuagccggcg

SEQ ID NO: 1494628 - RNA, 13 nt, Pseudomonas aeruginosa PA01
gcgguuauccgcc

SEQ ID NO: 1494629 - RNA, 14 nt, Pseudomonas aeruginosa PA01
gcgguuauccgccg

SEQ ID NO: 1494630 - RNA, 18 nt, Pseudomonas aeruginosa PA01
gcgguuauccgccgccgg

SEQ ID NO: 1494631 - RNA, 17 nt, Pseudomonas aeruginosa PA01
gcgguuauccgccggcu

SEQ ID NO: 1494632 - RNA, 22 nt, Pseudomonas aeruginosa PA01
gcgguuauccgccggugcgcga

SEQ ID NO: 1494633 - RNA, 23 nt, Pseudomonas aeruginosa PA01
gcgguuauccgccggugcgcgau

SEQ ID NO: 1494634 - RNA, 18 nt, Pseudomonas aeruginosa PA01
gcgguuauccgccgugga

SEQ ID NO: 1494635 - RNA, 17 nt, Pseudomonas aeruginosa PA01
gcggugggcgagggcgc

SEQ ID NO: 1494636 - RNA, 22 nt, Pseudomonas aeruginosa PA01
gcggugcgcaugucguccaggc

SEQ ID NO: 1494637 - RNA, 14 nt, Pseudomonas aeruginosa PA01
gcggugcgccggcg

SEQ ID NO: 1494638 - RNA, 13 nt, Pseudomonas aeruginosa PA01
gcggugcgcgcca

SEQ ID NO: 1494639 - RNA, 20 nt, Pseudomonas aeruginosa PA01
gcggugcguucgcgggcgcc

SEQ ID NO: 1494640 - RNA, 21 nt, Pseudomonas aeruginosa PA01
gcggugcguucgcgggcgccg

SEQ ID NO: 1494641 - RNA, 19 nt, Pseudomonas aeruginosa PA01
gcggugccgugggucgccu

SEQ ID NO: 1494642 - RNA, 14 nt, Pseudomonas aeruginosa PA01
gcggugccgcgcag

SEQ ID NO: 1494643 - RNA, 15 nt, Pseudomonas aeruginosa PA01
gcggugccgcgcagc

SEQ ID NO: 1494644 - RNA, 11 nt, Pseudomonas aeruginosa PA01
gcggugccgcg

SEQ ID NO: 1494645 - RNA, 23 nt, Pseudomonas aeruginosa PA01
gcggugccgcagacaucgccgag

SEQ ID NO: 1494646 - RNA, 18 nt, Pseudomonas aeruginosa PA01
gcgguggggccgccgaug

SEQ ID NO: 1494647 - RNA, 22 nt, Pseudomonas aeruginosa PA01
gcgguggggccgccgaugccga

SEQ ID NO: 1494648 - RNA, 13 nt, Pseudomonas aeruginosa PA01
gcgguggcgauca

SEQ ID NO: 1494649 - RNA, 17 nt, Pseudomonas aeruginosa PA01
gcgguggaugccggugg

SEQ ID NO: 1494650 - RNA, 17 nt, Pseudomonas aeruginosa PA01
gcggucccuucgugggc

SEQ ID NO: 1494651 - RNA, 22 nt, Pseudomonas aeruginosa PA01
gcggucccuucgugggccugcu

SEQ ID NO: 1494652 - RNA, 17 nt, Pseudomonas aeruginosa PA01
gcggucccagaccagca

SEQ ID NO: 1494653 - RNA, 15 nt, Pseudomonas aeruginosa PA01
gcggucccaucagca

SEQ ID NO: 1494654 - RNA, 14 nt, Pseudomonas aeruginosa PA01
gcggucgauguccu

SEQ ID NO: 1494655 - RNA, 15 nt, Pseudomonas aeruginosa PA01
gcggucgaugucgcg

SEQ ID NO: 1494656 - RNA, 19 nt, Pseudomonas aeruginosa PA01
gcggucgaugucgcggccc

SEQ ID NO: 1494657 - RNA, 22 nt, Pseudomonas aeruginosa PA01
gcgguccgccgcgggacgccgc

SEQ ID NO: 1494658 - RNA, 23 nt, Pseudomonas aeruginosa PA01
gcgguccgcgguagcugcgcagg

SEQ ID NO: 1494659 - RNA, 18 nt, Pseudomonas aeruginosa PA01
gcggucgauccgaccugg

SEQ ID NO: 1494660 - RNA, 20 nt, Pseudomonas aeruginosa PA01
gcggucagcaguugccgggu

SEQ ID NO: 1494661 - RNA, 16 nt, Pseudomonas aeruginosa PA01
gcggucaggccaagcu

SEQ ID NO: 1494662 - RNA, 22 nt, Pseudomonas aeruginosa PA01
gcggucaccagggucacgccgc

SEQ ID NO: 1494663 - RNA, 24 nt, Pseudomonas aeruginosa PA01
gcggucacccauucgaugccgcgc

SEQ ID NO: 1494664 - RNA, 13 nt, Pseudomonas aeruginosa PA01
gcgguauagcuca

SEQ ID NO: 1494665 - RNA, 21 nt, Pseudomonas aeruginosa PA01
gcgguauagcucauggccagg

SEQ ID NO: 1494666 - RNA, 22 nt, Pseudomonas aeruginosa PA01
gcgguauagcucauggccaggu

SEQ ID NO: 1494667 - RNA, 14 nt, Pseudomonas aeruginosa PA01
gcgguacccgccgg

SEQ ID NO: 1494668 - RNA, 17 nt, Pseudomonas aeruginosa PA01
gcgguagccgaggcggc

SEQ ID NO: 1494669 - RNA, 20 nt, Pseudomonas aeruginosa PA01
gcgguagcgccgcgccaacu

SEQ ID NO: 1494670 - RNA, 13 nt, Pseudomonas aeruginosa PA01
gcgguagcgcgaa

SEQ ID NO: 1494671 - RNA, 22 nt, Pseudomonas aeruginosa PA01
gcgguacccagcuugcuggcgu

SEQ ID NO: 1494672 - RNA, 17 nt, Pseudomonas aeruginosa PA01
gcgguaccagcagcgcc

SEQ ID NO: 1494673 - RNA, 18 nt, Pseudomonas aeruginosa PA01
gcgguaccagcagcgccg

SEQ ID NO: 1494674 - RNA, 13 nt, Pseudomonas aeruginosa PA01
gcgguaccagcgc

SEQ ID NO: 1494675 - RNA, 17 nt, Pseudomonas aeruginosa PA01
gcgguacaccgccaggg

SEQ ID NO: 1494676 - RNA, 18 nt, Pseudomonas aeruginosa PA01
gcgguacaccgccagggu

SEQ ID NO: 1494677 - RNA, 14 nt, Pseudomonas aeruginosa PA01
gcgguacaggcgca

SEQ ID NO: 1494678 - RNA, 23 nt, Pseudomonas aeruginosa PA01
gcgguacaggcgcaccuggcggu

SEQ ID NO: 1494679 - RNA, 20 nt, Pseudomonas aeruginosa PA01
gcgguacagcccccaggcac

SEQ ID NO: 1494680 - RNA, 21 nt, Pseudomonas aeruginosa PA01
gcgguacagcccccaggcacc

SEQ ID NO: 1494681 - RNA, 14 nt, Pseudomonas aeruginosa PA01
gcgguacagccggu

SEQ ID NO: 1494682 - RNA, 17 nt, Pseudomonas aeruginosa PA01
gcgguagggaucgucgc

SEQ ID NO: 1494683 - RNA, 21 nt, Pseudomonas aeruginosa PA01
gcgguaguaggguucgccgac

SEQ ID NO: 1494684 - RNA, 22 nt, Pseudomonas aeruginosa PA01
gcgguaguaggguucgccgacg

SEQ ID NO: 1494685 - RNA, 16 nt, Pseudomonas aeruginosa PA01
gcgguaguccacggag

SEQ ID NO: 1494686 - RNA, 20 nt, Pseudomonas aeruginosa PA01
gcgguaggugagcgacccgc

SEQ ID NO: 1494687 - RNA, 16 nt, Pseudomonas aeruginosa PA01
gcgguagcgggccagc

SEQ ID NO: 1494688 - RNA, 20 nt, Pseudomonas aeruginosa PA01
gcgguagcgggccagcagcu

SEQ ID NO: 1494689 - RNA, 16 nt, Pseudomonas aeruginosa PA01
gcgguagcugcgcagg

SEQ ID NO: 1494690 - RNA, 13 nt, Pseudomonas aeruginosa PA01
gcgguaggccagc

SEQ ID NO: 1494691 - RNA, 19 nt, Pseudomonas aeruginosa PA01
gcgggccuuuucuuuggcg

SEQ ID NO: 1494692 - RNA, 18 nt, Pseudomonas aeruginosa PA01
gcgggcgccggaccagcc

SEQ ID NO: 1494693 - RNA, 22 nt, Pseudomonas aeruginosa PA01
gcgggcgccuuuuucauggccu

SEQ ID NO: 1494694 - RNA, 23 nt, Pseudomonas aeruginosa PA01
gcgggcgccuuuuucauggccug

SEQ ID NO: 1494695 - RNA, 16 nt, Pseudomonas aeruginosa PA01
gcgggcgcgaggcgcc

SEQ ID NO: 1494696 - RNA, 17 nt, Pseudomonas aeruginosa PA01
gcgggcgcgaggcgccc

SEQ ID NO: 1494697 - RNA, 16 nt, Pseudomonas aeruginosa PA01
gcgggcgccgaugccg

SEQ ID NO: 1494698 - RNA, 15 nt, Pseudomonas aeruginosa PA01
gcgggcgcgccugag

SEQ ID NO: 1494699 - RNA, 18 nt, Pseudomonas aeruginosa PA01
gcgggcgcgcgccaccgc

SEQ ID NO: 1494700 - RNA, 19 nt, Pseudomonas aeruginosa PA01
gcgggcgcgcgccaccgcc

SEQ ID NO: 1494701 - RNA, 17 nt, Pseudomonas aeruginosa PA01
gcgggcgcuuucgagaa

SEQ ID NO: 1494702 - RNA, 20 nt, Pseudomonas aeruginosa PA01
gcgggcggaucagcucgauc

SEQ ID NO: 1494703 - RNA, 13 nt, Pseudomonas aeruginosa PA01
gcgggcgcuugaa

SEQ ID NO: 1494704 - RNA, 19 nt, Pseudomonas aeruginosa PA01
gcgggcgcuugaagccggc

SEQ ID NO: 1494705 - RNA, 14 nt, Pseudomonas aeruginosa PA01
gcgggcgcggaucg

SEQ ID NO: 1494706 - RNA, 20 nt, Pseudomonas aeruginosa PA01
gcggugccauggaucaccag

SEQ ID NO: 1494707 - RNA, 17 nt, Pseudomonas aeruginosa PA01
gcggugcaguucgccgu

SEQ ID NO: 1494708 - RNA, 22 nt, Pseudomonas aeruginosa PA01
gcggugaucgaaaaaaggcgcc

SEQ ID NO: 1494709 - RNA, 17 nt, Pseudomonas aeruginosa PA01
gcggugaccagcggcac

SEQ ID NO: 1494710 - RNA, 18 nt, Pseudomonas aeruginosa PA01
gcggugagcagggugacg

SEQ ID NO: 1494711 - RNA, 22 nt, Pseudomonas aeruginosa PA01
gcggugaccguuucgccgccgg

SEQ ID NO: 1494712 - RNA, 13 nt, Pseudomonas aeruginosa PA01
gcggugaaggcga

SEQ ID NO: 1494713 - RNA, 17 nt, Pseudomonas aeruginosa PA01
gcggucuucaucaccuu

SEQ ID NO: 1494714 - RNA, 21 nt, Pseudomonas aeruginosa PA01
gcggucuucccguaaggccag

SEQ ID NO: 1494715 - RNA, 23 nt, Pseudomonas aeruginosa PA01
gcggucuucccguaaggccaggc

SEQ ID NO: 1494716 - RNA, 22 nt, Pseudomonas aeruginosa PA01
gcggucuugaucacguccaggu

SEQ ID NO: 1494717 - RNA, 19 nt, Pseudomonas aeruginosa PA01
gcggucuuuuuccaggcaa

SEQ ID NO: 1494718 - RNA, 15 nt, Pseudomonas aeruginosa PA01
gcggucggccaggcg

SEQ ID NO: 1494719 - RNA, 18 nt, Pseudomonas aeruginosa PA01
gcggucggccaggcggcc

SEQ ID NO: 1494720 - RNA, 20 nt, Pseudomonas aeruginosa PA01
gcggucgccgaacagccgcc

SEQ ID NO: 1494721 - RNA, 23 nt, Pseudomonas aeruginosa PA01
gcggucgccgaacagccgcccca

SEQ ID NO: 1494722 - RNA, 12 nt, Pseudomonas aeruginosa PA01
gcggucgccgac

SEQ ID NO: 1494723 - RNA, 16 nt, Pseudomonas aeruginosa PA01
gcggucgccgccggcg

SEQ ID NO: 1494724 - RNA, 13 nt, Pseudomonas aeruginosa PA01
gcggucgccggcg

SEQ ID NO: 1494725 - RNA, 14 nt, Pseudomonas aeruginosa PA01
gcggucgcggaccu

SEQ ID NO: 1494726 - RNA, 23 nt, Pseudomonas aeruginosa PA01
gcggucgcggaccuccagccggc

SEQ ID NO: 1494727 - RNA, 14 nt, Pseudomonas aeruginosa PA01
gcggucgcgcccgc

SEQ ID NO: 1494728 - RNA, 20 nt, Pseudomonas aeruginosa PA01
gcggucgcgcccgcugugcg

SEQ ID NO: 1494729 - RNA, 20 nt, Pseudomonas aeruginosa PA01
gcggucguagcccaugguca

SEQ ID NO: 1494730 - RNA, 14 nt, Pseudomonas aeruginosa PA01
gcggucgucgccau

SEQ ID NO: 1494731 - RNA, 16 nt, Pseudomonas aeruginosa PA01
gcggucgugcagcagc

SEQ ID NO: 1494732 - RNA, 20 nt, Pseudomonas aeruginosa PA01
gcggucgugcagcagcgccu

SEQ ID NO: 1494733 - RNA, 22 nt, Pseudomonas aeruginosa PA01
gcggucggugagcacgccgcga

SEQ ID NO: 1494734 - RNA, 18 nt, Pseudomonas aeruginosa PA01
gcggucguaggaacgugc

SEQ ID NO: 1494735 - RNA, 17 nt, Pseudomonas aeruginosa PA01
gcggucggcucagccga

SEQ ID NO: 1494736 - RNA, 22 nt, Pseudomonas aeruginosa PA01
gcggucggguucuugcugacgu

SEQ ID NO: 1494737 - RNA, 14 nt, Pseudomonas aeruginosa PA01
gcggucucggcggg

SEQ ID NO: 1494738 - RNA, 14 nt, Pseudomonas aeruginosa PA01
gcggucucgaacgc

SEQ ID NO: 1494739 - RNA, 15 nt, Pseudomonas aeruginosa PA01
gcggucucgaacgcc

SEQ ID NO: 1494740 - RNA, 18 nt, Pseudomonas aeruginosa PA01
gcggucucgaacgccagg

SEQ ID NO: 1494741 - RNA, 19 nt, Pseudomonas aeruginosa PA01
gcggucucgaacgccaggc

SEQ ID NO: 1494742 - RNA, 18 nt, Pseudomonas aeruginosa PA01
gcguucaccguggcgcug

SEQ ID NO: 1494743 - RNA, 20 nt, Pseudomonas aeruginosa PA01
gcguucaucgucggcagcca

SEQ ID NO: 1494744 - RNA, 14 nt, Pseudomonas aeruginosa PA01
gcucagcaggucgc

SEQ ID NO: 1494745 - RNA, 18 nt, Pseudomonas aeruginosa PA01
gcucagcccaggcgccgc

SEQ ID NO: 1494746 - RNA, 19 nt, Pseudomonas aeruginosa PA01
gcucagcccaggcgccgcu

SEQ ID NO: 1494747 - RNA, 20 nt, Pseudomonas aeruginosa PA01
gcucagcccaggcgccgcuc

SEQ ID NO: 1494748 - RNA, 13 nt, Pseudomonas aeruginosa PA01
gcucagccgacca

SEQ ID NO: 1494749 - RNA, 17 nt, Pseudomonas aeruginosa PA01
gcucagccgaggucgcc

SEQ ID NO: 1494750 - RNA, 16 nt, Pseudomonas aeruginosa PA01
gcucagcucggcgaug

SEQ ID NO: 1494751 - RNA, 19 nt, Pseudomonas aeruginosa PA01
gcucagcucggcgaugccg

SEQ ID NO: 1494752 - RNA, 22 nt, Pseudomonas aeruginosa PA01
gcucagcucggcgaugccgccg

SEQ ID NO: 1494753 - RNA, 13 nt, Pseudomonas aeruginosa PA01
gcucagcuccagg

SEQ ID NO: 1494754 - RNA, 18 nt, Pseudomonas aeruginosa PA01
gcucagcuccaggccgcg

SEQ ID NO: 1494755 - RNA, 23 nt, Pseudomonas aeruginosa PA01
gcucagcuccaggccgcgggucu

SEQ ID NO: 1494756 - RNA, 13 nt, Pseudomonas aeruginosa PA01
gcucagcguccuc

SEQ ID NO: 1494757 - RNA, 21 nt, Pseudomonas aeruginosa PA01
gcucagcgcggcggcggccgc

SEQ ID NO: 1494758 - RNA, 18 nt, Pseudomonas aeruginosa PA01
gcucagcggcccagcgcc

SEQ ID NO: 1494759 - RNA, 19 nt, Pseudomonas aeruginosa PA01
gcucagcggcccagcgccc

SEQ ID NO: 1494760 - RNA, 22 nt, Pseudomonas aeruginosa PA01
gcucagcggcccagcgccccgc

SEQ ID NO: 1494761 - RNA, 16 nt, Pseudomonas aeruginosa PA01
gcucagcgcuucggcu

SEQ ID NO: 1494762 - RNA, 23 nt, Pseudomonas aeruginosa PA01
gcucagcgcuucggcuccagcac

SEQ ID NO: 1494763 - RNA, 13 nt, Pseudomonas aeruginosa PA01
gcucagcgcgcuc

SEQ ID NO: 1494764 - RNA, 15 nt, Pseudomonas aeruginosa PA01
gcucagcgcgcucgg

SEQ ID NO: 1494765 - RNA, 16 nt, Pseudomonas aeruginosa PA01
gcucagcgcgcucggc

SEQ ID NO: 1494766 - RNA, 15 nt, Pseudomonas aeruginosa PA01
gcucagccguggcac

SEQ ID NO: 1494767 - RNA, 22 nt, Pseudomonas aeruginosa PA01
gcucagccguggcacccaggcc

SEQ ID NO: 1494768 - RNA, 24 nt, Pseudomonas aeruginosa PA01
gcucagccguggcacccaggccac

SEQ ID NO: 1494769 - RNA, 12 nt, Pseudomonas aeruginosa PA01
gcucagccgcgc

SEQ ID NO: 1494770 - RNA, 17 nt, Pseudomonas aeruginosa PA01
gcucagccgcgccgggg

SEQ ID NO: 1494771 - RNA, 16 nt, Pseudomonas aeruginosa PA01
gcucagccgcuggcgu

SEQ ID NO: 1494772 - RNA, 17 nt, Pseudomonas aeruginosa PA01
gcucagccgcuggcguc

SEQ ID NO: 1494773 - RNA, 13 nt, Pseudomonas aeruginosa PA01
gcucagcgcaugc

SEQ ID NO: 1494774 - RNA, 12 nt, Pseudomonas aeruginosa PA01
gcucagcgccgc

SEQ ID NO: 1494775 - RNA, 13 nt, Pseudomonas aeruginosa PA01
gcucagcgccgcu

SEQ ID NO: 1494776 - RNA, 14 nt, Pseudomonas aeruginosa PA01
gcucagcgccggcc

SEQ ID NO: 1494777 - RNA, 15 nt, Pseudomonas aeruginosa PA01
gcucagcgccggcca

SEQ ID NO: 1494778 - RNA, 16 nt, Pseudomonas aeruginosa PA01
gcucagcgccggccag

SEQ ID NO: 1494779 - RNA, 17 nt, Pseudomonas aeruginosa PA01
gcucagcgccggccagg

SEQ ID NO: 1494780 - RNA, 20 nt, Pseudomonas aeruginosa PA01
gcucagcgccggccaggggc

SEQ ID NO: 1494781 - RNA, 22 nt, Pseudomonas aeruginosa PA01
gcucaggcagcgaucgccgcca

SEQ ID NO: 1494782 - RNA, 18 nt, Pseudomonas aeruginosa PA01
gcucaggacguccuggcc

SEQ ID NO: 1494783 - RNA, 19 nt, Pseudomonas aeruginosa PA01
gcucaggacguccuggccg

SEQ ID NO: 1494784 - RNA, 22 nt, Pseudomonas aeruginosa PA01
gcucaggacguccuggccgagc

SEQ ID NO: 1494785 - RNA, 16 nt, Pseudomonas aeruginosa PA01
gcucaggcgcugcugg

SEQ ID NO: 1494786 - RNA, 17 nt, Pseudomonas aeruginosa PA01
gcucaggcgucccgcuc

SEQ ID NO: 1494787 - RNA, 21 nt, Pseudomonas aeruginosa PA01
gcucaggcguucgucguggcc

SEQ ID NO: 1494788 - RNA, 13 nt, Pseudomonas aeruginosa PA01
gcucaggcggccg

SEQ ID NO: 1494789 - RNA, 13 nt, Pseudomonas aeruginosa PA01
gcucaggccucga

SEQ ID NO: 1494790 - RNA, 14 nt, Pseudomonas aeruginosa PA01
gcucaggccgccgc

SEQ ID NO: 1494791 - RNA, 19 nt, Pseudomonas aeruginosa PA01
gcucaggccgccgcgucga

SEQ ID NO: 1494792 - RNA, 15 nt, Pseudomonas aeruginosa PA01
gcucaggccuuggcu

SEQ ID NO: 1494793 - RNA, 23 nt, Pseudomonas aeruginosa PA01
gcucaggucggucgaacugacca

SEQ ID NO: 1494794 - RNA, 11 nt, Pseudomonas aeruginosa PA01
gcucaggucgu

SEQ ID NO: 1494795 - RNA, 18 nt, Pseudomonas aeruginosa PA01
gcucaggucguagggcgu

SEQ ID NO: 1494796 - RNA, 20 nt, Pseudomonas aeruginosa PA01
gcucaggucguagggcguca

SEQ ID NO: 1494797 - RNA, 15 nt, Pseudomonas aeruginosa PA01
gcucaguucggccag

SEQ ID NO: 1494798 - RNA, 18 nt, Pseudomonas aeruginosa PA01
gcucaguucggccagcgg

SEQ ID NO: 1494799 - RNA, 19 nt, Pseudomonas aeruginosa PA01
gcucaguucggccagcggc

SEQ ID NO: 1494800 - RNA, 20 nt, Pseudomonas aeruginosa PA01
gcucaguucggccagcggca

SEQ ID NO: 1494801 - RNA, 19 nt, Pseudomonas aeruginosa PA01
gcucaggcugugcaggaag

SEQ ID NO: 1494802 - RNA, 24 nt, Pseudomonas aeruginosa PA01
gcucaggcugugcaggaaggcgac

SEQ ID NO: 1494803 - RNA, 22 nt, Pseudomonas aeruginosa PA01
gcucagggaauggaugcgcggc

SEQ ID NO: 1494804 - RNA, 17 nt, Pseudomonas aeruginosa PA01
gcucagggucucgcggg

SEQ ID NO: 1494805 - RNA, 16 nt, Pseudomonas aeruginosa PA01
gcucaggucgaacugc

SEQ ID NO: 1494806 - RNA, 12 nt, Pseudomonas aeruginosa PA01
gcucaucgcccg

SEQ ID NO: 1494807 - RNA, 19 nt, Pseudomonas aeruginosa PA01
gcucaucgcguagguggcg

SEQ ID NO: 1494808 - RNA, 23 nt, Pseudomonas aeruginosa PA01
gcucaucgcguagguggcgccgc

SEQ ID NO: 1494809 - RNA, 14 nt, Pseudomonas aeruginosa PA01
gcucaucggcgaca

SEQ ID NO: 1494810 - RNA, 16 nt, Pseudomonas aeruginosa PA01
gcucaguugcugauca

SEQ ID NO: 1494811 - RNA, 21 nt, Pseudomonas aeruginosa PA01
gcucaguugcugaucaggccg

SEQ ID NO: 1494812 - RNA, 22 nt, Pseudomonas aeruginosa PA01
gcucagucgguagagcaguugg

SEQ ID NO: 1494813 - RNA, 18 nt, Pseudomonas aeruginosa PA01
gcucagucgaccgucgcc

SEQ ID NO: 1494814 - RNA, 23 nt, Pseudomonas aeruginosa PA01
gcucccccacguacuccagcaac

SEQ ID NO: 1494815 - RNA, 15 nt, Pseudomonas aeruginosa PA01
gcuccccgcaccugc

SEQ ID NO: 1494816 - RNA, 16 nt, Pseudomonas aeruginosa PA01
gcuccccgcaccugcc

SEQ ID NO: 1494817 - RNA, 14 nt, Pseudomonas aeruginosa PA01
gcuccccgccgcca

SEQ ID NO: 1494818 - RNA, 20 nt, Pseudomonas aeruginosa PA01
gcucccaggcgucgccgacu

SEQ ID NO: 1494819 - RNA, 22 nt, Pseudomonas aeruginosa PA01
gcucccaccgcuuucagcgccg

SEQ ID NO: 1494820 - RNA, 23 nt, Pseudomonas aeruginosa PA01
gcucccaccgcuuucagcgccgc

SEQ ID NO: 1494821 - RNA, 18 nt, Pseudomonas aeruginosa PA01
gcuccaucaguugcgcgc

SEQ ID NO: 1494822 - RNA, 20 nt, Pseudomonas aeruginosa PA01
gcuccauccagucggcgcug

SEQ ID NO: 1494823 - RNA, 18 nt, Pseudomonas aeruginosa PA01
gcuccaguugcagcaccc

SEQ ID NO: 1494824 - RNA, 20 nt, Pseudomonas aeruginosa PA01
gcuccaguugcagcaccccc

SEQ ID NO: 1494825 - RNA, 14 nt, Pseudomonas aeruginosa PA01
gcuccaggcccggc

SEQ ID NO: 1494826 - RNA, 17 nt, Pseudomonas aeruginosa PA01
gcuccagcuugucgucg

SEQ ID NO: 1494827 - RNA, 19 nt, Pseudomonas aeruginosa PA01
gcuccagcuugucgucggc

SEQ ID NO: 1494828 - RNA, 16 nt, Pseudomonas aeruginosa PA01
gcuccaggaucgccuc

SEQ ID NO: 1494829 - RNA, 15 nt, Pseudomonas aeruginosa PA01
gcuccagguucggcg

SEQ ID NO: 1494830 - RNA, 19 nt, Pseudomonas aeruginosa PA01
gcuccagguucggcgccag

SEQ ID NO: 1494831 - RNA, 21 nt, Pseudomonas aeruginosa PA01
gcuccagguucggcgccagcu

SEQ ID NO: 1494832 - RNA, 18 nt, Pseudomonas aeruginosa PA01
gcuccagucggggcaggc

SEQ ID NO: 1494833 - RNA, 19 nt, Pseudomonas aeruginosa PA01
gcuccagggcugccaccga

SEQ ID NO: 1494834 - RNA, 13 nt, Pseudomonas aeruginosa PA01
gcuccagggcgaa

SEQ ID NO: 1494835 - RNA, 13 nt, Pseudomonas aeruginosa PA01
gcuccagggcgcu

SEQ ID NO: 1494836 - RNA, 20 nt, Pseudomonas aeruginosa PA01
gcuccagggcgcugaccagg

SEQ ID NO: 1494837 - RNA, 13 nt, Pseudomonas aeruginosa PA01
gcuccagcgccuc

SEQ ID NO: 1494838 - RNA, 15 nt, Pseudomonas aeruginosa PA01
gcuccagcgccucga

SEQ ID NO: 1494839 - RNA, 17 nt, Pseudomonas aeruginosa PA01
gcuccagcgccucgacc

SEQ ID NO: 1494840 - RNA, 20 nt, Pseudomonas aeruginosa PA01
gcuccagcgccucgaccaga

SEQ ID NO: 1494841 - RNA, 15 nt, Pseudomonas aeruginosa PA01
gcuccagcgcccagg

SEQ ID NO: 1494842 - RNA, 16 nt, Pseudomonas aeruginosa PA01
gcuccagcgcccaggu

SEQ ID NO: 1494843 - RNA, 14 nt, Pseudomonas aeruginosa PA01
gcuccagccgcugc

SEQ ID NO: 1494844 - RNA, 18 nt, Pseudomonas aeruginosa PA01
gcuccagccgggcuccgc

SEQ ID NO: 1494845 - RNA, 23 nt, Pseudomonas aeruginosa PA01
gcuccagcgaauggacaggcgcc

SEQ ID NO: 1494846 - RNA, 24 nt, Pseudomonas aeruginosa PA01
gcuccagcgaauggacaggcgccc

SEQ ID NO: 1494847 - RNA, 16 nt, Pseudomonas aeruginosa PA01
gcuccagcuccuccag

SEQ ID NO: 1494848 - RNA, 20 nt, Pseudomonas aeruginosa PA01
gcuccagcgugcccgcugca

SEQ ID NO: 1494849 - RNA, 20 nt, Pseudomonas aeruginosa PA01
gcuccagcgggaaggucggc

SEQ ID NO: 1494850 - RNA, 23 nt, Pseudomonas aeruginosa PA01
gcuccagcgggaaggucggcagc

SEQ ID NO: 1494851 - RNA, 18 nt, Pseudomonas aeruginosa PA01
gcuccagcggcagcucgg

SEQ ID NO: 1494852 - RNA, 19 nt, Pseudomonas aeruginosa PA01
gcuccagcggcagcucggc

SEQ ID NO: 1494853 - RNA, 17 nt, Pseudomonas aeruginosa PA01
gcucaugugggcuaccg

SEQ ID NO: 1494854 - RNA, 17 nt, Pseudomonas aeruginosa PA01
gcucauucggccagcgc

SEQ ID NO: 1494855 - RNA, 15 nt, Pseudomonas aeruginosa PA01
gcucauggccggggu

SEQ ID NO: 1494856 - RNA, 14 nt, Pseudomonas aeruginosa PA01
gcucauggcgccgc

SEQ ID NO: 1494857 - RNA, 16 nt, Pseudomonas aeruginosa PA01
gcucauggcgccgcca

SEQ ID NO: 1494858 - RNA, 17 nt, Pseudomonas aeruginosa PA01
gcucaugagauccgcca

SEQ ID NO: 1494859 - RNA, 18 nt, Pseudomonas aeruginosa PA01
gcucaugagauccgccag

SEQ ID NO: 1494860 - RNA, 21 nt, Pseudomonas aeruginosa PA01
gcucaucuucucguucagcgc

SEQ ID NO: 1494861 - RNA, 17 nt, Pseudomonas aeruginosa PA01
gcuccaaugcaccugcg

SEQ ID NO: 1494862 - RNA, 18 nt, Pseudomonas aeruginosa PA01
gcuccaauucgacgccga

SEQ ID NO: 1494863 - RNA, 21 nt, Pseudomonas aeruginosa PA01
gcuccacacccggucgcgcug

SEQ ID NO: 1494864 - RNA, 22 nt, Pseudomonas aeruginosa PA01
gcuccacacccggucgcgcugg

SEQ ID NO: 1494865 - RNA, 14 nt, Pseudomonas aeruginosa PA01
gcuccaacagcagg

SEQ ID NO: 1494866 - RNA, 19 nt, Pseudomonas aeruginosa PA01
gcuccaacaggcauugccg

SEQ ID NO: 1494867 - RNA, 21 nt, Pseudomonas aeruginosa PA01
gcuccaacaggcauugccguc

SEQ ID NO: 1494868 - RNA, 20 nt, Pseudomonas aeruginosa PA01
gcucauuggcggaugagccg

SEQ ID NO: 1494869 - RNA, 15 nt, Pseudomonas aeruginosa PA01
gcuccagcaaugcca

SEQ ID NO: 1494870 - RNA, 21 nt, Pseudomonas aeruginosa PA01
gcuccagcaaugccagcgcca

SEQ ID NO: 1494871 - RNA, 14 nt, Pseudomonas aeruginosa PA01
gcuccagcaccagc

SEQ ID NO: 1494872 - RNA, 17 nt, Pseudomonas aeruginosa PA01
gcuccagcaccggcggc

SEQ ID NO: 1494873 - RNA, 20 nt, Pseudomonas aeruginosa PA01
gcuccagcaccggcggcgcc

SEQ ID NO: 1494874 - RNA, 21 nt, Pseudomonas aeruginosa PA01
gcuccagcaccggcggcgcca

SEQ ID NO: 1494875 - RNA, 18 nt, Pseudomonas aeruginosa PA01
gcuccagaccuccaggua

SEQ ID NO: 1494876 - RNA, 22 nt, Pseudomonas aeruginosa PA01
gcuccagacucuccaggucggu

SEQ ID NO: 1494877 - RNA, 21 nt, Pseudomonas aeruginosa PA01
gcuccagaucgccguucucga

SEQ ID NO: 1494878 - RNA, 21 nt, Pseudomonas aeruginosa PA01
gcuccagcagggccagcgccu

SEQ ID NO: 1494879 - RNA, 23 nt, Pseudomonas aeruginosa PA01
gcuccagcagggccagcgccugg

SEQ ID NO: 1494880 - RNA, 23 nt, Pseudomonas aeruginosa PA01
gcuccagcaucaccuugcggaac

SEQ ID NO: 1494881 - RNA, 13 nt, Pseudomonas aeruginosa PA01
gcuccagccaggc

SEQ ID NO: 1494882 - RNA, 15 nt, Pseudomonas aeruginosa PA01
gcuccaccagggccu

SEQ ID NO: 1494883 - RNA, 14 nt, Pseudomonas aeruginosa PA01
gcuccacugcuugg

SEQ ID NO: 1494884 - RNA, 16 nt, Pseudomonas aeruginosa PA01
gcuccacgucggcccg

SEQ ID NO: 1494885 - RNA, 17 nt, Pseudomonas aeruginosa PA01
gcuccacagcugccagc

SEQ ID NO: 1494886 - RNA, 18 nt, Pseudomonas aeruginosa PA01
gcuccacagcugccagcc

SEQ ID NO: 1494887 - RNA, 22 nt, Pseudomonas aeruginosa PA01
gcuccacagcugccagccccgc

SEQ ID NO: 1494888 - RNA, 17 nt, Pseudomonas aeruginosa PA01
gcuccaccgcgcuccgc

SEQ ID NO: 1494889 - RNA, 18 nt, Pseudomonas aeruginosa PA01
gcuccaccgcccccggcg

SEQ ID NO: 1494890 - RNA, 21 nt, Pseudomonas aeruginosa PA01
gcuccaccgcccccggcgcca

SEQ ID NO: 1494891 - RNA, 16 nt, Pseudomonas aeruginosa PA01
gcuccacccaggcgcc

SEQ ID NO: 1494892 - RNA, 18 nt, Pseudomonas aeruginosa PA01
gcuccacccaggcgccga

SEQ ID NO: 1494893 - RNA, 12 nt, Pseudomonas aeruginosa PA01
gcuccacccgca

SEQ ID NO: 1494894 - RNA, 17 nt, Pseudomonas aeruginosa PA01
gcuccacccgcagccgc

SEQ ID NO: 1494895 - RNA, 18 nt, Pseudomonas aeruginosa PA01
gcuccaccgauggcgcgc

SEQ ID NO: 1494896 - RNA, 21 nt, Pseudomonas aeruginosa PA01
gcucgcgggucaccaccggga

SEQ ID NO: 1494897 - RNA, 13 nt, Pseudomonas aeruginosa PA01
gcucgcgggccgc

SEQ ID NO: 1494898 - RNA, 20 nt, Pseudomonas aeruginosa PA01
gcucgcgguaggccagcucc

SEQ ID NO: 1494899 - RNA, 20 nt, Pseudomonas aeruginosa PA01
gcucgcggcguaggccucgg

SEQ ID NO: 1494900 - RNA, 12 nt, Pseudomonas aeruginosa PA01
gcucgcggcugg

SEQ ID NO: 1494901 - RNA, 14 nt, Pseudomonas aeruginosa PA01
gcucgcggcuggcc

SEQ ID NO: 1494902 - RNA, 15 nt, Pseudomonas aeruginosa PA01
gcucgcggcgcucgu

SEQ ID NO: 1494903 - RNA, 16 nt, Pseudomonas aeruginosa PA01
gcucgcgcagccaggc

SEQ ID NO: 1494904 - RNA, 19 nt, Pseudomonas aeruginosa PA01
gcucgcgcagccaggcgag

SEQ ID NO: 1494905 - RNA, 16 nt, Pseudomonas aeruginosa PA01
gcucgcgcacggcgaa

SEQ ID NO: 1494906 - RNA, 19 nt, Pseudomonas aeruginosa PA01
gcucgcgcaaccagccgga

SEQ ID NO: 1494907 - RNA, 19 nt, Pseudomonas aeruginosa PA01
gcucgcgcaagcgcccggc

SEQ ID NO: 1494908 - RNA, 20 nt, Pseudomonas aeruginosa PA01
gcucgcgcaagcgcccggcg

SEQ ID NO: 1494909 - RNA, 21 nt, Pseudomonas aeruginosa PA01
gcucgcgcaagcgcccggcga

SEQ ID NO: 1494910 - RNA, 22 nt, Pseudomonas aeruginosa PA01
gcucgcgcaagcgcccggcgaa

SEQ ID NO: 1494911 - RNA, 18 nt, Pseudomonas aeruginosa PA01
gcucgccugguaggcggc

SEQ ID NO: 1494912 - RNA, 23 nt, Pseudomonas aeruginosa PA01
gcucgccugguaggcggcgacga

SEQ ID NO: 1494913 - RNA, 17 nt, Pseudomonas aeruginosa PA01
gcucgccucgggccaug

SEQ ID NO: 1494914 - RNA, 15 nt, Pseudomonas aeruginosa PA01
gcucgccccggcggc

SEQ ID NO: 1494915 - RNA, 17 nt, Pseudomonas aeruginosa PA01
gcucgcccaugcgcggc

SEQ ID NO: 1494916 - RNA, 13 nt, Pseudomonas aeruginosa PA01
gcucgcccagcag

SEQ ID NO: 1494917 - RNA, 15 nt, Pseudomonas aeruginosa PA01
gcucgcagagggcga

SEQ ID NO: 1494918 - RNA, 14 nt, Pseudomonas aeruginosa PA01
gcucggcaagcgaa

SEQ ID NO: 1494919 - RNA, 19 nt, Pseudomonas aeruginosa PA01
gcucggcaagcgaaccgag

SEQ ID NO: 1494920 - RNA, 24 nt, Pseudomonas aeruginosa PA01
gcucggaucaggcgggcuccgccg

SEQ ID NO: 1494921 - RNA, 19 nt, Pseudomonas aeruginosa PA01
gcucggccgagggcagccu

SEQ ID NO: 1494922 - RNA, 18 nt, Pseudomonas aeruginosa PA01
gcucggcauucgacccgc

SEQ ID NO: 1494923 - RNA, 19 nt, Pseudomonas aeruginosa PA01
gcucggcauucgacccgcc

SEQ ID NO: 1494924 - RNA, 21 nt, Pseudomonas aeruginosa PA01
gcucggacugaaaccccacca

SEQ ID NO: 1494925 - RNA, 19 nt, Pseudomonas aeruginosa PA01
gcucgcccagcaggcgcgc

SEQ ID NO: 1494926 - RNA, 21 nt, Pseudomonas aeruginosa PA01
gcucggacaagggccagagca

SEQ ID NO: 1494927 - RNA, 19 nt, Pseudomonas aeruginosa PA01
gcucggaaaccucgccggu

SEQ ID NO: 1494928 - RNA, 21 nt, Pseudomonas aeruginosa PA01
gcucggaaaccucgccgguca

SEQ ID NO: 1494929 - RNA, 14 nt, Pseudomonas aeruginosa PA01
gcucgcguccgcag

SEQ ID NO: 1494930 - RNA, 17 nt, Pseudomonas aeruginosa PA01
gcucgcgguuauccgcc

SEQ ID NO: 1494931 - RNA, 21 nt, Pseudomonas aeruginosa PA01
gcucgcgguuauccgccgccu

SEQ ID NO: 1494932 - RNA, 22 nt, Pseudomonas aeruginosa PA01
gcucgcgguuauccgccgccua

SEQ ID NO: 1494933 - RNA, 19 nt, Pseudomonas aeruginosa PA01
gcucgcgguuauccgccgg

SEQ ID NO: 1494934 - RNA, 21 nt, Pseudomonas aeruginosa PA01
gcucgcgguuauccgccggaa

SEQ ID NO: 1494935 - RNA, 20 nt, Pseudomonas aeruginosa PA01
gcucggcgacauagccggcg

SEQ ID NO: 1494936 - RNA, 14 nt, Pseudomonas aeruginosa PA01
gcucggcggcaggc

SEQ ID NO: 1494937 - RNA, 18 nt, Pseudomonas aeruginosa PA01
gcucggcggcaggcugcg

SEQ ID NO: 1494938 - RNA, 23 nt, Pseudomonas aeruginosa PA01
gcucggcggccauugccgcgggc

SEQ ID NO: 1494939 - RNA, 15 nt, Pseudomonas aeruginosa PA01
gcucggcggccucgc

SEQ ID NO: 1494940 - RNA, 22 nt, Pseudomonas aeruginosa PA01
gcucggcggguauccgccgggc

SEQ ID NO: 1494941 - RNA, 16 nt, Pseudomonas aeruginosa PA01
gcucggcgggacggcg

SEQ ID NO: 1494942 - RNA, 17 nt, Pseudomonas aeruginosa PA01
gcucggcgggcugccgc

SEQ ID NO: 1494943 - RNA, 20 nt, Pseudomonas aeruginosa PA01
gcucggcgggcugccgcgga

SEQ ID NO: 1494944 - RNA, 20 nt, Pseudomonas aeruginosa PA01
gcucggccuguuuccagaag

SEQ ID NO: 1494945 - RNA, 17 nt, Pseudomonas aeruginosa PA01
gcucggccuugagcgcc

SEQ ID NO: 1494946 - RNA, 19 nt, Pseudomonas aeruginosa PA01
gcucggccuugagcgccga

SEQ ID NO: 1494947 - RNA, 20 nt, Pseudomonas aeruginosa PA01
gcucggccuuguccgcgcgc

SEQ ID NO: 1494948 - RNA, 17 nt, Pseudomonas aeruginosa PA01
gcucggccuuguccggc

SEQ ID NO: 1494949 - RNA, 19 nt, Pseudomonas aeruginosa PA01
gcucggccuuguccggcac

SEQ ID NO: 1494950 - RNA, 15 nt, Pseudomonas aeruginosa PA01
gcucggccgccuggc

SEQ ID NO: 1494951 - RNA, 16 nt, Pseudomonas aeruginosa PA01
gcucggccgccuggcg

SEQ ID NO: 1494952 - RNA, 15 nt, Pseudomonas aeruginosa PA01
gcucggccgccagca

SEQ ID NO: 1494953 - RNA, 14 nt, Pseudomonas aeruginosa PA01
gcucggccucgauc

SEQ ID NO: 1494954 - RNA, 21 nt, Pseudomonas aeruginosa PA01
gcucggccugaucaucugggc

SEQ ID NO: 1494955 - RNA, 20 nt, Pseudomonas aeruginosa PA01
gcucggccugcugcgccggc

SEQ ID NO: 1494956 - RNA, 17 nt, Pseudomonas aeruginosa PA01
gcucggccugguccggc

SEQ ID NO: 1494957 - RNA, 18 nt, Pseudomonas aeruginosa PA01
gcucggccugguccggca

SEQ ID NO: 1494958 - RNA, 19 nt, Pseudomonas aeruginosa PA01
gcucggccugguccggcac

SEQ ID NO: 1494959 - RNA, 22 nt, Pseudomonas aeruginosa PA01
gcuccgaagggaacccgcggcg

SEQ ID NO: 1494960 - RNA, 12 nt, Pseudomonas aeruginosa PA01
gcucccuggcgg

SEQ ID NO: 1494961 - RNA, 13 nt, Pseudomonas aeruginosa PA01
gcucccuggcgga

SEQ ID NO: 1494962 - RNA, 12 nt, Pseudomonas aeruginosa PA01
gcucccgcggcc

SEQ ID NO: 1494963 - RNA, 17 nt, Pseudomonas aeruginosa PA01
gcucccgcggcccaagg

SEQ ID NO: 1494964 - RNA, 16 nt, Pseudomonas aeruginosa PA01
gcuccggaacgccugc

SEQ ID NO: 1494965 - RNA, 22 nt, Pseudomonas aeruginosa PA01
gcuccggacucgcuaucaggca

SEQ ID NO: 1494966 - RNA, 13 nt, Pseudomonas aeruginosa PA01
gcuccggauggcu

SEQ ID NO: 1494967 - RNA, 15 nt, Pseudomonas aeruginosa PA01
gcuccggcagcaggg

SEQ ID NO: 1494968 - RNA, 15 nt, Pseudomonas aeruginosa PA01
gcuccgacuccugca

SEQ ID NO: 1494969 - RNA, 17 nt, Pseudomonas aeruginosa PA01
gcuccgacuccugcaac

SEQ ID NO: 1494970 - RNA, 17 nt, Pseudomonas aeruginosa PA01
gcuccggcgcgccaugg

SEQ ID NO: 1494971 - RNA, 14 nt, Pseudomonas aeruginosa PA01
gcuccggcgccagg

SEQ ID NO: 1494972 - RNA, 16 nt, Pseudomonas aeruginosa PA01
gcuccggcgccaggcc

SEQ ID NO: 1494973 - RNA, 18 nt, Pseudomonas aeruginosa PA01
gcuccggcgccaggccgg

SEQ ID NO: 1494974 - RNA, 20 nt, Pseudomonas aeruginosa PA01
gcuccuggaugcuccgcgcc

SEQ ID NO: 1494975 - RNA, 23 nt, Pseudomonas aeruginosa PA01
gcuccuggaugcuccgcgccuca

SEQ ID NO: 1494976 - RNA, 17 nt, Pseudomonas aeruginosa PA01
gcuccuguugcuggccg

SEQ ID NO: 1494977 - RNA, 18 nt, Pseudomonas aeruginosa PA01
gcuccuguugcuggccgg

SEQ ID NO: 1494978 - RNA, 18 nt, Pseudomonas aeruginosa PA01
gcuccuggugcggcacca

SEQ ID NO: 1494979 - RNA, 19 nt, Pseudomonas aeruginosa PA01
gcuccuggugcggcaccag

SEQ ID NO: 1494980 - RNA, 20 nt, Pseudomonas aeruginosa PA01
gcuccggcguaccguuggcg

SEQ ID NO: 1494981 - RNA, 16 nt, Pseudomonas aeruginosa PA01
gcuccgggcccgugcg

SEQ ID NO: 1494982 - RNA, 14 nt, Pseudomonas aeruginosa PA01
gcuccgggcuccac

SEQ ID NO: 1494983 - RNA, 17 nt, Pseudomonas aeruginosa PA01
gcuccgggcuccaccag

SEQ ID NO: 1494984 - RNA, 19 nt, Pseudomonas aeruginosa PA01
gcuccgggcuggccaccag

SEQ ID NO: 1494985 - RNA, 22 nt, Pseudomonas aeruginosa PA01
gcuccgggcuggccaccagcac

SEQ ID NO: 1494986 - RNA, 21 nt, Pseudomonas aeruginosa PA01
gcuccggguacuggcgcugcg

SEQ ID NO: 1494987 - RNA, 23 nt, Pseudomonas aeruginosa PA01
gcuccggguacuggcgcugcgcg

SEQ ID NO: 1494988 - RNA, 16 nt, Pseudomonas aeruginosa PA01
gcucgaacgccgcccg

SEQ ID NO: 1494989 - RNA, 21 nt, Pseudomonas aeruginosa PA01
gcucgaacgccgcccgucgcg

SEQ ID NO: 1494990 - RNA, 17 nt, Pseudomonas aeruginosa PA01
gcucgaacggcggaucg

SEQ ID NO: 1494991 - RNA, 16 nt, Pseudomonas aeruginosa PA01
gcucgaacaucagcag

SEQ ID NO: 1494992 - RNA, 16 nt, Pseudomonas aeruginosa PA01
gcuccuugcgccaggc

SEQ ID NO: 1494993 - RNA, 17 nt, Pseudomonas aeruginosa PA01
gcuccuugcgccaggcc

SEQ ID NO: 1494994 - RNA, 18 nt, Pseudomonas aeruginosa PA01
gcucgaaagccuccagca

SEQ ID NO: 1494995 - RNA, 20 nt, Pseudomonas aeruginosa PA01
gcuccuugcgcuccuuggcu

SEQ ID NO: 1494996 - RNA, 22 nt, Pseudomonas aeruginosa PA01
gcuccuuucggaacagcgccuu

SEQ ID NO: 1494997 - RNA, 19 nt, Pseudomonas aeruginosa PA01
gcuccuucgguaccugguc

SEQ ID NO: 1494998 - RNA, 22 nt, Pseudomonas aeruginosa PA01
gcuccuucuccggggcccggca

SEQ ID NO: 1494999 - RNA, 21 nt, Pseudomonas aeruginosa PA01
gcuccuugacccucugguugg

SEQ ID NO: 1495000 - RNA, 14 nt, Pseudomonas aeruginosa PA01
gcucgaagccgccg

SEQ ID NO: 1495001 - RNA, 15 nt, Pseudomonas aeruginosa PA01
gcucgaagccgccgu

SEQ ID NO: 1495002 - RNA, 19 nt, Pseudomonas aeruginosa PA01
gcucgacauacuccgccgc

SEQ ID NO: 1495003 - RNA, 18 nt, Pseudomonas aeruginosa PA01
gcucgacauugcugccga

SEQ ID NO: 1495004 - RNA, 13 nt, Pseudomonas aeruginosa PA01
gcucgagccggcu

SEQ ID NO: 1495005 - RNA, 15 nt, Pseudomonas aeruginosa PA01
gcucgagccggcuga

SEQ ID NO: 1495006 - RNA, 19 nt, Pseudomonas aeruginosa PA01
gcucgaccaccucggcguc

SEQ ID NO: 1495007 - RNA, 20 nt, Pseudomonas aeruginosa PA01
gcucgaccgccugcucgcgg

SEQ ID NO: 1495008 - RNA, 14 nt, Pseudomonas aeruginosa PA01
gcucgacccgcccg

SEQ ID NO: 1495009 - RNA, 21 nt, Pseudomonas aeruginosa PA01
gcucgacccgcccgccguccu

SEQ ID NO: 1495010 - RNA, 15 nt, Pseudomonas aeruginosa PA01
gcucgagggcgaccg

SEQ ID NO: 1495011 - RNA, 16 nt, Pseudomonas aeruginosa PA01
gcucgagggcgaccgc

SEQ ID NO: 1495012 - RNA, 21 nt, Pseudomonas aeruginosa PA01
gcucgagggcgaccgccaggc

SEQ ID NO: 1495013 - RNA, 15 nt, Pseudomonas aeruginosa PA01
gcucgaggccaggau

SEQ ID NO: 1495014 - RNA, 11 nt, Pseudomonas aeruginosa PA01
gcucgaggccg

SEQ ID NO: 1495015 - RNA, 13 nt, Pseudomonas aeruginosa PA01
gcucgaggccgag

SEQ ID NO: 1495016 - RNA, 18 nt, Pseudomonas aeruginosa PA01
gcucgaggccgagccggc

SEQ ID NO: 1495017 - RNA, 19 nt, Pseudomonas aeruginosa PA01
gcucgaggccgagccggca

SEQ ID NO: 1495018 - RNA, 17 nt, Pseudomonas aeruginosa PA01
gcucgcaacgcuguccg

SEQ ID NO: 1495019 - RNA, 18 nt, Pseudomonas aeruginosa PA01
gcucgcaaucagcgcgau

SEQ ID NO: 1495020 - RNA, 14 nt, Pseudomonas aeruginosa PA01
gcucgcaccaggcc

SEQ ID NO: 1495021 - RNA, 17 nt, Pseudomonas aeruginosa PA01
gcucgcaccaggccagg

SEQ ID NO: 1495022 - RNA, 13 nt, Pseudomonas aeruginosa PA01
gcucucuucggcc

SEQ ID NO: 1495023 - RNA, 18 nt, Pseudomonas aeruginosa PA01
gcucugccagaaggccug

SEQ ID NO: 1495024 - RNA, 22 nt, Pseudomonas aeruginosa PA01
gcucugccagaaggccugcgcu

SEQ ID NO: 1495025 - RNA, 14 nt, Pseudomonas aeruginosa PA01
gcucucgcuggugg

SEQ ID NO: 1495026 - RNA, 18 nt, Pseudomonas aeruginosa PA01
gcucucggugaccaccag

SEQ ID NO: 1495027 - RNA, 15 nt, Pseudomonas aeruginosa PA01
gcucucgcgcacgcu

SEQ ID NO: 1495028 - RNA, 20 nt, Pseudomonas aeruginosa PA01
gcucucgcgcagcaggaucc

SEQ ID NO: 1495029 - RNA, 19 nt, Pseudomonas aeruginosa PA01
gcucucgccgccuucggca

SEQ ID NO: 1495030 - RNA, 21 nt, Pseudomonas aeruginosa PA01
gcucucgaacaccaggcgcca

SEQ ID NO: 1495031 - RNA, 23 nt, Pseudomonas aeruginosa PA01
gcucucgaacaccaggcgccagg

SEQ ID NO: 1495032 - RNA, 14 nt, Pseudomonas aeruginosa PA01
gcucucgaacaccg

SEQ ID NO: 1495033 - RNA, 18 nt, Pseudomonas aeruginosa PA01
gcucucgaacaccggcga

SEQ ID NO: 1495034 - RNA, 15 nt, Pseudomonas aeruginosa PA01
gcucucgaacagcag

SEQ ID NO: 1495035 - RNA, 22 nt, Pseudomonas aeruginosa PA01
gcucucgaacagcagcaagccg

SEQ ID NO: 1495036 - RNA, 14 nt, Pseudomonas aeruginosa PA01
gcugaauucccgcu

SEQ ID NO: 1495037 - RNA, 15 nt, Pseudomonas aeruginosa PA01
gcugaauucccgcuc

SEQ ID NO: 1495038 - RNA, 21 nt, Pseudomonas aeruginosa PA01
gcugaauaccaccgggccguc

SEQ ID NO: 1495039 - RNA, 23 nt, Pseudomonas aeruginosa PA01
gcugaauaccacguggccggcgc

SEQ ID NO: 1495040 - RNA, 20 nt, Pseudomonas aeruginosa PA01
gcugaacagcgccaccagca

SEQ ID NO: 1495041 - RNA, 17 nt, Pseudomonas aeruginosa PA01
gcugaagcugucgcccu

SEQ ID NO: 1495042 - RNA, 13 nt, Pseudomonas aeruginosa PA01
gcugaaggucgcc

SEQ ID NO: 1495043 - RNA, 15 nt, Pseudomonas aeruginosa PA01
gcugaaggucgccgc

SEQ ID NO: 1495044 - RNA, 18 nt, Pseudomonas aeruginosa PA01
gcugaaggucgccgcgcu

SEQ ID NO: 1495045 - RNA, 20 nt, Pseudomonas aeruginosa PA01
gcugaaggucgccgcgcuga

SEQ ID NO: 1495046 - RNA, 15 nt, Pseudomonas aeruginosa PA01
gcugaaguccuggcc

SEQ ID NO: 1495047 - RNA, 17 nt, Pseudomonas aeruginosa PA01
gcugaaguccuggccga

SEQ ID NO: 1495048 - RNA, 20 nt, Pseudomonas aeruginosa PA01
gcugaaguccuggccgagca

SEQ ID NO: 1495049 - RNA, 23 nt, Pseudomonas aeruginosa PA01
gcugaaguccuggccgagcauca

SEQ ID NO: 1495050 - RNA, 13 nt, Pseudomonas aeruginosa PA01
gcucggcgucguc

SEQ ID NO: 1495051 - RNA, 16 nt, Pseudomonas aeruginosa PA01
gcucggcggugaccgg

SEQ ID NO: 1495052 - RNA, 17 nt, Pseudomonas aeruginosa PA01
gcucggcggucaggcca

SEQ ID NO: 1495053 - RNA, 16 nt, Pseudomonas aeruginosa PA01
gcucggcguagccggc

SEQ ID NO: 1495054 - RNA, 18 nt, Pseudomonas aeruginosa PA01
gcucggcuccagccaggc

SEQ ID NO: 1495055 - RNA, 19 nt, Pseudomonas aeruginosa PA01
gcucggcuccagccaggcc

SEQ ID NO: 1495056 - RNA, 20 nt, Pseudomonas aeruginosa PA01
gcucggcuccagccaggccc

SEQ ID NO: 1495057 - RNA, 18 nt, Pseudomonas aeruginosa PA01
gcucggcuccaggaccgg

SEQ ID NO: 1495058 - RNA, 14 nt, Pseudomonas aeruginosa PA01
gcucggcucgcggu

SEQ ID NO: 1495059 - RNA, 17 nt, Pseudomonas aeruginosa PA01
gcucggcucgcgguucg

SEQ ID NO: 1495060 - RNA, 16 nt, Pseudomonas aeruginosa PA01
gcucggcugcuugccg

SEQ ID NO: 1495061 - RNA, 20 nt, Pseudomonas aeruginosa PA01
gcucggcugcuugccggugc

SEQ ID NO: 1495062 - RNA, 21 nt, Pseudomonas aeruginosa PA01
gcucggcugcuugccggugcc

SEQ ID NO: 1495063 - RNA, 13 nt, Pseudomonas aeruginosa PA01
gcucggcuucgcg

SEQ ID NO: 1495064 - RNA, 14 nt, Pseudomonas aeruginosa PA01
gcucggcuucgcgu

SEQ ID NO: 1495065 - RNA, 14 nt, Pseudomonas aeruginosa PA01
gcucguucgcccag

SEQ ID NO: 1495066 - RNA, 16 nt, Pseudomonas aeruginosa PA01
gcucguugauccgcgu

SEQ ID NO: 1495067 - RNA, 13 nt, Pseudomonas aeruginosa PA01
gcucguugcacag

SEQ ID NO: 1495068 - RNA, 21 nt, Pseudomonas aeruginosa PA01
gcucguugcacagcgcccaga

SEQ ID NO: 1495069 - RNA, 15 nt, Pseudomonas aeruginosa PA01
gcucguugcccggcu

SEQ ID NO: 1495070 - RNA, 15 nt, Pseudomonas aeruginosa PA01
gcucguuggcggcca

SEQ ID NO: 1495071 - RNA, 17 nt, Pseudomonas aeruginosa PA01
gcucguugcgccgcucc

SEQ ID NO: 1495072 - RNA, 19 nt, Pseudomonas aeruginosa PA01
gcucuaccgagaucaccuu

SEQ ID NO: 1495073 - RNA, 23 nt, Pseudomonas aeruginosa PA01
gcucuaucgacgguuucaggccu

SEQ ID NO: 1495074 - RNA, 23 nt, Pseudomonas aeruginosa PA01
gcucuccacuaccgccgagggcg

SEQ ID NO: 1495075 - RNA, 22 nt, Pseudomonas aeruginosa PA01
gcucuccgucaaugcggccugc

SEQ ID NO: 1495076 - RNA, 19 nt, Pseudomonas aeruginosa PA01
gcugaucaucgagaacagg

SEQ ID NO: 1495077 - RNA, 23 nt, Pseudomonas aeruginosa PA01
gcugaucaggaggaucgccagga

SEQ ID NO: 1495078 - RNA, 13 nt, Pseudomonas aeruginosa PA01
gcugaucaggccg

SEQ ID NO: 1495079 - RNA, 14 nt, Pseudomonas aeruginosa PA01
gcugaucaggccga

SEQ ID NO: 1495080 - RNA, 15 nt, Pseudomonas aeruginosa PA01
gcugaucaguaccgg

SEQ ID NO: 1495081 - RNA, 20 nt, Pseudomonas aeruginosa PA01
gcugaucaguaccggcagcg

SEQ ID NO: 1495082 - RNA, 23 nt, Pseudomonas aeruginosa PA01
gcugaucaguaccggcagcgccg

SEQ ID NO: 1495083 - RNA, 19 nt, Pseudomonas aeruginosa PA01
gcugaucacccgcccgccg

SEQ ID NO: 1495084 - RNA, 16 nt, Pseudomonas aeruginosa PA01
gcugaucagcccgcug

SEQ ID NO: 1495085 - RNA, 20 nt, Pseudomonas aeruginosa PA01
gcugaucacguagaugccgg

SEQ ID NO: 1495086 - RNA, 20 nt, Pseudomonas aeruginosa PA01
gcugaucgcgcagaucgccg

SEQ ID NO: 1495087 - RNA, 21 nt, Pseudomonas aeruginosa PA01
gcugaucgcgcagaucgccgc

SEQ ID NO: 1495088 - RNA, 22 nt, Pseudomonas aeruginosa PA01
gcugaucgcgcagaucgccgcg

SEQ ID NO: 1495089 - RNA, 14 nt, Pseudomonas aeruginosa PA01
gcugaucugccggu

SEQ ID NO: 1495090 - RNA, 16 nt, Pseudomonas aeruginosa PA01
gcugaucggccgccag

SEQ ID NO: 1495091 - RNA, 19 nt, Pseudomonas aeruginosa PA01
gcugaucggccgccagugc

SEQ ID NO: 1495092 - RNA, 20 nt, Pseudomonas aeruginosa PA01
gcugaucggccgccagugca

SEQ ID NO: 1495093 - RNA, 14 nt, Pseudomonas aeruginosa PA01
gcugaucucggcca

SEQ ID NO: 1495094 - RNA, 15 nt, Pseudomonas aeruginosa PA01
gcugaucucggcgac

SEQ ID NO: 1495095 - RNA, 18 nt, Pseudomonas aeruginosa PA01
gcugaguuucacgucgag

SEQ ID NO: 1495096 - RNA, 21 nt, Pseudomonas aeruginosa PA01
gcugaguuugcccagcgccgc

SEQ ID NO: 1495097 - RNA, 20 nt, Pseudomonas aeruginosa PA01
gcugaggaagagcagcgcgg

SEQ ID NO: 1495098 - RNA, 16 nt, Pseudomonas aeruginosa PA01
gcugaggacugccagg

SEQ ID NO: 1495099 - RNA, 18 nt, Pseudomonas aeruginosa PA01
gcugaggacugccagggu

SEQ ID NO: 1495100 - RNA, 22 nt, Pseudomonas aeruginosa PA01
gcugaggacugccaggguaccg

SEQ ID NO: 1495101 - RNA, 22 nt, Pseudomonas aeruginosa PA01
gcugaggaucacgauggccggc

SEQ ID NO: 1495102 - RNA, 15 nt, Pseudomonas aeruginosa PA01
gcugaggaucagcca

SEQ ID NO: 1495103 - RNA, 22 nt, Pseudomonas aeruginosa PA01
gcugaggaucagccagccggcg

SEQ ID NO: 1495104 - RNA, 14 nt, Pseudomonas aeruginosa PA01
gcugaggccgacga

SEQ ID NO: 1495105 - RNA, 15 nt, Pseudomonas aeruginosa PA01
gcugaggccgacgaa

SEQ ID NO: 1495106 - RNA, 19 nt, Pseudomonas aeruginosa PA01
gcugaggccgacgaacagc

SEQ ID NO: 1495107 - RNA, 20 nt, Pseudomonas aeruginosa PA01
gcugaggccgacgaacagcc

SEQ ID NO: 1495108 - RNA, 13 nt, Pseudomonas aeruginosa PA01
gcugaggccgccc

SEQ ID NO: 1495109 - RNA, 14 nt, Pseudomonas aeruginosa PA01
gcugaggccgcccu

SEQ ID NO: 1495110 - RNA, 14 nt, Pseudomonas aeruginosa PA01
gcugaggcuggcga

SEQ ID NO: 1495111 - RNA, 21 nt, Pseudomonas aeruginosa PA01
gcugaggguggaacccauggc

SEQ ID NO: 1495112 - RNA, 15 nt, Pseudomonas aeruginosa PA01
gcugagcaccgggac

SEQ ID NO: 1495113 - RNA, 17 nt, Pseudomonas aeruginosa PA01
gcugagcagucgccugg

SEQ ID NO: 1495114 - RNA, 18 nt, Pseudomonas aeruginosa PA01
gcugagcagucgccuggc

SEQ ID NO: 1495115 - RNA, 23 nt, Pseudomonas aeruginosa PA01
gcugagcaguugcgggcgcaggu

SEQ ID NO: 1495116 - RNA, 16 nt, Pseudomonas aeruginosa PA01
gcugagcaggccgacg

SEQ ID NO: 1495117 - RNA, 23 nt, Pseudomonas aeruginosa PA01
gcugagcaggccgacggcgcgcu

SEQ ID NO: 1495118 - RNA, 17 nt, Pseudomonas aeruginosa PA01
gcugagcgccaggcgca

SEQ ID NO: 1495119 - RNA, 12 nt, Pseudomonas aeruginosa PA01
gcugagcgccuc

SEQ ID NO: 1495120 - RNA, 15 nt, Pseudomonas aeruginosa PA01
gcugagcgccucgau

SEQ ID NO: 1495121 - RNA, 17 nt, Pseudomonas aeruginosa PA01
gcugagcgccucgaucg

SEQ ID NO: 1495122 - RNA, 12 nt, Pseudomonas aeruginosa PA01
gcugagcgcggu

SEQ ID NO: 1495123 - RNA, 18 nt, Pseudomonas aeruginosa PA01
gcugagcggcugguggcc

SEQ ID NO: 1495124 - RNA, 14 nt, Pseudomonas aeruginosa PA01
gcugaccaggucgu

SEQ ID NO: 1495125 - RNA, 18 nt, Pseudomonas aeruginosa PA01
gcugaccagcccggcggc

SEQ ID NO: 1495126 - RNA, 20 nt, Pseudomonas aeruginosa PA01
gcugaccagcccggcggcgg

SEQ ID NO: 1495127 - RNA, 22 nt, Pseudomonas aeruginosa PA01
gcugaccagcccggcggcggca

SEQ ID NO: 1495128 - RNA, 17 nt, Pseudomonas aeruginosa PA01
gcugaccaccagggcga

SEQ ID NO: 1495129 - RNA, 17 nt, Pseudomonas aeruginosa PA01
gcugaccacccggugca

SEQ ID NO: 1495130 - RNA, 22 nt, Pseudomonas aeruginosa PA01
gcugacccaggcuucggcgcgc

SEQ ID NO: 1495131 - RNA, 23 nt, Pseudomonas aeruginosa PA01
gcugacccaggcuucggcgcgcu

SEQ ID NO: 1495132 - RNA, 14 nt, Pseudomonas aeruginosa PA01
gcugacccagcgca

SEQ ID NO: 1495133 - RNA, 18 nt, Pseudomonas aeruginosa PA01
gcugagaccgauccagca

SEQ ID NO: 1495134 - RNA, 19 nt, Pseudomonas aeruginosa PA01
gcugagaccgauccagcag

SEQ ID NO: 1495135 - RNA, 18 nt, Pseudomonas aeruginosa PA01
gcugagaccuuccugcca

SEQ ID NO: 1495136 - RNA, 19 nt, Pseudomonas aeruginosa PA01
gcugaugcccgggucgucg

SEQ ID NO: 1495137 - RNA, 19 nt, Pseudomonas aeruginosa PA01
gcugaugaugccgcggcga

SEQ ID NO: 1495138 - RNA, 16 nt, Pseudomonas aeruginosa PA01
gcugcaauucgucggc

SEQ ID NO: 1495139 - RNA, 18 nt, Pseudomonas aeruginosa PA01
gcugcaauucgucggccu

SEQ ID NO: 1495140 - RNA, 20 nt, Pseudomonas aeruginosa PA01
gcugcaauucgcagagaucg

SEQ ID NO: 1495141 - RNA, 15 nt, Pseudomonas aeruginosa PA01
gcugcaaucgcugcc

SEQ ID NO: 1495142 - RNA, 19 nt, Pseudomonas aeruginosa PA01
gcugcaaucgcugccgguc

SEQ ID NO: 1495143 - RNA, 21 nt, Pseudomonas aeruginosa PA01
gcugcacagccauagcgccgg

SEQ ID NO: 1495144 - RNA, 22 nt, Pseudomonas aeruginosa PA01
gcugcacagccauagcgccggc

SEQ ID NO: 1495145 - RNA, 13 nt, Pseudomonas aeruginosa PA01
gcugcaacgccgc

SEQ ID NO: 1495146 - RNA, 15 nt, Pseudomonas aeruginosa PA01
gcugcaacgccgcgg

SEQ ID NO: 1495147 - RNA, 15 nt, Pseudomonas aeruginosa PA01
gcugcaacuccgccu

SEQ ID NO: 1495148 - RNA, 19 nt, Pseudomonas aeruginosa PA01
gcugcaaggcuucggcggu

SEQ ID NO: 1495149 - RNA, 20 nt, Pseudomonas aeruginosa PA01
gcugcaaggcuucggcgguc

SEQ ID NO: 1495150 - RNA, 15 nt, Pseudomonas aeruginosa PA01
gcugcaucggcgcgc

SEQ ID NO: 1495151 - RNA, 18 nt, Pseudomonas aeruginosa PA01
gcugcaucggcgcgccga

SEQ ID NO: 1495152 - RNA, 22 nt, Pseudomonas aeruginosa PA01
gcugcaucggcgcgccgaaggc

SEQ ID NO: 1495153 - RNA, 19 nt, Pseudomonas aeruginosa PA01
gcugcaucggcucggcaag

SEQ ID NO: 1495154 - RNA, 20 nt, Pseudomonas aeruginosa PA01
gcugcaucggcucggcaagc

SEQ ID NO: 1495155 - RNA, 17 nt, Pseudomonas aeruginosa PA01
gcugcagcgccccagca

SEQ ID NO: 1495156 - RNA, 16 nt, Pseudomonas aeruginosa PA01
gcugcagcaucaggcg

SEQ ID NO: 1495157 - RNA, 22 nt, Pseudomonas aeruginosa PA01
gcugcccagcccgccuuccagc

SEQ ID NO: 1495158 - RNA, 13 nt, Pseudomonas aeruginosa PA01
gcugcccggcgcg

SEQ ID NO: 1495159 - RNA, 15 nt, Pseudomonas aeruginosa PA01
gcugcccaucgccuc

SEQ ID NO: 1495160 - RNA, 17 nt, Pseudomonas aeruginosa PA01
gcugcccaucgccucca

SEQ ID NO: 1495161 - RNA, 21 nt, Pseudomonas aeruginosa PA01
gcugcccaucgccuccacggc

SEQ ID NO: 1495162 - RNA, 20 nt, Pseudomonas aeruginosa PA01
gcugcccagguagccggcga

SEQ ID NO: 1495163 - RNA, 22 nt, Pseudomonas aeruginosa PA01
gcugcccagguagccggcgagc

SEQ ID NO: 1495164 - RNA, 14 nt, Pseudomonas aeruginosa PA01
gcugcccucgacga

SEQ ID NO: 1495165 - RNA, 20 nt, Pseudomonas aeruginosa PA01
gcugccgaacaggcguccca

SEQ ID NO: 1495166 - RNA, 22 nt, Pseudomonas aeruginosa PA01
gcugccgaacagacgggacagg

SEQ ID NO: 1495167 - RNA, 14 nt, Pseudomonas aeruginosa PA01
gcugccgaacagca

SEQ ID NO: 1495168 - RNA, 12 nt, Pseudomonas aeruginosa PA01
gcugcccuggcg

SEQ ID NO: 1495169 - RNA, 13 nt, Pseudomonas aeruginosa PA01
gcugcccuggcgc

SEQ ID NO: 1495170 - RNA, 14 nt, Pseudomonas aeruginosa PA01
gcugcccuggcgcg

SEQ ID NO: 1495171 - RNA, 15 nt, Pseudomonas aeruginosa PA01
gcugccgaucagcca

SEQ ID NO: 1495172 - RNA, 14 nt, Pseudomonas aeruginosa PA01
gcugccgcagauca

SEQ ID NO: 1495173 - RNA, 23 nt, Pseudomonas aeruginosa PA01
gcugccgaggcugaucugccggu

SEQ ID NO: 1495174 - RNA, 23 nt, Pseudomonas aeruginosa PA01
gcugccgagcagggucacgccga

SEQ ID NO: 1495175 - RNA, 16 nt, Pseudomonas aeruginosa PA01
gcugccgagcaggugc

SEQ ID NO: 1495176 - RNA, 21 nt, Pseudomonas aeruginosa PA01
gcugccgagaaucugcccggc

SEQ ID NO: 1495177 - RNA, 16 nt, Pseudomonas aeruginosa PA01
gcugccauggcggcgg

SEQ ID NO: 1495178 - RNA, 17 nt, Pseudomonas aeruginosa PA01
gcugccacccggcucgg

SEQ ID NO: 1495179 - RNA, 14 nt, Pseudomonas aeruginosa PA01
gcugcccaccacca

SEQ ID NO: 1495180 - RNA, 16 nt, Pseudomonas aeruginosa PA01
gcugcccaacuggcgg

SEQ ID NO: 1495181 - RNA, 13 nt, Pseudomonas aeruginosa PA01
gcugcccaggcug

SEQ ID NO: 1495182 - RNA, 16 nt, Pseudomonas aeruginosa PA01
gcugcccagauccccu

SEQ ID NO: 1495183 - RNA, 20 nt, Pseudomonas aeruginosa PA01
gcugcaugaaaaagcccggc

SEQ ID NO: 1495184 - RNA, 21 nt, Pseudomonas aeruginosa PA01
gcugcaugaaaaagcccggcc

SEQ ID NO: 1495185 - RNA, 22 nt, Pseudomonas aeruginosa PA01
gcugcaugaaaaagcccggccg

SEQ ID NO: 1495186 - RNA, 17 nt, Pseudomonas aeruginosa PA01
gcugcaugagugucgcc

SEQ ID NO: 1495187 - RNA, 20 nt, Pseudomonas aeruginosa PA01
gcugcaugggcucgcgcggg

SEQ ID NO: 1495188 - RNA, 22 nt, Pseudomonas aeruginosa PA01
gcugcaugggcucgcgcggggc

SEQ ID NO: 1495189 - RNA, 15 nt, Pseudomonas aeruginosa PA01
gcugcauguccgcag

SEQ ID NO: 1495190 - RNA, 16 nt, Pseudomonas aeruginosa PA01
gcugcauguccgccag

SEQ ID NO: 1495191 - RNA, 17 nt, Pseudomonas aeruginosa PA01
gcugcaugugccaggcc

SEQ ID NO: 1495192 - RNA, 20 nt, Pseudomonas aeruginosa PA01
gcugcaugugccaggccugg

SEQ ID NO: 1495193 - RNA, 19 nt, Pseudomonas aeruginosa PA01
gcugcgccguuucgacgau

SEQ ID NO: 1495194 - RNA, 23 nt, Pseudomonas aeruginosa PA01
gcugcgccguuucgacgaugcuc

SEQ ID NO: 1495195 - RNA, 21 nt, Pseudomonas aeruginosa PA01
gcugcgccgcguucgccgagc

SEQ ID NO: 1495196 - RNA, 12 nt, Pseudomonas aeruginosa PA01
gcugcgccgccg

SEQ ID NO: 1495197 - RNA, 13 nt, Pseudomonas aeruginosa PA01
gcugcgccgccgu

SEQ ID NO: 1495198 - RNA, 12 nt, Pseudomonas aeruginosa PA01
gcugcgccgccu

SEQ ID NO: 1495199 - RNA, 17 nt, Pseudomonas aeruginosa PA01
gcugcgccgccuuucug

SEQ ID NO: 1495200 - RNA, 17 nt, Pseudomonas aeruginosa PA01
gcugcgcccgcucgacc

SEQ ID NO: 1495201 - RNA, 18 nt, Pseudomonas aeruginosa PA01
gcugcgcccgcucgaccc

SEQ ID NO: 1495202 - RNA, 18 nt, Pseudomonas aeruginosa PA01
gcugccggcuugcugcag

SEQ ID NO: 1495203 - RNA, 15 nt, Pseudomonas aeruginosa PA01
gcugccgggcgagcu

SEQ ID NO: 1495204 - RNA, 19 nt, Pseudomonas aeruginosa PA01
gcugccgggcucugguagc

SEQ ID NO: 1495205 - RNA, 15 nt, Pseudomonas aeruginosa PA01
gcugccggucaggcu

SEQ ID NO: 1495206 - RNA, 14 nt, Pseudomonas aeruginosa PA01
gcugcgccaggccg

SEQ ID NO: 1495207 - RNA, 15 nt, Pseudomonas aeruginosa PA01
gcugcgccaggccgu

SEQ ID NO: 1495208 - RNA, 13 nt, Pseudomonas aeruginosa PA01
gcugcgccaggcu

SEQ ID NO: 1495209 - RNA, 13 nt, Pseudomonas aeruginosa PA01
gcugccggccagg

SEQ ID NO: 1495210 - RNA, 14 nt, Pseudomonas aeruginosa PA01
gcugccggccaggg

SEQ ID NO: 1495211 - RNA, 22 nt, Pseudomonas aeruginosa PA01
gcugccggccagggucgccagc

SEQ ID NO: 1495212 - RNA, 14 nt, Pseudomonas aeruginosa PA01
gcugccggccaggu

SEQ ID NO: 1495213 - RNA, 17 nt, Pseudomonas aeruginosa PA01
gcugccggccagguagc

SEQ ID NO: 1495214 - RNA, 14 nt, Pseudomonas aeruginosa PA01
gcugccggcgcgca

SEQ ID NO: 1495215 - RNA, 15 nt, Pseudomonas aeruginosa PA01
gcugccggcgcgcac

SEQ ID NO: 1495216 - RNA, 19 nt, Pseudomonas aeruginosa PA01
gcugccggcauugcccaau

SEQ ID NO: 1495217 - RNA, 20 nt, Pseudomonas aeruginosa PA01
gcugccgccuucgcgggcca

SEQ ID NO: 1495218 - RNA, 21 nt, Pseudomonas aeruginosa PA01
gcugccgccuucgcgggccag

SEQ ID NO: 1495219 - RNA, 18 nt, Pseudomonas aeruginosa PA01
gcugccgccgccgucgac

SEQ ID NO: 1495220 - RNA, 15 nt, Pseudomonas aeruginosa PA01
gcugccgccgcgcag

SEQ ID NO: 1495221 - RNA, 15 nt, Pseudomonas aeruginosa PA01
gcugccgccgcgccc

SEQ ID NO: 1495222 - RNA, 18 nt, Pseudomonas aeruginosa PA01
gcugccgccgcgcccggc

SEQ ID NO: 1495223 - RNA, 17 nt, Pseudomonas aeruginosa PA01
gcugccgccgcgcugca

SEQ ID NO: 1495224 - RNA, 23 nt, Pseudomonas aeruginosa PA01
gcugccgcgcguggcuucgucca

SEQ ID NO: 1495225 - RNA, 23 nt, Pseudomonas aeruginosa PA01
gcugccgcugacggucugccagc

SEQ ID NO: 1495226 - RNA, 23 nt, Pseudomonas aeruginosa PA01
gcugccgccgucuccgccgcuau

SEQ ID NO: 1495227 - RNA, 13 nt, Pseudomonas aeruginosa PA01
gcugccgccagcu

SEQ ID NO: 1495228 - RNA, 15 nt, Pseudomonas aeruginosa PA01
gcugccgccagcuca

SEQ ID NO: 1495229 - RNA, 22 nt, Pseudomonas aeruginosa PA01
gcugcgcguacaucccgccgau

SEQ ID NO: 1495230 - RNA, 20 nt, Pseudomonas aeruginosa PA01
gcugcgggcguagcgcggca

SEQ ID NO: 1495231 - RNA, 20 nt, Pseudomonas aeruginosa PA01
gcugcggggccggacgcgac

SEQ ID NO: 1495232 - RNA, 12 nt, Pseudomonas aeruginosa PA01
gcugcgcggccu

SEQ ID NO: 1495233 - RNA, 14 nt, Pseudomonas aeruginosa PA01
gcugcgcggccugc

SEQ ID NO: 1495234 - RNA, 22 nt, Pseudomonas aeruginosa PA01
gcugcgcggccugcgccggacc

SEQ ID NO: 1495235 - RNA, 17 nt, Pseudomonas aeruginosa PA01
gcugcgcgggucguccu

SEQ ID NO: 1495236 - RNA, 14 nt, Pseudomonas aeruginosa PA01
gcugcggggugagc

SEQ ID NO: 1495237 - RNA, 15 nt, Pseudomonas aeruginosa PA01
gcugcgcgcaccaua

SEQ ID NO: 1495238 - RNA, 13 nt, Pseudomonas aeruginosa PA01
gcugcgccuggcc

SEQ ID NO: 1495239 - RNA, 16 nt, Pseudomonas aeruginosa PA01
gcugcgccuggccgcg

SEQ ID NO: 1495240 - RNA, 18 nt, Pseudomonas aeruginosa PA01
gcugcgcgcggcccacca

SEQ ID NO: 1495241 - RNA, 12 nt, Pseudomonas aeruginosa PA01
gcugcgcgccgc

SEQ ID NO: 1495242 - RNA, 22 nt, Pseudomonas aeruginosa PA01
gcugcggguucagucggccagg

SEQ ID NO: 1495243 - RNA, 20 nt, Pseudomonas aeruginosa PA01
gcugcgucgucgcggcgccu

SEQ ID NO: 1495244 - RNA, 23 nt, Pseudomonas aeruginosa PA01
gcugcuaggcuggaagccgcgcu

SEQ ID NO: 1495245 - RNA, 15 nt, Pseudomonas aeruginosa PA01
gcugcgugcgccgcu

SEQ ID NO: 1495246 - RNA, 16 nt, Pseudomonas aeruginosa PA01
gcugcgugcguugcgc

SEQ ID NO: 1495247 - RNA, 19 nt, Pseudomonas aeruginosa PA01
gcugcgugcguugcgcggc

SEQ ID NO: 1495248 - RNA, 20 nt, Pseudomonas aeruginosa PA01
gcugcgugcguugcgcggca

SEQ ID NO: 1495249 - RNA, 16 nt, Pseudomonas aeruginosa PA01
gcugcgucguuggccg

SEQ ID NO: 1495250 - RNA, 19 nt, Pseudomonas aeruginosa PA01
gcugcgucguuggccggcu

SEQ ID NO: 1495251 - RNA, 21 nt, Pseudomonas aeruginosa PA01
gcugcgucguuggccggcugc

SEQ ID NO: 1495252 - RNA, 15 nt, Pseudomonas aeruginosa PA01
gcugcgugccagcac

SEQ ID NO: 1495253 - RNA, 17 nt, Pseudomonas aeruginosa PA01
gcugcgugccagcaccu

SEQ ID NO: 1495254 - RNA, 13 nt, Pseudomonas aeruginosa PA01
gcugcgugccagg

SEQ ID NO: 1495255 - RNA, 15 nt, Pseudomonas aeruginosa PA01
ggaaauaggcgucgu

SEQ ID NO: 1495256 - RNA, 15 nt, Pseudomonas aeruginosa PA01
ggaaaggccucggcg

SEQ ID NO: 1495257 - RNA, 20 nt, Pseudomonas aeruginosa PA01
ggaaauccuugagcacccgg

SEQ ID NO: 1495258 - RNA, 23 nt, Pseudomonas aeruginosa PA01
ggaaauccuuucgaucuggcugc

SEQ ID NO: 1495259 - RNA, 16 nt, Pseudomonas aeruginosa PA01
ggaaagccuggccggc

SEQ ID NO: 1495260 - RNA, 19 nt, Pseudomonas aeruginosa PA01
ggaaagcuccucggccuug

SEQ ID NO: 1495261 - RNA, 20 nt, Pseudomonas aeruginosa PA01
ggaaagccccgcuucggcgg

SEQ ID NO: 1495262 - RNA, 15 nt, Pseudomonas aeruginosa PA01
ggaaacgacaggcug

SEQ ID NO: 1495263 - RNA, 15 nt, Pseudomonas aeruginosa PA01
ggaaaccggccagcg

SEQ ID NO: 1495264 - RNA, 17 nt, Pseudomonas aeruginosa PA01
ggaaaccggccagcgca

SEQ ID NO: 1495265 - RNA, 16 nt, Pseudomonas aeruginosa PA01
ggaaaccucgccgguc

SEQ ID NO: 1495266 - RNA, 20 nt, Pseudomonas aeruginosa PA01
ggaaacgccgagaacgcggc

SEQ ID NO: 1495267 - RNA, 21 nt, Pseudomonas aeruginosa PA01
ggaaacgccgagaacgcggcg

SEQ ID NO: 1495268 - RNA, 23 nt, Pseudomonas aeruginosa PA01
ggaaagaccgaacaucagcagca

SEQ ID NO: 1495269 - RNA, 20 nt, Pseudomonas aeruginosa PA01
ggaaacgcgcgcucucgccg

SEQ ID NO: 1495270 - RNA, 16 nt, Pseudomonas aeruginosa PA01
ggaaagaaacggugga

SEQ ID NO: 1495271 - RNA, 15 nt, Pseudomonas aeruginosa PA01
ggaaacacgucgauc

SEQ ID NO: 1495272 - RNA, 16 nt, Pseudomonas aeruginosa PA01
ggaaacaagcucuucg

SEQ ID NO: 1495273 - RNA, 20 nt, Pseudomonas aeruginosa PA01
ggaaaagccccgcuucggcg

SEQ ID NO: 1495274 - RNA, 21 nt, Pseudomonas aeruginosa PA01
ggaaacccaugcccgccccgc

SEQ ID NO: 1495275 - RNA, 16 nt, Pseudomonas aeruginosa PA01
ggaaaccccggccugg

SEQ ID NO: 1495276 - RNA, 17 nt, Pseudomonas aeruginosa PA01
ggaaaccccggccuggc

SEQ ID NO: 1495277 - RNA, 16 nt, Pseudomonas aeruginosa PA01
ggaaaccgcggccggc

SEQ ID NO: 1495278 - RNA, 17 nt, Pseudomonas aeruginosa PA01
ggaaaccgcggccggcu

SEQ ID NO: 1495279 - RNA, 22 nt, Pseudomonas aeruginosa PA01
ggaaaaacccggcccaggccgg

SEQ ID NO: 1495280 - RNA, 16 nt, Pseudomonas aeruginosa PA01
gcuuuuucaugagcgc

SEQ ID NO: 1495281 - RNA, 19 nt, Pseudomonas aeruginosa PA01
gcuuuuucaugagcgcccg

SEQ ID NO: 1495282 - RNA, 19 nt, Pseudomonas aeruginosa PA01
gcuuuuucaugggcgcgcg

SEQ ID NO: 1495283 - RNA, 17 nt, Pseudomonas aeruginosa PA01
gcuuuugaacaccagcg

SEQ ID NO: 1495284 - RNA, 21 nt, Pseudomonas aeruginosa PA01
gcuuuuccggcgccggcagga

SEQ ID NO: 1495285 - RNA, 14 nt, Pseudomonas aeruginosa PA01
gcuuuuccagcgca

SEQ ID NO: 1495286 - RNA, 20 nt, Pseudomonas aeruginosa PA01
gcuuuucucgccucccggcu

SEQ ID NO: 1495287 - RNA, 15 nt, Pseudomonas aeruginosa PA01
gcuuugcgccucgcg

SEQ ID NO: 1495288 - RNA, 12 nt, Pseudomonas aeruginosa PA01
gcuuugcgcgca

SEQ ID NO: 1495289 - RNA, 13 nt, Pseudomonas aeruginosa PA01
gcuuugcgcgcag

SEQ ID NO: 1495290 - RNA, 16 nt, Pseudomonas aeruginosa PA01
gcuuucguagggcgaa

SEQ ID NO: 1495291 - RNA, 19 nt, Pseudomonas aeruginosa PA01
gcuuucuucgccuggcgcg

SEQ ID NO: 1495292 - RNA, 20 nt, Pseudomonas aeruginosa PA01
gcuuggugucggccgccagg

SEQ ID NO: 1495293 - RNA, 17 nt, Pseudomonas aeruginosa PA01
gcuuguaguagcgcccg

SEQ ID NO: 1495294 - RNA, 20 nt, Pseudomonas aeruginosa PA01
gcuuguaguagcgcccgacg

SEQ ID NO: 1495295 - RNA, 17 nt, Pseudomonas aeruginosa PA01
gcuugucacgcucggca

SEQ ID NO: 1495296 - RNA, 17 nt, Pseudomonas aeruginosa PA01
gcuuguccagggcgccc

SEQ ID NO: 1495297 - RNA, 15 nt, Pseudomonas aeruginosa PA01
gcuuguccaucggcu

SEQ ID NO: 1495298 - RNA, 16 nt, Pseudomonas aeruginosa PA01
gcuuguccgagaccgg

SEQ ID NO: 1495299 - RNA, 14 nt, Pseudomonas aeruginosa PA01
gcuuguccuccagc

SEQ ID NO: 1495300 - RNA, 21 nt, Pseudomonas aeruginosa PA01
gcuuguccuccagcugcgccu

SEQ ID NO: 1495301 - RNA, 22 nt, Pseudomonas aeruginosa PA01
gcuuguccuggcgcaugucgcg

SEQ ID NO: 1495302 - RNA, 22 nt, Pseudomonas aeruginosa PA01
gcuuguugcgcuccacccaggc

SEQ ID NO: 1495303 - RNA, 24 nt, Pseudomonas aeruginosa PA01
gcuuguuggccagcagccaggccu

SEQ ID NO: 1495304 - RNA, 15 nt, Pseudomonas aeruginosa PA01
gcuugugggcaugcu

SEQ ID NO: 1495305 - RNA, 12 nt, Pseudomonas aeruginosa PA01
gcuugucgccuu

SEQ ID NO: 1495306 - RNA, 17 nt, Pseudomonas aeruginosa PA01
gcuugucgccuucccgg

SEQ ID NO: 1495307 - RNA, 14 nt, Pseudomonas aeruginosa PA01
gcuuguccuuggcc

SEQ ID NO: 1495308 - RNA, 15 nt, Pseudomonas aeruginosa PA01
gcuugucgucggccu

SEQ ID NO: 1495309 - RNA, 13 nt, Pseudomonas aeruginosa PA01
gcuuucagcgccg

SEQ ID NO: 1495310 - RNA, 21 nt, Pseudomonas aeruginosa PA01
gcuuucagcgccgcucggcga

SEQ ID NO: 1495311 - RNA, 16 nt, Pseudomonas aeruginosa PA01
gcuuucaggcgcucgu

SEQ ID NO: 1495312 - RNA, 16 nt, Pseudomonas aeruginosa PA01
gcuuuccaccgccagc

SEQ ID NO: 1495313 - RNA, 14 nt, Pseudomonas aeruginosa PA01
gcuuucaucaggcg

SEQ ID NO: 1495314 - RNA, 16 nt, Pseudomonas aeruginosa PA01
gcuuuccugcuccagc

SEQ ID NO: 1495315 - RNA, 18 nt, Pseudomonas aeruginosa PA01
gcuuucgagaaagcgcag

SEQ ID NO: 1495316 - RNA, 16 nt, Pseudomonas aeruginosa PA01
gcuuucgaagcgcucc

SEQ ID NO: 1495317 - RNA, 20 nt, Pseudomonas aeruginosa PA01
gcuuucccgcuucggcccgc

SEQ ID NO: 1495318 - RNA, 17 nt, Pseudomonas aeruginosa PA01
gcuuuccagcccggcgu

SEQ ID NO: 1495319 - RNA, 14 nt, Pseudomonas aeruginosa PA01
gcuuuccaggcgcc

SEQ ID NO: 1495320 - RNA, 16 nt, Pseudomonas aeruginosa PA01
gcuuuccaggcgccgc

SEQ ID NO: 1495321 - RNA, 20 nt, Pseudomonas aeruginosa PA01
gcuuuccagggccuggcgca

SEQ ID NO: 1495322 - RNA, 14 nt, Pseudomonas aeruginosa PA01
gcuuggcaccgcgc

SEQ ID NO: 1495323 - RNA, 15 nt, Pseudomonas aeruginosa PA01
gcuuggcaccgcgca

SEQ ID NO: 1495324 - RNA, 16 nt, Pseudomonas aeruginosa PA01
gcuuggcaccgcgcag

SEQ ID NO: 1495325 - RNA, 21 nt, Pseudomonas aeruginosa PA01
gcuuggcaccgcgcagcguca

SEQ ID NO: 1495326 - RNA, 18 nt, Pseudomonas aeruginosa PA01
gcuuggagcgggcgccgg

SEQ ID NO: 1495327 - RNA, 17 nt, Pseudomonas aeruginosa PA01
gcuuggacagcucgcgg

SEQ ID NO: 1495328 - RNA, 20 nt, Pseudomonas aeruginosa PA01
gcuuggccagcaggccgagc

SEQ ID NO: 1495329 - RNA, 16 nt, Pseudomonas aeruginosa PA01
gcuuggccagcgcggu

SEQ ID NO: 1495330 - RNA, 15 nt, Pseudomonas aeruginosa PA01
gcuuggcccugcgcg

SEQ ID NO: 1495331 - RNA, 15 nt, Pseudomonas aeruginosa PA01
gcuuggccaggcgcu

SEQ ID NO: 1495332 - RNA, 19 nt, Pseudomonas aeruginosa PA01
gcuuggccaggucgcgcag

SEQ ID NO: 1495333 - RNA, 15 nt, Pseudomonas aeruginosa PA01
gcuuggccaggucgu

SEQ ID NO: 1495334 - RNA, 16 nt, Pseudomonas aeruginosa PA01
gcuuggccauggcgcu

SEQ ID NO: 1495335 - RNA, 22 nt, Pseudomonas aeruginosa PA01
gcuuggccauggcgcuugcgca

SEQ ID NO: 1495336 - RNA, 12 nt, Pseudomonas aeruginosa PA01
gcuugcgguagu

SEQ ID NO: 1495337 - RNA, 19 nt, Pseudomonas aeruginosa PA01
gcuugcgguaguccacgga

SEQ ID NO: 1495338 - RNA, 17 nt, Pseudomonas aeruginosa PA01
gcuugcggucauccgcc

SEQ ID NO: 1495339 - RNA, 18 nt, Pseudomonas aeruginosa PA01
gcuugcgguuauccgccg

SEQ ID NO: 1495340 - RNA, 22 nt, Pseudomonas aeruginosa PA01
gcuugcgguuauccgccgccgg

SEQ ID NO: 1495341 - RNA, 19 nt, Pseudomonas aeruginosa PA01
gcuugcguuccuccucguc

SEQ ID NO: 1495342 - RNA, 18 nt, Pseudomonas aeruginosa PA01
gcuugcguucgcuccagu

SEQ ID NO: 1495343 - RNA, 13 nt, Pseudomonas aeruginosa PA01
gcuugcgcgcggc

SEQ ID NO: 1495344 - RNA, 16 nt, Pseudomonas aeruginosa PA01
gcuugcgcgccgccgc

SEQ ID NO: 1495345 - RNA, 20 nt, Pseudomonas aeruginosa PA01
gcuugcucauguugcgggcu

SEQ ID NO: 1495346 - RNA, 15 nt, Pseudomonas aeruginosa PA01
gcuugcgcuggccgg

SEQ ID NO: 1495347 - RNA, 19 nt, Pseudomonas aeruginosa PA01
gcuugcugaagccccaguc

SEQ ID NO: 1495348 - RNA, 19 nt, Pseudomonas aeruginosa PA01
gcuugcuggcgcgauccgc

SEQ ID NO: 1495349 - RNA, 22 nt, Pseudomonas aeruginosa PA01
gcuugcuggcgcgauccgcgcg

SEQ ID NO: 1495350 - RNA, 14 nt, Pseudomonas aeruginosa PA01
gcuuggccuugccg

SEQ ID NO: 1495351 - RNA, 20 nt, Pseudomonas aeruginosa PA01
gcuuggccuugccguccagc

SEQ ID NO: 1495352 - RNA, 16 nt, Pseudomonas aeruginosa PA01
gcuuggcgaucacggc

SEQ ID NO: 1495353 - RNA, 16 nt, Pseudomonas aeruginosa PA01
gcuuggcgaacuccac

SEQ ID NO: 1495354 - RNA, 17 nt, Pseudomonas aeruginosa PA01
gcuuggcgaauagccgg

SEQ ID NO: 1495355 - RNA, 20 nt, Pseudomonas aeruginosa PA01
gcuuggcgaauagccggcgc

SEQ ID NO: 1495356 - RNA, 15 nt, Pseudomonas aeruginosa PA01
gcuuggcggucagcg

SEQ ID NO: 1495357 - RNA, 16 nt, Pseudomonas aeruginosa PA01
gcuugggcgcggagaa

SEQ ID NO: 1495358 - RNA, 17 nt, Pseudomonas aeruginosa PA01
gcuugggcgccucgccg

SEQ ID NO: 1495359 - RNA, 15 nt, Pseudomonas aeruginosa PA01
gcuugggcgccucgc

SEQ ID NO: 1495360 - RNA, 21 nt, Pseudomonas aeruginosa PA01
gcuugguauccaccucgcccu

SEQ ID NO: 1495361 - RNA, 16 nt, Pseudomonas aeruginosa PA01
gcuuggucgggcgccg

SEQ ID NO: 1495362 - RNA, 17 nt, Pseudomonas aeruginosa PA01
gcuuggucgggcgccgc

SEQ ID NO: 1495363 - RNA, 18 nt, Pseudomonas aeruginosa PA01
gcuuggucgggcgccgcg

SEQ ID NO: 1495364 - RNA, 21 nt, Pseudomonas aeruginosa PA01
gcuuggucgggcgccgcgccu

SEQ ID NO: 1495365 - RNA, 16 nt, Pseudomonas aeruginosa PA01
gcuugcaguucagcca

SEQ ID NO: 1495366 - RNA, 18 nt, Pseudomonas aeruginosa PA01
gcuugccacugcgcgcca

SEQ ID NO: 1495367 - RNA, 19 nt, Pseudomonas aeruginosa PA01
gcuugccacugcgcgccag

SEQ ID NO: 1495368 - RNA, 13 nt, Pseudomonas aeruginosa PA01
gcuugcagguagc

SEQ ID NO: 1495369 - RNA, 15 nt, Pseudomonas aeruginosa PA01
gcuugcagucgaaaa

SEQ ID NO: 1495370 - RNA, 20 nt, Pseudomonas aeruginosa PA01
gcuugaggaaguagugcagc

SEQ ID NO: 1495371 - RNA, 19 nt, Pseudomonas aeruginosa PA01
gcuugaggaaguggccggu

SEQ ID NO: 1495372 - RNA, 22 nt, Pseudomonas aeruginosa PA01
gcuugagguaggccagccccag

SEQ ID NO: 1495373 - RNA, 22 nt, Pseudomonas aeruginosa PA01
gcuugaggucggccucgagcau

SEQ ID NO: 1495374 - RNA, 15 nt, Pseudomonas aeruginosa PA01
gcuugcaauccgugc

SEQ ID NO: 1495375 - RNA, 23 nt, Pseudomonas aeruginosa PA01
gcuugcaauccgugcgccgggcu

SEQ ID NO: 1495376 - RNA, 16 nt, Pseudomonas aeruginosa PA01
gcuugcacaccugguc

SEQ ID NO: 1495377 - RNA, 14 nt, Pseudomonas aeruginosa PA01
gcuugaugcuuucg

SEQ ID NO: 1495378 - RNA, 13 nt, Pseudomonas aeruginosa PA01
gcuugcgccgccu

SEQ ID NO: 1495379 - RNA, 14 nt, Pseudomonas aeruginosa PA01
gcuugcgccgccuc

SEQ ID NO: 1495380 - RNA, 22 nt, Pseudomonas aeruginosa PA01
gcuugcgcgccaccagcguggc

SEQ ID NO: 1495381 - RNA, 18 nt, Pseudomonas aeruginosa PA01
gcuugcgcccccaacgga

SEQ ID NO: 1495382 - RNA, 15 nt, Pseudomonas aeruginosa PA01
gcuugccgagcuggg

SEQ ID NO: 1495383 - RNA, 15 nt, Pseudomonas aeruginosa PA01
gcuugccgcucaggc

SEQ ID NO: 1495384 - RNA, 15 nt, Pseudomonas aeruginosa PA01
gcuugccgcugcgca

SEQ ID NO: 1495385 - RNA, 13 nt, Pseudomonas aeruginosa PA01
gcuugccggcagc

SEQ ID NO: 1495386 - RNA, 15 nt, Pseudomonas aeruginosa PA01
gcuugccggccgcca

SEQ ID NO: 1495387 - RNA, 12 nt, Pseudomonas aeruginosa PA01
gcuugccggcga

SEQ ID NO: 1495388 - RNA, 16 nt, Pseudomonas aeruginosa PA01
gcuugccguccagcga

SEQ ID NO: 1495389 - RNA, 19 nt, Pseudomonas aeruginosa PA01
gcuugccguccagcgagaa

SEQ ID NO: 1495390 - RNA, 14 nt, Pseudomonas aeruginosa PA01
gcuugccggcgcgc

SEQ ID NO: 1495391 - RNA, 15 nt, Pseudomonas aeruginosa PA01
gcuugccggcgcgcg

SEQ ID NO: 1495392 - RNA, 18 nt, Pseudomonas aeruginosa PA01
gcuugccggcgcgcgguu

SEQ ID NO: 1495393 - RNA, 12 nt, Pseudomonas aeruginosa PA01
gcuugccggcgg

SEQ ID NO: 1495394 - RNA, 15 nt, Pseudomonas aeruginosa PA01
gcuugccggcggcgc

SEQ ID NO: 1495395 - RNA, 13 nt, Pseudomonas aeruginosa PA01
gcuugccgggguc

SEQ ID NO: 1495396 - RNA, 17 nt, Pseudomonas aeruginosa PA01
gcuugccggggucgagg

SEQ ID NO: 1495397 - RNA, 15 nt, Pseudomonas aeruginosa PA01
gcuucugcuggccgc

SEQ ID NO: 1495398 - RNA, 19 nt, Pseudomonas aeruginosa PA01
gcuucugcuggccgcgcag

SEQ ID NO: 1495399 - RNA, 12 nt, Pseudomonas aeruginosa PA01
gcuucuucggca

SEQ ID NO: 1495400 - RNA, 14 nt, Pseudomonas aeruginosa PA01
gcuucucggcagcg

SEQ ID NO: 1495401 - RNA, 18 nt, Pseudomonas aeruginosa PA01
gcuucugucccugggcca

SEQ ID NO: 1495402 - RNA, 15 nt, Pseudomonas aeruginosa PA01
gcuucugugggcagc

SEQ ID NO: 1495403 - RNA, 17 nt, Pseudomonas aeruginosa PA01
gcuucugugggcagcgg

SEQ ID NO: 1495404 - RNA, 23 nt, Pseudomonas aeruginosa PA01
gcuucuacgccuugcggcgccga

SEQ ID NO: 1495405 - RNA, 16 nt, Pseudomonas aeruginosa PA01
gcuucguugcuccugc

SEQ ID NO: 1495406 - RNA, 18 nt, Pseudomonas aeruginosa PA01
gcuucguuggcgacgacg

SEQ ID NO: 1495407 - RNA, 19 nt, Pseudomonas aeruginosa PA01
gcuucucgacguaggcggc

SEQ ID NO: 1495408 - RNA, 17 nt, Pseudomonas aeruginosa PA01
gcuucucgucgccgccg

SEQ ID NO: 1495409 - RNA, 18 nt, Pseudomonas aeruginosa PA01
gcuugagcagccaggcga

SEQ ID NO: 1495410 - RNA, 17 nt, Pseudomonas aeruginosa PA01
gcuugagccauucggcu

SEQ ID NO: 1495411 - RNA, 21 nt, Pseudomonas aeruginosa PA01
gcuugagccauucggcuuccu

SEQ ID NO: 1495412 - RNA, 18 nt, Pseudomonas aeruginosa PA01
gcuugagaccuucgcggg

SEQ ID NO: 1495413 - RNA, 21 nt, Pseudomonas aeruginosa PA01
gcuugaccuugccgccggucu

SEQ ID NO: 1495414 - RNA, 14 nt, Pseudomonas aeruginosa PA01
gcuugaccgccgcc

SEQ ID NO: 1495415 - RNA, 15 nt, Pseudomonas aeruginosa PA01
gcuugaccgccgccg

SEQ ID NO: 1495416 - RNA, 16 nt, Pseudomonas aeruginosa PA01
gcuugaccgccgccgc

SEQ ID NO: 1495417 - RNA, 21 nt, Pseudomonas aeruginosa PA01
gcuucuuucauuuucgcgcuc

SEQ ID NO: 1495418 - RNA, 16 nt, Pseudomonas aeruginosa PA01
gcuugacccguugcgc

SEQ ID NO: 1495419 - RNA, 23 nt, Pseudomonas aeruginosa PA01
gcuugaccaccaugugcuggcgg

SEQ ID NO: 1495420 - RNA, 18 nt, Pseudomonas aeruginosa PA01
gcuugaacgcgcgccuga

SEQ ID NO: 1495421 - RNA, 20 nt, Pseudomonas aeruginosa PA01
gcuugaaccgcgagaccccg

SEQ ID NO: 1495422 - RNA, 21 nt, Pseudomonas aeruginosa PA01
gcuugaaccgcgagaccccgg

SEQ ID NO: 1495423 - RNA, 17 nt, Pseudomonas aeruginosa PA01
gcuucccaggccagcgg

SEQ ID NO: 1495424 - RNA, 12 nt, Pseudomonas aeruginosa PA01
gcuuccagccag

SEQ ID NO: 1495425 - RNA, 13 nt, Pseudomonas aeruginosa PA01
gcuuccaggcgcg

SEQ ID NO: 1495426 - RNA, 19 nt, Pseudomonas aeruginosa PA01
gcuuccaggguagcgccgc

SEQ ID NO: 1495427 - RNA, 14 nt, Pseudomonas aeruginosa PA01
gcuuccgccaggcg

SEQ ID NO: 1495428 - RNA, 18 nt, Pseudomonas aeruginosa PA01
gcuuccgccaggcgcagc

SEQ ID NO: 1495429 - RNA, 14 nt, Pseudomonas aeruginosa PA01
gcuuccgccggcgc

SEQ ID NO: 1495430 - RNA, 16 nt, Pseudomonas aeruginosa PA01
gcuuccgccggcgccg

SEQ ID NO: 1495431 - RNA, 20 nt, Pseudomonas aeruginosa PA01
gcuuccgccggcgccgccuc

SEQ ID NO: 1495432 - RNA, 23 nt, Pseudomonas aeruginosa PA01
gcuuccgcgcggcgcccugccgg

SEQ ID NO: 1495433 - RNA, 16 nt, Pseudomonas aeruginosa PA01
gcuuccuccaucgccu

SEQ ID NO: 1495434 - RNA, 14 nt, Pseudomonas aeruginosa PA01
gcuuccggcagcca

SEQ ID NO: 1495435 - RNA, 20 nt, Pseudomonas aeruginosa PA01
gcuuccggcagccagccgcc

SEQ ID NO: 1495436 - RNA, 21 nt, Pseudomonas aeruginosa PA01
gcuuccggcagccagccgccg

SEQ ID NO: 1495437 - RNA, 14 nt, Pseudomonas aeruginosa PA01
gcuuccggcccggc

SEQ ID NO: 1495438 - RNA, 13 nt, Pseudomonas aeruginosa PA01
gcuuccggcgcca

SEQ ID NO: 1495439 - RNA, 14 nt, Pseudomonas aeruginosa PA01
gcuuccggcgcucc

SEQ ID NO: 1495440 - RNA, 18 nt, Pseudomonas aeruginosa PA01
gcuuccggcuccaguugc

SEQ ID NO: 1495441 - RNA, 15 nt, Pseudomonas aeruginosa PA01
gcuucagcgcgccga

SEQ ID NO: 1495442 - RNA, 17 nt, Pseudomonas aeruginosa PA01
gcuucagcucgaggcca

SEQ ID NO: 1495443 - RNA, 21 nt, Pseudomonas aeruginosa PA01
gcuucagcuucuacuucggcu

SEQ ID NO: 1495444 - RNA, 16 nt, Pseudomonas aeruginosa PA01
gcuucaggcucggccu

SEQ ID NO: 1495445 - RNA, 17 nt, Pseudomonas aeruginosa PA01
gcuucaggcucggccug

SEQ ID NO: 1495446 - RNA, 18 nt, Pseudomonas aeruginosa PA01
gcuucaggcucggccugu

SEQ ID NO: 1495447 - RNA, 13 nt, Pseudomonas aeruginosa PA01
gcuucagcccggc

SEQ ID NO: 1495448 - RNA, 17 nt, Pseudomonas aeruginosa PA01
gcuucagcccggcacca

SEQ ID NO: 1495449 - RNA, 15 nt, Pseudomonas aeruginosa PA01
gcuucagcgccaggc

SEQ ID NO: 1495450 - RNA, 17 nt, Pseudomonas aeruginosa PA01
gcuucagcgccaggccg

SEQ ID NO: 1495451 - RNA, 18 nt, Pseudomonas aeruginosa PA01
gcuucagcgccaggccga

SEQ ID NO: 1495452 - RNA, 23 nt, Pseudomonas aeruginosa PA01
gcuucagcgccgggucgaccuug

SEQ ID NO: 1495453 - RNA, 19 nt, Pseudomonas aeruginosa PA01
gcuucauccugcgcgccuc

SEQ ID NO: 1495454 - RNA, 23 nt, Pseudomonas aeruginosa PA01
gcuucaucgcgccaaugccgucg

SEQ ID NO: 1495455 - RNA, 16 nt, Pseudomonas aeruginosa PA01
gcuucaucaggcugcu

SEQ ID NO: 1495456 - RNA, 17 nt, Pseudomonas aeruginosa PA01
gcuucaucuccugcugg

SEQ ID NO: 1495457 - RNA, 17 nt, Pseudomonas aeruginosa PA01
gcuucaggguggcgcug

SEQ ID NO: 1495458 - RNA, 18 nt, Pseudomonas aeruginosa PA01
gcuucaugaagucagcca

SEQ ID NO: 1495459 - RNA, 16 nt, Pseudomonas aeruginosa PA01
gcuuccaccagacgca

SEQ ID NO: 1495460 - RNA, 19 nt, Pseudomonas aeruginosa PA01
gcuuccaccagacgcagca

SEQ ID NO: 1495461 - RNA, 16 nt, Pseudomonas aeruginosa PA01
gcuuccaccgccugcc

SEQ ID NO: 1495462 - RNA, 19 nt, Pseudomonas aeruginosa PA01
gcuuccaccgccugcccca

SEQ ID NO: 1495463 - RNA, 16 nt, Pseudomonas aeruginosa PA01
gcuucggucagguggg

SEQ ID NO: 1495464 - RNA, 21 nt, Pseudomonas aeruginosa PA01
gcuucguccagcgaggcgugg

SEQ ID NO: 1495465 - RNA, 17 nt, Pseudomonas aeruginosa PA01
gcuucguccgccuggga

SEQ ID NO: 1495466 - RNA, 16 nt, Pseudomonas aeruginosa PA01
gcuucguccugcugcu

SEQ ID NO: 1495467 - RNA, 17 nt, Pseudomonas aeruginosa PA01
gcuucguccugcugcug

SEQ ID NO: 1495468 - RNA, 18 nt, Pseudomonas aeruginosa PA01
gcuucguccugcugcugg

SEQ ID NO: 1495469 - RNA, 15 nt, Pseudomonas aeruginosa PA01
gcuucgucgcgcagg

SEQ ID NO: 1495470 - RNA, 14 nt, Pseudomonas aeruginosa PA01
gcuucggcuccagc

SEQ ID NO: 1495471 - RNA, 19 nt, Pseudomonas aeruginosa PA01
gcuucggcuccagcaccag

SEQ ID NO: 1495472 - RNA, 23 nt, Pseudomonas aeruginosa PA01
gcuucgggagucaacgccuggcc

SEQ ID NO: 1495473 - RNA, 14 nt, Pseudomonas aeruginosa PA01
gcuucggcggcuuc

SEQ ID NO: 1495474 - RNA, 19 nt, Pseudomonas aeruginosa PA01
gcuucggcggucaggcuca

SEQ ID NO: 1495475 - RNA, 15 nt, Pseudomonas aeruginosa PA01
gcuucggcggauaac

SEQ ID NO: 1495476 - RNA, 18 nt, Pseudomonas aeruginosa PA01
gcuucgcguugcaggcga

SEQ ID NO: 1495477 - RNA, 17 nt, Pseudomonas aeruginosa PA01
gcuucgcugaugccggc

SEQ ID NO: 1495478 - RNA, 11 nt, Pseudomonas aeruginosa PA01
gcuucgcuggu

SEQ ID NO: 1495479 - RNA, 19 nt, Pseudomonas aeruginosa PA01
gcuucgcgaucggcguccg

SEQ ID NO: 1495480 - RNA, 13 nt, Pseudomonas aeruginosa PA01
gcuucgccgcccu

SEQ ID NO: 1495481 - RNA, 15 nt, Pseudomonas aeruginosa PA01
gcuucgccgcccugg

SEQ ID NO: 1495482 - RNA, 15 nt, Pseudomonas aeruginosa PA01
gcuucgcggaucuca

SEQ ID NO: 1495483 - RNA, 20 nt, Pseudomonas aeruginosa PA01
gcuucgcggaucucaggacc

SEQ ID NO: 1495484 - RNA, 22 nt, Pseudomonas aeruginosa PA01
gcuucgcgggugaccuggccgc

SEQ ID NO: 1495485 - RNA, 19 nt, Pseudomonas aeruginosa PA01
gcuucgcgcagcucggcca

SEQ ID NO: 1495486 - RNA, 17 nt, Pseudomonas aeruginosa PA01
gcuucgcccgccgccug

SEQ ID NO: 1495487 - RNA, 12 nt, Pseudomonas aeruginosa PA01
gcuucgccgccg

SEQ ID NO: 1495488 - RNA, 13 nt, Pseudomonas aeruginosa PA01
gcuucgccgccgc

SEQ ID NO: 1495489 - RNA, 18 nt, Pseudomonas aeruginosa PA01
gcuucgccgccgcgcgcg

SEQ ID NO: 1495490 - RNA, 21 nt, Pseudomonas aeruginosa PA01
gcuucgccgccgcgcgcgcgg

SEQ ID NO: 1495491 - RNA, 16 nt, Pseudomonas aeruginosa PA01
gcuucgcccauggcac

SEQ ID NO: 1495492 - RNA, 15 nt, Pseudomonas aeruginosa PA01
gcuuccucgcccuca

SEQ ID NO: 1495493 - RNA, 13 nt, Pseudomonas aeruginosa PA01
gcuuccucggcac

SEQ ID NO: 1495494 - RNA, 20 nt, Pseudomonas aeruginosa PA01
gcuucgaagcucucgccgcg

SEQ ID NO: 1495495 - RNA, 21 nt, Pseudomonas aeruginosa PA01
gcuucgaagcucucgccgcgc

SEQ ID NO: 1495496 - RNA, 17 nt, Pseudomonas aeruginosa PA01
gcugggcagcgccgccg

SEQ ID NO: 1495497 - RNA, 22 nt, Pseudomonas aeruginosa PA01
gcuggcugcccaguugcgcggc

SEQ ID NO: 1495498 - RNA, 15 nt, Pseudomonas aeruginosa PA01
gcuggcugcccucga

SEQ ID NO: 1495499 - RNA, 18 nt, Pseudomonas aeruginosa PA01
gcuggcugcccucgacga

SEQ ID NO: 1495500 - RNA, 16 nt, Pseudomonas aeruginosa PA01
gcuggcuauucgccca

SEQ ID NO: 1495501 - RNA, 17 nt, Pseudomonas aeruginosa PA01
gcuggcugaagccgggc

SEQ ID NO: 1495502 - RNA, 18 nt, Pseudomonas aeruginosa PA01
gcuggcugaagccgggca

SEQ ID NO: 1495503 - RNA, 19 nt, Pseudomonas aeruginosa PA01
gcuggcugguaacgggcga

SEQ ID NO: 1495504 - RNA, 20 nt, Pseudomonas aeruginosa PA01
gcuggcugguaacgggcgaa

SEQ ID NO: 1495505 - RNA, 16 nt, Pseudomonas aeruginosa PA01
gcuggcuguaggugcc

SEQ ID NO: 1495506 - RNA, 15 nt, Pseudomonas aeruginosa PA01
gcugggcgcagcccu

SEQ ID NO: 1495507 - RNA, 14 nt, Pseudomonas aeruginosa PA01
gcugggcgccggca

SEQ ID NO: 1495508 - RNA, 14 nt, Pseudomonas aeruginosa PA01
gcugggcgccucgu

SEQ ID NO: 1495509 - RNA, 17 nt, Pseudomonas aeruginosa PA01
gcugggcgccucgucga

SEQ ID NO: 1495510 - RNA, 20 nt, Pseudomonas aeruginosa PA01
gcugggcgcccuucagcgcc

SEQ ID NO: 1495511 - RNA, 21 nt, Pseudomonas aeruginosa PA01
gcugggcgcccuucagcgccu

SEQ ID NO: 1495512 - RNA, 14 nt, Pseudomonas aeruginosa PA01
gcugggccagcgcc

SEQ ID NO: 1495513 - RNA, 18 nt, Pseudomonas aeruginosa PA01
gcugggccgaaccggggc

SEQ ID NO: 1495514 - RNA, 22 nt, Pseudomonas aeruginosa PA01
gcugggccuugagcaggcguuc

SEQ ID NO: 1495515 - RNA, 14 nt, Pseudomonas aeruginosa PA01
gcugggccuugauc

SEQ ID NO: 1495516 - RNA, 19 nt, Pseudomonas aeruginosa PA01
gcugggcgaacagcgagac

SEQ ID NO: 1495517 - RNA, 23 nt, Pseudomonas aeruginosa PA01
gcugggcgaacagcgagacccgg

SEQ ID NO: 1495518 - RNA, 20 nt, Pseudomonas aeruginosa PA01
gcuggcguuguugccgccga

SEQ ID NO: 1495519 - RNA, 22 nt, Pseudomonas aeruginosa PA01
gcuggcguuguugccgccgaag

SEQ ID NO: 1495520 - RNA, 13 nt, Pseudomonas aeruginosa PA01
gcuggcgucgccu

SEQ ID NO: 1495521 - RNA, 12 nt, Pseudomonas aeruginosa PA01
gcuggcgucggg

SEQ ID NO: 1495522 - RNA, 12 nt, Pseudomonas aeruginosa PA01
gcuggcguggug

SEQ ID NO: 1495523 - RNA, 21 nt, Pseudomonas aeruginosa PA01
gcuggcggugcggucggcgcc

SEQ ID NO: 1495524 - RNA, 16 nt, Pseudomonas aeruginosa PA01
gcuggcguaccucgcc

SEQ ID NO: 1495525 - RNA, 21 nt, Pseudomonas aeruginosa PA01
gcuggcguagaagucguccuc

SEQ ID NO: 1495526 - RNA, 15 nt, Pseudomonas aeruginosa PA01
gcuggcgucgaaugc

SEQ ID NO: 1495527 - RNA, 15 nt, Pseudomonas aeruginosa PA01
gcuggcgucgaccgc

SEQ ID NO: 1495528 - RNA, 17 nt, Pseudomonas aeruginosa PA01
gcuggcgucgaccgccu

SEQ ID NO: 1495529 - RNA, 19 nt, Pseudomonas aeruginosa PA01
gcuggcgucgacgccgaag

SEQ ID NO: 1495530 - RNA, 14 nt, Pseudomonas aeruginosa PA01
gcuggcggcucggc

SEQ ID NO: 1495531 - RNA, 13 nt, Pseudomonas aeruginosa PA01
gcuggcggccgag

SEQ ID NO: 1495532 - RNA, 12 nt, Pseudomonas aeruginosa PA01
gcuggcggccgc

SEQ ID NO: 1495533 - RNA, 17 nt, Pseudomonas aeruginosa PA01
gcuggcggccuucggcg

SEQ ID NO: 1495534 - RNA, 21 nt, Pseudomonas aeruginosa PA01
gcuggcggccuucggcgucga

SEQ ID NO: 1495535 - RNA, 14 nt, Pseudomonas aeruginosa PA01
gcuggcggcgacga

SEQ ID NO: 1495536 - RNA, 23 nt, Pseudomonas aeruginosa PA01
gcuggcggauguaguccagcgcc

SEQ ID NO: 1495537 - RNA, 16 nt, Pseudomonas aeruginosa PA01
gcuggcggcaucggcg

SEQ ID NO: 1495538 - RNA, 17 nt, Pseudomonas aeruginosa PA01
gcuggcggcaucggcgc

SEQ ID NO: 1495539 - RNA, 18 nt, Pseudomonas aeruginosa PA01
gcuggcggcaucggcgcc

SEQ ID NO: 1495540 - RNA, 19 nt, Pseudomonas aeruginosa PA01
gcuggcggcaucggcgccg

SEQ ID NO: 1495541 - RNA, 12 nt, Pseudomonas aeruginosa PA01
gcuggcggcaug

SEQ ID NO: 1495542 - RNA, 16 nt, Pseudomonas aeruginosa PA01
gcuggcggaaggugcc

SEQ ID NO: 1495543 - RNA, 19 nt, Pseudomonas aeruginosa PA01
gcuggcggaaggugccuuc

SEQ ID NO: 1495544 - RNA, 19 nt, Pseudomonas aeruginosa PA01
gcugcugaaaaacgccugg

SEQ ID NO: 1495545 - RNA, 14 nt, Pseudomonas aeruginosa PA01
gcugcucgauggcg

SEQ ID NO: 1495546 - RNA, 16 nt, Pseudomonas aeruginosa PA01
gcugcucgauggcggc

SEQ ID NO: 1495547 - RNA, 22 nt, Pseudomonas aeruginosa PA01
gcugcucgcagagggcgaugcc

SEQ ID NO: 1495548 - RNA, 15 nt, Pseudomonas aeruginosa PA01
gcugcucgcagccgg

SEQ ID NO: 1495549 - RNA, 12 nt, Pseudomonas aeruginosa PA01
gcugcucgccuc

SEQ ID NO: 1495550 - RNA, 18 nt, Pseudomonas aeruginosa PA01
gcugcucgccucgggcca

SEQ ID NO: 1495551 - RNA, 13 nt, Pseudomonas aeruginosa PA01
gcugcuccaucag

SEQ ID NO: 1495552 - RNA, 21 nt, Pseudomonas aeruginosa PA01
gcugcucagcgcgcucggccu

SEQ ID NO: 1495553 - RNA, 12 nt, Pseudomonas aeruginosa PA01
gcugcucaugcc

SEQ ID NO: 1495554 - RNA, 16 nt, Pseudomonas aeruginosa PA01
gcugcuccagcccggc

SEQ ID NO: 1495555 - RNA, 21 nt, Pseudomonas aeruginosa PA01
gcugcuccagcccggcucggc

SEQ ID NO: 1495556 - RNA, 19 nt, Pseudomonas aeruginosa PA01
gcugcucagggccgcgccg

SEQ ID NO: 1495557 - RNA, 22 nt, Pseudomonas aeruginosa PA01
gcugcuccuccccguccuggcg

SEQ ID NO: 1495558 - RNA, 13 nt, Pseudomonas aeruginosa PA01
gcugcucgaagca

SEQ ID NO: 1495559 - RNA, 16 nt, Pseudomonas aeruginosa PA01
gcugcucgaccaccuc

SEQ ID NO: 1495560 - RNA, 21 nt, Pseudomonas aeruginosa PA01
gcugcucgaccaccucggcgu

SEQ ID NO: 1495561 - RNA, 22 nt, Pseudomonas aeruginosa PA01
gcugcucgaccaccucggcguc

SEQ ID NO: 1495562 - RNA, 18 nt, Pseudomonas aeruginosa PA01
gcugguagugcuggcgca

SEQ ID NO: 1495563 - RNA, 19 nt, Pseudomonas aeruginosa PA01
gcuggucaauaccacccuu

SEQ ID NO: 1495564 - RNA, 15 nt, Pseudomonas aeruginosa PA01
gcuggguuuccugca

SEQ ID NO: 1495565 - RNA, 15 nt, Pseudomonas aeruginosa PA01
gcugguagcccaggc

SEQ ID NO: 1495566 - RNA, 20 nt, Pseudomonas aeruginosa PA01
gcugguagcccaggccgaag

SEQ ID NO: 1495567 - RNA, 16 nt, Pseudomonas aeruginosa PA01
gcugguaggagccguc

SEQ ID NO: 1495568 - RNA, 20 nt, Pseudomonas aeruginosa PA01
gcugguaauggugaucaccu

SEQ ID NO: 1495569 - RNA, 17 nt, Pseudomonas aeruginosa PA01
gcugguccuggcgcgag

SEQ ID NO: 1495570 - RNA, 19 nt, Pseudomonas aeruginosa PA01
gcugguccuggcgcgagaa

SEQ ID NO: 1495571 - RNA, 14 nt, Pseudomonas aeruginosa PA01
gcuggucaggcuga

SEQ ID NO: 1495572 - RNA, 16 nt, Pseudomonas aeruginosa PA01
gcuggucaguucggcc

SEQ ID NO: 1495573 - RNA, 18 nt, Pseudomonas aeruginosa PA01
gcuggucaguucggccca

SEQ ID NO: 1495574 - RNA, 19 nt, Pseudomonas aeruginosa PA01
gcuggucaguucggcccag

SEQ ID NO: 1495575 - RNA, 20 nt, Pseudomonas aeruginosa PA01
gcuggucaguucggcccagc

SEQ ID NO: 1495576 - RNA, 21 nt, Pseudomonas aeruginosa PA01
gcugguccagcacgcuggcga

SEQ ID NO: 1495577 - RNA, 23 nt, Pseudomonas aeruginosa PA01
gcugguccagcacgcuggcgagg

SEQ ID NO: 1495578 - RNA, 20 nt, Pseudomonas aeruginosa PA01
gcugguccagcuggcgcagc

SEQ ID NO: 1495579 - RNA, 18 nt, Pseudomonas aeruginosa PA01
gcugggucaucgaggcca

SEQ ID NO: 1495580 - RNA, 23 nt, Pseudomonas aeruginosa PA01
gcuggggugcagauggucgccgg

SEQ ID NO: 1495581 - RNA, 18 nt, Pseudomonas aeruginosa PA01
gcugggguugcggcgccc

SEQ ID NO: 1495582 - RNA, 15 nt, Pseudomonas aeruginosa PA01
gcugggucacgucca

SEQ ID NO: 1495583 - RNA, 17 nt, Pseudomonas aeruginosa PA01
gcugggucacguggccg

SEQ ID NO: 1495584 - RNA, 21 nt, Pseudomonas aeruginosa PA01
gcugggucacguggccgccca

SEQ ID NO: 1495585 - RNA, 21 nt, Pseudomonas aeruginosa PA01
gcugggcuucgcugaugccgg

SEQ ID NO: 1495586 - RNA, 17 nt, Pseudomonas aeruginosa PA01
gcugggcugggucggcu

SEQ ID NO: 1495587 - RNA, 14 nt, Pseudomonas aeruginosa PA01
gcugggcgucgaac

SEQ ID NO: 1495588 - RNA, 23 nt, Pseudomonas aeruginosa PA01
gcugggcgucgaacaccggcgcc

SEQ ID NO: 1495589 - RNA, 19 nt, Pseudomonas aeruginosa PA01
gcuggggaacugggcgagc

SEQ ID NO: 1495590 - RNA, 21 nt, Pseudomonas aeruginosa PA01
gcuggggaacugggcgagcau

SEQ ID NO: 1495591 - RNA, 16 nt, Pseudomonas aeruginosa PA01
gcuggggacggaagca

SEQ ID NO: 1495592 - RNA, 17 nt, Pseudomonas aeruginosa PA01
gcugggcggcuggccga

SEQ ID NO: 1495593 - RNA, 24 nt, Pseudomonas aeruginosa PA01
gcuggugcugcuccaucaguugcg

SEQ ID NO: 1495594 - RNA, 14 nt, Pseudomonas aeruginosa PA01
gcuggugccgcugu

SEQ ID NO: 1495595 - RNA, 13 nt, Pseudomonas aeruginosa PA01
gcuggugccgcug

SEQ ID NO: 1495596 - RNA, 18 nt, Pseudomonas aeruginosa PA01
gcuggugcccugggcggc

SEQ ID NO: 1495597 - RNA, 12 nt, Pseudomonas aeruginosa PA01
gcuggugccgau

SEQ ID NO: 1495598 - RNA, 18 nt, Pseudomonas aeruginosa PA01
gcuggugccgaucagccc

SEQ ID NO: 1495599 - RNA, 20 nt, Pseudomonas aeruginosa PA01
gcuggucguucagugccagc

SEQ ID NO: 1495600 - RNA, 13 nt, Pseudomonas aeruginosa PA01
gcuggucggcauc

SEQ ID NO: 1495601 - RNA, 16 nt, Pseudomonas aeruginosa PA01
gcuggucucuuccagc

SEQ ID NO: 1495602 - RNA, 15 nt, Pseudomonas aeruginosa PA01
gcugguugaccaggc

SEQ ID NO: 1495603 - RNA, 16 nt, Pseudomonas aeruginosa PA01
gcugguugccagcagc

SEQ ID NO: 1495604 - RNA, 22 nt, Pseudomonas aeruginosa PA01
gcugguugccagcagcgcugau

SEQ ID NO: 1495605 - RNA, 19 nt, Pseudomonas aeruginosa PA01
gcugguugcccaggguggc

SEQ ID NO: 1495606 - RNA, 16 nt, Pseudomonas aeruginosa PA01
gcugguugaggucgac

SEQ ID NO: 1495607 - RNA, 18 nt, Pseudomonas aeruginosa PA01
gcugguugaggucgacga

SEQ ID NO: 1495608 - RNA, 19 nt, Pseudomonas aeruginosa PA01
gcugguuggcgaggucgcg

SEQ ID NO: 1495609 - RNA, 15 nt, Pseudomonas aeruginosa PA01
gcugguuggacaccu

SEQ ID NO: 1495610 - RNA, 19 nt, Pseudomonas aeruginosa PA01
gcugguuuagcucggcgau

SEQ ID NO: 1495611 - RNA, 13 nt, Pseudomonas aeruginosa PA01
gcuggugggugau

SEQ ID NO: 1495612 - RNA, 21 nt, Pseudomonas aeruginosa PA01
gcugguggcccugggcggcga

SEQ ID NO: 1495613 - RNA, 19 nt, Pseudomonas aeruginosa PA01
gcugguggacgucgucggc

SEQ ID NO: 1495614 - RNA, 21 nt, Pseudomonas aeruginosa PA01
gcugguggacgucgucggcga

SEQ ID NO: 1495615 - RNA, 22 nt, Pseudomonas aeruginosa PA01
gcugguggacgucgucggcgac

SEQ ID NO: 1495616 - RNA, 18 nt, Pseudomonas aeruginosa PA01
gcugucaaucgcgcaacg

SEQ ID NO: 1495617 - RNA, 16 nt, Pseudomonas aeruginosa PA01
gcugucagggcuugcg

SEQ ID NO: 1495618 - RNA, 19 nt, Pseudomonas aeruginosa PA01
gcugucagggcuugcgcgc

SEQ ID NO: 1495619 - RNA, 18 nt, Pseudomonas aeruginosa PA01
gcuguaguaggcgguggc

SEQ ID NO: 1495620 - RNA, 14 nt, Pseudomonas aeruginosa PA01
gcuguccacgccga

SEQ ID NO: 1495621 - RNA, 16 nt, Pseudomonas aeruginosa PA01
gcuguccagcaggcgu

SEQ ID NO: 1495622 - RNA, 16 nt, Pseudomonas aeruginosa PA01
gcuguccagcgcuccu

SEQ ID NO: 1495623 - RNA, 14 nt, Pseudomonas aeruginosa PA01
gcuguccgccgccg

SEQ ID NO: 1495624 - RNA, 23 nt, Pseudomonas aeruginosa PA01
gcuguccgccgccgcggcgcgga

SEQ ID NO: 1495625 - RNA, 14 nt, Pseudomonas aeruginosa PA01
gcuguccgccggcc

SEQ ID NO: 1495626 - RNA, 14 nt, Pseudomonas aeruginosa PA01
gcuguccgcgccgc

SEQ ID NO: 1495627 - RNA, 13 nt, Pseudomonas aeruginosa PA01
gcugucccggcca

SEQ ID NO: 1495628 - RNA, 17 nt, Pseudomonas aeruginosa PA01
gcugucgacgcagccgg

SEQ ID NO: 1495629 - RNA, 18 nt, Pseudomonas aeruginosa PA01
gcugucgagcacggcgcu

SEQ ID NO: 1495630 - RNA, 18 nt, Pseudomonas aeruginosa PA01
gcuguagcggcucgccga

SEQ ID NO: 1495631 - RNA, 21 nt, Pseudomonas aeruginosa PA01
gcuguaguugacgucgccgau

SEQ ID NO: 1495632 - RNA, 17 nt, Pseudomonas aeruginosa PA01
gcuguagggcgaauaac

SEQ ID NO: 1495633 - RNA, 15 nt, Pseudomonas aeruginosa PA01
gcuguagccggcgau

SEQ ID NO: 1495634 - RNA, 23 nt, Pseudomonas aeruginosa PA01
gcuguagccggcgaugugcggcg

SEQ ID NO: 1495635 - RNA, 21 nt, Pseudomonas aeruginosa PA01
gcuguagccggcgccgucgac

SEQ ID NO: 1495636 - RNA, 22 nt, Pseudomonas aeruginosa PA01
gcuguacaagcgcaacgcgcgc

SEQ ID NO: 1495637 - RNA, 19 nt, Pseudomonas aeruginosa PA01
gcuguacagcaggagcgcc

SEQ ID NO: 1495638 - RNA, 12 nt, Pseudomonas aeruginosa PA01
gcugucggccag

SEQ ID NO: 1495639 - RNA, 15 nt, Pseudomonas aeruginosa PA01
gcugucggccagccc

SEQ ID NO: 1495640 - RNA, 17 nt, Pseudomonas aeruginosa PA01
gcugucggccagccccu

SEQ ID NO: 1495641 - RNA, 21 nt, Pseudomonas aeruginosa PA01
gcugucggccaucgccgucuc

SEQ ID NO: 1495642 - RNA, 15 nt, Pseudomonas aeruginosa PA01
gcugucggccucgac

SEQ ID NO: 1495643 - RNA, 17 nt, Pseudomonas aeruginosa PA01
gcugucggccucgacga

SEQ ID NO: 1495644 - RNA, 18 nt, Pseudomonas aeruginosa PA01
gcugucgcggacccgcgc

SEQ ID NO: 1495645 - RNA, 21 nt, Pseudomonas aeruginosa PA01
gcugucgcggacccgcgccgg

SEQ ID NO: 1495646 - RNA, 23 nt, Pseudomonas aeruginosa PA01
gcugucgagggucugcucgacga

SEQ ID NO: 1495647 - RNA, 22 nt, Pseudomonas aeruginosa PA01
gcugucgccggucaggcugcgg

SEQ ID NO: 1495648 - RNA, 14 nt, Pseudomonas aeruginosa PA01
gcugucgccgagca

SEQ ID NO: 1495649 - RNA, 14 nt, Pseudomonas aeruginosa PA01
gcugucgcccgggc

SEQ ID NO: 1495650 - RNA, 14 nt, Pseudomonas aeruginosa PA01
gcugucguccagcg

SEQ ID NO: 1495651 - RNA, 22 nt, Pseudomonas aeruginosa PA01
gcugucgucgaggguggcgccg

SEQ ID NO: 1495652 - RNA, 17 nt, Pseudomonas aeruginosa PA01
gcugucgucuucggcca

SEQ ID NO: 1495653 - RNA, 19 nt, Pseudomonas aeruginosa PA01
gcugucgucggcgcggccg

SEQ ID NO: 1495654 - RNA, 20 nt, Pseudomonas aeruginosa PA01
gcugucgucggcgcggccgg

SEQ ID NO: 1495655 - RNA, 22 nt, Pseudomonas aeruginosa PA01
gcugucgucggcgcggccggcg

SEQ ID NO: 1495656 - RNA, 13 nt, Pseudomonas aeruginosa PA01
gcugucggcgccc

SEQ ID NO: 1495657 - RNA, 23 nt, Pseudomonas aeruginosa PA01
gcugugcgucgagggccuugucg

SEQ ID NO: 1495658 - RNA, 16 nt, Pseudomonas aeruginosa PA01
gcugugcugcaccagc

SEQ ID NO: 1495659 - RNA, 20 nt, Pseudomonas aeruginosa PA01
gcugugcuggccacccuugc

SEQ ID NO: 1495660 - RNA, 18 nt, Pseudomonas aeruginosa PA01
gcuguggagccggugccg

SEQ ID NO: 1495661 - RNA, 15 nt, Pseudomonas aeruginosa PA01
gcugugcagggcagc

SEQ ID NO: 1495662 - RNA, 14 nt, Pseudomonas aeruginosa PA01
gcugugccccaggc

SEQ ID NO: 1495663 - RNA, 16 nt, Pseudomonas aeruginosa PA01
gcugugcgccaggccg

SEQ ID NO: 1495664 - RNA, 18 nt, Pseudomonas aeruginosa PA01
gcugugcaggaaggcgac

SEQ ID NO: 1495665 - RNA, 15 nt, Pseudomonas aeruginosa PA01
gcugucguggacgcc

SEQ ID NO: 1495666 - RNA, 17 nt, Pseudomonas aeruginosa PA01
gcugucuaucugcgccg

SEQ ID NO: 1495667 - RNA, 14 nt, Pseudomonas aeruginosa PA01
gcugucucgccagc

SEQ ID NO: 1495668 - RNA, 19 nt, Pseudomonas aeruginosa PA01
gcugucucgccagcccggc

SEQ ID NO: 1495669 - RNA, 22 nt, Pseudomonas aeruginosa PA01
gcugucucgccagcccggcagg

SEQ ID NO: 1495670 - RNA, 23 nt, Pseudomonas aeruginosa PA01
gcugugaggugggcgcgccgcag

SEQ ID NO: 1495671 - RNA, 13 nt, Pseudomonas aeruginosa PA01
gcuguuccucguc

SEQ ID NO: 1495672 - RNA, 18 nt, Pseudomonas aeruginosa PA01
gcuguucuugauccgcuc

SEQ ID NO: 1495673 - RNA, 22 nt, Pseudomonas aeruginosa PA01
gcuguucgggucgcguucgucg

SEQ ID NO: 1495674 - RNA, 18 nt, Pseudomonas aeruginosa PA01
gcuguuugcggcgcaggc

SEQ ID NO: 1495675 - RNA, 23 nt, Pseudomonas aeruginosa PA01
gcuguuugcggcgcaggcggauc

SEQ ID NO: 1495676 - RNA, 17 nt, Pseudomonas aeruginosa PA01
gcuguuucagcccacgc

SEQ ID NO: 1495677 - RNA, 14 nt, Pseudomonas aeruginosa PA01
gcuguuucaggccg

SEQ ID NO: 1495678 - RNA, 15 nt, Pseudomonas aeruginosa PA01
gcuguuucaggccgg

SEQ ID NO: 1495679 - RNA, 16 nt, Pseudomonas aeruginosa PA01
gcuguuucaggccggc

SEQ ID NO: 1495680 - RNA, 17 nt, Pseudomonas aeruginosa PA01
gcuguuucaggccggcg

SEQ ID NO: 1495681 - RNA, 18 nt, Pseudomonas aeruginosa PA01
gcuguuucaggccggcgu

SEQ ID NO: 1495682 - RNA, 16 nt, Pseudomonas aeruginosa PA01
gcuguugcccugggcc

SEQ ID NO: 1495683 - RNA, 20 nt, Pseudomonas aeruginosa PA01
gcuguugcccugggccggcg

SEQ ID NO: 1495684 - RNA, 19 nt, Pseudomonas aeruginosa PA01
gcuguugccgcugcaggcc

SEQ ID NO: 1495685 - RNA, 20 nt, Pseudomonas aeruginosa PA01
gcuguugccgcugcaggcca

SEQ ID NO: 1495686 - RNA, 19 nt, Pseudomonas aeruginosa PA01
gcuuaauacggcgcaggcu

SEQ ID NO: 1495687 - RNA, 17 nt, Pseudomonas aeruginosa PA01
gcuuaccuugccggugc

SEQ ID NO: 1495688 - RNA, 14 nt, Pseudomonas aeruginosa PA01
gcuuacccgcgacc

SEQ ID NO: 1495689 - RNA, 14 nt, Pseudomonas aeruginosa PA01
gcuucaccggugcc

SEQ ID NO: 1495690 - RNA, 15 nt, Pseudomonas aeruginosa PA01
gcuucaaccguggcu

SEQ ID NO: 1495691 - RNA, 13 nt, Pseudomonas aeruginosa PA01
gcuucaagcggcc

SEQ ID NO: 1495692 - RNA, 12 nt, Pseudomonas aeruginosa PA01
ggccgcgcccca

SEQ ID NO: 1495693 - RNA, 17 nt, Pseudomonas aeruginosa PA01
ggccgcgccccacggcg

SEQ ID NO: 1495694 - RNA, 18 nt, Pseudomonas aeruginosa PA01
ggccgcgccccacggcgc

SEQ ID NO: 1495695 - RNA, 21 nt, Pseudomonas aeruginosa PA01
ggccgcgccccacggcgcggc

SEQ ID NO: 1495696 - RNA, 22 nt, Pseudomonas aeruginosa PA01
ggccgcgagagguucaccgacc

SEQ ID NO: 1495697 - RNA, 15 nt, Pseudomonas aeruginosa PA01
ggccgcgccgaaggc

SEQ ID NO: 1495698 - RNA, 13 nt, Pseudomonas aeruginosa PA01
ggccgcgccgacc

SEQ ID NO: 1495699 - RNA, 14 nt, Pseudomonas aeruginosa PA01
ggccgcgccgaccc

SEQ ID NO: 1495700 - RNA, 12 nt, Pseudomonas aeruginosa PA01
ggccgcgccgcc

SEQ ID NO: 1495701 - RNA, 13 nt, Pseudomonas aeruginosa PA01
ggccgcgccgccc

SEQ ID NO: 1495702 - RNA, 18 nt, Pseudomonas aeruginosa PA01
ggccgcgccgcccuggcc

SEQ ID NO: 1495703 - RNA, 19 nt, Pseudomonas aeruginosa PA01
ggccgcgccgcccuggccg

SEQ ID NO: 1495704 - RNA, 20 nt, Pseudomonas aeruginosa PA01
ggccgcgccgcccuggccgc

SEQ ID NO: 1495705 - RNA, 20 nt, Pseudomonas aeruginosa PA01
ggccgcgccuucagcgccag

SEQ ID NO: 1495706 - RNA, 22 nt, Pseudomonas aeruginosa PA01
ggccgcgccuucagcgccagca

SEQ ID NO: 1495707 - RNA, 21 nt, Pseudomonas aeruginosa PA01
ggccgcgccuuucgcucaggc

SEQ ID NO: 1495708 - RNA, 20 nt, Pseudomonas aeruginosa PA01
ggccgcgccggcucccugca

SEQ ID NO: 1495709 - RNA, 13 nt, Pseudomonas aeruginosa PA01
ggccgcgccggau

SEQ ID NO: 1495710 - RNA, 14 nt, Pseudomonas aeruginosa PA01
ggccgcgccggauc

SEQ ID NO: 1495711 - RNA, 23 nt, Pseudomonas aeruginosa PA01
ggccgcggcccugcgccgcagcg

SEQ ID NO: 1495712 - RNA, 14 nt, Pseudomonas aeruginosa PA01
ggccgcggccgaaa

SEQ ID NO: 1495713 - RNA, 21 nt, Pseudomonas aeruginosa PA01
ggccgcggccgaaaucgaugu

SEQ ID NO: 1495714 - RNA, 16 nt, Pseudomonas aeruginosa PA01
ggccgccugccuuccu

SEQ ID NO: 1495715 - RNA, 21 nt, Pseudomonas aeruginosa PA01
ggccgccugccuuccuugacc

SEQ ID NO: 1495716 - RNA, 19 nt, Pseudomonas aeruginosa PA01
ggccgccugcucggccugc

SEQ ID NO: 1495717 - RNA, 20 nt, Pseudomonas aeruginosa PA01
ggccgccugcucggccugcu

SEQ ID NO: 1495718 - RNA, 12 nt, Pseudomonas aeruginosa PA01
ggccgccuggcc

SEQ ID NO: 1495719 - RNA, 19 nt, Pseudomonas aeruginosa PA01
ggccgccuggcgcauggcg

SEQ ID NO: 1495720 - RNA, 16 nt, Pseudomonas aeruginosa PA01
ggccgccuggcgugcc

SEQ ID NO: 1495721 - RNA, 14 nt, Pseudomonas aeruginosa PA01
ggccgccuggucgg

SEQ ID NO: 1495722 - RNA, 24 nt, Pseudomonas aeruginosa PA01
ggccgccuggucggggccggcgau

SEQ ID NO: 1495723 - RNA, 16 nt, Pseudomonas aeruginosa PA01
ggccgccucgcgccgc

SEQ ID NO: 1495724 - RNA, 22 nt, Pseudomonas aeruginosa PA01
ggccgccucgcgccgcgccagc

SEQ ID NO: 1495725 - RNA, 23 nt, Pseudomonas aeruginosa PA01
ggccgccucgcgccgcgccagca

SEQ ID NO: 1495726 - RNA, 18 nt, Pseudomonas aeruginosa PA01
ggccgccuuccucggccg

SEQ ID NO: 1495727 - RNA, 19 nt, Pseudomonas aeruginosa PA01
ggccgccuuccucggccgc

SEQ ID NO: 1495728 - RNA, 14 nt, Pseudomonas aeruginosa PA01
ggccgccgaugccg

SEQ ID NO: 1495729 - RNA, 17 nt, Pseudomonas aeruginosa PA01
ggccgccgaugccgacg

SEQ ID NO: 1495730 - RNA, 13 nt, Pseudomonas aeruginosa PA01
ggccgccgauccc

SEQ ID NO: 1495731 - RNA, 17 nt, Pseudomonas aeruginosa PA01
ggccgccgagugugccg

SEQ ID NO: 1495732 - RNA, 13 nt, Pseudomonas aeruginosa PA01
ggccgccgccgcc

SEQ ID NO: 1495733 - RNA, 14 nt, Pseudomonas aeruginosa PA01
ggccgccgccgccg

SEQ ID NO: 1495734 - RNA, 17 nt, Pseudomonas aeruginosa PA01
ggccgccgccgccgucg

SEQ ID NO: 1495735 - RNA, 14 nt, Pseudomonas aeruginosa PA01
ggccgccuauggcg

SEQ ID NO: 1495736 - RNA, 16 nt, Pseudomonas aeruginosa PA01
ggccgccuauggcgga

SEQ ID NO: 1495737 - RNA, 18 nt, Pseudomonas aeruginosa PA01
ggccgccguacaggccac

SEQ ID NO: 1495738 - RNA, 15 nt, Pseudomonas aeruginosa PA01
ggccgcagcgcagcc

SEQ ID NO: 1495739 - RNA, 15 nt, Pseudomonas aeruginosa PA01
ggccgcaggcagcac

SEQ ID NO: 1495740 - RNA, 22 nt, Pseudomonas aeruginosa PA01
ggccgauuucgaugacgccauc

SEQ ID NO: 1495741 - RNA, 15 nt, Pseudomonas aeruginosa PA01
ggccgcaaccagccc

SEQ ID NO: 1495742 - RNA, 16 nt, Pseudomonas aeruginosa PA01
ggccgcaaccagcccu

SEQ ID NO: 1495743 - RNA, 17 nt, Pseudomonas aeruginosa PA01
ggccgcaaccagcccug

SEQ ID NO: 1495744 - RNA, 21 nt, Pseudomonas aeruginosa PA01
ggccgcaagcgguauugucga

SEQ ID NO: 1495745 - RNA, 21 nt, Pseudomonas aeruginosa PA01
ggccgcaaguaccgccggcag

SEQ ID NO: 1495746 - RNA, 13 nt, Pseudomonas aeruginosa PA01
ggccgcaccagga

SEQ ID NO: 1495747 - RNA, 15 nt, Pseudomonas aeruginosa PA01
ggccggccucggcgg

SEQ ID NO: 1495748 - RNA, 23 nt, Pseudomonas aeruginosa PA01
ggccggccucggcggcgcgaacc

SEQ ID NO: 1495749 - RNA, 17 nt, Pseudomonas aeruginosa PA01
ggccggcgaaccguggu

SEQ ID NO: 1495750 - RNA, 12 nt, Pseudomonas aeruginosa PA01
ggccggcgagcc

SEQ ID NO: 1495751 - RNA, 13 nt, Pseudomonas aeruginosa PA01
ggccggcgaggcg

SEQ ID NO: 1495752 - RNA, 20 nt, Pseudomonas aeruginosa PA01
ggccggcgagggcggcgacc

SEQ ID NO: 1495753 - RNA, 14 nt, Pseudomonas aeruginosa PA01
ggccggcgaagucg

SEQ ID NO: 1495754 - RNA, 12 nt, Pseudomonas aeruginosa PA01
ggccggcgacca

SEQ ID NO: 1495755 - RNA, 15 nt, Pseudomonas aeruginosa PA01
ggccggcgaccagcg

SEQ ID NO: 1495756 - RNA, 15 nt, Pseudomonas aeruginosa PA01
ggccggcgaccagcu

SEQ ID NO: 1495757 - RNA, 18 nt, Pseudomonas aeruginosa PA01
ggccggcgaccagcucga

SEQ ID NO: 1495758 - RNA, 17 nt, Pseudomonas aeruginosa PA01
ggccggcgaccuugucc

SEQ ID NO: 1495759 - RNA, 17 nt, Pseudomonas aeruginosa PA01
ggccggcaggccgaugg

SEQ ID NO: 1495760 - RNA, 16 nt, Pseudomonas aeruginosa PA01
ggccggccuccagcgc

SEQ ID NO: 1495761 - RNA, 17 nt, Pseudomonas aeruginosa PA01
ggccggccuccagcgcc

SEQ ID NO: 1495762 - RNA, 21 nt, Pseudomonas aeruginosa PA01
ggccggcaggaggaucgcggc

SEQ ID NO: 1495763 - RNA, 15 nt, Pseudomonas aeruginosa PA01
ggccggcagcagcgc

SEQ ID NO: 1495764 - RNA, 14 nt, Pseudomonas aeruginosa PA01
ggccggcagcgagc

SEQ ID NO: 1495765 - RNA, 18 nt, Pseudomonas aeruginosa PA01
ggccggcagcgagcgggu

SEQ ID NO: 1495766 - RNA, 13 nt, Pseudomonas aeruginosa PA01
ggccggcaccagc

SEQ ID NO: 1495767 - RNA, 16 nt, Pseudomonas aeruginosa PA01
ggccggcaccagcagu

SEQ ID NO: 1495768 - RNA, 14 nt, Pseudomonas aeruginosa PA01
ggccggcaacgaac

SEQ ID NO: 1495769 - RNA, 22 nt, Pseudomonas aeruginosa PA01
ggccggcaacgaacuucagggc

SEQ ID NO: 1495770 - RNA, 16 nt, Pseudomonas aeruginosa PA01
ggccggauggccgccg

SEQ ID NO: 1495771 - RNA, 16 nt, Pseudomonas aeruginosa PA01
ggccggaugccaccgc

SEQ ID NO: 1495772 - RNA, 19 nt, Pseudomonas aeruginosa PA01
ggccggaugccaccgcucg

SEQ ID NO: 1495773 - RNA, 22 nt, Pseudomonas aeruginosa PA01
ggccggaugccaccgcucgagu

SEQ ID NO: 1495774 - RNA, 13 nt, Pseudomonas aeruginosa PA01
ggccggaucggcc

SEQ ID NO: 1495775 - RNA, 14 nt, Pseudomonas aeruginosa PA01
ggccggaucggccu

SEQ ID NO: 1495776 - RNA, 15 nt, Pseudomonas aeruginosa PA01
ggccggaucggccuu

SEQ ID NO: 1495777 - RNA, 17 nt, Pseudomonas aeruginosa PA01
ggccggaucggccuugg

SEQ ID NO: 1495778 - RNA, 16 nt, Pseudomonas aeruginosa PA01
ggccgcuuggccaugg

SEQ ID NO: 1495779 - RNA, 15 nt, Pseudomonas aeruginosa PA01
ggccggacgcgacug

SEQ ID NO: 1495780 - RNA, 22 nt, Pseudomonas aeruginosa PA01
ggccggaacggcuugcugacau

SEQ ID NO: 1495781 - RNA, 22 nt, Pseudomonas aeruginosa PA01
ggccggacaggaaaaagcccgc

SEQ ID NO: 1495782 - RNA, 16 nt, Pseudomonas aeruginosa PA01
ggccggagcaggccau

SEQ ID NO: 1495783 - RNA, 17 nt, Pseudomonas aeruginosa PA01
ggccggagccgcguuca

SEQ ID NO: 1495784 - RNA, 17 nt, Pseudomonas aeruginosa PA01
ggccgcuugaagcggcc

SEQ ID NO: 1495785 - RNA, 13 nt, Pseudomonas aeruginosa PA01
ggccgcuugaucu

SEQ ID NO: 1495786 - RNA, 13 nt, Pseudomonas aeruginosa PA01
ggccgcuucgccg

SEQ ID NO: 1495787 - RNA, 16 nt, Pseudomonas aeruginosa PA01
ggccgcuuuccacccg

SEQ ID NO: 1495788 - RNA, 17 nt, Pseudomonas aeruginosa PA01
ggccgcuuuccacccga

SEQ ID NO: 1495789 - RNA, 21 nt, Pseudomonas aeruginosa PA01
ggccgcuuccggcccggccag

SEQ ID NO: 1495790 - RNA, 23 nt, Pseudomonas aeruginosa PA01
ggccgcuuccggcccggccaggu

SEQ ID NO: 1495791 - RNA, 15 nt, Pseudomonas aeruginosa PA01
ggccgcuuacgcggc

SEQ ID NO: 1495792 - RNA, 18 nt, Pseudomonas aeruginosa PA01
ggccgcuuacgcggccuu

SEQ ID NO: 1495793 - RNA, 19 nt, Pseudomonas aeruginosa PA01
ggccgcuucaagcggccau

SEQ ID NO: 1495794 - RNA, 17 nt, Pseudomonas aeruginosa PA01
ggccgcggcguugucgg

SEQ ID NO: 1495795 - RNA, 21 nt, Pseudomonas aeruginosa PA01
ggccgcggcguugucggccag

SEQ ID NO: 1495796 - RNA, 23 nt, Pseudomonas aeruginosa PA01
ggccgcggcguugucggccagca

SEQ ID NO: 1495797 - RNA, 14 nt, Pseudomonas aeruginosa PA01
ggccgcgcugucgg

SEQ ID NO: 1495798 - RNA, 19 nt, Pseudomonas aeruginosa PA01
ggccgcgcugucggccucg

SEQ ID NO: 1495799 - RNA, 19 nt, Pseudomonas aeruginosa PA01
ggccugcagccuggcgucg

SEQ ID NO: 1495800 - RNA, 14 nt, Pseudomonas aeruginosa PA01
ggccugcagcaggu

SEQ ID NO: 1495801 - RNA, 17 nt, Pseudomonas aeruginosa PA01
ggccugcagcaggucga

SEQ ID NO: 1495802 - RNA, 15 nt, Pseudomonas aeruginosa PA01
ggccugccguugcac

SEQ ID NO: 1495803 - RNA, 13 nt, Pseudomonas aeruginosa PA01
ggccugcgccgga

SEQ ID NO: 1495804 - RNA, 16 nt, Pseudomonas aeruginosa PA01
ggccugcgccggacca

SEQ ID NO: 1495805 - RNA, 16 nt, Pseudomonas aeruginosa PA01
ggccugcgcuuccggc

SEQ ID NO: 1495806 - RNA, 23 nt, Pseudomonas aeruginosa PA01
ggccugcgcuuccggcagccagc

SEQ ID NO: 1495807 - RNA, 20 nt, Pseudomonas aeruginosa PA01
ggccugcucagcguccucag

SEQ ID NO: 1495808 - RNA, 23 nt, Pseudomonas aeruginosa PA01
ggccugcuccagcggagcgaccg

SEQ ID NO: 1495809 - RNA, 20 nt, Pseudomonas aeruginosa PA01
ggccugcuccucggcagcgc

SEQ ID NO: 1495810 - RNA, 21 nt, Pseudomonas aeruginosa PA01
ggccugcuccucggcagcgcu

SEQ ID NO: 1495811 - RNA, 16 nt, Pseudomonas aeruginosa PA01
ggccugcucgaacggc

SEQ ID NO: 1495812 - RNA, 16 nt, Pseudomonas aeruginosa PA01
ggccugcucgcgcagc

SEQ ID NO: 1495813 - RNA, 17 nt, Pseudomonas aeruginosa PA01
ggccugcucgcgcagcc

SEQ ID NO: 1495814 - RNA, 16 nt, Pseudomonas aeruginosa PA01
ggccugcugcgccggc

SEQ ID NO: 1495815 - RNA, 17 nt, Pseudomonas aeruginosa PA01
ggccugcugcgccggca

SEQ ID NO: 1495816 - RNA, 17 nt, Pseudomonas aeruginosa PA01
ggccugcugcgggcgcu

SEQ ID NO: 1495817 - RNA, 20 nt, Pseudomonas aeruginosa PA01
ggccugcugcgggcgcugca

SEQ ID NO: 1495818 - RNA, 14 nt, Pseudomonas aeruginosa PA01
ggccugcucggcuc

SEQ ID NO: 1495819 - RNA, 19 nt, Pseudomonas aeruginosa PA01
ggccugaucaucugggcca

SEQ ID NO: 1495820 - RNA, 20 nt, Pseudomonas aeruginosa PA01
ggccugaucaucugggccau

SEQ ID NO: 1495821 - RNA, 22 nt, Pseudomonas aeruginosa PA01
ggccugaucaucugggccaucg

SEQ ID NO: 1495822 - RNA, 16 nt, Pseudomonas aeruginosa PA01
ggccugcaacacccag

SEQ ID NO: 1495823 - RNA, 16 nt, Pseudomonas aeruginosa PA01
ggccugcaacgccgcc

SEQ ID NO: 1495824 - RNA, 17 nt, Pseudomonas aeruginosa PA01
ggccugcaacgccgcca

SEQ ID NO: 1495825 - RNA, 18 nt, Pseudomonas aeruginosa PA01
ggccugcaccagccaguc

SEQ ID NO: 1495826 - RNA, 19 nt, Pseudomonas aeruginosa PA01
ggccugacgcaagcgcucg

SEQ ID NO: 1495827 - RNA, 21 nt, Pseudomonas aeruginosa PA01
ggccugacgcaagcgcucggc

SEQ ID NO: 1495828 - RNA, 15 nt, Pseudomonas aeruginosa PA01
ggccuccggacgcug

SEQ ID NO: 1495829 - RNA, 17 nt, Pseudomonas aeruginosa PA01
ggccuccggacgcugca

SEQ ID NO: 1495830 - RNA, 15 nt, Pseudomonas aeruginosa PA01
ggccugagcugccgc

SEQ ID NO: 1495831 - RNA, 19 nt, Pseudomonas aeruginosa PA01
ggccugagcugccgcuucg

SEQ ID NO: 1495832 - RNA, 15 nt, Pseudomonas aeruginosa PA01
ggccugagccggccg

SEQ ID NO: 1495833 - RNA, 13 nt, Pseudomonas aeruginosa PA01
ggccucccagccg

SEQ ID NO: 1495834 - RNA, 17 nt, Pseudomonas aeruginosa PA01
ggccuccagcaacgccg

SEQ ID NO: 1495835 - RNA, 17 nt, Pseudomonas aeruginosa PA01
ggccuccccggcccgcg

SEQ ID NO: 1495836 - RNA, 15 nt, Pseudomonas aeruginosa PA01
ggccuccacccgcga

SEQ ID NO: 1495837 - RNA, 14 nt, Pseudomonas aeruginosa PA01
ggccuccagcgccu

SEQ ID NO: 1495838 - RNA, 22 nt, Pseudomonas aeruginosa PA01
ggccuccagcgccucgccgagc

SEQ ID NO: 1495839 - RNA, 18 nt, Pseudomonas aeruginosa PA01
ggccuccagcgccuggcg

SEQ ID NO: 1495840 - RNA, 22 nt, Pseudomonas aeruginosa PA01
ggccuccaggcuggccuuggcc

SEQ ID NO: 1495841 - RNA, 18 nt, Pseudomonas aeruginosa PA01
ggccguuguagagacaga

SEQ ID NO: 1495842 - RNA, 17 nt, Pseudomonas aeruginosa PA01
ggccguuuugccgcucg

SEQ ID NO: 1495843 - RNA, 22 nt, Pseudomonas aeruginosa PA01
ggccguuuuuuaugccgaggcg

SEQ ID NO: 1495844 - RNA, 15 nt, Pseudomonas aeruginosa PA01
ggccguuggcgaacu

SEQ ID NO: 1495845 - RNA, 16 nt, Pseudomonas aeruginosa PA01
ggccguuggcgaacuu

SEQ ID NO: 1495846 - RNA, 16 nt, Pseudomonas aeruginosa PA01
ggccguugcgggcgau

SEQ ID NO: 1495847 - RNA, 18 nt, Pseudomonas aeruginosa PA01
ggccguucuccgggucgg

SEQ ID NO: 1495848 - RNA, 16 nt, Pseudomonas aeruginosa PA01
ggccguugcgcaggcg

SEQ ID NO: 1495849 - RNA, 18 nt, Pseudomonas aeruginosa PA01
ggccguugcgcaggcggu

SEQ ID NO: 1495850 - RNA, 22 nt, Pseudomonas aeruginosa PA01
ggccguugagcaccucgaccug

SEQ ID NO: 1495851 - RNA, 14 nt, Pseudomonas aeruginosa PA01
ggccguugaccagc

SEQ ID NO: 1495852 - RNA, 22 nt, Pseudomonas aeruginosa PA01
ggccgugccucagagucgcacc

SEQ ID NO: 1495853 - RNA, 23 nt, Pseudomonas aeruginosa PA01
ggccgugcggagggucaggccga

SEQ ID NO: 1495854 - RNA, 15 nt, Pseudomonas aeruginosa PA01
ggccgugcucgauga

SEQ ID NO: 1495855 - RNA, 19 nt, Pseudomonas aeruginosa PA01
ggccgugcucgaugaucga

SEQ ID NO: 1495856 - RNA, 15 nt, Pseudomonas aeruginosa PA01
ggccgugggccgccg

SEQ ID NO: 1495857 - RNA, 18 nt, Pseudomonas aeruginosa PA01
ggccgugggccgccgaac

SEQ ID NO: 1495858 - RNA, 14 nt, Pseudomonas aeruginosa PA01
ggccguggcgcccc

SEQ ID NO: 1495859 - RNA, 15 nt, Pseudomonas aeruginosa PA01
ggccguggcgcccca

SEQ ID NO: 1495860 - RNA, 17 nt, Pseudomonas aeruginosa PA01
ggccguggcgccccagg

SEQ ID NO: 1495861 - RNA, 20 nt, Pseudomonas aeruginosa PA01
ggccgugcaugccgacgagc

SEQ ID NO: 1495862 - RNA, 17 nt, Pseudomonas aeruginosa PA01
ggccgucuccaggcgcg

SEQ ID NO: 1495863 - RNA, 19 nt, Pseudomonas aeruginosa PA01
ggccgucuccaggcgcgcc

SEQ ID NO: 1495864 - RNA, 17 nt, Pseudomonas aeruginosa PA01
ggccgucgggcauggcg

SEQ ID NO: 1495865 - RNA, 18 nt, Pseudomonas aeruginosa PA01
ggccgucgggcauggcga

SEQ ID NO: 1495866 - RNA, 20 nt, Pseudomonas aeruginosa PA01
ggccgucgacccgccucacc

SEQ ID NO: 1495867 - RNA, 23 nt, Pseudomonas aeruginosa PA01
ggccgucgagggcaaaggcgcgc

SEQ ID NO: 1495868 - RNA, 20 nt, Pseudomonas aeruginosa PA01
ggccgucgaggucggcgauc

SEQ ID NO: 1495869 - RNA, 15 nt, Pseudomonas aeruginosa PA01
ggccgucggccuggc

SEQ ID NO: 1495870 - RNA, 16 nt, Pseudomonas aeruginosa PA01
ggccgucggccuggcg

SEQ ID NO: 1495871 - RNA, 14 nt, Pseudomonas aeruginosa PA01
ggccgucggccugc

SEQ ID NO: 1495872 - RNA, 20 nt, Pseudomonas aeruginosa PA01
ggccgguugcgaccggccuu

SEQ ID NO: 1495873 - RNA, 17 nt, Pseudomonas aeruginosa PA01
ggccgguugcggcgccg

SEQ ID NO: 1495874 - RNA, 20 nt, Pseudomonas aeruginosa PA01
ggccgguugcggcgccgguu

SEQ ID NO: 1495875 - RNA, 21 nt, Pseudomonas aeruginosa PA01
ggccgguuccgaaucgccuac

SEQ ID NO: 1495876 - RNA, 18 nt, Pseudomonas aeruginosa PA01
ggccguaccagucgcccg

SEQ ID NO: 1495877 - RNA, 20 nt, Pseudomonas aeruginosa PA01
ggccguaccagucgcccgcu

SEQ ID NO: 1495878 - RNA, 14 nt, Pseudomonas aeruginosa PA01
ggccguagaccacc

SEQ ID NO: 1495879 - RNA, 15 nt, Pseudomonas aeruginosa PA01
ggccguagaccacca

SEQ ID NO: 1495880 - RNA, 18 nt, Pseudomonas aeruginosa PA01
ggccguagaccaccagca

SEQ ID NO: 1495881 - RNA, 20 nt, Pseudomonas aeruginosa PA01
ggccguagaccaccagcagc

SEQ ID NO: 1495882 - RNA, 22 nt, Pseudomonas aeruginosa PA01
ggccgucccagucggcguccgc

SEQ ID NO: 1495883 - RNA, 15 nt, Pseudomonas aeruginosa PA01
ggccguccaggcugc

SEQ ID NO: 1495884 - RNA, 12 nt, Pseudomonas aeruginosa PA01
ggccguccaggc

SEQ ID NO: 1495885 - RNA, 14 nt, Pseudomonas aeruginosa PA01
ggccguccgccagg

SEQ ID NO: 1495886 - RNA, 15 nt, Pseudomonas aeruginosa PA01
ggccguccgccaggu

SEQ ID NO: 1495887 - RNA, 20 nt, Pseudomonas aeruginosa PA01
ggccgucgaagggcacgccg

SEQ ID NO: 1495888 - RNA, 23 nt, Pseudomonas aeruginosa PA01
ggccgucgaagggcacgccgcuc

SEQ ID NO: 1495889 - RNA, 15 nt, Pseudomonas aeruginosa PA01
ggccguccucgggau

SEQ ID NO: 1495890 - RNA, 19 nt, Pseudomonas aeruginosa PA01
ggccgggguauccgggcac

SEQ ID NO: 1495891 - RNA, 17 nt, Pseudomonas aeruginosa PA01
ggccgggggucgcggcg

SEQ ID NO: 1495892 - RNA, 19 nt, Pseudomonas aeruginosa PA01
ggccgggucaucaccggca

SEQ ID NO: 1495893 - RNA, 20 nt, Pseudomonas aeruginosa PA01
ggccgggucaucaccggcag

SEQ ID NO: 1495894 - RNA, 19 nt, Pseudomonas aeruginosa PA01
ggccgggggcggcgccugg

SEQ ID NO: 1495895 - RNA, 13 nt, Pseudomonas aeruginosa PA01
ggccggggcgcgc

SEQ ID NO: 1495896 - RNA, 13 nt, Pseudomonas aeruginosa PA01
ggccggcgaugcg

SEQ ID NO: 1495897 - RNA, 15 nt, Pseudomonas aeruginosa PA01
ggccggcgauggccc

SEQ ID NO: 1495898 - RNA, 17 nt, Pseudomonas aeruginosa PA01
ggccggcgauggccgcc

SEQ ID NO: 1495899 - RNA, 21 nt, Pseudomonas aeruginosa PA01
ggccggcgauggccgccugca

SEQ ID NO: 1495900 - RNA, 23 nt, Pseudomonas aeruginosa PA01
ggccaggcgcuccuccagcgccg

SEQ ID NO: 1495901 - RNA, 15 nt, Pseudomonas aeruginosa PA01
ggccaggcggccgac

SEQ ID NO: 1495902 - RNA, 12 nt, Pseudomonas aeruginosa PA01
ggccaggcgcga

SEQ ID NO: 1495903 - RNA, 13 nt, Pseudomonas aeruginosa PA01
ggccaggcgcgac

SEQ ID NO: 1495904 - RNA, 17 nt, Pseudomonas aeruginosa PA01
ggccaggcucgcgaugc

SEQ ID NO: 1495905 - RNA, 17 nt, Pseudomonas aeruginosa PA01
ggccaggcucuucuucg

SEQ ID NO: 1495906 - RNA, 16 nt, Pseudomonas aeruginosa PA01
ggcccaugauggucgg

SEQ ID NO: 1495907 - RNA, 17 nt, Pseudomonas aeruginosa PA01
ggccccaaggggccgcg

SEQ ID NO: 1495908 - RNA, 22 nt, Pseudomonas aeruginosa PA01
ggcccauuucguagcccaggcg

SEQ ID NO: 1495909 - RNA, 23 nt, Pseudomonas aeruginosa PA01
ggccccaccuggcgacaggcgau

SEQ ID NO: 1495910 - RNA, 16 nt, Pseudomonas aeruginosa PA01
ggccccagcgcgagcg

SEQ ID NO: 1495911 - RNA, 13 nt, Pseudomonas aeruginosa PA01
ggccccaggcgau

SEQ ID NO: 1495912 - RNA, 16 nt, Pseudomonas aeruginosa PA01
ggccccaggcgaucca

SEQ ID NO: 1495913 - RNA, 11 nt, Pseudomonas aeruginosa PA01
ggccaggaucg

SEQ ID NO: 1495914 - RNA, 19 nt, Pseudomonas aeruginosa PA01
ggccaggaucgucggcccg

SEQ ID NO: 1495915 - RNA, 21 nt, Pseudomonas aeruginosa PA01
ggccaggaucgucggcccgca

SEQ ID NO: 1495916 - RNA, 18 nt, Pseudomonas aeruginosa PA01
ggccaggcaaucgaucgc

SEQ ID NO: 1495917 - RNA, 12 nt, Pseudomonas aeruginosa PA01
ggccaggcagac

SEQ ID NO: 1495918 - RNA, 17 nt, Pseudomonas aeruginosa PA01
ggccaggcagaccagcg

SEQ ID NO: 1495919 - RNA, 18 nt, Pseudomonas aeruginosa PA01
ggccaggcagaccagcgc

SEQ ID NO: 1495920 - RNA, 19 nt, Pseudomonas aeruginosa PA01
ggccaggcagaccagcgca

SEQ ID NO: 1495921 - RNA, 16 nt, Pseudomonas aeruginosa PA01
ggccaggcauccagca

SEQ ID NO: 1495922 - RNA, 20 nt, Pseudomonas aeruginosa PA01
ggccaggcauccagcaccgc

SEQ ID NO: 1495923 - RNA, 17 nt, Pseudomonas aeruginosa PA01
ggccaggccccaggccg

SEQ ID NO: 1495924 - RNA, 18 nt, Pseudomonas aeruginosa PA01
ggccaggccccaggccgc

SEQ ID NO: 1495925 - RNA, 20 nt, Pseudomonas aeruginosa PA01
ggccaggccccagggccggc

SEQ ID NO: 1495926 - RNA, 21 nt, Pseudomonas aeruginosa PA01
ggccaggccccagggccggcg

SEQ ID NO: 1495927 - RNA, 18 nt, Pseudomonas aeruginosa PA01
ggccaggaugaccaggcu

SEQ ID NO: 1495928 - RNA, 14 nt, Pseudomonas aeruginosa PA01
ggccaggcauuccu

SEQ ID NO: 1495929 - RNA, 14 nt, Pseudomonas aeruginosa PA01
ggccaggccacggc

SEQ ID NO: 1495930 - RNA, 14 nt, Pseudomonas aeruginosa PA01
ggccaggccgccca

SEQ ID NO: 1495931 - RNA, 23 nt, Pseudomonas aeruginosa PA01
ggccaggccgagcgcgccgccga

SEQ ID NO: 1495932 - RNA, 14 nt, Pseudomonas aeruginosa PA01
ggccaggcccuugg

SEQ ID NO: 1495933 - RNA, 21 nt, Pseudomonas aeruginosa PA01
ggccaggcgcaccagcaggcg

SEQ ID NO: 1495934 - RNA, 14 nt, Pseudomonas aeruginosa PA01
ggccaggcgccagg

SEQ ID NO: 1495935 - RNA, 14 nt, Pseudomonas aeruginosa PA01
ggccaggccggcgc

SEQ ID NO: 1495936 - RNA, 13 nt, Pseudomonas aeruginosa PA01
ggccccagggccg

SEQ ID NO: 1495937 - RNA, 16 nt, Pseudomonas aeruginosa PA01
ggccccagggccggcg

SEQ ID NO: 1495938 - RNA, 23 nt, Pseudomonas aeruginosa PA01
ggccccagggccggcgcccuucg

SEQ ID NO: 1495939 - RNA, 13 nt, Pseudomonas aeruginosa PA01
ggcccgacgccgc

SEQ ID NO: 1495940 - RNA, 19 nt, Pseudomonas aeruginosa PA01
ggcccgacgccgcccggca

SEQ ID NO: 1495941 - RNA, 16 nt, Pseudomonas aeruginosa PA01
ggcccgagccggacga

SEQ ID NO: 1495942 - RNA, 16 nt, Pseudomonas aeruginosa PA01
ggcccgagcaggcugc

SEQ ID NO: 1495943 - RNA, 19 nt, Pseudomonas aeruginosa PA01
ggcccgagcaggcugccga

SEQ ID NO: 1495944 - RNA, 20 nt, Pseudomonas aeruginosa PA01
ggccccgcgguacccggcag

SEQ ID NO: 1495945 - RNA, 15 nt, Pseudomonas aeruginosa PA01
ggcccgacggugcgg

SEQ ID NO: 1495946 - RNA, 16 nt, Pseudomonas aeruginosa PA01
ggcccgcaaucagcgg

SEQ ID NO: 1495947 - RNA, 20 nt, Pseudomonas aeruginosa PA01
ggcccgcaugaacgccucgc

SEQ ID NO: 1495948 - RNA, 21 nt, Pseudomonas aeruginosa PA01
ggcccgccacagaucgccagc

SEQ ID NO: 1495949 - RNA, 12 nt, Pseudomonas aeruginosa PA01
ggcccgccccgc

SEQ ID NO: 1495950 - RNA, 17 nt, Pseudomonas aeruginosa PA01
ggcccggcgcugcccgg

SEQ ID NO: 1495951 - RNA, 15 nt, Pseudomonas aeruginosa PA01
ggcccggcgcggcgg

SEQ ID NO: 1495952 - RNA, 14 nt, Pseudomonas aeruginosa PA01
ggcccggccgccug

SEQ ID NO: 1495953 - RNA, 12 nt, Pseudomonas aeruginosa PA01
ggcccggccgcc

SEQ ID NO: 1495954 - RNA, 19 nt, Pseudomonas aeruginosa PA01
ggcccgggucacggucagc

SEQ ID NO: 1495955 - RNA, 18 nt, Pseudomonas aeruginosa PA01
ggcccggggcucugccgg

SEQ ID NO: 1495956 - RNA, 13 nt, Pseudomonas aeruginosa PA01
ggcccgggccugg

SEQ ID NO: 1495957 - RNA, 12 nt, Pseudomonas aeruginosa PA01
ggcccgggcgcc

SEQ ID NO: 1495958 - RNA, 16 nt, Pseudomonas aeruginosa PA01
ggcccgggcgccaccg

SEQ ID NO: 1495959 - RNA, 16 nt, Pseudomonas aeruginosa PA01
ggcccggucuagccgg

SEQ ID NO: 1495960 - RNA, 12 nt, Pseudomonas aeruginosa PA01
ggcccggucagc

SEQ ID NO: 1495961 - RNA, 17 nt, Pseudomonas aeruginosa PA01
ggcccguuccaccgccu

SEQ ID NO: 1495962 - RNA, 23 nt, Pseudomonas aeruginosa PA01
ggcccguuccaccgccuggacca

SEQ ID NO: 1495963 - RNA, 15 nt, Pseudomonas aeruginosa PA01
ggcccgugguagucg

SEQ ID NO: 1495964 - RNA, 21 nt, Pseudomonas aeruginosa PA01
ggcccgguugagauccuggcc

SEQ ID NO: 1495965 - RNA, 22 nt, Pseudomonas aeruginosa PA01
ggcccgguugagauccuggccg

SEQ ID NO: 1495966 - RNA, 23 nt, Pseudomonas aeruginosa PA01
ggcccgguugagauccuggccgg

SEQ ID NO: 1495967 - RNA, 20 nt, Pseudomonas aeruginosa PA01
ggcccgguuggccaggacca

SEQ ID NO: 1495968 - RNA, 22 nt, Pseudomonas aeruginosa PA01
ggcccgcggucacucggccucg

SEQ ID NO: 1495969 - RNA, 12 nt, Pseudomonas aeruginosa PA01
ggcccgccgccg

SEQ ID NO: 1495970 - RNA, 22 nt, Pseudomonas aeruginosa PA01
ggcccgcucuugauacccaccg

SEQ ID NO: 1495971 - RNA, 17 nt, Pseudomonas aeruginosa PA01
ggcccggagaucgccgc

SEQ ID NO: 1495972 - RNA, 22 nt, Pseudomonas aeruginosa PA01
ggcccggccagguaggcgacga

SEQ ID NO: 1495973 - RNA, 23 nt, Pseudomonas aeruginosa PA01
ggcccggccagguaggcgacgaa

SEQ ID NO: 1495974 - RNA, 13 nt, Pseudomonas aeruginosa PA01
ggcccggccaucc

SEQ ID NO: 1495975 - RNA, 19 nt, Pseudomonas aeruginosa PA01
ggcccggccauccuggccg

SEQ ID NO: 1495976 - RNA, 21 nt, Pseudomonas aeruginosa PA01
ggcccggcaggcagugccggg

SEQ ID NO: 1495977 - RNA, 13 nt, Pseudomonas aeruginosa PA01
ggcccggcaggcg

SEQ ID NO: 1495978 - RNA, 18 nt, Pseudomonas aeruginosa PA01
ggcccggcaggcgcacgc

SEQ ID NO: 1495979 - RNA, 15 nt, Pseudomonas aeruginosa PA01
ggcccgccgcggcga

SEQ ID NO: 1495980 - RNA, 18 nt, Pseudomonas aeruginosa PA01
ggcccgccgcggcgagca

SEQ ID NO: 1495981 - RNA, 16 nt, Pseudomonas aeruginosa PA01
ggcccgccggucaacc

SEQ ID NO: 1495982 - RNA, 16 nt, Pseudomonas aeruginosa PA01
ggcccgcggaucgcgc

SEQ ID NO: 1495983 - RNA, 21 nt, Pseudomonas aeruginosa PA01
ggcccgcggaucgcgccgucg

SEQ ID NO: 1495984 - RNA, 19 nt, Pseudomonas aeruginosa PA01
ggcccgccguugccagcau

SEQ ID NO: 1495985 - RNA, 20 nt, Pseudomonas aeruginosa PA01
ggcccgccguugccagcauc

SEQ ID NO: 1495986 - RNA, 12 nt, Pseudomonas aeruginosa PA01
ggcccgcgccgc

SEQ ID NO: 1495987 - RNA, 13 nt, Pseudomonas aeruginosa PA01
ggcccgcgccgcc

SEQ ID NO: 1495988 - RNA, 15 nt, Pseudomonas aeruginosa PA01
ggcccgcgccgccuc

SEQ ID NO: 1495989 - RNA, 18 nt, Pseudomonas aeruginosa PA01
ggccgacagagcggccgg

SEQ ID NO: 1495990 - RNA, 19 nt, Pseudomonas aeruginosa PA01
ggccgacagagcggccggc

SEQ ID NO: 1495991 - RNA, 14 nt, Pseudomonas aeruginosa PA01
ggccgacagcggcu

SEQ ID NO: 1495992 - RNA, 16 nt, Pseudomonas aeruginosa PA01
ggccgacagcggcugg

SEQ ID NO: 1495993 - RNA, 20 nt, Pseudomonas aeruginosa PA01
ggccgacagcggcuggcgcu

SEQ ID NO: 1495994 - RNA, 13 nt, Pseudomonas aeruginosa PA01
ggccgacaggcug

SEQ ID NO: 1495995 - RNA, 14 nt, Pseudomonas aeruginosa PA01
ggccgacaggcugg

SEQ ID NO: 1495996 - RNA, 13 nt, Pseudomonas aeruginosa PA01
ggccgaccagcag

SEQ ID NO: 1495997 - RNA, 23 nt, Pseudomonas aeruginosa PA01
ggccgaccagcagggccagcagc

SEQ ID NO: 1495998 - RNA, 11 nt, Pseudomonas aeruginosa PA01
ggccgacccgu

SEQ ID NO: 1495999 - RNA, 16 nt, Pseudomonas aeruginosa PA01
ggccgacccgugcgcc

SEQ ID NO: 1496000 - RNA, 17 nt, Pseudomonas aeruginosa PA01
ggccgaccaggugcugg

SEQ ID NO: 1496001 - RNA, 13 nt, Pseudomonas aeruginosa PA01
ggccgaccagcgc

SEQ ID NO: 1496002 - RNA, 15 nt, Pseudomonas aeruginosa PA01
ggccgaccagcgccg

SEQ ID NO: 1496003 - RNA, 14 nt, Pseudomonas aeruginosa PA01
ggccgaccuugucc

SEQ ID NO: 1496004 - RNA, 14 nt, Pseudomonas aeruginosa PA01
ggccgacgccgcug

SEQ ID NO: 1496005 - RNA, 15 nt, Pseudomonas aeruginosa PA01
ggccgacgccgcugg

SEQ ID NO: 1496006 - RNA, 17 nt, Pseudomonas aeruginosa PA01
ggccgacgccgcuggaa

SEQ ID NO: 1496007 - RNA, 14 nt, Pseudomonas aeruginosa PA01
ggccgacgaaggcc

SEQ ID NO: 1496008 - RNA, 16 nt, Pseudomonas aeruginosa PA01
ggccgacgaaggccgc

SEQ ID NO: 1496009 - RNA, 19 nt, Pseudomonas aeruginosa PA01
ggccgacgaaggccgcggu

SEQ ID NO: 1496010 - RNA, 20 nt, Pseudomonas aeruginosa PA01
ggccgacgaaggccgcgguc

SEQ ID NO: 1496011 - RNA, 19 nt, Pseudomonas aeruginosa PA01
ggccgacccgcagcggcgc

SEQ ID NO: 1496012 - RNA, 15 nt, Pseudomonas aeruginosa PA01
ggccgaccucggcgg

SEQ ID NO: 1496013 - RNA, 20 nt, Pseudomonas aeruginosa PA01
ggccgaacucacggaugccg

SEQ ID NO: 1496014 - RNA, 20 nt, Pseudomonas aeruginosa PA01
ggccgaacucaugcccagcu

SEQ ID NO: 1496015 - RNA, 22 nt, Pseudomonas aeruginosa PA01
ggccgaacucaugcccagcuug

SEQ ID NO: 1496016 - RNA, 18 nt, Pseudomonas aeruginosa PA01
ggccgaacucuggcggcg

SEQ ID NO: 1496017 - RNA, 13 nt, Pseudomonas aeruginosa PA01
ggccgaagcuguc

SEQ ID NO: 1496018 - RNA, 15 nt, Pseudomonas aeruginosa PA01
ggccgaagcugucga

SEQ ID NO: 1496019 - RNA, 22 nt, Pseudomonas aeruginosa PA01
ggccgaagcugucgagcacggc

SEQ ID NO: 1496020 - RNA, 14 nt, Pseudomonas aeruginosa PA01
ggccgaaggccagg

SEQ ID NO: 1496021 - RNA, 16 nt, Pseudomonas aeruginosa PA01
ggccgaaggccaggcc

SEQ ID NO: 1496022 - RNA, 19 nt, Pseudomonas aeruginosa PA01
ggccgaaggccaggccggc

SEQ ID NO: 1496023 - RNA, 20 nt, Pseudomonas aeruginosa PA01
ggccgaaggccaggccggcg

SEQ ID NO: 1496024 - RNA, 19 nt, Pseudomonas aeruginosa PA01
ggccgaaggcgcuccccug

SEQ ID NO: 1496025 - RNA, 17 nt, Pseudomonas aeruginosa PA01
ggccgaagaggcccucg

SEQ ID NO: 1496026 - RNA, 23 nt, Pseudomonas aeruginosa PA01
ggccgaagaggcccucggcgccg

SEQ ID NO: 1496027 - RNA, 19 nt, Pseudomonas aeruginosa PA01
ggccgaauccuccagccgg

SEQ ID NO: 1496028 - RNA, 23 nt, Pseudomonas aeruginosa PA01
ggccgaauccuccagccggcgac

SEQ ID NO: 1496029 - RNA, 17 nt, Pseudomonas aeruginosa PA01
ggccgaaucgaacaggg

SEQ ID NO: 1496030 - RNA, 17 nt, Pseudomonas aeruginosa PA01
ggccgacaccucgauca

SEQ ID NO: 1496031 - RNA, 23 nt, Pseudomonas aeruginosa PA01
ggccgaauaggcgaucuccggca

SEQ ID NO: 1496032 - RNA, 17 nt, Pseudomonas aeruginosa PA01
ggccgaauccgccggcg

SEQ ID NO: 1496033 - RNA, 16 nt, Pseudomonas aeruginosa PA01
ggcccuccccuggccc

SEQ ID NO: 1496034 - RNA, 17 nt, Pseudomonas aeruginosa PA01
ggcccucggcgaccaac

SEQ ID NO: 1496035 - RNA, 17 nt, Pseudomonas aeruginosa PA01
ggcccucggcgccgagc

SEQ ID NO: 1496036 - RNA, 19 nt, Pseudomonas aeruginosa PA01
ggcccucggcgccgagcau

SEQ ID NO: 1496037 - RNA, 19 nt, Pseudomonas aeruginosa PA01
ggcccucggcggcgagcgg

SEQ ID NO: 1496038 - RNA, 15 nt, Pseudomonas aeruginosa PA01
ggcccugcagcgcca

SEQ ID NO: 1496039 - RNA, 21 nt, Pseudomonas aeruginosa PA01
ggcccugccagaggaucggcc

SEQ ID NO: 1496040 - RNA, 22 nt, Pseudomonas aeruginosa PA01
ggcccugccagaggaucggcca

SEQ ID NO: 1496041 - RNA, 23 nt, Pseudomonas aeruginosa PA01
ggcccugccagaggaucggccaa

SEQ ID NO: 1496042 - RNA, 15 nt, Pseudomonas aeruginosa PA01
ggcccucucucgccu

SEQ ID NO: 1496043 - RNA, 17 nt, Pseudomonas aeruginosa PA01
ggcccuggccuuggcca

SEQ ID NO: 1496044 - RNA, 19 nt, Pseudomonas aeruginosa PA01
ggcccuggccuuggccacg

SEQ ID NO: 1496045 - RNA, 12 nt, Pseudomonas aeruginosa PA01
ggcccuggcgca

SEQ ID NO: 1496046 - RNA, 12 nt, Pseudomonas aeruginosa PA01
ggcccuggauca

SEQ ID NO: 1496047 - RNA, 20 nt, Pseudomonas aeruginosa PA01
ggcccuggaucaccgcggcg

SEQ ID NO: 1496048 - RNA, 19 nt, Pseudomonas aeruginosa PA01
ggcccugggccccggccgg

SEQ ID NO: 1496049 - RNA, 15 nt, Pseudomonas aeruginosa PA01
ggcccugcucgccgg

SEQ ID NO: 1496050 - RNA, 14 nt, Pseudomonas aeruginosa PA01
ggcccuggaccucg

SEQ ID NO: 1496051 - RNA, 19 nt, Pseudomonas aeruginosa PA01
ggcccugcgccgcagcggc

SEQ ID NO: 1496052 - RNA, 20 nt, Pseudomonas aeruginosa PA01
ggcccugcgccgcagcggcc

SEQ ID NO: 1496053 - RNA, 14 nt, Pseudomonas aeruginosa PA01
ggcccugcgcgcgc

SEQ ID NO: 1496054 - RNA, 18 nt, Pseudomonas aeruginosa PA01
ggccgaaauugaccaggu

SEQ ID NO: 1496055 - RNA, 15 nt, Pseudomonas aeruginosa PA01
ggccgaaccggggcg

SEQ ID NO: 1496056 - RNA, 20 nt, Pseudomonas aeruginosa PA01
ggcccuucacgagaccaccg

SEQ ID NO: 1496057 - RNA, 17 nt, Pseudomonas aeruginosa PA01
ggcccuuuuccaccggc

SEQ ID NO: 1496058 - RNA, 16 nt, Pseudomonas aeruginosa PA01
ggccgaaagcacugcg

SEQ ID NO: 1496059 - RNA, 18 nt, Pseudomonas aeruginosa PA01
ggccgaaagcacugcggc

SEQ ID NO: 1496060 - RNA, 13 nt, Pseudomonas aeruginosa PA01
ggcccuggcggcg

SEQ ID NO: 1496061 - RNA, 18 nt, Pseudomonas aeruginosa PA01
ggcccugguacagcgccu

SEQ ID NO: 1496062 - RNA, 14 nt, Pseudomonas aeruginosa PA01
ggcccugggcggcg

SEQ ID NO: 1496063 - RNA, 15 nt, Pseudomonas aeruginosa PA01
ggcccugggcggcgg

SEQ ID NO: 1496064 - RNA, 15 nt, Pseudomonas aeruginosa PA01
ggcccuuggucaggc

SEQ ID NO: 1496065 - RNA, 20 nt, Pseudomonas aeruginosa PA01
ggcccuuggucaggccgacc

SEQ ID NO: 1496066 - RNA, 13 nt, Pseudomonas aeruginosa PA01
ggcccuugucgcc

SEQ ID NO: 1496067 - RNA, 14 nt, Pseudomonas aeruginosa PA01
ggcccuugagcaug

SEQ ID NO: 1496068 - RNA, 17 nt, Pseudomonas aeruginosa PA01
ggcccuugagcauggcg

SEQ ID NO: 1496069 - RNA, 17 nt, Pseudomonas aeruginosa PA01
ggcccuugagggccucg

SEQ ID NO: 1496070 - RNA, 20 nt, Pseudomonas aeruginosa PA01
ggcccuugagggccucggcg

SEQ ID NO: 1496071 - RNA, 21 nt, Pseudomonas aeruginosa PA01
ggcccuugagggccucggcga

SEQ ID NO: 1496072 - RNA, 22 nt, Pseudomonas aeruginosa PA01
ggcccuugagggccucggcgaa

SEQ ID NO: 1496073 - RNA, 15 nt, Pseudomonas aeruginosa PA01
ggccgacucgcgauc

SEQ ID NO: 1496074 - RNA, 22 nt, Pseudomonas aeruginosa PA01
ggccgacucgcgaucgaucggc

SEQ ID NO: 1496075 - RNA, 17 nt, Pseudomonas aeruginosa PA01
ggccgacgugcacccgc

SEQ ID NO: 1496076 - RNA, 19 nt, Pseudomonas aeruginosa PA01
ggccgacguccaucagcgu

SEQ ID NO: 1496077 - RNA, 14 nt, Pseudomonas aeruginosa PA01
ggccgacgcuuccu

SEQ ID NO: 1496078 - RNA, 16 nt, Pseudomonas aeruginosa PA01
ggccgacgcuuccucg

SEQ ID NO: 1496079 - RNA, 14 nt, Pseudomonas aeruginosa PA01
ggccgacgcgcugc

SEQ ID NO: 1496080 - RNA, 15 nt, Pseudomonas aeruginosa PA01
ggccgacgcgcugcc

SEQ ID NO: 1496081 - RNA, 13 nt, Pseudomonas aeruginosa PA01
ggccgacggcgcg

SEQ ID NO: 1496082 - RNA, 16 nt, Pseudomonas aeruginosa PA01
ggccgacggcgcgcug

SEQ ID NO: 1496083 - RNA, 22 nt, Pseudomonas aeruginosa PA01
ggccgacggcgcgcugcgugcg

SEQ ID NO: 1496084 - RNA, 15 nt, Pseudomonas aeruginosa PA01
ggccgagaucgguca

SEQ ID NO: 1496085 - RNA, 15 nt, Pseudomonas aeruginosa PA01
ggccgagaccgcagc

SEQ ID NO: 1496086 - RNA, 14 nt, Pseudomonas aeruginosa PA01
ggccgagcaggcgc

SEQ ID NO: 1496087 - RNA, 15 nt, Pseudomonas aeruginosa PA01
ggccgagcagcgcca

SEQ ID NO: 1496088 - RNA, 21 nt, Pseudomonas aeruginosa PA01
ggccgagcagcgccagccagg

SEQ ID NO: 1496089 - RNA, 22 nt, Pseudomonas aeruginosa PA01
ggccgagcauguaggcgcacca

SEQ ID NO: 1496090 - RNA, 23 nt, Pseudomonas aeruginosa PA01
ggccgagcauguaggcgcaccag

SEQ ID NO: 1496091 - RNA, 17 nt, Pseudomonas aeruginosa PA01
ggccgagcccagcggca

SEQ ID NO: 1496092 - RNA, 17 nt, Pseudomonas aeruginosa PA01
ggccgagcccgagugcg

SEQ ID NO: 1496093 - RNA, 22 nt, Pseudomonas aeruginosa PA01
ggccgagcccgagugcgcccag

SEQ ID NO: 1496094 - RNA, 18 nt, Pseudomonas aeruginosa PA01
ggccgagaaaccgccauc

SEQ ID NO: 1496095 - RNA, 19 nt, Pseudomonas aeruginosa PA01
ggccgagaaaccgccaucg

SEQ ID NO: 1496096 - RNA, 19 nt, Pseudomonas aeruginosa PA01
ggccgagcaauccggcgcu

SEQ ID NO: 1496097 - RNA, 20 nt, Pseudomonas aeruginosa PA01
ggccgagcaauccggcgcug

SEQ ID NO: 1496098 - RNA, 21 nt, Pseudomonas aeruginosa PA01
ggccgagcaauccggcgcugc

SEQ ID NO: 1496099 - RNA, 22 nt, Pseudomonas aeruginosa PA01
ggccgagcaauccggcgcugcc

SEQ ID NO: 1496100 - RNA, 15 nt, Pseudomonas aeruginosa PA01
ggccgagcaccacgc

SEQ ID NO: 1496101 - RNA, 20 nt, Pseudomonas aeruginosa PA01
ggccgagcaccggcaggacg

SEQ ID NO: 1496102 - RNA, 17 nt, Pseudomonas aeruginosa PA01
ggccgagaagguucucg

SEQ ID NO: 1496103 - RNA, 21 nt, Pseudomonas aeruginosa PA01
ggccgagaagguucucggcca

SEQ ID NO: 1496104 - RNA, 13 nt, Pseudomonas aeruginosa PA01
ggccgagcgacuc

SEQ ID NO: 1496105 - RNA, 13 nt, Pseudomonas aeruginosa PA01
ggccgagccggca

SEQ ID NO: 1496106 - RNA, 14 nt, Pseudomonas aeruginosa PA01
ggccgagccgacau

SEQ ID NO: 1496107 - RNA, 21 nt, Pseudomonas aeruginosa PA01
ggccgagccgacauccugucg

SEQ ID NO: 1496108 - RNA, 17 nt, Pseudomonas aeruginosa PA01
ggccgagcgcgccgccg

SEQ ID NO: 1496109 - RNA, 13 nt, Pseudomonas aeruginosa PA01
ggccgagcgcagc

SEQ ID NO: 1496110 - RNA, 15 nt, Pseudomonas aeruginosa PA01
ggccgagcgcagcgc

SEQ ID NO: 1496111 - RNA, 17 nt, Pseudomonas aeruginosa PA01
ggccgagcgcagcgcca

SEQ ID NO: 1496112 - RNA, 18 nt, Pseudomonas aeruginosa PA01
ggccgagcgcagcgccac

SEQ ID NO: 1496113 - RNA, 19 nt, Pseudomonas aeruginosa PA01
ggccgagcgcagcgccacc

SEQ ID NO: 1496114 - RNA, 20 nt, Pseudomonas aeruginosa PA01
ggccgagcgcagcgccacca

SEQ ID NO: 1496115 - RNA, 13 nt, Pseudomonas aeruginosa PA01
ggccgagcgccgc

SEQ ID NO: 1496116 - RNA, 14 nt, Pseudomonas aeruginosa PA01
ggccgagcgccgcc

SEQ ID NO: 1496117 - RNA, 13 nt, Pseudomonas aeruginosa PA01
ggccgagcgcgag

SEQ ID NO: 1496118 - RNA, 17 nt, Pseudomonas aeruginosa PA01
ggccgagcgcgagugca

SEQ ID NO: 1496119 - RNA, 13 nt, Pseudomonas aeruginosa PA01
ggccgaggccggc

SEQ ID NO: 1496120 - RNA, 12 nt, Pseudomonas aeruginosa PA01
ggccgagggcag

SEQ ID NO: 1496121 - RNA, 23 nt, Pseudomonas aeruginosa PA01
ggccgagggcagccucagcgaca

SEQ ID NO: 1496122 - RNA, 14 nt, Pseudomonas aeruginosa PA01
ggccgagggcgagu

SEQ ID NO: 1496123 - RNA, 14 nt, Pseudomonas aeruginosa PA01
ggccgagggcgcgc

SEQ ID NO: 1496124 - RNA, 17 nt, Pseudomonas aeruginosa PA01
ggccgagggcgcgcagu

SEQ ID NO: 1496125 - RNA, 16 nt, Pseudomonas aeruginosa PA01
ggccgagggcugagac

SEQ ID NO: 1496126 - RNA, 16 nt, Pseudomonas aeruginosa PA01
ggccgagggcugccgc

SEQ ID NO: 1496127 - RNA, 19 nt, Pseudomonas aeruginosa PA01
ggccgagggcugccgcccg

SEQ ID NO: 1496128 - RNA, 20 nt, Pseudomonas aeruginosa PA01
ggccgagggcugccgcccgg

SEQ ID NO: 1496129 - RNA, 21 nt, Pseudomonas aeruginosa PA01
ggccgagggcugccgcccggu

SEQ ID NO: 1496130 - RNA, 17 nt, Pseudomonas aeruginosa PA01
ggccgaggaggccagca

SEQ ID NO: 1496131 - RNA, 20 nt, Pseudomonas aeruginosa PA01
ggccgaggaugcucgccugg

SEQ ID NO: 1496132 - RNA, 22 nt, Pseudomonas aeruginosa PA01
ggccgaggaugcucgccuggua

SEQ ID NO: 1496133 - RNA, 14 nt, Pseudomonas aeruginosa PA01
ggccgagcugccgc

SEQ ID NO: 1496134 - RNA, 19 nt, Pseudomonas aeruginosa PA01
ggccgagcugccgcaccgc

SEQ ID NO: 1496135 - RNA, 20 nt, Pseudomonas aeruginosa PA01
ggccgagcugccgcaccgcc

SEQ ID NO: 1496136 - RNA, 13 nt, Pseudomonas aeruginosa PA01
ggccgagcugcuc

SEQ ID NO: 1496137 - RNA, 15 nt, Pseudomonas aeruginosa PA01
ggccgagcugcucga

SEQ ID NO: 1496138 - RNA, 13 nt, Pseudomonas aeruginosa PA01
ggccgaggaacuc

SEQ ID NO: 1496139 - RNA, 18 nt, Pseudomonas aeruginosa PA01
ggccgaggaaggcgcugg

SEQ ID NO: 1496140 - RNA, 13 nt, Pseudomonas aeruginosa PA01
ggccgagcgcgcc

SEQ ID NO: 1496141 - RNA, 21 nt, Pseudomonas aeruginosa PA01
ggccgagcgugcgcaugcccg

SEQ ID NO: 1496142 - RNA, 15 nt, Pseudomonas aeruginosa PA01
ggccgaguucgcgca

SEQ ID NO: 1496143 - RNA, 20 nt, Pseudomonas aeruginosa PA01
ggccgaguucgcgcaggcgc

SEQ ID NO: 1496144 - RNA, 21 nt, Pseudomonas aeruginosa PA01
ggccgaguucgcgcaggcgcu

SEQ ID NO: 1496145 - RNA, 16 nt, Pseudomonas aeruginosa PA01
ggccgaucagcgccuc

SEQ ID NO: 1496146 - RNA, 21 nt, Pseudomonas aeruginosa PA01
ggccgaucagcgccucggcgc

SEQ ID NO: 1496147 - RNA, 22 nt, Pseudomonas aeruginosa PA01
ggccgaucagcgccucggcgca

SEQ ID NO: 1496148 - RNA, 14 nt, Pseudomonas aeruginosa PA01
ggccgaucagcuug

SEQ ID NO: 1496149 - RNA, 18 nt, Pseudomonas aeruginosa PA01
ggccgaucaucaucaggu

SEQ ID NO: 1496150 - RNA, 15 nt, Pseudomonas aeruginosa PA01
ggccgaucaucggcu

SEQ ID NO: 1496151 - RNA, 17 nt, Pseudomonas aeruginosa PA01
ggccgaucaucggcugg

SEQ ID NO: 1496152 - RNA, 20 nt, Pseudomonas aeruginosa PA01
ggccgaucaucggcuggucg

SEQ ID NO: 1496153 - RNA, 21 nt, Pseudomonas aeruginosa PA01
ggccgagguggagaucagcgg

SEQ ID NO: 1496154 - RNA, 14 nt, Pseudomonas aeruginosa PA01
ggccgaguccgcgc

SEQ ID NO: 1496155 - RNA, 18 nt, Pseudomonas aeruginosa PA01
ggccgaguccgcgcgcgc

SEQ ID NO: 1496156 - RNA, 18 nt, Pseudomonas aeruginosa PA01
ggccgagggugaucagcc

SEQ ID NO: 1496157 - RNA, 17 nt, Pseudomonas aeruginosa PA01
ggccgagguccaucuug

SEQ ID NO: 1496158 - RNA, 17 nt, Pseudomonas aeruginosa PA01
ggccgaggucgaccagc

SEQ ID NO: 1496159 - RNA, 21 nt, Pseudomonas aeruginosa PA01
ggccgaggcgcuucugcucgg

SEQ ID NO: 1496160 - RNA, 15 nt, Pseudomonas aeruginosa PA01
ggccgaucaccacca

SEQ ID NO: 1496161 - RNA, 17 nt, Pseudomonas aeruginosa PA01
ggccgaucaccaccagc

SEQ ID NO: 1496162 - RNA, 19 nt, Pseudomonas aeruginosa PA01
ggccgaucaccaccagcgc

SEQ ID NO: 1496163 - RNA, 20 nt, Pseudomonas aeruginosa PA01
ggccgaucaccaccagcgcc

SEQ ID NO: 1496164 - RNA, 16 nt, Pseudomonas aeruginosa PA01
ggccgaucaccaccug

SEQ ID NO: 1496165 - RNA, 16 nt, Pseudomonas aeruginosa PA01
ggccgaucaccagcgc

SEQ ID NO: 1496166 - RNA, 17 nt, Pseudomonas aeruginosa PA01
ggccgaucaccagcgcc

SEQ ID NO: 1496167 - RNA, 21 nt, Pseudomonas aeruginosa PA01
ggccgaucaccagcgccaggc

SEQ ID NO: 1496168 - RNA, 16 nt, Pseudomonas aeruginosa PA01
ggccgaucaccuggcc

SEQ ID NO: 1496169 - RNA, 21 nt, Pseudomonas aeruginosa PA01
ggccgaucaccuucaccggca

SEQ ID NO: 1496170 - RNA, 16 nt, Pseudomonas aeruginosa PA01
ggccgaucuucagcag

SEQ ID NO: 1496171 - RNA, 23 nt, Pseudomonas aeruginosa PA01
ggccgaucuucagcagcaggcgc

SEQ ID NO: 1496172 - RNA, 16 nt, Pseudomonas aeruginosa PA01
ggccgaucuucgccga

SEQ ID NO: 1496173 - RNA, 16 nt, Pseudomonas aeruginosa PA01
ggccgaugaacgccgc

SEQ ID NO: 1496174 - RNA, 19 nt, Pseudomonas aeruginosa PA01
ggccgaugccgaccuugcc

SEQ ID NO: 1496175 - RNA, 21 nt, Pseudomonas aeruginosa PA01
ggccgaugccgggcaacgcgc

SEQ ID NO: 1496176 - RNA, 21 nt, Pseudomonas aeruginosa PA01
ggccgaugcgcaacgggcggc

SEQ ID NO: 1496177 - RNA, 19 nt, Pseudomonas aeruginosa PA01
ggccgaucucguggacccg

SEQ ID NO: 1496178 - RNA, 20 nt, Pseudomonas aeruginosa PA01
ggccgaucucgugggccagc

SEQ ID NO: 1496179 - RNA, 22 nt, Pseudomonas aeruginosa PA01
ggccgaucucgugggccagcag

SEQ ID NO: 1496180 - RNA, 16 nt, Pseudomonas aeruginosa PA01
ggccgaucgagcggcc

SEQ ID NO: 1496181 - RNA, 14 nt, Pseudomonas aeruginosa PA01
ggccgaucgccucg

SEQ ID NO: 1496182 - RNA, 23 nt, Pseudomonas aeruginosa PA01
ggccgaucgccucguucagcagc

SEQ ID NO: 1496183 - RNA, 15 nt, Pseudomonas aeruginosa PA01
ggccgaugcgcgacu

SEQ ID NO: 1496184 - RNA, 18 nt, Pseudomonas aeruginosa PA01
ggccgaugcuaucgcgug

SEQ ID NO: 1496185 - RNA, 19 nt, Pseudomonas aeruginosa PA01
ggccgaugcuaucgcgugg

SEQ ID NO: 1496186 - RNA, 20 nt, Pseudomonas aeruginosa PA01
ggccgauggaaaucggccac

SEQ ID NO: 1496187 - RNA, 14 nt, Pseudomonas aeruginosa PA01
ggccgauggccccg

SEQ ID NO: 1496188 - RNA, 22 nt, Pseudomonas aeruginosa PA01
ggccgaugugaaaacggcgcau

SEQ ID NO: 1496189 - RNA, 15 nt, Pseudomonas aeruginosa PA01
ggccacgccgccguc

SEQ ID NO: 1496190 - RNA, 17 nt, Pseudomonas aeruginosa PA01
ggccacgaacaggcugu

SEQ ID NO: 1496191 - RNA, 21 nt, Pseudomonas aeruginosa PA01
ggccacgaacugcauggccuu

SEQ ID NO: 1496192 - RNA, 15 nt, Pseudomonas aeruginosa PA01
ggccacgcgaccagc

SEQ ID NO: 1496193 - RNA, 18 nt, Pseudomonas aeruginosa PA01
ggccacgcgaccagcgcc

SEQ ID NO: 1496194 - RNA, 22 nt, Pseudomonas aeruginosa PA01
ggccacgcgaccagcgccaggc

SEQ ID NO: 1496195 - RNA, 14 nt, Pseudomonas aeruginosa PA01
ggccacggccgcug

SEQ ID NO: 1496196 - RNA, 14 nt, Pseudomonas aeruginosa PA01
ggccacggccggcg

SEQ ID NO: 1496197 - RNA, 15 nt, Pseudomonas aeruginosa PA01
ggccacggccggcga

SEQ ID NO: 1496198 - RNA, 20 nt, Pseudomonas aeruginosa PA01
ggccacgcucucgaacagca

SEQ ID NO: 1496199 - RNA, 13 nt, Pseudomonas aeruginosa PA01
ggccacccuugcg

SEQ ID NO: 1496200 - RNA, 20 nt, Pseudomonas aeruginosa PA01
ggccacccuuggagccgccc

SEQ ID NO: 1496201 - RNA, 21 nt, Pseudomonas aeruginosa PA01
ggccacccuuggagccgcccu

SEQ ID NO: 1496202 - RNA, 13 nt, Pseudomonas aeruginosa PA01
ggccacccuugug

SEQ ID NO: 1496203 - RNA, 19 nt, Pseudomonas aeruginosa PA01
ggccacccuuguggccgau

SEQ ID NO: 1496204 - RNA, 16 nt, Pseudomonas aeruginosa PA01
ggccaccgggaucagc

SEQ ID NO: 1496205 - RNA, 19 nt, Pseudomonas aeruginosa PA01
ggccaccgucggauggccg

SEQ ID NO: 1496206 - RNA, 14 nt, Pseudomonas aeruginosa PA01
ggccaccuucgccc

SEQ ID NO: 1496207 - RNA, 17 nt, Pseudomonas aeruginosa PA01
ggccaccugcggguggc

SEQ ID NO: 1496208 - RNA, 20 nt, Pseudomonas aeruginosa PA01
ggccaccugcuccggcguac

SEQ ID NO: 1496209 - RNA, 14 nt, Pseudomonas aeruginosa PA01
ggccaccuggcucu

SEQ ID NO: 1496210 - RNA, 14 nt, Pseudomonas aeruginosa PA01
ggccaacugggccu

SEQ ID NO: 1496211 - RNA, 12 nt, Pseudomonas aeruginosa PA01
ggccaacugagc

SEQ ID NO: 1496212 - RNA, 22 nt, Pseudomonas aeruginosa PA01
ggccaacgguagcggaucagcc

SEQ ID NO: 1496213 - RNA, 14 nt, Pseudomonas aeruginosa PA01
ggccaaccaccggc

SEQ ID NO: 1496214 - RNA, 17 nt, Pseudomonas aeruginosa PA01
ggccaaccaccggcgca

SEQ ID NO: 1496215 - RNA, 13 nt, Pseudomonas aeruginosa PA01
ggccaacggccgc

SEQ ID NO: 1496216 - RNA, 16 nt, Pseudomonas aeruginosa PA01
ggccaacggccgcuug

SEQ ID NO: 1496217 - RNA, 20 nt, Pseudomonas aeruginosa PA01
ggccaccaucacgucgcgca

SEQ ID NO: 1496218 - RNA, 16 nt, Pseudomonas aeruginosa PA01
ggccaaugcccggacc

SEQ ID NO: 1496219 - RNA, 15 nt, Pseudomonas aeruginosa PA01
ggccaagucggccgc

SEQ ID NO: 1496220 - RNA, 16 nt, Pseudomonas aeruginosa PA01
ggccaagucggccgcc

SEQ ID NO: 1496221 - RNA, 22 nt, Pseudomonas aeruginosa PA01
ggccaagucggccgcccagcgg

SEQ ID NO: 1496222 - RNA, 13 nt, Pseudomonas aeruginosa PA01
ggccagccggcgc

SEQ ID NO: 1496223 - RNA, 14 nt, Pseudomonas aeruginosa PA01
ggccagccgcuagc

SEQ ID NO: 1496224 - RNA, 15 nt, Pseudomonas aeruginosa PA01
ggccagccgcgcggc

SEQ ID NO: 1496225 - RNA, 16 nt, Pseudomonas aeruginosa PA01
ggccagccgcgcggca

SEQ ID NO: 1496226 - RNA, 22 nt, Pseudomonas aeruginosa PA01
ggccagccgcgcggcauagcgc

SEQ ID NO: 1496227 - RNA, 19 nt, Pseudomonas aeruginosa PA01
ggccagcgccgccgcugcg

SEQ ID NO: 1496228 - RNA, 22 nt, Pseudomonas aeruginosa PA01
ggccagcgccgccgcugcgucg

SEQ ID NO: 1496229 - RNA, 21 nt, Pseudomonas aeruginosa PA01
ggccagcgccguacgcaccgc

SEQ ID NO: 1496230 - RNA, 15 nt, Pseudomonas aeruginosa PA01
ggccagcgccuggcg

SEQ ID NO: 1496231 - RNA, 18 nt, Pseudomonas aeruginosa PA01
ggccagcgccuggcgcaa

SEQ ID NO: 1496232 - RNA, 22 nt, Pseudomonas aeruginosa PA01
ggccagcuccagcaccggcggc

SEQ ID NO: 1496233 - RNA, 22 nt, Pseudomonas aeruginosa PA01
ggccaggaccagggcgggccgc

SEQ ID NO: 1496234 - RNA, 14 nt, Pseudomonas aeruginosa PA01
ggccaggaccaucg

SEQ ID NO: 1496235 - RNA, 19 nt, Pseudomonas aeruginosa PA01
ggccaggaccaucggcacc

SEQ ID NO: 1496236 - RNA, 15 nt, Pseudomonas aeruginosa PA01
ggccaggacgccacc

SEQ ID NO: 1496237 - RNA, 22 nt, Pseudomonas aeruginosa PA01
ggccaggacgccaccaggccgc

SEQ ID NO: 1496238 - RNA, 16 nt, Pseudomonas aeruginosa PA01
ggccaggacgcuggcg

SEQ ID NO: 1496239 - RNA, 17 nt, Pseudomonas aeruginosa PA01
ggccaggacgcuggcga

SEQ ID NO: 1496240 - RNA, 18 nt, Pseudomonas aeruginosa PA01
ggccaggagcaucggcgc

SEQ ID NO: 1496241 - RNA, 19 nt, Pseudomonas aeruginosa PA01
ggccaggagcaucggcgcg

SEQ ID NO: 1496242 - RNA, 17 nt, Pseudomonas aeruginosa PA01
ggccagcuccgccugac

SEQ ID NO: 1496243 - RNA, 15 nt, Pseudomonas aeruginosa PA01
ggccaggaagcgggc

SEQ ID NO: 1496244 - RNA, 13 nt, Pseudomonas aeruginosa PA01
ggccagcgcggcc

SEQ ID NO: 1496245 - RNA, 17 nt, Pseudomonas aeruginosa PA01
ggccagcgggcugucgu

SEQ ID NO: 1496246 - RNA, 18 nt, Pseudomonas aeruginosa PA01
ggccagcguccuucggcg

SEQ ID NO: 1496247 - RNA, 13 nt, Pseudomonas aeruginosa PA01
ggccagcgucgcc

SEQ ID NO: 1496248 - RNA, 22 nt, Pseudomonas aeruginosa PA01
ggccagcgucgccugccaggcg

SEQ ID NO: 1496249 - RNA, 21 nt, Pseudomonas aeruginosa PA01
ggccagcaauacccgccgcug

SEQ ID NO: 1496250 - RNA, 16 nt, Pseudomonas aeruginosa PA01
ggccagcaaugcccgc

SEQ ID NO: 1496251 - RNA, 14 nt, Pseudomonas aeruginosa PA01
ggccagcagcgccu

SEQ ID NO: 1496252 - RNA, 18 nt, Pseudomonas aeruginosa PA01
ggccagaauuccagcagg

SEQ ID NO: 1496253 - RNA, 19 nt, Pseudomonas aeruginosa PA01
ggccagaauuccagcaggu

SEQ ID NO: 1496254 - RNA, 18 nt, Pseudomonas aeruginosa PA01
ggccagagcacgaaagcg

SEQ ID NO: 1496255 - RNA, 16 nt, Pseudomonas aeruginosa PA01
ggccagcagggccgcc

SEQ ID NO: 1496256 - RNA, 17 nt, Pseudomonas aeruginosa PA01
ggccagcagggccgccg

SEQ ID NO: 1496257 - RNA, 14 nt, Pseudomonas aeruginosa PA01
ggccagcagggugg

SEQ ID NO: 1496258 - RNA, 19 nt, Pseudomonas aeruginosa PA01
ggccagcaggguggccagg

SEQ ID NO: 1496259 - RNA, 13 nt, Pseudomonas aeruginosa PA01
ggccagcaggcug

SEQ ID NO: 1496260 - RNA, 14 nt, Pseudomonas aeruginosa PA01
ggccagcaggcugg

SEQ ID NO: 1496261 - RNA, 16 nt, Pseudomonas aeruginosa PA01
ggccagcaggcuggcg

SEQ ID NO: 1496262 - RNA, 18 nt, Pseudomonas aeruginosa PA01
ggccagcaggcuggcggc

SEQ ID NO: 1496263 - RNA, 20 nt, Pseudomonas aeruginosa PA01
ggccagcagcuccgggcugg

SEQ ID NO: 1496264 - RNA, 14 nt, Pseudomonas aeruginosa PA01
ggccagcagcgcug

SEQ ID NO: 1496265 - RNA, 14 nt, Pseudomonas aeruginosa PA01
ggccagcagcggcg

SEQ ID NO: 1496266 - RNA, 15 nt, Pseudomonas aeruginosa PA01
ggccagcagcggcgg

SEQ ID NO: 1496267 - RNA, 20 nt, Pseudomonas aeruginosa PA01
ggccagcagcggcggcgccg

SEQ ID NO: 1496268 - RNA, 22 nt, Pseudomonas aeruginosa PA01
ggccagcagcggcggcgccggc

SEQ ID NO: 1496269 - RNA, 13 nt, Pseudomonas aeruginosa PA01
ggccagcaggccg

SEQ ID NO: 1496270 - RNA, 19 nt, Pseudomonas aeruginosa PA01
ggccagcaggccgagcgug

SEQ ID NO: 1496271 - RNA, 15 nt, Pseudomonas aeruginosa PA01
ggccagcaggccgau

SEQ ID NO: 1496272 - RNA, 23 nt, Pseudomonas aeruginosa PA01
ggccagcaggccgaucagcggcg

SEQ ID NO: 1496273 - RNA, 23 nt, Pseudomonas aeruginosa PA01
ggccagcaggccgugggccggcg

SEQ ID NO: 1496274 - RNA, 13 nt, Pseudomonas aeruginosa PA01
ggccagcaggcgc

SEQ ID NO: 1496275 - RNA, 19 nt, Pseudomonas aeruginosa PA01
ggccagcaggcgccgcgca

SEQ ID NO: 1496276 - RNA, 20 nt, Pseudomonas aeruginosa PA01
ggccagcaggcgccgcgcau

SEQ ID NO: 1496277 - RNA, 21 nt, Pseudomonas aeruginosa PA01
ggccagcaggcgcucggcgac

SEQ ID NO: 1496278 - RNA, 17 nt, Pseudomonas aeruginosa PA01
ggccagcccccucgccc

SEQ ID NO: 1496279 - RNA, 20 nt, Pseudomonas aeruginosa PA01
ggccagcccccucgcccucg

SEQ ID NO: 1496280 - RNA, 11 nt, Pseudomonas aeruginosa PA01
ggccagcccgg

SEQ ID NO: 1496281 - RNA, 22 nt, Pseudomonas aeruginosa PA01
ggccagcccggccucgccgguc

SEQ ID NO: 1496282 - RNA, 16 nt, Pseudomonas aeruginosa PA01
ggccagccgcgccagu

SEQ ID NO: 1496283 - RNA, 17 nt, Pseudomonas aeruginosa PA01
ggccagccgcgccagug

SEQ ID NO: 1496284 - RNA, 12 nt, Pseudomonas aeruginosa PA01
ggccagccgcgc

SEQ ID NO: 1496285 - RNA, 14 nt, Pseudomonas aeruginosa PA01
ggccagccgcgcca

SEQ ID NO: 1496286 - RNA, 13 nt, Pseudomonas aeruginosa PA01
ggcagcggcgagu

SEQ ID NO: 1496287 - RNA, 12 nt, Pseudomonas aeruginosa PA01
ggcagcggcgca

SEQ ID NO: 1496288 - RNA, 16 nt, Pseudomonas aeruginosa PA01
ggcagcgcguagacca

SEQ ID NO: 1496289 - RNA, 20 nt, Pseudomonas aeruginosa PA01
ggcagcgcuacgcaggcccu

SEQ ID NO: 1496290 - RNA, 13 nt, Pseudomonas aeruginosa PA01
ggcagcucggcga

SEQ ID NO: 1496291 - RNA, 15 nt, Pseudomonas aeruginosa PA01
ggcagcucggcgaca

SEQ ID NO: 1496292 - RNA, 22 nt, Pseudomonas aeruginosa PA01
ggcagcucugcgacuggaugca

SEQ ID NO: 1496293 - RNA, 17 nt, Pseudomonas aeruginosa PA01
ggcagauguccaggcag

SEQ ID NO: 1496294 - RNA, 18 nt, Pseudomonas aeruginosa PA01
ggcagauguccaggcagg

SEQ ID NO: 1496295 - RNA, 14 nt, Pseudomonas aeruginosa PA01
ggcagcgcgcggcc

SEQ ID NO: 1496296 - RNA, 17 nt, Pseudomonas aeruginosa PA01
ggcagcgcgcggccagu

SEQ ID NO: 1496297 - RNA, 22 nt, Pseudomonas aeruginosa PA01
ggcagcgcgauaucgcaggcca

SEQ ID NO: 1496298 - RNA, 13 nt, Pseudomonas aeruginosa PA01
ggcagauccgccg

SEQ ID NO: 1496299 - RNA, 12 nt, Pseudomonas aeruginosa PA01
ggcagaucgcgc

SEQ ID NO: 1496300 - RNA, 16 nt, Pseudomonas aeruginosa PA01
ggcagaucgcgccgag

SEQ ID NO: 1496301 - RNA, 23 nt, Pseudomonas aeruginosa PA01
ggcagaguggcgcggcugaucgg

SEQ ID NO: 1496302 - RNA, 23 nt, Pseudomonas aeruginosa PA01
ggcagaguuucucggucgccgcc

SEQ ID NO: 1496303 - RNA, 23 nt, Pseudomonas aeruginosa PA01
ggcagaccugcagcaggaucagc

SEQ ID NO: 1496304 - RNA, 19 nt, Pseudomonas aeruginosa PA01
ggcagaccuggugggcggc

SEQ ID NO: 1496305 - RNA, 21 nt, Pseudomonas aeruginosa PA01
ggcagaccuggugggcggcgg

SEQ ID NO: 1496306 - RNA, 23 nt, Pseudomonas aeruginosa PA01
ggcagaccuggugggcggcggcu

SEQ ID NO: 1496307 - RNA, 16 nt, Pseudomonas aeruginosa PA01
ggcagacuucgccgug

SEQ ID NO: 1496308 - RNA, 14 nt, Pseudomonas aeruginosa PA01
ggcaggccugggca

SEQ ID NO: 1496309 - RNA, 18 nt, Pseudomonas aeruginosa PA01
ggcaggcgcaucaggcca

SEQ ID NO: 1496310 - RNA, 14 nt, Pseudomonas aeruginosa PA01
ggcaggcgcccggu

SEQ ID NO: 1496311 - RNA, 22 nt, Pseudomonas aeruginosa PA01
ggcaggcgcccggucagguugg

SEQ ID NO: 1496312 - RNA, 14 nt, Pseudomonas aeruginosa PA01
ggcaggcggcggcg

SEQ ID NO: 1496313 - RNA, 17 nt, Pseudomonas aeruginosa PA01
ggcaggcggcggcguug

SEQ ID NO: 1496314 - RNA, 14 nt, Pseudomonas aeruginosa PA01
ggcaggcgcggcau

SEQ ID NO: 1496315 - RNA, 12 nt, Pseudomonas aeruginosa PA01
ggcaggcgcggg

SEQ ID NO: 1496316 - RNA, 15 nt, Pseudomonas aeruginosa PA01
ggcaggcggucagcg

SEQ ID NO: 1496317 - RNA, 21 nt, Pseudomonas aeruginosa PA01
ggcaggucguugacgaucugc

SEQ ID NO: 1496318 - RNA, 15 nt, Pseudomonas aeruginosa PA01
ggcaggcgaugaccg

SEQ ID NO: 1496319 - RNA, 18 nt, Pseudomonas aeruginosa PA01
ggcaggcgaugaccgccc

SEQ ID NO: 1496320 - RNA, 17 nt, Pseudomonas aeruginosa PA01
ggcaggccuucggcgcc

SEQ ID NO: 1496321 - RNA, 22 nt, Pseudomonas aeruginosa PA01
ggcaggccuucggcgccggagc

SEQ ID NO: 1496322 - RNA, 17 nt, Pseudomonas aeruginosa PA01
ggcaggcgcacgcgcag

SEQ ID NO: 1496323 - RNA, 15 nt, Pseudomonas aeruginosa PA01
ggcaggccgauggcc

SEQ ID NO: 1496324 - RNA, 14 nt, Pseudomonas aeruginosa PA01
ggcaggccgaggcc

SEQ ID NO: 1496325 - RNA, 15 nt, Pseudomonas aeruginosa PA01
ggcaggaucggcgcg

SEQ ID NO: 1496326 - RNA, 17 nt, Pseudomonas aeruginosa PA01
ggcaggaucggcgcggu

SEQ ID NO: 1496327 - RNA, 21 nt, Pseudomonas aeruginosa PA01
ggcaggcacgcugccagcagg

SEQ ID NO: 1496328 - RNA, 22 nt, Pseudomonas aeruginosa PA01
ggcaggccagcuuccaggcgcg

SEQ ID NO: 1496329 - RNA, 23 nt, Pseudomonas aeruginosa PA01
ggcaggcaugguggaucgacugc

SEQ ID NO: 1496330 - RNA, 18 nt, Pseudomonas aeruginosa PA01
ggcaggccacggccgcug

SEQ ID NO: 1496331 - RNA, 19 nt, Pseudomonas aeruginosa PA01
ggcaggccacggccgcugc

SEQ ID NO: 1496332 - RNA, 15 nt, Pseudomonas aeruginosa PA01
ggcaggcaggccugg

SEQ ID NO: 1496333 - RNA, 17 nt, Pseudomonas aeruginosa PA01
ggcaggaccucgggcga

SEQ ID NO: 1496334 - RNA, 15 nt, Pseudomonas aeruginosa PA01
ggcaggauaucgccc

SEQ ID NO: 1496335 - RNA, 17 nt, Pseudomonas aeruginosa PA01
ggcaggauaucgcccag

SEQ ID NO: 1496336 - RNA, 18 nt, Pseudomonas aeruginosa PA01
ggcaggauaucgcccagg

SEQ ID NO: 1496337 - RNA, 22 nt, Pseudomonas aeruginosa PA01
ggcaggauaucgcccagggcca

SEQ ID NO: 1496338 - RNA, 13 nt, Pseudomonas aeruginosa PA01
ggcaggaacgccc

SEQ ID NO: 1496339 - RNA, 21 nt, Pseudomonas aeruginosa PA01
ggcaggaacgcccgcggcagc

SEQ ID NO: 1496340 - RNA, 16 nt, Pseudomonas aeruginosa PA01
ggcaggaaauccgccg

SEQ ID NO: 1496341 - RNA, 17 nt, Pseudomonas aeruginosa PA01
ggcaggaaauccgccgc

SEQ ID NO: 1496342 - RNA, 23 nt, Pseudomonas aeruginosa PA01
ggcagcuuggcggucagcgacug

SEQ ID NO: 1496343 - RNA, 14 nt, Pseudomonas aeruginosa PA01
ggcagguuucgcga

SEQ ID NO: 1496344 - RNA, 15 nt, Pseudomonas aeruginosa PA01
ggcaguacguggcgc

SEQ ID NO: 1496345 - RNA, 23 nt, Pseudomonas aeruginosa PA01
ggcaguacucaugaccgccgcuc

SEQ ID NO: 1496346 - RNA, 21 nt, Pseudomonas aeruginosa PA01
ggcagguugugguugggcagg

SEQ ID NO: 1496347 - RNA, 21 nt, Pseudomonas aeruginosa PA01
ggcagguuguucgccgcagcg

SEQ ID NO: 1496348 - RNA, 18 nt, Pseudomonas aeruginosa PA01
ggcagguggucguugcgc

SEQ ID NO: 1496349 - RNA, 19 nt, Pseudomonas aeruginosa PA01
ggcagguucagcaggucgc

SEQ ID NO: 1496350 - RNA, 16 nt, Pseudomonas aeruginosa PA01
ggcagguugcacggcc

SEQ ID NO: 1496351 - RNA, 17 nt, Pseudomonas aeruginosa PA01
ggcagguugcacggccg

SEQ ID NO: 1496352 - RNA, 13 nt, Pseudomonas aeruginosa PA01
ggcagguggccgg

SEQ ID NO: 1496353 - RNA, 12 nt, Pseudomonas aeruginosa PA01
ggcagguggcgg

SEQ ID NO: 1496354 - RNA, 16 nt, Pseudomonas aeruginosa PA01
ggcagguggcgggucg

SEQ ID NO: 1496355 - RNA, 15 nt, Pseudomonas aeruginosa PA01
ggcagguggacggca

SEQ ID NO: 1496356 - RNA, 16 nt, Pseudomonas aeruginosa PA01
ggcagguggacggcau

SEQ ID NO: 1496357 - RNA, 20 nt, Pseudomonas aeruginosa PA01
ggcaucgucgaagcugaggu

SEQ ID NO: 1496358 - RNA, 16 nt, Pseudomonas aeruginosa PA01
ggcaucgucgaagggc

SEQ ID NO: 1496359 - RNA, 13 nt, Pseudomonas aeruginosa PA01
ggcauagcgcagc

SEQ ID NO: 1496360 - RNA, 20 nt, Pseudomonas aeruginosa PA01
ggcauaggaauacggcgcga

SEQ ID NO: 1496361 - RNA, 17 nt, Pseudomonas aeruginosa PA01
ggcauagaugccgcccu

SEQ ID NO: 1496362 - RNA, 23 nt, Pseudomonas aeruginosa PA01
ggcauagaugccggccucgacgc

SEQ ID NO: 1496363 - RNA, 22 nt, Pseudomonas aeruginosa PA01
ggcauagccgaacuccgccagc

SEQ ID NO: 1496364 - RNA, 19 nt, Pseudomonas aeruginosa PA01
ggcaucguggccaugggua

SEQ ID NO: 1496365 - RNA, 13 nt, Pseudomonas aeruginosa PA01
ggcaucucgaugg

SEQ ID NO: 1496366 - RNA, 12 nt, Pseudomonas aeruginosa PA01
ggcaucugccgg

SEQ ID NO: 1496367 - RNA, 20 nt, Pseudomonas aeruginosa PA01
ggcaugaacgaaaacgccgc

SEQ ID NO: 1496368 - RNA, 22 nt, Pseudomonas aeruginosa PA01
ggcaugaacgaaaacgccgcuu

SEQ ID NO: 1496369 - RNA, 21 nt, Pseudomonas aeruginosa PA01
ggcaugaagcuuuuccagcgc

SEQ ID NO: 1496370 - RNA, 18 nt, Pseudomonas aeruginosa PA01
ggcauuggugcugccgau

SEQ ID NO: 1496371 - RNA, 15 nt, Pseudomonas aeruginosa PA01
ggcauugccguccgu

SEQ ID NO: 1496372 - RNA, 15 nt, Pseudomonas aeruginosa PA01
ggcauuggcacccug

SEQ ID NO: 1496373 - RNA, 21 nt, Pseudomonas aeruginosa PA01
ggcauuggcacccuggacccg

SEQ ID NO: 1496374 - RNA, 21 nt, Pseudomonas aeruginosa PA01
ggcauugcacaacgggugcug

SEQ ID NO: 1496375 - RNA, 14 nt, Pseudomonas aeruginosa PA01
ggcauugagggcga

SEQ ID NO: 1496376 - RNA, 15 nt, Pseudomonas aeruginosa PA01
ggcauucgcagcggc

SEQ ID NO: 1496377 - RNA, 17 nt, Pseudomonas aeruginosa PA01
ggcauucgcagcggccc

SEQ ID NO: 1496378 - RNA, 12 nt, Pseudomonas aeruginosa PA01
ggcauucgccgg

SEQ ID NO: 1496379 - RNA, 15 nt, Pseudomonas aeruginosa PA01
ggcauucgccgggcu

SEQ ID NO: 1496380 - RNA, 17 nt, Pseudomonas aeruginosa PA01
ggcauucguccagccgc

SEQ ID NO: 1496381 - RNA, 16 nt, Pseudomonas aeruginosa PA01
ggcauucgucgccgcu

SEQ ID NO: 1496382 - RNA, 15 nt, Pseudomonas aeruginosa PA01
ggcaugguguccggc

SEQ ID NO: 1496383 - RNA, 16 nt, Pseudomonas aeruginosa PA01
ggcauguuggcgccuu

SEQ ID NO: 1496384 - RNA, 18 nt, Pseudomonas aeruginosa PA01
ggcauguuggcgccuucg

SEQ ID NO: 1496385 - RNA, 20 nt, Pseudomonas aeruginosa PA01
ggcauuacuugcccacgcag

SEQ ID NO: 1496386 - RNA, 14 nt, Pseudomonas aeruginosa PA01
ggcauuccgggcga

SEQ ID NO: 1496387 - RNA, 18 nt, Pseudomonas aeruginosa PA01
ggcauuccuccagggucg

SEQ ID NO: 1496388 - RNA, 17 nt, Pseudomonas aeruginosa PA01
ggcauucaucaccagcu

SEQ ID NO: 1496389 - RNA, 18 nt, Pseudomonas aeruginosa PA01
ggcauucaccagcgacga

SEQ ID NO: 1496390 - RNA, 11 nt, Pseudomonas aeruginosa PA01
ggcauggcgau

SEQ ID NO: 1496391 - RNA, 23 nt, Pseudomonas aeruginosa PA01
ggcauggcuggcgcuaccgcgca

SEQ ID NO: 1496392 - RNA, 22 nt, Pseudomonas aeruginosa PA01
ggcaugggcauccugccgccug

SEQ ID NO: 1496393 - RNA, 12 nt, Pseudomonas aeruginosa PA01
ggcaugggccag

SEQ ID NO: 1496394 - RNA, 14 nt, Pseudomonas aeruginosa PA01
ggcaugggcgcggg

SEQ ID NO: 1496395 - RNA, 18 nt, Pseudomonas aeruginosa PA01
ggcaugguccguucggcg

SEQ ID NO: 1496396 - RNA, 15 nt, Pseudomonas aeruginosa PA01
ggcaugggucagcgc

SEQ ID NO: 1496397 - RNA, 17 nt, Pseudomonas aeruginosa PA01
ggcaugggucagcgcca

SEQ ID NO: 1496398 - RNA, 19 nt, Pseudomonas aeruginosa PA01
ggcaugggucagcgccagc

SEQ ID NO: 1496399 - RNA, 20 nt, Pseudomonas aeruginosa PA01
ggcaugggucagcgccagca

SEQ ID NO: 1496400 - RNA, 19 nt, Pseudomonas aeruginosa PA01
ggcaugaccgauggcgccg

SEQ ID NO: 1496401 - RNA, 21 nt, Pseudomonas aeruginosa PA01
ggcaugaggggaaucgccguc

SEQ ID NO: 1496402 - RNA, 15 nt, Pseudomonas aeruginosa PA01
ggcauggccgaccgc

SEQ ID NO: 1496403 - RNA, 14 nt, Pseudomonas aeruginosa PA01
ggcaauggccggcg

SEQ ID NO: 1496404 - RNA, 15 nt, Pseudomonas aeruginosa PA01
ggcaauggccggcgg

SEQ ID NO: 1496405 - RNA, 12 nt, Pseudomonas aeruginosa PA01
ggcacaggaccc

SEQ ID NO: 1496406 - RNA, 21 nt, Pseudomonas aeruginosa PA01
ggcacaggacccuuccagcgu

SEQ ID NO: 1496407 - RNA, 22 nt, Pseudomonas aeruginosa PA01
ggcaagacgaaagagcccggca

SEQ ID NO: 1496408 - RNA, 18 nt, Pseudomonas aeruginosa PA01
ggcaacgagcaggacugc

SEQ ID NO: 1496409 - RNA, 14 nt, Pseudomonas aeruginosa PA01
ggcaagcaggccgc

SEQ ID NO: 1496410 - RNA, 23 nt, Pseudomonas aeruginosa PA01
ggcaagccucgcguucgcggucg

SEQ ID NO: 1496411 - RNA, 22 nt, Pseudomonas aeruginosa PA01
ggcaagcgcaugaggcuggcca

SEQ ID NO: 1496412 - RNA, 14 nt, Pseudomonas aeruginosa PA01
ggcaagcgccggca

SEQ ID NO: 1496413 - RNA, 16 nt, Pseudomonas aeruginosa PA01
ggcaaucugcccggca

SEQ ID NO: 1496414 - RNA, 19 nt, Pseudomonas aeruginosa PA01
ggcaaaaaugcccuuggcu

SEQ ID NO: 1496415 - RNA, 16 nt, Pseudomonas aeruginosa PA01
ggauuguaucggcucc

SEQ ID NO: 1496416 - RNA, 20 nt, Pseudomonas aeruginosa PA01
ggauuucgccgaguggccgc

SEQ ID NO: 1496417 - RNA, 18 nt, Pseudomonas aeruginosa PA01
ggauuuccgcggccggca

SEQ ID NO: 1496418 - RNA, 22 nt, Pseudomonas aeruginosa PA01
ggcaaccgucgaacagguggcu

SEQ ID NO: 1496419 - RNA, 15 nt, Pseudomonas aeruginosa PA01
ggcaaccgggcggga

SEQ ID NO: 1496420 - RNA, 20 nt, Pseudomonas aeruginosa PA01
ggcaaccggguaccugcucg

SEQ ID NO: 1496421 - RNA, 22 nt, Pseudomonas aeruginosa PA01
ggcaaccggguaccugcucgcg

SEQ ID NO: 1496422 - RNA, 16 nt, Pseudomonas aeruginosa PA01
ggcaacgauaccgccg

SEQ ID NO: 1496423 - RNA, 23 nt, Pseudomonas aeruginosa PA01
ggcaacgauaccgccgccggccu

SEQ ID NO: 1496424 - RNA, 22 nt, Pseudomonas aeruginosa PA01
ggcaacgauucgacgcagcgcg

SEQ ID NO: 1496425 - RNA, 15 nt, Pseudomonas aeruginosa PA01
ggcaacgccaggccg

SEQ ID NO: 1496426 - RNA, 14 nt, Pseudomonas aeruginosa PA01
ggcaacgccaggcu

SEQ ID NO: 1496427 - RNA, 18 nt, Pseudomonas aeruginosa PA01
ggcaaaggcccggcgcgg

SEQ ID NO: 1496428 - RNA, 13 nt, Pseudomonas aeruginosa PA01
ggcaaaggcgcgc

SEQ ID NO: 1496429 - RNA, 16 nt, Pseudomonas aeruginosa PA01
ggcaaagcgcgggcug

SEQ ID NO: 1496430 - RNA, 22 nt, Pseudomonas aeruginosa PA01
ggcaaaguauucggugcgccgu

SEQ ID NO: 1496431 - RNA, 20 nt, Pseudomonas aeruginosa PA01
ggcacgcugcuugcgcaccu

SEQ ID NO: 1496432 - RNA, 22 nt, Pseudomonas aeruginosa PA01
ggcacgcucuggccguucucca

SEQ ID NO: 1496433 - RNA, 18 nt, Pseudomonas aeruginosa PA01
ggcacggcaucgauccgc

SEQ ID NO: 1496434 - RNA, 18 nt, Pseudomonas aeruginosa PA01
ggcacucagccagcggcg

SEQ ID NO: 1496435 - RNA, 19 nt, Pseudomonas aeruginosa PA01
ggcacucagccagcggcgc

SEQ ID NO: 1496436 - RNA, 21 nt, Pseudomonas aeruginosa PA01
ggcacucgaugaacagcgcga

SEQ ID NO: 1496437 - RNA, 22 nt, Pseudomonas aeruginosa PA01
ggcacuccguugaccugguugc

SEQ ID NO: 1496438 - RNA, 17 nt, Pseudomonas aeruginosa PA01
ggcacucggcgaccacc

SEQ ID NO: 1496439 - RNA, 22 nt, Pseudomonas aeruginosa PA01
ggcacgccgguggccaggcucu

SEQ ID NO: 1496440 - RNA, 16 nt, Pseudomonas aeruginosa PA01
ggcacgcucaggcgca

SEQ ID NO: 1496441 - RNA, 20 nt, Pseudomonas aeruginosa PA01
ggcacgcugccagcaggccg

SEQ ID NO: 1496442 - RNA, 14 nt, Pseudomonas aeruginosa PA01
ggcacgcugccgcc

SEQ ID NO: 1496443 - RNA, 15 nt, Pseudomonas aeruginosa PA01
ggcacgcugccgccg

SEQ ID NO: 1496444 - RNA, 19 nt, Pseudomonas aeruginosa PA01
ggcacgaccacaucggcca

SEQ ID NO: 1496445 - RNA, 22 nt, Pseudomonas aeruginosa PA01
ggcacgaaccauugcggcccgc

SEQ ID NO: 1496446 - RNA, 18 nt, Pseudomonas aeruginosa PA01
ggcacgaacccaggcgcu

SEQ ID NO: 1496447 - RNA, 20 nt, Pseudomonas aeruginosa PA01
ggcacgaacccaggcgcugc

SEQ ID NO: 1496448 - RNA, 17 nt, Pseudomonas aeruginosa PA01
ggcacgaaccguccgca

SEQ ID NO: 1496449 - RNA, 19 nt, Pseudomonas aeruginosa PA01
ggcacgaaccguccgcagc

SEQ ID NO: 1496450 - RNA, 21 nt, Pseudomonas aeruginosa PA01
ggcaccuugcgaaaagcccgc

SEQ ID NO: 1496451 - RNA, 22 nt, Pseudomonas aeruginosa PA01
ggcaccuugcgaaaagcccgcc

SEQ ID NO: 1496452 - RNA, 13 nt, Pseudomonas aeruginosa PA01
ggcaccucgaugg

SEQ ID NO: 1496453 - RNA, 13 nt, Pseudomonas aeruginosa PA01
ggcaccgaucgcc

SEQ ID NO: 1496454 - RNA, 20 nt, Pseudomonas aeruginosa PA01
ggcaccgaucgcccgcgccu

SEQ ID NO: 1496455 - RNA, 12 nt, Pseudomonas aeruginosa PA01
ggcaccgccgag

SEQ ID NO: 1496456 - RNA, 22 nt, Pseudomonas aeruginosa PA01
ggcaccgccgaggaacauccgc

SEQ ID NO: 1496457 - RNA, 13 nt, Pseudomonas aeruginosa PA01
ggcaccgccagcc

SEQ ID NO: 1496458 - RNA, 14 nt, Pseudomonas aeruginosa PA01
ggcaccaccagcgc

SEQ ID NO: 1496459 - RNA, 17 nt, Pseudomonas aeruginosa PA01
ggcaccaguggcgccgc

SEQ ID NO: 1496460 - RNA, 20 nt, Pseudomonas aeruginosa PA01
ggcaccaguggcgccgccau

SEQ ID NO: 1496461 - RNA, 20 nt, Pseudomonas aeruginosa PA01
ggaaaucgguugccgcgcca

SEQ ID NO: 1496462 - RNA, 23 nt, Pseudomonas aeruginosa PA01
ggaaaucggccacuccagccccg

SEQ ID NO: 1496463 - RNA, 15 nt, Pseudomonas aeruginosa PA01
ggaucgcccggcgcu

SEQ ID NO: 1496464 - RNA, 19 nt, Pseudomonas aeruginosa PA01
ggaucgcgaagaacacgcc

SEQ ID NO: 1496465 - RNA, 19 nt, Pseudomonas aeruginosa PA01
ggaucgcgcaaugccgcgu

SEQ ID NO: 1496466 - RNA, 22 nt, Pseudomonas aeruginosa PA01
ggaucgcgcaaugccgcgucga

SEQ ID NO: 1496467 - RNA, 12 nt, Pseudomonas aeruginosa PA01
ggaucgccgcga

SEQ ID NO: 1496468 - RNA, 15 nt, Pseudomonas aeruginosa PA01
ggaucgccgcgaccu

SEQ ID NO: 1496469 - RNA, 20 nt, Pseudomonas aeruginosa PA01
ggaucgccgcgaccugcucg

SEQ ID NO: 1496470 - RNA, 17 nt, Pseudomonas aeruginosa PA01
ggaacaagccgccuucg

SEQ ID NO: 1496471 - RNA, 13 nt, Pseudomonas aeruginosa PA01
ggaucgccacgcc

SEQ ID NO: 1496472 - RNA, 15 nt, Pseudomonas aeruginosa PA01
ggaucgccaggacgc

SEQ ID NO: 1496473 - RNA, 23 nt, Pseudomonas aeruginosa PA01
ggaucgccauaggaugccgaggu

SEQ ID NO: 1496474 - RNA, 19 nt, Pseudomonas aeruginosa PA01
ggaucgaguaagugccgac

SEQ ID NO: 1496475 - RNA, 23 nt, Pseudomonas aeruginosa PA01
ggaucgaucagcgagcuucgccg

SEQ ID NO: 1496476 - RNA, 19 nt, Pseudomonas aeruginosa PA01
ggaucgaucucgucggcgg

SEQ ID NO: 1496477 - RNA, 12 nt, Pseudomonas aeruginosa PA01
ggaucggcgccc

SEQ ID NO: 1496478 - RNA, 14 nt, Pseudomonas aeruginosa PA01
ggaucggcgcccag

SEQ ID NO: 1496479 - RNA, 18 nt, Pseudomonas aeruginosa PA01
ggaucggcgcccagcacc

SEQ ID NO: 1496480 - RNA, 13 nt, Pseudomonas aeruginosa PA01
ggaucggcgcggu

SEQ ID NO: 1496481 - RNA, 20 nt, Pseudomonas aeruginosa PA01
ggaucggccucgcggcgcuc

SEQ ID NO: 1496482 - RNA, 16 nt, Pseudomonas aeruginosa PA01
ggaucggcauggccac

SEQ ID NO: 1496483 - RNA, 19 nt, Pseudomonas aeruginosa PA01
ggaucggauagccgugcag

SEQ ID NO: 1496484 - RNA, 22 nt, Pseudomonas aeruginosa PA01
ggaucggccaacugagcggcgg

SEQ ID NO: 1496485 - RNA, 16 nt, Pseudomonas aeruginosa PA01
ggaucgcuaccgacag

SEQ ID NO: 1496486 - RNA, 18 nt, Pseudomonas aeruginosa PA01
ggaucgcucucgcgcuug

SEQ ID NO: 1496487 - RNA, 22 nt, Pseudomonas aeruginosa PA01
ggaucgccuccaccagcgccgg

SEQ ID NO: 1496488 - RNA, 20 nt, Pseudomonas aeruginosa PA01
ggaucgcggcguaggcgcgc

SEQ ID NO: 1496489 - RNA, 21 nt, Pseudomonas aeruginosa PA01
ggaucgcggcguaggcgcgcc

SEQ ID NO: 1496490 - RNA, 15 nt, Pseudomonas aeruginosa PA01
ggaucgcgcuggcca

SEQ ID NO: 1496491 - RNA, 16 nt, Pseudomonas aeruginosa PA01
ggaucgcgcuggccag

SEQ ID NO: 1496492 - RNA, 17 nt, Pseudomonas aeruginosa PA01
ggaucgcgcugggcgca

SEQ ID NO: 1496493 - RNA, 19 nt, Pseudomonas aeruginosa PA01
ggaucgcgcugggcgcagc

SEQ ID NO: 1496494 - RNA, 12 nt, Pseudomonas aeruginosa PA01
ggaucgcggccu

SEQ ID NO: 1496495 - RNA, 20 nt, Pseudomonas aeruginosa PA01
ggaucgcggccuucucgucg

SEQ ID NO: 1496496 - RNA, 21 nt, Pseudomonas aeruginosa PA01
ggaucgcggccuucucgucgc

SEQ ID NO: 1496497 - RNA, 12 nt, Pseudomonas aeruginosa PA01
ggaucgcgccgu

SEQ ID NO: 1496498 - RNA, 17 nt, Pseudomonas aeruginosa PA01
ggaucgcgccgucgcug

SEQ ID NO: 1496499 - RNA, 22 nt, Pseudomonas aeruginosa PA01
ggaucgcgccgucgcuggcgau

SEQ ID NO: 1496500 - RNA, 15 nt, Pseudomonas aeruginosa PA01
ggaucgcgcggcugg

SEQ ID NO: 1496501 - RNA, 16 nt, Pseudomonas aeruginosa PA01
ggaugaccacgucgcg

SEQ ID NO: 1496502 - RNA, 17 nt, Pseudomonas aeruginosa PA01
ggaucuucuaccuggcg

SEQ ID NO: 1496503 - RNA, 19 nt, Pseudomonas aeruginosa PA01
ggaucuucuaccuggcgcu

SEQ ID NO: 1496504 - RNA, 21 nt, Pseudomonas aeruginosa PA01
ggaucuucuaccuggcgcuga

SEQ ID NO: 1496505 - RNA, 20 nt, Pseudomonas aeruginosa PA01
ggaugaacgacuccagcuuc

SEQ ID NO: 1496506 - RNA, 17 nt, Pseudomonas aeruginosa PA01
ggaugaacugcagcuug

SEQ ID NO: 1496507 - RNA, 19 nt, Pseudomonas aeruginosa PA01
ggaugaaguacuggucgcg

SEQ ID NO: 1496508 - RNA, 20 nt, Pseudomonas aeruginosa PA01
ggaugagccgcugguccagc

SEQ ID NO: 1496509 - RNA, 15 nt, Pseudomonas aeruginosa PA01
ggaugacccgcaccu

SEQ ID NO: 1496510 - RNA, 18 nt, Pseudomonas aeruginosa PA01
ggaugacccgcucgccgg

SEQ ID NO: 1496511 - RNA, 13 nt, Pseudomonas aeruginosa PA01
ggaugcaaccgcc

SEQ ID NO: 1496512 - RNA, 21 nt, Pseudomonas aeruginosa PA01
ggaugaucagggcaccgccga

SEQ ID NO: 1496513 - RNA, 20 nt, Pseudomonas aeruginosa PA01
ggaugaucggcuccagcuug

SEQ ID NO: 1496514 - RNA, 16 nt, Pseudomonas aeruginosa PA01
ggaucucggcggccag

SEQ ID NO: 1496515 - RNA, 22 nt, Pseudomonas aeruginosa PA01
ggaucucggcggccaggcggcu

SEQ ID NO: 1496516 - RNA, 15 nt, Pseudomonas aeruginosa PA01
ggaucuccucggcca

SEQ ID NO: 1496517 - RNA, 21 nt, Pseudomonas aeruginosa PA01
ggaucuccucggccaacggcc

SEQ ID NO: 1496518 - RNA, 17 nt, Pseudomonas aeruginosa PA01
ggaucuccuggcgcguc

SEQ ID NO: 1496519 - RNA, 15 nt, Pseudomonas aeruginosa PA01
ggaucuccugggucg

SEQ ID NO: 1496520 - RNA, 16 nt, Pseudomonas aeruginosa PA01
ggaucuccugggucga

SEQ ID NO: 1496521 - RNA, 14 nt, Pseudomonas aeruginosa PA01
ggaucugcucgacg

SEQ ID NO: 1496522 - RNA, 15 nt, Pseudomonas aeruginosa PA01
ggaucugcucgacgu

SEQ ID NO: 1496523 - RNA, 20 nt, Pseudomonas aeruginosa PA01
ggaucucccguaccagcgcg

SEQ ID NO: 1496524 - RNA, 21 nt, Pseudomonas aeruginosa PA01
ggaucucccguaccagcgcga

SEQ ID NO: 1496525 - RNA, 14 nt, Pseudomonas aeruginosa PA01
ggaucuccgcgcca

SEQ ID NO: 1496526 - RNA, 22 nt, Pseudomonas aeruginosa PA01
ggaucgucgccaagcccggcga

SEQ ID NO: 1496527 - RNA, 18 nt, Pseudomonas aeruginosa PA01
ggaucgucgcggcgcgag

SEQ ID NO: 1496528 - RNA, 22 nt, Pseudomonas aeruginosa PA01
ggaucgucgaaagccucgacga

SEQ ID NO: 1496529 - RNA, 13 nt, Pseudomonas aeruginosa PA01
ggaugcggcgcug

SEQ ID NO: 1496530 - RNA, 15 nt, Pseudomonas aeruginosa PA01
ggaugcugaucagca

SEQ ID NO: 1496531 - RNA, 22 nt, Pseudomonas aeruginosa PA01
ggaugcucgccugguaggcggc

SEQ ID NO: 1496532 - RNA, 15 nt, Pseudomonas aeruginosa PA01
ggauggcgaucgagc

SEQ ID NO: 1496533 - RNA, 17 nt, Pseudomonas aeruginosa PA01
ggauggcgcgguccgcg

SEQ ID NO: 1496534 - RNA, 21 nt, Pseudomonas aeruginosa PA01
ggaugcagucccgccaggcgc

SEQ ID NO: 1496535 - RNA, 22 nt, Pseudomonas aeruginosa PA01
ggaugcaguugagucgcgcgcg

SEQ ID NO: 1496536 - RNA, 13 nt, Pseudomonas aeruginosa PA01
ggaugcagccgau

SEQ ID NO: 1496537 - RNA, 12 nt, Pseudomonas aeruginosa PA01
ggaugcagcgcu

SEQ ID NO: 1496538 - RNA, 24 nt, Pseudomonas aeruginosa PA01
ggaugcagcgcuuguagcagccgc

SEQ ID NO: 1496539 - RNA, 19 nt, Pseudomonas aeruginosa PA01
ggaugcacgugcagcucgg

SEQ ID NO: 1496540 - RNA, 23 nt, Pseudomonas aeruginosa PA01
ggaugccgaccacguaguaggcg

SEQ ID NO: 1496541 - RNA, 17 nt, Pseudomonas aeruginosa PA01
ggaugcccgucaggccu

SEQ ID NO: 1496542 - RNA, 16 nt, Pseudomonas aeruginosa PA01
ggaugcccuggucggc

SEQ ID NO: 1496543 - RNA, 13 nt, Pseudomonas aeruginosa PA01
ggaugccggcgcu

SEQ ID NO: 1496544 - RNA, 14 nt, Pseudomonas aeruginosa PA01
ggaugccggcgcug

SEQ ID NO: 1496545 - RNA, 14 nt, Pseudomonas aeruginosa PA01
ggaugccggcggca

SEQ ID NO: 1496546 - RNA, 16 nt, Pseudomonas aeruginosa PA01
ggaugccggcggcauc

SEQ ID NO: 1496547 - RNA, 14 nt, Pseudomonas aeruginosa PA01
ggaugccgccggca

SEQ ID NO: 1496548 - RNA, 12 nt, Pseudomonas aeruginosa PA01
ggaugcgccagc

SEQ ID NO: 1496549 - RNA, 13 nt, Pseudomonas aeruginosa PA01
ggaugcgccagcg

SEQ ID NO: 1496550 - RNA, 17 nt, Pseudomonas aeruginosa PA01
ggauggcugacccgcug

SEQ ID NO: 1496551 - RNA, 22 nt, Pseudomonas aeruginosa PA01
ggauggcguuugcgucauccgc

SEQ ID NO: 1496552 - RNA, 16 nt, Pseudomonas aeruginosa PA01
ggauggucgagggcgc

SEQ ID NO: 1496553 - RNA, 15 nt, Pseudomonas aeruginosa PA01
ggauggucaggccgg

SEQ ID NO: 1496554 - RNA, 15 nt, Pseudomonas aeruginosa PA01
ggauguccgccgccc

SEQ ID NO: 1496555 - RNA, 17 nt, Pseudomonas aeruginosa PA01
ggauguaguccagcgcc

SEQ ID NO: 1496556 - RNA, 17 nt, Pseudomonas aeruginosa PA01
ggaugucgcuggccagc

SEQ ID NO: 1496557 - RNA, 20 nt, Pseudomonas aeruginosa PA01
ggaugucgcuggccagcuug

SEQ ID NO: 1496558 - RNA, 12 nt, Pseudomonas aeruginosa PA01
ggaugucggcga

SEQ ID NO: 1496559 - RNA, 15 nt, Pseudomonas aeruginosa PA01
ggaugucggcgaacu

SEQ ID NO: 1496560 - RNA, 15 nt, Pseudomonas aeruginosa PA01
ggaugugcucagcga

SEQ ID NO: 1496561 - RNA, 18 nt, Pseudomonas aeruginosa PA01
ggauguucgaaggccagu

SEQ ID NO: 1496562 - RNA, 15 nt, Pseudomonas aeruginosa PA01
ggauguucuucaccu

SEQ ID NO: 1496563 - RNA, 20 nt, Pseudomonas aeruginosa PA01
ggauucgccagccucggcga

SEQ ID NO: 1496564 - RNA, 15 nt, Pseudomonas aeruginosa PA01
ggauuccuacgaagg

SEQ ID NO: 1496565 - RNA, 18 nt, Pseudomonas aeruginosa PA01
ggauugacgauggccagc

SEQ ID NO: 1496566 - RNA, 20 nt, Pseudomonas aeruginosa PA01
ggauugacgauggccagccc

SEQ ID NO: 1496567 - RNA, 17 nt, Pseudomonas aeruginosa PA01
ggcgcauccgcccgauc

SEQ ID NO: 1496568 - RNA, 14 nt, Pseudomonas aeruginosa PA01
ggcgcaucggcgga

SEQ ID NO: 1496569 - RNA, 13 nt, Pseudomonas aeruginosa PA01
ggcgcaucgucga

SEQ ID NO: 1496570 - RNA, 23 nt, Pseudomonas aeruginosa PA01
ggcgcaucgucgaaacgcuggcg

SEQ ID NO: 1496571 - RNA, 16 nt, Pseudomonas aeruginosa PA01
ggcgcaugaggccugg

SEQ ID NO: 1496572 - RNA, 17 nt, Pseudomonas aeruginosa PA01
ggcgcaugaggccuggu

SEQ ID NO: 1496573 - RNA, 19 nt, Pseudomonas aeruginosa PA01
ggcgcaugcccagggccag

SEQ ID NO: 1496574 - RNA, 21 nt, Pseudomonas aeruginosa PA01
ggcgcaugcccagggccagca

SEQ ID NO: 1496575 - RNA, 15 nt, Pseudomonas aeruginosa PA01
ggcgcaugcgccggc

SEQ ID NO: 1496576 - RNA, 14 nt, Pseudomonas aeruginosa PA01
ggcgcauggcgcuc

SEQ ID NO: 1496577 - RNA, 14 nt, Pseudomonas aeruginosa PA01
ggcgcaucagcgcc

SEQ ID NO: 1496578 - RNA, 15 nt, Pseudomonas aeruginosa PA01
ggcgcaucagcgccg

SEQ ID NO: 1496579 - RNA, 15 nt, Pseudomonas aeruginosa PA01
ggcgcaucaggccaa

SEQ ID NO: 1496580 - RNA, 12 nt, Pseudomonas aeruginosa PA01
ggcgcagcgccc

SEQ ID NO: 1496581 - RNA, 22 nt, Pseudomonas aeruginosa PA01
ggcgcagcgcccgauaggcgcc

SEQ ID NO: 1496582 - RNA, 12 nt, Pseudomonas aeruginosa PA01
ggcgcagcggca

SEQ ID NO: 1496583 - RNA, 14 nt, Pseudomonas aeruginosa PA01
ggcgcagcggcagc

SEQ ID NO: 1496584 - RNA, 13 nt, Pseudomonas aeruginosa PA01
ggcgcccagcacc

SEQ ID NO: 1496585 - RNA, 18 nt, Pseudomonas aeruginosa PA01
ggcgcccagcaccacagc

SEQ ID NO: 1496586 - RNA, 23 nt, Pseudomonas aeruginosa PA01
ggcgcccaacgucuucaggcgcu

SEQ ID NO: 1496587 - RNA, 18 nt, Pseudomonas aeruginosa PA01
ggcgcccaaugcaucggc

SEQ ID NO: 1496588 - RNA, 21 nt, Pseudomonas aeruginosa PA01
ggcgcccaaugcaucggccgg

SEQ ID NO: 1496589 - RNA, 19 nt, Pseudomonas aeruginosa PA01
ggcgccauaggccagcacc

SEQ ID NO: 1496590 - RNA, 20 nt, Pseudomonas aeruginosa PA01
ggcgccauaggccagcaccu

SEQ ID NO: 1496591 - RNA, 21 nt, Pseudomonas aeruginosa PA01
ggcgccagucauugcgcuccg

SEQ ID NO: 1496592 - RNA, 21 nt, Pseudomonas aeruginosa PA01
ggcgccaguaauggggaucgc

SEQ ID NO: 1496593 - RNA, 22 nt, Pseudomonas aeruginosa PA01
ggcgccaggcguuccagcucgg

SEQ ID NO: 1496594 - RNA, 18 nt, Pseudomonas aeruginosa PA01
ggcgccaggcugaccgcg

SEQ ID NO: 1496595 - RNA, 19 nt, Pseudomonas aeruginosa PA01
ggcgccaggcugaccgcgu

SEQ ID NO: 1496596 - RNA, 15 nt, Pseudomonas aeruginosa PA01
ggcgccagggacgcg

SEQ ID NO: 1496597 - RNA, 15 nt, Pseudomonas aeruginosa PA01
ggcgccagggccggg

SEQ ID NO: 1496598 - RNA, 17 nt, Pseudomonas aeruginosa PA01
ggcgccagguagugccg

SEQ ID NO: 1496599 - RNA, 15 nt, Pseudomonas aeruginosa PA01
ggcgcauguccagcc

SEQ ID NO: 1496600 - RNA, 18 nt, Pseudomonas aeruginosa PA01
ggcgccaggccggcgagg

SEQ ID NO: 1496601 - RNA, 12 nt, Pseudomonas aeruginosa PA01
ggcgccaggccu

SEQ ID NO: 1496602 - RNA, 12 nt, Pseudomonas aeruginosa PA01
ggcgccaggcgu

SEQ ID NO: 1496603 - RNA, 16 nt, Pseudomonas aeruginosa PA01
ggcgccaggccggcga

SEQ ID NO: 1496604 - RNA, 16 nt, Pseudomonas aeruginosa PA01
ggcgccaaccgggcag

SEQ ID NO: 1496605 - RNA, 22 nt, Pseudomonas aeruginosa PA01
ggcgccaaccgggcagcagccg

SEQ ID NO: 1496606 - RNA, 18 nt, Pseudomonas aeruginosa PA01
ggcgcagaucgcggcgca

SEQ ID NO: 1496607 - RNA, 20 nt, Pseudomonas aeruginosa PA01
ggcgcagaucgcggcgcagg

SEQ ID NO: 1496608 - RNA, 16 nt, Pseudomonas aeruginosa PA01
ggcgcagacaggccuc

SEQ ID NO: 1496609 - RNA, 22 nt, Pseudomonas aeruginosa PA01
ggcgcagacgucuuccgggacc

SEQ ID NO: 1496610 - RNA, 18 nt, Pseudomonas aeruginosa PA01
ggcgcagcaacuguccga

SEQ ID NO: 1496611 - RNA, 17 nt, Pseudomonas aeruginosa PA01
ggcgcacugagggucag

SEQ ID NO: 1496612 - RNA, 12 nt, Pseudomonas aeruginosa PA01
ggcgcacgcgca

SEQ ID NO: 1496613 - RNA, 17 nt, Pseudomonas aeruginosa PA01
ggcgcacggccugcacc

SEQ ID NO: 1496614 - RNA, 13 nt, Pseudomonas aeruginosa PA01
ggcgcacgccggc

SEQ ID NO: 1496615 - RNA, 18 nt, Pseudomonas aeruginosa PA01
ggcgcacgccggccucgc

SEQ ID NO: 1496616 - RNA, 15 nt, Pseudomonas aeruginosa PA01
ggcgcagcagcgacu

SEQ ID NO: 1496617 - RNA, 21 nt, Pseudomonas aeruginosa PA01
ggcgcagcagcgacucgcugg

SEQ ID NO: 1496618 - RNA, 23 nt, Pseudomonas aeruginosa PA01
ggcgcagcaucaucuccgcggag

SEQ ID NO: 1496619 - RNA, 19 nt, Pseudomonas aeruginosa PA01
ggcgcagccgcaaggccag

SEQ ID NO: 1496620 - RNA, 12 nt, Pseudomonas aeruginosa PA01
ggcgcagccaga

SEQ ID NO: 1496621 - RNA, 15 nt, Pseudomonas aeruginosa PA01
ggcgcagccagagcu

SEQ ID NO: 1496622 - RNA, 20 nt, Pseudomonas aeruginosa PA01
ggcgcagccagagcuccagg

SEQ ID NO: 1496623 - RNA, 12 nt, Pseudomonas aeruginosa PA01
ggcgcagccagg

SEQ ID NO: 1496624 - RNA, 18 nt, Pseudomonas aeruginosa PA01
ggcgcagccaggcgaugg

SEQ ID NO: 1496625 - RNA, 13 nt, Pseudomonas aeruginosa PA01
ggcgcagccgcug

SEQ ID NO: 1496626 - RNA, 13 nt, Pseudomonas aeruginosa PA01
ggcgcaccuggcg

SEQ ID NO: 1496627 - RNA, 15 nt, Pseudomonas aeruginosa PA01
ggcgcaccuggcggu

SEQ ID NO: 1496628 - RNA, 23 nt, Pseudomonas aeruginosa PA01
ggcgcacgccgcggaaggcccgc

SEQ ID NO: 1496629 - RNA, 15 nt, Pseudomonas aeruginosa PA01
ggcgcaacaccuugc

SEQ ID NO: 1496630 - RNA, 18 nt, Pseudomonas aeruginosa PA01
ggcgcaacaccuugcgca

SEQ ID NO: 1496631 - RNA, 13 nt, Pseudomonas aeruginosa PA01
ggcgcaccagcag

SEQ ID NO: 1496632 - RNA, 16 nt, Pseudomonas aeruginosa PA01
ggcgcaccagcaggcg

SEQ ID NO: 1496633 - RNA, 13 nt, Pseudomonas aeruginosa PA01
ggcgcaccaggcc

SEQ ID NO: 1496634 - RNA, 15 nt, Pseudomonas aeruginosa PA01
ggcgcaccaggccag

SEQ ID NO: 1496635 - RNA, 22 nt, Pseudomonas aeruginosa PA01
ggcgcccagggcuucgcggugg

SEQ ID NO: 1496636 - RNA, 15 nt, Pseudomonas aeruginosa PA01
ggcgccccaggcgcc

SEQ ID NO: 1496637 - RNA, 17 nt, Pseudomonas aeruginosa PA01
ggcgccccaggcgggca

SEQ ID NO: 1496638 - RNA, 17 nt, Pseudomonas aeruginosa PA01
ggcgcccaugccgcccg

SEQ ID NO: 1496639 - RNA, 15 nt, Pseudomonas aeruginosa PA01
ggcgcccgagggcgc

SEQ ID NO: 1496640 - RNA, 17 nt, Pseudomonas aeruginosa PA01
ggcgcccgagggcgccg

SEQ ID NO: 1496641 - RNA, 20 nt, Pseudomonas aeruginosa PA01
ggcgccgaccacgaccgcgu

SEQ ID NO: 1496642 - RNA, 21 nt, Pseudomonas aeruginosa PA01
ggcgccgaccacgaccgcguc

SEQ ID NO: 1496643 - RNA, 20 nt, Pseudomonas aeruginosa PA01
ggcgccgaccgcaccgccag

SEQ ID NO: 1496644 - RNA, 21 nt, Pseudomonas aeruginosa PA01
ggcgccgaccgcaccgccagc

SEQ ID NO: 1496645 - RNA, 17 nt, Pseudomonas aeruginosa PA01
ggcgccgagcagcggcg

SEQ ID NO: 1496646 - RNA, 15 nt, Pseudomonas aeruginosa PA01
ggcgccgaccguggc

SEQ ID NO: 1496647 - RNA, 14 nt, Pseudomonas aeruginosa PA01
ggcgccgaccucca

SEQ ID NO: 1496648 - RNA, 13 nt, Pseudomonas aeruginosa PA01
ggcgccgagguag

SEQ ID NO: 1496649 - RNA, 14 nt, Pseudomonas aeruginosa PA01
ggcgccgaugccgc

SEQ ID NO: 1496650 - RNA, 21 nt, Pseudomonas aeruginosa PA01
ggcgccgaugccggccggcag

SEQ ID NO: 1496651 - RNA, 12 nt, Pseudomonas aeruginosa PA01
ggcgccgccguc

SEQ ID NO: 1496652 - RNA, 20 nt, Pseudomonas aeruginosa PA01
ggcgccgccggugcaccagg

SEQ ID NO: 1496653 - RNA, 13 nt, Pseudomonas aeruginosa PA01
ggcgccgccggug

SEQ ID NO: 1496654 - RNA, 16 nt, Pseudomonas aeruginosa PA01
ggcgccgaucaggcgu

SEQ ID NO: 1496655 - RNA, 22 nt, Pseudomonas aeruginosa PA01
ggcgccgauggcugucggcgcc

SEQ ID NO: 1496656 - RNA, 22 nt, Pseudomonas aeruginosa PA01
ggcgccgccucgggcagccccu

SEQ ID NO: 1496657 - RNA, 15 nt, Pseudomonas aeruginosa PA01
ggcgccgccuggccg

SEQ ID NO: 1496658 - RNA, 14 nt, Pseudomonas aeruginosa PA01
ggcgccgcgccagg

SEQ ID NO: 1496659 - RNA, 18 nt, Pseudomonas aeruginosa PA01
ggcgccgcgccagguuca

SEQ ID NO: 1496660 - RNA, 21 nt, Pseudomonas aeruginosa PA01
ggcgccgcgccuucugcaccu

SEQ ID NO: 1496661 - RNA, 16 nt, Pseudomonas aeruginosa PA01
ggcgccgcgcggcgcc

SEQ ID NO: 1496662 - RNA, 11 nt, Pseudomonas aeruginosa PA01
ggcgccggguc

SEQ ID NO: 1496663 - RNA, 16 nt, Pseudomonas aeruginosa PA01
ggcgccgggcugccga

SEQ ID NO: 1496664 - RNA, 17 nt, Pseudomonas aeruginosa PA01
ggcgccgggcugccgaa

SEQ ID NO: 1496665 - RNA, 23 nt, Pseudomonas aeruginosa PA01
ggcgccggcauugccgacuuccu

SEQ ID NO: 1496666 - RNA, 11 nt, Pseudomonas aeruginosa PA01
ggcgccggcau

SEQ ID NO: 1496667 - RNA, 16 nt, Pseudomonas aeruginosa PA01
ggcgccggagcugguc

SEQ ID NO: 1496668 - RNA, 20 nt, Pseudomonas aeruginosa PA01
ggcgccgcuugagaccuucg

SEQ ID NO: 1496669 - RNA, 13 nt, Pseudomonas aeruginosa PA01
ggcgccgcuggcg

SEQ ID NO: 1496670 - RNA, 23 nt, Pseudomonas aeruginosa PA01
ggcgccgcucgaugcccgccagc

SEQ ID NO: 1496671 - RNA, 19 nt, Pseudomonas aeruginosa PA01
ggcgccgcuagggcgcccu

SEQ ID NO: 1496672 - RNA, 12 nt, Pseudomonas aeruginosa PA01
ggcgccgcgguc

SEQ ID NO: 1496673 - RNA, 17 nt, Pseudomonas aeruginosa PA01
ggcgccggugcuggcga

SEQ ID NO: 1496674 - RNA, 19 nt, Pseudomonas aeruginosa PA01
ggcgccggugaggcgcagc

SEQ ID NO: 1496675 - RNA, 21 nt, Pseudomonas aeruginosa PA01
ggcgccggugcaugaaggcgc

SEQ ID NO: 1496676 - RNA, 19 nt, Pseudomonas aeruginosa PA01
ggcgccgucaucgcugacc

SEQ ID NO: 1496677 - RNA, 20 nt, Pseudomonas aeruginosa PA01
ggcgccgguugcugcugcgg

SEQ ID NO: 1496678 - RNA, 22 nt, Pseudomonas aeruginosa PA01
ggcgccguccugcaacugcucg

SEQ ID NO: 1496679 - RNA, 15 nt, Pseudomonas aeruginosa PA01
ggcgccugcgcuucg

SEQ ID NO: 1496680 - RNA, 17 nt, Pseudomonas aeruginosa PA01
ggcgccugcggaccaca

SEQ ID NO: 1496681 - RNA, 13 nt, Pseudomonas aeruginosa PA01
ggcgccucgucga

SEQ ID NO: 1496682 - RNA, 21 nt, Pseudomonas aeruginosa PA01
ggcgccuucagagcaggguga

SEQ ID NO: 1496683 - RNA, 17 nt, Pseudomonas aeruginosa PA01
ggcgccuucagcgccgc

SEQ ID NO: 1496684 - RNA, 19 nt, Pseudomonas aeruginosa PA01
ggcgccuucagcgccgcca

SEQ ID NO: 1496685 - RNA, 18 nt, Pseudomonas aeruginosa PA01
ggcgccuucaucgccacc

SEQ ID NO: 1496686 - RNA, 18 nt, Pseudomonas aeruginosa PA01
ggcgccuggccuggaacu

SEQ ID NO: 1496687 - RNA, 16 nt, Pseudomonas aeruginosa PA01
ggcgccugcugcgcgg

SEQ ID NO: 1496688 - RNA, 15 nt, Pseudomonas aeruginosa PA01
ggcgauggccagcgc

SEQ ID NO: 1496689 - RNA, 17 nt, Pseudomonas aeruginosa PA01
ggcgauggccagcgcgu

SEQ ID NO: 1496690 - RNA, 14 nt, Pseudomonas aeruginosa PA01
ggcgauggccauca

SEQ ID NO: 1496691 - RNA, 20 nt, Pseudomonas aeruginosa PA01
ggcgauggccaucagggucg

SEQ ID NO: 1496692 - RNA, 22 nt, Pseudomonas aeruginosa PA01
ggcgaugcguuugucgaccugc

SEQ ID NO: 1496693 - RNA, 18 nt, Pseudomonas aeruginosa PA01
ggcgaugcucagcgccgg

SEQ ID NO: 1496694 - RNA, 19 nt, Pseudomonas aeruginosa PA01
ggcgaugcucagcgccggc

SEQ ID NO: 1496695 - RNA, 21 nt, Pseudomonas aeruginosa PA01
ggcgaugcucagcgccggcca

SEQ ID NO: 1496696 - RNA, 17 nt, Pseudomonas aeruginosa PA01
ggcgaugcgcgugguau

SEQ ID NO: 1496697 - RNA, 19 nt, Pseudomonas aeruginosa PA01
ggcgaugcgcgugguaucg

SEQ ID NO: 1496698 - RNA, 17 nt, Pseudomonas aeruginosa PA01
ggcgaugcgcaggccgg

SEQ ID NO: 1496699 - RNA, 14 nt, Pseudomonas aeruginosa PA01
ggcgaugcgccggu

SEQ ID NO: 1496700 - RNA, 22 nt, Pseudomonas aeruginosa PA01
ggcgauggucaggacgcuacgc

SEQ ID NO: 1496701 - RNA, 15 nt, Pseudomonas aeruginosa PA01
ggcgauggcgcgcgg

SEQ ID NO: 1496702 - RNA, 13 nt, Pseudomonas aeruginosa PA01
ggcgauggcggug

SEQ ID NO: 1496703 - RNA, 16 nt, Pseudomonas aeruginosa PA01
ggcgauggcggugacc

SEQ ID NO: 1496704 - RNA, 12 nt, Pseudomonas aeruginosa PA01
ggcgauggcgua

SEQ ID NO: 1496705 - RNA, 22 nt, Pseudomonas aeruginosa PA01
ggcgauggcguagaggcucggc

SEQ ID NO: 1496706 - RNA, 23 nt, Pseudomonas aeruginosa PA01
ggcgauggcguagaggcucggcg

SEQ ID NO: 1496707 - RNA, 19 nt, Pseudomonas aeruginosa PA01
ggcgauggcguccaccgcu

SEQ ID NO: 1496708 - RNA, 21 nt, Pseudomonas aeruginosa PA01
ggcgauggcccguuccaccgc

SEQ ID NO: 1496709 - RNA, 21 nt, Pseudomonas aeruginosa PA01
ggcgauggccuggucggcgcg

SEQ ID NO: 1496710 - RNA, 15 nt, Pseudomonas aeruginosa PA01
ggcgauggccgccug

SEQ ID NO: 1496711 - RNA, 19 nt, Pseudomonas aeruginosa PA01
ggcgauggccgccagcagg

SEQ ID NO: 1496712 - RNA, 19 nt, Pseudomonas aeruginosa PA01
ggcgauggugcgcucgcgg

SEQ ID NO: 1496713 - RNA, 20 nt, Pseudomonas aeruginosa PA01
ggcgauguaggucaccgcgc

SEQ ID NO: 1496714 - RNA, 20 nt, Pseudomonas aeruginosa PA01
ggcgauguccuggaucggca

SEQ ID NO: 1496715 - RNA, 16 nt, Pseudomonas aeruginosa PA01
ggcgauguugcgcagg

SEQ ID NO: 1496716 - RNA, 18 nt, Pseudomonas aeruginosa PA01
ggcgauuccacgggccug

SEQ ID NO: 1496717 - RNA, 18 nt, Pseudomonas aeruginosa PA01
ggcgauguucgcccccuu

SEQ ID NO: 1496718 - RNA, 20 nt, Pseudomonas aeruginosa PA01
ggcgaugggucgcguggggu

SEQ ID NO: 1496719 - RNA, 17 nt, Pseudomonas aeruginosa PA01
ggcgauucguucgagca

SEQ ID NO: 1496720 - RNA, 21 nt, Pseudomonas aeruginosa PA01
ggcgauguugaacagcgccgg

SEQ ID NO: 1496721 - RNA, 14 nt, Pseudomonas aeruginosa PA01
ggcgauucgcggcg

SEQ ID NO: 1496722 - RNA, 17 nt, Pseudomonas aeruginosa PA01
ggcgauucgcggcgaca

SEQ ID NO: 1496723 - RNA, 16 nt, Pseudomonas aeruginosa PA01
ggcgaucucggcgcgg

SEQ ID NO: 1496724 - RNA, 22 nt, Pseudomonas aeruginosa PA01
ggcgaucucggcgcgggcaugg

SEQ ID NO: 1496725 - RNA, 18 nt, Pseudomonas aeruginosa PA01
ggcgaucuccucgauccg

SEQ ID NO: 1496726 - RNA, 19 nt, Pseudomonas aeruginosa PA01
ggcgaucuccucgauccgc

SEQ ID NO: 1496727 - RNA, 19 nt, Pseudomonas aeruginosa PA01
ggcgaucgucgagaugcug

SEQ ID NO: 1496728 - RNA, 14 nt, Pseudomonas aeruginosa PA01
ggcgaugaacaccg

SEQ ID NO: 1496729 - RNA, 21 nt, Pseudomonas aeruginosa PA01
ggcgaucugugcgagcgcgug

SEQ ID NO: 1496730 - RNA, 22 nt, Pseudomonas aeruginosa PA01
ggcgaucuucagguaggcgcgg

SEQ ID NO: 1496731 - RNA, 19 nt, Pseudomonas aeruginosa PA01
ggcgaucuucaucucuucg

SEQ ID NO: 1496732 - RNA, 16 nt, Pseudomonas aeruginosa PA01
ggcgaucuugaucgcc

SEQ ID NO: 1496733 - RNA, 14 nt, Pseudomonas aeruginosa PA01
ggcgaucgaccugc

SEQ ID NO: 1496734 - RNA, 15 nt, Pseudomonas aeruginosa PA01
ggcgaucgaccugcc

SEQ ID NO: 1496735 - RNA, 13 nt, Pseudomonas aeruginosa PA01
ggcgaucgacgcc

SEQ ID NO: 1496736 - RNA, 20 nt, Pseudomonas aeruginosa PA01
ggcgaucgacgccucggcgc

SEQ ID NO: 1496737 - RNA, 13 nt, Pseudomonas aeruginosa PA01
ggcgaucgccccg

SEQ ID NO: 1496738 - RNA, 14 nt, Pseudomonas aeruginosa PA01
ggcgaucgccgcgg

SEQ ID NO: 1496739 - RNA, 17 nt, Pseudomonas aeruginosa PA01
ggcgaucgccgcggcga

SEQ ID NO: 1496740 - RNA, 22 nt, Pseudomonas aeruginosa PA01
ggcgaucgccggguugccgcug

SEQ ID NO: 1496741 - RNA, 12 nt, Pseudomonas aeruginosa PA01
ggcgaucgccug

SEQ ID NO: 1496742 - RNA, 19 nt, Pseudomonas aeruginosa PA01
ggcgaucggguagagcgcg

SEQ ID NO: 1496743 - RNA, 22 nt, Pseudomonas aeruginosa PA01
ggcgaucggguagagcgcggcg

SEQ ID NO: 1496744 - RNA, 24 nt, Pseudomonas aeruginosa PA01
ggcgaucggguagagcgcggcgca

SEQ ID NO: 1496745 - RNA, 17 nt, Pseudomonas aeruginosa PA01
ggcgaugcccaggccgc

SEQ ID NO: 1496746 - RNA, 18 nt, Pseudomonas aeruginosa PA01
ggcgaugcccaggccgcc

SEQ ID NO: 1496747 - RNA, 20 nt, Pseudomonas aeruginosa PA01
ggcgaugcccaggccgccga

SEQ ID NO: 1496748 - RNA, 22 nt, Pseudomonas aeruginosa PA01
ggcgaugcccaggccgccgauc

SEQ ID NO: 1496749 - RNA, 13 nt, Pseudomonas aeruginosa PA01
ggcgaugccgagg

SEQ ID NO: 1496750 - RNA, 12 nt, Pseudomonas aeruginosa PA01
ggcgaugccgau

SEQ ID NO: 1496751 - RNA, 16 nt, Pseudomonas aeruginosa PA01
ggcgaugccgauggcg

SEQ ID NO: 1496752 - RNA, 18 nt, Pseudomonas aeruginosa PA01
ggcgaugccgcgccaggc

SEQ ID NO: 1496753 - RNA, 20 nt, Pseudomonas aeruginosa PA01
ggcgaugccgcgccaggcgc

SEQ ID NO: 1496754 - RNA, 14 nt, Pseudomonas aeruginosa PA01
ggcgaugccggaga

SEQ ID NO: 1496755 - RNA, 14 nt, Pseudomonas aeruginosa PA01
ggcgaugccgccca

SEQ ID NO: 1496756 - RNA, 20 nt, Pseudomonas aeruginosa PA01
ggcgaugccgcccagcaccg

SEQ ID NO: 1496757 - RNA, 17 nt, Pseudomonas aeruginosa PA01
ggcgaugaagcugaugc

SEQ ID NO: 1496758 - RNA, 20 nt, Pseudomonas aeruginosa PA01
ggcgaugaccagcucggcgg

SEQ ID NO: 1496759 - RNA, 20 nt, Pseudomonas aeruginosa PA01
ggcgaugauggucaacacca

SEQ ID NO: 1496760 - RNA, 15 nt, Pseudomonas aeruginosa PA01
ggcgaugaucagccc

SEQ ID NO: 1496761 - RNA, 16 nt, Pseudomonas aeruginosa PA01
ggcgaugaucagcccu

SEQ ID NO: 1496762 - RNA, 17 nt, Pseudomonas aeruginosa PA01
ggcgaucgaaggaucgc

SEQ ID NO: 1496763 - RNA, 14 nt, Pseudomonas aeruginosa PA01
ggcgaucccggcgu

SEQ ID NO: 1496764 - RNA, 14 nt, Pseudomonas aeruginosa PA01
ggcgaucaugccuu

SEQ ID NO: 1496765 - RNA, 16 nt, Pseudomonas aeruginosa PA01
ggcgauccacagcagg

SEQ ID NO: 1496766 - RNA, 24 nt, Pseudomonas aeruginosa PA01
ggcgauccgcgcuuccgcaucggc

SEQ ID NO: 1496767 - RNA, 22 nt, Pseudomonas aeruginosa PA01
ggcgauccgcgcauaggaggcg

SEQ ID NO: 1496768 - RNA, 23 nt, Pseudomonas aeruginosa PA01
ggcgaucacgccgcgcaccagca

SEQ ID NO: 1496769 - RNA, 18 nt, Pseudomonas aeruginosa PA01
ggcgaucacggcgccccg

SEQ ID NO: 1496770 - RNA, 12 nt, Pseudomonas aeruginosa PA01
ggcgaucagcga

SEQ ID NO: 1496771 - RNA, 21 nt, Pseudomonas aeruginosa PA01
ggcgauccagaagaucagcgc

SEQ ID NO: 1496772 - RNA, 22 nt, Pseudomonas aeruginosa PA01
ggcgauccagaagaucagcgcg

SEQ ID NO: 1496773 - RNA, 13 nt, Pseudomonas aeruginosa PA01
ggcgaucaucgcg

SEQ ID NO: 1496774 - RNA, 17 nt, Pseudomonas aeruginosa PA01
ggcgaucaggcagcgcg

SEQ ID NO: 1496775 - RNA, 18 nt, Pseudomonas aeruginosa PA01
ggcgaucaggcagcgcgc

SEQ ID NO: 1496776 - RNA, 13 nt, Pseudomonas aeruginosa PA01
ggcgaucagcggg

SEQ ID NO: 1496777 - RNA, 15 nt, Pseudomonas aeruginosa PA01
ggcgaucagcgggcg

SEQ ID NO: 1496778 - RNA, 20 nt, Pseudomonas aeruginosa PA01
ggcgaucagcgggcgguaga

SEQ ID NO: 1496779 - RNA, 23 nt, Pseudomonas aeruginosa PA01
ggcgaucaccagggugcgcucgu

SEQ ID NO: 1496780 - RNA, 16 nt, Pseudomonas aeruginosa PA01
ggcgaguucgcgcagg

SEQ ID NO: 1496781 - RNA, 20 nt, Pseudomonas aeruginosa PA01
ggcgagucuugaggaagucg

SEQ ID NO: 1496782 - RNA, 21 nt, Pseudomonas aeruginosa PA01
ggcgagucgaucaggucgccg

SEQ ID NO: 1496783 - RNA, 14 nt, Pseudomonas aeruginosa PA01
ggcgauagccgacc

SEQ ID NO: 1496784 - RNA, 17 nt, Pseudomonas aeruginosa PA01
ggcgauacccaggccgu

SEQ ID NO: 1496785 - RNA, 19 nt, Pseudomonas aeruginosa PA01
ggcgauacccaggccgucg

SEQ ID NO: 1496786 - RNA, 22 nt, Pseudomonas aeruginosa PA01
ggcgauacccaggccgucgagg

SEQ ID NO: 1496787 - RNA, 21 nt, Pseudomonas aeruginosa PA01
ggcgaucacccggcgaagcuc

SEQ ID NO: 1496788 - RNA, 22 nt, Pseudomonas aeruginosa PA01
ggcgauaucccgccgccgcgcc

SEQ ID NO: 1496789 - RNA, 23 nt, Pseudomonas aeruginosa PA01
ggcgauaucccgccgccgcgccu

SEQ ID NO: 1496790 - RNA, 14 nt, Pseudomonas aeruginosa PA01
ggcgauaggcgcgc

SEQ ID NO: 1496791 - RNA, 16 nt, Pseudomonas aeruginosa PA01
ggcgaggacgccgggc

SEQ ID NO: 1496792 - RNA, 14 nt, Pseudomonas aeruginosa PA01
ggcgaggaacagca

SEQ ID NO: 1496793 - RNA, 17 nt, Pseudomonas aeruginosa PA01
ggcgaggaacagcacca

SEQ ID NO: 1496794 - RNA, 16 nt, Pseudomonas aeruginosa PA01
ggccuggcccggcgca

SEQ ID NO: 1496795 - RNA, 22 nt, Pseudomonas aeruginosa PA01
ggccuggcccuggcgcaggcgg

SEQ ID NO: 1496796 - RNA, 17 nt, Pseudomonas aeruginosa PA01
ggccuggaucucggcgg

SEQ ID NO: 1496797 - RNA, 14 nt, Pseudomonas aeruginosa PA01
ggccugggacggcg

SEQ ID NO: 1496798 - RNA, 23 nt, Pseudomonas aeruginosa PA01
ggccuggcgguugaugccgacgu

SEQ ID NO: 1496799 - RNA, 16 nt, Pseudomonas aeruginosa PA01
ggccuggcucaugucg

SEQ ID NO: 1496800 - RNA, 14 nt, Pseudomonas aeruginosa PA01
ggccuggcuggccu

SEQ ID NO: 1496801 - RNA, 15 nt, Pseudomonas aeruginosa PA01
ggccuggcuggccuu

SEQ ID NO: 1496802 - RNA, 17 nt, Pseudomonas aeruginosa PA01
ggccuggaacuggucgg

SEQ ID NO: 1496803 - RNA, 19 nt, Pseudomonas aeruginosa PA01
ggccuggagaaacucgcgg

SEQ ID NO: 1496804 - RNA, 13 nt, Pseudomonas aeruginosa PA01
ggccuggagcgcc

SEQ ID NO: 1496805 - RNA, 17 nt, Pseudomonas aeruginosa PA01
ggccuggagcgccucga

SEQ ID NO: 1496806 - RNA, 14 nt, Pseudomonas aeruginosa PA01
ggccuggaacacca

SEQ ID NO: 1496807 - RNA, 16 nt, Pseudomonas aeruginosa PA01
ggccuggaacaccagg

SEQ ID NO: 1496808 - RNA, 17 nt, Pseudomonas aeruginosa PA01
ggccuggaacaccaggc

SEQ ID NO: 1496809 - RNA, 23 nt, Pseudomonas aeruginosa PA01
ggccuggaacaccaggccgcaag

SEQ ID NO: 1496810 - RNA, 11 nt, Pseudomonas aeruginosa PA01
ggccuggcgca

SEQ ID NO: 1496811 - RNA, 19 nt, Pseudomonas aeruginosa PA01
ggccuggcgcaacaggcgc

SEQ ID NO: 1496812 - RNA, 16 nt, Pseudomonas aeruginosa PA01
ggccuggcgcacggcc

SEQ ID NO: 1496813 - RNA, 12 nt, Pseudomonas aeruginosa PA01
ggccuggcgccg

SEQ ID NO: 1496814 - RNA, 13 nt, Pseudomonas aeruginosa PA01
ggccuggcgcgcg

SEQ ID NO: 1496815 - RNA, 18 nt, Pseudomonas aeruginosa PA01
ggccuggcgcgcgcgcca

SEQ ID NO: 1496816 - RNA, 11 nt, Pseudomonas aeruginosa PA01
ggccuggcgcu

SEQ ID NO: 1496817 - RNA, 19 nt, Pseudomonas aeruginosa PA01
ggccuggcgcucagcgccg

SEQ ID NO: 1496818 - RNA, 20 nt, Pseudomonas aeruginosa PA01
ggccuggcgcucagcgccgc

SEQ ID NO: 1496819 - RNA, 21 nt, Pseudomonas aeruginosa PA01
ggcgaggucgcggacgaggau

SEQ ID NO: 1496820 - RNA, 15 nt, Pseudomonas aeruginosa PA01
ggcgaggucggccug

SEQ ID NO: 1496821 - RNA, 16 nt, Pseudomonas aeruginosa PA01
ggcgaggucggccugc

SEQ ID NO: 1496822 - RNA, 17 nt, Pseudomonas aeruginosa PA01
ggcgaggucggccugcg

SEQ ID NO: 1496823 - RNA, 23 nt, Pseudomonas aeruginosa PA01
ggcgaggucggccugcggguucg

SEQ ID NO: 1496824 - RNA, 16 nt, Pseudomonas aeruginosa PA01
ggcgagguugcccacg

SEQ ID NO: 1496825 - RNA, 14 nt, Pseudomonas aeruginosa PA01
ggcgaguaagcgcg

SEQ ID NO: 1496826 - RNA, 14 nt, Pseudomonas aeruginosa PA01
ggcgaggcguucca

SEQ ID NO: 1496827 - RNA, 14 nt, Pseudomonas aeruginosa PA01
ggcgagggcgccgg

SEQ ID NO: 1496828 - RNA, 14 nt, Pseudomonas aeruginosa PA01
ggcgagggcgcgca

SEQ ID NO: 1496829 - RNA, 16 nt, Pseudomonas aeruginosa PA01
ggcgagggcggcgacc

SEQ ID NO: 1496830 - RNA, 14 nt, Pseudomonas aeruginosa PA01
ggcgagggcggcgc

SEQ ID NO: 1496831 - RNA, 16 nt, Pseudomonas aeruginosa PA01
ggcgagggcggcgcgg

SEQ ID NO: 1496832 - RNA, 21 nt, Pseudomonas aeruginosa PA01
ggcgagggcggcgcgggcgcg

SEQ ID NO: 1496833 - RNA, 14 nt, Pseudomonas aeruginosa PA01
ggcgaggcgcgccu

SEQ ID NO: 1496834 - RNA, 22 nt, Pseudomonas aeruginosa PA01
ggcgaggauuuccggcuugccg

SEQ ID NO: 1496835 - RNA, 18 nt, Pseudomonas aeruginosa PA01
ggcgaggauggccguccu

SEQ ID NO: 1496836 - RNA, 19 nt, Pseudomonas aeruginosa PA01
ggcgaggaugaucagggca

SEQ ID NO: 1496837 - RNA, 20 nt, Pseudomonas aeruginosa PA01
ggcgaggaugaucagggcac

SEQ ID NO: 1496838 - RNA, 15 nt, Pseudomonas aeruginosa PA01
ggcgaggaucacgca

SEQ ID NO: 1496839 - RNA, 17 nt, Pseudomonas aeruginosa PA01
ggcgaggaucgccagca

SEQ ID NO: 1496840 - RNA, 22 nt, Pseudomonas aeruginosa PA01
ggcggauguaguccagcgccgc

SEQ ID NO: 1496841 - RNA, 17 nt, Pseudomonas aeruginosa PA01
ggcggauucaggcgcgc

SEQ ID NO: 1496842 - RNA, 20 nt, Pseudomonas aeruginosa PA01
ggcggauugacgauggccag

SEQ ID NO: 1496843 - RNA, 18 nt, Pseudomonas aeruginosa PA01
ggcggauuuccugcggca

SEQ ID NO: 1496844 - RNA, 19 nt, Pseudomonas aeruginosa PA01
ggcggauuuccugcggcac

SEQ ID NO: 1496845 - RNA, 22 nt, Pseudomonas aeruginosa PA01
ggcggauuuccugcggcacgaa

SEQ ID NO: 1496846 - RNA, 22 nt, Pseudomonas aeruginosa PA01
ggcggaucugcucgacgucguc

SEQ ID NO: 1496847 - RNA, 18 nt, Pseudomonas aeruginosa PA01
ggcggaugacguucccgu

SEQ ID NO: 1496848 - RNA, 14 nt, Pseudomonas aeruginosa PA01
ggcggaucgccgcc

SEQ ID NO: 1496849 - RNA, 15 nt, Pseudomonas aeruginosa PA01
ggcggaucagcccgc

SEQ ID NO: 1496850 - RNA, 21 nt, Pseudomonas aeruginosa PA01
ggcggaucagcccgcugaccg

SEQ ID NO: 1496851 - RNA, 17 nt, Pseudomonas aeruginosa PA01
ggcggaucagcucgauc

SEQ ID NO: 1496852 - RNA, 18 nt, Pseudomonas aeruginosa PA01
ggcggaucagcucgauca

SEQ ID NO: 1496853 - RNA, 16 nt, Pseudomonas aeruginosa PA01
ggcggaucgagcagcg

SEQ ID NO: 1496854 - RNA, 17 nt, Pseudomonas aeruginosa PA01
ggcggaucgagcagcgg

SEQ ID NO: 1496855 - RNA, 22 nt, Pseudomonas aeruginosa PA01
ggcggaucgagcagcggcgcca

SEQ ID NO: 1496856 - RNA, 19 nt, Pseudomonas aeruginosa PA01
ggcggaucgaucagcagca

SEQ ID NO: 1496857 - RNA, 12 nt, Pseudomonas aeruginosa PA01
ggcggaucgcca

SEQ ID NO: 1496858 - RNA, 16 nt, Pseudomonas aeruginosa PA01
ggcggaucgcccggcg

SEQ ID NO: 1496859 - RNA, 18 nt, Pseudomonas aeruginosa PA01
ggcggaucgcccggcgcu

SEQ ID NO: 1496860 - RNA, 21 nt, Pseudomonas aeruginosa PA01
ggcggaucgcccggcgcucca

SEQ ID NO: 1496861 - RNA, 14 nt, Pseudomonas aeruginosa PA01
ggcgcuugggcgcg

SEQ ID NO: 1496862 - RNA, 17 nt, Pseudomonas aeruginosa PA01
ggcgcuuguagcccagg

SEQ ID NO: 1496863 - RNA, 18 nt, Pseudomonas aeruginosa PA01
ggcgcuuguagcccaggg

SEQ ID NO: 1496864 - RNA, 18 nt, Pseudomonas aeruginosa PA01
ggcgcuuguccaucggcu

SEQ ID NO: 1496865 - RNA, 17 nt, Pseudomonas aeruginosa PA01
ggcgcuuguccgagacc

SEQ ID NO: 1496866 - RNA, 21 nt, Pseudomonas aeruginosa PA01
ggcgcuuguccgagaccggca

SEQ ID NO: 1496867 - RNA, 19 nt, Pseudomonas aeruginosa PA01
ggcgcuuucccgcuucggc

SEQ ID NO: 1496868 - RNA, 19 nt, Pseudomonas aeruginosa PA01
ggcgcuucagcgccucgac

SEQ ID NO: 1496869 - RNA, 15 nt, Pseudomonas aeruginosa PA01
ggcgcuucugcucgg

SEQ ID NO: 1496870 - RNA, 16 nt, Pseudomonas aeruginosa PA01
ggcgcuucugcucggc

SEQ ID NO: 1496871 - RNA, 19 nt, Pseudomonas aeruginosa PA01
ggcgcuucugcucggccug

SEQ ID NO: 1496872 - RNA, 17 nt, Pseudomonas aeruginosa PA01
ggcgcuugaagccggcg

SEQ ID NO: 1496873 - RNA, 18 nt, Pseudomonas aeruginosa PA01
ggcgcuugaagccggcgu

SEQ ID NO: 1496874 - RNA, 23 nt, Pseudomonas aeruginosa PA01
ggcgcuugcucuccacuaccgcc

SEQ ID NO: 1496875 - RNA, 16 nt, Pseudomonas aeruginosa PA01
ggcgcuugcgggcgcg

SEQ ID NO: 1496876 - RNA, 18 nt, Pseudomonas aeruginosa PA01
ggcgcuugcgggcgcgcc

SEQ ID NO: 1496877 - RNA, 19 nt, Pseudomonas aeruginosa PA01
ggcgcuugcgggcgcgccu

SEQ ID NO: 1496878 - RNA, 13 nt, Pseudomonas aeruginosa PA01
ggcgcuugagcag

SEQ ID NO: 1496879 - RNA, 17 nt, Pseudomonas aeruginosa PA01
ggcgcuugagcagccag

SEQ ID NO: 1496880 - RNA, 15 nt, Pseudomonas aeruginosa PA01
ggcgcuugccgcgcc

SEQ ID NO: 1496881 - RNA, 18 nt, Pseudomonas aeruginosa PA01
ggcgcuugccgcgcccgg

SEQ ID NO: 1496882 - RNA, 19 nt, Pseudomonas aeruginosa PA01
ggcgcuugccgcgcccggc

SEQ ID NO: 1496883 - RNA, 14 nt, Pseudomonas aeruginosa PA01
ggcgcuucggcgga

SEQ ID NO: 1496884 - RNA, 14 nt, Pseudomonas aeruginosa PA01
ggcgcugucgcccg

SEQ ID NO: 1496885 - RNA, 13 nt, Pseudomonas aeruginosa PA01
ggcgcugucgccg

SEQ ID NO: 1496886 - RNA, 22 nt, Pseudomonas aeruginosa PA01
ggcgcuguuugcggcgcaggcg

SEQ ID NO: 1496887 - RNA, 16 nt, Pseudomonas aeruginosa PA01
ggcgcuguuggccugg

SEQ ID NO: 1496888 - RNA, 16 nt, Pseudomonas aeruginosa PA01
ggcgcugggcggcugg

SEQ ID NO: 1496889 - RNA, 18 nt, Pseudomonas aeruginosa PA01
ggcgcugggcggcuggcc

SEQ ID NO: 1496890 - RNA, 15 nt, Pseudomonas aeruginosa PA01
ggcgcugguccagca

SEQ ID NO: 1496891 - RNA, 16 nt, Pseudomonas aeruginosa PA01
ggcgcugguccagcac

SEQ ID NO: 1496892 - RNA, 19 nt, Pseudomonas aeruginosa PA01
ggcgcugguccuucagcug

SEQ ID NO: 1496893 - RNA, 19 nt, Pseudomonas aeruginosa PA01
ggcgcuguaggcgagcagc

SEQ ID NO: 1496894 - RNA, 20 nt, Pseudomonas aeruginosa PA01
ggcgcuguaggcgagcagcg

SEQ ID NO: 1496895 - RNA, 23 nt, Pseudomonas aeruginosa PA01
ggcgcuguaggcgagcagcggca

SEQ ID NO: 1496896 - RNA, 18 nt, Pseudomonas aeruginosa PA01
ggcggccccuucagcucc

SEQ ID NO: 1496897 - RNA, 21 nt, Pseudomonas aeruginosa PA01
ggcggccccuucagcuccagc

SEQ ID NO: 1496898 - RNA, 14 nt, Pseudomonas aeruginosa PA01
ggcggccauugccg

SEQ ID NO: 1496899 - RNA, 13 nt, Pseudomonas aeruginosa PA01
ggcggccgacgug

SEQ ID NO: 1496900 - RNA, 14 nt, Pseudomonas aeruginosa PA01
ggcggccgacgugc

SEQ ID NO: 1496901 - RNA, 22 nt, Pseudomonas aeruginosa PA01
ggcggccgacgugcacccgcug

SEQ ID NO: 1496902 - RNA, 13 nt, Pseudomonas aeruginosa PA01
ggcggccgccggc

SEQ ID NO: 1496903 - RNA, 14 nt, Pseudomonas aeruginosa PA01
ggcggccgccggcg

SEQ ID NO: 1496904 - RNA, 16 nt, Pseudomonas aeruginosa PA01
ggcggccgccggcgcc

SEQ ID NO: 1496905 - RNA, 16 nt, Pseudomonas aeruginosa PA01
ggcggccgccuugacc

SEQ ID NO: 1496906 - RNA, 15 nt, Pseudomonas aeruginosa PA01
ggcggccgcaugccg

SEQ ID NO: 1496907 - RNA, 21 nt, Pseudomonas aeruginosa PA01
ggcggccagggcaugggucag

SEQ ID NO: 1496908 - RNA, 17 nt, Pseudomonas aeruginosa PA01
ggcggcauaggcccggc

SEQ ID NO: 1496909 - RNA, 18 nt, Pseudomonas aeruginosa PA01
ggcggcauaggcccggcg

SEQ ID NO: 1496910 - RNA, 12 nt, Pseudomonas aeruginosa PA01
ggcggcagcacg

SEQ ID NO: 1496911 - RNA, 19 nt, Pseudomonas aeruginosa PA01
ggcggcacuccaggaacca

SEQ ID NO: 1496912 - RNA, 20 nt, Pseudomonas aeruginosa PA01
ggcggcacucggcgaccacc

SEQ ID NO: 1496913 - RNA, 15 nt, Pseudomonas aeruginosa PA01
ggcggcacgguggac

SEQ ID NO: 1496914 - RNA, 15 nt, Pseudomonas aeruginosa PA01
ggcggauuugccgcc

SEQ ID NO: 1496915 - RNA, 21 nt, Pseudomonas aeruginosa PA01
ggcggcagcugcggcggcacc

SEQ ID NO: 1496916 - RNA, 22 nt, Pseudomonas aeruginosa PA01
ggcggcagcugcggcggcacca

SEQ ID NO: 1496917 - RNA, 13 nt, Pseudomonas aeruginosa PA01
ggcggcaggcgcc

SEQ ID NO: 1496918 - RNA, 14 nt, Pseudomonas aeruginosa PA01
ggcggcaggucgga

SEQ ID NO: 1496919 - RNA, 17 nt, Pseudomonas aeruginosa PA01
ggcggcaggcugcgccg

SEQ ID NO: 1496920 - RNA, 22 nt, Pseudomonas aeruginosa PA01
ggcggcaggcugcgccgcugcg

SEQ ID NO: 1496921 - RNA, 13 nt, Pseudomonas aeruginosa PA01
ggcggcuggcgcg

SEQ ID NO: 1496922 - RNA, 14 nt, Pseudomonas aeruginosa PA01
ggcggcuggcgcga

SEQ ID NO: 1496923 - RNA, 15 nt, Pseudomonas aeruginosa PA01
ggcggcuggcguggg

SEQ ID NO: 1496924 - RNA, 16 nt, Pseudomonas aeruginosa PA01
ggcggcugcugcgccu

SEQ ID NO: 1496925 - RNA, 23 nt, Pseudomonas aeruginosa PA01
ggcggcuucagccagaccggcag

SEQ ID NO: 1496926 - RNA, 12 nt, Pseudomonas aeruginosa PA01
ggcggcuguugc

SEQ ID NO: 1496927 - RNA, 16 nt, Pseudomonas aeruginosa PA01
ggcgggccagcaggcg

SEQ ID NO: 1496928 - RNA, 17 nt, Pseudomonas aeruginosa PA01
ggcgggccagcuggcga

SEQ ID NO: 1496929 - RNA, 12 nt, Pseudomonas aeruginosa PA01
ggcgggccaugc

SEQ ID NO: 1496930 - RNA, 15 nt, Pseudomonas aeruginosa PA01
ggcgggccaugcgcu

SEQ ID NO: 1496931 - RNA, 17 nt, Pseudomonas aeruginosa PA01
ggcgggccauugcaggu

SEQ ID NO: 1496932 - RNA, 18 nt, Pseudomonas aeruginosa PA01
ggcggcgucgucgcugcg

SEQ ID NO: 1496933 - RNA, 21 nt, Pseudomonas aeruginosa PA01
ggcggcgucccggcgccgccc

SEQ ID NO: 1496934 - RNA, 19 nt, Pseudomonas aeruginosa PA01
ggcggcggucgcgaucugc

SEQ ID NO: 1496935 - RNA, 17 nt, Pseudomonas aeruginosa PA01
ggcggcguauucgccga

SEQ ID NO: 1496936 - RNA, 20 nt, Pseudomonas aeruginosa PA01
ggcggcguauucgccgaaga

SEQ ID NO: 1496937 - RNA, 18 nt, Pseudomonas aeruginosa PA01
ggcggcgguucgccgagc

SEQ ID NO: 1496938 - RNA, 21 nt, Pseudomonas aeruginosa PA01
ggcggccugcucgcgcagcca

SEQ ID NO: 1496939 - RNA, 12 nt, Pseudomonas aeruginosa PA01
ggcggccugggu

SEQ ID NO: 1496940 - RNA, 14 nt, Pseudomonas aeruginosa PA01
ggcggccuggguga

SEQ ID NO: 1496941 - RNA, 11 nt, Pseudomonas aeruginosa PA01
ggcggccuggu

SEQ ID NO: 1496942 - RNA, 19 nt, Pseudomonas aeruginosa PA01
ggcggccugguagucgccg

SEQ ID NO: 1496943 - RNA, 14 nt, Pseudomonas aeruginosa PA01
ggcggccucguagg

SEQ ID NO: 1496944 - RNA, 19 nt, Pseudomonas aeruginosa PA01
ggcggccucguaggcggcg

SEQ ID NO: 1496945 - RNA, 16 nt, Pseudomonas aeruginosa PA01
ggcggccugccccgcc

SEQ ID NO: 1496946 - RNA, 22 nt, Pseudomonas aeruginosa PA01
ggcggccugccccgccggcgcu

SEQ ID NO: 1496947 - RNA, 14 nt, Pseudomonas aeruginosa PA01
ggcggccuucggcg

SEQ ID NO: 1496948 - RNA, 15 nt, Pseudomonas aeruginosa PA01
ggcggccuucggcgu

SEQ ID NO: 1496949 - RNA, 24 nt, Pseudomonas aeruginosa PA01
ggcggccuuuucggcggccaggcg

SEQ ID NO: 1496950 - RNA, 21 nt, Pseudomonas aeruginosa PA01
ggcggcgagcuggaucggcag

SEQ ID NO: 1496951 - RNA, 13 nt, Pseudomonas aeruginosa PA01
ggcggcgcagacg

SEQ ID NO: 1496952 - RNA, 19 nt, Pseudomonas aeruginosa PA01
ggcggcggcuaccagcgcu

SEQ ID NO: 1496953 - RNA, 15 nt, Pseudomonas aeruginosa PA01
ggcggcggcucaggc

SEQ ID NO: 1496954 - RNA, 17 nt, Pseudomonas aeruginosa PA01
ggcggcggggaaggcgu

SEQ ID NO: 1496955 - RNA, 15 nt, Pseudomonas aeruginosa PA01
ggcggcgggccggcg

SEQ ID NO: 1496956 - RNA, 16 nt, Pseudomonas aeruginosa PA01
ggcggcgggccggcgu

SEQ ID NO: 1496957 - RNA, 13 nt, Pseudomonas aeruginosa PA01
ggcggcgauggac

SEQ ID NO: 1496958 - RNA, 12 nt, Pseudomonas aeruginosa PA01
ggcggcgccagg

SEQ ID NO: 1496959 - RNA, 17 nt, Pseudomonas aeruginosa PA01
ggcggcgccaggccggc

SEQ ID NO: 1496960 - RNA, 19 nt, Pseudomonas aeruginosa PA01
ggcggcgccaggccggcga

SEQ ID NO: 1496961 - RNA, 14 nt, Pseudomonas aeruginosa PA01
ggcggcgcaucggc

SEQ ID NO: 1496962 - RNA, 15 nt, Pseudomonas aeruginosa PA01
ggcggcgcaucggcg

SEQ ID NO: 1496963 - RNA, 10 nt, Pseudomonas aeruginosa PA01
ggcggcgcca

SEQ ID NO: 1496964 - RNA, 13 nt, Pseudomonas aeruginosa PA01
ggcgcucgcgcug

SEQ ID NO: 1496965 - RNA, 16 nt, Pseudomonas aeruginosa PA01
ggcgcucgcgggccgc

SEQ ID NO: 1496966 - RNA, 17 nt, Pseudomonas aeruginosa PA01
ggcgcucgcgggccgcc

SEQ ID NO: 1496967 - RNA, 20 nt, Pseudomonas aeruginosa PA01
ggcgcucgcgggccgccugg

SEQ ID NO: 1496968 - RNA, 14 nt, Pseudomonas aeruginosa PA01
ggcgcuccagggcg

SEQ ID NO: 1496969 - RNA, 14 nt, Pseudomonas aeruginosa PA01
ggcgcucgacgauc

SEQ ID NO: 1496970 - RNA, 14 nt, Pseudomonas aeruginosa PA01
ggcgcuccaacagc

SEQ ID NO: 1496971 - RNA, 15 nt, Pseudomonas aeruginosa PA01
ggcgcuccaccaggg

SEQ ID NO: 1496972 - RNA, 14 nt, Pseudomonas aeruginosa PA01
ggcgcuccaccgcc

SEQ ID NO: 1496973 - RNA, 18 nt, Pseudomonas aeruginosa PA01
ggcgcucgcccuugcgcc

SEQ ID NO: 1496974 - RNA, 23 nt, Pseudomonas aeruginosa PA01
ggcgcucgcccuugcgccgcggu

SEQ ID NO: 1496975 - RNA, 12 nt, Pseudomonas aeruginosa PA01
ggcgcucgaggg

SEQ ID NO: 1496976 - RNA, 20 nt, Pseudomonas aeruginosa PA01
ggcgcucgagcuugaggucg

SEQ ID NO: 1496977 - RNA, 14 nt, Pseudomonas aeruginosa PA01
ggcgcucggcggcg

SEQ ID NO: 1496978 - RNA, 13 nt, Pseudomonas aeruginosa PA01
ggcgcucggcucc

SEQ ID NO: 1496979 - RNA, 12 nt, Pseudomonas aeruginosa PA01
ggcgcucggcga

SEQ ID NO: 1496980 - RNA, 14 nt, Pseudomonas aeruginosa PA01
ggcgcucggcgacc

SEQ ID NO: 1496981 - RNA, 15 nt, Pseudomonas aeruginosa PA01
ggcgcucggcgaccu

SEQ ID NO: 1496982 - RNA, 17 nt, Pseudomonas aeruginosa PA01
ggcgcucguugcgccgc

SEQ ID NO: 1496983 - RNA, 19 nt, Pseudomonas aeruginosa PA01
ggcgcucguugcgccgcuc

SEQ ID NO: 1496984 - RNA, 21 nt, Pseudomonas aeruginosa PA01
ggcgcucguugcgccgcuccu

SEQ ID NO: 1496985 - RNA, 24 nt, Pseudomonas aeruginosa PA01
ggcgcucguugcgccgcuccuggc

SEQ ID NO: 1496986 - RNA, 20 nt, Pseudomonas aeruginosa PA01
ggcgcucggcaucgaccaug

SEQ ID NO: 1496987 - RNA, 22 nt, Pseudomonas aeruginosa PA01
ggcgcugaacaagcccuggugg

SEQ ID NO: 1496988 - RNA, 18 nt, Pseudomonas aeruginosa PA01
ggcgcugaacagcuggcg

SEQ ID NO: 1496989 - RNA, 18 nt, Pseudomonas aeruginosa PA01
ggcgcucugcaguguggc

SEQ ID NO: 1496990 - RNA, 16 nt, Pseudomonas aeruginosa PA01
ggcgcucuucacuucc

SEQ ID NO: 1496991 - RNA, 20 nt, Pseudomonas aeruginosa PA01
ggcgcucuucacuuccagcu

SEQ ID NO: 1496992 - RNA, 15 nt, Pseudomonas aeruginosa PA01
ggcgcugaagcggcc

SEQ ID NO: 1496993 - RNA, 16 nt, Pseudomonas aeruginosa PA01
ggcgcugaagcggccg

SEQ ID NO: 1496994 - RNA, 18 nt, Pseudomonas aeruginosa PA01
ggcgcugaagcggccgag

SEQ ID NO: 1496995 - RNA, 12 nt, Pseudomonas aeruginosa PA01
ggcgcugaccag

SEQ ID NO: 1496996 - RNA, 16 nt, Pseudomonas aeruginosa PA01
ggcgcugaccgcuccc

SEQ ID NO: 1496997 - RNA, 17 nt, Pseudomonas aeruginosa PA01
ggcgcugaccucgaugg

SEQ ID NO: 1496998 - RNA, 21 nt, Pseudomonas aeruginosa PA01
ggcgcguugcuuccaggcacc

SEQ ID NO: 1496999 - RNA, 16 nt, Pseudomonas aeruginosa PA01
ggcgcguuggcuggcg

SEQ ID NO: 1497000 - RNA, 16 nt, Pseudomonas aeruginosa PA01
ggcgcguugugccgcc

SEQ ID NO: 1497001 - RNA, 16 nt, Pseudomonas aeruginosa PA01
ggcgcguaggcgaaca

SEQ ID NO: 1497002 - RNA, 17 nt, Pseudomonas aeruginosa PA01
ggcgcguugcccagccc

SEQ ID NO: 1497003 - RNA, 19 nt, Pseudomonas aeruginosa PA01
ggcgcguucucccugagcc

SEQ ID NO: 1497004 - RNA, 18 nt, Pseudomonas aeruginosa PA01
ggcgcguucucugucgga

SEQ ID NO: 1497005 - RNA, 15 nt, Pseudomonas aeruginosa PA01
ggcgcuccgccgaac

SEQ ID NO: 1497006 - RNA, 18 nt, Pseudomonas aeruginosa PA01
ggcgcuccgccgaacgcc

SEQ ID NO: 1497007 - RNA, 18 nt, Pseudomonas aeruginosa PA01
ggcgcuccggaacgccug

SEQ ID NO: 1497008 - RNA, 19 nt, Pseudomonas aeruginosa PA01
ggcgcuccggaacgccugc

SEQ ID NO: 1497009 - RNA, 17 nt, Pseudomonas aeruginosa PA01
ggcgcuccuccagcgcc

SEQ ID NO: 1497010 - RNA, 20 nt, Pseudomonas aeruginosa PA01
ggcgcuccuccagcgccgcc

SEQ ID NO: 1497011 - RNA, 21 nt, Pseudomonas aeruginosa PA01
ggcgcuccuccagcgccgcca

SEQ ID NO: 1497012 - RNA, 15 nt, Pseudomonas aeruginosa PA01
ggcgcuccuccucga

SEQ ID NO: 1497013 - RNA, 20 nt, Pseudomonas aeruginosa PA01
ggcgcuccuggagguucggc

SEQ ID NO: 1497014 - RNA, 20 nt, Pseudomonas aeruginosa PA01
ggcgcuccuggugcggcacc

SEQ ID NO: 1497015 - RNA, 20 nt, Pseudomonas aeruginosa PA01
ggcgcuccuugagcagcucg

SEQ ID NO: 1497016 - RNA, 19 nt, Pseudomonas aeruginosa PA01
ggcgcuacgaaggcgugcc

SEQ ID NO: 1497017 - RNA, 13 nt, Pseudomonas aeruginosa PA01
ggcgcuaccgcgc

SEQ ID NO: 1497018 - RNA, 22 nt, Pseudomonas aeruginosa PA01
ggcgcuaccgcgcauggcggcg

SEQ ID NO: 1497019 - RNA, 14 nt, Pseudomonas aeruginosa PA01
ggcgcuacgcucgc

SEQ ID NO: 1497020 - RNA, 17 nt, Pseudomonas aeruginosa PA01
ggcgcuacgcucgccga

SEQ ID NO: 1497021 - RNA, 15 nt, Pseudomonas aeruginosa PA01
ggcgcuggcgggcgc

SEQ ID NO: 1497022 - RNA, 12 nt, Pseudomonas aeruginosa PA01
ggcgcuggcggg

SEQ ID NO: 1497023 - RNA, 14 nt, Pseudomonas aeruginosa PA01
ggcgcuggccagcg

SEQ ID NO: 1497024 - RNA, 11 nt, Pseudomonas aeruginosa PA01
ggcgcuggcca

SEQ ID NO: 1497025 - RNA, 13 nt, Pseudomonas aeruginosa PA01
ggcgcuggccagc

SEQ ID NO: 1497026 - RNA, 12 nt, Pseudomonas aeruginosa PA01
ggcgcuggccga

SEQ ID NO: 1497027 - RNA, 12 nt, Pseudomonas aeruginosa PA01
ggcgcuggccgc

SEQ ID NO: 1497028 - RNA, 16 nt, Pseudomonas aeruginosa PA01
ggcgcuggcgccgaug

SEQ ID NO: 1497029 - RNA, 17 nt, Pseudomonas aeruginosa PA01
ggcgcuggcgccgaugc

SEQ ID NO: 1497030 - RNA, 22 nt, Pseudomonas aeruginosa PA01
ggcgcuggccgcgcgaccgcgg

SEQ ID NO: 1497031 - RNA, 23 nt, Pseudomonas aeruginosa PA01
ggcgcuggccgcgcgaccgcggc

SEQ ID NO: 1497032 - RNA, 20 nt, Pseudomonas aeruginosa PA01
ggcgcugcgguaccagcgca

SEQ ID NO: 1497033 - RNA, 23 nt, Pseudomonas aeruginosa PA01
ggcgcugcugguggacgucgucg

SEQ ID NO: 1497034 - RNA, 22 nt, Pseudomonas aeruginosa PA01
ggcgcugcccggguugagguag

SEQ ID NO: 1497035 - RNA, 12 nt, Pseudomonas aeruginosa PA01
ggcgcugcagcc

SEQ ID NO: 1497036 - RNA, 14 nt, Pseudomonas aeruginosa PA01
ggcgcugagcgccu

SEQ ID NO: 1497037 - RNA, 22 nt, Pseudomonas aeruginosa PA01
ggcgcugagcgccucgaucgcc

SEQ ID NO: 1497038 - RNA, 23 nt, Pseudomonas aeruginosa PA01
ggcgcugagcgccucgaucgccu

SEQ ID NO: 1497039 - RNA, 14 nt, Pseudomonas aeruginosa PA01
ggcgcugagcgcgg

SEQ ID NO: 1497040 - RNA, 16 nt, Pseudomonas aeruginosa PA01
ggcgcugagcgcgguc

SEQ ID NO: 1497041 - RNA, 19 nt, Pseudomonas aeruginosa PA01
ggcgcugaggaagagcagc

SEQ ID NO: 1497042 - RNA, 21 nt, Pseudomonas aeruginosa PA01
ggcgcugaggaagagcagcgc

SEQ ID NO: 1497043 - RNA, 22 nt, Pseudomonas aeruginosa PA01
ggcgcugaggaagagcagcgcg

SEQ ID NO: 1497044 - RNA, 17 nt, Pseudomonas aeruginosa PA01
ggcgcugaggaucagcc

SEQ ID NO: 1497045 - RNA, 18 nt, Pseudomonas aeruginosa PA01
ggcgcugaggaucagcca

SEQ ID NO: 1497046 - RNA, 20 nt, Pseudomonas aeruginosa PA01
ggcgcugaggaucagccagc

SEQ ID NO: 1497047 - RNA, 21 nt, Pseudomonas aeruginosa PA01
ggcgcugaggaucagccagcc

SEQ ID NO: 1497048 - RNA, 22 nt, Pseudomonas aeruginosa PA01
ggcgcugaggaucagccagccg

SEQ ID NO: 1497049 - RNA, 19 nt, Pseudomonas aeruginosa PA01
ggcgcugcaaucgcugccg

SEQ ID NO: 1497050 - RNA, 13 nt, Pseudomonas aeruginosa PA01
ggcgcugccgaac

SEQ ID NO: 1497051 - RNA, 14 nt, Pseudomonas aeruginosa PA01
ggcgcugccgauca

SEQ ID NO: 1497052 - RNA, 17 nt, Pseudomonas aeruginosa PA01
ggcgcugccgaucagcc

SEQ ID NO: 1497053 - RNA, 22 nt, Pseudomonas aeruginosa PA01
ggcgcugccguagaggucgccg

SEQ ID NO: 1497054 - RNA, 16 nt, Pseudomonas aeruginosa PA01
ggcgcugccggccagg

SEQ ID NO: 1497055 - RNA, 20 nt, Pseudomonas aeruginosa PA01
ggcgcugccggccagggucg

SEQ ID NO: 1497056 - RNA, 15 nt, Pseudomonas aeruginosa PA01
ggcgcugcgagcgcu

SEQ ID NO: 1497057 - RNA, 20 nt, Pseudomonas aeruginosa PA01
ggcgcgggucuucaggccgc

SEQ ID NO: 1497058 - RNA, 21 nt, Pseudomonas aeruginosa PA01
ggcgcgggucaucggcccgac

SEQ ID NO: 1497059 - RNA, 16 nt, Pseudomonas aeruginosa PA01
ggcgcggguguccucg

SEQ ID NO: 1497060 - RNA, 22 nt, Pseudomonas aeruginosa PA01
ggcgcggguucgugccaggcgg

SEQ ID NO: 1497061 - RNA, 23 nt, Pseudomonas aeruginosa PA01
ggcgcggguucgugccaggcggc

SEQ ID NO: 1497062 - RNA, 15 nt, Pseudomonas aeruginosa PA01
ggcgcgguccgcggu

SEQ ID NO: 1497063 - RNA, 16 nt, Pseudomonas aeruginosa PA01
ggcgcgguccgcggua

SEQ ID NO: 1497064 - RNA, 14 nt, Pseudomonas aeruginosa PA01
ggcgcggugccgug

SEQ ID NO: 1497065 - RNA, 18 nt, Pseudomonas aeruginosa PA01
ggcgcgguugccgcugcg

SEQ ID NO: 1497066 - RNA, 21 nt, Pseudomonas aeruginosa PA01
ggcgcgguugccgcugcggcg

SEQ ID NO: 1497067 - RNA, 22 nt, Pseudomonas aeruginosa PA01
ggcgcggugggccuugagcaug

SEQ ID NO: 1497068 - RNA, 20 nt, Pseudomonas aeruginosa PA01
ggcgcguacgcccgcagcca

SEQ ID NO: 1497069 - RNA, 19 nt, Pseudomonas aeruginosa PA01
ggcgcgguuucgcagcgcu

SEQ ID NO: 1497070 - RNA, 22 nt, Pseudomonas aeruginosa PA01
ggcgcgguuucgcagcgcuccu

SEQ ID NO: 1497071 - RNA, 17 nt, Pseudomonas aeruginosa PA01
ggcgcgucaugccgccg

SEQ ID NO: 1497072 - RNA, 22 nt, Pseudomonas aeruginosa PA01
ggcgcggacgauggucgccgcg

SEQ ID NO: 1497073 - RNA, 16 nt, Pseudomonas aeruginosa PA01
ggcgcggacggccugc

SEQ ID NO: 1497074 - RNA, 16 nt, Pseudomonas aeruginosa PA01
ggcgcggacgggccgc

SEQ ID NO: 1497075 - RNA, 13 nt, Pseudomonas aeruginosa PA01
ggcgcggaccgca

SEQ ID NO: 1497076 - RNA, 21 nt, Pseudomonas aeruginosa PA01
ggcgcgcugguuuagcucggc

SEQ ID NO: 1497077 - RNA, 19 nt, Pseudomonas aeruginosa PA01
ggcgcggacauggcgcucg

SEQ ID NO: 1497078 - RNA, 23 nt, Pseudomonas aeruginosa PA01
ggcgcggacauggcgcucgagcu

SEQ ID NO: 1497079 - RNA, 13 nt, Pseudomonas aeruginosa PA01
ggcgcggaucggc

SEQ ID NO: 1497080 - RNA, 20 nt, Pseudomonas aeruginosa PA01
ggcgcgggccuucaggcugc

SEQ ID NO: 1497081 - RNA, 16 nt, Pseudomonas aeruginosa PA01
ggcgcgggcgaaggcc

SEQ ID NO: 1497082 - RNA, 18 nt, Pseudomonas aeruginosa PA01
ggcgcgggcgaaggccuc

SEQ ID NO: 1497083 - RNA, 13 nt, Pseudomonas aeruginosa PA01
ggcgcgggcgcgc

SEQ ID NO: 1497084 - RNA, 16 nt, Pseudomonas aeruginosa PA01
ggcgcgggcgcgcgcc

SEQ ID NO: 1497085 - RNA, 17 nt, Pseudomonas aeruginosa PA01
ggcgcgggcgcgcgcca

SEQ ID NO: 1497086 - RNA, 14 nt, Pseudomonas aeruginosa PA01
ggcgcgggcggccu

SEQ ID NO: 1497087 - RNA, 13 nt, Pseudomonas aeruginosa PA01
ggcgcgggcgccg

SEQ ID NO: 1497088 - RNA, 16 nt, Pseudomonas aeruginosa PA01
ggcgcgggcggcggcg

SEQ ID NO: 1497089 - RNA, 16 nt, Pseudomonas aeruginosa PA01
ggcgcgggcggccucg

SEQ ID NO: 1497090 - RNA, 16 nt, Pseudomonas aeruginosa PA01
ggcgcggggccccggc

SEQ ID NO: 1497091 - RNA, 16 nt, Pseudomonas aeruginosa PA01
ggcgcgcgcgccaggu

SEQ ID NO: 1497092 - RNA, 22 nt, Pseudomonas aeruginosa PA01
ggcgcgcgcgcugccaguggcg

SEQ ID NO: 1497093 - RNA, 23 nt, Pseudomonas aeruginosa PA01
ggcgcgcggccagcgcggccgcc

SEQ ID NO: 1497094 - RNA, 19 nt, Pseudomonas aeruginosa PA01
ggcgcgcggcagcaccagg

SEQ ID NO: 1497095 - RNA, 12 nt, Pseudomonas aeruginosa PA01
ggcgcgcggcca

SEQ ID NO: 1497096 - RNA, 20 nt, Pseudomonas aeruginosa PA01
ggcgcgcggucuucaucacc

SEQ ID NO: 1497097 - RNA, 22 nt, Pseudomonas aeruginosa PA01
ggcgcgcggucuucaucaccuu

SEQ ID NO: 1497098 - RNA, 14 nt, Pseudomonas aeruginosa PA01
ggcgcgcgucgaug

SEQ ID NO: 1497099 - RNA, 20 nt, Pseudomonas aeruginosa PA01
ggcgcgcgucguccagggcg

SEQ ID NO: 1497100 - RNA, 18 nt, Pseudomonas aeruginosa PA01
ggcgcgcgggccuucgcc

SEQ ID NO: 1497101 - RNA, 16 nt, Pseudomonas aeruginosa PA01
ggcgcgcugcggguca

SEQ ID NO: 1497102 - RNA, 21 nt, Pseudomonas aeruginosa PA01
ggcgcgcugcgugcgccgcuc

SEQ ID NO: 1497103 - RNA, 22 nt, Pseudomonas aeruginosa PA01
ggcgcgcugcgugcgccgcucg

SEQ ID NO: 1497104 - RNA, 11 nt, Pseudomonas aeruginosa PA01
ggcgcgcuggc

SEQ ID NO: 1497105 - RNA, 18 nt, Pseudomonas aeruginosa PA01
ggcgcgcuggcagaacgc

SEQ ID NO: 1497106 - RNA, 21 nt, Pseudomonas aeruginosa PA01
ggcgcgcuuuccggcgcggcc

SEQ ID NO: 1497107 - RNA, 22 nt, Pseudomonas aeruginosa PA01
ggcgcgcuuuccggcgcggccu

SEQ ID NO: 1497108 - RNA, 24 nt, Pseudomonas aeruginosa PA01
ggcgcgcuuuccggcgcggccugc

SEQ ID NO: 1497109 - RNA, 17 nt, Pseudomonas aeruginosa PA01
ggcgcggaagcgccugc

SEQ ID NO: 1497110 - RNA, 16 nt, Pseudomonas aeruginosa PA01
ggcgcgcuugccgcug

SEQ ID NO: 1497111 - RNA, 18 nt, Pseudomonas aeruginosa PA01
ggcgcgcuccggcgcgcc

SEQ ID NO: 1497112 - RNA, 16 nt, Pseudomonas aeruginosa PA01
ggcgccugagcagcgc

SEQ ID NO: 1497113 - RNA, 16 nt, Pseudomonas aeruginosa PA01
ggcgccuuccaggcgu

SEQ ID NO: 1497114 - RNA, 19 nt, Pseudomonas aeruginosa PA01
ggcgccuucgccggaagcu

SEQ ID NO: 1497115 - RNA, 16 nt, Pseudomonas aeruginosa PA01
ggcgccuucgggcgcc

SEQ ID NO: 1497116 - RNA, 13 nt, Pseudomonas aeruginosa PA01
ggcgccuugcgcc

SEQ ID NO: 1497117 - RNA, 19 nt, Pseudomonas aeruginosa PA01
ggcgccuugcgccaggccu

SEQ ID NO: 1497118 - RNA, 21 nt, Pseudomonas aeruginosa PA01
ggcgccuuuuucauggccugg

SEQ ID NO: 1497119 - RNA, 22 nt, Pseudomonas aeruginosa PA01
ggcgccuuuuucauggccuggc

SEQ ID NO: 1497120 - RNA, 23 nt, Pseudomonas aeruginosa PA01
ggcgccuuuuucauggccuggcg

SEQ ID NO: 1497121 - RNA, 14 nt, Pseudomonas aeruginosa PA01
ggcgcgaccgucgg

SEQ ID NO: 1497122 - RNA, 12 nt, Pseudomonas aeruginosa PA01
ggcgcgaccgcc

SEQ ID NO: 1497123 - RNA, 15 nt, Pseudomonas aeruginosa PA01
ggcgcgaccgcccgc

SEQ ID NO: 1497124 - RNA, 16 nt, Pseudomonas aeruginosa PA01
ggcgcgaccgcccgcc

SEQ ID NO: 1497125 - RNA, 14 nt, Pseudomonas aeruginosa PA01
ggcgcgcgccgggc

SEQ ID NO: 1497126 - RNA, 17 nt, Pseudomonas aeruginosa PA01
ggcgcgcgccgggcuca

SEQ ID NO: 1497127 - RNA, 19 nt, Pseudomonas aeruginosa PA01
ggcgcgcgccucagcggcu

SEQ ID NO: 1497128 - RNA, 16 nt, Pseudomonas aeruginosa PA01
ggcgcgacgaggcgcg

SEQ ID NO: 1497129 - RNA, 17 nt, Pseudomonas aeruginosa PA01
ggcgcgacgaggcgcgg

SEQ ID NO: 1497130 - RNA, 21 nt, Pseudomonas aeruginosa PA01
ggcgcgacgaggcgcggcgga

SEQ ID NO: 1497131 - RNA, 15 nt, Pseudomonas aeruginosa PA01
ggcgcgaaccagcag

SEQ ID NO: 1497132 - RNA, 17 nt, Pseudomonas aeruginosa PA01
ggcgcgacagcucgugg

SEQ ID NO: 1497133 - RNA, 22 nt, Pseudomonas aeruginosa PA01
ggcgcgacagcucguggcuggc

SEQ ID NO: 1497134 - RNA, 23 nt, Pseudomonas aeruginosa PA01
ggcgcgacagcucguggcuggcg

SEQ ID NO: 1497135 - RNA, 17 nt, Pseudomonas aeruginosa PA01
ggcgcgaaucuucggcg

SEQ ID NO: 1497136 - RNA, 19 nt, Pseudomonas aeruginosa PA01
ggcgcgaaguagcgggaga

SEQ ID NO: 1497137 - RNA, 17 nt, Pseudomonas aeruginosa PA01
ggcgcgaagucgcaguc

SEQ ID NO: 1497138 - RNA, 21 nt, Pseudomonas aeruginosa PA01
ggcguuuuucauggcggcauc

SEQ ID NO: 1497139 - RNA, 21 nt, Pseudomonas aeruginosa PA01
ggcguuuuuucuuuccagcgc

SEQ ID NO: 1497140 - RNA, 14 nt, Pseudomonas aeruginosa PA01
ggcuaacuguucgg

SEQ ID NO: 1497141 - RNA, 19 nt, Pseudomonas aeruginosa PA01
ggcguuuucguugccgcgc

SEQ ID NO: 1497142 - RNA, 22 nt, Pseudomonas aeruginosa PA01
ggcguuuucguugccgcgcucg

SEQ ID NO: 1497143 - RNA, 19 nt, Pseudomonas aeruginosa PA01
ggcguuuucguuggcgcga

SEQ ID NO: 1497144 - RNA, 23 nt, Pseudomonas aeruginosa PA01
ggcguuuucguuggcgcgaccgc

SEQ ID NO: 1497145 - RNA, 19 nt, Pseudomonas aeruginosa PA01
ggcguuuucguuggcggcc

SEQ ID NO: 1497146 - RNA, 20 nt, Pseudomonas aeruginosa PA01
ggcguuuucguuggcggcca

SEQ ID NO: 1497147 - RNA, 23 nt, Pseudomonas aeruginosa PA01
ggcguuuucguuggcggccauca

SEQ ID NO: 1497148 - RNA, 19 nt, Pseudomonas aeruginosa PA01
ggcguuguugccgccgaag

SEQ ID NO: 1497149 - RNA, 19 nt, Pseudomonas aeruginosa PA01
ggcguuguuggucaggcug

SEQ ID NO: 1497150 - RNA, 20 nt, Pseudomonas aeruginosa PA01
ggcguugucggcaaccgggc

SEQ ID NO: 1497151 - RNA, 19 nt, Pseudomonas aeruginosa PA01
ggcguuguagaucugcacc

SEQ ID NO: 1497152 - RNA, 14 nt, Pseudomonas aeruginosa PA01
ggcguugcgcgccu

SEQ ID NO: 1497153 - RNA, 15 nt, Pseudomonas aeruginosa PA01
ggcguugcgcgccuc

SEQ ID NO: 1497154 - RNA, 15 nt, Pseudomonas aeruginosa PA01
ggcguugcccaugau

SEQ ID NO: 1497155 - RNA, 22 nt, Pseudomonas aeruginosa PA01
ggcguugcagugcgccgcagcg

SEQ ID NO: 1497156 - RNA, 13 nt, Pseudomonas aeruginosa PA01
ggcguuggccagc

SEQ ID NO: 1497157 - RNA, 15 nt, Pseudomonas aeruginosa PA01
ggcguuggccagcgc

SEQ ID NO: 1497158 - RNA, 19 nt, Pseudomonas aeruginosa PA01
ggcguuggccgaggaggcc

SEQ ID NO: 1497159 - RNA, 17 nt, Pseudomonas aeruginosa PA01
ggcguuauccgccgaua

SEQ ID NO: 1497160 - RNA, 17 nt, Pseudomonas aeruginosa PA01
ggcguuauccgccgccg

SEQ ID NO: 1497161 - RNA, 21 nt, Pseudomonas aeruginosa PA01
ggcguuauccgccgccgacgu

SEQ ID NO: 1497162 - RNA, 17 nt, Pseudomonas aeruginosa PA01
ggcguuauccgccgcuc

SEQ ID NO: 1497163 - RNA, 22 nt, Pseudomonas aeruginosa PA01
ggcguucugcuucucggcuacc

SEQ ID NO: 1497164 - RNA, 14 nt, Pseudomonas aeruginosa PA01
ggcguucuuggccg

SEQ ID NO: 1497165 - RNA, 17 nt, Pseudomonas aeruginosa PA01
ggcguugaacugcccgc

SEQ ID NO: 1497166 - RNA, 20 nt, Pseudomonas aeruginosa PA01
ggcguugaacugcccgcagg

SEQ ID NO: 1497167 - RNA, 14 nt, Pseudomonas aeruginosa PA01
ggcguucgccgagc

SEQ ID NO: 1497168 - RNA, 15 nt, Pseudomonas aeruginosa PA01
ggcguucgucgaccu

SEQ ID NO: 1497169 - RNA, 20 nt, Pseudomonas aeruginosa PA01
ggcguucgucguggccauag

SEQ ID NO: 1497170 - RNA, 15 nt, Pseudomonas aeruginosa PA01
ggcguuaugcgcccu

SEQ ID NO: 1497171 - RNA, 13 nt, Pseudomonas aeruginosa PA01
ggcguuagccgcc

SEQ ID NO: 1497172 - RNA, 18 nt, Pseudomonas aeruginosa PA01
ggcguuagccgccugcgg

SEQ ID NO: 1497173 - RNA, 14 nt, Pseudomonas aeruginosa PA01
ggcguuccaccagg

SEQ ID NO: 1497174 - RNA, 15 nt, Pseudomonas aeruginosa PA01
ggcguuccaccaggc

SEQ ID NO: 1497175 - RNA, 19 nt, Pseudomonas aeruginosa PA01
ggcguuccaccaggcgucg

SEQ ID NO: 1497176 - RNA, 20 nt, Pseudomonas aeruginosa PA01
ggcguuccaccaggcgucgc

SEQ ID NO: 1497177 - RNA, 18 nt, Pseudomonas aeruginosa PA01
ggcguuccagcucggcga

SEQ ID NO: 1497178 - RNA, 17 nt, Pseudomonas aeruginosa PA01
ggcguuccaggcggcgg

SEQ ID NO: 1497179 - RNA, 19 nt, Pseudomonas aeruginosa PA01
ggcguuccaguucggccgc

SEQ ID NO: 1497180 - RNA, 21 nt, Pseudomonas aeruginosa PA01
ggcgugucgaggaaggccagc

SEQ ID NO: 1497181 - RNA, 19 nt, Pseudomonas aeruginosa PA01
ggcgugguggaugacccgc

SEQ ID NO: 1497182 - RNA, 16 nt, Pseudomonas aeruginosa PA01
ggcgugguggcgggga

SEQ ID NO: 1497183 - RNA, 14 nt, Pseudomonas aeruginosa PA01
ggcguguucgucga

SEQ ID NO: 1497184 - RNA, 16 nt, Pseudomonas aeruginosa PA01
ggcguguucgucgauc

SEQ ID NO: 1497185 - RNA, 17 nt, Pseudomonas aeruginosa PA01
ggcgugggccagcccag

SEQ ID NO: 1497186 - RNA, 18 nt, Pseudomonas aeruginosa PA01
ggcguggcucgaucagcc

SEQ ID NO: 1497187 - RNA, 22 nt, Pseudomonas aeruginosa PA01
ggcguggucuccgugcuggccg

SEQ ID NO: 1497188 - RNA, 13 nt, Pseudomonas aeruginosa PA01
ggcgugggcgccg

SEQ ID NO: 1497189 - RNA, 20 nt, Pseudomonas aeruginosa PA01
ggcgugggcgccggcgcgca

SEQ ID NO: 1497190 - RNA, 14 nt, Pseudomonas aeruginosa PA01
ggcguggucggcgg

SEQ ID NO: 1497191 - RNA, 18 nt, Pseudomonas aeruginosa PA01
ggcuaucccccggccgau

SEQ ID NO: 1497192 - RNA, 20 nt, Pseudomonas aeruginosa PA01
ggcuauccuccaggccgccg

SEQ ID NO: 1497193 - RNA, 24 nt, Pseudomonas aeruginosa PA01
ggcuauccuccaggccgccggcga

SEQ ID NO: 1497194 - RNA, 16 nt, Pseudomonas aeruginosa PA01
ggcuagguuuccccgu

SEQ ID NO: 1497195 - RNA, 17 nt, Pseudomonas aeruginosa PA01
ggcuagucgcgcagcgc

SEQ ID NO: 1497196 - RNA, 16 nt, Pseudomonas aeruginosa PA01
ggcuacuucgccgggu

SEQ ID NO: 1497197 - RNA, 21 nt, Pseudomonas aeruginosa PA01
ggcuacaucgucugcgcggcg

SEQ ID NO: 1497198 - RNA, 20 nt, Pseudomonas aeruginosa PA01
ggcuaccaggaagcucggca

SEQ ID NO: 1497199 - RNA, 13 nt, Pseudomonas aeruginosa PA01
ggcuacaggccgu

SEQ ID NO: 1497200 - RNA, 13 nt, Pseudomonas aeruginosa PA01
ggcuaaccgccuu

SEQ ID NO: 1497201 - RNA, 24 nt, Pseudomonas aeruginosa PA01
ggcuacccgcagggcucgugccau

SEQ ID NO: 1497202 - RNA, 15 nt, Pseudomonas aeruginosa PA01
ggcuacccgcgccuu

SEQ ID NO: 1497203 - RNA, 12 nt, Pseudomonas aeruginosa PA01
ggcucacgcccc

SEQ ID NO: 1497204 - RNA, 22 nt, Pseudomonas aeruginosa PA01
ggcucagauuaucugcgacuga

SEQ ID NO: 1497205 - RNA, 19 nt, Pseudomonas aeruginosa PA01
ggcucacucccguccagcg

SEQ ID NO: 1497206 - RNA, 20 nt, Pseudomonas aeruginosa PA01
ggcucacucccguccagcgc

SEQ ID NO: 1497207 - RNA, 14 nt, Pseudomonas aeruginosa PA01
ggcucagccgcugg

SEQ ID NO: 1497208 - RNA, 17 nt, Pseudomonas aeruginosa PA01
ggcucagccgcuggcgu

SEQ ID NO: 1497209 - RNA, 14 nt, Pseudomonas aeruginosa PA01
ggcucagcccaggc

SEQ ID NO: 1497210 - RNA, 15 nt, Pseudomonas aeruginosa PA01
ggcucagcccaggcg

SEQ ID NO: 1497211 - RNA, 19 nt, Pseudomonas aeruginosa PA01
ggcucagcccaggcgccgc

SEQ ID NO: 1497212 - RNA, 22 nt, Pseudomonas aeruginosa PA01
ggcucagcccaggcgccgcucg

SEQ ID NO: 1497213 - RNA, 22 nt, Pseudomonas aeruginosa PA01
ggcucagcgcaugcggaaggcu

SEQ ID NO: 1497214 - RNA, 12 nt, Pseudomonas aeruginosa PA01
ggcucagcgcgc

SEQ ID NO: 1497215 - RNA, 23 nt, Pseudomonas aeruginosa PA01
ggcucagcgcgccgaguucgccg

SEQ ID NO: 1497216 - RNA, 20 nt, Pseudomonas aeruginosa PA01
ggcucagcgcggcggcggcc

SEQ ID NO: 1497217 - RNA, 15 nt, Pseudomonas aeruginosa PA01
ggcucaacugguugg

SEQ ID NO: 1497218 - RNA, 20 nt, Pseudomonas aeruginosa PA01
ggcucaacugguuggccgcc

SEQ ID NO: 1497219 - RNA, 14 nt, Pseudomonas aeruginosa PA01
ggcuauucccgccg

SEQ ID NO: 1497220 - RNA, 22 nt, Pseudomonas aeruginosa PA01
ggcuauucccgccgcuccggcu

SEQ ID NO: 1497221 - RNA, 21 nt, Pseudomonas aeruginosa PA01
ggcuccagcgggaaggucggc

SEQ ID NO: 1497222 - RNA, 17 nt, Pseudomonas aeruginosa PA01
ggcuccaggaccggcag

SEQ ID NO: 1497223 - RNA, 22 nt, Pseudomonas aeruginosa PA01
ggcuccaggaccggcaggucgg

SEQ ID NO: 1497224 - RNA, 15 nt, Pseudomonas aeruginosa PA01
ggcuccacugcuugg

SEQ ID NO: 1497225 - RNA, 17 nt, Pseudomonas aeruginosa PA01
ggcuccacugcuuggcc

SEQ ID NO: 1497226 - RNA, 20 nt, Pseudomonas aeruginosa PA01
ggcuccacugcuuggccagg

SEQ ID NO: 1497227 - RNA, 22 nt, Pseudomonas aeruginosa PA01
ggcuccacugcuuggccaggcg

SEQ ID NO: 1497228 - RNA, 17 nt, Pseudomonas aeruginosa PA01
ggcuccagcaucaccuu

SEQ ID NO: 1497229 - RNA, 18 nt, Pseudomonas aeruginosa PA01
ggcuccagccaggcccgg

SEQ ID NO: 1497230 - RNA, 19 nt, Pseudomonas aeruginosa PA01
ggcuccagccaggcccggu

SEQ ID NO: 1497231 - RNA, 14 nt, Pseudomonas aeruginosa PA01
ggcuccagccgcug

SEQ ID NO: 1497232 - RNA, 16 nt, Pseudomonas aeruginosa PA01
ggcuccagccgcugca

SEQ ID NO: 1497233 - RNA, 14 nt, Pseudomonas aeruginosa PA01
ggcucagcgcuucg

SEQ ID NO: 1497234 - RNA, 18 nt, Pseudomonas aeruginosa PA01
ggcucaggcacucgauga

SEQ ID NO: 1497235 - RNA, 16 nt, Pseudomonas aeruginosa PA01
ggcucagcucggcgau

SEQ ID NO: 1497236 - RNA, 21 nt, Pseudomonas aeruginosa PA01
ggcucagcucggcgaugccgc

SEQ ID NO: 1497237 - RNA, 20 nt, Pseudomonas aeruginosa PA01
ggcucagcucucccgaggcg

SEQ ID NO: 1497238 - RNA, 16 nt, Pseudomonas aeruginosa PA01
ggcucaguucggccag

SEQ ID NO: 1497239 - RNA, 15 nt, Pseudomonas aeruginosa PA01
ggcucaggccgccgc

SEQ ID NO: 1497240 - RNA, 16 nt, Pseudomonas aeruginosa PA01
ggcucaggccgccgcg

SEQ ID NO: 1497241 - RNA, 12 nt, Pseudomonas aeruginosa PA01
ggcucaggccgg

SEQ ID NO: 1497242 - RNA, 16 nt, Pseudomonas aeruginosa PA01
ggcucaggccgggcac

SEQ ID NO: 1497243 - RNA, 19 nt, Pseudomonas aeruginosa PA01
ggcucaucgcccgcccucg

SEQ ID NO: 1497244 - RNA, 15 nt, Pseudomonas aeruginosa PA01
ggcucaucucguuga

SEQ ID NO: 1497245 - RNA, 23 nt, Pseudomonas aeruginosa PA01
ggcucauggccgggguucuucgu

SEQ ID NO: 1497246 - RNA, 13 nt, Pseudomonas aeruginosa PA01
ggcucaugggcga

SEQ ID NO: 1497247 - RNA, 17 nt, Pseudomonas aeruginosa PA01
ggcucaugggcgaugcg

SEQ ID NO: 1497248 - RNA, 19 nt, Pseudomonas aeruginosa PA01
ggcuccggcgccaggccgg

SEQ ID NO: 1497249 - RNA, 21 nt, Pseudomonas aeruginosa PA01
ggcuccucugccugcgcccuc

SEQ ID NO: 1497250 - RNA, 18 nt, Pseudomonas aeruginosa PA01
ggcuccggguacuggcgc

SEQ ID NO: 1497251 - RNA, 15 nt, Pseudomonas aeruginosa PA01
ggcucgacaggucgg

SEQ ID NO: 1497252 - RNA, 19 nt, Pseudomonas aeruginosa PA01
ggcucgacaggucggcgaa

SEQ ID NO: 1497253 - RNA, 13 nt, Pseudomonas aeruginosa PA01
ggcuccgccgccg

SEQ ID NO: 1497254 - RNA, 15 nt, Pseudomonas aeruginosa PA01
ggcuccgccgcgagc

SEQ ID NO: 1497255 - RNA, 21 nt, Pseudomonas aeruginosa PA01
ggcuccgcgcacggaucgcgc

SEQ ID NO: 1497256 - RNA, 18 nt, Pseudomonas aeruginosa PA01
ggcuccgcgcguucagcc

SEQ ID NO: 1497257 - RNA, 19 nt, Pseudomonas aeruginosa PA01
ggcuccggauggcugaccc

SEQ ID NO: 1497258 - RNA, 15 nt, Pseudomonas aeruginosa PA01
ggcuccgacuggugg

SEQ ID NO: 1497259 - RNA, 13 nt, Pseudomonas aeruginosa PA01
ggcuccagggcga

SEQ ID NO: 1497260 - RNA, 18 nt, Pseudomonas aeruginosa PA01
ggcuccaguugcagcacc

SEQ ID NO: 1497261 - RNA, 19 nt, Pseudomonas aeruginosa PA01
ggcgugccguggcucggcg

SEQ ID NO: 1497262 - RNA, 14 nt, Pseudomonas aeruginosa PA01
ggcgugccuguucc

SEQ ID NO: 1497263 - RNA, 21 nt, Pseudomonas aeruginosa PA01
ggcgugccuguuccuccgcca

SEQ ID NO: 1497264 - RNA, 12 nt, Pseudomonas aeruginosa PA01
ggcgugccgcug

SEQ ID NO: 1497265 - RNA, 17 nt, Pseudomonas aeruginosa PA01
ggcgugccgcuggccga

SEQ ID NO: 1497266 - RNA, 21 nt, Pseudomonas aeruginosa PA01
ggcgugcuccagcaccguggc

SEQ ID NO: 1497267 - RNA, 21 nt, Pseudomonas aeruginosa PA01
ggcgugcuggcuauucgccca

SEQ ID NO: 1497268 - RNA, 14 nt, Pseudomonas aeruginosa PA01
ggcgugcuuggcga

SEQ ID NO: 1497269 - RNA, 21 nt, Pseudomonas aeruginosa PA01
ggcgugcuuggcgaggcgcgc

SEQ ID NO: 1497270 - RNA, 15 nt, Pseudomonas aeruginosa PA01
ggcguggaaggccac

SEQ ID NO: 1497271 - RNA, 14 nt, Pseudomonas aeruginosa PA01
ggcgugcucggcga

SEQ ID NO: 1497272 - RNA, 20 nt, Pseudomonas aeruginosa PA01
ggcgugcucggcgaucucgc

SEQ ID NO: 1497273 - RNA, 13 nt, Pseudomonas aeruginosa PA01
ggcguggccggcg

SEQ ID NO: 1497274 - RNA, 19 nt, Pseudomonas aeruginosa PA01
ggcguggcgaucaggcagc

SEQ ID NO: 1497275 - RNA, 15 nt, Pseudomonas aeruginosa PA01
ggcguggcggccgcc

SEQ ID NO: 1497276 - RNA, 16 nt, Pseudomonas aeruginosa PA01
ggcguggcggccgccg

SEQ ID NO: 1497277 - RNA, 14 nt, Pseudomonas aeruginosa PA01
ggcgugcaggccga

SEQ ID NO: 1497278 - RNA, 17 nt, Pseudomonas aeruginosa PA01
ggcgugcaggccgauca

SEQ ID NO: 1497279 - RNA, 20 nt, Pseudomonas aeruginosa PA01
ggcgugcaggccgaucagga

SEQ ID NO: 1497280 - RNA, 14 nt, Pseudomonas aeruginosa PA01
ggcgugcaggccgc

SEQ ID NO: 1497281 - RNA, 16 nt, Pseudomonas aeruginosa PA01
ggcgugcaggccgccg

SEQ ID NO: 1497282 - RNA, 15 nt, Pseudomonas aeruginosa PA01
ggcgugauccgcagg

SEQ ID NO: 1497283 - RNA, 21 nt, Pseudomonas aeruginosa PA01
ggcgugcccuuuuccuccagg

SEQ ID NO: 1497284 - RNA, 20 nt, Pseudomonas aeruginosa PA01
ggcgugccgaccuguaccgc

SEQ ID NO: 1497285 - RNA, 17 nt, Pseudomonas aeruginosa PA01
ggcgugccgcaggccgc

SEQ ID NO: 1497286 - RNA, 14 nt, Pseudomonas aeruginosa PA01
ggcgugccgccagg

SEQ ID NO: 1497287 - RNA, 17 nt, Pseudomonas aeruginosa PA01
ggcgugccgccaggccu

SEQ ID NO: 1497288 - RNA, 21 nt, Pseudomonas aeruginosa PA01
ggcgugccgccaggccuucca

SEQ ID NO: 1497289 - RNA, 14 nt, Pseudomonas aeruginosa PA01
ggcgugccgggcag

SEQ ID NO: 1497290 - RNA, 17 nt, Pseudomonas aeruginosa PA01
ggcgugccgggccggcc

SEQ ID NO: 1497291 - RNA, 23 nt, Pseudomonas aeruginosa PA01
ggcgugcaggguauuuuccagca

SEQ ID NO: 1497292 - RNA, 22 nt, Pseudomonas aeruginosa PA01
ggcgugcaguacuuggccagca

SEQ ID NO: 1497293 - RNA, 23 nt, Pseudomonas aeruginosa PA01
ggcgugcauggccgggccgauca

SEQ ID NO: 1497294 - RNA, 15 nt, Pseudomonas aeruginosa PA01
ggcgugccaggagcu

SEQ ID NO: 1497295 - RNA, 22 nt, Pseudomonas aeruginosa PA01
ggcgugcccauccgcucggcga

SEQ ID NO: 1497296 - RNA, 22 nt, Pseudomonas aeruginosa PA01
ggcgucguccugcgcggcgacg

SEQ ID NO: 1497297 - RNA, 20 nt, Pseudomonas aeruginosa PA01
ggcgucgggcgaaacggcag

SEQ ID NO: 1497298 - RNA, 13 nt, Pseudomonas aeruginosa PA01
ggcgucgucgauc

SEQ ID NO: 1497299 - RNA, 16 nt, Pseudomonas aeruginosa PA01
ggcgucgucgaucgga

SEQ ID NO: 1497300 - RNA, 20 nt, Pseudomonas aeruginosa PA01
ggcgucgucggggugccgcc

SEQ ID NO: 1497301 - RNA, 21 nt, Pseudomonas aeruginosa PA01
ggcgucgucgcugcgcggguc

SEQ ID NO: 1497302 - RNA, 13 nt, Pseudomonas aeruginosa PA01
ggcgucguugccg

SEQ ID NO: 1497303 - RNA, 22 nt, Pseudomonas aeruginosa PA01
ggcgucucauggaacagcagcc

SEQ ID NO: 1497304 - RNA, 17 nt, Pseudomonas aeruginosa PA01
ggcgucuccugccgccg

SEQ ID NO: 1497305 - RNA, 16 nt, Pseudomonas aeruginosa PA01
ggcgugaagccgccgc

SEQ ID NO: 1497306 - RNA, 15 nt, Pseudomonas aeruginosa PA01
ggcgugaaguagccg

SEQ ID NO: 1497307 - RNA, 18 nt, Pseudomonas aeruginosa PA01
ggcgugaaguagccgccg

SEQ ID NO: 1497308 - RNA, 16 nt, Pseudomonas aeruginosa PA01
ggcgugaacgcggcga

SEQ ID NO: 1497309 - RNA, 18 nt, Pseudomonas aeruginosa PA01
ggcgucuuccggcucgcc

SEQ ID NO: 1497310 - RNA, 16 nt, Pseudomonas aeruginosa PA01
ggcgucuucggcggcg

SEQ ID NO: 1497311 - RNA, 20 nt, Pseudomonas aeruginosa PA01
ggcgucuucggcggcgccgg

SEQ ID NO: 1497312 - RNA, 22 nt, Pseudomonas aeruginosa PA01
ggcgucuucggcggcgccggug

SEQ ID NO: 1497313 - RNA, 15 nt, Pseudomonas aeruginosa PA01
ggcgucugccgcucg

SEQ ID NO: 1497314 - RNA, 21 nt, Pseudomonas aeruginosa PA01
ggcgucucggagugaggccga

SEQ ID NO: 1497315 - RNA, 23 nt, Pseudomonas aeruginosa PA01
ggcgucucggagugaggccgagc

SEQ ID NO: 1497316 - RNA, 16 nt, Pseudomonas aeruginosa PA01
ggcgucugcucauucg

SEQ ID NO: 1497317 - RNA, 22 nt, Pseudomonas aeruginosa PA01
ggcgucugcucauucggccagc

SEQ ID NO: 1497318 - RNA, 23 nt, Pseudomonas aeruginosa PA01
ggcgucugcucauucggccagcg

SEQ ID NO: 1497319 - RNA, 20 nt, Pseudomonas aeruginosa PA01
ggcgucuggggugaggccga

SEQ ID NO: 1497320 - RNA, 21 nt, Pseudomonas aeruginosa PA01
ggcgucuggggugaggccgag

SEQ ID NO: 1497321 - RNA, 15 nt, Pseudomonas aeruginosa PA01
ggcguccgcuggccu

SEQ ID NO: 1497322 - RNA, 15 nt, Pseudomonas aeruginosa PA01
ggcguccggcgagca

SEQ ID NO: 1497323 - RNA, 20 nt, Pseudomonas aeruginosa PA01
ggcgucccuggagcagggcg

SEQ ID NO: 1497324 - RNA, 18 nt, Pseudomonas aeruginosa PA01
ggcguccuugggaucguc

SEQ ID NO: 1497325 - RNA, 20 nt, Pseudomonas aeruginosa PA01
ggcguccuugggaucgucga

SEQ ID NO: 1497326 - RNA, 16 nt, Pseudomonas aeruginosa PA01
ggcguccuugcccggc

SEQ ID NO: 1497327 - RNA, 20 nt, Pseudomonas aeruginosa PA01
ggcguccuugcccggcgcca

SEQ ID NO: 1497328 - RNA, 13 nt, Pseudomonas aeruginosa PA01
ggcguccuugccg

SEQ ID NO: 1497329 - RNA, 14 nt, Pseudomonas aeruginosa PA01
ggcguccuggucga

SEQ ID NO: 1497330 - RNA, 14 nt, Pseudomonas aeruginosa PA01
ggcguccucggaga

SEQ ID NO: 1497331 - RNA, 18 nt, Pseudomonas aeruginosa PA01
ggcguccuugccgaggaa

SEQ ID NO: 1497332 - RNA, 18 nt, Pseudomonas aeruginosa PA01
ggcgucgaaacgggcgcu

SEQ ID NO: 1497333 - RNA, 23 nt, Pseudomonas aeruginosa PA01
ggcgucgaaacgggcgcucuggc

SEQ ID NO: 1497334 - RNA, 19 nt, Pseudomonas aeruginosa PA01
ggcgucgaaaugcucgugc

SEQ ID NO: 1497335 - RNA, 20 nt, Pseudomonas aeruginosa PA01
ggcgucgaaaugcucgugca

SEQ ID NO: 1497336 - RNA, 16 nt, Pseudomonas aeruginosa PA01
ggcgucgaaggcggcg

SEQ ID NO: 1497337 - RNA, 15 nt, Pseudomonas aeruginosa PA01
ggcgucgaaggccuc

SEQ ID NO: 1497338 - RNA, 19 nt, Pseudomonas aeruginosa PA01
ggcgucgaacaccggcgcc

SEQ ID NO: 1497339 - RNA, 21 nt, Pseudomonas aeruginosa PA01
ggcgucgaacaccggcgccgc

SEQ ID NO: 1497340 - RNA, 16 nt, Pseudomonas aeruginosa PA01
ggcgggcgccaucgcu

SEQ ID NO: 1497341 - RNA, 17 nt, Pseudomonas aeruginosa PA01
ggcguccaguagcgccu

SEQ ID NO: 1497342 - RNA, 15 nt, Pseudomonas aeruginosa PA01
ggcgggccgcucagg

SEQ ID NO: 1497343 - RNA, 13 nt, Pseudomonas aeruginosa PA01
ggcgggccgcucg

SEQ ID NO: 1497344 - RNA, 15 nt, Pseudomonas aeruginosa PA01
ggcgggccgcucgcg

SEQ ID NO: 1497345 - RNA, 17 nt, Pseudomonas aeruginosa PA01
ggcgggccgcucgcgcg

SEQ ID NO: 1497346 - RNA, 15 nt, Pseudomonas aeruginosa PA01
ggcgggccgcgccuu

SEQ ID NO: 1497347 - RNA, 19 nt, Pseudomonas aeruginosa PA01
ggcgggccgcgccuuucgc

SEQ ID NO: 1497348 - RNA, 12 nt, Pseudomonas aeruginosa PA01
ggcgggccgcgc

SEQ ID NO: 1497349 - RNA, 12 nt, Pseudomonas aeruginosa PA01
ggcgggccuugc

SEQ ID NO: 1497350 - RNA, 16 nt, Pseudomonas aeruginosa PA01
ggcgggccuugcgacc

SEQ ID NO: 1497351 - RNA, 18 nt, Pseudomonas aeruginosa PA01
ggcgggccuugcgaccag

SEQ ID NO: 1497352 - RNA, 12 nt, Pseudomonas aeruginosa PA01
ggcguccgccuc

SEQ ID NO: 1497353 - RNA, 14 nt, Pseudomonas aeruginosa PA01
ggcguccgccucgc

SEQ ID NO: 1497354 - RNA, 14 nt, Pseudomonas aeruginosa PA01
ggcguccgcggccu

SEQ ID NO: 1497355 - RNA, 19 nt, Pseudomonas aeruginosa PA01
ggcguccgcggccugcucg

SEQ ID NO: 1497356 - RNA, 17 nt, Pseudomonas aeruginosa PA01
ggcgucccgcuccagcc

SEQ ID NO: 1497357 - RNA, 21 nt, Pseudomonas aeruginosa PA01
ggcgucccgcuccagccggca

SEQ ID NO: 1497358 - RNA, 18 nt, Pseudomonas aeruginosa PA01
ggcgucccggcgccgccc

SEQ ID NO: 1497359 - RNA, 20 nt, Pseudomonas aeruginosa PA01
ggcgucccggcgccgcccuu

SEQ ID NO: 1497360 - RNA, 23 nt, Pseudomonas aeruginosa PA01
ggcguccccuuccuccucgccgc

SEQ ID NO: 1497361 - RNA, 22 nt, Pseudomonas aeruginosa PA01
ggcgucccgcaguagcucgccg

SEQ ID NO: 1497362 - RNA, 19 nt, Pseudomonas aeruginosa PA01
ggcgucccauggcgccacg

SEQ ID NO: 1497363 - RNA, 20 nt, Pseudomonas aeruginosa PA01
ggcgucccauggcgccacgc

SEQ ID NO: 1497364 - RNA, 16 nt, Pseudomonas aeruginosa PA01
ggcguccauggcggcg

SEQ ID NO: 1497365 - RNA, 13 nt, Pseudomonas aeruginosa PA01
ggcgucggcaugg

SEQ ID NO: 1497366 - RNA, 16 nt, Pseudomonas aeruginosa PA01
ggcgucggcgaucacg

SEQ ID NO: 1497367 - RNA, 17 nt, Pseudomonas aeruginosa PA01
ggcgucggcgcgggcgc

SEQ ID NO: 1497368 - RNA, 14 nt, Pseudomonas aeruginosa PA01
ggcgucggcgcuuu

SEQ ID NO: 1497369 - RNA, 15 nt, Pseudomonas aeruginosa PA01
ggcgucggcugcgcu

SEQ ID NO: 1497370 - RNA, 23 nt, Pseudomonas aeruginosa PA01
ggcgucggagagauagucgccgu

SEQ ID NO: 1497371 - RNA, 15 nt, Pseudomonas aeruginosa PA01
ggcgucgccgucguc

SEQ ID NO: 1497372 - RNA, 20 nt, Pseudomonas aeruginosa PA01
ggcgucgccuuccaccacca

SEQ ID NO: 1497373 - RNA, 22 nt, Pseudomonas aeruginosa PA01
ggcgucgcggagaauccgcucg

SEQ ID NO: 1497374 - RNA, 15 nt, Pseudomonas aeruginosa PA01
ggcgucgcgccagca

SEQ ID NO: 1497375 - RNA, 18 nt, Pseudomonas aeruginosa PA01
ggcgucgcgccagcaccg

SEQ ID NO: 1497376 - RNA, 22 nt, Pseudomonas aeruginosa PA01
ggcgucgcgccagcaccguggu

SEQ ID NO: 1497377 - RNA, 21 nt, Pseudomonas aeruginosa PA01
ggcgucgacgaacggaucgcu

SEQ ID NO: 1497378 - RNA, 18 nt, Pseudomonas aeruginosa PA01
ggcgucgaccacggccuu

SEQ ID NO: 1497379 - RNA, 17 nt, Pseudomonas aeruginosa PA01
ggcgucgaucaggcggg

SEQ ID NO: 1497380 - RNA, 21 nt, Pseudomonas aeruginosa PA01
ggcgucgaucccgaucgccaa

SEQ ID NO: 1497381 - RNA, 22 nt, Pseudomonas aeruginosa PA01
ggcgucgaugucgaacaacccg

SEQ ID NO: 1497382 - RNA, 13 nt, Pseudomonas aeruginosa PA01
ggcgucgcccucg

SEQ ID NO: 1497383 - RNA, 16 nt, Pseudomonas aeruginosa PA01
ggcgucgcccucggcg

SEQ ID NO: 1497384 - RNA, 18 nt, Pseudomonas aeruginosa PA01
ggcgucgcccucggcgcu

SEQ ID NO: 1497385 - RNA, 24 nt, Pseudomonas aeruginosa PA01
ggcgucgcccucggcgcuggccag

SEQ ID NO: 1497386 - RNA, 12 nt, Pseudomonas aeruginosa PA01
ggcgucgccgac

SEQ ID NO: 1497387 - RNA, 22 nt, Pseudomonas aeruginosa PA01
ggcucuuugcgacugacgcuca

SEQ ID NO: 1497388 - RNA, 14 nt, Pseudomonas aeruginosa PA01
ggcugaacagcgcc

SEQ ID NO: 1497389 - RNA, 15 nt, Pseudomonas aeruginosa PA01
ggcugaacagcgcca

SEQ ID NO: 1497390 - RNA, 16 nt, Pseudomonas aeruginosa PA01
ggcugaacagcgccac

SEQ ID NO: 1497391 - RNA, 18 nt, Pseudomonas aeruginosa PA01
ggcugaacagcgccacca

SEQ ID NO: 1497392 - RNA, 19 nt, Pseudomonas aeruginosa PA01
ggcugaacagcgccaccag

SEQ ID NO: 1497393 - RNA, 19 nt, Pseudomonas aeruginosa PA01
ggcugaagaagcugcccca

SEQ ID NO: 1497394 - RNA, 17 nt, Pseudomonas aeruginosa PA01
ggcugacccgcugcugg

SEQ ID NO: 1497395 - RNA, 15 nt, Pseudomonas aeruginosa PA01
ggcugaaggccgaac

SEQ ID NO: 1497396 - RNA, 15 nt, Pseudomonas aeruginosa PA01
ggcugaccuucgccg

SEQ ID NO: 1497397 - RNA, 14 nt, Pseudomonas aeruginosa PA01
ggcugacgucgacg

SEQ ID NO: 1497398 - RNA, 16 nt, Pseudomonas aeruginosa PA01
ggcugacgucgacgca

SEQ ID NO: 1497399 - RNA, 17 nt, Pseudomonas aeruginosa PA01
ggcugacgucgacgcag

SEQ ID NO: 1497400 - RNA, 14 nt, Pseudomonas aeruginosa PA01
ggcugacgcuggcg

SEQ ID NO: 1497401 - RNA, 13 nt, Pseudomonas aeruginosa PA01
ggcugaccgcgug

SEQ ID NO: 1497402 - RNA, 15 nt, Pseudomonas aeruginosa PA01
ggcugaccgcguggg

SEQ ID NO: 1497403 - RNA, 20 nt, Pseudomonas aeruginosa PA01
ggcucgugccaucaggccgc

SEQ ID NO: 1497404 - RNA, 21 nt, Pseudomonas aeruginosa PA01
ggcucgugccaucaggccgcg

SEQ ID NO: 1497405 - RNA, 14 nt, Pseudomonas aeruginosa PA01
ggcucgugcccucg

SEQ ID NO: 1497406 - RNA, 20 nt, Pseudomonas aeruginosa PA01
ggcucguucaugucggcucc

SEQ ID NO: 1497407 - RNA, 21 nt, Pseudomonas aeruginosa PA01
ggcucguucaugucggcuccu

SEQ ID NO: 1497408 - RNA, 20 nt, Pseudomonas aeruginosa PA01
ggcucguucguucuguucgu

SEQ ID NO: 1497409 - RNA, 17 nt, Pseudomonas aeruginosa PA01
ggcucuguuccucggcg

SEQ ID NO: 1497410 - RNA, 18 nt, Pseudomonas aeruginosa PA01
ggcucuguuccucggcgg

SEQ ID NO: 1497411 - RNA, 20 nt, Pseudomonas aeruginosa PA01
ggcucuguuccucggcggcg

SEQ ID NO: 1497412 - RNA, 12 nt, Pseudomonas aeruginosa PA01
ggcucuggcgca

SEQ ID NO: 1497413 - RNA, 19 nt, Pseudomonas aeruginosa PA01
ggcucugguagccgcaguc

SEQ ID NO: 1497414 - RNA, 22 nt, Pseudomonas aeruginosa PA01
ggcucuggaugcggcgcugcca

SEQ ID NO: 1497415 - RNA, 15 nt, Pseudomonas aeruginosa PA01
ggcucugcuccagca

SEQ ID NO: 1497416 - RNA, 13 nt, Pseudomonas aeruginosa PA01
ggcucugggccau

SEQ ID NO: 1497417 - RNA, 18 nt, Pseudomonas aeruginosa PA01
ggcucgcaaucagcgcga

SEQ ID NO: 1497418 - RNA, 18 nt, Pseudomonas aeruginosa PA01
ggcucgccgaaaggccgu

SEQ ID NO: 1497419 - RNA, 22 nt, Pseudomonas aeruginosa PA01
ggcucgccgacuuccaggcgca

SEQ ID NO: 1497420 - RNA, 14 nt, Pseudomonas aeruginosa PA01
ggcucgccgccagc

SEQ ID NO: 1497421 - RNA, 19 nt, Pseudomonas aeruginosa PA01
ggcucgccgccgggcgcgc

SEQ ID NO: 1497422 - RNA, 19 nt, Pseudomonas aeruginosa PA01
ggcucgaucggcagggcgc

SEQ ID NO: 1497423 - RNA, 23 nt, Pseudomonas aeruginosa PA01
ggcucgaucggcagggcgccgac

SEQ ID NO: 1497424 - RNA, 13 nt, Pseudomonas aeruginosa PA01
ggcucgaucagcc

SEQ ID NO: 1497425 - RNA, 16 nt, Pseudomonas aeruginosa PA01
ggcucgaucagccggc

SEQ ID NO: 1497426 - RNA, 20 nt, Pseudomonas aeruginosa PA01
ggcucgaucagccggcgcgc

SEQ ID NO: 1497427 - RNA, 14 nt, Pseudomonas aeruginosa PA01
ggcucgacgaggaa

SEQ ID NO: 1497428 - RNA, 21 nt, Pseudomonas aeruginosa PA01
ggcucgcccagcaggcgcgcc

SEQ ID NO: 1497429 - RNA, 17 nt, Pseudomonas aeruginosa PA01
ggcucgccccggcggcg

SEQ ID NO: 1497430 - RNA, 20 nt, Pseudomonas aeruginosa PA01
ggcucgccccggcggcgauc

SEQ ID NO: 1497431 - RNA, 18 nt, Pseudomonas aeruginosa PA01
ggcucgcgcggggcgcgc

SEQ ID NO: 1497432 - RNA, 20 nt, Pseudomonas aeruginosa PA01
ggcucgcgcggggcgcgcug

SEQ ID NO: 1497433 - RNA, 18 nt, Pseudomonas aeruginosa PA01
ggcucgcgggucaccagc

SEQ ID NO: 1497434 - RNA, 16 nt, Pseudomonas aeruginosa PA01
ggcucgcggcgcucgu

SEQ ID NO: 1497435 - RNA, 18 nt, Pseudomonas aeruginosa PA01
ggcucgcggcgcucgucg

SEQ ID NO: 1497436 - RNA, 19 nt, Pseudomonas aeruginosa PA01
ggcucgcggcgcucgucgg

SEQ ID NO: 1497437 - RNA, 13 nt, Pseudomonas aeruginosa PA01
ggcucgcucucga

SEQ ID NO: 1497438 - RNA, 21 nt, Pseudomonas aeruginosa PA01
ggcucgcucucgaacaccggc

SEQ ID NO: 1497439 - RNA, 20 nt, Pseudomonas aeruginosa PA01
ggcucggccagggccgcucg

SEQ ID NO: 1497440 - RNA, 13 nt, Pseudomonas aeruginosa PA01
ggcucggcaagcg

SEQ ID NO: 1497441 - RNA, 18 nt, Pseudomonas aeruginosa PA01
ggcucggcacgcguggcg

SEQ ID NO: 1497442 - RNA, 19 nt, Pseudomonas aeruginosa PA01
ggcucggcacgcguggcga

SEQ ID NO: 1497443 - RNA, 22 nt, Pseudomonas aeruginosa PA01
ggcucggcacgcguggcgagug

SEQ ID NO: 1497444 - RNA, 14 nt, Pseudomonas aeruginosa PA01
ggcucgggcgcgga

SEQ ID NO: 1497445 - RNA, 21 nt, Pseudomonas aeruginosa PA01
ggcucgguucauggacgguau

SEQ ID NO: 1497446 - RNA, 20 nt, Pseudomonas aeruginosa PA01
ggcucgguuccagcucgucg

SEQ ID NO: 1497447 - RNA, 12 nt, Pseudomonas aeruginosa PA01
ggcucggcagcg

SEQ ID NO: 1497448 - RNA, 12 nt, Pseudomonas aeruginosa PA01
ggcucggcggcc

SEQ ID NO: 1497449 - RNA, 15 nt, Pseudomonas aeruginosa PA01
ggcugccgcagauca

SEQ ID NO: 1497450 - RNA, 20 nt, Pseudomonas aeruginosa PA01
ggcugccgcaguagaugccg

SEQ ID NO: 1497451 - RNA, 19 nt, Pseudomonas aeruginosa PA01
ggcugccgagaaucugccc

SEQ ID NO: 1497452 - RNA, 14 nt, Pseudomonas aeruginosa PA01
ggcugccgagcagg

SEQ ID NO: 1497453 - RNA, 13 nt, Pseudomonas aeruginosa PA01
ggcugccgccgcc

SEQ ID NO: 1497454 - RNA, 19 nt, Pseudomonas aeruginosa PA01
ggcugccgccgccgucgac

SEQ ID NO: 1497455 - RNA, 15 nt, Pseudomonas aeruginosa PA01
ggcugccggcccucg

SEQ ID NO: 1497456 - RNA, 18 nt, Pseudomonas aeruginosa PA01
ggcugccggcccucgcga

SEQ ID NO: 1497457 - RNA, 22 nt, Pseudomonas aeruginosa PA01
ggcugccgccuucgcgggccag

SEQ ID NO: 1497458 - RNA, 21 nt, Pseudomonas aeruginosa PA01
ggcugccgcgcguggcuucgu

SEQ ID NO: 1497459 - RNA, 12 nt, Pseudomonas aeruginosa PA01
ggcugccgggcu

SEQ ID NO: 1497460 - RNA, 12 nt, Pseudomonas aeruginosa PA01
ggcugccgguac

SEQ ID NO: 1497461 - RNA, 16 nt, Pseudomonas aeruginosa PA01
ggcugcgauauggccg

SEQ ID NO: 1497462 - RNA, 16 nt, Pseudomonas aeruginosa PA01
ggcugcgccgcugcgg

SEQ ID NO: 1497463 - RNA, 16 nt, Pseudomonas aeruginosa PA01
ggcugcgcaccucggc

SEQ ID NO: 1497464 - RNA, 12 nt, Pseudomonas aeruginosa PA01
ggcugcgcgcca

SEQ ID NO: 1497465 - RNA, 14 nt, Pseudomonas aeruginosa PA01
ggcugcgcucggcg

SEQ ID NO: 1497466 - RNA, 18 nt, Pseudomonas aeruginosa PA01
ggcugcgcucggcgcucg

SEQ ID NO: 1497467 - RNA, 13 nt, Pseudomonas aeruginosa PA01
ggcugcggccucg

SEQ ID NO: 1497468 - RNA, 12 nt, Pseudomonas aeruginosa PA01
ggcugcggcgga

SEQ ID NO: 1497469 - RNA, 21 nt, Pseudomonas aeruginosa PA01
ggcugcgucguuggccggcug

SEQ ID NO: 1497470 - RNA, 12 nt, Pseudomonas aeruginosa PA01
ggcugcgugcca

SEQ ID NO: 1497471 - RNA, 19 nt, Pseudomonas aeruginosa PA01
ggcugcucgccucgggcca

SEQ ID NO: 1497472 - RNA, 20 nt, Pseudomonas aeruginosa PA01
ggcugcucgccucgggccau

SEQ ID NO: 1497473 - RNA, 22 nt, Pseudomonas aeruginosa PA01
ggcugcucgccucgggccauga

SEQ ID NO: 1497474 - RNA, 17 nt, Pseudomonas aeruginosa PA01
ggcugcugcgccuggcc

SEQ ID NO: 1497475 - RNA, 19 nt, Pseudomonas aeruginosa PA01
ggcugcugcgccuggccgc

SEQ ID NO: 1497476 - RNA, 20 nt, Pseudomonas aeruginosa PA01
ggcugcugcgccuggccgcg

SEQ ID NO: 1497477 - RNA, 22 nt, Pseudomonas aeruginosa PA01
ggcugcugcgccuggccgcgca

SEQ ID NO: 1497478 - RNA, 15 nt, Pseudomonas aeruginosa PA01
ggcugaucggccgcc

SEQ ID NO: 1497479 - RNA, 16 nt, Pseudomonas aeruginosa PA01
ggcugaucggccgcca

SEQ ID NO: 1497480 - RNA, 17 nt, Pseudomonas aeruginosa PA01
ggcugaucggccgccag

SEQ ID NO: 1497481 - RNA, 21 nt, Pseudomonas aeruginosa PA01
ggcugaucggccgccagugca

SEQ ID NO: 1497482 - RNA, 17 nt, Pseudomonas aeruginosa PA01
ggcugaucucggccaug

SEQ ID NO: 1497483 - RNA, 14 nt, Pseudomonas aeruginosa PA01
ggcugaucuugccg

SEQ ID NO: 1497484 - RNA, 18 nt, Pseudomonas aeruginosa PA01
ggcugaucuugccgcugg

SEQ ID NO: 1497485 - RNA, 21 nt, Pseudomonas aeruginosa PA01
ggcugaugcccgggucgucgg

SEQ ID NO: 1497486 - RNA, 21 nt, Pseudomonas aeruginosa PA01
ggcugcaacgagaggaagucg

SEQ ID NO: 1497487 - RNA, 16 nt, Pseudomonas aeruginosa PA01
ggcugcaacgccgcgg

SEQ ID NO: 1497488 - RNA, 16 nt, Pseudomonas aeruginosa PA01
ggcugcaacgccggcc

SEQ ID NO: 1497489 - RNA, 22 nt, Pseudomonas aeruginosa PA01
ggcugcaacuuccacucgccga

SEQ ID NO: 1497490 - RNA, 15 nt, Pseudomonas aeruginosa PA01
ggcugaggcuggcga

SEQ ID NO: 1497491 - RNA, 23 nt, Pseudomonas aeruginosa PA01
ggcugaggucgcgggcgauggcc

SEQ ID NO: 1497492 - RNA, 15 nt, Pseudomonas aeruginosa PA01
ggcugaguucgucga

SEQ ID NO: 1497493 - RNA, 20 nt, Pseudomonas aeruginosa PA01
ggcugaggccgacgaacagc

SEQ ID NO: 1497494 - RNA, 18 nt, Pseudomonas aeruginosa PA01
ggcugaucagcccgcuga

SEQ ID NO: 1497495 - RNA, 14 nt, Pseudomonas aeruginosa PA01
ggcugagcgccagg

SEQ ID NO: 1497496 - RNA, 15 nt, Pseudomonas aeruginosa PA01
ggcugagcgccaggc

SEQ ID NO: 1497497 - RNA, 17 nt, Pseudomonas aeruginosa PA01
ggcugagcgccaggcgc

SEQ ID NO: 1497498 - RNA, 18 nt, Pseudomonas aeruginosa PA01
ggcugagcgccaggcgca

SEQ ID NO: 1497499 - RNA, 23 nt, Pseudomonas aeruginosa PA01
ggcugagaccuuccugccagcgc

SEQ ID NO: 1497500 - RNA, 17 nt, Pseudomonas aeruginosa PA01
ggcugagacgcugccgu

SEQ ID NO: 1497501 - RNA, 21 nt, Pseudomonas aeruginosa PA01
ggcugagacgcugccguucgc

SEQ ID NO: 1497502 - RNA, 16 nt, Pseudomonas aeruginosa PA01
ggcugcccaggcugag

SEQ ID NO: 1497503 - RNA, 15 nt, Pseudomonas aeruginosa PA01
ggcugcauguccgcc

SEQ ID NO: 1497504 - RNA, 22 nt, Pseudomonas aeruginosa PA01
ggcugccaccgagggcaggaac

SEQ ID NO: 1497505 - RNA, 18 nt, Pseudomonas aeruginosa PA01
ggcugcccaacuggcgga

SEQ ID NO: 1497506 - RNA, 23 nt, Pseudomonas aeruginosa PA01
ggcugcccaacuggcggaugcgu

SEQ ID NO: 1497507 - RNA, 17 nt, Pseudomonas aeruginosa PA01
ggcugcccaagggccug

SEQ ID NO: 1497508 - RNA, 18 nt, Pseudomonas aeruginosa PA01
ggcugcccaagggccugg

SEQ ID NO: 1497509 - RNA, 14 nt, Pseudomonas aeruginosa PA01
ggcugcccaccacc

SEQ ID NO: 1497510 - RNA, 15 nt, Pseudomonas aeruginosa PA01
ggcugcaucggcucg

SEQ ID NO: 1497511 - RNA, 17 nt, Pseudomonas aeruginosa PA01
ggcugcaucggcucggc

SEQ ID NO: 1497512 - RNA, 21 nt, Pseudomonas aeruginosa PA01
ggcugcagguaggcgguggcg

SEQ ID NO: 1497513 - RNA, 18 nt, Pseudomonas aeruginosa PA01
ggcuugaccgccgccgcc

SEQ ID NO: 1497514 - RNA, 19 nt, Pseudomonas aeruginosa PA01
ggcuucugguucguccgcg

SEQ ID NO: 1497515 - RNA, 20 nt, Pseudomonas aeruginosa PA01
ggcuucuucaccaggccgaa

SEQ ID NO: 1497516 - RNA, 14 nt, Pseudomonas aeruginosa PA01
ggcuucuucaggca

SEQ ID NO: 1497517 - RNA, 17 nt, Pseudomonas aeruginosa PA01
ggcuucuuccuggccgg

SEQ ID NO: 1497518 - RNA, 13 nt, Pseudomonas aeruginosa PA01
ggcuugcaauccg

SEQ ID NO: 1497519 - RNA, 23 nt, Pseudomonas aeruginosa PA01
ggcuugccgaugucgccggcaug

SEQ ID NO: 1497520 - RNA, 14 nt, Pseudomonas aeruginosa PA01
ggcuugcagguagc

SEQ ID NO: 1497521 - RNA, 18 nt, Pseudomonas aeruginosa PA01
ggcuugcaguucagccac

SEQ ID NO: 1497522 - RNA, 22 nt, Pseudomonas aeruginosa PA01
ggcuugccacugcgcgccaguc

SEQ ID NO: 1497523 - RNA, 15 nt, Pseudomonas aeruginosa PA01
ggcuugcgcgccacc

SEQ ID NO: 1497524 - RNA, 16 nt, Pseudomonas aeruginosa PA01
ggcuugcgcgccacca

SEQ ID NO: 1497525 - RNA, 12 nt, Pseudomonas aeruginosa PA01
ggcuugccggcg

SEQ ID NO: 1497526 - RNA, 14 nt, Pseudomonas aeruginosa PA01
ggcuugccggcgcg

SEQ ID NO: 1497527 - RNA, 17 nt, Pseudomonas aeruginosa PA01
ggcuugccggcggcgcu

SEQ ID NO: 1497528 - RNA, 20 nt, Pseudomonas aeruginosa PA01
ggcuugcguucgcuccaguc

SEQ ID NO: 1497529 - RNA, 13 nt, Pseudomonas aeruginosa PA01
ggcuugcugacga

SEQ ID NO: 1497530 - RNA, 16 nt, Pseudomonas aeruginosa PA01
ggcuucggcgcgcugg

SEQ ID NO: 1497531 - RNA, 17 nt, Pseudomonas aeruginosa PA01
ggcuucuacgccuugcg

SEQ ID NO: 1497532 - RNA, 22 nt, Pseudomonas aeruginosa PA01
ggcuucguccagcgaggcgugg

SEQ ID NO: 1497533 - RNA, 17 nt, Pseudomonas aeruginosa PA01
ggcuucguccgccuggg

SEQ ID NO: 1497534 - RNA, 19 nt, Pseudomonas aeruginosa PA01
ggcuucguccugcugcugg

SEQ ID NO: 1497535 - RNA, 16 nt, Pseudomonas aeruginosa PA01
ggcuucgccgccgcgc

SEQ ID NO: 1497536 - RNA, 16 nt, Pseudomonas aeruginosa PA01
ggcuucgaggcgggcg

SEQ ID NO: 1497537 - RNA, 19 nt, Pseudomonas aeruginosa PA01
ggcuuccgagcaguugcag

SEQ ID NO: 1497538 - RNA, 21 nt, Pseudomonas aeruginosa PA01
ggcuucgaugcuuagcccggg

SEQ ID NO: 1497539 - RNA, 18 nt, Pseudomonas aeruginosa PA01
ggcuucgcgguggaugcc

SEQ ID NO: 1497540 - RNA, 13 nt, Pseudomonas aeruginosa PA01
ggcuucgcgugcc

SEQ ID NO: 1497541 - RNA, 22 nt, Pseudomonas aeruginosa PA01
ggcuucgcgugccagacgcucg

SEQ ID NO: 1497542 - RNA, 21 nt, Pseudomonas aeruginosa PA01
ggcuucgcguugcaggcgacg

SEQ ID NO: 1497543 - RNA, 18 nt, Pseudomonas aeruginosa PA01
ggcuuccgccgccagguc

SEQ ID NO: 1497544 - RNA, 15 nt, Pseudomonas aeruginosa PA01
ggcuucccaggccag

SEQ ID NO: 1497545 - RNA, 17 nt, Pseudomonas aeruginosa PA01
ggcuucccaggccagcg

SEQ ID NO: 1497546 - RNA, 18 nt, Pseudomonas aeruginosa PA01
ggcuucccaggccagcgg

SEQ ID NO: 1497547 - RNA, 14 nt, Pseudomonas aeruginosa PA01
ggcuucgaccacga

SEQ ID NO: 1497548 - RNA, 23 nt, Pseudomonas aeruginosa PA01
ggcuuccuccaucgccucgcgga

SEQ ID NO: 1497549 - RNA, 15 nt, Pseudomonas aeruginosa PA01
ggcuuccuggccggg

SEQ ID NO: 1497550 - RNA, 14 nt, Pseudomonas aeruginosa PA01
ggcuuccuggcgcc

SEQ ID NO: 1497551 - RNA, 14 nt, Pseudomonas aeruginosa PA01
ggcuuccugggcga

SEQ ID NO: 1497552 - RNA, 16 nt, Pseudomonas aeruginosa PA01
ggcuuuccaccgccag

SEQ ID NO: 1497553 - RNA, 17 nt, Pseudomonas aeruginosa PA01
ggcuuuccaccgccagc

SEQ ID NO: 1497554 - RNA, 20 nt, Pseudomonas aeruginosa PA01
ggcuuuccaccgccagcacc

SEQ ID NO: 1497555 - RNA, 19 nt, Pseudomonas aeruginosa PA01
ggcuuuccagcaggcgcuc

SEQ ID NO: 1497556 - RNA, 20 nt, Pseudomonas aeruginosa PA01
ggcuuuccagcaggcgcucg

SEQ ID NO: 1497557 - RNA, 20 nt, Pseudomonas aeruginosa PA01
ggcuuuccaggcgccgcuug

SEQ ID NO: 1497558 - RNA, 21 nt, Pseudomonas aeruginosa PA01
ggcuuuccagggccuggcgca

SEQ ID NO: 1497559 - RNA, 21 nt, Pseudomonas aeruginosa PA01
ggcuuucccuguagcguuccg

SEQ ID NO: 1497560 - RNA, 19 nt, Pseudomonas aeruginosa PA01
ggcuuuucauuaccggcga

SEQ ID NO: 1497561 - RNA, 21 nt, Pseudomonas aeruginosa PA01
ggcuuuucauuuaucgcugcg

SEQ ID NO: 1497562 - RNA, 16 nt, Pseudomonas aeruginosa PA01
ggcuuguccuggcgca

SEQ ID NO: 1497563 - RNA, 20 nt, Pseudomonas aeruginosa PA01
ggcuuggucgggcgccgcgc

SEQ ID NO: 1497564 - RNA, 22 nt, Pseudomonas aeruginosa PA01
ggcuuggucgggcgccgcgccu

SEQ ID NO: 1497565 - RNA, 17 nt, Pseudomonas aeruginosa PA01
ggcuugggucagcgggu

SEQ ID NO: 1497566 - RNA, 21 nt, Pseudomonas aeruginosa PA01
ggcuuguucagcucggcguag

SEQ ID NO: 1497567 - RNA, 22 nt, Pseudomonas aeruginosa PA01
ggcuuguugcgcuccacccagg

SEQ ID NO: 1497568 - RNA, 19 nt, Pseudomonas aeruginosa PA01
ggcuuuuucaugagcgccc

SEQ ID NO: 1497569 - RNA, 21 nt, Pseudomonas aeruginosa PA01
ggcuuuuucauggcuggcccu

SEQ ID NO: 1497570 - RNA, 20 nt, Pseudomonas aeruginosa PA01
ggcuuuuucaugggcgcgcg

SEQ ID NO: 1497571 - RNA, 18 nt, Pseudomonas aeruginosa PA01
ggcuuuuuuaugcgcagc

SEQ ID NO: 1497572 - RNA, 18 nt, Pseudomonas aeruginosa PA01
ggcuuuuuuucgccugcg

SEQ ID NO: 1497573 - RNA, 21 nt, Pseudomonas aeruginosa PA01
gggaaaaaagggagccaggcg

SEQ ID NO: 1497574 - RNA, 13 nt, Pseudomonas aeruginosa PA01
gggaaacagggcg

SEQ ID NO: 1497575 - RNA, 19 nt, Pseudomonas aeruginosa PA01
gggaaacagggcgacgccg

SEQ ID NO: 1497576 - RNA, 22 nt, Pseudomonas aeruginosa PA01
gggaaaccuucgguggcgacca

SEQ ID NO: 1497577 - RNA, 12 nt, Pseudomonas aeruginosa PA01
gggaacuggcgu

SEQ ID NO: 1497578 - RNA, 16 nt, Pseudomonas aeruginosa PA01
gggaacugggcgagca

SEQ ID NO: 1497579 - RNA, 18 nt, Pseudomonas aeruginosa PA01
gggaacuuggcgcgcagg

SEQ ID NO: 1497580 - RNA, 20 nt, Pseudomonas aeruginosa PA01
gggaaaucgguugccgcgcc

SEQ ID NO: 1497581 - RNA, 21 nt, Pseudomonas aeruginosa PA01
gggaacgaguugggcgaccug

SEQ ID NO: 1497582 - RNA, 21 nt, Pseudomonas aeruginosa PA01
gggaacgccgggcaacgccag

SEQ ID NO: 1497583 - RNA, 14 nt, Pseudomonas aeruginosa PA01
gggaacccgcggcg

SEQ ID NO: 1497584 - RNA, 19 nt, Pseudomonas aeruginosa PA01
gggaacccgcggcgcgccu

SEQ ID NO: 1497585 - RNA, 23 nt, Pseudomonas aeruginosa PA01
gggaacagcccgucgcgcgccgg

SEQ ID NO: 1497586 - RNA, 14 nt, Pseudomonas aeruginosa PA01
ggcuggugccgcug

SEQ ID NO: 1497587 - RNA, 15 nt, Pseudomonas aeruginosa PA01
ggcuggugccgcugu

SEQ ID NO: 1497588 - RNA, 14 nt, Pseudomonas aeruginosa PA01
ggcuggugccguac

SEQ ID NO: 1497589 - RNA, 17 nt, Pseudomonas aeruginosa PA01
ggcuggugccguacuca

SEQ ID NO: 1497590 - RNA, 17 nt, Pseudomonas aeruginosa PA01
ggcuggucaguucggcc

SEQ ID NO: 1497591 - RNA, 19 nt, Pseudomonas aeruginosa PA01
ggcugguggucaccgccag

SEQ ID NO: 1497592 - RNA, 13 nt, Pseudomonas aeruginosa PA01
ggcuggugcgggu

SEQ ID NO: 1497593 - RNA, 18 nt, Pseudomonas aeruginosa PA01
ggcugguugccagcagcg

SEQ ID NO: 1497594 - RNA, 20 nt, Pseudomonas aeruginosa PA01
ggcugguugccagcagcgcu

SEQ ID NO: 1497595 - RNA, 19 nt, Pseudomonas aeruginosa PA01
ggcuguaaucgccgcuucg

SEQ ID NO: 1497596 - RNA, 21 nt, Pseudomonas aeruginosa PA01
ggcuguacagcaggagcgcca

SEQ ID NO: 1497597 - RNA, 19 nt, Pseudomonas aeruginosa PA01
ggcuguagggacaggcuag

SEQ ID NO: 1497598 - RNA, 14 nt, Pseudomonas aeruginosa PA01
ggcuguagggcgaa

SEQ ID NO: 1497599 - RNA, 15 nt, Pseudomonas aeruginosa PA01
ggcuguagcgcuccu

SEQ ID NO: 1497600 - RNA, 21 nt, Pseudomonas aeruginosa PA01
ggcuguagcgcuccuguucgu

SEQ ID NO: 1497601 - RNA, 20 nt, Pseudomonas aeruginosa PA01
ggcuguagcggaucaggccc

SEQ ID NO: 1497602 - RNA, 14 nt, Pseudomonas aeruginosa PA01
ggcugucagggcgc

SEQ ID NO: 1497603 - RNA, 17 nt, Pseudomonas aeruginosa PA01
ggcuguccagcaggcgu

SEQ ID NO: 1497604 - RNA, 13 nt, Pseudomonas aeruginosa PA01
ggcugucgcggac

SEQ ID NO: 1497605 - RNA, 19 nt, Pseudomonas aeruginosa PA01
ggcugucgcggacccgcgc

SEQ ID NO: 1497606 - RNA, 20 nt, Pseudomonas aeruginosa PA01
ggcugucggccaucgccguc

SEQ ID NO: 1497607 - RNA, 20 nt, Pseudomonas aeruginosa PA01
ggcugugcagggcagcggcc

SEQ ID NO: 1497608 - RNA, 19 nt, Pseudomonas aeruginosa PA01
ggcugugcaucugcgacau

SEQ ID NO: 1497609 - RNA, 14 nt, Pseudomonas aeruginosa PA01
ggcugugcgccagg

SEQ ID NO: 1497610 - RNA, 22 nt, Pseudomonas aeruginosa PA01
ggcugugcgccaggccggugca

SEQ ID NO: 1497611 - RNA, 22 nt, Pseudomonas aeruginosa PA01
ggcugugcucgacgggcgcuuc

SEQ ID NO: 1497612 - RNA, 22 nt, Pseudomonas aeruginosa PA01
ggcugugcucgaggaagcgccc

SEQ ID NO: 1497613 - RNA, 14 nt, Pseudomonas aeruginosa PA01
ggcuguggcgcggc

SEQ ID NO: 1497614 - RNA, 23 nt, Pseudomonas aeruginosa PA01
ggcugugggucgggucggcgaag

SEQ ID NO: 1497615 - RNA, 15 nt, Pseudomonas aeruginosa PA01
ggcuguugucgaaca

SEQ ID NO: 1497616 - RNA, 16 nt, Pseudomonas aeruginosa PA01
ggcuucagcgccaggc

SEQ ID NO: 1497617 - RNA, 19 nt, Pseudomonas aeruginosa PA01
ggcuucagcgccaggccga

SEQ ID NO: 1497618 - RNA, 22 nt, Pseudomonas aeruginosa PA01
ggcuucagcgccaggccgauca

SEQ ID NO: 1497619 - RNA, 15 nt, Pseudomonas aeruginosa PA01
ggcuucagcgccggg

SEQ ID NO: 1497620 - RNA, 14 nt, Pseudomonas aeruginosa PA01
ggcuggccagcccu

SEQ ID NO: 1497621 - RNA, 15 nt, Pseudomonas aeruginosa PA01
ggcuggccagcccug

SEQ ID NO: 1497622 - RNA, 17 nt, Pseudomonas aeruginosa PA01
ggcuggccagcccuggu

SEQ ID NO: 1497623 - RNA, 21 nt, Pseudomonas aeruginosa PA01
ggcuggccagcaauacccgcc

SEQ ID NO: 1497624 - RNA, 22 nt, Pseudomonas aeruginosa PA01
ggcuggccagcaauacccgccg

SEQ ID NO: 1497625 - RNA, 14 nt, Pseudomonas aeruginosa PA01
ggcuggcagggcgc

SEQ ID NO: 1497626 - RNA, 19 nt, Pseudomonas aeruginosa PA01
ggcuggcagggcgcgucca

SEQ ID NO: 1497627 - RNA, 22 nt, Pseudomonas aeruginosa PA01
ggcuggacgugcaggaucaccu

SEQ ID NO: 1497628 - RNA, 22 nt, Pseudomonas aeruginosa PA01
ggcuggaucgaucucgucggcg

SEQ ID NO: 1497629 - RNA, 16 nt, Pseudomonas aeruginosa PA01
ggcugcuucggcagcc

SEQ ID NO: 1497630 - RNA, 18 nt, Pseudomonas aeruginosa PA01
ggcuggaagccgcgcucg

SEQ ID NO: 1497631 - RNA, 21 nt, Pseudomonas aeruginosa PA01
ggcuggaagccgcgcucgcgg

SEQ ID NO: 1497632 - RNA, 14 nt, Pseudomonas aeruginosa PA01
ggcugcuguccagc

SEQ ID NO: 1497633 - RNA, 17 nt, Pseudomonas aeruginosa PA01
ggcugcuguccagcgcu

SEQ ID NO: 1497634 - RNA, 12 nt, Pseudomonas aeruginosa PA01
ggcugcuggcga

SEQ ID NO: 1497635 - RNA, 14 nt, Pseudomonas aeruginosa PA01
ggcugcuggcgaag

SEQ ID NO: 1497636 - RNA, 22 nt, Pseudomonas aeruginosa PA01
ggcugcuggcgaagcuggggcu

SEQ ID NO: 1497637 - RNA, 14 nt, Pseudomonas aeruginosa PA01
ggcugcugcugcgg

SEQ ID NO: 1497638 - RNA, 15 nt, Pseudomonas aeruginosa PA01
ggcugcugcugcggc

SEQ ID NO: 1497639 - RNA, 18 nt, Pseudomonas aeruginosa PA01
ggcugcugcugcggcggu

SEQ ID NO: 1497640 - RNA, 15 nt, Pseudomonas aeruginosa PA01
ggcuggaccuccugg

SEQ ID NO: 1497641 - RNA, 17 nt, Pseudomonas aeruginosa PA01
ggcuggcgcuugccgcg

SEQ ID NO: 1497642 - RNA, 15 nt, Pseudomonas aeruginosa PA01
ggcuggcguugacug

SEQ ID NO: 1497643 - RNA, 17 nt, Pseudomonas aeruginosa PA01
ggcuggcuccccccugg

SEQ ID NO: 1497644 - RNA, 15 nt, Pseudomonas aeruginosa PA01
ggcuggcugcccucg

SEQ ID NO: 1497645 - RNA, 19 nt, Pseudomonas aeruginosa PA01
ggcuggcugcccucgacga

SEQ ID NO: 1497646 - RNA, 19 nt, Pseudomonas aeruginosa PA01
ggcuggcggggucgcgccg

SEQ ID NO: 1497647 - RNA, 20 nt, Pseudomonas aeruginosa PA01
ggcuggcugguaacgggcga

SEQ ID NO: 1497648 - RNA, 17 nt, Pseudomonas aeruginosa PA01
ggcuggggccggccugg

SEQ ID NO: 1497649 - RNA, 16 nt, Pseudomonas aeruginosa PA01
ggcugggcagcgccgc

SEQ ID NO: 1497650 - RNA, 21 nt, Pseudomonas aeruginosa PA01
ggcuggcgcaauacaccgcug

SEQ ID NO: 1497651 - RNA, 19 nt, Pseudomonas aeruginosa PA01
ggcuggcgcaggaccgcca

SEQ ID NO: 1497652 - RNA, 15 nt, Pseudomonas aeruginosa PA01
ggcuggccgcgacgu

SEQ ID NO: 1497653 - RNA, 19 nt, Pseudomonas aeruginosa PA01
ggcuggccgccucgcgccg

SEQ ID NO: 1497654 - RNA, 16 nt, Pseudomonas aeruginosa PA01
ggcuggcggcauaggc

SEQ ID NO: 1497655 - RNA, 14 nt, Pseudomonas aeruginosa PA01
ggcuggcggcaucg

SEQ ID NO: 1497656 - RNA, 16 nt, Pseudomonas aeruginosa PA01
ggcuggcgccgcgggu

SEQ ID NO: 1497657 - RNA, 17 nt, Pseudomonas aeruginosa PA01
ggcuggcgcuaccgcgc

SEQ ID NO: 1497658 - RNA, 15 nt, Pseudomonas aeruginosa PA01
ggcuggccaccgcca

SEQ ID NO: 1497659 - RNA, 14 nt, Pseudomonas aeruginosa PA01
ggcuggccgaggac

SEQ ID NO: 1497660 - RNA, 15 nt, Pseudomonas aeruginosa PA01
ggcuggccgagggcg

SEQ ID NO: 1497661 - RNA, 17 nt, Pseudomonas aeruginosa PA01
ggcuggccucagggcgc

SEQ ID NO: 1497662 - RNA, 14 nt, Pseudomonas aeruginosa PA01
ggcuggccucggcg

SEQ ID NO: 1497663 - RNA, 16 nt, Pseudomonas aeruginosa PA01
ggcuggccucggcgau

SEQ ID NO: 1497664 - RNA, 12 nt, Pseudomonas aeruginosa PA01
ggcuggcgaacc

SEQ ID NO: 1497665 - RNA, 20 nt, Pseudomonas aeruginosa PA01
ggcuggcgaaccaguccagc

SEQ ID NO: 1497666 - RNA, 23 nt, Pseudomonas aeruginosa PA01
ggcuggcgaaccaguccagcacg

SEQ ID NO: 1497667 - RNA, 18 nt, Pseudomonas aeruginosa PA01
gguuauucgcccuacccc

SEQ ID NO: 1497668 - RNA, 15 nt, Pseudomonas aeruginosa PA01
gguuauccgccgccg

SEQ ID NO: 1497669 - RNA, 23 nt, Pseudomonas aeruginosa PA01
gguuauccgccggaaccugcaug

SEQ ID NO: 1497670 - RNA, 17 nt, Pseudomonas aeruginosa PA01
gguucagcagcggcacc

SEQ ID NO: 1497671 - RNA, 20 nt, Pseudomonas aeruginosa PA01
gguucagcaggucgcggccc

SEQ ID NO: 1497672 - RNA, 22 nt, Pseudomonas aeruginosa PA01
gguucagcgggacagcuugccg

SEQ ID NO: 1497673 - RNA, 15 nt, Pseudomonas aeruginosa PA01
gguucaucgccgcca

SEQ ID NO: 1497674 - RNA, 21 nt, Pseudomonas aeruginosa PA01
gguucaucgagcggcggccgu

SEQ ID NO: 1497675 - RNA, 18 nt, Pseudomonas aeruginosa PA01
gguucaggguggcgauca

SEQ ID NO: 1497676 - RNA, 16 nt, Pseudomonas aeruginosa PA01
gguuccagcggccgcg

SEQ ID NO: 1497677 - RNA, 17 nt, Pseudomonas aeruginosa PA01
gguucggggaacagcgc

SEQ ID NO: 1497678 - RNA, 18 nt, Pseudomonas aeruginosa PA01
gguucggggaacagcgcc

SEQ ID NO: 1497679 - RNA, 21 nt, Pseudomonas aeruginosa PA01
gguucggggaacagcgccagc

SEQ ID NO: 1497680 - RNA, 18 nt, Pseudomonas aeruginosa PA01
gguucguccgcgcgaucg

SEQ ID NO: 1497681 - RNA, 15 nt, Pseudomonas aeruginosa PA01
gguucggcaaggcgc

SEQ ID NO: 1497682 - RNA, 13 nt, Pseudomonas aeruginosa PA01
gguucggcagcgc

SEQ ID NO: 1497683 - RNA, 15 nt, Pseudomonas aeruginosa PA01
gguucggcagcgccu

SEQ ID NO: 1497684 - RNA, 18 nt, Pseudomonas aeruginosa PA01
gguucggcagguugcucg

SEQ ID NO: 1497685 - RNA, 17 nt, Pseudomonas aeruginosa PA01
gguucgcguggcccggc

SEQ ID NO: 1497686 - RNA, 23 nt, Pseudomonas aeruginosa PA01
gguucgcguggcccggcgcggcg

SEQ ID NO: 1497687 - RNA, 16 nt, Pseudomonas aeruginosa PA01
gguuccucacggcgca

SEQ ID NO: 1497688 - RNA, 18 nt, Pseudomonas aeruginosa PA01
gguuccucacggcgcagc

SEQ ID NO: 1497689 - RNA, 18 nt, Pseudomonas aeruginosa PA01
gguucgaaugcugcccgg

SEQ ID NO: 1497690 - RNA, 21 nt, Pseudomonas aeruginosa PA01
gguucgacacgcucagccccg

SEQ ID NO: 1497691 - RNA, 20 nt, Pseudomonas aeruginosa PA01
gguucgagucccguccgcug

SEQ ID NO: 1497692 - RNA, 12 nt, Pseudomonas aeruginosa PA01
gguucgccgacg

SEQ ID NO: 1497693 - RNA, 16 nt, Pseudomonas aeruginosa PA01
gguucgcccgcgggca

SEQ ID NO: 1497694 - RNA, 19 nt, Pseudomonas aeruginosa PA01
gguuaccggcgaccaccgc

SEQ ID NO: 1497695 - RNA, 22 nt, Pseudomonas aeruginosa PA01
gguguugauggucaccuugacc

SEQ ID NO: 1497696 - RNA, 18 nt, Pseudomonas aeruginosa PA01
gguguucccggaucagcu

SEQ ID NO: 1497697 - RNA, 14 nt, Pseudomonas aeruginosa PA01
ggugugcagcagca

SEQ ID NO: 1497698 - RNA, 20 nt, Pseudomonas aeruginosa PA01
ggugucguuguugccgcgca

SEQ ID NO: 1497699 - RNA, 15 nt, Pseudomonas aeruginosa PA01
ggugugcucaggcga

SEQ ID NO: 1497700 - RNA, 16 nt, Pseudomonas aeruginosa PA01
ggugugcucaggcgaa

SEQ ID NO: 1497701 - RNA, 13 nt, Pseudomonas aeruginosa PA01
gguugugaucgac

SEQ ID NO: 1497702 - RNA, 20 nt, Pseudomonas aeruginosa PA01
gguuggcgaggucgcggacg

SEQ ID NO: 1497703 - RNA, 18 nt, Pseudomonas aeruginosa PA01
gguugggcagcgucgccg

SEQ ID NO: 1497704 - RNA, 21 nt, Pseudomonas aeruginosa PA01
gguugguggccgcgccgcccu

SEQ ID NO: 1497705 - RNA, 16 nt, Pseudomonas aeruginosa PA01
gguuggucugcucggc

SEQ ID NO: 1497706 - RNA, 19 nt, Pseudomonas aeruginosa PA01
gguuggucugcucggcgau

SEQ ID NO: 1497707 - RNA, 19 nt, Pseudomonas aeruginosa PA01
gguuguacagguuguucgg

SEQ ID NO: 1497708 - RNA, 15 nt, Pseudomonas aeruginosa PA01
gguugcgcuggcgca

SEQ ID NO: 1497709 - RNA, 21 nt, Pseudomonas aeruginosa PA01
gguugcugcugcggggccgga

SEQ ID NO: 1497710 - RNA, 23 nt, Pseudomonas aeruginosa PA01
gguugcucugggcauggcuggcg

SEQ ID NO: 1497711 - RNA, 13 nt, Pseudomonas aeruginosa PA01
gguugcggcgccc

SEQ ID NO: 1497712 - RNA, 14 nt, Pseudomonas aeruginosa PA01
gguugcggcgcccg

SEQ ID NO: 1497713 - RNA, 16 nt, Pseudomonas aeruginosa PA01
gguugcggcgcccgcc

SEQ ID NO: 1497714 - RNA, 19 nt, Pseudomonas aeruginosa PA01
gguugcggcgcccgccaag

SEQ ID NO: 1497715 - RNA, 12 nt, Pseudomonas aeruginosa PA01
gguuggccgccu

SEQ ID NO: 1497716 - RNA, 14 nt, Pseudomonas aeruginosa PA01
gguuggccgccugg

SEQ ID NO: 1497717 - RNA, 16 nt, Pseudomonas aeruginosa PA01
gguuggccgccuggcg

SEQ ID NO: 1497718 - RNA, 16 nt, Pseudomonas aeruginosa PA01
gguuggcgcaggccgg

SEQ ID NO: 1497719 - RNA, 20 nt, Pseudomonas aeruginosa PA01
gguuggcuacccgcagggcu

SEQ ID NO: 1497720 - RNA, 22 nt, Pseudomonas aeruginosa PA01
gguuggcuacccgcagggcucg

SEQ ID NO: 1497721 - RNA, 20 nt, Pseudomonas aeruginosa PA01
gguuggccaguuggcccuug

SEQ ID NO: 1497722 - RNA, 13 nt, Pseudomonas aeruginosa PA01
gguuggccuggcc

SEQ ID NO: 1497723 - RNA, 18 nt, Pseudomonas aeruginosa PA01
gguuggccuggcccggcg

SEQ ID NO: 1497724 - RNA, 22 nt, Pseudomonas aeruginosa PA01
gguuggccuggcccggcgcacu

SEQ ID NO: 1497725 - RNA, 11 nt, Pseudomonas aeruginosa PA01
gguugcgccgc

SEQ ID NO: 1497726 - RNA, 18 nt, Pseudomonas aeruginosa PA01
gguugcgcggcaggacga

SEQ ID NO: 1497727 - RNA, 21 nt, Pseudomonas aeruginosa PA01
gguugcgccauugccgccagg

SEQ ID NO: 1497728 - RNA, 16 nt, Pseudomonas aeruginosa PA01
gguugcgaggcccgua

SEQ ID NO: 1497729 - RNA, 20 nt, Pseudomonas aeruginosa PA01
gguugcccucgcagccggcg

SEQ ID NO: 1497730 - RNA, 20 nt, Pseudomonas aeruginosa PA01
gguugccugcuguguccggc

SEQ ID NO: 1497731 - RNA, 14 nt, Pseudomonas aeruginosa PA01
gguugccgccgauc

SEQ ID NO: 1497732 - RNA, 21 nt, Pseudomonas aeruginosa PA01
gguugccgccgaucagcgcgc

SEQ ID NO: 1497733 - RNA, 13 nt, Pseudomonas aeruginosa PA01
gguugccgcgccg

SEQ ID NO: 1497734 - RNA, 21 nt, Pseudomonas aeruginosa PA01
gguugccggagacgauggcga

SEQ ID NO: 1497735 - RNA, 15 nt, Pseudomonas aeruginosa PA01
gguugccggcgugca

SEQ ID NO: 1497736 - RNA, 18 nt, Pseudomonas aeruginosa PA01
gguugaucgacgccagcu

SEQ ID NO: 1497737 - RNA, 24 nt, Pseudomonas aeruginosa PA01
gguugaucgagaaauaggcgcugc

SEQ ID NO: 1497738 - RNA, 14 nt, Pseudomonas aeruginosa PA01
gguugaugccgacg

SEQ ID NO: 1497739 - RNA, 20 nt, Pseudomonas aeruginosa PA01
gguugauuuccgcaccgagg

SEQ ID NO: 1497740 - RNA, 22 nt, Pseudomonas aeruginosa PA01
gguugcagccaccagccgaaca

SEQ ID NO: 1497741 - RNA, 12 nt, Pseudomonas aeruginosa PA01
gguugccaggcc

SEQ ID NO: 1497742 - RNA, 14 nt, Pseudomonas aeruginosa PA01
gguugccaggccgg

SEQ ID NO: 1497743 - RNA, 16 nt, Pseudomonas aeruginosa PA01
gguugccaggccggcg

SEQ ID NO: 1497744 - RNA, 18 nt, Pseudomonas aeruginosa PA01
gguugccaggccggcgca

SEQ ID NO: 1497745 - RNA, 19 nt, Pseudomonas aeruginosa PA01
gguugcccagcaggcucau

SEQ ID NO: 1497746 - RNA, 13 nt, Pseudomonas aeruginosa PA01
gguugaccccgcg

SEQ ID NO: 1497747 - RNA, 17 nt, Pseudomonas aeruginosa PA01
gguugaccccgcggccg

SEQ ID NO: 1497748 - RNA, 15 nt, Pseudomonas aeruginosa PA01
gguugaaggcgcggu

SEQ ID NO: 1497749 - RNA, 23 nt, Pseudomonas aeruginosa PA01
gguugacccagagccgcucggcg

SEQ ID NO: 1497750 - RNA, 22 nt, Pseudomonas aeruginosa PA01
gguugaccuuguccuggccggc

SEQ ID NO: 1497751 - RNA, 20 nt, Pseudomonas aeruginosa PA01
gguugacgaugcggcccgcc

SEQ ID NO: 1497752 - RNA, 21 nt, Pseudomonas aeruginosa PA01
gguugacgaugcggcccgccg

SEQ ID NO: 1497753 - RNA, 20 nt, Pseudomonas aeruginosa PA01
gguugagauccuggccggcg

SEQ ID NO: 1497754 - RNA, 23 nt, Pseudomonas aeruginosa PA01
gguugagauccuggccggcggcg

SEQ ID NO: 1497755 - RNA, 20 nt, Pseudomonas aeruginosa PA01
gguugaguugcaggccggcg

SEQ ID NO: 1497756 - RNA, 21 nt, Pseudomonas aeruginosa PA01
gguugaguugcaggccggcga

SEQ ID NO: 1497757 - RNA, 14 nt, Pseudomonas aeruginosa PA01
gguugaggcgcucg

SEQ ID NO: 1497758 - RNA, 20 nt, Pseudomonas aeruginosa PA01
gguugaggcgcucguagagc

SEQ ID NO: 1497759 - RNA, 23 nt, Pseudomonas aeruginosa PA01
gguugagguagagcacgccgucg

SEQ ID NO: 1497760 - RNA, 21 nt, Pseudomonas aeruginosa PA01
gguucugcucgaacaucagca

SEQ ID NO: 1497761 - RNA, 20 nt, Pseudomonas aeruginosa PA01
gguucugccagagcgcugcc

SEQ ID NO: 1497762 - RNA, 22 nt, Pseudomonas aeruginosa PA01
gguucuccaggcuuugcggcaa

SEQ ID NO: 1497763 - RNA, 14 nt, Pseudomonas aeruginosa PA01
gguucucggccacc

SEQ ID NO: 1497764 - RNA, 20 nt, Pseudomonas aeruginosa PA01
ggugggcagcagcgaacgcc

SEQ ID NO: 1497765 - RNA, 20 nt, Pseudomonas aeruginosa PA01
gguggcguucucgaucaucg

SEQ ID NO: 1497766 - RNA, 13 nt, Pseudomonas aeruginosa PA01
ggugggcgccgcu

SEQ ID NO: 1497767 - RNA, 14 nt, Pseudomonas aeruginosa PA01
gguggggcgccggc

SEQ ID NO: 1497768 - RNA, 19 nt, Pseudomonas aeruginosa PA01
gguggggccgccgaugccg

SEQ ID NO: 1497769 - RNA, 20 nt, Pseudomonas aeruginosa PA01
gguggucgccgcccacgccu

SEQ ID NO: 1497770 - RNA, 19 nt, Pseudomonas aeruginosa PA01
gguggucgaugggcgagcg

SEQ ID NO: 1497771 - RNA, 17 nt, Pseudomonas aeruginosa PA01
gguggugaacaggcgga

SEQ ID NO: 1497772 - RNA, 18 nt, Pseudomonas aeruginosa PA01
gguggugaucagcggccg

SEQ ID NO: 1497773 - RNA, 16 nt, Pseudomonas aeruginosa PA01
ggugguagagcggcac

SEQ ID NO: 1497774 - RNA, 15 nt, Pseudomonas aeruginosa PA01
gguggucagccagcc

SEQ ID NO: 1497775 - RNA, 15 nt, Pseudomonas aeruginosa PA01
gguguccgcggugcc

SEQ ID NO: 1497776 - RNA, 18 nt, Pseudomonas aeruginosa PA01
gguguccggcggcgauga

SEQ ID NO: 1497777 - RNA, 14 nt, Pseudomonas aeruginosa PA01
gguguccaccacca

SEQ ID NO: 1497778 - RNA, 17 nt, Pseudomonas aeruginosa PA01
gguguccaccaccagca

SEQ ID NO: 1497779 - RNA, 20 nt, Pseudomonas aeruginosa PA01
gguguccaccaccagcaggc

SEQ ID NO: 1497780 - RNA, 15 nt, Pseudomonas aeruginosa PA01
ggugucggccgccag

SEQ ID NO: 1497781 - RNA, 14 nt, Pseudomonas aeruginosa PA01
ggugucaggccgag

SEQ ID NO: 1497782 - RNA, 22 nt, Pseudomonas aeruginosa PA01
gguguacuugacggcgccgaug

SEQ ID NO: 1497783 - RNA, 19 nt, Pseudomonas aeruginosa PA01
gguguagaccaccagcagg

SEQ ID NO: 1497784 - RNA, 15 nt, Pseudomonas aeruginosa PA01
gguguagcugcagcg

SEQ ID NO: 1497785 - RNA, 18 nt, Pseudomonas aeruginosa PA01
gguguagcugcagcgccc

SEQ ID NO: 1497786 - RNA, 19 nt, Pseudomonas aeruginosa PA01
gguguaggcgaucuggcga

SEQ ID NO: 1497787 - RNA, 22 nt, Pseudomonas aeruginosa PA01
gguguaucggcggauaacgccg

SEQ ID NO: 1497788 - RNA, 17 nt, Pseudomonas aeruginosa PA01
ggugauguaggccgcuu

SEQ ID NO: 1497789 - RNA, 14 nt, Pseudomonas aeruginosa PA01
ggugaugcgucgca

SEQ ID NO: 1497790 - RNA, 20 nt, Pseudomonas aeruginosa PA01
ggugaugguaucgccguccu

SEQ ID NO: 1497791 - RNA, 17 nt, Pseudomonas aeruginosa PA01
ggugaugaagucggcgu

SEQ ID NO: 1497792 - RNA, 14 nt, Pseudomonas aeruginosa PA01
gguggaccagcgcc

SEQ ID NO: 1497793 - RNA, 15 nt, Pseudomonas aeruginosa PA01
gguggaccagcgccg

SEQ ID NO: 1497794 - RNA, 16 nt, Pseudomonas aeruginosa PA01
gguggaccagcgccgc

SEQ ID NO: 1497795 - RNA, 17 nt, Pseudomonas aeruginosa PA01
gguggaccagcgccgcc

SEQ ID NO: 1497796 - RNA, 18 nt, Pseudomonas aeruginosa PA01
gguggaccagcgccgcca

SEQ ID NO: 1497797 - RNA, 21 nt, Pseudomonas aeruginosa PA01
gguggaacagccgcagcggca

SEQ ID NO: 1497798 - RNA, 20 nt, Pseudomonas aeruginosa PA01
gguggaacccauggcgcgau

SEQ ID NO: 1497799 - RNA, 13 nt, Pseudomonas aeruginosa PA01
gguggaacgaggc

SEQ ID NO: 1497800 - RNA, 13 nt, Pseudomonas aeruginosa PA01
gguggaagcgcgc

SEQ ID NO: 1497801 - RNA, 20 nt, Pseudomonas aeruginosa PA01
ggugcuggucgugguccagc

SEQ ID NO: 1497802 - RNA, 16 nt, Pseudomonas aeruginosa PA01
ggugcuggugcggccg

SEQ ID NO: 1497803 - RNA, 19 nt, Pseudomonas aeruginosa PA01
ggugcuggugggcgucgcu

SEQ ID NO: 1497804 - RNA, 13 nt, Pseudomonas aeruginosa PA01
ggugcuuggcacc

SEQ ID NO: 1497805 - RNA, 22 nt, Pseudomonas aeruginosa PA01
ggugcuuuccugcuccagcagg

SEQ ID NO: 1497806 - RNA, 18 nt, Pseudomonas aeruginosa PA01
ggugcuuugcauggccug

SEQ ID NO: 1497807 - RNA, 12 nt, Pseudomonas aeruginosa PA01
ggugcugccgau

SEQ ID NO: 1497808 - RNA, 16 nt, Pseudomonas aeruginosa PA01
ggugcugcgcgcggcc

SEQ ID NO: 1497809 - RNA, 19 nt, Pseudomonas aeruginosa PA01
ggugcuggcgucgccuucc

SEQ ID NO: 1497810 - RNA, 13 nt, Pseudomonas aeruginosa PA01
gguggccgcgccg

SEQ ID NO: 1497811 - RNA, 23 nt, Pseudomonas aeruginosa PA01
gguggccgcguaccaguagcgac

SEQ ID NO: 1497812 - RNA, 20 nt, Pseudomonas aeruginosa PA01
gguggccuccugcaacgccu

SEQ ID NO: 1497813 - RNA, 14 nt, Pseudomonas aeruginosa PA01
gguggcgaacagca

SEQ ID NO: 1497814 - RNA, 16 nt, Pseudomonas aeruginosa PA01
gguggcgaacagcacc

SEQ ID NO: 1497815 - RNA, 17 nt, Pseudomonas aeruginosa PA01
gguggcgaacagcaccu

SEQ ID NO: 1497816 - RNA, 17 nt, Pseudomonas aeruginosa PA01
gguggcgcacugccagg

SEQ ID NO: 1497817 - RNA, 21 nt, Pseudomonas aeruginosa PA01
gguggcgcacugccaggagca

SEQ ID NO: 1497818 - RNA, 15 nt, Pseudomonas aeruginosa PA01
gguggcgaccaggac

SEQ ID NO: 1497819 - RNA, 19 nt, Pseudomonas aeruginosa PA01
gguggcgaccaggacagca

SEQ ID NO: 1497820 - RNA, 15 nt, Pseudomonas aeruginosa PA01
gguggcgacgaagac

SEQ ID NO: 1497821 - RNA, 21 nt, Pseudomonas aeruginosa PA01
gguggcgacgaagacgcugcg

SEQ ID NO: 1497822 - RNA, 18 nt, Pseudomonas aeruginosa PA01
gguggcgacgccggucgg

SEQ ID NO: 1497823 - RNA, 12 nt, Pseudomonas aeruginosa PA01
gguggcgaucac

SEQ ID NO: 1497824 - RNA, 14 nt, Pseudomonas aeruginosa PA01
gguggcggcggcga

SEQ ID NO: 1497825 - RNA, 15 nt, Pseudomonas aeruginosa PA01
gguggcggcggcgag

SEQ ID NO: 1497826 - RNA, 14 nt, Pseudomonas aeruginosa PA01
gguggcggaucugc

SEQ ID NO: 1497827 - RNA, 13 nt, Pseudomonas aeruginosa PA01
gguggcggcgacg

SEQ ID NO: 1497828 - RNA, 15 nt, Pseudomonas aeruginosa PA01
gguggcgggucggcg

SEQ ID NO: 1497829 - RNA, 11 nt, Pseudomonas aeruginosa PA01
gguggcgcgga

SEQ ID NO: 1497830 - RNA, 14 nt, Pseudomonas aeruginosa PA01
gguggcgcgcacca

SEQ ID NO: 1497831 - RNA, 13 nt, Pseudomonas aeruginosa PA01
gguggcgcuggcc

SEQ ID NO: 1497832 - RNA, 13 nt, Pseudomonas aeruginosa PA01
gguggcgcugucg

SEQ ID NO: 1497833 - RNA, 14 nt, Pseudomonas aeruginosa PA01
gguggcgcugucgc

SEQ ID NO: 1497834 - RNA, 13 nt, Pseudomonas aeruginosa PA01
gguggcgccggcu

SEQ ID NO: 1497835 - RNA, 23 nt, Pseudomonas aeruginosa PA01
gguggcgccggcugacgcuggcg

SEQ ID NO: 1497836 - RNA, 12 nt, Pseudomonas aeruginosa PA01
gguggcgccgcc

SEQ ID NO: 1497837 - RNA, 17 nt, Pseudomonas aeruginosa PA01
gguggcgccgccggcga

SEQ ID NO: 1497838 - RNA, 14 nt, Pseudomonas aeruginosa PA01
gguggcgcccagcc

SEQ ID NO: 1497839 - RNA, 18 nt, Pseudomonas aeruginosa PA01
gguggcgcccaugccgcc

SEQ ID NO: 1497840 - RNA, 21 nt, Pseudomonas aeruginosa PA01
gguggcgcccaugccgcccgg

SEQ ID NO: 1497841 - RNA, 16 nt, Pseudomonas aeruginosa PA01
guagcgggccagcagc

SEQ ID NO: 1497842 - RNA, 16 nt, Pseudomonas aeruginosa PA01
guagcguugcgccaga

SEQ ID NO: 1497843 - RNA, 15 nt, Pseudomonas aeruginosa PA01
guagcguugcgcgag

SEQ ID NO: 1497844 - RNA, 16 nt, Pseudomonas aeruginosa PA01
guagcguugcgcgagc

SEQ ID NO: 1497845 - RNA, 18 nt, Pseudomonas aeruginosa PA01
guagcguuaucgccgguc

SEQ ID NO: 1497846 - RNA, 21 nt, Pseudomonas aeruginosa PA01
guagcguuaucgccgguccuc

SEQ ID NO: 1497847 - RNA, 21 nt, Pseudomonas aeruginosa PA01
guagcggcguucgccgagcaa

SEQ ID NO: 1497848 - RNA, 16 nt, Pseudomonas aeruginosa PA01
guagcggcucgccgaa

SEQ ID NO: 1497849 - RNA, 23 nt, Pseudomonas aeruginosa PA01
guagcggccucguucggcgacca

SEQ ID NO: 1497850 - RNA, 14 nt, Pseudomonas aeruginosa PA01
guagcggcgaagcg

SEQ ID NO: 1497851 - RNA, 15 nt, Pseudomonas aeruginosa PA01
guagcggcaggagca

SEQ ID NO: 1497852 - RNA, 22 nt, Pseudomonas aeruginosa PA01
guagcggcaggguacgggucgg

SEQ ID NO: 1497853 - RNA, 20 nt, Pseudomonas aeruginosa PA01
guagccggccagggcgcggu

SEQ ID NO: 1497854 - RNA, 14 nt, Pseudomonas aeruginosa PA01
guagccggcgagcg

SEQ ID NO: 1497855 - RNA, 18 nt, Pseudomonas aeruginosa PA01
guagccggcgaucagcgc

SEQ ID NO: 1497856 - RNA, 14 nt, Pseudomonas aeruginosa PA01
guagccggcgaucc

SEQ ID NO: 1497857 - RNA, 19 nt, Pseudomonas aeruginosa PA01
guagccggcgauccgcugc

SEQ ID NO: 1497858 - RNA, 15 nt, Pseudomonas aeruginosa PA01
guagccggcgaugug

SEQ ID NO: 1497859 - RNA, 12 nt, Pseudomonas aeruginosa PA01
guagccggcgcc

SEQ ID NO: 1497860 - RNA, 14 nt, Pseudomonas aeruginosa PA01
guagccggcgccgu

SEQ ID NO: 1497861 - RNA, 16 nt, Pseudomonas aeruginosa PA01
guagccggcgcggcgc

SEQ ID NO: 1497862 - RNA, 17 nt, Pseudomonas aeruginosa PA01
guagccggcgcggcgca

SEQ ID NO: 1497863 - RNA, 13 nt, Pseudomonas aeruginosa PA01
guagccggcggcg

SEQ ID NO: 1497864 - RNA, 14 nt, Pseudomonas aeruginosa PA01
guagcccgcggcga

SEQ ID NO: 1497865 - RNA, 19 nt, Pseudomonas aeruginosa PA01
guagcccccgccgcugagg

SEQ ID NO: 1497866 - RNA, 19 nt, Pseudomonas aeruginosa PA01
guagccccggcccggcgug

SEQ ID NO: 1497867 - RNA, 14 nt, Pseudomonas aeruginosa PA01
guagccgaggcggc

SEQ ID NO: 1497868 - RNA, 15 nt, Pseudomonas aeruginosa PA01
guagccgaggcggcc

SEQ ID NO: 1497869 - RNA, 18 nt, Pseudomonas aeruginosa PA01
guagcccugggcgaugcg

SEQ ID NO: 1497870 - RNA, 20 nt, Pseudomonas aeruginosa PA01
guagcccuucuccgccagcc

SEQ ID NO: 1497871 - RNA, 17 nt, Pseudomonas aeruginosa PA01
guagccgaacggguaga

SEQ ID NO: 1497872 - RNA, 18 nt, Pseudomonas aeruginosa PA01
guagccggccaaccaccg

SEQ ID NO: 1497873 - RNA, 20 nt, Pseudomonas aeruginosa PA01
guagccggccaaccaccggc

SEQ ID NO: 1497874 - RNA, 13 nt, Pseudomonas aeruginosa PA01
guagccgcgccgg

SEQ ID NO: 1497875 - RNA, 15 nt, Pseudomonas aeruginosa PA01
guagccgcgccggcc

SEQ ID NO: 1497876 - RNA, 16 nt, Pseudomonas aeruginosa PA01
guagccgcgcgccagc

SEQ ID NO: 1497877 - RNA, 21 nt, Pseudomonas aeruginosa PA01
guagccgacccgcuugagcca

SEQ ID NO: 1497878 - RNA, 19 nt, Pseudomonas aeruginosa PA01
guagccgcaguccagggcg

SEQ ID NO: 1497879 - RNA, 20 nt, Pseudomonas aeruginosa PA01
guagccgcaguccagggcga

SEQ ID NO: 1497880 - RNA, 23 nt, Pseudomonas aeruginosa PA01
guagccgcaguccagggcgaugg

SEQ ID NO: 1497881 - RNA, 16 nt, Pseudomonas aeruginosa PA01
guagccgcccaccgcg

SEQ ID NO: 1497882 - RNA, 19 nt, Pseudomonas aeruginosa PA01
guacuccgagggccgcgcc

SEQ ID NO: 1497883 - RNA, 17 nt, Pseudomonas aeruginosa PA01
guacucgauggucaggu

SEQ ID NO: 1497884 - RNA, 20 nt, Pseudomonas aeruginosa PA01
guacucgauggucagguagg

SEQ ID NO: 1497885 - RNA, 13 nt, Pseudomonas aeruginosa PA01
guacuccuccagc

SEQ ID NO: 1497886 - RNA, 23 nt, Pseudomonas aeruginosa PA01
guagaacaggcgauagccgacca

SEQ ID NO: 1497887 - RNA, 16 nt, Pseudomonas aeruginosa PA01
guagaacaggcugccg

SEQ ID NO: 1497888 - RNA, 11 nt, Pseudomonas aeruginosa PA01
guagaccacca

SEQ ID NO: 1497889 - RNA, 15 nt, Pseudomonas aeruginosa PA01
guagaccaccagcag

SEQ ID NO: 1497890 - RNA, 23 nt, Pseudomonas aeruginosa PA01
guagacguccuccaccgcuccgg

SEQ ID NO: 1497891 - RNA, 20 nt, Pseudomonas aeruginosa PA01
guagaagucguccucgcccu

SEQ ID NO: 1497892 - RNA, 14 nt, Pseudomonas aeruginosa PA01
guagaacggcggca

SEQ ID NO: 1497893 - RNA, 14 nt, Pseudomonas aeruginosa PA01
guagaacucgcccu

SEQ ID NO: 1497894 - RNA, 20 nt, Pseudomonas aeruginosa PA01
guagaggucgccguccuugu

SEQ ID NO: 1497895 - RNA, 14 nt, Pseudomonas aeruginosa PA01
guagagguugccgu

SEQ ID NO: 1497896 - RNA, 19 nt, Pseudomonas aeruginosa PA01
guagagucgcucgcgcagg

SEQ ID NO: 1497897 - RNA, 20 nt, Pseudomonas aeruginosa PA01
guagagcgcggcgcaggcga

SEQ ID NO: 1497898 - RNA, 20 nt, Pseudomonas aeruginosa PA01
guagaggaugccggccucga

SEQ ID NO: 1497899 - RNA, 16 nt, Pseudomonas aeruginosa PA01
guagaggcucggcggc

SEQ ID NO: 1497900 - RNA, 19 nt, Pseudomonas aeruginosa PA01
guagaggcugucgucgagg

SEQ ID NO: 1497901 - RNA, 16 nt, Pseudomonas aeruginosa PA01
guagagacggcggcga

SEQ ID NO: 1497902 - RNA, 12 nt, Pseudomonas aeruginosa PA01
guagagcacgcc

SEQ ID NO: 1497903 - RNA, 17 nt, Pseudomonas aeruginosa PA01
guagagcagcccgggca

SEQ ID NO: 1497904 - RNA, 19 nt, Pseudomonas aeruginosa PA01
guagccaggggucaggccg

SEQ ID NO: 1497905 - RNA, 17 nt, Pseudomonas aeruginosa PA01
guagccaugcacacgcu

SEQ ID NO: 1497906 - RNA, 19 nt, Pseudomonas aeruginosa PA01
guagccaugcacacgcucc

SEQ ID NO: 1497907 - RNA, 14 nt, Pseudomonas aeruginosa PA01
guagccauggcgga

SEQ ID NO: 1497908 - RNA, 13 nt, Pseudomonas aeruginosa PA01
guagcccaggcgg

SEQ ID NO: 1497909 - RNA, 14 nt, Pseudomonas aeruginosa PA01
guagcccaggggca

SEQ ID NO: 1497910 - RNA, 16 nt, Pseudomonas aeruginosa PA01
guagaguucggcugcg

SEQ ID NO: 1497911 - RNA, 17 nt, Pseudomonas aeruginosa PA01
guagaguuugccgaacu

SEQ ID NO: 1497912 - RNA, 20 nt, Pseudomonas aeruginosa PA01
guagaucauuuuccggguca

SEQ ID NO: 1497913 - RNA, 15 nt, Pseudomonas aeruginosa PA01
guaggcgguggccac

SEQ ID NO: 1497914 - RNA, 17 nt, Pseudomonas aeruginosa PA01
guaggcgucgucgaccu

SEQ ID NO: 1497915 - RNA, 22 nt, Pseudomonas aeruginosa PA01
guaggcucccccgcgccgccgg

SEQ ID NO: 1497916 - RNA, 19 nt, Pseudomonas aeruginosa PA01
guaggcucugcuccagcaa

SEQ ID NO: 1497917 - RNA, 20 nt, Pseudomonas aeruginosa PA01
guagggcaucgccgacaggu

SEQ ID NO: 1497918 - RNA, 14 nt, Pseudomonas aeruginosa PA01
guagggacggugca

SEQ ID NO: 1497919 - RNA, 23 nt, Pseudomonas aeruginosa PA01
guagggacggugcaggccgacgu

SEQ ID NO: 1497920 - RNA, 14 nt, Pseudomonas aeruginosa PA01
guaggcguccuggc

SEQ ID NO: 1497921 - RNA, 16 nt, Pseudomonas aeruginosa PA01
guaggcguccuggcga

SEQ ID NO: 1497922 - RNA, 18 nt, Pseudomonas aeruginosa PA01
guagggucgcagcaggcc

SEQ ID NO: 1497923 - RNA, 16 nt, Pseudomonas aeruginosa PA01
guaggguucgccgacg

SEQ ID NO: 1497924 - RNA, 17 nt, Pseudomonas aeruginosa PA01
guaggguucgccgacgu

SEQ ID NO: 1497925 - RNA, 17 nt, Pseudomonas aeruginosa PA01
guaggugaagcccaggc

SEQ ID NO: 1497926 - RNA, 15 nt, Pseudomonas aeruginosa PA01
guaggugaccgccca

SEQ ID NO: 1497927 - RNA, 17 nt, Pseudomonas aeruginosa PA01
guaggugaccgcccagg

SEQ ID NO: 1497928 - RNA, 15 nt, Pseudomonas aeruginosa PA01
guagguagcguugcg

SEQ ID NO: 1497929 - RNA, 20 nt, Pseudomonas aeruginosa PA01
guagggcguauaaccgcucg

SEQ ID NO: 1497930 - RNA, 21 nt, Pseudomonas aeruginosa PA01
guaggggaauuucacgccgaa

SEQ ID NO: 1497931 - RNA, 15 nt, Pseudomonas aeruginosa PA01
guagggguggccagg

SEQ ID NO: 1497932 - RNA, 20 nt, Pseudomonas aeruginosa PA01
guagggcgaacaaccgcucg

SEQ ID NO: 1497933 - RNA, 21 nt, Pseudomonas aeruginosa PA01
guagggcgaacaacgccgccg

SEQ ID NO: 1497934 - RNA, 23 nt, Pseudomonas aeruginosa PA01
guagggcgaacaacgccgccggc

SEQ ID NO: 1497935 - RNA, 21 nt, Pseudomonas aeruginosa PA01
guagggcgaauaucgcggcgc

SEQ ID NO: 1497936 - RNA, 19 nt, Pseudomonas aeruginosa PA01
guagggcgacgcccgaggc

SEQ ID NO: 1497937 - RNA, 20 nt, Pseudomonas aeruginosa PA01
guagggcgcauaaccgcucg

SEQ ID NO: 1497938 - RNA, 14 nt, Pseudomonas aeruginosa PA01
guauccgccggccg

SEQ ID NO: 1497939 - RNA, 22 nt, Pseudomonas aeruginosa PA01
guauccgccggccggggcgcgc

SEQ ID NO: 1497940 - RNA, 22 nt, Pseudomonas aeruginosa PA01
guauccguacuggcgccaggcc

SEQ ID NO: 1497941 - RNA, 14 nt, Pseudomonas aeruginosa PA01
guauccuccgcgac

SEQ ID NO: 1497942 - RNA, 18 nt, Pseudomonas aeruginosa PA01
guauagcucauggccagg

SEQ ID NO: 1497943 - RNA, 13 nt, Pseudomonas aeruginosa PA01
guauaccagcggc

SEQ ID NO: 1497944 - RNA, 14 nt, Pseudomonas aeruginosa PA01
guauaccagcggcu

SEQ ID NO: 1497945 - RNA, 19 nt, Pseudomonas aeruginosa PA01
guaguucuccaccgccacc

SEQ ID NO: 1497946 - RNA, 12 nt, Pseudomonas aeruginosa PA01
guaggccagcgg

SEQ ID NO: 1497947 - RNA, 22 nt, Pseudomonas aeruginosa PA01
guaggccaggcagaccagcgca

SEQ ID NO: 1497948 - RNA, 20 nt, Pseudomonas aeruginosa PA01
guaggacagguucaggucga

SEQ ID NO: 1497949 - RNA, 23 nt, Pseudomonas aeruginosa PA01
guaggacagguucaggucgaugc

SEQ ID NO: 1497950 - RNA, 15 nt, Pseudomonas aeruginosa PA01
guaggcaggcgcggc

SEQ ID NO: 1497951 - RNA, 18 nt, Pseudomonas aeruginosa PA01
guaggcaucgacgccagc

SEQ ID NO: 1497952 - RNA, 23 nt, Pseudomonas aeruginosa PA01
guaggcaucgaucuugcccaugu

SEQ ID NO: 1497953 - RNA, 21 nt, Pseudomonas aeruginosa PA01
guaggccacuucccggcgcag

SEQ ID NO: 1497954 - RNA, 15 nt, Pseudomonas aeruginosa PA01
guaggcacaggaccc

SEQ ID NO: 1497955 - RNA, 23 nt, Pseudomonas aeruginosa PA01
guaggcacaggacccuuccagcg

SEQ ID NO: 1497956 - RNA, 17 nt, Pseudomonas aeruginosa PA01
guaggagaugcagcguc

SEQ ID NO: 1497957 - RNA, 14 nt, Pseudomonas aeruginosa PA01
guaggagccggcca

SEQ ID NO: 1497958 - RNA, 16 nt, Pseudomonas aeruginosa PA01
guaggagccggccagg

SEQ ID NO: 1497959 - RNA, 13 nt, Pseudomonas aeruginosa PA01
guaggagccgucg

SEQ ID NO: 1497960 - RNA, 17 nt, Pseudomonas aeruginosa PA01
guaggacagggccaggc

SEQ ID NO: 1497961 - RNA, 20 nt, Pseudomonas aeruginosa PA01
guaggacagggccaggccga

SEQ ID NO: 1497962 - RNA, 24 nt, Pseudomonas aeruginosa PA01
guaggacagggccaggccgagcaa

SEQ ID NO: 1497963 - RNA, 17 nt, Pseudomonas aeruginosa PA01
guaggccgucgcugccg

SEQ ID NO: 1497964 - RNA, 22 nt, Pseudomonas aeruginosa PA01
guaggcgauggccuggucggcg

SEQ ID NO: 1497965 - RNA, 16 nt, Pseudomonas aeruginosa PA01
guaggcgcaccaggcc

SEQ ID NO: 1497966 - RNA, 21 nt, Pseudomonas aeruginosa PA01
aagucguuguacuggccgaaa

SEQ ID NO: 1497967 - RNA, 22 nt, Pseudomonas aeruginosa PA01
guaggcgcugcaaucgcugccg

SEQ ID NO: 1497968 - RNA, 23 nt, Pseudomonas aeruginosa PA01
guaggcgcugcaaucgcugccgg

SEQ ID NO: 1497969 - RNA, 14 nt, Pseudomonas aeruginosa PA01
guaggcgcgggugg

SEQ ID NO: 1497970 - RNA, 13 nt, Pseudomonas aeruginosa PA01
guaggcgccgccg

SEQ ID NO: 1497971 - RNA, 13 nt, Pseudomonas aeruginosa PA01
guaggcgagcagc

SEQ ID NO: 1497972 - RNA, 20 nt, Pseudomonas aeruginosa PA01
guaaugcaacccgccgcuga

SEQ ID NO: 1497973 - RNA, 23 nt, Pseudomonas aeruginosa PA01
guaauucgcugacgaggacgccg

SEQ ID NO: 1497974 - RNA, 14 nt, Pseudomonas aeruginosa PA01
guacagcaggagcg

SEQ ID NO: 1497975 - RNA, 16 nt, Pseudomonas aeruginosa PA01
guacagcaggagcgcc

SEQ ID NO: 1497976 - RNA, 14 nt, Pseudomonas aeruginosa PA01
guacagcacccagg

SEQ ID NO: 1497977 - RNA, 16 nt, Pseudomonas aeruginosa PA01
guacagcacccaggcg

SEQ ID NO: 1497978 - RNA, 15 nt, Pseudomonas aeruginosa PA01
guaacccagggugcg

SEQ ID NO: 1497979 - RNA, 16 nt, Pseudomonas aeruginosa PA01
gguuuccugcccgacc

SEQ ID NO: 1497980 - RNA, 16 nt, Pseudomonas aeruginosa PA01
gguuuccggccaggcg

SEQ ID NO: 1497981 - RNA, 19 nt, Pseudomonas aeruginosa PA01
gguuuccccguggcgccgc

SEQ ID NO: 1497982 - RNA, 21 nt, Pseudomonas aeruginosa PA01
gguuuccgccggacccugccg

SEQ ID NO: 1497983 - RNA, 15 nt, Pseudomonas aeruginosa PA01
gguuucgcugcugcc

SEQ ID NO: 1497984 - RNA, 22 nt, Pseudomonas aeruginosa PA01
gguuucugcuggccaccgcggc

SEQ ID NO: 1497985 - RNA, 18 nt, Pseudomonas aeruginosa PA01
gguuucuucgccuugccc

SEQ ID NO: 1497986 - RNA, 19 nt, Pseudomonas aeruginosa PA01
gguuucuucgccuugcccu

SEQ ID NO: 1497987 - RNA, 17 nt, Pseudomonas aeruginosa PA01
guaccgcugcggccggc

SEQ ID NO: 1497988 - RNA, 18 nt, Pseudomonas aeruginosa PA01
guaccgcugcggccggcg

SEQ ID NO: 1497989 - RNA, 13 nt, Pseudomonas aeruginosa PA01
guaccgcuggcgc

SEQ ID NO: 1497990 - RNA, 14 nt, Pseudomonas aeruginosa PA01
guaccgcuggcgcu

SEQ ID NO: 1497991 - RNA, 16 nt, Pseudomonas aeruginosa PA01
guaccgggccaggcaa

SEQ ID NO: 1497992 - RNA, 14 nt, Pseudomonas aeruginosa PA01
guaccggccaggcg

SEQ ID NO: 1497993 - RNA, 19 nt, Pseudomonas aeruginosa PA01
guaccggcagcgccgaggu

SEQ ID NO: 1497994 - RNA, 18 nt, Pseudomonas aeruginosa PA01
guaccggcuacaggccgu

SEQ ID NO: 1497995 - RNA, 23 nt, Pseudomonas aeruginosa PA01
guaccgccacguacagcgcgaca

SEQ ID NO: 1497996 - RNA, 21 nt, Pseudomonas aeruginosa PA01
guaccaggguguugucgcggc

SEQ ID NO: 1497997 - RNA, 15 nt, Pseudomonas aeruginosa PA01
guaccagcgcgcagc

SEQ ID NO: 1497998 - RNA, 15 nt, Pseudomonas aeruginosa PA01
guaccagccgcgguc

SEQ ID NO: 1497999 - RNA, 20 nt, Pseudomonas aeruginosa PA01
guaccagggaagcgcgcgcc

SEQ ID NO: 1498000 - RNA, 22 nt, Pseudomonas aeruginosa PA01
guaccagggaagcgcgcgccag

SEQ ID NO: 1498001 - RNA, 23 nt, Pseudomonas aeruginosa PA01
guaccagggaagcgcgcgccagu

SEQ ID NO: 1498002 - RNA, 14 nt, Pseudomonas aeruginosa PA01
guaccacgcccgcg

SEQ ID NO: 1498003 - RNA, 21 nt, Pseudomonas aeruginosa PA01
guaccagcaaugcccagcgca

SEQ ID NO: 1498004 - RNA, 22 nt, Pseudomonas aeruginosa PA01
guaccagcaaugcccagcgcag

SEQ ID NO: 1498005 - RNA, 14 nt, Pseudomonas aeruginosa PA01
guaccagcagcgcc

SEQ ID NO: 1498006 - RNA, 16 nt, Pseudomonas aeruginosa PA01
guaccagcagcgccga

SEQ ID NO: 1498007 - RNA, 17 nt, Pseudomonas aeruginosa PA01
guacagcccccgccggc

SEQ ID NO: 1498008 - RNA, 22 nt, Pseudomonas aeruginosa PA01
guacagcccccgccggccggga

SEQ ID NO: 1498009 - RNA, 21 nt, Pseudomonas aeruginosa PA01
guacagccgguugcguuuccg

SEQ ID NO: 1498010 - RNA, 19 nt, Pseudomonas aeruginosa PA01
guacagcgccacggccagc

SEQ ID NO: 1498011 - RNA, 21 nt, Pseudomonas aeruginosa PA01
guacagcgccacggccagcag

SEQ ID NO: 1498012 - RNA, 13 nt, Pseudomonas aeruginosa PA01
guacagcgccugg

SEQ ID NO: 1498013 - RNA, 21 nt, Pseudomonas aeruginosa PA01
guacagcgccuggucggcggc

SEQ ID NO: 1498014 - RNA, 20 nt, Pseudomonas aeruginosa PA01
guacagcgcgacaucggcga

SEQ ID NO: 1498015 - RNA, 22 nt, Pseudomonas aeruginosa PA01
guacagcucgcgcaaccagccg

SEQ ID NO: 1498016 - RNA, 14 nt, Pseudomonas aeruginosa PA01
guacagcucggcgc

SEQ ID NO: 1498017 - RNA, 17 nt, Pseudomonas aeruginosa PA01
guacagcucggcgcccu

SEQ ID NO: 1498018 - RNA, 18 nt, Pseudomonas aeruginosa PA01
guacagcugcaccgcgcg

SEQ ID NO: 1498019 - RNA, 22 nt, Pseudomonas aeruginosa PA01
guacagcucaccccaggaaaac

SEQ ID NO: 1498020 - RNA, 14 nt, Pseudomonas aeruginosa PA01
guacagcgggccgg

SEQ ID NO: 1498021 - RNA, 17 nt, Pseudomonas aeruginosa PA01
guacagcgggucggcga

SEQ ID NO: 1498022 - RNA, 15 nt, Pseudomonas aeruginosa PA01
guacgcccagcagcg

SEQ ID NO: 1498023 - RNA, 16 nt, Pseudomonas aeruginosa PA01
guacgcccccuccccu

SEQ ID NO: 1498024 - RNA, 22 nt, Pseudomonas aeruginosa PA01
guacgcccuccagcacccaggu

SEQ ID NO: 1498025 - RNA, 20 nt, Pseudomonas aeruginosa PA01
guacgcucaccaccaccgcg

SEQ ID NO: 1498026 - RNA, 21 nt, Pseudomonas aeruginosa PA01
guacgcucaccaccaccgcgc

SEQ ID NO: 1498027 - RNA, 20 nt, Pseudomonas aeruginosa PA01
guacgcguacgacuucggcg

SEQ ID NO: 1498028 - RNA, 21 nt, Pseudomonas aeruginosa PA01
guacgcguacgacuucggcga

SEQ ID NO: 1498029 - RNA, 14 nt, Pseudomonas aeruginosa PA01
guacgcugccaggu

SEQ ID NO: 1498030 - RNA, 15 nt, Pseudomonas aeruginosa PA01
guacggaugccgcga

SEQ ID NO: 1498031 - RNA, 14 nt, Pseudomonas aeruginosa PA01
guacggcaccacca

SEQ ID NO: 1498032 - RNA, 17 nt, Pseudomonas aeruginosa PA01
guacggcaccaccaccg

SEQ ID NO: 1498033 - RNA, 15 nt, Pseudomonas aeruginosa PA01
guacggcagcggcgu

SEQ ID NO: 1498034 - RNA, 19 nt, Pseudomonas aeruginosa PA01
guacggccuucacgcagcu

SEQ ID NO: 1498035 - RNA, 23 nt, Pseudomonas aeruginosa PA01
guacucaggccgggcggaugacc

SEQ ID NO: 1498036 - RNA, 17 nt, Pseudomonas aeruginosa PA01
ggucuuuuucgcgugcu

SEQ ID NO: 1498037 - RNA, 14 nt, Pseudomonas aeruginosa PA01
ggugaaccugacca

SEQ ID NO: 1498038 - RNA, 14 nt, Pseudomonas aeruginosa PA01
ggugaacagcggcc

SEQ ID NO: 1498039 - RNA, 18 nt, Pseudomonas aeruginosa PA01
ggugaccguuucgccgcc

SEQ ID NO: 1498040 - RNA, 19 nt, Pseudomonas aeruginosa PA01
ggugaccguuucgccgccg

SEQ ID NO: 1498041 - RNA, 23 nt, Pseudomonas aeruginosa PA01
ggugaccguuucgccgccggcca

SEQ ID NO: 1498042 - RNA, 14 nt, Pseudomonas aeruginosa PA01
ggugaacgccaggc

SEQ ID NO: 1498043 - RNA, 15 nt, Pseudomonas aeruginosa PA01
ggugaacgccaggca

SEQ ID NO: 1498044 - RNA, 13 nt, Pseudomonas aeruginosa PA01
ggugaacucaugc

SEQ ID NO: 1498045 - RNA, 18 nt, Pseudomonas aeruginosa PA01
ggugaacucaugcaggcc

SEQ ID NO: 1498046 - RNA, 17 nt, Pseudomonas aeruginosa PA01
ggucucguagcagccac

SEQ ID NO: 1498047 - RNA, 23 nt, Pseudomonas aeruginosa PA01
ggucucuacgccauacugggcgg

SEQ ID NO: 1498048 - RNA, 23 nt, Pseudomonas aeruginosa PA01
ggucucuucgucggucauguccg

SEQ ID NO: 1498049 - RNA, 17 nt, Pseudomonas aeruginosa PA01
ggucucgaucagcgccg

SEQ ID NO: 1498050 - RNA, 15 nt, Pseudomonas aeruginosa PA01
ggucucgaucggccc

SEQ ID NO: 1498051 - RNA, 19 nt, Pseudomonas aeruginosa PA01
ggucucgcgcagcggcgga

SEQ ID NO: 1498052 - RNA, 18 nt, Pseudomonas aeruginosa PA01
ggucucgauggcagccuu

SEQ ID NO: 1498053 - RNA, 21 nt, Pseudomonas aeruginosa PA01
ggucucgccaccccgcuccgc

SEQ ID NO: 1498054 - RNA, 13 nt, Pseudomonas aeruginosa PA01
ggucucgccgccg

SEQ ID NO: 1498055 - RNA, 13 nt, Pseudomonas aeruginosa PA01
ggucgugcagcac

SEQ ID NO: 1498056 - RNA, 18 nt, Pseudomonas aeruginosa PA01
ggucuccgugcuggccgg

SEQ ID NO: 1498057 - RNA, 19 nt, Pseudomonas aeruginosa PA01
ggucuccgugcuggccggc

SEQ ID NO: 1498058 - RNA, 16 nt, Pseudomonas aeruginosa PA01
ggugaccuggccgccg

SEQ ID NO: 1498059 - RNA, 17 nt, Pseudomonas aeruginosa PA01
ggugaagcccaccacca

SEQ ID NO: 1498060 - RNA, 22 nt, Pseudomonas aeruginosa PA01
ggugacgcucuucaccucgaug

SEQ ID NO: 1498061 - RNA, 18 nt, Pseudomonas aeruginosa PA01
ggugacggugaucgccgc

SEQ ID NO: 1498062 - RNA, 12 nt, Pseudomonas aeruginosa PA01
ggugacggugca

SEQ ID NO: 1498063 - RNA, 14 nt, Pseudomonas aeruginosa PA01
ggugacggugcagc

SEQ ID NO: 1498064 - RNA, 17 nt, Pseudomonas aeruginosa PA01
ggugagguugccgccga

SEQ ID NO: 1498065 - RNA, 16 nt, Pseudomonas aeruginosa PA01
ggugauaccgccggcg

SEQ ID NO: 1498066 - RNA, 18 nt, Pseudomonas aeruginosa PA01
ggugauaccgccggcggc

SEQ ID NO: 1498067 - RNA, 19 nt, Pseudomonas aeruginosa PA01
ggugauaccgccggcggcg

SEQ ID NO: 1498068 - RNA, 20 nt, Pseudomonas aeruginosa PA01
ggugauaccgccggcggcga

SEQ ID NO: 1498069 - RNA, 16 nt, Pseudomonas aeruginosa PA01
ggugaggaccuggccg

SEQ ID NO: 1498070 - RNA, 23 nt, Pseudomonas aeruginosa PA01
ggugaggccgagccgacauccug

SEQ ID NO: 1498071 - RNA, 17 nt, Pseudomonas aeruginosa PA01
ggugacguugcgccgca

SEQ ID NO: 1498072 - RNA, 13 nt, Pseudomonas aeruginosa PA01
ggucgcguuggcg

SEQ ID NO: 1498073 - RNA, 17 nt, Pseudomonas aeruginosa PA01
ggucgcguuggcgugcu

SEQ ID NO: 1498074 - RNA, 20 nt, Pseudomonas aeruginosa PA01
ggucgcguuccagcuccguc

SEQ ID NO: 1498075 - RNA, 22 nt, Pseudomonas aeruginosa PA01
ggucgcguuccagcuccgucug

SEQ ID NO: 1498076 - RNA, 18 nt, Pseudomonas aeruginosa PA01
ggucgcguucgucggcca

SEQ ID NO: 1498077 - RNA, 12 nt, Pseudomonas aeruginosa PA01
ggucgcggcugc

SEQ ID NO: 1498078 - RNA, 17 nt, Pseudomonas aeruginosa PA01
ggucgcggcuggccgcc

SEQ ID NO: 1498079 - RNA, 20 nt, Pseudomonas aeruginosa PA01
ggucgcggcuggccgccugg

SEQ ID NO: 1498080 - RNA, 20 nt, Pseudomonas aeruginosa PA01
ggucgcguagaccaucgccg

SEQ ID NO: 1498081 - RNA, 23 nt, Pseudomonas aeruginosa PA01
ggucgcggugcaguucgccguuc

SEQ ID NO: 1498082 - RNA, 13 nt, Pseudomonas aeruginosa PA01
ggucgcuccagcc

SEQ ID NO: 1498083 - RNA, 14 nt, Pseudomonas aeruginosa PA01
ggucgcuccagccc

SEQ ID NO: 1498084 - RNA, 16 nt, Pseudomonas aeruginosa PA01
ggucgcugaccacccg

SEQ ID NO: 1498085 - RNA, 17 nt, Pseudomonas aeruginosa PA01
ggucgcugaccagcccg

SEQ ID NO: 1498086 - RNA, 19 nt, Pseudomonas aeruginosa PA01
ggucgcugaccagcccggc

SEQ ID NO: 1498087 - RNA, 21 nt, Pseudomonas aeruginosa PA01
ggucgcugaccagcccggcgg

SEQ ID NO: 1498088 - RNA, 14 nt, Pseudomonas aeruginosa PA01
ggucgcugcccucg

SEQ ID NO: 1498089 - RNA, 15 nt, Pseudomonas aeruginosa PA01
ggucgcugcucaggg

SEQ ID NO: 1498090 - RNA, 18 nt, Pseudomonas aeruginosa PA01
ggucgcugcucagggccg

SEQ ID NO: 1498091 - RNA, 15 nt, Pseudomonas aeruginosa PA01
ggucgcugcugaaaa

SEQ ID NO: 1498092 - RNA, 20 nt, Pseudomonas aeruginosa PA01
ggucggcagcgucgagcugg

SEQ ID NO: 1498093 - RNA, 18 nt, Pseudomonas aeruginosa PA01
ggucggcauccggcaggc

SEQ ID NO: 1498094 - RNA, 21 nt, Pseudomonas aeruginosa PA01
ggucggcagguggguaccgaa

SEQ ID NO: 1498095 - RNA, 14 nt, Pseudomonas aeruginosa PA01
ggucggcacgaugu

SEQ ID NO: 1498096 - RNA, 13 nt, Pseudomonas aeruginosa PA01
ggucggcacggcc

SEQ ID NO: 1498097 - RNA, 14 nt, Pseudomonas aeruginosa PA01
ggucggcagcagcu

SEQ ID NO: 1498098 - RNA, 19 nt, Pseudomonas aeruginosa PA01
ggucggcagcagcuugccg

SEQ ID NO: 1498099 - RNA, 14 nt, Pseudomonas aeruginosa PA01
ggucggcaccgagc

SEQ ID NO: 1498100 - RNA, 18 nt, Pseudomonas aeruginosa PA01
ggucggcaccugcagacg

SEQ ID NO: 1498101 - RNA, 22 nt, Pseudomonas aeruginosa PA01
ggucggaucggauagccgugca

SEQ ID NO: 1498102 - RNA, 17 nt, Pseudomonas aeruginosa PA01
ggucgcuggcaccggcc

SEQ ID NO: 1498103 - RNA, 21 nt, Pseudomonas aeruginosa PA01
ggucgcuggcaccggccaggc

SEQ ID NO: 1498104 - RNA, 14 nt, Pseudomonas aeruginosa PA01
ggucgcuggcgucg

SEQ ID NO: 1498105 - RNA, 17 nt, Pseudomonas aeruginosa PA01
ggucgcuggcgucgacc

SEQ ID NO: 1498106 - RNA, 23 nt, Pseudomonas aeruginosa PA01
ggucgcuggcgucgaccgccugc

SEQ ID NO: 1498107 - RNA, 20 nt, Pseudomonas aeruginosa PA01
ggucgcuuuuuccgcugccg

SEQ ID NO: 1498108 - RNA, 14 nt, Pseudomonas aeruginosa PA01
ggucggagugcucg

SEQ ID NO: 1498109 - RNA, 18 nt, Pseudomonas aeruginosa PA01
ggucggacuccgcccagu

SEQ ID NO: 1498110 - RNA, 23 nt, Pseudomonas aeruginosa PA01
ggucggaaagcagggcgauggcc

SEQ ID NO: 1498111 - RNA, 17 nt, Pseudomonas aeruginosa PA01
ggucggaacgaccacgc

SEQ ID NO: 1498112 - RNA, 19 nt, Pseudomonas aeruginosa PA01
ggucgucgaagcgcagcag

SEQ ID NO: 1498113 - RNA, 22 nt, Pseudomonas aeruginosa PA01
ggucgucgcgguacagccgguu

SEQ ID NO: 1498114 - RNA, 15 nt, Pseudomonas aeruginosa PA01
ggucguagcccaugg

SEQ ID NO: 1498115 - RNA, 17 nt, Pseudomonas aeruginosa PA01
ggucguaggcgcgggcg

SEQ ID NO: 1498116 - RNA, 20 nt, Pseudomonas aeruginosa PA01
ggucgguucgcccaguacca

SEQ ID NO: 1498117 - RNA, 18 nt, Pseudomonas aeruginosa PA01
ggucgguucgcggcgcag

SEQ ID NO: 1498118 - RNA, 18 nt, Pseudomonas aeruginosa PA01
ggucgguugcggccugau

SEQ ID NO: 1498119 - RNA, 17 nt, Pseudomonas aeruginosa PA01
ggucguacaccgcgcgg

SEQ ID NO: 1498120 - RNA, 17 nt, Pseudomonas aeruginosa PA01
ggucggcgagggcacca

SEQ ID NO: 1498121 - RNA, 17 nt, Pseudomonas aeruginosa PA01
ggucggcgccggugcug

SEQ ID NO: 1498122 - RNA, 12 nt, Pseudomonas aeruginosa PA01
ggucggcgcgca

SEQ ID NO: 1498123 - RNA, 15 nt, Pseudomonas aeruginosa PA01
ggucggcgcgcaccu

SEQ ID NO: 1498124 - RNA, 17 nt, Pseudomonas aeruginosa PA01
ggucggcgcgcccggcg

SEQ ID NO: 1498125 - RNA, 15 nt, Pseudomonas aeruginosa PA01
ggucggcgcggcgcu

SEQ ID NO: 1498126 - RNA, 22 nt, Pseudomonas aeruginosa PA01
ggucggcgggcaccgccagccc

SEQ ID NO: 1498127 - RNA, 18 nt, Pseudomonas aeruginosa PA01
ggucggcucagccgacca

SEQ ID NO: 1498128 - RNA, 18 nt, Pseudomonas aeruginosa PA01
ggucggcgucuuccggcu

SEQ ID NO: 1498129 - RNA, 12 nt, Pseudomonas aeruginosa PA01
ggucggcuggca

SEQ ID NO: 1498130 - RNA, 15 nt, Pseudomonas aeruginosa PA01
ggucggugacccgca

SEQ ID NO: 1498131 - RNA, 17 nt, Pseudomonas aeruginosa PA01
ggucgaacugaccacca

SEQ ID NO: 1498132 - RNA, 18 nt, Pseudomonas aeruginosa PA01
ggucgaacugaccaccag

SEQ ID NO: 1498133 - RNA, 19 nt, Pseudomonas aeruginosa PA01
ggucgaacugaccaccagg

SEQ ID NO: 1498134 - RNA, 17 nt, Pseudomonas aeruginosa PA01
ggucgaacugcacccgc

SEQ ID NO: 1498135 - RNA, 20 nt, Pseudomonas aeruginosa PA01
ggucgaaagcuucgucgcgc

SEQ ID NO: 1498136 - RNA, 21 nt, Pseudomonas aeruginosa PA01
ggucgaaagcuucgucgcgca

SEQ ID NO: 1498137 - RNA, 17 nt, Pseudomonas aeruginosa PA01
ggucgaacagcggcugg

SEQ ID NO: 1498138 - RNA, 20 nt, Pseudomonas aeruginosa PA01
ggucgaacagcggcuggccc

SEQ ID NO: 1498139 - RNA, 22 nt, Pseudomonas aeruginosa PA01
ggucgaacacuugaccgucggc

SEQ ID NO: 1498140 - RNA, 14 nt, Pseudomonas aeruginosa PA01
gguccuugggccag

SEQ ID NO: 1498141 - RNA, 18 nt, Pseudomonas aeruginosa PA01
gguccuugggccaggcau

SEQ ID NO: 1498142 - RNA, 19 nt, Pseudomonas aeruginosa PA01
gguccgcgguagcugcgca

SEQ ID NO: 1498143 - RNA, 17 nt, Pseudomonas aeruginosa PA01
gguccgccugguccagc

SEQ ID NO: 1498144 - RNA, 13 nt, Pseudomonas aeruginosa PA01
gguccgccgcggg

SEQ ID NO: 1498145 - RNA, 19 nt, Pseudomonas aeruginosa PA01
gguccgcuucagcgcgccg

SEQ ID NO: 1498146 - RNA, 21 nt, Pseudomonas aeruginosa PA01
gguccuggguauagaccagca

SEQ ID NO: 1498147 - RNA, 23 nt, Pseudomonas aeruginosa PA01
gguccuggguauagaccagcacc

SEQ ID NO: 1498148 - RNA, 17 nt, Pseudomonas aeruginosa PA01
gguccuggguggcgacg

SEQ ID NO: 1498149 - RNA, 15 nt, Pseudomonas aeruginosa PA01
ggucgaucaggcgca

SEQ ID NO: 1498150 - RNA, 15 nt, Pseudomonas aeruginosa PA01
ggucgagcagcgccg

SEQ ID NO: 1498151 - RNA, 16 nt, Pseudomonas aeruginosa PA01
ggucgagcagcgccgc

SEQ ID NO: 1498152 - RNA, 16 nt, Pseudomonas aeruginosa PA01
ggucgagacgccauca

SEQ ID NO: 1498153 - RNA, 13 nt, Pseudomonas aeruginosa PA01
ggucgacgccgcc

SEQ ID NO: 1498154 - RNA, 15 nt, Pseudomonas aeruginosa PA01
ggucgacgccgccga

SEQ ID NO: 1498155 - RNA, 15 nt, Pseudomonas aeruginosa PA01
ggucgacgccauggc

SEQ ID NO: 1498156 - RNA, 16 nt, Pseudomonas aeruginosa PA01
ggucgacgccauggcg

SEQ ID NO: 1498157 - RNA, 19 nt, Pseudomonas aeruginosa PA01
ggucgacgguucgaucccg

SEQ ID NO: 1498158 - RNA, 15 nt, Pseudomonas aeruginosa PA01
gguccggagggcccg

SEQ ID NO: 1498159 - RNA, 13 nt, Pseudomonas aeruginosa PA01
ggucgacugcugg

SEQ ID NO: 1498160 - RNA, 17 nt, Pseudomonas aeruginosa PA01
ggucgagaaggcugccg

SEQ ID NO: 1498161 - RNA, 18 nt, Pseudomonas aeruginosa PA01
ggucgagaaggcugccgg

SEQ ID NO: 1498162 - RNA, 21 nt, Pseudomonas aeruginosa PA01
ggucgacuucgcaccagccgg

SEQ ID NO: 1498163 - RNA, 23 nt, Pseudomonas aeruginosa PA01
ggucgacuucgcaccagccggcc

SEQ ID NO: 1498164 - RNA, 14 nt, Pseudomonas aeruginosa PA01
ggucgcgcucuggc

SEQ ID NO: 1498165 - RNA, 22 nt, Pseudomonas aeruginosa PA01
ggucgcgcucuggcccagcuug

SEQ ID NO: 1498166 - RNA, 14 nt, Pseudomonas aeruginosa PA01
ggucgcgcucaggc

SEQ ID NO: 1498167 - RNA, 15 nt, Pseudomonas aeruginosa PA01
ggucgcgcuggaccu

SEQ ID NO: 1498168 - RNA, 19 nt, Pseudomonas aeruginosa PA01
ggucgcgcuggaccuggcc

SEQ ID NO: 1498169 - RNA, 15 nt, Pseudomonas aeruginosa PA01
ggucgcgcugggcga

SEQ ID NO: 1498170 - RNA, 15 nt, Pseudomonas aeruginosa PA01
ggucgcggaucaggc

SEQ ID NO: 1498171 - RNA, 18 nt, Pseudomonas aeruginosa PA01
ggucgcggaacucgauga

SEQ ID NO: 1498172 - RNA, 13 nt, Pseudomonas aeruginosa PA01
ggucgcggcgacc

SEQ ID NO: 1498173 - RNA, 14 nt, Pseudomonas aeruginosa PA01
ggucgcggcgaccu

SEQ ID NO: 1498174 - RNA, 14 nt, Pseudomonas aeruginosa PA01
ggucgcgccgacga

SEQ ID NO: 1498175 - RNA, 18 nt, Pseudomonas aeruginosa PA01
ggucgcgccgacgacccg

SEQ ID NO: 1498176 - RNA, 23 nt, Pseudomonas aeruginosa PA01
ggucgcgccgguggcguacccgc

SEQ ID NO: 1498177 - RNA, 13 nt, Pseudomonas aeruginosa PA01
ggucgcgccgucc

SEQ ID NO: 1498178 - RNA, 23 nt, Pseudomonas aeruginosa PA01
ggucgcgccguccaucaggcguu

SEQ ID NO: 1498179 - RNA, 18 nt, Pseudomonas aeruginosa PA01
ggucgcgcccgcugugcg

SEQ ID NO: 1498180 - RNA, 12 nt, Pseudomonas aeruginosa PA01
ggucgcgcccgc

SEQ ID NO: 1498181 - RNA, 13 nt, Pseudomonas aeruginosa PA01
ggucgcgcaggcg

SEQ ID NO: 1498182 - RNA, 15 nt, Pseudomonas aeruginosa PA01
ggucgcgaucaccgc

SEQ ID NO: 1498183 - RNA, 22 nt, Pseudomonas aeruginosa PA01
ggucgccuugaccagcggcccg

SEQ ID NO: 1498184 - RNA, 16 nt, Pseudomonas aeruginosa PA01
ggucgcgcagcggcuc

SEQ ID NO: 1498185 - RNA, 16 nt, Pseudomonas aeruginosa PA01
ggucgcccucggccag

SEQ ID NO: 1498186 - RNA, 18 nt, Pseudomonas aeruginosa PA01
ggucgcccucggccaggc

SEQ ID NO: 1498187 - RNA, 21 nt, Pseudomonas aeruginosa PA01
ggucgccucgaacauggccac

SEQ ID NO: 1498188 - RNA, 14 nt, Pseudomonas aeruginosa PA01
ggucgccaugcccg

SEQ ID NO: 1498189 - RNA, 14 nt, Pseudomonas aeruginosa PA01
ggucgcccaccuug

SEQ ID NO: 1498190 - RNA, 21 nt, Pseudomonas aeruginosa PA01
ggucgcccgugccucggcgga

SEQ ID NO: 1498191 - RNA, 17 nt, Pseudomonas aeruginosa PA01
ggucgaugaucuugucg

SEQ ID NO: 1498192 - RNA, 14 nt, Pseudomonas aeruginosa PA01
ggucgaucucgucg

SEQ ID NO: 1498193 - RNA, 15 nt, Pseudomonas aeruginosa PA01
ggucgaucucgucga

SEQ ID NO: 1498194 - RNA, 18 nt, Pseudomonas aeruginosa PA01
ggucgaucucgucgaagc

SEQ ID NO: 1498195 - RNA, 16 nt, Pseudomonas aeruginosa PA01
ggucgaucuccuccuc

SEQ ID NO: 1498196 - RNA, 22 nt, Pseudomonas aeruginosa PA01
ggucgauccgaccuggggcggc

SEQ ID NO: 1498197 - RNA, 15 nt, Pseudomonas aeruginosa PA01
ggucgauccgcgccu

SEQ ID NO: 1498198 - RNA, 16 nt, Pseudomonas aeruginosa PA01
ggucagcuucgccgcc

SEQ ID NO: 1498199 - RNA, 18 nt, Pseudomonas aeruginosa PA01
ggucagcuucgccgcccu

SEQ ID NO: 1498200 - RNA, 18 nt, Pseudomonas aeruginosa PA01
ggucagcuugccgcaggu

SEQ ID NO: 1498201 - RNA, 15 nt, Pseudomonas aeruginosa PA01
ggucaggcugaucgg

SEQ ID NO: 1498202 - RNA, 14 nt, Pseudomonas aeruginosa PA01
ggucaggcugcgca

SEQ ID NO: 1498203 - RNA, 15 nt, Pseudomonas aeruginosa PA01
ggucaggcugcgcac

SEQ ID NO: 1498204 - RNA, 16 nt, Pseudomonas aeruginosa PA01
ggucaggcugcgcacc

SEQ ID NO: 1498205 - RNA, 18 nt, Pseudomonas aeruginosa PA01
ggucaggcuggccccggu

SEQ ID NO: 1498206 - RNA, 22 nt, Pseudomonas aeruginosa PA01
ggucaggcugguggucaccgcc

SEQ ID NO: 1498207 - RNA, 12 nt, Pseudomonas aeruginosa PA01
ggucaggccgag

SEQ ID NO: 1498208 - RNA, 20 nt, Pseudomonas aeruginosa PA01
ggucaggccgagaaaccgcc

SEQ ID NO: 1498209 - RNA, 22 nt, Pseudomonas aeruginosa PA01
ggucaggccgagcagcgccagc

SEQ ID NO: 1498210 - RNA, 23 nt, Pseudomonas aeruginosa PA01
ggucaggccgagcagcgccagcc

SEQ ID NO: 1498211 - RNA, 12 nt, Pseudomonas aeruginosa PA01
ggucaggccgau

SEQ ID NO: 1498212 - RNA, 14 nt, Pseudomonas aeruginosa PA01
ggucaggccgauca

SEQ ID NO: 1498213 - RNA, 17 nt, Pseudomonas aeruginosa PA01
ggucaggccgaucacca

SEQ ID NO: 1498214 - RNA, 18 nt, Pseudomonas aeruginosa PA01
gguaguccagcuccucga

SEQ ID NO: 1498215 - RNA, 14 nt, Pseudomonas aeruginosa PA01
gguaguccgcugcg

SEQ ID NO: 1498216 - RNA, 23 nt, Pseudomonas aeruginosa PA01
gguaggggucguugccgucgagc

SEQ ID NO: 1498217 - RNA, 16 nt, Pseudomonas aeruginosa PA01
gguaggcgucgucgac

SEQ ID NO: 1498218 - RNA, 21 nt, Pseudomonas aeruginosa PA01
gguaggcucccccgcgccgcc

SEQ ID NO: 1498219 - RNA, 18 nt, Pseudomonas aeruginosa PA01
gguaggcucugcuccagc

SEQ ID NO: 1498220 - RNA, 13 nt, Pseudomonas aeruginosa PA01
gguagcggucggg

SEQ ID NO: 1498221 - RNA, 21 nt, Pseudomonas aeruginosa PA01
gguagucgcucauggcgccgc

SEQ ID NO: 1498222 - RNA, 23 nt, Pseudomonas aeruginosa PA01
gguagucggggcauucguccagc

SEQ ID NO: 1498223 - RNA, 21 nt, Pseudomonas aeruginosa PA01
gguagucuucgaugcgccgca

SEQ ID NO: 1498224 - RNA, 20 nt, Pseudomonas aeruginosa PA01
gguagugucgaaguagccgg

SEQ ID NO: 1498225 - RNA, 14 nt, Pseudomonas aeruginosa PA01
gguagugccgcccu

SEQ ID NO: 1498226 - RNA, 23 nt, Pseudomonas aeruginosa PA01
ggucagcgguagguguacccagg

SEQ ID NO: 1498227 - RNA, 15 nt, Pseudomonas aeruginosa PA01
gguaguguugaagcc

SEQ ID NO: 1498228 - RNA, 15 nt, Pseudomonas aeruginosa PA01
ggucaggucgacgcc

SEQ ID NO: 1498229 - RNA, 18 nt, Pseudomonas aeruginosa PA01
ggucaggucgagggugau

SEQ ID NO: 1498230 - RNA, 18 nt, Pseudomonas aeruginosa PA01
ggucauccuggcccugga

SEQ ID NO: 1498231 - RNA, 19 nt, Pseudomonas aeruginosa PA01
ggucagguauucgccggcc

SEQ ID NO: 1498232 - RNA, 18 nt, Pseudomonas aeruginosa PA01
ggucagcgguaugccgca

SEQ ID NO: 1498233 - RNA, 18 nt, Pseudomonas aeruginosa PA01
ggucaucggcccgacgcc

SEQ ID NO: 1498234 - RNA, 16 nt, Pseudomonas aeruginosa PA01
ggucaugagguucagg

SEQ ID NO: 1498235 - RNA, 19 nt, Pseudomonas aeruginosa PA01
ggucaugagguucaggccg

SEQ ID NO: 1498236 - RNA, 15 nt, Pseudomonas aeruginosa PA01
ggucauggcguccgg

SEQ ID NO: 1498237 - RNA, 14 nt, Pseudomonas aeruginosa PA01
ggucaugccgucuu

SEQ ID NO: 1498238 - RNA, 21 nt, Pseudomonas aeruginosa PA01
ggucaugcgcccuacgccacc

SEQ ID NO: 1498239 - RNA, 16 nt, Pseudomonas aeruginosa PA01
ggucaugcccuggccg

SEQ ID NO: 1498240 - RNA, 17 nt, Pseudomonas aeruginosa PA01
ggucaugcccuggccga

SEQ ID NO: 1498241 - RNA, 21 nt, Pseudomonas aeruginosa PA01
gguccaggggccgaugccggg

SEQ ID NO: 1498242 - RNA, 22 nt, Pseudomonas aeruginosa PA01
gguccaggucaugcccuggccg

SEQ ID NO: 1498243 - RNA, 12 nt, Pseudomonas aeruginosa PA01
gguccaggcgac

SEQ ID NO: 1498244 - RNA, 17 nt, Pseudomonas aeruginosa PA01
gguccaguucagggcga

SEQ ID NO: 1498245 - RNA, 20 nt, Pseudomonas aeruginosa PA01
gguccaguucagggcgagca

SEQ ID NO: 1498246 - RNA, 13 nt, Pseudomonas aeruginosa PA01
gguccagcucggu

SEQ ID NO: 1498247 - RNA, 20 nt, Pseudomonas aeruginosa PA01
gguccagccagacguccggc

SEQ ID NO: 1498248 - RNA, 15 nt, Pseudomonas aeruginosa PA01
gguccagccagccgc

SEQ ID NO: 1498249 - RNA, 22 nt, Pseudomonas aeruginosa PA01
gguccgccacuucaagcuggcg

SEQ ID NO: 1498250 - RNA, 17 nt, Pseudomonas aeruginosa PA01
gguccgccagcaggcgu

SEQ ID NO: 1498251 - RNA, 16 nt, Pseudomonas aeruginosa PA01
ggucccagaccagcag

SEQ ID NO: 1498252 - RNA, 17 nt, Pseudomonas aeruginosa PA01
ggucccagaccagcagc

SEQ ID NO: 1498253 - RNA, 22 nt, Pseudomonas aeruginosa PA01
gguccgcaccguagcggcugcg

SEQ ID NO: 1498254 - RNA, 13 nt, Pseudomonas aeruginosa PA01
ggguacagcgcca

SEQ ID NO: 1498255 - RNA, 18 nt, Pseudomonas aeruginosa PA01
ggguaccgcuggcgcugg

SEQ ID NO: 1498256 - RNA, 15 nt, Pseudomonas aeruginosa PA01
ggguagccggccgau

SEQ ID NO: 1498257 - RNA, 17 nt, Pseudomonas aeruginosa PA01
ggguagccggccgauca

SEQ ID NO: 1498258 - RNA, 13 nt, Pseudomonas aeruginosa PA01
ggguacuggcgcu

SEQ ID NO: 1498259 - RNA, 15 nt, Pseudomonas aeruginosa PA01
gggguuuccucgaag

SEQ ID NO: 1498260 - RNA, 17 nt, Pseudomonas aeruginosa PA01
gggguuucugcuggcca

SEQ ID NO: 1498261 - RNA, 19 nt, Pseudomonas aeruginosa PA01
gggucagcucgacagcguc

SEQ ID NO: 1498262 - RNA, 14 nt, Pseudomonas aeruginosa PA01
gggucagcgccagc

SEQ ID NO: 1498263 - RNA, 15 nt, Pseudomonas aeruginosa PA01
gggucagcgccagca

SEQ ID NO: 1498264 - RNA, 22 nt, Pseudomonas aeruginosa PA01
gggucagcgccagcaacccgcc

SEQ ID NO: 1498265 - RNA, 15 nt, Pseudomonas aeruginosa PA01
gggucagccggccga

SEQ ID NO: 1498266 - RNA, 16 nt, Pseudomonas aeruginosa PA01
gggucagccggccgau

SEQ ID NO: 1498267 - RNA, 14 nt, Pseudomonas aeruginosa PA01
gggucagaccagcc

SEQ ID NO: 1498268 - RNA, 15 nt, Pseudomonas aeruginosa PA01
gggucagcaggcugc

SEQ ID NO: 1498269 - RNA, 15 nt, Pseudomonas aeruginosa PA01
gggucagcagcgcca

SEQ ID NO: 1498270 - RNA, 18 nt, Pseudomonas aeruginosa PA01
gggucagcagcgccagua

SEQ ID NO: 1498271 - RNA, 21 nt, Pseudomonas aeruginosa PA01
gggucacggugaggaccuggc

SEQ ID NO: 1498272 - RNA, 16 nt, Pseudomonas aeruginosa PA01
gggucacguggccgcc

SEQ ID NO: 1498273 - RNA, 13 nt, Pseudomonas aeruginosa PA01
gggucacgccgau

SEQ ID NO: 1498274 - RNA, 14 nt, Pseudomonas aeruginosa PA01
gggucacgccgauc

SEQ ID NO: 1498275 - RNA, 18 nt, Pseudomonas aeruginosa PA01
gggucacgcugggcaggu

SEQ ID NO: 1498276 - RNA, 16 nt, Pseudomonas aeruginosa PA01
ggguaucguugaucgg

SEQ ID NO: 1498277 - RNA, 17 nt, Pseudomonas aeruginosa PA01
ggguaucguugaucggc

SEQ ID NO: 1498278 - RNA, 15 nt, Pseudomonas aeruginosa PA01
gggucaccagcacca

SEQ ID NO: 1498279 - RNA, 12 nt, Pseudomonas aeruginosa PA01
gggucaccagcg

SEQ ID NO: 1498280 - RNA, 14 nt, Pseudomonas aeruginosa PA01
gggucaccagcgcc

SEQ ID NO: 1498281 - RNA, 15 nt, Pseudomonas aeruginosa PA01
gggucaccagcgccg

SEQ ID NO: 1498282 - RNA, 14 nt, Pseudomonas aeruginosa PA01
ggguaggccaggca

SEQ ID NO: 1498283 - RNA, 16 nt, Pseudomonas aeruginosa PA01
ggguaguagaucagcu

SEQ ID NO: 1498284 - RNA, 22 nt, Pseudomonas aeruginosa PA01
ggguaguaguggaagccguggc

SEQ ID NO: 1498285 - RNA, 21 nt, Pseudomonas aeruginosa PA01
ggguccaguucagggcgagca

SEQ ID NO: 1498286 - RNA, 15 nt, Pseudomonas aeruginosa PA01
ggguccaggcgccag

SEQ ID NO: 1498287 - RNA, 16 nt, Pseudomonas aeruginosa PA01
ggguccaggcgccaga

SEQ ID NO: 1498288 - RNA, 19 nt, Pseudomonas aeruginosa PA01
gggucagcuggcgcgccuc

SEQ ID NO: 1498289 - RNA, 14 nt, Pseudomonas aeruginosa PA01
gggucagcuugccg

SEQ ID NO: 1498290 - RNA, 18 nt, Pseudomonas aeruginosa PA01
gggucagcuugccgcagg

SEQ ID NO: 1498291 - RNA, 14 nt, Pseudomonas aeruginosa PA01
gggucaucaccggc

SEQ ID NO: 1498292 - RNA, 18 nt, Pseudomonas aeruginosa PA01
gggucaucaccggcagga

SEQ ID NO: 1498293 - RNA, 15 nt, Pseudomonas aeruginosa PA01
gggucaucgaggcca

SEQ ID NO: 1498294 - RNA, 21 nt, Pseudomonas aeruginosa PA01
gggucaggccgagaaaccgcc

SEQ ID NO: 1498295 - RNA, 15 nt, Pseudomonas aeruginosa PA01
gggucaggccgaggc

SEQ ID NO: 1498296 - RNA, 21 nt, Pseudomonas aeruginosa PA01
gggucaggccgaggcgcuucu

SEQ ID NO: 1498297 - RNA, 21 nt, Pseudomonas aeruginosa PA01
gggucaucggcccgacgccgc

SEQ ID NO: 1498298 - RNA, 22 nt, Pseudomonas aeruginosa PA01
gggucaugagguucaggccggg

SEQ ID NO: 1498299 - RNA, 13 nt, Pseudomonas aeruginosa PA01
gggucaugccgcc

SEQ ID NO: 1498300 - RNA, 16 nt, Pseudomonas aeruginosa PA01
ggguccagcggccgcg

SEQ ID NO: 1498301 - RNA, 16 nt, Pseudomonas aeruginosa PA01
gggucgagcuugccga

SEQ ID NO: 1498302 - RNA, 18 nt, Pseudomonas aeruginosa PA01
gggucgagcuugccgagg

SEQ ID NO: 1498303 - RNA, 13 nt, Pseudomonas aeruginosa PA01
ggguccuggauca

SEQ ID NO: 1498304 - RNA, 19 nt, Pseudomonas aeruginosa PA01
gggucgacaugcaggccgg

SEQ ID NO: 1498305 - RNA, 16 nt, Pseudomonas aeruginosa PA01
gggucgacuucgcacc

SEQ ID NO: 1498306 - RNA, 23 nt, Pseudomonas aeruginosa PA01
gggucgauugcugggugcggugg

SEQ ID NO: 1498307 - RNA, 15 nt, Pseudomonas aeruginosa PA01
gggucgaugcccucg

SEQ ID NO: 1498308 - RNA, 15 nt, Pseudomonas aeruginosa PA01
gggucgcagcaggcc

SEQ ID NO: 1498309 - RNA, 17 nt, Pseudomonas aeruginosa PA01
gggucgcagcaggccgc

SEQ ID NO: 1498310 - RNA, 16 nt, Pseudomonas aeruginosa PA01
gggucgcggcuggccg

SEQ ID NO: 1498311 - RNA, 19 nt, Pseudomonas aeruginosa PA01
gggucgcguucgucggcca

SEQ ID NO: 1498312 - RNA, 22 nt, Pseudomonas aeruginosa PA01
ggggcaucggccauucggccug

SEQ ID NO: 1498313 - RNA, 19 nt, Pseudomonas aeruginosa PA01
ggggccagcagggccgccg

SEQ ID NO: 1498314 - RNA, 17 nt, Pseudomonas aeruginosa PA01
ggggcauguccaccgcc

SEQ ID NO: 1498315 - RNA, 22 nt, Pseudomonas aeruginosa PA01
ggggcauguccaccgccgccag

SEQ ID NO: 1498316 - RNA, 16 nt, Pseudomonas aeruginosa PA01
ggggcccggcuccagc

SEQ ID NO: 1498317 - RNA, 14 nt, Pseudomonas aeruginosa PA01
ggggcccuccaggc

SEQ ID NO: 1498318 - RNA, 16 nt, Pseudomonas aeruginosa PA01
ggggcgcgcccgccag

SEQ ID NO: 1498319 - RNA, 19 nt, Pseudomonas aeruginosa PA01
ggggcgcgcccgccagguc

SEQ ID NO: 1498320 - RNA, 21 nt, Pseudomonas aeruginosa PA01
ggggcccggcaggcagugccg

SEQ ID NO: 1498321 - RNA, 13 nt, Pseudomonas aeruginosa PA01
ggggcaggcgcag

SEQ ID NO: 1498322 - RNA, 16 nt, Pseudomonas aeruginosa PA01
gggacaucaccacgcg

SEQ ID NO: 1498323 - RNA, 14 nt, Pseudomonas aeruginosa PA01
ggggcacgcuggcg

SEQ ID NO: 1498324 - RNA, 19 nt, Pseudomonas aeruginosa PA01
gggaaggucggcagcagcu

SEQ ID NO: 1498325 - RNA, 18 nt, Pseudomonas aeruginosa PA01
gggaaguaggccuggccg

SEQ ID NO: 1498326 - RNA, 16 nt, Pseudomonas aeruginosa PA01
gggaagcugccuucca

SEQ ID NO: 1498327 - RNA, 22 nt, Pseudomonas aeruginosa PA01
gggaagcggucguagcccaugg

SEQ ID NO: 1498328 - RNA, 15 nt, Pseudomonas aeruginosa PA01
gggaacgucuggcca

SEQ ID NO: 1498329 - RNA, 19 nt, Pseudomonas aeruginosa PA01
gggaagcaggucucgacgc

SEQ ID NO: 1498330 - RNA, 13 nt, Pseudomonas aeruginosa PA01
gggaaucgccagc

SEQ ID NO: 1498331 - RNA, 16 nt, Pseudomonas aeruginosa PA01
gggaaucgucacggcg

SEQ ID NO: 1498332 - RNA, 22 nt, Pseudomonas aeruginosa PA01
gggaaucgucacggcgugccgc

SEQ ID NO: 1498333 - RNA, 16 nt, Pseudomonas aeruginosa PA01
gggaaugcucagcacg

SEQ ID NO: 1498334 - RNA, 12 nt, Pseudomonas aeruginosa PA01
gggaauggcgga

SEQ ID NO: 1498335 - RNA, 20 nt, Pseudomonas aeruginosa PA01
gggacaccccgucucgcugc

SEQ ID NO: 1498336 - RNA, 14 nt, Pseudomonas aeruginosa PA01
gggacacggcgacc

SEQ ID NO: 1498337 - RNA, 17 nt, Pseudomonas aeruginosa PA01
gggaauuucacgccgaa

SEQ ID NO: 1498338 - RNA, 18 nt, Pseudomonas aeruginosa PA01
gggacauggagaccuggc

SEQ ID NO: 1498339 - RNA, 19 nt, Pseudomonas aeruginosa PA01
gggacagggcggcagcgug

SEQ ID NO: 1498340 - RNA, 16 nt, Pseudomonas aeruginosa PA01
gggguaggggucggcc

SEQ ID NO: 1498341 - RNA, 13 nt, Pseudomonas aeruginosa PA01
ggggugccgccag

SEQ ID NO: 1498342 - RNA, 21 nt, Pseudomonas aeruginosa PA01
ggggugccgccagucggccug

SEQ ID NO: 1498343 - RNA, 19 nt, Pseudomonas aeruginosa PA01
ggggucuggccggcgauca

SEQ ID NO: 1498344 - RNA, 22 nt, Pseudomonas aeruginosa PA01
ggggucuucguuuucaggcgac

SEQ ID NO: 1498345 - RNA, 22 nt, Pseudomonas aeruginosa PA01
ggggugcagauggucgccggag

SEQ ID NO: 1498346 - RNA, 20 nt, Pseudomonas aeruginosa PA01
gggggucuucgaaggucugc

SEQ ID NO: 1498347 - RNA, 12 nt, Pseudomonas aeruginosa PA01
ggggcuguugcu

SEQ ID NO: 1498348 - RNA, 14 nt, Pseudomonas aeruginosa PA01
ggggcugagcgcau

SEQ ID NO: 1498349 - RNA, 13 nt, Pseudomonas aeruginosa PA01
ggggcgcgcugcg

SEQ ID NO: 1498350 - RNA, 13 nt, Pseudomonas aeruginosa PA01
ggggcggccggcg

SEQ ID NO: 1498351 - RNA, 14 nt, Pseudomonas aeruginosa PA01
ggggcggccggcgc

SEQ ID NO: 1498352 - RNA, 13 nt, Pseudomonas aeruginosa PA01
ggggcggcucggc

SEQ ID NO: 1498353 - RNA, 13 nt, Pseudomonas aeruginosa PA01
ggggcgggccgcg

SEQ ID NO: 1498354 - RNA, 20 nt, Pseudomonas aeruginosa PA01
ggggcuagucgcgcagcgcc

SEQ ID NO: 1498355 - RNA, 18 nt, Pseudomonas aeruginosa PA01
ggggcucuuucauugcgc

SEQ ID NO: 1498356 - RNA, 16 nt, Pseudomonas aeruginosa PA01
ggggcugaacagcgcc

SEQ ID NO: 1498357 - RNA, 18 nt, Pseudomonas aeruginosa PA01
ggguugcggcgcccgcca

SEQ ID NO: 1498358 - RNA, 16 nt, Pseudomonas aeruginosa PA01
ggguguuguucgccag

SEQ ID NO: 1498359 - RNA, 16 nt, Pseudomonas aeruginosa PA01
ggguguugucggucag

SEQ ID NO: 1498360 - RNA, 21 nt, Pseudomonas aeruginosa PA01
ggguguucagcggcgcgucga

SEQ ID NO: 1498361 - RNA, 13 nt, Pseudomonas aeruginosa PA01
ggguuucgcugcc

SEQ ID NO: 1498362 - RNA, 17 nt, Pseudomonas aeruginosa PA01
ggguuuccgugugcagc

SEQ ID NO: 1498363 - RNA, 12 nt, Pseudomonas aeruginosa PA01
ggguuuccagca

SEQ ID NO: 1498364 - RNA, 13 nt, Pseudomonas aeruginosa PA01
ggguuuccagcag

SEQ ID NO: 1498365 - RNA, 14 nt, Pseudomonas aeruginosa PA01
ggguuuccagcagc

SEQ ID NO: 1498366 - RNA, 15 nt, Pseudomonas aeruginosa PA01
ggguuuccagcagca

SEQ ID NO: 1498367 - RNA, 18 nt, Pseudomonas aeruginosa PA01
ggguugucguugcgcagc

SEQ ID NO: 1498368 - RNA, 18 nt, Pseudomonas aeruginosa PA01
gguacagugacugaccgu

SEQ ID NO: 1498369 - RNA, 21 nt, Pseudomonas aeruginosa PA01
gguacaguucaggcugggccg

SEQ ID NO: 1498370 - RNA, 13 nt, Pseudomonas aeruginosa PA01
gguaccugccggc

SEQ ID NO: 1498371 - RNA, 13 nt, Pseudomonas aeruginosa PA01
gguaccugcucgc

SEQ ID NO: 1498372 - RNA, 16 nt, Pseudomonas aeruginosa PA01
gguaccguugcgcagg

SEQ ID NO: 1498373 - RNA, 18 nt, Pseudomonas aeruginosa PA01
gguacagcgccuggucgg

SEQ ID NO: 1498374 - RNA, 21 nt, Pseudomonas aeruginosa PA01
gguacagcgccuggucggcgg

SEQ ID NO: 1498375 - RNA, 14 nt, Pseudomonas aeruginosa PA01
gguagccugcggcc

SEQ ID NO: 1498376 - RNA, 20 nt, Pseudomonas aeruginosa PA01
gguagccugcggccagcgcc

SEQ ID NO: 1498377 - RNA, 14 nt, Pseudomonas aeruginosa PA01
gguagcgcuccagc

SEQ ID NO: 1498378 - RNA, 17 nt, Pseudomonas aeruginosa PA01
gguagcgcugcgcccgc

SEQ ID NO: 1498379 - RNA, 18 nt, Pseudomonas aeruginosa PA01
gguagcgggccagcagcu

SEQ ID NO: 1498380 - RNA, 19 nt, Pseudomonas aeruginosa PA01
gguagcggcgcaccgacgc

SEQ ID NO: 1498381 - RNA, 17 nt, Pseudomonas aeruginosa PA01
gguagccggcgagcgcc

SEQ ID NO: 1498382 - RNA, 18 nt, Pseudomonas aeruginosa PA01
gguagccggcgaucagcg

SEQ ID NO: 1498383 - RNA, 12 nt, Pseudomonas aeruginosa PA01
gguagccggccg

SEQ ID NO: 1498384 - RNA, 17 nt, Pseudomonas aeruginosa PA01
gguagccguucgacgcu

SEQ ID NO: 1498385 - RNA, 17 nt, Pseudomonas aeruginosa PA01
gguagccgaggcggccg

SEQ ID NO: 1498386 - RNA, 15 nt, Pseudomonas aeruginosa PA01
gguagccgaucaacg

SEQ ID NO: 1498387 - RNA, 16 nt, Pseudomonas aeruginosa PA01
gguagccgaucaacgc

SEQ ID NO: 1498388 - RNA, 21 nt, Pseudomonas aeruginosa PA01
gguagccgccuuguuccaggc

SEQ ID NO: 1498389 - RNA, 14 nt, Pseudomonas aeruginosa PA01
gguagccgcgccgg

SEQ ID NO: 1498390 - RNA, 16 nt, Pseudomonas aeruginosa PA01
gguagccgcgccggcc

SEQ ID NO: 1498391 - RNA, 18 nt, Pseudomonas aeruginosa PA01
gguagaccacgcaggcca

SEQ ID NO: 1498392 - RNA, 20 nt, Pseudomonas aeruginosa PA01
gguagagaagcguucgccga

SEQ ID NO: 1498393 - RNA, 16 nt, Pseudomonas aeruginosa PA01
gguagagaugcagcag

SEQ ID NO: 1498394 - RNA, 23 nt, Pseudomonas aeruginosa PA01
gguagaagaacaucggcgcuccg

SEQ ID NO: 1498395 - RNA, 22 nt, Pseudomonas aeruginosa PA01
gguagaaggugcccagcggcgc

SEQ ID NO: 1498396 - RNA, 15 nt, Pseudomonas aeruginosa PA01
gguacgcucaccacc

SEQ ID NO: 1498397 - RNA, 22 nt, Pseudomonas aeruginosa PA01
gguacugccgcuaucgcuggcg

SEQ ID NO: 1498398 - RNA, 15 nt, Pseudomonas aeruginosa PA01
gguacuccuccagca

SEQ ID NO: 1498399 - RNA, 14 nt, Pseudomonas aeruginosa PA01
gguacggcgccgcu

SEQ ID NO: 1498400 - RNA, 12 nt, Pseudomonas aeruginosa PA01
gguacucggccc

SEQ ID NO: 1498401 - RNA, 14 nt, Pseudomonas aeruginosa PA01
gguacggaagcggc

SEQ ID NO: 1498402 - RNA, 19 nt, Pseudomonas aeruginosa PA01
gguacggaugccgcgagcc

SEQ ID NO: 1498403 - RNA, 19 nt, Pseudomonas aeruginosa PA01
gguacgcccuccagcaccc

SEQ ID NO: 1498404 - RNA, 16 nt, Pseudomonas aeruginosa PA01
gguacgccgcgcugcg

SEQ ID NO: 1498405 - RNA, 15 nt, Pseudomonas aeruginosa PA01
gggucggcacggcca

SEQ ID NO: 1498406 - RNA, 22 nt, Pseudomonas aeruginosa PA01
gggucguacaccagauggcugg

SEQ ID NO: 1498407 - RNA, 22 nt, Pseudomonas aeruginosa PA01
gggucguacaccgcgcggcaca

SEQ ID NO: 1498408 - RNA, 19 nt, Pseudomonas aeruginosa PA01
gggucgguucgcggcgcag

SEQ ID NO: 1498409 - RNA, 21 nt, Pseudomonas aeruginosa PA01
gggucggcggauaaacggcau

SEQ ID NO: 1498410 - RNA, 16 nt, Pseudomonas aeruginosa PA01
gggucgucgcccuggc

SEQ ID NO: 1498411 - RNA, 13 nt, Pseudomonas aeruginosa PA01
gggucuccgcucg

SEQ ID NO: 1498412 - RNA, 18 nt, Pseudomonas aeruginosa PA01
gggucucgaucagcgccg

SEQ ID NO: 1498413 - RNA, 11 nt, Pseudomonas aeruginosa PA01
gggugaggcgc

SEQ ID NO: 1498414 - RNA, 17 nt, Pseudomonas aeruginosa PA01
gggugaggcgcauggac

SEQ ID NO: 1498415 - RNA, 12 nt, Pseudomonas aeruginosa PA01
gggugaccuggc

SEQ ID NO: 1498416 - RNA, 15 nt, Pseudomonas aeruginosa PA01
gggugaccuggccgc

SEQ ID NO: 1498417 - RNA, 15 nt, Pseudomonas aeruginosa PA01
gggugaagcgcaggc

SEQ ID NO: 1498418 - RNA, 15 nt, Pseudomonas aeruginosa PA01
gggugaagcucuucu

SEQ ID NO: 1498419 - RNA, 14 nt, Pseudomonas aeruginosa PA01
gggugaagcugcgg

SEQ ID NO: 1498420 - RNA, 13 nt, Pseudomonas aeruginosa PA01
gggugaacuggcc

SEQ ID NO: 1498421 - RNA, 15 nt, Pseudomonas aeruginosa PA01
gggucuugccggucu

SEQ ID NO: 1498422 - RNA, 18 nt, Pseudomonas aeruginosa PA01
gggucuugucuuucugcg

SEQ ID NO: 1498423 - RNA, 18 nt, Pseudomonas aeruginosa PA01
gggucuucaggccgaguc

SEQ ID NO: 1498424 - RNA, 18 nt, Pseudomonas aeruginosa PA01
gggucugcucgacgaucu

SEQ ID NO: 1498425 - RNA, 16 nt, Pseudomonas aeruginosa PA01
gggucugcucggcgcc

SEQ ID NO: 1498426 - RNA, 21 nt, Pseudomonas aeruginosa PA01
gggucugcucggcgcccuggg

SEQ ID NO: 1498427 - RNA, 21 nt, Pseudomonas aeruginosa PA01
gggugcucaggacguccuggc

SEQ ID NO: 1498428 - RNA, 20 nt, Pseudomonas aeruginosa PA01
gggugcugaagauaucgccu

SEQ ID NO: 1498429 - RNA, 17 nt, Pseudomonas aeruginosa PA01
gggugcugcggaugggc

SEQ ID NO: 1498430 - RNA, 23 nt, Pseudomonas aeruginosa PA01
ggguggaacccgcuucgucgguc

SEQ ID NO: 1498431 - RNA, 16 nt, Pseudomonas aeruginosa PA01
ggguggaacgaggcga

SEQ ID NO: 1498432 - RNA, 11 nt, Pseudomonas aeruginosa PA01
ggguggccagg

SEQ ID NO: 1498433 - RNA, 15 nt, Pseudomonas aeruginosa PA01
ggguggcaugggcca

SEQ ID NO: 1498434 - RNA, 17 nt, Pseudomonas aeruginosa PA01
ggguggcaugggccagu

SEQ ID NO: 1498435 - RNA, 17 nt, Pseudomonas aeruginosa PA01
ggguggaguaccaggcc

SEQ ID NO: 1498436 - RNA, 19 nt, Pseudomonas aeruginosa PA01
ggguggaguaccaggccac

SEQ ID NO: 1498437 - RNA, 13 nt, Pseudomonas aeruginosa PA01
ggguggcgcuggc

SEQ ID NO: 1498438 - RNA, 15 nt, Pseudomonas aeruginosa PA01
ggguggcgcccaugc

SEQ ID NO: 1498439 - RNA, 21 nt, Pseudomonas aeruginosa PA01
gggugucguuguugccgcgca

SEQ ID NO: 1498440 - RNA, 12 nt, Pseudomonas aeruginosa PA01
gggugucggcga

SEQ ID NO: 1498441 - RNA, 15 nt, Pseudomonas aeruginosa PA01
gggugucggcgauca

SEQ ID NO: 1498442 - RNA, 22 nt, Pseudomonas aeruginosa PA01
ggguggcgaaggcaaugccgcc

SEQ ID NO: 1498443 - RNA, 12 nt, Pseudomonas aeruginosa PA01
ggguggcgacga

SEQ ID NO: 1498444 - RNA, 22 nt, Pseudomonas aeruginosa PA01
ggguggcgcgcaccaccuggca

SEQ ID NO: 1498445 - RNA, 15 nt, Pseudomonas aeruginosa PA01
gggugcgcggcgaag

SEQ ID NO: 1498446 - RNA, 15 nt, Pseudomonas aeruginosa PA01
gggugcggugggcga

SEQ ID NO: 1498447 - RNA, 15 nt, Pseudomonas aeruginosa PA01
gggugcgggcgcggg

SEQ ID NO: 1498448 - RNA, 12 nt, Pseudomonas aeruginosa PA01
gggugccuuccg

SEQ ID NO: 1498449 - RNA, 21 nt, Pseudomonas aeruginosa PA01
gggugccuuccgcgcccaggc

SEQ ID NO: 1498450 - RNA, 22 nt, Pseudomonas aeruginosa PA01
gggugccgccagucggccuggc

SEQ ID NO: 1498451 - RNA, 21 nt, Pseudomonas aeruginosa PA01
gggugcccaucaggcucaggc

SEQ ID NO: 1498452 - RNA, 12 nt, Pseudomonas aeruginosa PA01
gggugaucagcc

SEQ ID NO: 1498453 - RNA, 16 nt, Pseudomonas aeruginosa PA01
gggugaucagcuccgc

SEQ ID NO: 1498454 - RNA, 23 nt, Pseudomonas aeruginosa PA01
gggugaucagcuccgccucgauc

SEQ ID NO: 1498455 - RNA, 21 nt, Pseudomonas aeruginosa PA01
gggugauccagcuggcgcguu

SEQ ID NO: 1498456 - RNA, 21 nt, Pseudomonas aeruginosa PA01
gggugcagauggucgccggag

SEQ ID NO: 1498457 - RNA, 15 nt, Pseudomonas aeruginosa PA01
gggugccgauggaga

SEQ ID NO: 1498458 - RNA, 18 nt, Pseudomonas aeruginosa PA01
guccaacccauguggcgc

SEQ ID NO: 1498459 - RNA, 21 nt, Pseudomonas aeruginosa PA01
guccaacccauguggcgcagc

SEQ ID NO: 1498460 - RNA, 13 nt, Pseudomonas aeruginosa PA01
guccaccaccagc

SEQ ID NO: 1498461 - RNA, 15 nt, Pseudomonas aeruginosa PA01
guccaccaccagcag

SEQ ID NO: 1498462 - RNA, 20 nt, Pseudomonas aeruginosa PA01
guccaccaccagcaggccca

SEQ ID NO: 1498463 - RNA, 12 nt, Pseudomonas aeruginosa PA01
guccaccaccga

SEQ ID NO: 1498464 - RNA, 21 nt, Pseudomonas aeruginosa PA01
guccaccaccgacgggucgcc

SEQ ID NO: 1498465 - RNA, 16 nt, Pseudomonas aeruginosa PA01
guccaccagccagcuc

SEQ ID NO: 1498466 - RNA, 18 nt, Pseudomonas aeruginosa PA01
guccaccagccagcucgg

SEQ ID NO: 1498467 - RNA, 21 nt, Pseudomonas aeruginosa PA01
guccaccagccagcucggcga

SEQ ID NO: 1498468 - RNA, 13 nt, Pseudomonas aeruginosa PA01
guccaccagcccg

SEQ ID NO: 1498469 - RNA, 15 nt, Pseudomonas aeruginosa PA01
guccaccagcccgca

SEQ ID NO: 1498470 - RNA, 17 nt, Pseudomonas aeruginosa PA01
guccaccgaguggcgca

SEQ ID NO: 1498471 - RNA, 14 nt, Pseudomonas aeruginosa PA01
guccaccagcgccc

SEQ ID NO: 1498472 - RNA, 16 nt, Pseudomonas aeruginosa PA01
guccaccaggcgccgg

SEQ ID NO: 1498473 - RNA, 20 nt, Pseudomonas aeruginosa PA01
guccaccaggcgccgggucg

SEQ ID NO: 1498474 - RNA, 22 nt, Pseudomonas aeruginosa PA01
guccagcaaggugcgggcgacg

SEQ ID NO: 1498475 - RNA, 17 nt, Pseudomonas aeruginosa PA01
guccagcacgcuggcga

SEQ ID NO: 1498476 - RNA, 14 nt, Pseudomonas aeruginosa PA01
guccagcacgguga

SEQ ID NO: 1498477 - RNA, 21 nt, Pseudomonas aeruginosa PA01
guccagcacggugaaccaggc

SEQ ID NO: 1498478 - RNA, 14 nt, Pseudomonas aeruginosa PA01
guccacuccggcag

SEQ ID NO: 1498479 - RNA, 23 nt, Pseudomonas aeruginosa PA01
guccacguugcaguccaggccgu

SEQ ID NO: 1498480 - RNA, 15 nt, Pseudomonas aeruginosa PA01
guccacuggcccacg

SEQ ID NO: 1498481 - RNA, 19 nt, Pseudomonas aeruginosa PA01
guccacuggcccacggcgc

SEQ ID NO: 1498482 - RNA, 20 nt, Pseudomonas aeruginosa PA01
guccacggagaagcguccga

SEQ ID NO: 1498483 - RNA, 21 nt, Pseudomonas aeruginosa PA01
guccacguugagcaucaccgc

SEQ ID NO: 1498484 - RNA, 14 nt, Pseudomonas aeruginosa PA01
guccacggcgcguc

SEQ ID NO: 1498485 - RNA, 15 nt, Pseudomonas aeruginosa PA01
guccacggcgcgucg

SEQ ID NO: 1498486 - RNA, 20 nt, Pseudomonas aeruginosa PA01
guccacgccgaagucggcga

SEQ ID NO: 1498487 - RNA, 21 nt, Pseudomonas aeruginosa PA01
guccacgccauaggcggcgca

SEQ ID NO: 1498488 - RNA, 16 nt, Pseudomonas aeruginosa PA01
guccacgacgaacggc

SEQ ID NO: 1498489 - RNA, 21 nt, Pseudomonas aeruginosa PA01
guccacgacgaacggcgcuuc

SEQ ID NO: 1498490 - RNA, 13 nt, Pseudomonas aeruginosa PA01
guccaccgccgcc

SEQ ID NO: 1498491 - RNA, 17 nt, Pseudomonas aeruginosa PA01
guccaccgccgccagca

SEQ ID NO: 1498492 - RNA, 15 nt, Pseudomonas aeruginosa PA01
guccaccgcggccuc

SEQ ID NO: 1498493 - RNA, 22 nt, Pseudomonas aeruginosa PA01
guccaccgcggccucgcuggcg

SEQ ID NO: 1498494 - RNA, 12 nt, Pseudomonas aeruginosa PA01
guccaccggcgc

SEQ ID NO: 1498495 - RNA, 13 nt, Pseudomonas aeruginosa PA01
guccaccuggcgg

SEQ ID NO: 1498496 - RNA, 14 nt, Pseudomonas aeruginosa PA01
gucauggcguccgg

SEQ ID NO: 1498497 - RNA, 17 nt, Pseudomonas aeruginosa PA01
gucauguccggggcgau

SEQ ID NO: 1498498 - RNA, 13 nt, Pseudomonas aeruginosa PA01
gucauggugccga

SEQ ID NO: 1498499 - RNA, 16 nt, Pseudomonas aeruginosa PA01
gucauggugccgagca

SEQ ID NO: 1498500 - RNA, 15 nt, Pseudomonas aeruginosa PA01
gucauggccagcucg

SEQ ID NO: 1498501 - RNA, 20 nt, Pseudomonas aeruginosa PA01
gucauggcgcacgccgcgga

SEQ ID NO: 1498502 - RNA, 22 nt, Pseudomonas aeruginosa PA01
gucaugcgcccuacgccaccug

SEQ ID NO: 1498503 - RNA, 23 nt, Pseudomonas aeruginosa PA01
gucaugaccagagccgccgaaca

SEQ ID NO: 1498504 - RNA, 19 nt, Pseudomonas aeruginosa PA01
gucaugaugccuuucgggg

SEQ ID NO: 1498505 - RNA, 17 nt, Pseudomonas aeruginosa PA01
gucaugcacuucgacca

SEQ ID NO: 1498506 - RNA, 17 nt, Pseudomonas aeruginosa PA01
gucaugcccaggccgaa

SEQ ID NO: 1498507 - RNA, 14 nt, Pseudomonas aeruginosa PA01
gucaugccgccauc

SEQ ID NO: 1498508 - RNA, 15 nt, Pseudomonas aeruginosa PA01
gucaugccgccgucg

SEQ ID NO: 1498509 - RNA, 16 nt, Pseudomonas aeruginosa PA01
gucaugcccuggccga

SEQ ID NO: 1498510 - RNA, 19 nt, Pseudomonas aeruginosa PA01
gucaugcccuggccgacgc

SEQ ID NO: 1498511 - RNA, 12 nt, Pseudomonas aeruginosa PA01
gucaugccgucu

SEQ ID NO: 1498512 - RNA, 16 nt, Pseudomonas aeruginosa PA01
gucaugccgucuucga

SEQ ID NO: 1498513 - RNA, 13 nt, Pseudomonas aeruginosa PA01
gucaguucggccc

SEQ ID NO: 1498514 - RNA, 20 nt, Pseudomonas aeruginosa PA01
gucaguucggcccagcagcg

SEQ ID NO: 1498515 - RNA, 18 nt, Pseudomonas aeruginosa PA01
gucaguucggugccgccg

SEQ ID NO: 1498516 - RNA, 20 nt, Pseudomonas aeruginosa PA01
gucaguucggugccgccggc

SEQ ID NO: 1498517 - RNA, 21 nt, Pseudomonas aeruginosa PA01
gucaguucggugccgccggcg

SEQ ID NO: 1498518 - RNA, 21 nt, Pseudomonas aeruginosa PA01
gucaguuccaggucggcggca

SEQ ID NO: 1498519 - RNA, 13 nt, Pseudomonas aeruginosa PA01
gucagucgagcag

SEQ ID NO: 1498520 - RNA, 24 nt, Pseudomonas aeruginosa PA01
gucagguaggagaugcagcgucgc

SEQ ID NO: 1498521 - RNA, 20 nt, Pseudomonas aeruginosa PA01
gucagguaggcaucgacgcc

SEQ ID NO: 1498522 - RNA, 14 nt, Pseudomonas aeruginosa PA01
gucaggucgacgcc

SEQ ID NO: 1498523 - RNA, 18 nt, Pseudomonas aeruginosa PA01
gucagguauucgccggcc

SEQ ID NO: 1498524 - RNA, 18 nt, Pseudomonas aeruginosa PA01
gucaggcaaucucccccu

SEQ ID NO: 1498525 - RNA, 20 nt, Pseudomonas aeruginosa PA01
gucaggaucggcgcccagca

SEQ ID NO: 1498526 - RNA, 20 nt, Pseudomonas aeruginosa PA01
gucaggaucacaucgcccgg

SEQ ID NO: 1498527 - RNA, 23 nt, Pseudomonas aeruginosa PA01
gucagggcuugcgcgccaccagc

SEQ ID NO: 1498528 - RNA, 19 nt, Pseudomonas aeruginosa PA01
gucaggcucagcucggcga

SEQ ID NO: 1498529 - RNA, 22 nt, Pseudomonas aeruginosa PA01
gucaggcugaucuugccgcugg

SEQ ID NO: 1498530 - RNA, 13 nt, Pseudomonas aeruginosa PA01
gucaggcugcgca

SEQ ID NO: 1498531 - RNA, 22 nt, Pseudomonas aeruginosa PA01
gucaggcugcgcaccucggcca

SEQ ID NO: 1498532 - RNA, 23 nt, Pseudomonas aeruginosa PA01
gucaggcugcggcggaaggcggc

SEQ ID NO: 1498533 - RNA, 14 nt, Pseudomonas aeruginosa PA01
gucaggcuggcccc

SEQ ID NO: 1498534 - RNA, 19 nt, Pseudomonas aeruginosa PA01
gucaggcuggccccgguga

SEQ ID NO: 1498535 - RNA, 17 nt, Pseudomonas aeruginosa PA01
gucaggcuggugccgcu

SEQ ID NO: 1498536 - RNA, 18 nt, Pseudomonas aeruginosa PA01
gucaggcuggugccgcug

SEQ ID NO: 1498537 - RNA, 21 nt, Pseudomonas aeruginosa PA01
gucaggcugguggucaccgcc

SEQ ID NO: 1498538 - RNA, 22 nt, Pseudomonas aeruginosa PA01
gucaggcugguggucaccgcca

SEQ ID NO: 1498539 - RNA, 17 nt, Pseudomonas aeruginosa PA01
guaucgaugcgcgcggc

SEQ ID NO: 1498540 - RNA, 19 nt, Pseudomonas aeruginosa PA01
guaucgaugcgcgcggcga

SEQ ID NO: 1498541 - RNA, 17 nt, Pseudomonas aeruginosa PA01
gucagcuggcgcgccuc

SEQ ID NO: 1498542 - RNA, 18 nt, Pseudomonas aeruginosa PA01
gucagcuggcgcgccucc

SEQ ID NO: 1498543 - RNA, 14 nt, Pseudomonas aeruginosa PA01
guaucgccguccug

SEQ ID NO: 1498544 - RNA, 13 nt, Pseudomonas aeruginosa PA01
gucagcucgacag

SEQ ID NO: 1498545 - RNA, 15 nt, Pseudomonas aeruginosa PA01
gucccugaccagcag

SEQ ID NO: 1498546 - RNA, 22 nt, Pseudomonas aeruginosa PA01
gucccugaccagcagggugcgg

SEQ ID NO: 1498547 - RNA, 19 nt, Pseudomonas aeruginosa PA01
gucccugcacagggacgcg

SEQ ID NO: 1498548 - RNA, 19 nt, Pseudomonas aeruginosa PA01
gucccugcccgcgccucgc

SEQ ID NO: 1498549 - RNA, 18 nt, Pseudomonas aeruginosa PA01
gucccguuccggcgcagc

SEQ ID NO: 1498550 - RNA, 23 nt, Pseudomonas aeruginosa PA01
gucccggguguccuuugccugau

SEQ ID NO: 1498551 - RNA, 19 nt, Pseudomonas aeruginosa PA01
gucccugucccgccgcgcc

SEQ ID NO: 1498552 - RNA, 23 nt, Pseudomonas aeruginosa PA01
gucccugucccgccgcgccgcuc

SEQ ID NO: 1498553 - RNA, 15 nt, Pseudomonas aeruginosa PA01
gucccugggccaugu

SEQ ID NO: 1498554 - RNA, 18 nt, Pseudomonas aeruginosa PA01
gucccugggccugcaggu

SEQ ID NO: 1498555 - RNA, 16 nt, Pseudomonas aeruginosa PA01
gucccugggcgcaggg

SEQ ID NO: 1498556 - RNA, 12 nt, Pseudomonas aeruginosa PA01
gucccuggccgg

SEQ ID NO: 1498557 - RNA, 15 nt, Pseudomonas aeruginosa PA01
gucccuggccggcga

SEQ ID NO: 1498558 - RNA, 21 nt, Pseudomonas aeruginosa PA01
guccgagagcagggccuggcc

SEQ ID NO: 1498559 - RNA, 14 nt, Pseudomonas aeruginosa PA01
guccgagcaggucg

SEQ ID NO: 1498560 - RNA, 15 nt, Pseudomonas aeruginosa PA01
guccgagcaggucgc

SEQ ID NO: 1498561 - RNA, 19 nt, Pseudomonas aeruginosa PA01
guccgagcaggucgcggaa

SEQ ID NO: 1498562 - RNA, 21 nt, Pseudomonas aeruginosa PA01
guccgauucuuggcucggcag

SEQ ID NO: 1498563 - RNA, 15 nt, Pseudomonas aeruginosa PA01
guccgccaccacggc

SEQ ID NO: 1498564 - RNA, 16 nt, Pseudomonas aeruginosa PA01
guccgccagccggcug

SEQ ID NO: 1498565 - RNA, 18 nt, Pseudomonas aeruginosa PA01
guccgccugguccagcag

SEQ ID NO: 1498566 - RNA, 15 nt, Pseudomonas aeruginosa PA01
guccgcgccacgcag

SEQ ID NO: 1498567 - RNA, 19 nt, Pseudomonas aeruginosa PA01
guccgcgccaugccggcgc

SEQ ID NO: 1498568 - RNA, 13 nt, Pseudomonas aeruginosa PA01
guccgcgaugcgu

SEQ ID NO: 1498569 - RNA, 14 nt, Pseudomonas aeruginosa PA01
guccgcagcacagc

SEQ ID NO: 1498570 - RNA, 21 nt, Pseudomonas aeruginosa PA01
guccgcaccguagcggcugcg

SEQ ID NO: 1498571 - RNA, 22 nt, Pseudomonas aeruginosa PA01
guccgcagcgccacuuccagcu

SEQ ID NO: 1498572 - RNA, 15 nt, Pseudomonas aeruginosa PA01
guccgcaguugaggc

SEQ ID NO: 1498573 - RNA, 19 nt, Pseudomonas aeruginosa PA01
guccgcaguucgccccgcc

SEQ ID NO: 1498574 - RNA, 23 nt, Pseudomonas aeruginosa PA01
guccgcaguucgccccgccgcca

SEQ ID NO: 1498575 - RNA, 15 nt, Pseudomonas aeruginosa PA01
guccggcuccggcug

SEQ ID NO: 1498576 - RNA, 16 nt, Pseudomonas aeruginosa PA01
guccggcuccggcugc

SEQ ID NO: 1498577 - RNA, 21 nt, Pseudomonas aeruginosa PA01
guccggcggcgaugaagcuga

SEQ ID NO: 1498578 - RNA, 13 nt, Pseudomonas aeruginosa PA01
guccggcggcugc

SEQ ID NO: 1498579 - RNA, 16 nt, Pseudomonas aeruginosa PA01
guccggcgcugagcga

SEQ ID NO: 1498580 - RNA, 16 nt, Pseudomonas aeruginosa PA01
guccggcgccaacugc

SEQ ID NO: 1498581 - RNA, 15 nt, Pseudomonas aeruginosa PA01
guccgcgccucgcgc

SEQ ID NO: 1498582 - RNA, 22 nt, Pseudomonas aeruginosa PA01
guccgcgccucgcgcaacgccg

SEQ ID NO: 1498583 - RNA, 13 nt, Pseudomonas aeruginosa PA01
guccgcgccgcgc

SEQ ID NO: 1498584 - RNA, 23 nt, Pseudomonas aeruginosa PA01
guccgcgccgcgucgccgccagc

SEQ ID NO: 1498585 - RNA, 22 nt, Pseudomonas aeruginosa PA01
guccggccgcccgagccgcugc

SEQ ID NO: 1498586 - RNA, 15 nt, Pseudomonas aeruginosa PA01
guccggcgaccacca

SEQ ID NO: 1498587 - RNA, 11 nt, Pseudomonas aeruginosa PA01
guccggcgaga

SEQ ID NO: 1498588 - RNA, 20 nt, Pseudomonas aeruginosa PA01
guccggcgagaaaggcugcu

SEQ ID NO: 1498589 - RNA, 19 nt, Pseudomonas aeruginosa PA01
guccggcgagcacggcgaa

SEQ ID NO: 1498590 - RNA, 19 nt, Pseudomonas aeruginosa PA01
guccagcgggcccauggcg

SEQ ID NO: 1498591 - RNA, 14 nt, Pseudomonas aeruginosa PA01
guccagcgcgccgc

SEQ ID NO: 1498592 - RNA, 15 nt, Pseudomonas aeruginosa PA01
guccagcgcgccgcg

SEQ ID NO: 1498593 - RNA, 14 nt, Pseudomonas aeruginosa PA01
guccaggccgcagg

SEQ ID NO: 1498594 - RNA, 13 nt, Pseudomonas aeruginosa PA01
guccagcucggcc

SEQ ID NO: 1498595 - RNA, 14 nt, Pseudomonas aeruginosa PA01
guccagcucggcca

SEQ ID NO: 1498596 - RNA, 15 nt, Pseudomonas aeruginosa PA01
guccagcucggccau

SEQ ID NO: 1498597 - RNA, 21 nt, Pseudomonas aeruginosa PA01
guccagcucggccaucagcgc

SEQ ID NO: 1498598 - RNA, 23 nt, Pseudomonas aeruginosa PA01
guccagcucggccaucagcgcca

SEQ ID NO: 1498599 - RNA, 18 nt, Pseudomonas aeruginosa PA01
guccagcucggucagcgg

SEQ ID NO: 1498600 - RNA, 16 nt, Pseudomonas aeruginosa PA01
guccagcuccaccagg

SEQ ID NO: 1498601 - RNA, 16 nt, Pseudomonas aeruginosa PA01
guccagcggcaugccg

SEQ ID NO: 1498602 - RNA, 21 nt, Pseudomonas aeruginosa PA01
guccagccagacguccggcag

SEQ ID NO: 1498603 - RNA, 15 nt, Pseudomonas aeruginosa PA01
guccagccagccgcc

SEQ ID NO: 1498604 - RNA, 18 nt, Pseudomonas aeruginosa PA01
guccagccagugcaugcg

SEQ ID NO: 1498605 - RNA, 13 nt, Pseudomonas aeruginosa PA01
guccagccggcgc

SEQ ID NO: 1498606 - RNA, 22 nt, Pseudomonas aeruginosa PA01
guccagccgguaggggccgacg

SEQ ID NO: 1498607 - RNA, 23 nt, Pseudomonas aeruginosa PA01
guccagccgguaggggccgacga

SEQ ID NO: 1498608 - RNA, 22 nt, Pseudomonas aeruginosa PA01
guccagcgccgagacgaucagc

SEQ ID NO: 1498609 - RNA, 15 nt, Pseudomonas aeruginosa PA01
guccagcgcgcccgg

SEQ ID NO: 1498610 - RNA, 19 nt, Pseudomonas aeruginosa PA01
guccagcgcgcccggcgcc

SEQ ID NO: 1498611 - RNA, 20 nt, Pseudomonas aeruginosa PA01
guccagcgcgcccggcgcca

SEQ ID NO: 1498612 - RNA, 22 nt, Pseudomonas aeruginosa PA01
guccagcgcgcccggcgccacc

SEQ ID NO: 1498613 - RNA, 14 nt, Pseudomonas aeruginosa PA01
guccagcgccgcgc

SEQ ID NO: 1498614 - RNA, 16 nt, Pseudomonas aeruginosa PA01
guccagcgccgcgcug

SEQ ID NO: 1498615 - RNA, 17 nt, Pseudomonas aeruginosa PA01
guccagcgccgcgcugc

SEQ ID NO: 1498616 - RNA, 16 nt, Pseudomonas aeruginosa PA01
guccaggcuguggcgc

SEQ ID NO: 1498617 - RNA, 19 nt, Pseudomonas aeruginosa PA01
guccagggcauccaucgcc

SEQ ID NO: 1498618 - RNA, 20 nt, Pseudomonas aeruginosa PA01
guccagggcauccaucgcca

SEQ ID NO: 1498619 - RNA, 12 nt, Pseudomonas aeruginosa PA01
guccagggcgaa

SEQ ID NO: 1498620 - RNA, 23 nt, Pseudomonas aeruginosa PA01
guccagggcgaaccacucggcgc

SEQ ID NO: 1498621 - RNA, 16 nt, Pseudomonas aeruginosa PA01
guccagggcgauggcg

SEQ ID NO: 1498622 - RNA, 20 nt, Pseudomonas aeruginosa PA01
guccagggcgauggcgguga

SEQ ID NO: 1498623 - RNA, 14 nt, Pseudomonas aeruginosa PA01
guccagggcuucga

SEQ ID NO: 1498624 - RNA, 18 nt, Pseudomonas aeruginosa PA01
guccagggugaucacacc

SEQ ID NO: 1498625 - RNA, 16 nt, Pseudomonas aeruginosa PA01
guccaggucaugcccu

SEQ ID NO: 1498626 - RNA, 17 nt, Pseudomonas aeruginosa PA01
guccagguugugcucga

SEQ ID NO: 1498627 - RNA, 13 nt, Pseudomonas aeruginosa PA01
guccaggugcggc

SEQ ID NO: 1498628 - RNA, 14 nt, Pseudomonas aeruginosa PA01
guccaggcgcugcu

SEQ ID NO: 1498629 - RNA, 16 nt, Pseudomonas aeruginosa PA01
guccaggcgcugcucg

SEQ ID NO: 1498630 - RNA, 12 nt, Pseudomonas aeruginosa PA01
guccaggcgcug

SEQ ID NO: 1498631 - RNA, 21 nt, Pseudomonas aeruginosa PA01
guccaggcgcgaacgcuccca

SEQ ID NO: 1498632 - RNA, 20 nt, Pseudomonas aeruginosa PA01
guccaggcugaguucgucga

SEQ ID NO: 1498633 - RNA, 14 nt, Pseudomonas aeruginosa PA01
guccaggcgucggc

SEQ ID NO: 1498634 - RNA, 19 nt, Pseudomonas aeruginosa PA01
guccaggcgggccagcugg

SEQ ID NO: 1498635 - RNA, 13 nt, Pseudomonas aeruginosa PA01
guccagcuggcgc

SEQ ID NO: 1498636 - RNA, 14 nt, Pseudomonas aeruginosa PA01
gucccacaggccgg

SEQ ID NO: 1498637 - RNA, 15 nt, Pseudomonas aeruginosa PA01
gucccacaggccggc

SEQ ID NO: 1498638 - RNA, 16 nt, Pseudomonas aeruginosa PA01
gucccacaggccggcu

SEQ ID NO: 1498639 - RNA, 12 nt, Pseudomonas aeruginosa PA01
guccaugcucgc

SEQ ID NO: 1498640 - RNA, 17 nt, Pseudomonas aeruginosa PA01
guccaugcucgccaccu

SEQ ID NO: 1498641 - RNA, 22 nt, Pseudomonas aeruginosa PA01
guccauguagcguugcaggcag

SEQ ID NO: 1498642 - RNA, 15 nt, Pseudomonas aeruginosa PA01
guccaguagcgccug

SEQ ID NO: 1498643 - RNA, 16 nt, Pseudomonas aeruginosa PA01
guccaucucgccgcgc

SEQ ID NO: 1498644 - RNA, 20 nt, Pseudomonas aeruginosa PA01
guccaucuguaccaccgcca

SEQ ID NO: 1498645 - RNA, 23 nt, Pseudomonas aeruginosa PA01
guccaugccguacaggucggcgc

SEQ ID NO: 1498646 - RNA, 17 nt, Pseudomonas aeruginosa PA01
gucgacgaccuugccca

SEQ ID NO: 1498647 - RNA, 21 nt, Pseudomonas aeruginosa PA01
gucgacgacgaaaggccgcgc

SEQ ID NO: 1498648 - RNA, 13 nt, Pseudomonas aeruginosa PA01
gucgacgaacagg

SEQ ID NO: 1498649 - RNA, 19 nt, Pseudomonas aeruginosa PA01
gucgacgaacaggaagcgc

SEQ ID NO: 1498650 - RNA, 16 nt, Pseudomonas aeruginosa PA01
gucgaccuugccgacg

SEQ ID NO: 1498651 - RNA, 17 nt, Pseudomonas aeruginosa PA01
gucgaccuugccgacgc

SEQ ID NO: 1498652 - RNA, 22 nt, Pseudomonas aeruginosa PA01
gucgaccuggguaccgacgguc

SEQ ID NO: 1498653 - RNA, 23 nt, Pseudomonas aeruginosa PA01
gucgaccugcggguuggucggca

SEQ ID NO: 1498654 - RNA, 13 nt, Pseudomonas aeruginosa PA01
gucgaccaggcgu

SEQ ID NO: 1498655 - RNA, 16 nt, Pseudomonas aeruginosa PA01
gucgaacugaccacca

SEQ ID NO: 1498656 - RNA, 13 nt, Pseudomonas aeruginosa PA01
gucgacccaggcc

SEQ ID NO: 1498657 - RNA, 17 nt, Pseudomonas aeruginosa PA01
gucgaccaucaccagcg

SEQ ID NO: 1498658 - RNA, 20 nt, Pseudomonas aeruginosa PA01
gucgaccaucaccagcgccg

SEQ ID NO: 1498659 - RNA, 21 nt, Pseudomonas aeruginosa PA01
gucgaccaucaccagcgccgu

SEQ ID NO: 1498660 - RNA, 22 nt, Pseudomonas aeruginosa PA01
gucgaccaucaccagcgccguc

SEQ ID NO: 1498661 - RNA, 14 nt, Pseudomonas aeruginosa PA01
gucgaacagcggcu

SEQ ID NO: 1498662 - RNA, 16 nt, Pseudomonas aeruginosa PA01
gucgaacagcggcugg

SEQ ID NO: 1498663 - RNA, 14 nt, Pseudomonas aeruginosa PA01
gucgaacaggcccu

SEQ ID NO: 1498664 - RNA, 23 nt, Pseudomonas aeruginosa PA01
gucgaaccagcucagcuccaggc

SEQ ID NO: 1498665 - RNA, 20 nt, Pseudomonas aeruginosa PA01
gucgaaccagggacgcccgg

SEQ ID NO: 1498666 - RNA, 13 nt, Pseudomonas aeruginosa PA01
gucgaccagcggc

SEQ ID NO: 1498667 - RNA, 15 nt, Pseudomonas aeruginosa PA01
gucgaccagcggcgg

SEQ ID NO: 1498668 - RNA, 13 nt, Pseudomonas aeruginosa PA01
gucgaccagccag

SEQ ID NO: 1498669 - RNA, 17 nt, Pseudomonas aeruginosa PA01
gucgaccagccagucgg

SEQ ID NO: 1498670 - RNA, 14 nt, Pseudomonas aeruginosa PA01
gucgaacagcagcu

SEQ ID NO: 1498671 - RNA, 16 nt, Pseudomonas aeruginosa PA01
gucgaacaacccgcca

SEQ ID NO: 1498672 - RNA, 16 nt, Pseudomonas aeruginosa PA01
guccuugugcugcucg

SEQ ID NO: 1498673 - RNA, 18 nt, Pseudomonas aeruginosa PA01
gucgaacaccggcgccgc

SEQ ID NO: 1498674 - RNA, 16 nt, Pseudomonas aeruginosa PA01
gucgaaaugcucgugc

SEQ ID NO: 1498675 - RNA, 17 nt, Pseudomonas aeruginosa PA01
gucgaaacgcuggcggc

SEQ ID NO: 1498676 - RNA, 20 nt, Pseudomonas aeruginosa PA01
gucgaaacgcuggcggccga

SEQ ID NO: 1498677 - RNA, 21 nt, Pseudomonas aeruginosa PA01
gucgaaacgcuggcggccgag

SEQ ID NO: 1498678 - RNA, 14 nt, Pseudomonas aeruginosa PA01
gucgaaacgggcgc

SEQ ID NO: 1498679 - RNA, 16 nt, Pseudomonas aeruginosa PA01
gucgaaagccugccgg

SEQ ID NO: 1498680 - RNA, 18 nt, Pseudomonas aeruginosa PA01
gucgaaagcuucgucgcg

SEQ ID NO: 1498681 - RNA, 22 nt, Pseudomonas aeruginosa PA01
gucgaaagcuucgucgcgcagg

SEQ ID NO: 1498682 - RNA, 14 nt, Pseudomonas aeruginosa PA01
guccuugcccggcg

SEQ ID NO: 1498683 - RNA, 17 nt, Pseudomonas aeruginosa PA01
guccuugaucuuguccg

SEQ ID NO: 1498684 - RNA, 11 nt, Pseudomonas aeruginosa PA01
guccuuggccu

SEQ ID NO: 1498685 - RNA, 14 nt, Pseudomonas aeruginosa PA01
guccuugggaucgu

SEQ ID NO: 1498686 - RNA, 19 nt, Pseudomonas aeruginosa PA01
guccgggcgguacaggcgc

SEQ ID NO: 1498687 - RNA, 13 nt, Pseudomonas aeruginosa PA01
guccgggcgcggc

SEQ ID NO: 1498688 - RNA, 16 nt, Pseudomonas aeruginosa PA01
guccggcugucgacgc

SEQ ID NO: 1498689 - RNA, 17 nt, Pseudomonas aeruginosa PA01
guccgggaugccggugc

SEQ ID NO: 1498690 - RNA, 19 nt, Pseudomonas aeruginosa PA01
guccgggaugccggugcug

SEQ ID NO: 1498691 - RNA, 19 nt, Pseudomonas aeruginosa PA01
guccgggaaguccgggcgc

SEQ ID NO: 1498692 - RNA, 17 nt, Pseudomonas aeruginosa PA01
guccgggaaugcucagc

SEQ ID NO: 1498693 - RNA, 23 nt, Pseudomonas aeruginosa PA01
guccgggaaugcucagcacggcg

SEQ ID NO: 1498694 - RNA, 15 nt, Pseudomonas aeruginosa PA01
guccgggugaugccc

SEQ ID NO: 1498695 - RNA, 20 nt, Pseudomonas aeruginosa PA01
guccuggucgcugaggccgc

SEQ ID NO: 1498696 - RNA, 13 nt, Pseudomonas aeruginosa PA01
guccuucggcgca

SEQ ID NO: 1498697 - RNA, 18 nt, Pseudomonas aeruginosa PA01
guccuucggcgcucuuca

SEQ ID NO: 1498698 - RNA, 15 nt, Pseudomonas aeruginosa PA01
guccuugagcgccag

SEQ ID NO: 1498699 - RNA, 18 nt, Pseudomonas aeruginosa PA01
guccuugaguagcuggcg

SEQ ID NO: 1498700 - RNA, 21 nt, Pseudomonas aeruginosa PA01
guccuugaguagcuggcgcag

SEQ ID NO: 1498701 - RNA, 16 nt, Pseudomonas aeruginosa PA01
gucgacgcaucgacgg

SEQ ID NO: 1498702 - RNA, 21 nt, Pseudomonas aeruginosa PA01
gucgacgcaucgacggggcgu

SEQ ID NO: 1498703 - RNA, 14 nt, Pseudomonas aeruginosa PA01
gucgacgccauggc

SEQ ID NO: 1498704 - RNA, 17 nt, Pseudomonas aeruginosa PA01
gucgacgcagcgcgcgu

SEQ ID NO: 1498705 - RNA, 23 nt, Pseudomonas aeruginosa PA01
gucgacgcagcgcgcgucggcga

SEQ ID NO: 1498706 - RNA, 17 nt, Pseudomonas aeruginosa PA01
gucgacgcagggcggcg

SEQ ID NO: 1498707 - RNA, 17 nt, Pseudomonas aeruginosa PA01
gucgacgaucuguucga

SEQ ID NO: 1498708 - RNA, 14 nt, Pseudomonas aeruginosa PA01
gucgacgccgccga

SEQ ID NO: 1498709 - RNA, 14 nt, Pseudomonas aeruginosa PA01
gucgacgccgagcu

SEQ ID NO: 1498710 - RNA, 12 nt, Pseudomonas aeruginosa PA01
gucgacgcccug

SEQ ID NO: 1498711 - RNA, 14 nt, Pseudomonas aeruginosa PA01
gucgacgcccuggg

SEQ ID NO: 1498712 - RNA, 20 nt, Pseudomonas aeruginosa PA01
gucgacgcccugggcgacgc

SEQ ID NO: 1498713 - RNA, 21 nt, Pseudomonas aeruginosa PA01
gucgacgcccugggcgacgcg

SEQ ID NO: 1498714 - RNA, 22 nt, Pseudomonas aeruginosa PA01
gucgacgccgaagccgcuggca

SEQ ID NO: 1498715 - RNA, 14 nt, Pseudomonas aeruginosa PA01
gucgagcagcgccg

SEQ ID NO: 1498716 - RNA, 15 nt, Pseudomonas aeruginosa PA01
gucgagcagcgcgcg

SEQ ID NO: 1498717 - RNA, 23 nt, Pseudomonas aeruginosa PA01
gucgagcagcgcgcggcucggcg

SEQ ID NO: 1498718 - RNA, 13 nt, Pseudomonas aeruginosa PA01
gucgagcagcgcc

SEQ ID NO: 1498719 - RNA, 14 nt, Pseudomonas aeruginosa PA01
gucgagcacggcgc

SEQ ID NO: 1498720 - RNA, 17 nt, Pseudomonas aeruginosa PA01
gucgagcacggcgcugg

SEQ ID NO: 1498721 - RNA, 14 nt, Pseudomonas aeruginosa PA01
gucgagaugcugcg

SEQ ID NO: 1498722 - RNA, 16 nt, Pseudomonas aeruginosa PA01
gucgagcaccagcagg

SEQ ID NO: 1498723 - RNA, 17 nt, Pseudomonas aeruginosa PA01
gucgagcaccagcaggu

SEQ ID NO: 1498724 - RNA, 20 nt, Pseudomonas aeruginosa PA01
gucgagcaccagcaggucgg

SEQ ID NO: 1498725 - RNA, 23 nt, Pseudomonas aeruginosa PA01
gucgagcaccagcaggucggcgc

SEQ ID NO: 1498726 - RNA, 15 nt, Pseudomonas aeruginosa PA01
gucgagcaccaggcg

SEQ ID NO: 1498727 - RNA, 17 nt, Pseudomonas aeruginosa PA01
gucgagcaccaggcggu

SEQ ID NO: 1498728 - RNA, 16 nt, Pseudomonas aeruginosa PA01
gucgagaccgaccgac

SEQ ID NO: 1498729 - RNA, 14 nt, Pseudomonas aeruginosa PA01
gucgagacgccagc

SEQ ID NO: 1498730 - RNA, 15 nt, Pseudomonas aeruginosa PA01
gucgagacgccagcc

SEQ ID NO: 1498731 - RNA, 18 nt, Pseudomonas aeruginosa PA01
gucgaggucgacggcggc

SEQ ID NO: 1498732 - RNA, 20 nt, Pseudomonas aeruginosa PA01
gucgaggucgagguccacgu

SEQ ID NO: 1498733 - RNA, 23 nt, Pseudomonas aeruginosa PA01
gucgaucccggauucgccgagga

SEQ ID NO: 1498734 - RNA, 14 nt, Pseudomonas aeruginosa PA01
gucgauccgcgccu

SEQ ID NO: 1498735 - RNA, 18 nt, Pseudomonas aeruginosa PA01
gucgauccuucccacuug

SEQ ID NO: 1498736 - RNA, 20 nt, Pseudomonas aeruginosa PA01
gucgauccccaacccggcca

SEQ ID NO: 1498737 - RNA, 22 nt, Pseudomonas aeruginosa PA01
gucgauccccaacccggccagc

SEQ ID NO: 1498738 - RNA, 17 nt, Pseudomonas aeruginosa PA01
gucgaucguugccagcc

SEQ ID NO: 1498739 - RNA, 20 nt, Pseudomonas aeruginosa PA01
gucgaugacguugcugcccu

SEQ ID NO: 1498740 - RNA, 17 nt, Pseudomonas aeruginosa PA01
gucgaugacgauggcgc

SEQ ID NO: 1498741 - RNA, 20 nt, Pseudomonas aeruginosa PA01
gucgaucugcucguccaggc

SEQ ID NO: 1498742 - RNA, 22 nt, Pseudomonas aeruginosa PA01
gucgaucugcucguccaggccg

SEQ ID NO: 1498743 - RNA, 14 nt, Pseudomonas aeruginosa PA01
gucgaucucgccga

SEQ ID NO: 1498744 - RNA, 21 nt, Pseudomonas aeruginosa PA01
gucgaucucgaagaccagcgg

SEQ ID NO: 1498745 - RNA, 14 nt, Pseudomonas aeruginosa PA01
gucgagccagccca

SEQ ID NO: 1498746 - RNA, 18 nt, Pseudomonas aeruginosa PA01
gucgagccagcccagcgg

SEQ ID NO: 1498747 - RNA, 21 nt, Pseudomonas aeruginosa PA01
gucgagccagcccagcggcgc

SEQ ID NO: 1498748 - RNA, 14 nt, Pseudomonas aeruginosa PA01
gucgagccaggcgu

SEQ ID NO: 1498749 - RNA, 17 nt, Pseudomonas aeruginosa PA01
gucgagcaguuccggca

SEQ ID NO: 1498750 - RNA, 22 nt, Pseudomonas aeruginosa PA01
gucgagcagggagaaccaggcg

SEQ ID NO: 1498751 - RNA, 19 nt, Pseudomonas aeruginosa PA01
gucgagcagggucgcgagc

SEQ ID NO: 1498752 - RNA, 16 nt, Pseudomonas aeruginosa PA01
gucgaggaaggccagc

SEQ ID NO: 1498753 - RNA, 17 nt, Pseudomonas aeruginosa PA01
gucgaggaaggccagca

SEQ ID NO: 1498754 - RNA, 16 nt, Pseudomonas aeruginosa PA01
gucgaggaaggccagg

SEQ ID NO: 1498755 - RNA, 17 nt, Pseudomonas aeruginosa PA01
gucgaggaaggccaggu

SEQ ID NO: 1498756 - RNA, 20 nt, Pseudomonas aeruginosa PA01
gucgagggcgcguugcccag

SEQ ID NO: 1498757 - RNA, 16 nt, Pseudomonas aeruginosa PA01
gucgagggucugcugg

SEQ ID NO: 1498758 - RNA, 20 nt, Pseudomonas aeruginosa PA01
gucgaggguggucagccagc

SEQ ID NO: 1498759 - RNA, 18 nt, Pseudomonas aeruginosa PA01
gucgagggugguuuccag

SEQ ID NO: 1498760 - RNA, 21 nt, Pseudomonas aeruginosa PA01
gucgagggugguuuccaggcu

SEQ ID NO: 1498761 - RNA, 18 nt, Pseudomonas aeruginosa PA01
gucgaggcccucggcggc

SEQ ID NO: 1498762 - RNA, 14 nt, Pseudomonas aeruginosa PA01
gucgaggccgcgga

SEQ ID NO: 1498763 - RNA, 15 nt, Pseudomonas aeruginosa PA01
gucgaggauguacag

SEQ ID NO: 1498764 - RNA, 17 nt, Pseudomonas aeruginosa PA01
gucgaggcugccgaagc

SEQ ID NO: 1498765 - RNA, 14 nt, Pseudomonas aeruginosa PA01
gucgaggcugucgc

SEQ ID NO: 1498766 - RNA, 17 nt, Pseudomonas aeruginosa PA01
gucgaggcugucgcgga

SEQ ID NO: 1498767 - RNA, 17 nt, Pseudomonas aeruginosa PA01
gucgagggcaaaggcgc

SEQ ID NO: 1498768 - RNA, 16 nt, Pseudomonas aeruginosa PA01
gucgaggccucgucgu

SEQ ID NO: 1498769 - RNA, 21 nt, Pseudomonas aeruginosa PA01
gucgaugaucuugucgugccg

SEQ ID NO: 1498770 - RNA, 17 nt, Pseudomonas aeruginosa PA01
gucgaugccgcccgguu

SEQ ID NO: 1498771 - RNA, 12 nt, Pseudomonas aeruginosa PA01
gucgaugccgaa

SEQ ID NO: 1498772 - RNA, 21 nt, Pseudomonas aeruginosa PA01
gucgaugcccagccagggccg

SEQ ID NO: 1498773 - RNA, 22 nt, Pseudomonas aeruginosa PA01
gucgaugcccagccagggccgc

SEQ ID NO: 1498774 - RNA, 17 nt, Pseudomonas aeruginosa PA01
gucgaugcgcccgccgc

SEQ ID NO: 1498775 - RNA, 19 nt, Pseudomonas aeruginosa PA01
gucgaugcgcccgccgcga

SEQ ID NO: 1498776 - RNA, 22 nt, Pseudomonas aeruginosa PA01
gucgaugcgcccgccgcgagcg

SEQ ID NO: 1498777 - RNA, 20 nt, Pseudomonas aeruginosa PA01
gucgaugccuucggcggccg

SEQ ID NO: 1498778 - RNA, 14 nt, Pseudomonas aeruginosa PA01
gucgaugcuuucga

SEQ ID NO: 1498779 - RNA, 17 nt, Pseudomonas aeruginosa PA01
gucgaugcuuucgagca

SEQ ID NO: 1498780 - RNA, 12 nt, Pseudomonas aeruginosa PA01
gucgaugcugcc

SEQ ID NO: 1498781 - RNA, 19 nt, Pseudomonas aeruginosa PA01
gucgaugcguccgcgcagg

SEQ ID NO: 1498782 - RNA, 16 nt, Pseudomonas aeruginosa PA01
gucgaugggccguagg

SEQ ID NO: 1498783 - RNA, 16 nt, Pseudomonas aeruginosa PA01
gucgaugggcgagcga

SEQ ID NO: 1498784 - RNA, 19 nt, Pseudomonas aeruginosa PA01
gucgcacagccaggggcac

SEQ ID NO: 1498785 - RNA, 17 nt, Pseudomonas aeruginosa PA01
gucgauggucaggauca

SEQ ID NO: 1498786 - RNA, 14 nt, Pseudomonas aeruginosa PA01
gucgaugucgcggc

SEQ ID NO: 1498787 - RNA, 16 nt, Pseudomonas aeruginosa PA01
gucgaugucgcggccc

SEQ ID NO: 1498788 - RNA, 16 nt, Pseudomonas aeruginosa PA01
gucgaugucgcggcug

SEQ ID NO: 1498789 - RNA, 13 nt, Pseudomonas aeruginosa PA01
gucgcccagcgcc

SEQ ID NO: 1498790 - RNA, 14 nt, Pseudomonas aeruginosa PA01
gucgcccagcgccu

SEQ ID NO: 1498791 - RNA, 23 nt, Pseudomonas aeruginosa PA01
gucgcccaugugcuugaccgccg

SEQ ID NO: 1498792 - RNA, 13 nt, Pseudomonas aeruginosa PA01
gucgcccaggccg

SEQ ID NO: 1498793 - RNA, 15 nt, Pseudomonas aeruginosa PA01
gucgcccaggccgcu

SEQ ID NO: 1498794 - RNA, 16 nt, Pseudomonas aeruginosa PA01
gucgcccaggccgcug

SEQ ID NO: 1498795 - RNA, 19 nt, Pseudomonas aeruginosa PA01
gucgcccaggccgcuggcg

SEQ ID NO: 1498796 - RNA, 17 nt, Pseudomonas aeruginosa PA01
gucgcccuucaggucga

SEQ ID NO: 1498797 - RNA, 11 nt, Pseudomonas aeruginosa PA01
gucgcccuggu

SEQ ID NO: 1498798 - RNA, 14 nt, Pseudomonas aeruginosa PA01
gucgcccuggugca

SEQ ID NO: 1498799 - RNA, 13 nt, Pseudomonas aeruginosa PA01
gucgccacgcucu

SEQ ID NO: 1498800 - RNA, 16 nt, Pseudomonas aeruginosa PA01
gucgccauucggcgac

SEQ ID NO: 1498801 - RNA, 17 nt, Pseudomonas aeruginosa PA01
gucgccauucggcgacg

SEQ ID NO: 1498802 - RNA, 19 nt, Pseudomonas aeruginosa PA01
gucgccaugcggcaggccu

SEQ ID NO: 1498803 - RNA, 22 nt, Pseudomonas aeruginosa PA01
gucgccauggucguucagcggc

SEQ ID NO: 1498804 - RNA, 14 nt, Pseudomonas aeruginosa PA01
gucgccacgcccgc

SEQ ID NO: 1498805 - RNA, 21 nt, Pseudomonas aeruginosa PA01
gucgccacgcccgccguggcg

SEQ ID NO: 1498806 - RNA, 16 nt, Pseudomonas aeruginosa PA01
gucgcacuggucggcc

SEQ ID NO: 1498807 - RNA, 19 nt, Pseudomonas aeruginosa PA01
gucgcacuggucggccagu

SEQ ID NO: 1498808 - RNA, 20 nt, Pseudomonas aeruginosa PA01
gucgcaccgggaggcgccgc

SEQ ID NO: 1498809 - RNA, 23 nt, Pseudomonas aeruginosa PA01
gucgcaccgggaggcgccgcgcc

SEQ ID NO: 1498810 - RNA, 24 nt, Pseudomonas aeruginosa PA01
gucgcaccgggaggcgccgcgcca

SEQ ID NO: 1498811 - RNA, 13 nt, Pseudomonas aeruginosa PA01
gucgcaccuguuc

SEQ ID NO: 1498812 - RNA, 16 nt, Pseudomonas aeruginosa PA01
gucgcacgcagcgccg

SEQ ID NO: 1498813 - RNA, 17 nt, Pseudomonas aeruginosa PA01
gucgcagagacgcagcg

SEQ ID NO: 1498814 - RNA, 23 nt, Pseudomonas aeruginosa PA01
gucgcagagacgcagcgcuagcg

SEQ ID NO: 1498815 - RNA, 14 nt, Pseudomonas aeruginosa PA01
gucgcaccgccagc

SEQ ID NO: 1498816 - RNA, 21 nt, Pseudomonas aeruginosa PA01
gucgcagcaggccgcuggcga

SEQ ID NO: 1498817 - RNA, 14 nt, Pseudomonas aeruginosa PA01
gucgcgcagggcag

SEQ ID NO: 1498818 - RNA, 18 nt, Pseudomonas aeruginosa PA01
gucgcgcagggcagcgcg

SEQ ID NO: 1498819 - RNA, 20 nt, Pseudomonas aeruginosa PA01
gucgcgcagggcagcgcgau

SEQ ID NO: 1498820 - RNA, 13 nt, Pseudomonas aeruginosa PA01
gucgccuggcccu

SEQ ID NO: 1498821 - RNA, 12 nt, Pseudomonas aeruginosa PA01
gucgcgccagca

SEQ ID NO: 1498822 - RNA, 13 nt, Pseudomonas aeruginosa PA01
gucgccuuccacc

SEQ ID NO: 1498823 - RNA, 16 nt, Pseudomonas aeruginosa PA01
gucgccuuccaccacc

SEQ ID NO: 1498824 - RNA, 19 nt, Pseudomonas aeruginosa PA01
gucgccuuccaccaccagg

SEQ ID NO: 1498825 - RNA, 20 nt, Pseudomonas aeruginosa PA01
gucgccuuccaccaccaggg

SEQ ID NO: 1498826 - RNA, 19 nt, Pseudomonas aeruginosa PA01
gucgccucgaacauggcca

SEQ ID NO: 1498827 - RNA, 21 nt, Pseudomonas aeruginosa PA01
gucgcgcgcgcuucuugucgu

SEQ ID NO: 1498828 - RNA, 14 nt, Pseudomonas aeruginosa PA01
gucgcgcgcggcau

SEQ ID NO: 1498829 - RNA, 18 nt, Pseudomonas aeruginosa PA01
gucgcgcgcggccagcuc

SEQ ID NO: 1498830 - RNA, 19 nt, Pseudomonas aeruginosa PA01
gucgcgcgcggccagcucg

SEQ ID NO: 1498831 - RNA, 16 nt, Pseudomonas aeruginosa PA01
gucgcgcgccggagcc

SEQ ID NO: 1498832 - RNA, 23 nt, Pseudomonas aeruginosa PA01
gucgcgccgcccggcucgccgcc

SEQ ID NO: 1498833 - RNA, 13 nt, Pseudomonas aeruginosa PA01
gucgcgccgacga

SEQ ID NO: 1498834 - RNA, 14 nt, Pseudomonas aeruginosa PA01
gucgcgccggccau

SEQ ID NO: 1498835 - RNA, 21 nt, Pseudomonas aeruginosa PA01
gucgcgccggccauucgcugu

SEQ ID NO: 1498836 - RNA, 17 nt, Pseudomonas aeruginosa PA01
gucgcgccguccaucag

SEQ ID NO: 1498837 - RNA, 19 nt, Pseudomonas aeruginosa PA01
gucgcgcccagugcccggc

SEQ ID NO: 1498838 - RNA, 16 nt, Pseudomonas aeruginosa PA01
gucgcgcccccaucug

SEQ ID NO: 1498839 - RNA, 14 nt, Pseudomonas aeruginosa PA01
gucgcgccccgcca

SEQ ID NO: 1498840 - RNA, 16 nt, Pseudomonas aeruginosa PA01
gucgcgccccgccagg

SEQ ID NO: 1498841 - RNA, 14 nt, Pseudomonas aeruginosa PA01
gucgcgcccgcugu

SEQ ID NO: 1498842 - RNA, 20 nt, Pseudomonas aeruginosa PA01
gucgcgcuggaccuggccgg

SEQ ID NO: 1498843 - RNA, 22 nt, Pseudomonas aeruginosa PA01
gucgcgcuggaccuggccggcg

SEQ ID NO: 1498844 - RNA, 21 nt, Pseudomonas aeruginosa PA01
gucgcgcuugccuuccugggc

SEQ ID NO: 1498845 - RNA, 16 nt, Pseudomonas aeruginosa PA01
gucgcgcucuggccca

SEQ ID NO: 1498846 - RNA, 15 nt, Pseudomonas aeruginosa PA01
gucgcgcggccagcg

SEQ ID NO: 1498847 - RNA, 16 nt, Pseudomonas aeruginosa PA01
gucgcgcggccagcgu

SEQ ID NO: 1498848 - RNA, 18 nt, Pseudomonas aeruginosa PA01
gucgcgcggcgccugcug

SEQ ID NO: 1498849 - RNA, 14 nt, Pseudomonas aeruginosa PA01
gucgcgcguccagc

SEQ ID NO: 1498850 - RNA, 16 nt, Pseudomonas aeruginosa PA01
gucgcgcguccagccg

SEQ ID NO: 1498851 - RNA, 20 nt, Pseudomonas aeruginosa PA01
gucgccgaacagccgcccca

SEQ ID NO: 1498852 - RNA, 19 nt, Pseudomonas aeruginosa PA01
gucgccgaacggcagcugg

SEQ ID NO: 1498853 - RNA, 14 nt, Pseudomonas aeruginosa PA01
gucgccgaacuccg

SEQ ID NO: 1498854 - RNA, 14 nt, Pseudomonas aeruginosa PA01
gucgccgaccaggc

SEQ ID NO: 1498855 - RNA, 15 nt, Pseudomonas aeruginosa PA01
gucgccgaccaggcg

SEQ ID NO: 1498856 - RNA, 17 nt, Pseudomonas aeruginosa PA01
gucgccgaccaggcggc

SEQ ID NO: 1498857 - RNA, 12 nt, Pseudomonas aeruginosa PA01
gucgccgacacg

SEQ ID NO: 1498858 - RNA, 15 nt, Pseudomonas aeruginosa PA01
gucgccggccgcugu

SEQ ID NO: 1498859 - RNA, 22 nt, Pseudomonas aeruginosa PA01
gucgccgacuucggcaagcacc

SEQ ID NO: 1498860 - RNA, 18 nt, Pseudomonas aeruginosa PA01
gucgccggcaucguggcc

SEQ ID NO: 1498861 - RNA, 21 nt, Pseudomonas aeruginosa PA01
gucgccggcaucguggccaug

SEQ ID NO: 1498862 - RNA, 15 nt, Pseudomonas aeruginosa PA01
gucgccggcauggau

SEQ ID NO: 1498863 - RNA, 22 nt, Pseudomonas aeruginosa PA01
gucgccgugguggccguggcgc

SEQ ID NO: 1498864 - RNA, 20 nt, Pseudomonas aeruginosa PA01
gucgccguagaacagcacgu

SEQ ID NO: 1498865 - RNA, 16 nt, Pseudomonas aeruginosa PA01
gucgccguccuugucg

SEQ ID NO: 1498866 - RNA, 18 nt, Pseudomonas aeruginosa PA01
gucgccggugaggaugcg

SEQ ID NO: 1498867 - RNA, 14 nt, Pseudomonas aeruginosa PA01
gucgccggucaggc

SEQ ID NO: 1498868 - RNA, 22 nt, Pseudomonas aeruginosa PA01
gucgccgguaaugaaaagcccc

SEQ ID NO: 1498869 - RNA, 23 nt, Pseudomonas aeruginosa PA01
gucgccgggucgacuucgcacca

SEQ ID NO: 1498870 - RNA, 21 nt, Pseudomonas aeruginosa PA01
gucgccgggaaacagggcgac

SEQ ID NO: 1498871 - RNA, 23 nt, Pseudomonas aeruginosa PA01
gucgccgggaaacagggcgacgc

SEQ ID NO: 1498872 - RNA, 13 nt, Pseudomonas aeruginosa PA01
gucgccggcgcgc

SEQ ID NO: 1498873 - RNA, 12 nt, Pseudomonas aeruginosa PA01
gucgccggggcc

SEQ ID NO: 1498874 - RNA, 18 nt, Pseudomonas aeruginosa PA01
gucugccgcucguuggcg

SEQ ID NO: 1498875 - RNA, 23 nt, Pseudomonas aeruginosa PA01
gucugccgcucguuggcggccag

SEQ ID NO: 1498876 - RNA, 15 nt, Pseudomonas aeruginosa PA01
gucugccgcuggcgg

SEQ ID NO: 1498877 - RNA, 16 nt, Pseudomonas aeruginosa PA01
gucugccgcuggcggc

SEQ ID NO: 1498878 - RNA, 15 nt, Pseudomonas aeruginosa PA01
gucucggugcucagg

SEQ ID NO: 1498879 - RNA, 20 nt, Pseudomonas aeruginosa PA01
gucucucucugcauggcacc

SEQ ID NO: 1498880 - RNA, 20 nt, Pseudomonas aeruginosa PA01
gucucggagugaggccgagc

SEQ ID NO: 1498881 - RNA, 13 nt, Pseudomonas aeruginosa PA01
gucucgcugccga

SEQ ID NO: 1498882 - RNA, 13 nt, Pseudomonas aeruginosa PA01
gucucgccgccga

SEQ ID NO: 1498883 - RNA, 13 nt, Pseudomonas aeruginosa PA01
gucucgccgccgg

SEQ ID NO: 1498884 - RNA, 13 nt, Pseudomonas aeruginosa PA01
gucucgcgggcgu

SEQ ID NO: 1498885 - RNA, 17 nt, Pseudomonas aeruginosa PA01
gucucggcugccgccag

SEQ ID NO: 1498886 - RNA, 18 nt, Pseudomonas aeruginosa PA01
gucucggcugccgccagc

SEQ ID NO: 1498887 - RNA, 20 nt, Pseudomonas aeruginosa PA01
gucucggcugccgccagcuc

SEQ ID NO: 1498888 - RNA, 23 nt, Pseudomonas aeruginosa PA01
gucucgauggcagccuuggccac

SEQ ID NO: 1498889 - RNA, 15 nt, Pseudomonas aeruginosa PA01
gucuccugccgccga

SEQ ID NO: 1498890 - RNA, 17 nt, Pseudomonas aeruginosa PA01
gucucgccaccccgcuc

SEQ ID NO: 1498891 - RNA, 17 nt, Pseudomonas aeruginosa PA01
gucucgcgcagcggcgg

SEQ ID NO: 1498892 - RNA, 16 nt, Pseudomonas aeruginosa PA01
gucguuuuguccggcg

SEQ ID NO: 1498893 - RNA, 19 nt, Pseudomonas aeruginosa PA01
gucguuuuguccggcggcu

SEQ ID NO: 1498894 - RNA, 21 nt, Pseudomonas aeruginosa PA01
gucguuuuguccggcggcugc

SEQ ID NO: 1498895 - RNA, 17 nt, Pseudomonas aeruginosa PA01
gucguuguacuggccga

SEQ ID NO: 1498896 - RNA, 15 nt, Pseudomonas aeruginosa PA01
gucguuucucggcga

SEQ ID NO: 1498897 - RNA, 19 nt, Pseudomonas aeruginosa PA01
gucguuucucggcgauggc

SEQ ID NO: 1498898 - RNA, 17 nt, Pseudomonas aeruginosa PA01
gucguuguugccgcgca

SEQ ID NO: 1498899 - RNA, 17 nt, Pseudomonas aeruginosa PA01
gucguuguugcgggcga

SEQ ID NO: 1498900 - RNA, 17 nt, Pseudomonas aeruginosa PA01
gucguuucauucgucgc

SEQ ID NO: 1498901 - RNA, 16 nt, Pseudomonas aeruginosa PA01
gucucaccgcccugcg

SEQ ID NO: 1498902 - RNA, 16 nt, Pseudomonas aeruginosa PA01
gucucagcccucggcc

SEQ ID NO: 1498903 - RNA, 13 nt, Pseudomonas aeruginosa PA01
gucucagccggcg

SEQ ID NO: 1498904 - RNA, 14 nt, Pseudomonas aeruginosa PA01
gucucagccggcgc

SEQ ID NO: 1498905 - RNA, 14 nt, Pseudomonas aeruginosa PA01
gucucaggcgccag

SEQ ID NO: 1498906 - RNA, 23 nt, Pseudomonas aeruginosa PA01
gucucaggggccgacgcgcugcc

SEQ ID NO: 1498907 - RNA, 14 nt, Pseudomonas aeruginosa PA01
gucuaucugcgccg

SEQ ID NO: 1498908 - RNA, 16 nt, Pseudomonas aeruginosa PA01
gucuaucugcguaacg

SEQ ID NO: 1498909 - RNA, 19 nt, Pseudomonas aeruginosa PA01
gucucgacgcgcaugucga

SEQ ID NO: 1498910 - RNA, 16 nt, Pseudomonas aeruginosa PA01
gucucgaacgccaggc

SEQ ID NO: 1498911 - RNA, 16 nt, Pseudomonas aeruginosa PA01
gucucgaucagcgccg

SEQ ID NO: 1498912 - RNA, 17 nt, Pseudomonas aeruginosa PA01
gucucgaucagcgccgg

SEQ ID NO: 1498913 - RNA, 19 nt, Pseudomonas aeruginosa PA01
gucucgaucggcccgggcg

SEQ ID NO: 1498914 - RNA, 23 nt, Pseudomonas aeruginosa PA01
gucucgaucggcccgggcgccac

SEQ ID NO: 1498915 - RNA, 18 nt, Pseudomonas aeruginosa PA01
gucuccuccuccaucucg

SEQ ID NO: 1498916 - RNA, 17 nt, Pseudomonas aeruginosa PA01
gucuccaggcgcgccgu

SEQ ID NO: 1498917 - RNA, 20 nt, Pseudomonas aeruginosa PA01
gucuccaggcgcgccgugcg

SEQ ID NO: 1498918 - RNA, 18 nt, Pseudomonas aeruginosa PA01
gucugguaguaggcgcuc

SEQ ID NO: 1498919 - RNA, 22 nt, Pseudomonas aeruginosa PA01
gucugguaguaggcgcucugga

SEQ ID NO: 1498920 - RNA, 18 nt, Pseudomonas aeruginosa PA01
gucugugccgaggccgcc

SEQ ID NO: 1498921 - RNA, 21 nt, Pseudomonas aeruginosa PA01
gucuguucggccagggagucg

SEQ ID NO: 1498922 - RNA, 16 nt, Pseudomonas aeruginosa PA01
gucuggcgccuggccu

SEQ ID NO: 1498923 - RNA, 17 nt, Pseudomonas aeruginosa PA01
gucuggcgccuggccug

SEQ ID NO: 1498924 - RNA, 19 nt, Pseudomonas aeruginosa PA01
gucuggggugaggccgagc

SEQ ID NO: 1498925 - RNA, 21 nt, Pseudomonas aeruginosa PA01
gucugggaguuccgcgcaacc

SEQ ID NO: 1498926 - RNA, 19 nt, Pseudomonas aeruginosa PA01
gucugcuugcgcuggccgg

SEQ ID NO: 1498927 - RNA, 21 nt, Pseudomonas aeruginosa PA01
gucugcgguauaggccuugga

SEQ ID NO: 1498928 - RNA, 20 nt, Pseudomonas aeruginosa PA01
gucugcgcggcguucgcccu

SEQ ID NO: 1498929 - RNA, 24 nt, Pseudomonas aeruginosa PA01
gucugcgcggcguucgcccugcgg

SEQ ID NO: 1498930 - RNA, 14 nt, Pseudomonas aeruginosa PA01
gucugcgccucgcu

SEQ ID NO: 1498931 - RNA, 13 nt, Pseudomonas aeruginosa PA01
gucugcucgcgcu

SEQ ID NO: 1498932 - RNA, 23 nt, Pseudomonas aeruginosa PA01
gucugcucgcgcuucucgacgua

SEQ ID NO: 1498933 - RNA, 13 nt, Pseudomonas aeruginosa PA01
gucugcucggcga

SEQ ID NO: 1498934 - RNA, 14 nt, Pseudomonas aeruginosa PA01
gucugcugcgcgca

SEQ ID NO: 1498935 - RNA, 21 nt, Pseudomonas aeruginosa PA01
gucugcugggcggcgaggccg

SEQ ID NO: 1498936 - RNA, 22 nt, Pseudomonas aeruginosa PA01
gucugcucauucggccagcgcg

SEQ ID NO: 1498937 - RNA, 15 nt, Pseudomonas aeruginosa PA01
gucuuggccagccgc

SEQ ID NO: 1498938 - RNA, 17 nt, Pseudomonas aeruginosa PA01
gucuuggccagccgcgc

SEQ ID NO: 1498939 - RNA, 14 nt, Pseudomonas aeruginosa PA01
gucuuggcgcgcga

SEQ ID NO: 1498940 - RNA, 16 nt, Pseudomonas aeruginosa PA01
gucuugccgauggcgc

SEQ ID NO: 1498941 - RNA, 14 nt, Pseudomonas aeruginosa PA01
gucuugccgcugcg

SEQ ID NO: 1498942 - RNA, 23 nt, Pseudomonas aeruginosa PA01
gucuucucaaagggcagcggcga

SEQ ID NO: 1498943 - RNA, 18 nt, Pseudomonas aeruginosa PA01
gucuuucaggugggccac

SEQ ID NO: 1498944 - RNA, 17 nt, Pseudomonas aeruginosa PA01
gucuuguccucaucggg

SEQ ID NO: 1498945 - RNA, 13 nt, Pseudomonas aeruginosa PA01
gucuugucgcggg

SEQ ID NO: 1498946 - RNA, 20 nt, Pseudomonas aeruginosa PA01
gugaaaaucauccacaggcg

SEQ ID NO: 1498947 - RNA, 17 nt, Pseudomonas aeruginosa PA01
gucuucgguggcggcga

SEQ ID NO: 1498948 - RNA, 20 nt, Pseudomonas aeruginosa PA01
gucuucgaaggucugcccgu

SEQ ID NO: 1498949 - RNA, 13 nt, Pseudomonas aeruginosa PA01
gucuucgccggcc

SEQ ID NO: 1498950 - RNA, 14 nt, Pseudomonas aeruginosa PA01
gucuucgccggccu

SEQ ID NO: 1498951 - RNA, 16 nt, Pseudomonas aeruginosa PA01
gucuucgccggccugc

SEQ ID NO: 1498952 - RNA, 20 nt, Pseudomonas aeruginosa PA01
gucuucgcguuggcggugcc

SEQ ID NO: 1498953 - RNA, 15 nt, Pseudomonas aeruginosa PA01
gucuucgauggcggc

SEQ ID NO: 1498954 - RNA, 18 nt, Pseudomonas aeruginosa PA01
gucuucgauggcggccgc

SEQ ID NO: 1498955 - RNA, 20 nt, Pseudomonas aeruginosa PA01
gucuucgauggcggccgcca

SEQ ID NO: 1498956 - RNA, 17 nt, Pseudomonas aeruginosa PA01
gucuucccguaaggcca

SEQ ID NO: 1498957 - RNA, 22 nt, Pseudomonas aeruginosa PA01
gucuucagcacauagcugccga

SEQ ID NO: 1498958 - RNA, 14 nt, Pseudomonas aeruginosa PA01
gucuucaggcgcuc

SEQ ID NO: 1498959 - RNA, 19 nt, Pseudomonas aeruginosa PA01
gucuucaggcgcuccugga

SEQ ID NO: 1498960 - RNA, 16 nt, Pseudomonas aeruginosa PA01
gucuucaggcgugggc

SEQ ID NO: 1498961 - RNA, 22 nt, Pseudomonas aeruginosa PA01
gucuucaggcgugggccagccc

SEQ ID NO: 1498962 - RNA, 12 nt, Pseudomonas aeruginosa PA01
gugaagccgccg

SEQ ID NO: 1498963 - RNA, 16 nt, Pseudomonas aeruginosa PA01
gugaagccgccgccca

SEQ ID NO: 1498964 - RNA, 22 nt, Pseudomonas aeruginosa PA01
gugaagccgccgcccagcagca

SEQ ID NO: 1498965 - RNA, 17 nt, Pseudomonas aeruginosa PA01
gugaagcuggagcagca

SEQ ID NO: 1498966 - RNA, 20 nt, Pseudomonas aeruginosa PA01
gugaagcuggagcagcagcg

SEQ ID NO: 1498967 - RNA, 14 nt, Pseudomonas aeruginosa PA01
gugaaguagccgcc

SEQ ID NO: 1498968 - RNA, 16 nt, Pseudomonas aeruginosa PA01
gugaaguagccgccgg

SEQ ID NO: 1498969 - RNA, 13 nt, Pseudomonas aeruginosa PA01
gugaacuggccgu

SEQ ID NO: 1498970 - RNA, 14 nt, Pseudomonas aeruginosa PA01
gugaagcccaggcg

SEQ ID NO: 1498971 - RNA, 16 nt, Pseudomonas aeruginosa PA01
gugaagcccaggcgcu

SEQ ID NO: 1498972 - RNA, 18 nt, Pseudomonas aeruginosa PA01
gugaagcccaggcgcucg

SEQ ID NO: 1498973 - RNA, 22 nt, Pseudomonas aeruginosa PA01
gugaagcccaggcgcucggcgg

SEQ ID NO: 1498974 - RNA, 16 nt, Pseudomonas aeruginosa PA01
gugaagccccuggcgc

SEQ ID NO: 1498975 - RNA, 16 nt, Pseudomonas aeruginosa PA01
gugaacgagcccaggc

SEQ ID NO: 1498976 - RNA, 22 nt, Pseudomonas aeruginosa PA01
gugaacgagcccaggcagaucg

SEQ ID NO: 1498977 - RNA, 13 nt, Pseudomonas aeruginosa PA01
gugaacgccaggc

SEQ ID NO: 1498978 - RNA, 14 nt, Pseudomonas aeruginosa PA01
gugaacgccaggca

SEQ ID NO: 1498979 - RNA, 13 nt, Pseudomonas aeruginosa PA01
gugaacgcggcga

SEQ ID NO: 1498980 - RNA, 15 nt, Pseudomonas aeruginosa PA01
gugaaacggaucacg

SEQ ID NO: 1498981 - RNA, 14 nt, Pseudomonas aeruginosa PA01
gugaaccaggcgcc

SEQ ID NO: 1498982 - RNA, 16 nt, Pseudomonas aeruginosa PA01
gugaaccaggcgccga

SEQ ID NO: 1498983 - RNA, 14 nt, Pseudomonas aeruginosa PA01
gugacauggaugac

SEQ ID NO: 1498984 - RNA, 20 nt, Pseudomonas aeruginosa PA01
gugacacccugccgcgccgg

SEQ ID NO: 1498985 - RNA, 21 nt, Pseudomonas aeruginosa PA01
gugacccgcgcuuccagggua

SEQ ID NO: 1498986 - RNA, 19 nt, Pseudomonas aeruginosa PA01
gugacccgcacggcgacgc

SEQ ID NO: 1498987 - RNA, 13 nt, Pseudomonas aeruginosa PA01
gugaccagcggca

SEQ ID NO: 1498988 - RNA, 23 nt, Pseudomonas aeruginosa PA01
gugaccgagauucugcaggcgcu

SEQ ID NO: 1498989 - RNA, 16 nt, Pseudomonas aeruginosa PA01
gugagcgacccgcuga

SEQ ID NO: 1498990 - RNA, 15 nt, Pseudomonas aeruginosa PA01
gugagccccaugccg

SEQ ID NO: 1498991 - RNA, 18 nt, Pseudomonas aeruginosa PA01
gugagccccggcgucggc

SEQ ID NO: 1498992 - RNA, 23 nt, Pseudomonas aeruginosa PA01
gugagccccggcgucggcgcggg

SEQ ID NO: 1498993 - RNA, 23 nt, Pseudomonas aeruginosa PA01
gugagcauggcguugagguugcg

SEQ ID NO: 1498994 - RNA, 15 nt, Pseudomonas aeruginosa PA01
gugagcacgccgcga

SEQ ID NO: 1498995 - RNA, 22 nt, Pseudomonas aeruginosa PA01
gugaggccgagccgacauccug

SEQ ID NO: 1498996 - RNA, 13 nt, Pseudomonas aeruginosa PA01
gugaggcguucga

SEQ ID NO: 1498997 - RNA, 16 nt, Pseudomonas aeruginosa PA01
gugaggcguucgaggg

SEQ ID NO: 1498998 - RNA, 23 nt, Pseudomonas aeruginosa PA01
gugacguugcgccgcagcggcgu

SEQ ID NO: 1498999 - RNA, 15 nt, Pseudomonas aeruginosa PA01
gugacggugaucgcc

SEQ ID NO: 1499000 - RNA, 16 nt, Pseudomonas aeruginosa PA01
gugacggugaucgccg

SEQ ID NO: 1499001 - RNA, 14 nt, Pseudomonas aeruginosa PA01
gugacggugcagcc

SEQ ID NO: 1499002 - RNA, 12 nt, Pseudomonas aeruginosa PA01
gugacggaucac

SEQ ID NO: 1499003 - RNA, 12 nt, Pseudomonas aeruginosa PA01
gugacggccggg

SEQ ID NO: 1499004 - RNA, 19 nt, Pseudomonas aeruginosa PA01
gugacgcugcucaccaggu

SEQ ID NO: 1499005 - RNA, 14 nt, Pseudomonas aeruginosa PA01
gugaccuucaacgg

SEQ ID NO: 1499006 - RNA, 13 nt, Pseudomonas aeruginosa PA01
gugaccuggccgc

SEQ ID NO: 1499007 - RNA, 17 nt, Pseudomonas aeruginosa PA01
gugacgaacgaagcgcc

SEQ ID NO: 1499008 - RNA, 17 nt, Pseudomonas aeruginosa PA01
gugacgaaaccggcguc

SEQ ID NO: 1499009 - RNA, 19 nt, Pseudomonas aeruginosa PA01
gugaccguuucgccgccgg

SEQ ID NO: 1499010 - RNA, 23 nt, Pseudomonas aeruginosa PA01
gugaccguccagcgcgccgcgca

SEQ ID NO: 1499011 - RNA, 16 nt, Pseudomonas aeruginosa PA01
gugaccggcuugguca

SEQ ID NO: 1499012 - RNA, 20 nt, Pseudomonas aeruginosa PA01
gugaccggcuuggucacgcc

SEQ ID NO: 1499013 - RNA, 22 nt, Pseudomonas aeruginosa PA01
gugaccggcuuggucacgccgu

SEQ ID NO: 1499014 - RNA, 17 nt, Pseudomonas aeruginosa PA01
gucgggcuucagcgccg

SEQ ID NO: 1499015 - RNA, 18 nt, Pseudomonas aeruginosa PA01
gucgggcuucagcgccgg

SEQ ID NO: 1499016 - RNA, 14 nt, Pseudomonas aeruginosa PA01
gucgggcuucggug

SEQ ID NO: 1499017 - RNA, 16 nt, Pseudomonas aeruginosa PA01
gucgggcuucggugua

SEQ ID NO: 1499018 - RNA, 23 nt, Pseudomonas aeruginosa PA01
gucgggcuucgguguaucggcgg

SEQ ID NO: 1499019 - RNA, 14 nt, Pseudomonas aeruginosa PA01
gucggggcaggcgc

SEQ ID NO: 1499020 - RNA, 19 nt, Pseudomonas aeruginosa PA01
gucggggcgcaaggccagc

SEQ ID NO: 1499021 - RNA, 21 nt, Pseudomonas aeruginosa PA01
gucggggcgcaaggccagcgg

SEQ ID NO: 1499022 - RNA, 22 nt, Pseudomonas aeruginosa PA01
gucgggguucuugucgaccagc

SEQ ID NO: 1499023 - RNA, 12 nt, Pseudomonas aeruginosa PA01
gucggggugccg

SEQ ID NO: 1499024 - RNA, 14 nt, Pseudomonas aeruginosa PA01
gucggggugccgcc

SEQ ID NO: 1499025 - RNA, 15 nt, Pseudomonas aeruginosa PA01
gucggggugccgcca

SEQ ID NO: 1499026 - RNA, 23 nt, Pseudomonas aeruginosa PA01
gucggggugccgccagucggccu

SEQ ID NO: 1499027 - RNA, 21 nt, Pseudomonas aeruginosa PA01
gucgggcgaaacggcaggcca

SEQ ID NO: 1499028 - RNA, 23 nt, Pseudomonas aeruginosa PA01
gucgggcgaaacggcaggccagc

SEQ ID NO: 1499029 - RNA, 20 nt, Pseudomonas aeruginosa PA01
gucgggcgggaucaggucgc

SEQ ID NO: 1499030 - RNA, 21 nt, Pseudomonas aeruginosa PA01
gucgggcucagaagucccagc

SEQ ID NO: 1499031 - RNA, 14 nt, Pseudomonas aeruginosa PA01
gucgggcucgacga

SEQ ID NO: 1499032 - RNA, 16 nt, Pseudomonas aeruginosa PA01
gucgggcgccgcgccu

SEQ ID NO: 1499033 - RNA, 14 nt, Pseudomonas aeruginosa PA01
gucgggcauggcga

SEQ ID NO: 1499034 - RNA, 13 nt, Pseudomonas aeruginosa PA01
gucgggccgcgcu

SEQ ID NO: 1499035 - RNA, 15 nt, Pseudomonas aeruginosa PA01
gucgggccgcgcucg

SEQ ID NO: 1499036 - RNA, 23 nt, Pseudomonas aeruginosa PA01
gucggucauguccggggcgaucu

SEQ ID NO: 1499037 - RNA, 14 nt, Pseudomonas aeruginosa PA01
gucggucaucacgc

SEQ ID NO: 1499038 - RNA, 20 nt, Pseudomonas aeruginosa PA01
gucggucgaacugaccacca

SEQ ID NO: 1499039 - RNA, 22 nt, Pseudomonas aeruginosa PA01
gucggucgaacugaccaccagg

SEQ ID NO: 1499040 - RNA, 12 nt, Pseudomonas aeruginosa PA01
gucgguccgccg

SEQ ID NO: 1499041 - RNA, 14 nt, Pseudomonas aeruginosa PA01
gucgguccgccgau

SEQ ID NO: 1499042 - RNA, 13 nt, Pseudomonas aeruginosa PA01
gucggucggcggc

SEQ ID NO: 1499043 - RNA, 14 nt, Pseudomonas aeruginosa PA01
gucggucggcggcg

SEQ ID NO: 1499044 - RNA, 17 nt, Pseudomonas aeruginosa PA01
gucggucggcggcgguu

SEQ ID NO: 1499045 - RNA, 15 nt, Pseudomonas aeruginosa PA01
gucggucucgccacc

SEQ ID NO: 1499046 - RNA, 14 nt, Pseudomonas aeruginosa PA01
gucggucgcgacgg

SEQ ID NO: 1499047 - RNA, 14 nt, Pseudomonas aeruginosa PA01
gucggucuggcggc

SEQ ID NO: 1499048 - RNA, 16 nt, Pseudomonas aeruginosa PA01
gucggucuggcggccc

SEQ ID NO: 1499049 - RNA, 17 nt, Pseudomonas aeruginosa PA01
gucggugaagcgcggcg

SEQ ID NO: 1499050 - RNA, 24 nt, Pseudomonas aeruginosa PA01
gucggugaucgagacgccguagcg

SEQ ID NO: 1499051 - RNA, 14 nt, Pseudomonas aeruginosa PA01
gucggugccgcccg

SEQ ID NO: 1499052 - RNA, 18 nt, Pseudomonas aeruginosa PA01
gucggugccgcccggcgc

SEQ ID NO: 1499053 - RNA, 21 nt, Pseudomonas aeruginosa PA01
gucggugccgcccggcgccac

SEQ ID NO: 1499054 - RNA, 13 nt, Pseudomonas aeruginosa PA01
gucgggucggcga

SEQ ID NO: 1499055 - RNA, 20 nt, Pseudomonas aeruginosa PA01
gucggucaggacagcgugcg

SEQ ID NO: 1499056 - RNA, 23 nt, Pseudomonas aeruginosa PA01
gucggcgaaggcgaaccacacca

SEQ ID NO: 1499057 - RNA, 20 nt, Pseudomonas aeruginosa PA01
gucggcgaagccugcggcga

SEQ ID NO: 1499058 - RNA, 21 nt, Pseudomonas aeruginosa PA01
gucggcgaagccugcggcgag

SEQ ID NO: 1499059 - RNA, 18 nt, Pseudomonas aeruginosa PA01
gucggcgaacuggccacc

SEQ ID NO: 1499060 - RNA, 18 nt, Pseudomonas aeruginosa PA01
gucggcgaaguccaccag

SEQ ID NO: 1499061 - RNA, 16 nt, Pseudomonas aeruginosa PA01
gucggcgacgaugccg

SEQ ID NO: 1499062 - RNA, 18 nt, Pseudomonas aeruginosa PA01
gucggcgacgaugccgcc

SEQ ID NO: 1499063 - RNA, 21 nt, Pseudomonas aeruginosa PA01
gucggcgacgaugccgccgcc

SEQ ID NO: 1499064 - RNA, 12 nt, Pseudomonas aeruginosa PA01
gucggcgacgcu

SEQ ID NO: 1499065 - RNA, 14 nt, Pseudomonas aeruginosa PA01
gucggcggccucgg

SEQ ID NO: 1499066 - RNA, 17 nt, Pseudomonas aeruginosa PA01
gucggcggccucggccu

SEQ ID NO: 1499067 - RNA, 17 nt, Pseudomonas aeruginosa PA01
gucgcggacccgcgccg

SEQ ID NO: 1499068 - RNA, 22 nt, Pseudomonas aeruginosa PA01
gucgcggacccgcgccggcagc

SEQ ID NO: 1499069 - RNA, 16 nt, Pseudomonas aeruginosa PA01
gucgcggcugcgcgcc

SEQ ID NO: 1499070 - RNA, 17 nt, Pseudomonas aeruginosa PA01
gucgcggcugcgcgccg

SEQ ID NO: 1499071 - RNA, 20 nt, Pseudomonas aeruginosa PA01
gucgcggcugcgcgccgggu

SEQ ID NO: 1499072 - RNA, 14 nt, Pseudomonas aeruginosa PA01
gucgcggcgccugg

SEQ ID NO: 1499073 - RNA, 16 nt, Pseudomonas aeruginosa PA01
gucgcggcgccuggcg

SEQ ID NO: 1499074 - RNA, 14 nt, Pseudomonas aeruginosa PA01
gucgcggcgcgaga

SEQ ID NO: 1499075 - RNA, 14 nt, Pseudomonas aeruginosa PA01
gucggccuugguca

SEQ ID NO: 1499076 - RNA, 20 nt, Pseudomonas aeruginosa PA01
gucgcgggcaugcugcucgg

SEQ ID NO: 1499077 - RNA, 23 nt, Pseudomonas aeruginosa PA01
gucgcgggcaugcugcucggcau

SEQ ID NO: 1499078 - RNA, 17 nt, Pseudomonas aeruginosa PA01
gucggcgaacccggcgc

SEQ ID NO: 1499079 - RNA, 18 nt, Pseudomonas aeruginosa PA01
gucggcgaaauccucgcg

SEQ ID NO: 1499080 - RNA, 19 nt, Pseudomonas aeruginosa PA01
gucggcgaaauccucgcgc

SEQ ID NO: 1499081 - RNA, 20 nt, Pseudomonas aeruginosa PA01
gucggcgaaauccucgcgca

SEQ ID NO: 1499082 - RNA, 20 nt, Pseudomonas aeruginosa PA01
gucggcgaaaugcaggccgg

SEQ ID NO: 1499083 - RNA, 21 nt, Pseudomonas aeruginosa PA01
gucgcgcgaaagggucaggcc

SEQ ID NO: 1499084 - RNA, 15 nt, Pseudomonas aeruginosa PA01
gucgggacgcaugcg

SEQ ID NO: 1499085 - RNA, 19 nt, Pseudomonas aeruginosa PA01
gucgggacgcaugcgcggc

SEQ ID NO: 1499086 - RNA, 21 nt, Pseudomonas aeruginosa PA01
gucggcuucgcccauggcacg

SEQ ID NO: 1499087 - RNA, 15 nt, Pseudomonas aeruginosa PA01
gucgggaaaggccgc

SEQ ID NO: 1499088 - RNA, 17 nt, Pseudomonas aeruginosa PA01
gucgggaaaggccgcca

SEQ ID NO: 1499089 - RNA, 17 nt, Pseudomonas aeruginosa PA01
gucggcuggcagggcgc

SEQ ID NO: 1499090 - RNA, 18 nt, Pseudomonas aeruginosa PA01
gucggcuuccgccgccag

SEQ ID NO: 1499091 - RNA, 19 nt, Pseudomonas aeruginosa PA01
gucggcuuccgccgccagg

SEQ ID NO: 1499092 - RNA, 21 nt, Pseudomonas aeruginosa PA01
gucggcugcgcugggcgccga

SEQ ID NO: 1499093 - RNA, 18 nt, Pseudomonas aeruginosa PA01
gucggcucgguuccagcu

SEQ ID NO: 1499094 - RNA, 14 nt, Pseudomonas aeruginosa PA01
gucggcgcgacggc

SEQ ID NO: 1499095 - RNA, 20 nt, Pseudomonas aeruginosa PA01
gucggcggggcgcaccgccu

SEQ ID NO: 1499096 - RNA, 20 nt, Pseudomonas aeruginosa PA01
gucggcgggcaccgccagcc

SEQ ID NO: 1499097 - RNA, 23 nt, Pseudomonas aeruginosa PA01
gucggcguuuuuuuauccucgcg

SEQ ID NO: 1499098 - RNA, 14 nt, Pseudomonas aeruginosa PA01
gucggcucagccga

SEQ ID NO: 1499099 - RNA, 16 nt, Pseudomonas aeruginosa PA01
gucggcucagccgacc

SEQ ID NO: 1499100 - RNA, 14 nt, Pseudomonas aeruginosa PA01
gucggcucgcgccg

SEQ ID NO: 1499101 - RNA, 17 nt, Pseudomonas aeruginosa PA01
gucggcucgcgccggcg

SEQ ID NO: 1499102 - RNA, 18 nt, Pseudomonas aeruginosa PA01
gucggcucgcgccggcgc

SEQ ID NO: 1499103 - RNA, 23 nt, Pseudomonas aeruginosa PA01
gucggcguugcugaucgcuccgc

SEQ ID NO: 1499104 - RNA, 19 nt, Pseudomonas aeruginosa PA01
gucggcggucucgaacgcc

SEQ ID NO: 1499105 - RNA, 13 nt, Pseudomonas aeruginosa PA01
gucguaggcgcgg

SEQ ID NO: 1499106 - RNA, 17 nt, Pseudomonas aeruginosa PA01
gucguaguggccgucga

SEQ ID NO: 1499107 - RNA, 14 nt, Pseudomonas aeruginosa PA01
gucguauaggcgcu

SEQ ID NO: 1499108 - RNA, 19 nt, Pseudomonas aeruginosa PA01
gucgucaccucggcgccau

SEQ ID NO: 1499109 - RNA, 18 nt, Pseudomonas aeruginosa PA01
gucguaggucugcccgac

SEQ ID NO: 1499110 - RNA, 22 nt, Pseudomonas aeruginosa PA01
gucgucagcaggucucaccgcc

SEQ ID NO: 1499111 - RNA, 14 nt, Pseudomonas aeruginosa PA01
gucguccagggcgc

SEQ ID NO: 1499112 - RNA, 20 nt, Pseudomonas aeruginosa PA01
gucguccaucgccgcggcga

SEQ ID NO: 1499113 - RNA, 12 nt, Pseudomonas aeruginosa PA01
gucguccagcag

SEQ ID NO: 1499114 - RNA, 19 nt, Pseudomonas aeruginosa PA01
gucguccagcagguucggc

SEQ ID NO: 1499115 - RNA, 13 nt, Pseudomonas aeruginosa PA01
gucguccagcgcc

SEQ ID NO: 1499116 - RNA, 20 nt, Pseudomonas aeruginosa PA01
gucguccagcgccgagacga

SEQ ID NO: 1499117 - RNA, 16 nt, Pseudomonas aeruginosa PA01
gucguccagcggcucg

SEQ ID NO: 1499118 - RNA, 20 nt, Pseudomonas aeruginosa PA01
gucguccagcggcucgcuga

SEQ ID NO: 1499119 - RNA, 23 nt, Pseudomonas aeruginosa PA01
gucguccuggguaugcgcgguca

SEQ ID NO: 1499120 - RNA, 22 nt, Pseudomonas aeruginosa PA01
gucguccucgaaagccgccgcc

SEQ ID NO: 1499121 - RNA, 16 nt, Pseudomonas aeruginosa PA01
gucguccugcgcggcg

SEQ ID NO: 1499122 - RNA, 17 nt, Pseudomonas aeruginosa PA01
gucguccugcgcggcga

SEQ ID NO: 1499123 - RNA, 16 nt, Pseudomonas aeruginosa PA01
gucguagagcgugcgg

SEQ ID NO: 1499124 - RNA, 23 nt, Pseudomonas aeruginosa PA01
gucguagagguugcgcccgucga

SEQ ID NO: 1499125 - RNA, 20 nt, Pseudomonas aeruginosa PA01
gucguagcagguccgcgccu

SEQ ID NO: 1499126 - RNA, 13 nt, Pseudomonas aeruginosa PA01
gucguagccaggc

SEQ ID NO: 1499127 - RNA, 14 nt, Pseudomonas aeruginosa PA01
gucguagccaggca

SEQ ID NO: 1499128 - RNA, 19 nt, Pseudomonas aeruginosa PA01
gucguacucggcggggcgc

SEQ ID NO: 1499129 - RNA, 14 nt, Pseudomonas aeruginosa PA01
gucguacuggcgga

SEQ ID NO: 1499130 - RNA, 17 nt, Pseudomonas aeruginosa PA01
gucguagcgcagcggca

SEQ ID NO: 1499131 - RNA, 22 nt, Pseudomonas aeruginosa PA01
gucguagcgcagcggcaggcca

SEQ ID NO: 1499132 - RNA, 14 nt, Pseudomonas aeruginosa PA01
gucguagcgcgcgg

SEQ ID NO: 1499133 - RNA, 19 nt, Pseudomonas aeruginosa PA01
gucguagcgcgcggcgagc

SEQ ID NO: 1499134 - RNA, 16 nt, Pseudomonas aeruginosa PA01
gucguacaccgcgcgg

SEQ ID NO: 1499135 - RNA, 23 nt, Pseudomonas aeruginosa PA01
gucguacaccgcgcggcacagcg

SEQ ID NO: 1499136 - RNA, 18 nt, Pseudomonas aeruginosa PA01
gucgguuagaauaccggc

SEQ ID NO: 1499137 - RNA, 20 nt, Pseudomonas aeruginosa PA01
gucgguuagaauaccggccu

SEQ ID NO: 1499138 - RNA, 17 nt, Pseudomonas aeruginosa PA01
gucgguucgcggcgcag

SEQ ID NO: 1499139 - RNA, 21 nt, Pseudomonas aeruginosa PA01
gucgugcuugcagucgcggaa

SEQ ID NO: 1499140 - RNA, 19 nt, Pseudomonas aeruginosa PA01
gucguggacauacaggcgc

SEQ ID NO: 1499141 - RNA, 17 nt, Pseudomonas aeruginosa PA01
gucguggacgccgguga

SEQ ID NO: 1499142 - RNA, 18 nt, Pseudomonas aeruginosa PA01
gucguggauaggcggcgg

SEQ ID NO: 1499143 - RNA, 22 nt, Pseudomonas aeruginosa PA01
gucguggccauagagccgcugg

SEQ ID NO: 1499144 - RNA, 22 nt, Pseudomonas aeruginosa PA01
gucgugguccagcucggucagc

SEQ ID NO: 1499145 - RNA, 14 nt, Pseudomonas aeruginosa PA01
gucgugcgccggcc

SEQ ID NO: 1499146 - RNA, 15 nt, Pseudomonas aeruginosa PA01
gucgugccuccagcc

SEQ ID NO: 1499147 - RNA, 21 nt, Pseudomonas aeruginosa PA01
gucgugcagguguucggcggc

SEQ ID NO: 1499148 - RNA, 17 nt, Pseudomonas aeruginosa PA01
gucgugcagcagcgccu

SEQ ID NO: 1499149 - RNA, 21 nt, Pseudomonas aeruginosa PA01
gucgugcagcccggucacgcc

SEQ ID NO: 1499150 - RNA, 16 nt, Pseudomonas aeruginosa PA01
gucgugaucuucgagu

SEQ ID NO: 1499151 - RNA, 14 nt, Pseudomonas aeruginosa PA01
gucguucuugcgcg

SEQ ID NO: 1499152 - RNA, 19 nt, Pseudomonas aeruginosa PA01
gucguugagggcacggcca

SEQ ID NO: 1499153 - RNA, 23 nt, Pseudomonas aeruginosa PA01
gucguugagggcacggccagucg

SEQ ID NO: 1499154 - RNA, 14 nt, Pseudomonas aeruginosa PA01
gucguugcgccggc

SEQ ID NO: 1499155 - RNA, 22 nt, Pseudomonas aeruginosa PA01
gucguugccgucgagcaccagc

SEQ ID NO: 1499156 - RNA, 16 nt, Pseudomonas aeruginosa PA01
gucguuggccggcugc

SEQ ID NO: 1499157 - RNA, 13 nt, Pseudomonas aeruginosa PA01
gucguugcgcgca

SEQ ID NO: 1499158 - RNA, 14 nt, Pseudomonas aeruginosa PA01
gucguugcgcgcca

SEQ ID NO: 1499159 - RNA, 16 nt, Pseudomonas aeruginosa PA01
gucguugcgcgccagc

SEQ ID NO: 1499160 - RNA, 17 nt, Pseudomonas aeruginosa PA01
gucguugcgcgccagcg

SEQ ID NO: 1499161 - RNA, 15 nt, Pseudomonas aeruginosa PA01
gucguucucgcgcau

SEQ ID NO: 1499162 - RNA, 23 nt, Pseudomonas aeruginosa PA01
gucguucggcuguuucaggccgg

SEQ ID NO: 1499163 - RNA, 13 nt, Pseudomonas aeruginosa PA01
gucguucggcccg

SEQ ID NO: 1499164 - RNA, 18 nt, Pseudomonas aeruginosa PA01
gucguucagcccaccccc

SEQ ID NO: 1499165 - RNA, 15 nt, Pseudomonas aeruginosa PA01
gucguucagcggcgu

SEQ ID NO: 1499166 - RNA, 13 nt, Pseudomonas aeruginosa PA01
gucguucccggcc

SEQ ID NO: 1499167 - RNA, 17 nt, Pseudomonas aeruginosa PA01
gucgucgucacgcaggc

SEQ ID NO: 1499168 - RNA, 17 nt, Pseudomonas aeruginosa PA01
gucgucggucggccagg

SEQ ID NO: 1499169 - RNA, 23 nt, Pseudomonas aeruginosa PA01
gucgucgggcagaguggcgcggc

SEQ ID NO: 1499170 - RNA, 14 nt, Pseudomonas aeruginosa PA01
gucgucuucggcca

SEQ ID NO: 1499171 - RNA, 16 nt, Pseudomonas aeruginosa PA01
gucgucuucggccagu

SEQ ID NO: 1499172 - RNA, 23 nt, Pseudomonas aeruginosa PA01
gucgucguccagcgggcccaugg

SEQ ID NO: 1499173 - RNA, 12 nt, Pseudomonas aeruginosa PA01
gucgucggcgcg

SEQ ID NO: 1499174 - RNA, 14 nt, Pseudomonas aeruginosa PA01
gucgucggcgcggc

SEQ ID NO: 1499175 - RNA, 16 nt, Pseudomonas aeruginosa PA01
gucgucggcgcggccg

SEQ ID NO: 1499176 - RNA, 17 nt, Pseudomonas aeruginosa PA01
gucgucggcgcggccgg

SEQ ID NO: 1499177 - RNA, 20 nt, Pseudomonas aeruginosa PA01
gucgucggcgcggccggcgc

SEQ ID NO: 1499178 - RNA, 20 nt, Pseudomonas aeruginosa PA01
gucgucggagauagccuccu

SEQ ID NO: 1499179 - RNA, 18 nt, Pseudomonas aeruginosa PA01
gucgucgcggcgccuggc

SEQ ID NO: 1499180 - RNA, 20 nt, Pseudomonas aeruginosa PA01
gucgucgcggcgccuggcgu

SEQ ID NO: 1499181 - RNA, 14 nt, Pseudomonas aeruginosa PA01
gucgucgcgcagcu

SEQ ID NO: 1499182 - RNA, 17 nt, Pseudomonas aeruginosa PA01
gucgucgcgcagcuccu

SEQ ID NO: 1499183 - RNA, 17 nt, Pseudomonas aeruginosa PA01
gucgucgcagccgaaua

SEQ ID NO: 1499184 - RNA, 15 nt, Pseudomonas aeruginosa PA01
cgccgcagcaagucg

SEQ ID NO: 1499185 - RNA, 17 nt, Pseudomonas aeruginosa PA01
cgccgcagagccagccg

SEQ ID NO: 1499186 - RNA, 19 nt, Pseudomonas aeruginosa PA01
cgccgcagagccagccgca

SEQ ID NO: 1499187 - RNA, 20 nt, Pseudomonas aeruginosa PA01
cgccgcagagccagccgcag

SEQ ID NO: 1499188 - RNA, 22 nt, Pseudomonas aeruginosa PA01
cgccgcagagccagccgcagcc

SEQ ID NO: 1499189 - RNA, 16 nt, Pseudomonas aeruginosa PA01
cgccgcagaccagcga

SEQ ID NO: 1499190 - RNA, 17 nt, Pseudomonas aeruginosa PA01
cgccgcagcgcaagucg

SEQ ID NO: 1499191 - RNA, 14 nt, Pseudomonas aeruginosa PA01
cgccgcagcgguuc

SEQ ID NO: 1499192 - RNA, 12 nt, Pseudomonas aeruginosa PA01
cgccgcagccgu

SEQ ID NO: 1499193 - RNA, 17 nt, Pseudomonas aeruginosa PA01
cgccgcagccguggcgc

SEQ ID NO: 1499194 - RNA, 15 nt, Pseudomonas aeruginosa PA01
cgccgcaucgcugac

SEQ ID NO: 1499195 - RNA, 17 nt, Pseudomonas aeruginosa PA01
cgccgcaucgcugaccu

SEQ ID NO: 1499196 - RNA, 19 nt, Pseudomonas aeruginosa PA01
cgccgcagggugcggcugc

SEQ ID NO: 1499197 - RNA, 12 nt, Pseudomonas aeruginosa PA01
cgccgcaggucg

SEQ ID NO: 1499198 - RNA, 17 nt, Pseudomonas aeruginosa PA01
cgccgcaggucggcguc

SEQ ID NO: 1499199 - RNA, 20 nt, Pseudomonas aeruginosa PA01
cgccgcagguugcacuugaa

SEQ ID NO: 1499200 - RNA, 18 nt, Pseudomonas aeruginosa PA01
cgccgcaguacgaggggc

SEQ ID NO: 1499201 - RNA, 20 nt, Pseudomonas aeruginosa PA01
cgccgcaguacgaggggccg

SEQ ID NO: 1499202 - RNA, 18 nt, Pseudomonas aeruginosa PA01
cgccgcaguuguuccucg

SEQ ID NO: 1499203 - RNA, 16 nt, Pseudomonas aeruginosa PA01
cgccgcagcggccagg

SEQ ID NO: 1499204 - RNA, 12 nt, Pseudomonas aeruginosa PA01
cgccgcaggcgc

SEQ ID NO: 1499205 - RNA, 14 nt, Pseudomonas aeruginosa PA01
cgccgcaggcgcua

SEQ ID NO: 1499206 - RNA, 12 nt, Pseudomonas aeruginosa PA01
cgccgcagcucg

SEQ ID NO: 1499207 - RNA, 14 nt, Pseudomonas aeruginosa PA01
cgccgcagcucggc

SEQ ID NO: 1499208 - RNA, 19 nt, Pseudomonas aeruginosa PA01
cgccgcaggaaggcgaagc

SEQ ID NO: 1499209 - RNA, 15 nt, Pseudomonas aeruginosa PA01
cgccgcacaccgcgc

SEQ ID NO: 1499210 - RNA, 19 nt, Pseudomonas aeruginosa PA01
cgccgcacaccgcgcgcgc

SEQ ID NO: 1499211 - RNA, 23 nt, Pseudomonas aeruginosa PA01
cgccgcacaccgcgcgcgccugc

SEQ ID NO: 1499212 - RNA, 20 nt, Pseudomonas aeruginosa PA01
cgccgcaccacguagccggc

SEQ ID NO: 1499213 - RNA, 21 nt, Pseudomonas aeruginosa PA01
cgccgcaccacguagccggcg

SEQ ID NO: 1499214 - RNA, 18 nt, Pseudomonas aeruginosa PA01
cgccgcaccggcgauggc

SEQ ID NO: 1499215 - RNA, 19 nt, Pseudomonas aeruginosa PA01
cgccgcaccggcgauggcc

SEQ ID NO: 1499216 - RNA, 18 nt, Pseudomonas aeruginosa PA01
cgccgcaagcuuuuccga

SEQ ID NO: 1499217 - RNA, 18 nt, Pseudomonas aeruginosa PA01
cgccgcaagggcgucgcu

SEQ ID NO: 1499218 - RNA, 16 nt, Pseudomonas aeruginosa PA01
cgccgcaaguggcggc

SEQ ID NO: 1499219 - RNA, 17 nt, Pseudomonas aeruginosa PA01
cgccgcaaguggcggcu

SEQ ID NO: 1499220 - RNA, 20 nt, Pseudomonas aeruginosa PA01
cgccgcaaguggcggcugaa

SEQ ID NO: 1499221 - RNA, 22 nt, Pseudomonas aeruginosa PA01
cgccgcaacgaaaaagggcggc

SEQ ID NO: 1499222 - RNA, 16 nt, Pseudomonas aeruginosa PA01
cgccgauugugcaggg

SEQ ID NO: 1499223 - RNA, 14 nt, Pseudomonas aeruginosa PA01
cgccgaucccggcg

SEQ ID NO: 1499224 - RNA, 16 nt, Pseudomonas aeruginosa PA01
cgccgaucccggcggc

SEQ ID NO: 1499225 - RNA, 17 nt, Pseudomonas aeruginosa PA01
cgccgaucccgaucggc

SEQ ID NO: 1499226 - RNA, 18 nt, Pseudomonas aeruginosa PA01
cgccgaucccgaucggca

SEQ ID NO: 1499227 - RNA, 21 nt, Pseudomonas aeruginosa PA01
cgccgaucccgaucggcaagc

SEQ ID NO: 1499228 - RNA, 13 nt, Pseudomonas aeruginosa PA01
cgccgaucaggcg

SEQ ID NO: 1499229 - RNA, 22 nt, Pseudomonas aeruginosa PA01
cgccgaucaggcguaggccguc

SEQ ID NO: 1499230 - RNA, 12 nt, Pseudomonas aeruginosa PA01
cgccgauccagg

SEQ ID NO: 1499231 - RNA, 14 nt, Pseudomonas aeruginosa PA01
cgccgauccaggcg

SEQ ID NO: 1499232 - RNA, 15 nt, Pseudomonas aeruginosa PA01
cgcccagcagcggca

SEQ ID NO: 1499233 - RNA, 19 nt, Pseudomonas aeruginosa PA01
cgcccagcagcggcaggag

SEQ ID NO: 1499234 - RNA, 12 nt, Pseudomonas aeruginosa PA01
cgcccagcagca

SEQ ID NO: 1499235 - RNA, 17 nt, Pseudomonas aeruginosa PA01
cgccgacuggcagcgau

SEQ ID NO: 1499236 - RNA, 14 nt, Pseudomonas aeruginosa PA01
cgccgacuuccagg

SEQ ID NO: 1499237 - RNA, 19 nt, Pseudomonas aeruginosa PA01
cgccgacuuccaggcgcag

SEQ ID NO: 1499238 - RNA, 22 nt, Pseudomonas aeruginosa PA01
cgccgacuuccaggcgcaggcg

SEQ ID NO: 1499239 - RNA, 19 nt, Pseudomonas aeruginosa PA01
cgcccagcagcaggccggc

SEQ ID NO: 1499240 - RNA, 20 nt, Pseudomonas aeruginosa PA01
cgcccagcagcaggccggcg

SEQ ID NO: 1499241 - RNA, 22 nt, Pseudomonas aeruginosa PA01
cgccgacugcaacuggccgaga

SEQ ID NO: 1499242 - RNA, 15 nt, Pseudomonas aeruginosa PA01
cgccgagaacgcggc

SEQ ID NO: 1499243 - RNA, 19 nt, Pseudomonas aeruginosa PA01
cgccgagaacgcggcgaag

SEQ ID NO: 1499244 - RNA, 21 nt, Pseudomonas aeruginosa PA01
cgccgagaacgcggcgaaggg

SEQ ID NO: 1499245 - RNA, 19 nt, Pseudomonas aeruginosa PA01
cgccgacuugcucaucgcg

SEQ ID NO: 1499246 - RNA, 22 nt, Pseudomonas aeruginosa PA01
cgccgagauagcggcaacgcgc

SEQ ID NO: 1499247 - RNA, 15 nt, Pseudomonas aeruginosa PA01
cgccgagaacccggc

SEQ ID NO: 1499248 - RNA, 18 nt, Pseudomonas aeruginosa PA01
cgccgagaacccggccag

SEQ ID NO: 1499249 - RNA, 19 nt, Pseudomonas aeruginosa PA01
cgccgagaacccggccagg

SEQ ID NO: 1499250 - RNA, 17 nt, Pseudomonas aeruginosa PA01
cgccgagacgaucagca

SEQ ID NO: 1499251 - RNA, 20 nt, Pseudomonas aeruginosa PA01
cgccgagacgaucagcagga

SEQ ID NO: 1499252 - RNA, 14 nt, Pseudomonas aeruginosa PA01
cgcccagcaccaca

SEQ ID NO: 1499253 - RNA, 21 nt, Pseudomonas aeruginosa PA01
cgcccagcaccacagcaccac

SEQ ID NO: 1499254 - RNA, 23 nt, Pseudomonas aeruginosa PA01
cgcccagcaccacagcaccacgc

SEQ ID NO: 1499255 - RNA, 12 nt, Pseudomonas aeruginosa PA01
cgcccagcaccg

SEQ ID NO: 1499256 - RNA, 14 nt, Pseudomonas aeruginosa PA01
cgcccagaccugca

SEQ ID NO: 1499257 - RNA, 23 nt, Pseudomonas aeruginosa PA01
cgcccagaguucgcccagcucgc

SEQ ID NO: 1499258 - RNA, 18 nt, Pseudomonas aeruginosa PA01
cgcccacuccuccgccug

SEQ ID NO: 1499259 - RNA, 14 nt, Pseudomonas aeruginosa PA01
cgcccacgggcggc

SEQ ID NO: 1499260 - RNA, 14 nt, Pseudomonas aeruginosa PA01
cgccgaggcgucga

SEQ ID NO: 1499261 - RNA, 19 nt, Pseudomonas aeruginosa PA01
cgccgagggcgaagacuuc

SEQ ID NO: 1499262 - RNA, 15 nt, Pseudomonas aeruginosa PA01
cgccgaggcugcggg

SEQ ID NO: 1499263 - RNA, 14 nt, Pseudomonas aeruginosa PA01
cgccgagggcaagg

SEQ ID NO: 1499264 - RNA, 18 nt, Pseudomonas aeruginosa PA01
cgccgagggcaagguagu

SEQ ID NO: 1499265 - RNA, 12 nt, Pseudomonas aeruginosa PA01
cgccgaggcgcg

SEQ ID NO: 1499266 - RNA, 19 nt, Pseudomonas aeruginosa PA01
cgccgaggcgcgccacgca

SEQ ID NO: 1499267 - RNA, 12 nt, Pseudomonas aeruginosa PA01
cgccgagcagcg

SEQ ID NO: 1499268 - RNA, 13 nt, Pseudomonas aeruginosa PA01
cgccgagcagcgg

SEQ ID NO: 1499269 - RNA, 16 nt, Pseudomonas aeruginosa PA01
cgccgagcagcggcgc

SEQ ID NO: 1499270 - RNA, 12 nt, Pseudomonas aeruginosa PA01
cgccgagcaccc

SEQ ID NO: 1499271 - RNA, 16 nt, Pseudomonas aeruginosa PA01
cgccgagcaccccgac

SEQ ID NO: 1499272 - RNA, 14 nt, Pseudomonas aeruginosa PA01
cgccgagcagcacc

SEQ ID NO: 1499273 - RNA, 15 nt, Pseudomonas aeruginosa PA01
cgccgagcaaccgcg

SEQ ID NO: 1499274 - RNA, 20 nt, Pseudomonas aeruginosa PA01
cgccgagcaaccgcgauggc

SEQ ID NO: 1499275 - RNA, 14 nt, Pseudomonas aeruginosa PA01
cgccgagcaacggc

SEQ ID NO: 1499276 - RNA, 15 nt, Pseudomonas aeruginosa PA01
cgccgagcaacggca

SEQ ID NO: 1499277 - RNA, 17 nt, Pseudomonas aeruginosa PA01
cgccgagcaacggcagc

SEQ ID NO: 1499278 - RNA, 13 nt, Pseudomonas aeruginosa PA01
cgccgaggggcgg

SEQ ID NO: 1499279 - RNA, 15 nt, Pseudomonas aeruginosa PA01
cgccgaggggcggga

SEQ ID NO: 1499280 - RNA, 17 nt, Pseudomonas aeruginosa PA01
cgccgagggcgcggcgc

SEQ ID NO: 1499281 - RNA, 19 nt, Pseudomonas aeruginosa PA01
cgccgagggcgcggcgcca

SEQ ID NO: 1499282 - RNA, 20 nt, Pseudomonas aeruginosa PA01
cgccgagggcgcggcgccag

SEQ ID NO: 1499283 - RNA, 14 nt, Pseudomonas aeruginosa PA01
cgccgagggcgcca

SEQ ID NO: 1499284 - RNA, 16 nt, Pseudomonas aeruginosa PA01
cgccgagggcgccagg

SEQ ID NO: 1499285 - RNA, 17 nt, Pseudomonas aeruginosa PA01
cgccgagggcgccaggu

SEQ ID NO: 1499286 - RNA, 21 nt, Pseudomonas aeruginosa PA01
cgccgagggcgccaggugcag

SEQ ID NO: 1499287 - RNA, 14 nt, Pseudomonas aeruginosa PA01
cgccgaggcggcgc

SEQ ID NO: 1499288 - RNA, 14 nt, Pseudomonas aeruginosa PA01
cgccgauacagcgc

SEQ ID NO: 1499289 - RNA, 15 nt, Pseudomonas aeruginosa PA01
cgccgauacagcgcg

SEQ ID NO: 1499290 - RNA, 16 nt, Pseudomonas aeruginosa PA01
cgccgauacagcgcgc

SEQ ID NO: 1499291 - RNA, 16 nt, Pseudomonas aeruginosa PA01
cgccgaguuggcccaa

SEQ ID NO: 1499292 - RNA, 15 nt, Pseudomonas aeruginosa PA01
cgccgaucaccccgc

SEQ ID NO: 1499293 - RNA, 19 nt, Pseudomonas aeruginosa PA01
cgccgaucaccccgcccag

SEQ ID NO: 1499294 - RNA, 20 nt, Pseudomonas aeruginosa PA01
cgccgaucaccccgcccagu

SEQ ID NO: 1499295 - RNA, 15 nt, Pseudomonas aeruginosa PA01
cgccgaucaccagga

SEQ ID NO: 1499296 - RNA, 20 nt, Pseudomonas aeruginosa PA01
cgccgaucaccaggaucgcc

SEQ ID NO: 1499297 - RNA, 17 nt, Pseudomonas aeruginosa PA01
cgccgauauugaacgac

SEQ ID NO: 1499298 - RNA, 23 nt, Pseudomonas aeruginosa PA01
cgccgccaugguuuaccaggacc

SEQ ID NO: 1499299 - RNA, 18 nt, Pseudomonas aeruginosa PA01
cgccgccauugacgaaau

SEQ ID NO: 1499300 - RNA, 13 nt, Pseudomonas aeruginosa PA01
cgccgcccacgcc

SEQ ID NO: 1499301 - RNA, 12 nt, Pseudomonas aeruginosa PA01
cgccgcccagca

SEQ ID NO: 1499302 - RNA, 15 nt, Pseudomonas aeruginosa PA01
cgccgcccagcagca

SEQ ID NO: 1499303 - RNA, 23 nt, Pseudomonas aeruginosa PA01
cgccgcccagcagcaccaucagc

SEQ ID NO: 1499304 - RNA, 21 nt, Pseudomonas aeruginosa PA01
cgccgcccgagaggguggucg

SEQ ID NO: 1499305 - RNA, 14 nt, Pseudomonas aeruginosa PA01
cgccgcccgaggcg

SEQ ID NO: 1499306 - RNA, 15 nt, Pseudomonas aeruginosa PA01
cgccgcccgaggcga

SEQ ID NO: 1499307 - RNA, 16 nt, Pseudomonas aeruginosa PA01
cgccgcccgaggcgac

SEQ ID NO: 1499308 - RNA, 16 nt, Pseudomonas aeruginosa PA01
cgccgcccccagcgcg

SEQ ID NO: 1499309 - RNA, 16 nt, Pseudomonas aeruginosa PA01
cgccgcccccggcccg

SEQ ID NO: 1499310 - RNA, 12 nt, Pseudomonas aeruginosa PA01
cgccgcccgcgc

SEQ ID NO: 1499311 - RNA, 14 nt, Pseudomonas aeruginosa PA01
cgccgcccgcgccu

SEQ ID NO: 1499312 - RNA, 17 nt, Pseudomonas aeruginosa PA01
cgccgcccgcgccucca

SEQ ID NO: 1499313 - RNA, 13 nt, Pseudomonas aeruginosa PA01
cgccgcccggcac

SEQ ID NO: 1499314 - RNA, 17 nt, Pseudomonas aeruginosa PA01
cgccgcccggcagcggc

SEQ ID NO: 1499315 - RNA, 18 nt, Pseudomonas aeruginosa PA01
cgccgcccggcucgccgc

SEQ ID NO: 1499316 - RNA, 14 nt, Pseudomonas aeruginosa PA01
cgccgccagcaacg

SEQ ID NO: 1499317 - RNA, 16 nt, Pseudomonas aeruginosa PA01
cgccgccagcaacggc

SEQ ID NO: 1499318 - RNA, 11 nt, Pseudomonas aeruginosa PA01
cgccgccagcc

SEQ ID NO: 1499319 - RNA, 13 nt, Pseudomonas aeruginosa PA01
cgccgccagcagg

SEQ ID NO: 1499320 - RNA, 14 nt, Pseudomonas aeruginosa PA01
cgccgccagcagga

SEQ ID NO: 1499321 - RNA, 18 nt, Pseudomonas aeruginosa PA01
cgccgccagcaggaucgg

SEQ ID NO: 1499322 - RNA, 16 nt, Pseudomonas aeruginosa PA01
cgccgccagcauggcg

SEQ ID NO: 1499323 - RNA, 21 nt, Pseudomonas aeruginosa PA01
cgccgccaggcccugggcggc

SEQ ID NO: 1499324 - RNA, 14 nt, Pseudomonas aeruginosa PA01
cgccgccaggcggc

SEQ ID NO: 1499325 - RNA, 19 nt, Pseudomonas aeruginosa PA01
cgccgccaguucgcgcagg

SEQ ID NO: 1499326 - RNA, 23 nt, Pseudomonas aeruginosa PA01
cgccgccaguucggccaucagca

SEQ ID NO: 1499327 - RNA, 22 nt, Pseudomonas aeruginosa PA01
cgccgccaguugcuugaucgcc

SEQ ID NO: 1499328 - RNA, 12 nt, Pseudomonas aeruginosa PA01
cgccgccaggca

SEQ ID NO: 1499329 - RNA, 20 nt, Pseudomonas aeruginosa PA01
cgccgccaggcagaccugca

SEQ ID NO: 1499330 - RNA, 14 nt, Pseudomonas aeruginosa PA01
cgccgccaggcagg

SEQ ID NO: 1499331 - RNA, 16 nt, Pseudomonas aeruginosa PA01
cgccgccaggcaggcc

SEQ ID NO: 1499332 - RNA, 19 nt, Pseudomonas aeruginosa PA01
cgccgccaggcaggccggg

SEQ ID NO: 1499333 - RNA, 22 nt, Pseudomonas aeruginosa PA01
cgccgccacgugcacgccgugc

SEQ ID NO: 1499334 - RNA, 18 nt, Pseudomonas aeruginosa PA01
cgccgccaccacgaucag

SEQ ID NO: 1499335 - RNA, 20 nt, Pseudomonas aeruginosa PA01
cgccgccaacuggcugucga

SEQ ID NO: 1499336 - RNA, 13 nt, Pseudomonas aeruginosa PA01
cgccgccaaccac

SEQ ID NO: 1499337 - RNA, 19 nt, Pseudomonas aeruginosa PA01
cgccgccaaccacuccgcc

SEQ ID NO: 1499338 - RNA, 13 nt, Pseudomonas aeruginosa PA01
cgccgcccucgca

SEQ ID NO: 1499339 - RNA, 15 nt, Pseudomonas aeruginosa PA01
cgccgcccgucgcgc

SEQ ID NO: 1499340 - RNA, 18 nt, Pseudomonas aeruginosa PA01
cgccgcccgucgcgccgg

SEQ ID NO: 1499341 - RNA, 15 nt, Pseudomonas aeruginosa PA01
cgccgcccuggccgc

SEQ ID NO: 1499342 - RNA, 13 nt, Pseudomonas aeruginosa PA01
cgccgccgaagcc

SEQ ID NO: 1499343 - RNA, 23 nt, Pseudomonas aeruginosa PA01
cgccgccgaacaugccgaagagc

SEQ ID NO: 1499344 - RNA, 14 nt, Pseudomonas aeruginosa PA01
cgccgcccuguucg

SEQ ID NO: 1499345 - RNA, 14 nt, Pseudomonas aeruginosa PA01
cgccgccgaccggg

SEQ ID NO: 1499346 - RNA, 12 nt, Pseudomonas aeruginosa PA01
cgccgccgacgu

SEQ ID NO: 1499347 - RNA, 16 nt, Pseudomonas aeruginosa PA01
cgccgccgagaacccg

SEQ ID NO: 1499348 - RNA, 21 nt, Pseudomonas aeruginosa PA01
cgccgccgagaacccggccag

SEQ ID NO: 1499349 - RNA, 14 nt, Pseudomonas aeruginosa PA01
cgccgccgcagccg

SEQ ID NO: 1499350 - RNA, 12 nt, Pseudomonas aeruginosa PA01
cgccgccgcaac

SEQ ID NO: 1499351 - RNA, 22 nt, Pseudomonas aeruginosa PA01
cgccgccgaggauagcguccag

SEQ ID NO: 1499352 - RNA, 13 nt, Pseudomonas aeruginosa PA01
cgccgccgaggcg

SEQ ID NO: 1499353 - RNA, 15 nt, Pseudomonas aeruginosa PA01
cgccgccgaggcgcg

SEQ ID NO: 1499354 - RNA, 16 nt, Pseudomonas aeruginosa PA01
cgccgccgaggugcgg

SEQ ID NO: 1499355 - RNA, 16 nt, Pseudomonas aeruginosa PA01
cgccgccggcgaggau

SEQ ID NO: 1499356 - RNA, 16 nt, Pseudomonas aeruginosa PA01
cgccgccggccagccg

SEQ ID NO: 1499357 - RNA, 13 nt, Pseudomonas aeruginosa PA01
cgccgccggcgaa

SEQ ID NO: 1499358 - RNA, 14 nt, Pseudomonas aeruginosa PA01
cgccgccggcgaac

SEQ ID NO: 1499359 - RNA, 21 nt, Pseudomonas aeruginosa PA01
cgccgccggcgaacagccagc

SEQ ID NO: 1499360 - RNA, 13 nt, Pseudomonas aeruginosa PA01
cgccgccggcgag

SEQ ID NO: 1499361 - RNA, 12 nt, Pseudomonas aeruginosa PA01
cgccgcgccgcc

SEQ ID NO: 1499362 - RNA, 16 nt, Pseudomonas aeruginosa PA01
cgccgcgccgccgagg

SEQ ID NO: 1499363 - RNA, 12 nt, Pseudomonas aeruginosa PA01
cgccgcgccgcu

SEQ ID NO: 1499364 - RNA, 13 nt, Pseudomonas aeruginosa PA01
cgccgcgccgcuc

SEQ ID NO: 1499365 - RNA, 13 nt, Pseudomonas aeruginosa PA01
cgccgcgcgccau

SEQ ID NO: 1499366 - RNA, 15 nt, Pseudomonas aeruginosa PA01
cgccgcgccucgucg

SEQ ID NO: 1499367 - RNA, 17 nt, Pseudomonas aeruginosa PA01
cgccgcgccucgucgcg

SEQ ID NO: 1499368 - RNA, 18 nt, Pseudomonas aeruginosa PA01
cgccgcgccucgucgcgc

SEQ ID NO: 1499369 - RNA, 22 nt, Pseudomonas aeruginosa PA01
cgccgcgccucgucgcgccagg

SEQ ID NO: 1499370 - RNA, 13 nt, Pseudomonas aeruginosa PA01
cgccgcgccggcg

SEQ ID NO: 1499371 - RNA, 12 nt, Pseudomonas aeruginosa PA01
cgccgcgcgcca

SEQ ID NO: 1499372 - RNA, 20 nt, Pseudomonas aeruginosa PA01
cgccgcgagcgaaacggcgc

SEQ ID NO: 1499373 - RNA, 22 nt, Pseudomonas aeruginosa PA01
cgccgcgagcgaaacggcgcug

SEQ ID NO: 1499374 - RNA, 23 nt, Pseudomonas aeruginosa PA01
cgccgcgagcgaaacggcgcuga

SEQ ID NO: 1499375 - RNA, 15 nt, Pseudomonas aeruginosa PA01
cgccgcgagcgccgc

SEQ ID NO: 1499376 - RNA, 15 nt, Pseudomonas aeruginosa PA01
cgccgcgauauucgc

SEQ ID NO: 1499377 - RNA, 20 nt, Pseudomonas aeruginosa PA01
cgccgcgauauucgcccuac

SEQ ID NO: 1499378 - RNA, 23 nt, Pseudomonas aeruginosa PA01
cgccgcgagcaccaugcagcggc

SEQ ID NO: 1499379 - RNA, 20 nt, Pseudomonas aeruginosa PA01
cgccgcgaccugcucgucga

SEQ ID NO: 1499380 - RNA, 23 nt, Pseudomonas aeruginosa PA01
cgccgcgaccugcucgucgaugc

SEQ ID NO: 1499381 - RNA, 20 nt, Pseudomonas aeruginosa PA01
cgccgcgaaauggcagaaca

SEQ ID NO: 1499382 - RNA, 13 nt, Pseudomonas aeruginosa PA01
cgccgcgaacaca

SEQ ID NO: 1499383 - RNA, 19 nt, Pseudomonas aeruginosa PA01
cgccgcgaagcccagcgcc

SEQ ID NO: 1499384 - RNA, 15 nt, Pseudomonas aeruginosa PA01
cgccgccuuggcauc

SEQ ID NO: 1499385 - RNA, 17 nt, Pseudomonas aeruginosa PA01
cgccgccuuucugcccg

SEQ ID NO: 1499386 - RNA, 13 nt, Pseudomonas aeruginosa PA01
cgccgccuggccg

SEQ ID NO: 1499387 - RNA, 15 nt, Pseudomonas aeruginosa PA01
cgccgccuggccggu

SEQ ID NO: 1499388 - RNA, 19 nt, Pseudomonas aeruginosa PA01
cgccgccugggccgccucg

SEQ ID NO: 1499389 - RNA, 21 nt, Pseudomonas aeruginosa PA01
cgccgccuggguggcgacgaa

SEQ ID NO: 1499390 - RNA, 16 nt, Pseudomonas aeruginosa PA01
cgccgccuggugcccg

SEQ ID NO: 1499391 - RNA, 17 nt, Pseudomonas aeruginosa PA01
cgccgccuggugcccga

SEQ ID NO: 1499392 - RNA, 22 nt, Pseudomonas aeruginosa PA01
cgccgccuggugcccgaugccg

SEQ ID NO: 1499393 - RNA, 15 nt, Pseudomonas aeruginosa PA01
cgccgcgcuuggccu

SEQ ID NO: 1499394 - RNA, 14 nt, Pseudomonas aeruginosa PA01
cgccgcgcuucagg

SEQ ID NO: 1499395 - RNA, 18 nt, Pseudomonas aeruginosa PA01
cgccgcggaaggcccgcg

SEQ ID NO: 1499396 - RNA, 21 nt, Pseudomonas aeruginosa PA01
cgccgcggaaggcccgcgagc

SEQ ID NO: 1499397 - RNA, 16 nt, Pseudomonas aeruginosa PA01
cgccgcggacggccgg

SEQ ID NO: 1499398 - RNA, 22 nt, Pseudomonas aeruginosa PA01
cgccgcggcagaucccaucgcc

SEQ ID NO: 1499399 - RNA, 19 nt, Pseudomonas aeruginosa PA01
cgccgcggcaaugcggcga

SEQ ID NO: 1499400 - RNA, 20 nt, Pseudomonas aeruginosa PA01
cgccgcggcaaugcggcgau

SEQ ID NO: 1499401 - RNA, 14 nt, Pseudomonas aeruginosa PA01
cgccgcggcaccgg

SEQ ID NO: 1499402 - RNA, 18 nt, Pseudomonas aeruginosa PA01
cgccgcggcaccggcgac

SEQ ID NO: 1499403 - RNA, 19 nt, Pseudomonas aeruginosa PA01
cgccgcggcaccggcgacg

SEQ ID NO: 1499404 - RNA, 15 nt, Pseudomonas aeruginosa PA01
cgccgcuacugcgcg

SEQ ID NO: 1499405 - RNA, 20 nt, Pseudomonas aeruginosa PA01
cgccgcuagggcgcccucgc

SEQ ID NO: 1499406 - RNA, 21 nt, Pseudomonas aeruginosa PA01
cgccgcuagggcgcccucgcc

SEQ ID NO: 1499407 - RNA, 15 nt, Pseudomonas aeruginosa PA01
cgccgcuaucgccgc

SEQ ID NO: 1499408 - RNA, 16 nt, Pseudomonas aeruginosa PA01
cgccgcuaucgccgcc

SEQ ID NO: 1499409 - RNA, 18 nt, Pseudomonas aeruginosa PA01
cgccgcuaucgccgccgc

SEQ ID NO: 1499410 - RNA, 19 nt, Pseudomonas aeruginosa PA01
cgccgcuaucgccgccgca

SEQ ID NO: 1499411 - RNA, 20 nt, Pseudomonas aeruginosa PA01
cgccgcuaucgccgccgcag

SEQ ID NO: 1499412 - RNA, 16 nt, Pseudomonas aeruginosa PA01
cgccgcuaugggcacc

SEQ ID NO: 1499413 - RNA, 18 nt, Pseudomonas aeruginosa PA01
cgccgcuaugggcaccgc

SEQ ID NO: 1499414 - RNA, 14 nt, Pseudomonas aeruginosa PA01
cgccgcucacccug

SEQ ID NO: 1499415 - RNA, 15 nt, Pseudomonas aeruginosa PA01
cgccgcucacccugu

SEQ ID NO: 1499416 - RNA, 22 nt, Pseudomonas aeruginosa PA01
cgccgcugaaguccuggccgag

SEQ ID NO: 1499417 - RNA, 23 nt, Pseudomonas aeruginosa PA01
cgccgcugaaguccuggccgagc

SEQ ID NO: 1499418 - RNA, 17 nt, Pseudomonas aeruginosa PA01
cgccgcugcaccgaacg

SEQ ID NO: 1499419 - RNA, 23 nt, Pseudomonas aeruginosa PA01
cgccgcugcaccgaacggugcag

SEQ ID NO: 1499420 - RNA, 16 nt, Pseudomonas aeruginosa PA01
cgccgcugaggcucgc

SEQ ID NO: 1499421 - RNA, 20 nt, Pseudomonas aeruginosa PA01
cgccgcugaggcucgccggg

SEQ ID NO: 1499422 - RNA, 20 nt, Pseudomonas aeruginosa PA01
cgccgcugaucaguaccggc

SEQ ID NO: 1499423 - RNA, 13 nt, Pseudomonas aeruginosa PA01
cgccgcucugccc

SEQ ID NO: 1499424 - RNA, 17 nt, Pseudomonas aeruginosa PA01
cgccgcucugcccgacc

SEQ ID NO: 1499425 - RNA, 18 nt, Pseudomonas aeruginosa PA01
cgccgcucugcccgaccg

SEQ ID NO: 1499426 - RNA, 16 nt, Pseudomonas aeruginosa PA01
cgccgcucugcuggcc

SEQ ID NO: 1499427 - RNA, 19 nt, Pseudomonas aeruginosa PA01
cgccgcucauccgcuggua

SEQ ID NO: 1499428 - RNA, 21 nt, Pseudomonas aeruginosa PA01
cgccgcucaucugcaccacgu

SEQ ID NO: 1499429 - RNA, 13 nt, Pseudomonas aeruginosa PA01
cgccgcuccgcgc

SEQ ID NO: 1499430 - RNA, 17 nt, Pseudomonas aeruginosa PA01
cgccgcuccgcgccacg

SEQ ID NO: 1499431 - RNA, 13 nt, Pseudomonas aeruginosa PA01
cgccgcuaucgcc

SEQ ID NO: 1499432 - RNA, 13 nt, Pseudomonas aeruginosa PA01
cgccgcucggcga

SEQ ID NO: 1499433 - RNA, 14 nt, Pseudomonas aeruginosa PA01
cgccgcucggcgag

SEQ ID NO: 1499434 - RNA, 15 nt, Pseudomonas aeruginosa PA01
cgccgcucggcgagc

SEQ ID NO: 1499435 - RNA, 22 nt, Pseudomonas aeruginosa PA01
cgccgcucggcgagccgccggg

SEQ ID NO: 1499436 - RNA, 14 nt, Pseudomonas aeruginosa PA01
cgccgcuccuggca

SEQ ID NO: 1499437 - RNA, 14 nt, Pseudomonas aeruginosa PA01
cgccgcucgaugcc

SEQ ID NO: 1499438 - RNA, 14 nt, Pseudomonas aeruginosa PA01
cgccgcucgcgcac

SEQ ID NO: 1499439 - RNA, 17 nt, Pseudomonas aeruginosa PA01
cgccgcucgcgcacggc

SEQ ID NO: 1499440 - RNA, 13 nt, Pseudomonas aeruginosa PA01
cgccgcugcuggc

SEQ ID NO: 1499441 - RNA, 22 nt, Pseudomonas aeruginosa PA01
cgccgcugcuggcaucggugac

SEQ ID NO: 1499442 - RNA, 16 nt, Pseudomonas aeruginosa PA01
cgccgcuggaaccggc

SEQ ID NO: 1499443 - RNA, 19 nt, Pseudomonas aeruginosa PA01
cgccgcuggaaccggccgg

SEQ ID NO: 1499444 - RNA, 15 nt, Pseudomonas aeruginosa PA01
cgccgcugcggcugc

SEQ ID NO: 1499445 - RNA, 16 nt, Pseudomonas aeruginosa PA01
cgccggaaccugcaug

SEQ ID NO: 1499446 - RNA, 14 nt, Pseudomonas aeruginosa PA01
cgccgcuggcggca

SEQ ID NO: 1499447 - RNA, 17 nt, Pseudomonas aeruginosa PA01
cgccgcuggcggcaugc

SEQ ID NO: 1499448 - RNA, 14 nt, Pseudomonas aeruginosa PA01
cgccgcugggcagc

SEQ ID NO: 1499449 - RNA, 15 nt, Pseudomonas aeruginosa PA01
cgccgcuggccuggc

SEQ ID NO: 1499450 - RNA, 12 nt, Pseudomonas aeruginosa PA01
cgccgcuggcgg

SEQ ID NO: 1499451 - RNA, 21 nt, Pseudomonas aeruginosa PA01
cgccgcuggcauaaccggaag

SEQ ID NO: 1499452 - RNA, 19 nt, Pseudomonas aeruginosa PA01
cgccgcugcgucgucgcgg

SEQ ID NO: 1499453 - RNA, 14 nt, Pseudomonas aeruginosa PA01
cgccgcuggcggcg

SEQ ID NO: 1499454 - RNA, 15 nt, Pseudomonas aeruginosa PA01
cgccgcuggcggcgc

SEQ ID NO: 1499455 - RNA, 16 nt, Pseudomonas aeruginosa PA01
cgccgcuggcggcgcu

SEQ ID NO: 1499456 - RNA, 12 nt, Pseudomonas aeruginosa PA01
cgccgcuggcgu

SEQ ID NO: 1499457 - RNA, 17 nt, Pseudomonas aeruginosa PA01
cgccggagucguagcgc

SEQ ID NO: 1499458 - RNA, 19 nt, Pseudomonas aeruginosa PA01
cgccggagucguagcgcgc

SEQ ID NO: 1499459 - RNA, 13 nt, Pseudomonas aeruginosa PA01
cgccggaucggcu

SEQ ID NO: 1499460 - RNA, 22 nt, Pseudomonas aeruginosa PA01
cgccggaucggcugaccggcau

SEQ ID NO: 1499461 - RNA, 18 nt, Pseudomonas aeruginosa PA01
cgccggaagcuuccagcu

SEQ ID NO: 1499462 - RNA, 18 nt, Pseudomonas aeruginosa PA01
cgccggaaguggcagcgc

SEQ ID NO: 1499463 - RNA, 21 nt, Pseudomonas aeruginosa PA01
cgccggaaguggcagcgccgu

SEQ ID NO: 1499464 - RNA, 20 nt, Pseudomonas aeruginosa PA01
cgccggaaugacgagccgca

SEQ ID NO: 1499465 - RNA, 22 nt, Pseudomonas aeruginosa PA01
cgccggaaugacgagccgcagg

SEQ ID NO: 1499466 - RNA, 21 nt, Pseudomonas aeruginosa PA01
cgccggagggaaugaagaagc

SEQ ID NO: 1499467 - RNA, 19 nt, Pseudomonas aeruginosa PA01
cgccggaggggcggccgcc

SEQ ID NO: 1499468 - RNA, 18 nt, Pseudomonas aeruginosa PA01
cgccggaauguugcggcg

SEQ ID NO: 1499469 - RNA, 22 nt, Pseudomonas aeruginosa PA01
cgccggacaggccacccgccuc

SEQ ID NO: 1499470 - RNA, 12 nt, Pseudomonas aeruginosa PA01
cgccggaccaga

SEQ ID NO: 1499471 - RNA, 15 nt, Pseudomonas aeruginosa PA01
cgccggaccagaucg

SEQ ID NO: 1499472 - RNA, 17 nt, Pseudomonas aeruginosa PA01
cgccggaccagaucggc

SEQ ID NO: 1499473 - RNA, 20 nt, Pseudomonas aeruginosa PA01
cgccggaccagaucggcgcg

SEQ ID NO: 1499474 - RNA, 22 nt, Pseudomonas aeruginosa PA01
cgccggaccagaucggcgcgca

SEQ ID NO: 1499475 - RNA, 13 nt, Pseudomonas aeruginosa PA01
cgccggcagcucg

SEQ ID NO: 1499476 - RNA, 18 nt, Pseudomonas aeruginosa PA01
cgccggcagcucggccga

SEQ ID NO: 1499477 - RNA, 19 nt, Pseudomonas aeruginosa PA01
cgccggcagcucggccgag

SEQ ID NO: 1499478 - RNA, 20 nt, Pseudomonas aeruginosa PA01
cgccggcagcucggccgagg

SEQ ID NO: 1499479 - RNA, 23 nt, Pseudomonas aeruginosa PA01
cgccggcagcucggccgagggca

SEQ ID NO: 1499480 - RNA, 22 nt, Pseudomonas aeruginosa PA01
cgccggcacuguuccucagccc

SEQ ID NO: 1499481 - RNA, 12 nt, Pseudomonas aeruginosa PA01
cgccggcagcgc

SEQ ID NO: 1499482 - RNA, 14 nt, Pseudomonas aeruginosa PA01
cgccggcagcgccg

SEQ ID NO: 1499483 - RNA, 16 nt, Pseudomonas aeruginosa PA01
cgccggcagcgccgcg

SEQ ID NO: 1499484 - RNA, 17 nt, Pseudomonas aeruginosa PA01
cgccggcagcgccgcgc

SEQ ID NO: 1499485 - RNA, 22 nt, Pseudomonas aeruginosa PA01
cgccggcaccgucgagcaccag

SEQ ID NO: 1499486 - RNA, 22 nt, Pseudomonas aeruginosa PA01
cgccggccauucgcugucgagc

SEQ ID NO: 1499487 - RNA, 20 nt, Pseudomonas aeruginosa PA01
cgccggccauugccgccaga

SEQ ID NO: 1499488 - RNA, 15 nt, Pseudomonas aeruginosa PA01
cgccggcccagcagg

SEQ ID NO: 1499489 - RNA, 19 nt, Pseudomonas aeruginosa PA01
cgccggcccagcaggccgg

SEQ ID NO: 1499490 - RNA, 21 nt, Pseudomonas aeruginosa PA01
cgccggcccagcaggccggcc

SEQ ID NO: 1499491 - RNA, 19 nt, Pseudomonas aeruginosa PA01
cgccggcaggaacgcccgc

SEQ ID NO: 1499492 - RNA, 20 nt, Pseudomonas aeruginosa PA01
cgccggcaggaacgcccgcg

SEQ ID NO: 1499493 - RNA, 20 nt, Pseudomonas aeruginosa PA01
cgccggcaggccuucggcgc

SEQ ID NO: 1499494 - RNA, 22 nt, Pseudomonas aeruginosa PA01
cgccggcagugugccgcccugc

SEQ ID NO: 1499495 - RNA, 14 nt, Pseudomonas aeruginosa PA01
cgccggcagguaga

SEQ ID NO: 1499496 - RNA, 19 nt, Pseudomonas aeruginosa PA01
cgccggcagguagaccucg

SEQ ID NO: 1499497 - RNA, 12 nt, Pseudomonas aeruginosa PA01
cgccggcccgcg

SEQ ID NO: 1499498 - RNA, 14 nt, Pseudomonas aeruginosa PA01
cgccggcccgcgcg

SEQ ID NO: 1499499 - RNA, 15 nt, Pseudomonas aeruginosa PA01
cgccggcccgcgcgg

SEQ ID NO: 1499500 - RNA, 14 nt, Pseudomonas aeruginosa PA01
cgccggccgggagc

SEQ ID NO: 1499501 - RNA, 13 nt, Pseudomonas aeruginosa PA01
cgccggccgggcu

SEQ ID NO: 1499502 - RNA, 13 nt, Pseudomonas aeruginosa PA01
cgccggccggggc

SEQ ID NO: 1499503 - RNA, 15 nt, Pseudomonas aeruginosa PA01
cgccggccggggcgc

SEQ ID NO: 1499504 - RNA, 16 nt, Pseudomonas aeruginosa PA01
cgccggcacggcaucg

SEQ ID NO: 1499505 - RNA, 15 nt, Pseudomonas aeruginosa PA01
cgccggccggcucag

SEQ ID NO: 1499506 - RNA, 14 nt, Pseudomonas aeruginosa PA01
cgccggccucgcgc

SEQ ID NO: 1499507 - RNA, 17 nt, Pseudomonas aeruginosa PA01
cgccggccucgcgcaac

SEQ ID NO: 1499508 - RNA, 16 nt, Pseudomonas aeruginosa PA01
cgccggccucgcugcc

SEQ ID NO: 1499509 - RNA, 24 nt, Pseudomonas aeruginosa PA01
cgccggccucgcugccgccgcaga

SEQ ID NO: 1499510 - RNA, 14 nt, Pseudomonas aeruginosa PA01
cgccggccugcgcg

SEQ ID NO: 1499511 - RNA, 15 nt, Pseudomonas aeruginosa PA01
cgccggccugcgcgc

SEQ ID NO: 1499512 - RNA, 16 nt, Pseudomonas aeruginosa PA01
cgccggccugcgcgca

SEQ ID NO: 1499513 - RNA, 20 nt, Pseudomonas aeruginosa PA01
cgccggccugcgcgcaccag

SEQ ID NO: 1499514 - RNA, 15 nt, Pseudomonas aeruginosa PA01
cgccggcgaacagcc

SEQ ID NO: 1499515 - RNA, 20 nt, Pseudomonas aeruginosa PA01
cgccggcgaacagccagcgg

SEQ ID NO: 1499516 - RNA, 12 nt, Pseudomonas aeruginosa PA01
cgccggcgaacu

SEQ ID NO: 1499517 - RNA, 13 nt, Pseudomonas aeruginosa PA01
cgccggcgaugcc

SEQ ID NO: 1499518 - RNA, 17 nt, Pseudomonas aeruginosa PA01
cgccggcgaugcccagg

SEQ ID NO: 1499519 - RNA, 23 nt, Pseudomonas aeruginosa PA01
cgccggcgaugcccaggccgccg

SEQ ID NO: 1499520 - RNA, 16 nt, Pseudomonas aeruginosa PA01
cgccggcgaugcgcag

SEQ ID NO: 1499521 - RNA, 22 nt, Pseudomonas aeruginosa PA01
cgccggcgaugcgcaggccggg

SEQ ID NO: 1499522 - RNA, 13 nt, Pseudomonas aeruginosa PA01
cgccggcgaucgc

SEQ ID NO: 1499523 - RNA, 14 nt, Pseudomonas aeruginosa PA01
cgccggcgaucgcc

SEQ ID NO: 1499524 - RNA, 21 nt, Pseudomonas aeruginosa PA01
cgccggcgaucgccaggcgau

SEQ ID NO: 1499525 - RNA, 11 nt, Pseudomonas aeruginosa PA01
cgccggcgauc

SEQ ID NO: 1499526 - RNA, 14 nt, Pseudomonas aeruginosa PA01
cgccggcgaccgcg

SEQ ID NO: 1499527 - RNA, 17 nt, Pseudomonas aeruginosa PA01
cgccggcgaccgcgcgc

SEQ ID NO: 1499528 - RNA, 22 nt, Pseudomonas aeruginosa PA01
cgccggcgacgacgaucccggc

SEQ ID NO: 1499529 - RNA, 14 nt, Pseudomonas aeruginosa PA01
cgccggcgagccgc

SEQ ID NO: 1499530 - RNA, 15 nt, Pseudomonas aeruginosa PA01
cgccggcgagccgcu

SEQ ID NO: 1499531 - RNA, 16 nt, Pseudomonas aeruginosa PA01
cgccggcgagccgcug

SEQ ID NO: 1499532 - RNA, 11 nt, Pseudomonas aeruginosa PA01
cgccggcgcgc

SEQ ID NO: 1499533 - RNA, 16 nt, Pseudomonas aeruginosa PA01
cgccggcgcgcccagg

SEQ ID NO: 1499534 - RNA, 14 nt, Pseudomonas aeruginosa PA01
cgccggcgcgcggc

SEQ ID NO: 1499535 - RNA, 12 nt, Pseudomonas aeruginosa PA01
cgccggcgcggu

SEQ ID NO: 1499536 - RNA, 17 nt, Pseudomonas aeruginosa PA01
cgccggcgcggucucgc

SEQ ID NO: 1499537 - RNA, 12 nt, Pseudomonas aeruginosa PA01
cgccggcgcugc

SEQ ID NO: 1499538 - RNA, 16 nt, Pseudomonas aeruginosa PA01
cgccggcgcugcgagc

SEQ ID NO: 1499539 - RNA, 18 nt, Pseudomonas aeruginosa PA01
aacaccggaagcguccag

SEQ ID NO: 1499540 - RNA, 15 nt, Pseudomonas aeruginosa PA01
aacaccgggccgccg

SEQ ID NO: 1499541 - RNA, 19 nt, Pseudomonas aeruginosa PA01
aacaccgggccgccggcga

SEQ ID NO: 1499542 - RNA, 12 nt, Pseudomonas aeruginosa PA01
cgccggggccua

SEQ ID NO: 1499543 - RNA, 17 nt, Pseudomonas aeruginosa PA01
cgccggggcgcaggucg

SEQ ID NO: 1499544 - RNA, 22 nt, Pseudomonas aeruginosa PA01
cgccggggcgugcaggccgccg

SEQ ID NO: 1499545 - RNA, 23 nt, Pseudomonas aeruginosa PA01
cgccggggcgugcaggccgccga

SEQ ID NO: 1499546 - RNA, 16 nt, Pseudomonas aeruginosa PA01
cgccggguacagcgcc

SEQ ID NO: 1499547 - RNA, 22 nt, Pseudomonas aeruginosa PA01
cgccggguacagcgccacggcc

SEQ ID NO: 1499548 - RNA, 20 nt, Pseudomonas aeruginosa PA01
cgccggguagcguuaucgcc

SEQ ID NO: 1499549 - RNA, 21 nt, Pseudomonas aeruginosa PA01
cgccgggggucucguagcagc

SEQ ID NO: 1499550 - RNA, 17 nt, Pseudomonas aeruginosa PA01
cgccgggugccggugcg

SEQ ID NO: 1499551 - RNA, 22 nt, Pseudomonas aeruginosa PA01
cgccggguggaacgaggcgacc

SEQ ID NO: 1499552 - RNA, 18 nt, Pseudomonas aeruginosa PA01
cgccggguccaccgcggc

SEQ ID NO: 1499553 - RNA, 17 nt, Pseudomonas aeruginosa PA01
cgccgggucgacuucgc

SEQ ID NO: 1499554 - RNA, 16 nt, Pseudomonas aeruginosa PA01
cgccgggucgaugggc

SEQ ID NO: 1499555 - RNA, 23 nt, Pseudomonas aeruginosa PA01
cgccgggucgacaugcaggccgg

SEQ ID NO: 1499556 - RNA, 16 nt, Pseudomonas aeruginosa PA01
cgccgggucgaccuug

SEQ ID NO: 1499557 - RNA, 19 nt, Pseudomonas aeruginosa PA01
cgccgggucgaccuugccg

SEQ ID NO: 1499558 - RNA, 13 nt, Pseudomonas aeruginosa PA01
cgccggguugcgc

SEQ ID NO: 1499559 - RNA, 21 nt, Pseudomonas aeruginosa PA01
cgccggguugcgccgcaagug

SEQ ID NO: 1499560 - RNA, 21 nt, Pseudomonas aeruginosa PA01
cgccggguguuuuuccucgga

SEQ ID NO: 1499561 - RNA, 21 nt, Pseudomonas aeruginosa PA01
cgccgguaaugaaaagccccg

SEQ ID NO: 1499562 - RNA, 17 nt, Pseudomonas aeruginosa PA01
cgccggguuguccaggc

SEQ ID NO: 1499563 - RNA, 16 nt, Pseudomonas aeruginosa PA01
cgccgguagcggcgca

SEQ ID NO: 1499564 - RNA, 21 nt, Pseudomonas aeruginosa PA01
cgccgguagcggcgcaccgac

SEQ ID NO: 1499565 - RNA, 22 nt, Pseudomonas aeruginosa PA01
cgccgguagcggcgcaccgacg

SEQ ID NO: 1499566 - RNA, 22 nt, Pseudomonas aeruginosa PA01
cgccgguagccguucgacgcug

SEQ ID NO: 1499567 - RNA, 22 nt, Pseudomonas aeruginosa PA01
cgccggggaagauguucgccgc

SEQ ID NO: 1499568 - RNA, 23 nt, Pseudomonas aeruginosa PA01
cgccgggcugccgaacaggcguc

SEQ ID NO: 1499569 - RNA, 18 nt, Pseudomonas aeruginosa PA01
cgccgggcuccagcauca

SEQ ID NO: 1499570 - RNA, 16 nt, Pseudomonas aeruginosa PA01
cgccgggcucagcgcg

SEQ ID NO: 1499571 - RNA, 18 nt, Pseudomonas aeruginosa PA01
cgccgggcuggccgucga

SEQ ID NO: 1499572 - RNA, 21 nt, Pseudomonas aeruginosa PA01
cgccgggcggcgucgcggaga

SEQ ID NO: 1499573 - RNA, 14 nt, Pseudomonas aeruginosa PA01
cgccgggccgccuu

SEQ ID NO: 1499574 - RNA, 18 nt, Pseudomonas aeruginosa PA01
cgccgggccgccuugcgc

SEQ ID NO: 1499575 - RNA, 14 nt, Pseudomonas aeruginosa PA01
cgccgggccucggc

SEQ ID NO: 1499576 - RNA, 15 nt, Pseudomonas aeruginosa PA01
cgccgggccucggca

SEQ ID NO: 1499577 - RNA, 15 nt, Pseudomonas aeruginosa PA01
cgccgggccgcaucg

SEQ ID NO: 1499578 - RNA, 16 nt, Pseudomonas aeruginosa PA01
cgccgggccgcaucgc

SEQ ID NO: 1499579 - RNA, 12 nt, Pseudomonas aeruginosa PA01
cgccgggcgcga

SEQ ID NO: 1499580 - RNA, 13 nt, Pseudomonas aeruginosa PA01
cgccgggcgcgau

SEQ ID NO: 1499581 - RNA, 17 nt, Pseudomonas aeruginosa PA01
cgccgggcgcgaugccg

SEQ ID NO: 1499582 - RNA, 18 nt, Pseudomonas aeruginosa PA01
cgccgggcgcgcgccuca

SEQ ID NO: 1499583 - RNA, 22 nt, Pseudomonas aeruginosa PA01
cgccgggcgcgcgccucagcgg

SEQ ID NO: 1499584 - RNA, 18 nt, Pseudomonas aeruginosa PA01
cgccggucaaccgcgggc

SEQ ID NO: 1499585 - RNA, 23 nt, Pseudomonas aeruginosa PA01
cgccggucaaccgcgggcgaggu

SEQ ID NO: 1499586 - RNA, 18 nt, Pseudomonas aeruginosa PA01
cgccgguaguucgcugac

SEQ ID NO: 1499587 - RNA, 20 nt, Pseudomonas aeruginosa PA01
cgccgguaucccggcugagc

SEQ ID NO: 1499588 - RNA, 16 nt, Pseudomonas aeruginosa PA01
cgccggucaccacugg

SEQ ID NO: 1499589 - RNA, 14 nt, Pseudomonas aeruginosa PA01
cgccggucaggcug

SEQ ID NO: 1499590 - RNA, 19 nt, Pseudomonas aeruginosa PA01
cgccggucaggcugcggcg

SEQ ID NO: 1499591 - RNA, 20 nt, Pseudomonas aeruginosa PA01
cgccggucaggcugcggcgg

SEQ ID NO: 1499592 - RNA, 15 nt, Pseudomonas aeruginosa PA01
cgccggucagguagg

SEQ ID NO: 1499593 - RNA, 19 nt, Pseudomonas aeruginosa PA01
cgccggucagguaggcauc

SEQ ID NO: 1499594 - RNA, 15 nt, Pseudomonas aeruginosa PA01
cgccgguccucgaca

SEQ ID NO: 1499595 - RNA, 15 nt, Pseudomonas aeruginosa PA01
cgccgguuucgaccg

SEQ ID NO: 1499596 - RNA, 19 nt, Pseudomonas aeruginosa PA01
cgccgguuucgaccggcgc

SEQ ID NO: 1499597 - RNA, 21 nt, Pseudomonas aeruginosa PA01
cgccgguuucgaccggcgcgc

SEQ ID NO: 1499598 - RNA, 14 nt, Pseudomonas aeruginosa PA01
cgccggugccagga

SEQ ID NO: 1499599 - RNA, 20 nt, Pseudomonas aeruginosa PA01
cgccggugccaggaccagcc

SEQ ID NO: 1499600 - RNA, 16 nt, Pseudomonas aeruginosa PA01
cgccgguugcugcugc

SEQ ID NO: 1499601 - RNA, 21 nt, Pseudomonas aeruginosa PA01
cgccgguugcugcugcggggc

SEQ ID NO: 1499602 - RNA, 19 nt, Pseudomonas aeruginosa PA01
cgccgguugcugcuugcgc

SEQ ID NO: 1499603 - RNA, 23 nt, Pseudomonas aeruginosa PA01
cgccgguugcugcuugcgcgcgg

SEQ ID NO: 1499604 - RNA, 14 nt, Pseudomonas aeruginosa PA01
cgccggucgcgcuc

SEQ ID NO: 1499605 - RNA, 21 nt, Pseudomonas aeruginosa PA01
cgccggucgcgcucaggcgca

SEQ ID NO: 1499606 - RNA, 22 nt, Pseudomonas aeruginosa PA01
cgccggucgcgcucaggcgcag

SEQ ID NO: 1499607 - RNA, 16 nt, Pseudomonas aeruginosa PA01
cgccggugaggaugcg

SEQ ID NO: 1499608 - RNA, 15 nt, Pseudomonas aeruginosa PA01
cgccggugaggcgca

SEQ ID NO: 1499609 - RNA, 18 nt, Pseudomonas aeruginosa PA01
cgccggugaggcgcagca

SEQ ID NO: 1499610 - RNA, 20 nt, Pseudomonas aeruginosa PA01
cgccggugaggcgcagcagc

SEQ ID NO: 1499611 - RNA, 22 nt, Pseudomonas aeruginosa PA01
cgccggugaggcgcagcagcgc

SEQ ID NO: 1499612 - RNA, 23 nt, Pseudomonas aeruginosa PA01
cgccggugaggcgcagcagcgcc

SEQ ID NO: 1499613 - RNA, 18 nt, Pseudomonas aeruginosa PA01
cgccggugaucgagccgc

SEQ ID NO: 1499614 - RNA, 21 nt, Pseudomonas aeruginosa PA01
cgccggugaucgagccgccgg

SEQ ID NO: 1499615 - RNA, 23 nt, Pseudomonas aeruginosa PA01
cgccggugauguaggacgccucg

SEQ ID NO: 1499616 - RNA, 22 nt, Pseudomonas aeruginosa PA01
cgccggugcaccaggcgaugcg

SEQ ID NO: 1499617 - RNA, 20 nt, Pseudomonas aeruginosa PA01
cgccggugcaugaaggcgcu

SEQ ID NO: 1499618 - RNA, 22 nt, Pseudomonas aeruginosa PA01
cgccguagccgucguagcgcag

SEQ ID NO: 1499619 - RNA, 19 nt, Pseudomonas aeruginosa PA01
cgccguaggccacuucccg

SEQ ID NO: 1499620 - RNA, 23 nt, Pseudomonas aeruginosa PA01
cgccguaggccacuucccggcgc

SEQ ID NO: 1499621 - RNA, 15 nt, Pseudomonas aeruginosa PA01
cgccguacgcaccgc

SEQ ID NO: 1499622 - RNA, 17 nt, Pseudomonas aeruginosa PA01
cgccguacgcaccgcgu

SEQ ID NO: 1499623 - RNA, 15 nt, Pseudomonas aeruginosa PA01
cgccguacagcaggc

SEQ ID NO: 1499624 - RNA, 16 nt, Pseudomonas aeruginosa PA01
cgccguaaccaacagc

SEQ ID NO: 1499625 - RNA, 21 nt, Pseudomonas aeruginosa PA01
cgccguaaccaacagcguuca

SEQ ID NO: 1499626 - RNA, 15 nt, Pseudomonas aeruginosa PA01
cgccguccaccaagc

SEQ ID NO: 1499627 - RNA, 13 nt, Pseudomonas aeruginosa PA01
cgccguccaccag

SEQ ID NO: 1499628 - RNA, 14 nt, Pseudomonas aeruginosa PA01
cgccguccaccagc

SEQ ID NO: 1499629 - RNA, 16 nt, Pseudomonas aeruginosa PA01
cgccguccaccagcca

SEQ ID NO: 1499630 - RNA, 18 nt, Pseudomonas aeruginosa PA01
cgccguccaccagccagc

SEQ ID NO: 1499631 - RNA, 13 nt, Pseudomonas aeruginosa PA01
cgccgucauggcg

SEQ ID NO: 1499632 - RNA, 17 nt, Pseudomonas aeruginosa PA01
cgccgucaucgagcagu

SEQ ID NO: 1499633 - RNA, 20 nt, Pseudomonas aeruginosa PA01
cgccgucaucgcugaccugg

SEQ ID NO: 1499634 - RNA, 18 nt, Pseudomonas aeruginosa PA01
cgccgucgagccagccca

SEQ ID NO: 1499635 - RNA, 24 nt, Pseudomonas aeruginosa PA01
cgccgucgagccagcccagcggcg

SEQ ID NO: 1499636 - RNA, 15 nt, Pseudomonas aeruginosa PA01
cgccguccaucaggc

SEQ ID NO: 1499637 - RNA, 20 nt, Pseudomonas aeruginosa PA01
cgccuucccggucgacggcg

SEQ ID NO: 1499638 - RNA, 18 nt, Pseudomonas aeruginosa PA01
cgccuuccggcagguuca

SEQ ID NO: 1499639 - RNA, 20 nt, Pseudomonas aeruginosa PA01
cgccuuccagcccuucgacg

SEQ ID NO: 1499640 - RNA, 15 nt, Pseudomonas aeruginosa PA01
cgccuucaucgccac

SEQ ID NO: 1499641 - RNA, 16 nt, Pseudomonas aeruginosa PA01
cgccuucaucgccacc

SEQ ID NO: 1499642 - RNA, 14 nt, Pseudomonas aeruginosa PA01
cgccuucagcccca

SEQ ID NO: 1499643 - RNA, 15 nt, Pseudomonas aeruginosa PA01
cgccuucagcgccag

SEQ ID NO: 1499644 - RNA, 14 nt, Pseudomonas aeruginosa PA01
cgccuucagcgccu

SEQ ID NO: 1499645 - RNA, 16 nt, Pseudomonas aeruginosa PA01
cgccuucagcgccucc

SEQ ID NO: 1499646 - RNA, 23 nt, Pseudomonas aeruginosa PA01
cgccuucagcgccuccagcaccg

SEQ ID NO: 1499647 - RNA, 23 nt, Pseudomonas aeruginosa PA01
cgccuguccgggaaugcucagca

SEQ ID NO: 1499648 - RNA, 12 nt, Pseudomonas aeruginosa PA01
cgccugucgcuc

SEQ ID NO: 1499649 - RNA, 16 nt, Pseudomonas aeruginosa PA01
cgccugucgcuccggc

SEQ ID NO: 1499650 - RNA, 17 nt, Pseudomonas aeruginosa PA01
cgccugucgcuccggca

SEQ ID NO: 1499651 - RNA, 13 nt, Pseudomonas aeruginosa PA01
cgccugucggcac

SEQ ID NO: 1499652 - RNA, 15 nt, Pseudomonas aeruginosa PA01
cgccugucggcacga

SEQ ID NO: 1499653 - RNA, 20 nt, Pseudomonas aeruginosa PA01
cgccuguggcguuauucgcc

SEQ ID NO: 1499654 - RNA, 14 nt, Pseudomonas aeruginosa PA01
cgccugguccagca

SEQ ID NO: 1499655 - RNA, 21 nt, Pseudomonas aeruginosa PA01
cgccuggucgaucucgucgaa

SEQ ID NO: 1499656 - RNA, 18 nt, Pseudomonas aeruginosa PA01
cgccuggugcccgaugcc

SEQ ID NO: 1499657 - RNA, 23 nt, Pseudomonas aeruginosa PA01
cgccuggugcccgaugccgcgcc

SEQ ID NO: 1499658 - RNA, 21 nt, Pseudomonas aeruginosa PA01
cgccugguucugcuccggacu

SEQ ID NO: 1499659 - RNA, 19 nt, Pseudomonas aeruginosa PA01
cgccuguaccccguagcgc

SEQ ID NO: 1499660 - RNA, 13 nt, Pseudomonas aeruginosa PA01
cgccuguccaccg

SEQ ID NO: 1499661 - RNA, 19 nt, Pseudomonas aeruginosa PA01
cgccuguccaccgguggcg

SEQ ID NO: 1499662 - RNA, 22 nt, Pseudomonas aeruginosa PA01
cgccuguccaccgguggcgacg

SEQ ID NO: 1499663 - RNA, 16 nt, Pseudomonas aeruginosa PA01
cgccugguaggcggcg

SEQ ID NO: 1499664 - RNA, 17 nt, Pseudomonas aeruginosa PA01
cgccugguaggcggcga

SEQ ID NO: 1499665 - RNA, 18 nt, Pseudomonas aeruginosa PA01
cgccugguaggcggcgac

SEQ ID NO: 1499666 - RNA, 14 nt, Pseudomonas aeruginosa PA01
cgccugggcguaga

SEQ ID NO: 1499667 - RNA, 18 nt, Pseudomonas aeruginosa PA01
cgccugggcggucggcuc

SEQ ID NO: 1499668 - RNA, 20 nt, Pseudomonas aeruginosa PA01
cgccugggcggucggcucag

SEQ ID NO: 1499669 - RNA, 16 nt, Pseudomonas aeruginosa PA01
cgccuggucggcggcc

SEQ ID NO: 1499670 - RNA, 18 nt, Pseudomonas aeruginosa PA01
cgccuggucggggccggc

SEQ ID NO: 1499671 - RNA, 20 nt, Pseudomonas aeruginosa PA01
cgccuggucggggccggcga

SEQ ID NO: 1499672 - RNA, 21 nt, Pseudomonas aeruginosa PA01
cgccuggucggggccggcgau

SEQ ID NO: 1499673 - RNA, 14 nt, Pseudomonas aeruginosa PA01
cgccuggugcaggu

SEQ ID NO: 1499674 - RNA, 17 nt, Pseudomonas aeruginosa PA01
cgccuggugcaggucgc

SEQ ID NO: 1499675 - RNA, 19 nt, Pseudomonas aeruginosa PA01
cgccuggugcaggucgcgc

SEQ ID NO: 1499676 - RNA, 21 nt, Pseudomonas aeruginosa PA01
cgccuggugcaggucgcgcgg

SEQ ID NO: 1499677 - RNA, 18 nt, Pseudomonas aeruginosa PA01
cgccuggaccaggucgag

SEQ ID NO: 1499678 - RNA, 22 nt, Pseudomonas aeruginosa PA01
cgccuggagcagaaccgccagc

SEQ ID NO: 1499679 - RNA, 23 nt, Pseudomonas aeruginosa PA01
cgccuggagcagaaccgccagca

SEQ ID NO: 1499680 - RNA, 15 nt, Pseudomonas aeruginosa PA01
cgccuggaucagcgc

SEQ ID NO: 1499681 - RNA, 22 nt, Pseudomonas aeruginosa PA01
cgccuggaucagcgccucgacc

SEQ ID NO: 1499682 - RNA, 21 nt, Pseudomonas aeruginosa PA01
cgccuggaugaucgcgugggc

SEQ ID NO: 1499683 - RNA, 19 nt, Pseudomonas aeruginosa PA01
cgccuggcaaccgucgaac

SEQ ID NO: 1499684 - RNA, 12 nt, Pseudomonas aeruginosa PA01
cgccuggccgcg

SEQ ID NO: 1499685 - RNA, 16 nt, Pseudomonas aeruginosa PA01
cgccuggcccuggacc

SEQ ID NO: 1499686 - RNA, 14 nt, Pseudomonas aeruginosa PA01
cgccuggaaggcgc

SEQ ID NO: 1499687 - RNA, 17 nt, Pseudomonas aeruginosa PA01
cgccuggaaggcgcugg

SEQ ID NO: 1499688 - RNA, 21 nt, Pseudomonas aeruginosa PA01
cgccuggaaggcgcugggcgg

SEQ ID NO: 1499689 - RNA, 15 nt, Pseudomonas aeruginosa PA01
cgccugcuggccggu

SEQ ID NO: 1499690 - RNA, 19 nt, Pseudomonas aeruginosa PA01
cgccugcuggccggugcca

SEQ ID NO: 1499691 - RNA, 17 nt, Pseudomonas aeruginosa PA01
cgccugcuucagguagu

SEQ ID NO: 1499692 - RNA, 22 nt, Pseudomonas aeruginosa PA01
cgccugcuugaaauggcggacg

SEQ ID NO: 1499693 - RNA, 23 nt, Pseudomonas aeruginosa PA01
cgccugcuugaaauggcggacga

SEQ ID NO: 1499694 - RNA, 15 nt, Pseudomonas aeruginosa PA01
cgccuggcggcuggc

SEQ ID NO: 1499695 - RNA, 16 nt, Pseudomonas aeruginosa PA01
cgccuggcggcuggcg

SEQ ID NO: 1499696 - RNA, 16 nt, Pseudomonas aeruginosa PA01
cgccuggcuggccagc

SEQ ID NO: 1499697 - RNA, 17 nt, Pseudomonas aeruginosa PA01
cgccuggcuggccagca

SEQ ID NO: 1499698 - RNA, 19 nt, Pseudomonas aeruginosa PA01
cgccugggacggaacgucg

SEQ ID NO: 1499699 - RNA, 22 nt, Pseudomonas aeruginosa PA01
cgccugggacggaacgucggcc

SEQ ID NO: 1499700 - RNA, 15 nt, Pseudomonas aeruginosa PA01
cgccugggccgccuc

SEQ ID NO: 1499701 - RNA, 17 nt, Pseudomonas aeruginosa PA01
cgccugggccgccucgc

SEQ ID NO: 1499702 - RNA, 14 nt, Pseudomonas aeruginosa PA01
cgccugggccgcga

SEQ ID NO: 1499703 - RNA, 14 nt, Pseudomonas aeruginosa PA01
cgccugggccgcgc

SEQ ID NO: 1499704 - RNA, 14 nt, Pseudomonas aeruginosa PA01
cgccuggguggcga

SEQ ID NO: 1499705 - RNA, 15 nt, Pseudomonas aeruginosa PA01
cgccuggguggcgac

SEQ ID NO: 1499706 - RNA, 18 nt, Pseudomonas aeruginosa PA01
cgccuggguggcgacgaa

SEQ ID NO: 1499707 - RNA, 22 nt, Pseudomonas aeruginosa PA01
cgccuggguggcgacgaagacg

SEQ ID NO: 1499708 - RNA, 23 nt, Pseudomonas aeruginosa PA01
cgccuggguggcgacgaagacgc

SEQ ID NO: 1499709 - RNA, 15 nt, Pseudomonas aeruginosa PA01
cgccuggccggccag

SEQ ID NO: 1499710 - RNA, 18 nt, Pseudomonas aeruginosa PA01
cgccuggccggccagcca

SEQ ID NO: 1499711 - RNA, 20 nt, Pseudomonas aeruginosa PA01
cgccuggccggccagccagg

SEQ ID NO: 1499712 - RNA, 13 nt, Pseudomonas aeruginosa PA01
cgccuggccgcgc

SEQ ID NO: 1499713 - RNA, 14 nt, Pseudomonas aeruginosa PA01
cgccuggccgcgca

SEQ ID NO: 1499714 - RNA, 18 nt, Pseudomonas aeruginosa PA01
cgccuggccgcgcaggac

SEQ ID NO: 1499715 - RNA, 14 nt, Pseudomonas aeruginosa PA01
cgccuggcgcaacg

SEQ ID NO: 1499716 - RNA, 16 nt, Pseudomonas aeruginosa PA01
cgccuggcgcaacgcc

SEQ ID NO: 1499717 - RNA, 19 nt, Pseudomonas aeruginosa PA01
cgccuggcgcaacgccggc

SEQ ID NO: 1499718 - RNA, 17 nt, Pseudomonas aeruginosa PA01
cgccuggcgcaaggugc

SEQ ID NO: 1499719 - RNA, 18 nt, Pseudomonas aeruginosa PA01
cgccuggcgcgacgaggc

SEQ ID NO: 1499720 - RNA, 20 nt, Pseudomonas aeruginosa PA01
cgccuggcgcgacgaggcgc

SEQ ID NO: 1499721 - RNA, 14 nt, Pseudomonas aeruginosa PA01
cgccuggcgcaugg

SEQ ID NO: 1499722 - RNA, 15 nt, Pseudomonas aeruginosa PA01
cgccuggcgcauggc

SEQ ID NO: 1499723 - RNA, 12 nt, Pseudomonas aeruginosa PA01
cgccuggcguag

SEQ ID NO: 1499724 - RNA, 20 nt, Pseudomonas aeruginosa PA01
cgccuggcguagcguugcgc

SEQ ID NO: 1499725 - RNA, 17 nt, Pseudomonas aeruginosa PA01
cgccuggcgucccguug

SEQ ID NO: 1499726 - RNA, 20 nt, Pseudomonas aeruginosa PA01
cgccuggcgucccguugcgc

SEQ ID NO: 1499727 - RNA, 21 nt, Pseudomonas aeruginosa PA01
cgccuggcgucccguugcgca

SEQ ID NO: 1499728 - RNA, 18 nt, Pseudomonas aeruginosa PA01
cgccuggcgucgaugccg

SEQ ID NO: 1499729 - RNA, 14 nt, Pseudomonas aeruginosa PA01
cgccuggcuggcca

SEQ ID NO: 1499730 - RNA, 20 nt, Pseudomonas aeruginosa PA01
cgccgucgcggccaucggcg

SEQ ID NO: 1499731 - RNA, 14 nt, Pseudomonas aeruginosa PA01
cgccuccagcaccg

SEQ ID NO: 1499732 - RNA, 22 nt, Pseudomonas aeruginosa PA01
cgccgucgccgcugaugcgcug

SEQ ID NO: 1499733 - RNA, 13 nt, Pseudomonas aeruginosa PA01
cgccuccacggcg

SEQ ID NO: 1499734 - RNA, 15 nt, Pseudomonas aeruginosa PA01
cgccuccacggcggc

SEQ ID NO: 1499735 - RNA, 19 nt, Pseudomonas aeruginosa PA01
cgccucccaccgcgcggca

SEQ ID NO: 1499736 - RNA, 22 nt, Pseudomonas aeruginosa PA01
cgccucccaccgcgcggcacag

SEQ ID NO: 1499737 - RNA, 12 nt, Pseudomonas aeruginosa PA01
cgccuccaggcg

SEQ ID NO: 1499738 - RNA, 13 nt, Pseudomonas aeruginosa PA01
cgccuccaggcgc

SEQ ID NO: 1499739 - RNA, 17 nt, Pseudomonas aeruginosa PA01
cgccucccgccaaaugg

SEQ ID NO: 1499740 - RNA, 22 nt, Pseudomonas aeruginosa PA01
cgccuccagcgucugccgcugg

SEQ ID NO: 1499741 - RNA, 16 nt, Pseudomonas aeruginosa PA01
cgccuccucggcggcc

SEQ ID NO: 1499742 - RNA, 13 nt, Pseudomonas aeruginosa PA01
cgccuccgggcgu

SEQ ID NO: 1499743 - RNA, 14 nt, Pseudomonas aeruginosa PA01
cgccuccggcacgc

SEQ ID NO: 1499744 - RNA, 18 nt, Pseudomonas aeruginosa PA01
cgccucgaccucggccgc

SEQ ID NO: 1499745 - RNA, 15 nt, Pseudomonas aeruginosa PA01
cgccucgaccuggcc

SEQ ID NO: 1499746 - RNA, 17 nt, Pseudomonas aeruginosa PA01
cgccucgaccagcgccg

SEQ ID NO: 1499747 - RNA, 18 nt, Pseudomonas aeruginosa PA01
cgccuccucuaccaggcg

SEQ ID NO: 1499748 - RNA, 15 nt, Pseudomonas aeruginosa PA01
cgccucgaaggucag

SEQ ID NO: 1499749 - RNA, 17 nt, Pseudomonas aeruginosa PA01
cgccucgaaggucagcc

SEQ ID NO: 1499750 - RNA, 21 nt, Pseudomonas aeruginosa PA01
cgccucgaaggucagcccgug

SEQ ID NO: 1499751 - RNA, 13 nt, Pseudomonas aeruginosa PA01
cgccucgaccaga

SEQ ID NO: 1499752 - RNA, 13 nt, Pseudomonas aeruginosa PA01
cgccucggcggcu

SEQ ID NO: 1499753 - RNA, 22 nt, Pseudomonas aeruginosa PA01
cgccucggcgggagagggcggc

SEQ ID NO: 1499754 - RNA, 16 nt, Pseudomonas aeruginosa PA01
cgccucgggcgagcgc

SEQ ID NO: 1499755 - RNA, 22 nt, Pseudomonas aeruginosa PA01
cgccuccagguagaccuugccg

SEQ ID NO: 1499756 - RNA, 16 nt, Pseudomonas aeruginosa PA01
cgccucgucgagcgca

SEQ ID NO: 1499757 - RNA, 14 nt, Pseudomonas aeruginosa PA01
cgccucgucgacgc

SEQ ID NO: 1499758 - RNA, 21 nt, Pseudomonas aeruginosa PA01
cgccucgucgacgcccuggcg

SEQ ID NO: 1499759 - RNA, 17 nt, Pseudomonas aeruginosa PA01
cgccucgucgacgcuca

SEQ ID NO: 1499760 - RNA, 18 nt, Pseudomonas aeruginosa PA01
cgccucgucgacgcucag

SEQ ID NO: 1499761 - RNA, 23 nt, Pseudomonas aeruginosa PA01
cgccucgucgacgcucagcaccc

SEQ ID NO: 1499762 - RNA, 17 nt, Pseudomonas aeruginosa PA01
cgccucgucgccaugcg

SEQ ID NO: 1499763 - RNA, 19 nt, Pseudomonas aeruginosa PA01
cgccucgucggaggcgagg

SEQ ID NO: 1499764 - RNA, 23 nt, Pseudomonas aeruginosa PA01
cgccucgugcagcaagccgcagc

SEQ ID NO: 1499765 - RNA, 14 nt, Pseudomonas aeruginosa PA01
cgccugagcuggcc

SEQ ID NO: 1499766 - RNA, 18 nt, Pseudomonas aeruginosa PA01
cgccugagcuggcccagu

SEQ ID NO: 1499767 - RNA, 16 nt, Pseudomonas aeruginosa PA01
cgccugcaacgccagc

SEQ ID NO: 1499768 - RNA, 17 nt, Pseudomonas aeruginosa PA01
cgccugcaacgccagca

SEQ ID NO: 1499769 - RNA, 21 nt, Pseudomonas aeruginosa PA01
cgccugcaacgccagcaggcg

SEQ ID NO: 1499770 - RNA, 22 nt, Pseudomonas aeruginosa PA01
cgccugcaacgccagcaggcgc

SEQ ID NO: 1499771 - RNA, 20 nt, Pseudomonas aeruginosa PA01
cgccugcaacguccucgcgc

SEQ ID NO: 1499772 - RNA, 13 nt, Pseudomonas aeruginosa PA01
cgccugcaacucg

SEQ ID NO: 1499773 - RNA, 20 nt, Pseudomonas aeruginosa PA01
cgccuuuuucauggccuggc

SEQ ID NO: 1499774 - RNA, 21 nt, Pseudomonas aeruginosa PA01
cgccuuuuucauggccuggcg

SEQ ID NO: 1499775 - RNA, 23 nt, Pseudomonas aeruginosa PA01
cgccuuuuucauggccuggcgcu

SEQ ID NO: 1499776 - RNA, 21 nt, Pseudomonas aeruginosa PA01
cgccuuucugcccggcuucgc

SEQ ID NO: 1499777 - RNA, 15 nt, Pseudomonas aeruginosa PA01
cgcgaaagcgccccg

SEQ ID NO: 1499778 - RNA, 21 nt, Pseudomonas aeruginosa PA01
cgccuuuugacuugacccgac

SEQ ID NO: 1499779 - RNA, 24 nt, Pseudomonas aeruginosa PA01
cgccuuuuuucauuucguugcgcu

SEQ ID NO: 1499780 - RNA, 21 nt, Pseudomonas aeruginosa PA01
cgcgaaauggcagaacaucgc

SEQ ID NO: 1499781 - RNA, 19 nt, Pseudomonas aeruginosa PA01
cgcgaacacacccugcgca

SEQ ID NO: 1499782 - RNA, 22 nt, Pseudomonas aeruginosa PA01
cgcgaacacacccugcgcaagg

SEQ ID NO: 1499783 - RNA, 18 nt, Pseudomonas aeruginosa PA01
cgcgaaccgcuggugacg

SEQ ID NO: 1499784 - RNA, 22 nt, Pseudomonas aeruginosa PA01
cgcgaaccgcuggugacgguga

SEQ ID NO: 1499785 - RNA, 16 nt, Pseudomonas aeruginosa PA01
cgcgaacgguccugcg

SEQ ID NO: 1499786 - RNA, 17 nt, Pseudomonas aeruginosa PA01
cgcgaacgguccugcgg

SEQ ID NO: 1499787 - RNA, 20 nt, Pseudomonas aeruginosa PA01
cgcgaacgguccugcggauc

SEQ ID NO: 1499788 - RNA, 19 nt, Pseudomonas aeruginosa PA01
cgcgaacgcucccagccga

SEQ ID NO: 1499789 - RNA, 20 nt, Pseudomonas aeruginosa PA01
cgcgaacgcucccagccgac

SEQ ID NO: 1499790 - RNA, 22 nt, Pseudomonas aeruginosa PA01
cgcgaacgcucccagccgacgu

SEQ ID NO: 1499791 - RNA, 20 nt, Pseudomonas aeruginosa PA01
cgcgaaccacauccuugccg

SEQ ID NO: 1499792 - RNA, 16 nt, Pseudomonas aeruginosa PA01
cgcgaaccagcagcag

SEQ ID NO: 1499793 - RNA, 17 nt, Pseudomonas aeruginosa PA01
cgcgaaccagcagcagg

SEQ ID NO: 1499794 - RNA, 16 nt, Pseudomonas aeruginosa PA01
cgcgaacaguuccgac

SEQ ID NO: 1499795 - RNA, 20 nt, Pseudomonas aeruginosa PA01
cgcgaacaguuccgacugcg

SEQ ID NO: 1499796 - RNA, 23 nt, Pseudomonas aeruginosa PA01
cgcgaacaguuccgacugcgagc

SEQ ID NO: 1499797 - RNA, 21 nt, Pseudomonas aeruginosa PA01
cgccuugagcggcgcccuggc

SEQ ID NO: 1499798 - RNA, 19 nt, Pseudomonas aeruginosa PA01
cgccuugaccucgacgccg

SEQ ID NO: 1499799 - RNA, 20 nt, Pseudomonas aeruginosa PA01
cgccuugaccucgacgccga

SEQ ID NO: 1499800 - RNA, 22 nt, Pseudomonas aeruginosa PA01
cgccuugaccucgacgccgagc

SEQ ID NO: 1499801 - RNA, 14 nt, Pseudomonas aeruginosa PA01
cgccuugaccugcu

SEQ ID NO: 1499802 - RNA, 17 nt, Pseudomonas aeruginosa PA01
cgccuucuuuucuuccg

SEQ ID NO: 1499803 - RNA, 17 nt, Pseudomonas aeruginosa PA01
cgccuugaccagcggcc

SEQ ID NO: 1499804 - RNA, 21 nt, Pseudomonas aeruginosa PA01
cgccuugaccagcggcccggc

SEQ ID NO: 1499805 - RNA, 22 nt, Pseudomonas aeruginosa PA01
cgccuugaccagcggcccggcg

SEQ ID NO: 1499806 - RNA, 22 nt, Pseudomonas aeruginosa PA01
cgccuucugcaauugcuugcgc

SEQ ID NO: 1499807 - RNA, 14 nt, Pseudomonas aeruginosa PA01
cgccuucggcgaca

SEQ ID NO: 1499808 - RNA, 13 nt, Pseudomonas aeruginosa PA01
cgccuucgccgga

SEQ ID NO: 1499809 - RNA, 14 nt, Pseudomonas aeruginosa PA01
cgccuucgcggccg

SEQ ID NO: 1499810 - RNA, 13 nt, Pseudomonas aeruginosa PA01
cgccuucgcgggc

SEQ ID NO: 1499811 - RNA, 12 nt, Pseudomonas aeruginosa PA01
cgccuucggcgu

SEQ ID NO: 1499812 - RNA, 14 nt, Pseudomonas aeruginosa PA01
cgccuucggcgugc

SEQ ID NO: 1499813 - RNA, 20 nt, Pseudomonas aeruginosa PA01
cgccuucggcgugcauggcc

SEQ ID NO: 1499814 - RNA, 16 nt, Pseudomonas aeruginosa PA01
cgccuuccucggccgc

SEQ ID NO: 1499815 - RNA, 20 nt, Pseudomonas aeruginosa PA01
cgccuuccucggccgccagg

SEQ ID NO: 1499816 - RNA, 14 nt, Pseudomonas aeruginosa PA01
cgccuuccucggcg

SEQ ID NO: 1499817 - RNA, 15 nt, Pseudomonas aeruginosa PA01
cgccuuccucggcga

SEQ ID NO: 1499818 - RNA, 16 nt, Pseudomonas aeruginosa PA01
cgccuuccucggcgaa

SEQ ID NO: 1499819 - RNA, 18 nt, Pseudomonas aeruginosa PA01
cgccuuccucggcgauca

SEQ ID NO: 1499820 - RNA, 16 nt, Pseudomonas aeruginosa PA01
cgccuuggcaucgccg

SEQ ID NO: 1499821 - RNA, 19 nt, Pseudomonas aeruginosa PA01
cgccuuggcaucgccgccc

SEQ ID NO: 1499822 - RNA, 22 nt, Pseudomonas aeruginosa PA01
cgccuuggcaucgugcuucuca

SEQ ID NO: 1499823 - RNA, 13 nt, Pseudomonas aeruginosa PA01
cgccuugauggcg

SEQ ID NO: 1499824 - RNA, 14 nt, Pseudomonas aeruginosa PA01
cgccuugcagcacc

SEQ ID NO: 1499825 - RNA, 15 nt, Pseudomonas aeruginosa PA01
cgccuugcccggcgc

SEQ ID NO: 1499826 - RNA, 16 nt, Pseudomonas aeruginosa PA01
cgccuugcccggcgcg

SEQ ID NO: 1499827 - RNA, 18 nt, Pseudomonas aeruginosa PA01
cgccuugcccuggccggc

SEQ ID NO: 1499828 - RNA, 17 nt, Pseudomonas aeruginosa PA01
cgccuugcgcagcaacg

SEQ ID NO: 1499829 - RNA, 15 nt, Pseudomonas aeruginosa PA01
cgccuugcgccaggc

SEQ ID NO: 1499830 - RNA, 16 nt, Pseudomonas aeruginosa PA01
cgccuugcgccaggcc

SEQ ID NO: 1499831 - RNA, 16 nt, Pseudomonas aeruginosa PA01
cgccuugcgcgugcug

SEQ ID NO: 1499832 - RNA, 15 nt, Pseudomonas aeruginosa PA01
cgccuugcggcgccg

SEQ ID NO: 1499833 - RNA, 17 nt, Pseudomonas aeruginosa PA01
cgccuugcggcgccgag

SEQ ID NO: 1499834 - RNA, 18 nt, Pseudomonas aeruginosa PA01
cgccuugcggcgccgagg

SEQ ID NO: 1499835 - RNA, 23 nt, Pseudomonas aeruginosa PA01
cgccuugcggcgccgaggcccua

SEQ ID NO: 1499836 - RNA, 13 nt, Pseudomonas aeruginosa PA01
cgccuugcggggc

SEQ ID NO: 1499837 - RNA, 18 nt, Pseudomonas aeruginosa PA01
cgccuugcggggcggcgc

SEQ ID NO: 1499838 - RNA, 19 nt, Pseudomonas aeruginosa PA01
cgccuugcggggcggcgca

SEQ ID NO: 1499839 - RNA, 22 nt, Pseudomonas aeruginosa PA01
cgccuugcggggcggcgcaucg

SEQ ID NO: 1499840 - RNA, 24 nt, Pseudomonas aeruginosa PA01
cgccuugcgguccagcgagcgggc

SEQ ID NO: 1499841 - RNA, 13 nt, Pseudomonas aeruginosa PA01
cgccuugcguacc

SEQ ID NO: 1499842 - RNA, 20 nt, Pseudomonas aeruginosa PA01
cgccuugcguaccagcgcgc

SEQ ID NO: 1499843 - RNA, 16 nt, Pseudomonas aeruginosa PA01
cgccuugcucgacccg

SEQ ID NO: 1499844 - RNA, 23 nt, Pseudomonas aeruginosa PA01
cgcgaagccaggaagcggcggua

SEQ ID NO: 1499845 - RNA, 14 nt, Pseudomonas aeruginosa PA01
cgcgaagcccagcg

SEQ ID NO: 1499846 - RNA, 15 nt, Pseudomonas aeruginosa PA01
cgcgaagcccagcgc

SEQ ID NO: 1499847 - RNA, 18 nt, Pseudomonas aeruginosa PA01
cgcgaagcccagcgccgc

SEQ ID NO: 1499848 - RNA, 15 nt, Pseudomonas aeruginosa PA01
cgcgaagcgacggcg

SEQ ID NO: 1499849 - RNA, 16 nt, Pseudomonas aeruginosa PA01
cgcgaagcgcagcacg

SEQ ID NO: 1499850 - RNA, 15 nt, Pseudomonas aeruginosa PA01
cgcgaacucggcgcc

SEQ ID NO: 1499851 - RNA, 18 nt, Pseudomonas aeruginosa PA01
cgcgaacucggcgccgau

SEQ ID NO: 1499852 - RNA, 20 nt, Pseudomonas aeruginosa PA01
cgcgaacucggcgccgaucu

SEQ ID NO: 1499853 - RNA, 18 nt, Pseudomonas aeruginosa PA01
cgcgaagaccggccggcu

SEQ ID NO: 1499854 - RNA, 18 nt, Pseudomonas aeruginosa PA01
cgcgaagaacacgcccca

SEQ ID NO: 1499855 - RNA, 20 nt, Pseudomonas aeruginosa PA01
cgcgaauaccgcgcgcgcaa

SEQ ID NO: 1499856 - RNA, 22 nt, Pseudomonas aeruginosa PA01
cgcgaauaccgcgcgcgcaagg

SEQ ID NO: 1499857 - RNA, 15 nt, Pseudomonas aeruginosa PA01
cgcgaauagggcggc

SEQ ID NO: 1499858 - RNA, 21 nt, Pseudomonas aeruginosa PA01
cgcgaauagggcggcgccacc

SEQ ID NO: 1499859 - RNA, 15 nt, Pseudomonas aeruginosa PA01
cgcgaaggcgccuuc

SEQ ID NO: 1499860 - RNA, 19 nt, Pseudomonas aeruginosa PA01
cgcgaaggccacgccgacg

SEQ ID NO: 1499861 - RNA, 21 nt, Pseudomonas aeruginosa PA01
cgcgaaucuucggcgcgccgg

SEQ ID NO: 1499862 - RNA, 21 nt, Pseudomonas aeruginosa PA01
cgcgaaugguucaucuucgcg

SEQ ID NO: 1499863 - RNA, 17 nt, Pseudomonas aeruginosa PA01
cgcgaauccgcggcccu

SEQ ID NO: 1499864 - RNA, 18 nt, Pseudomonas aeruginosa PA01
cgcgaaugcccggcagcg

SEQ ID NO: 1499865 - RNA, 19 nt, Pseudomonas aeruginosa PA01
cgcgaaugcccggcagcgc

SEQ ID NO: 1499866 - RNA, 21 nt, Pseudomonas aeruginosa PA01
cgcgacagcgacucuucaaca

SEQ ID NO: 1499867 - RNA, 13 nt, Pseudomonas aeruginosa PA01
cgcgaccagcgcc

SEQ ID NO: 1499868 - RNA, 14 nt, Pseudomonas aeruginosa PA01
cgcgaccagcgcca

SEQ ID NO: 1499869 - RNA, 17 nt, Pseudomonas aeruginosa PA01
cgcgaccagcgccaggc

SEQ ID NO: 1499870 - RNA, 13 nt, Pseudomonas aeruginosa PA01
cgcgacccaucgc

SEQ ID NO: 1499871 - RNA, 17 nt, Pseudomonas aeruginosa PA01
cgcgacccaucgccgaa

SEQ ID NO: 1499872 - RNA, 14 nt, Pseudomonas aeruginosa PA01
cgcgacccuggccg

SEQ ID NO: 1499873 - RNA, 15 nt, Pseudomonas aeruginosa PA01
cgcgacccuggccgc

SEQ ID NO: 1499874 - RNA, 17 nt, Pseudomonas aeruginosa PA01
cgcgacaguucgccgcc

SEQ ID NO: 1499875 - RNA, 19 nt, Pseudomonas aeruginosa PA01
cgcgacaguucgccgcccg

SEQ ID NO: 1499876 - RNA, 23 nt, Pseudomonas aeruginosa PA01
cgcgacagcucguggcuggcgcc

SEQ ID NO: 1499877 - RNA, 16 nt, Pseudomonas aeruginosa PA01
cgcgaccacaggcggc

SEQ ID NO: 1499878 - RNA, 15 nt, Pseudomonas aeruginosa PA01
cgcgccgauccaggc

SEQ ID NO: 1499879 - RNA, 23 nt, Pseudomonas aeruginosa PA01
cgcgccgauccaggcguggggcg

SEQ ID NO: 1499880 - RNA, 14 nt, Pseudomonas aeruginosa PA01
cgcgccgaccagcc

SEQ ID NO: 1499881 - RNA, 13 nt, Pseudomonas aeruginosa PA01
cgcgccgaacucg

SEQ ID NO: 1499882 - RNA, 12 nt, Pseudomonas aeruginosa PA01
cgcgccgacagc

SEQ ID NO: 1499883 - RNA, 22 nt, Pseudomonas aeruginosa PA01
cgcgccgacagcacgauggcga

SEQ ID NO: 1499884 - RNA, 14 nt, Pseudomonas aeruginosa PA01
cgcgccgaaggcga

SEQ ID NO: 1499885 - RNA, 23 nt, Pseudomonas aeruginosa PA01
cgcgccgaaggcgauauggccga

SEQ ID NO: 1499886 - RNA, 19 nt, Pseudomonas aeruginosa PA01
cgcgcccgccaggucgagg

SEQ ID NO: 1499887 - RNA, 14 nt, Pseudomonas aeruginosa PA01
cgcgcccugcaggc

SEQ ID NO: 1499888 - RNA, 13 nt, Pseudomonas aeruginosa PA01
cgcgccccgccag

SEQ ID NO: 1499889 - RNA, 14 nt, Pseudomonas aeruginosa PA01
cgcgccccugcgcc

SEQ ID NO: 1499890 - RNA, 16 nt, Pseudomonas aeruginosa PA01
cgcgccauuccgcggc

SEQ ID NO: 1499891 - RNA, 17 nt, Pseudomonas aeruginosa PA01
cgcgccauuccgcggca

SEQ ID NO: 1499892 - RNA, 18 nt, Pseudomonas aeruginosa PA01
cgcgccauuccgcggcac

SEQ ID NO: 1499893 - RNA, 20 nt, Pseudomonas aeruginosa PA01
cgcgccauuccgcggcacuc

SEQ ID NO: 1499894 - RNA, 15 nt, Pseudomonas aeruginosa PA01
cgcgccgcgucgccg

SEQ ID NO: 1499895 - RNA, 18 nt, Pseudomonas aeruginosa PA01
cgcgccgcgucgccgcca

SEQ ID NO: 1499896 - RNA, 20 nt, Pseudomonas aeruginosa PA01
cgcgccgcgucgccgccagc

SEQ ID NO: 1499897 - RNA, 13 nt, Pseudomonas aeruginosa PA01
cgcgccggcccgg

SEQ ID NO: 1499898 - RNA, 14 nt, Pseudomonas aeruginosa PA01
cgcgccgcggcggc

SEQ ID NO: 1499899 - RNA, 19 nt, Pseudomonas aeruginosa PA01
cgcgccggcgaucgccagg

SEQ ID NO: 1499900 - RNA, 22 nt, Pseudomonas aeruginosa PA01
cgcgccggcgaucgccaggcga

SEQ ID NO: 1499901 - RNA, 15 nt, Pseudomonas aeruginosa PA01
cgcgccgcgccagca

SEQ ID NO: 1499902 - RNA, 12 nt, Pseudomonas aeruginosa PA01
cgcgccgcgcuu

SEQ ID NO: 1499903 - RNA, 15 nt, Pseudomonas aeruginosa PA01
cgcgccgcgcuuggc

SEQ ID NO: 1499904 - RNA, 23 nt, Pseudomonas aeruginosa PA01
cgcgccgcgcuuggccuugccgu

SEQ ID NO: 1499905 - RNA, 12 nt, Pseudomonas aeruginosa PA01
cgcgccgcggaa

SEQ ID NO: 1499906 - RNA, 21 nt, Pseudomonas aeruginosa PA01
cgcgccgcggaaucgcguagc

SEQ ID NO: 1499907 - RNA, 13 nt, Pseudomonas aeruginosa PA01
cgcgccagcgcca

SEQ ID NO: 1499908 - RNA, 14 nt, Pseudomonas aeruginosa PA01
cgcgccaugccggc

SEQ ID NO: 1499909 - RNA, 15 nt, Pseudomonas aeruginosa PA01
cgcgccaugccggcg

SEQ ID NO: 1499910 - RNA, 13 nt, Pseudomonas aeruginosa PA01
cgcgccagcaccg

SEQ ID NO: 1499911 - RNA, 15 nt, Pseudomonas aeruginosa PA01
cgcgccaucggcggu

SEQ ID NO: 1499912 - RNA, 15 nt, Pseudomonas aeruginosa PA01
cgcgccaucggucgc

SEQ ID NO: 1499913 - RNA, 12 nt, Pseudomonas aeruginosa PA01
cgcgccagcgcc

SEQ ID NO: 1499914 - RNA, 18 nt, Pseudomonas aeruginosa PA01
cgcgccagcaggcgcagc

SEQ ID NO: 1499915 - RNA, 22 nt, Pseudomonas aeruginosa PA01
cgcgccagcaggcgcagcagcg

SEQ ID NO: 1499916 - RNA, 23 nt, Pseudomonas aeruginosa PA01
cgcgccagccaggaagagcccgc

SEQ ID NO: 1499917 - RNA, 20 nt, Pseudomonas aeruginosa PA01
cgcgccagccccaggcgcgg

SEQ ID NO: 1499918 - RNA, 20 nt, Pseudomonas aeruginosa PA01
cgcgccagcacggcgcaggg

SEQ ID NO: 1499919 - RNA, 22 nt, Pseudomonas aeruginosa PA01
cgcgccagcacggcgcagggca

SEQ ID NO: 1499920 - RNA, 21 nt, Pseudomonas aeruginosa PA01
cgcgccagagaucgcccagcg

SEQ ID NO: 1499921 - RNA, 23 nt, Pseudomonas aeruginosa PA01
cgcgccagagaucgcccagcggc

SEQ ID NO: 1499922 - RNA, 15 nt, Pseudomonas aeruginosa PA01
cgcgccacgcucucc

SEQ ID NO: 1499923 - RNA, 15 nt, Pseudomonas aeruginosa PA01
cgcgcaguucagggc

SEQ ID NO: 1499924 - RNA, 18 nt, Pseudomonas aeruginosa PA01
cgcgcaguuccuucaccg

SEQ ID NO: 1499925 - RNA, 15 nt, Pseudomonas aeruginosa PA01
cgcgcaggccgguga

SEQ ID NO: 1499926 - RNA, 22 nt, Pseudomonas aeruginosa PA01
cgcgcauagcaggccuggagcg

SEQ ID NO: 1499927 - RNA, 16 nt, Pseudomonas aeruginosa PA01
cgcgcaggcgcuggcg

SEQ ID NO: 1499928 - RNA, 23 nt, Pseudomonas aeruginosa PA01
cgcgcaguucgucuuccagcggc

SEQ ID NO: 1499929 - RNA, 21 nt, Pseudomonas aeruginosa PA01
cgcgcaucaccccgcaaccgc

SEQ ID NO: 1499930 - RNA, 19 nt, Pseudomonas aeruginosa PA01
cgcgcaucgaugccuugcg

SEQ ID NO: 1499931 - RNA, 15 nt, Pseudomonas aeruginosa PA01
cgcgccacgcaggaa

SEQ ID NO: 1499932 - RNA, 17 nt, Pseudomonas aeruginosa PA01
cgcgcagccacuggcgg

SEQ ID NO: 1499933 - RNA, 15 nt, Pseudomonas aeruginosa PA01
cgcgcagccaggcga

SEQ ID NO: 1499934 - RNA, 16 nt, Pseudomonas aeruginosa PA01
cgcgcagccaggcgag

SEQ ID NO: 1499935 - RNA, 17 nt, Pseudomonas aeruginosa PA01
cgcgcagccaggcgagg

SEQ ID NO: 1499936 - RNA, 16 nt, Pseudomonas aeruginosa PA01
cgcgcagcagguagug

SEQ ID NO: 1499937 - RNA, 15 nt, Pseudomonas aeruginosa PA01
cgcgcagcaguaccu

SEQ ID NO: 1499938 - RNA, 13 nt, Pseudomonas aeruginosa PA01
cgcgcagcaggcg

SEQ ID NO: 1499939 - RNA, 20 nt, Pseudomonas aeruginosa PA01
cgcgcaggaagaaggcgucc

SEQ ID NO: 1499940 - RNA, 13 nt, Pseudomonas aeruginosa PA01
cgcgcaggaccug

SEQ ID NO: 1499941 - RNA, 18 nt, Pseudomonas aeruginosa PA01
cgcgcaggacggauaacg

SEQ ID NO: 1499942 - RNA, 22 nt, Pseudomonas aeruginosa PA01
cgcgcagcuugccuuccaggcu

SEQ ID NO: 1499943 - RNA, 15 nt, Pseudomonas aeruginosa PA01
cgcgcagcuccucgg

SEQ ID NO: 1499944 - RNA, 16 nt, Pseudomonas aeruginosa PA01
cgcgcagcuccucggc

SEQ ID NO: 1499945 - RNA, 20 nt, Pseudomonas aeruginosa PA01
cgcgcagcugguaggagccg

SEQ ID NO: 1499946 - RNA, 17 nt, Pseudomonas aeruginosa PA01
cgcgcagcucggccaac

SEQ ID NO: 1499947 - RNA, 14 nt, Pseudomonas aeruginosa PA01
cgcgcagcaacggc

SEQ ID NO: 1499948 - RNA, 15 nt, Pseudomonas aeruginosa PA01
cgcgcagcaacggcg

SEQ ID NO: 1499949 - RNA, 13 nt, Pseudomonas aeruginosa PA01
cgcgcagaugauc

SEQ ID NO: 1499950 - RNA, 14 nt, Pseudomonas aeruginosa PA01
cgcgcagaugaucg

SEQ ID NO: 1499951 - RNA, 17 nt, Pseudomonas aeruginosa PA01
cgcgcagaugaucgcca

SEQ ID NO: 1499952 - RNA, 19 nt, Pseudomonas aeruginosa PA01
cgcgcagaugaucgccacc

SEQ ID NO: 1499953 - RNA, 21 nt, Pseudomonas aeruginosa PA01
cgcgcagaugaucgccaccgg

SEQ ID NO: 1499954 - RNA, 15 nt, Pseudomonas aeruginosa PA01
cgcgcagauagucga

SEQ ID NO: 1499955 - RNA, 20 nt, Pseudomonas aeruginosa PA01
cgcgcagauagucgaaguac

SEQ ID NO: 1499956 - RNA, 15 nt, Pseudomonas aeruginosa PA01
cgcgcagaccaucag

SEQ ID NO: 1499957 - RNA, 22 nt, Pseudomonas aeruginosa PA01
cgcgcagaccaucagcuggauc

SEQ ID NO: 1499958 - RNA, 21 nt, Pseudomonas aeruginosa PA01
cgcgcagacgauugaccuccc

SEQ ID NO: 1499959 - RNA, 22 nt, Pseudomonas aeruginosa PA01
cgcgcagacgauugaccucccg

SEQ ID NO: 1499960 - RNA, 14 nt, Pseudomonas aeruginosa PA01
cgcgcaccgcggcg

SEQ ID NO: 1499961 - RNA, 17 nt, Pseudomonas aeruginosa PA01
cgcgcaccgcggcgagc

SEQ ID NO: 1499962 - RNA, 12 nt, Pseudomonas aeruginosa PA01
cgcgcaccgcgg

SEQ ID NO: 1499963 - RNA, 14 nt, Pseudomonas aeruginosa PA01
cgcgcaccuggcgg

SEQ ID NO: 1499964 - RNA, 18 nt, Pseudomonas aeruginosa PA01
cgcgcaccuggcggucgc

SEQ ID NO: 1499965 - RNA, 22 nt, Pseudomonas aeruginosa PA01
cgcgcaccuggcggucgccgcc

SEQ ID NO: 1499966 - RNA, 17 nt, Pseudomonas aeruginosa PA01
cgcgcaccucgaccgcg

SEQ ID NO: 1499967 - RNA, 13 nt, Pseudomonas aeruginosa PA01
cgcgcaccuggcg

SEQ ID NO: 1499968 - RNA, 19 nt, Pseudomonas aeruginosa PA01
cgcgcaccugggcguuggc

SEQ ID NO: 1499969 - RNA, 18 nt, Pseudomonas aeruginosa PA01
cgcgcaaccguuccagcg

SEQ ID NO: 1499970 - RNA, 19 nt, Pseudomonas aeruginosa PA01
cgcgcaaccguuccagcgc

SEQ ID NO: 1499971 - RNA, 12 nt, Pseudomonas aeruginosa PA01
cgcgcaacgccg

SEQ ID NO: 1499972 - RNA, 16 nt, Pseudomonas aeruginosa PA01
cgcgcaaccagccgga

SEQ ID NO: 1499973 - RNA, 17 nt, Pseudomonas aeruginosa PA01
cgcgauguuggcgucga

SEQ ID NO: 1499974 - RNA, 14 nt, Pseudomonas aeruginosa PA01
cgcgauugcagcuc

SEQ ID NO: 1499975 - RNA, 23 nt, Pseudomonas aeruginosa PA01
cgcgauugcagcuccuggucgcg

SEQ ID NO: 1499976 - RNA, 15 nt, Pseudomonas aeruginosa PA01
cgcgauucgccgggc

SEQ ID NO: 1499977 - RNA, 16 nt, Pseudomonas aeruginosa PA01
cgcgauucgccgggcu

SEQ ID NO: 1499978 - RNA, 16 nt, Pseudomonas aeruginosa PA01
cgcgcaaaccggcagc

SEQ ID NO: 1499979 - RNA, 19 nt, Pseudomonas aeruginosa PA01
cgcgcaaaccggcagcauc

SEQ ID NO: 1499980 - RNA, 14 nt, Pseudomonas aeruginosa PA01
cgcgaggucucgau

SEQ ID NO: 1499981 - RNA, 18 nt, Pseudomonas aeruginosa PA01
cgcgaggucucgauggug

SEQ ID NO: 1499982 - RNA, 21 nt, Pseudomonas aeruginosa PA01
cgcgaggucugugccgugauc

SEQ ID NO: 1499983 - RNA, 20 nt, Pseudomonas aeruginosa PA01
cgcgagguuccgcggcgacg

SEQ ID NO: 1499984 - RNA, 12 nt, Pseudomonas aeruginosa PA01
cgcgaucaccgc

SEQ ID NO: 1499985 - RNA, 22 nt, Pseudomonas aeruginosa PA01
cgcgaguccuucggcgcauagc

SEQ ID NO: 1499986 - RNA, 13 nt, Pseudomonas aeruginosa PA01
cgcgaucagccgc

SEQ ID NO: 1499987 - RNA, 14 nt, Pseudomonas aeruginosa PA01
cgcgaguucgccgg

SEQ ID NO: 1499988 - RNA, 15 nt, Pseudomonas aeruginosa PA01
cgcgaucggcguccg

SEQ ID NO: 1499989 - RNA, 23 nt, Pseudomonas aeruginosa PA01
cgcgaucggcguccgcggccugc

SEQ ID NO: 1499990 - RNA, 14 nt, Pseudomonas aeruginosa PA01
cgcgauccaccgcc

SEQ ID NO: 1499991 - RNA, 17 nt, Pseudomonas aeruginosa PA01
cgcgauccaccgccagg

SEQ ID NO: 1499992 - RNA, 22 nt, Pseudomonas aeruginosa PA01
cgcgauccaccgccagggcgcu

SEQ ID NO: 1499993 - RNA, 19 nt, Pseudomonas aeruginosa PA01
cgcgaucgcggccagccgc

SEQ ID NO: 1499994 - RNA, 23 nt, Pseudomonas aeruginosa PA01
cgcgaugguaguccgcugcgagc

SEQ ID NO: 1499995 - RNA, 13 nt, Pseudomonas aeruginosa PA01
cgcgaugguaugg

SEQ ID NO: 1499996 - RNA, 22 nt, Pseudomonas aeruginosa PA01
cgcgaugguauggcggucggcc

SEQ ID NO: 1499997 - RNA, 23 nt, Pseudomonas aeruginosa PA01
cgcgaucucuacuaccgccagcg

SEQ ID NO: 1499998 - RNA, 15 nt, Pseudomonas aeruginosa PA01
cgcgagcgcggccgg

SEQ ID NO: 1499999 - RNA, 16 nt, Pseudomonas aeruginosa PA01
cgcgagcgcggccggc

SEQ ID NO: 1500000 - RNA, 14 nt, Pseudomonas aeruginosa PA01
cgcgagcuggcgcc

SEQ ID NO: 1500001 - RNA, 22 nt, Pseudomonas aeruginosa PA01
cgcgagcuggcgccgucaucgc

SEQ ID NO: 1500002 - RNA, 17 nt, Pseudomonas aeruginosa PA01
cgcgaggagccguaggg

SEQ ID NO: 1500003 - RNA, 20 nt, Pseudomonas aeruginosa PA01
cgcgaggagccguagggcgc

SEQ ID NO: 1500004 - RNA, 21 nt, Pseudomonas aeruginosa PA01
cgcgaggagccguagggcgca

SEQ ID NO: 1500005 - RNA, 22 nt, Pseudomonas aeruginosa PA01
cgcgaggggaacauugccacca

SEQ ID NO: 1500006 - RNA, 21 nt, Pseudomonas aeruginosa PA01
cgcgagggggccucggccagc

SEQ ID NO: 1500007 - RNA, 19 nt, Pseudomonas aeruginosa PA01
cgcgaggcguucgucgacc

SEQ ID NO: 1500008 - RNA, 15 nt, Pseudomonas aeruginosa PA01
cgcgaggcgcucuuc

SEQ ID NO: 1500009 - RNA, 23 nt, Pseudomonas aeruginosa PA01
cgcgaggcgcucuucacuuccag

SEQ ID NO: 1500010 - RNA, 13 nt, Pseudomonas aeruginosa PA01
cgcgaggaucagc

SEQ ID NO: 1500011 - RNA, 18 nt, Pseudomonas aeruginosa PA01
cgcgaggcgcccgccggc

SEQ ID NO: 1500012 - RNA, 20 nt, Pseudomonas aeruginosa PA01
cgcgaggcgcccgccggccg

SEQ ID NO: 1500013 - RNA, 12 nt, Pseudomonas aeruginosa PA01
cgcgaggccggc

SEQ ID NO: 1500014 - RNA, 20 nt, Pseudomonas aeruginosa PA01
cgcgaggccguaccagucgc

SEQ ID NO: 1500015 - RNA, 12 nt, Pseudomonas aeruginosa PA01
cgcgaggcgagu

SEQ ID NO: 1500016 - RNA, 19 nt, Pseudomonas aeruginosa PA01
cgcgaggcgaguaccaccg

SEQ ID NO: 1500017 - RNA, 13 nt, Pseudomonas aeruginosa PA01
cgcgaggcgcagg

SEQ ID NO: 1500018 - RNA, 21 nt, Pseudomonas aeruginosa PA01
cgcgagccuucagcacggcgc

SEQ ID NO: 1500019 - RNA, 23 nt, Pseudomonas aeruginosa PA01
cgcgagccuucagcacggcgcgg

SEQ ID NO: 1500020 - RNA, 13 nt, Pseudomonas aeruginosa PA01
cgcgagcgccgcc

SEQ ID NO: 1500021 - RNA, 15 nt, Pseudomonas aeruginosa PA01
cgcgagcgccgccgg

SEQ ID NO: 1500022 - RNA, 13 nt, Pseudomonas aeruginosa PA01
cgcgagccguccu

SEQ ID NO: 1500023 - RNA, 14 nt, Pseudomonas aeruginosa PA01
cgcgagccguccug

SEQ ID NO: 1500024 - RNA, 16 nt, Pseudomonas aeruginosa PA01
cgcgagccguccugcg

SEQ ID NO: 1500025 - RNA, 20 nt, Pseudomonas aeruginosa PA01
cgcgagccguccugcggccg

SEQ ID NO: 1500026 - RNA, 22 nt, Pseudomonas aeruginosa PA01
cgcgagccguccugcggccgca

SEQ ID NO: 1500027 - RNA, 24 nt, Pseudomonas aeruginosa PA01
cgcgagcaugcucacugcgagcac

SEQ ID NO: 1500028 - RNA, 14 nt, Pseudomonas aeruginosa PA01
cgcgagccagccgu

SEQ ID NO: 1500029 - RNA, 13 nt, Pseudomonas aeruginosa PA01
cgcgaccgucggc

SEQ ID NO: 1500030 - RNA, 13 nt, Pseudomonas aeruginosa PA01
cgcgaccuccggc

SEQ ID NO: 1500031 - RNA, 15 nt, Pseudomonas aeruginosa PA01
cgcgaccuccggcgc

SEQ ID NO: 1500032 - RNA, 19 nt, Pseudomonas aeruginosa PA01
cgcgaccuccggcgccagg

SEQ ID NO: 1500033 - RNA, 22 nt, Pseudomonas aeruginosa PA01
cgcgaccuccggcgccaggccc

SEQ ID NO: 1500034 - RNA, 14 nt, Pseudomonas aeruginosa PA01
cgcgaccugcucgu

SEQ ID NO: 1500035 - RNA, 23 nt, Pseudomonas aeruginosa PA01
cgcgaccugcucgucgaugcugc

SEQ ID NO: 1500036 - RNA, 17 nt, Pseudomonas aeruginosa PA01
cgcgacgaggcgcggcg

SEQ ID NO: 1500037 - RNA, 22 nt, Pseudomonas aeruginosa PA01
cgcgacgaggcgcggcggaggc

SEQ ID NO: 1500038 - RNA, 16 nt, Pseudomonas aeruginosa PA01
cgcgacgacugcggca

SEQ ID NO: 1500039 - RNA, 12 nt, Pseudomonas aeruginosa PA01
cgcgacgcgacc

SEQ ID NO: 1500040 - RNA, 17 nt, Pseudomonas aeruginosa PA01
cgcgacgcgaccuccgg

SEQ ID NO: 1500041 - RNA, 15 nt, Pseudomonas aeruginosa PA01
cgcgacgcgcuggac

SEQ ID NO: 1500042 - RNA, 20 nt, Pseudomonas aeruginosa PA01
cgcgacgcuacguuccaggg

SEQ ID NO: 1500043 - RNA, 13 nt, Pseudomonas aeruginosa PA01
cgcgacgcuccag

SEQ ID NO: 1500044 - RNA, 17 nt, Pseudomonas aeruginosa PA01
cgcgacgcuccagcggc

SEQ ID NO: 1500045 - RNA, 22 nt, Pseudomonas aeruginosa PA01
cgcgacgcuccagcggcagcuc

SEQ ID NO: 1500046 - RNA, 18 nt, Pseudomonas aeruginosa PA01
cgcgacgcuccaggugca

SEQ ID NO: 1500047 - RNA, 21 nt, Pseudomonas aeruginosa PA01
cgcggaugucgggcucgacga

SEQ ID NO: 1500048 - RNA, 19 nt, Pseudomonas aeruginosa PA01
cgcggauguucgccacgcu

SEQ ID NO: 1500049 - RNA, 14 nt, Pseudomonas aeruginosa PA01
cgcggauuggccgg

SEQ ID NO: 1500050 - RNA, 20 nt, Pseudomonas aeruginosa PA01
cgcggauuggccgggccgau

SEQ ID NO: 1500051 - RNA, 12 nt, Pseudomonas aeruginosa PA01
cgcggcacagcg

SEQ ID NO: 1500052 - RNA, 19 nt, Pseudomonas aeruginosa PA01
cgcggcacagcguggccag

SEQ ID NO: 1500053 - RNA, 21 nt, Pseudomonas aeruginosa PA01
cgcggcacagcguggccagcg

SEQ ID NO: 1500054 - RNA, 17 nt, Pseudomonas aeruginosa PA01
cgcggcaaccuguggaa

SEQ ID NO: 1500055 - RNA, 16 nt, Pseudomonas aeruginosa PA01
cgcggcaaugcggcga

SEQ ID NO: 1500056 - RNA, 17 nt, Pseudomonas aeruginosa PA01
cgcggcaaugcggcgau

SEQ ID NO: 1500057 - RNA, 18 nt, Pseudomonas aeruginosa PA01
cgcggcaaugcggcgaug

SEQ ID NO: 1500058 - RNA, 22 nt, Pseudomonas aeruginosa PA01
cgcggauccccucccgcgccag

SEQ ID NO: 1500059 - RNA, 15 nt, Pseudomonas aeruginosa PA01
cgcggauccacgccu

SEQ ID NO: 1500060 - RNA, 16 nt, Pseudomonas aeruginosa PA01
cgcggauccacgccug

SEQ ID NO: 1500061 - RNA, 14 nt, Pseudomonas aeruginosa PA01
cgcggaucgcgccg

SEQ ID NO: 1500062 - RNA, 13 nt, Pseudomonas aeruginosa PA01
cgcggaucugcuc

SEQ ID NO: 1500063 - RNA, 23 nt, Pseudomonas aeruginosa PA01
cgcggaucuggcccuuuuccucg

SEQ ID NO: 1500064 - RNA, 14 nt, Pseudomonas aeruginosa PA01
cgcggaugcccugg

SEQ ID NO: 1500065 - RNA, 19 nt, Pseudomonas aeruginosa PA01
cgcggaugcccuggucggc

SEQ ID NO: 1500066 - RNA, 16 nt, Pseudomonas aeruginosa PA01
cgcggaugaccuucgg

SEQ ID NO: 1500067 - RNA, 21 nt, Pseudomonas aeruginosa PA01
cgcggcaccgcuuucguaggg

SEQ ID NO: 1500068 - RNA, 16 nt, Pseudomonas aeruginosa PA01
cgcggcagcaccaggc

SEQ ID NO: 1500069 - RNA, 21 nt, Pseudomonas aeruginosa PA01
cgcggcagcagccaaccgucg

SEQ ID NO: 1500070 - RNA, 13 nt, Pseudomonas aeruginosa PA01
cgcggcagcaggc

SEQ ID NO: 1500071 - RNA, 16 nt, Pseudomonas aeruginosa PA01
cgcggcagcaggcggg

SEQ ID NO: 1500072 - RNA, 12 nt, Pseudomonas aeruginosa PA01
cgcggcaggggc

SEQ ID NO: 1500073 - RNA, 20 nt, Pseudomonas aeruginosa PA01
cgcggcauagaugccggccu

SEQ ID NO: 1500074 - RNA, 15 nt, Pseudomonas aeruginosa PA01
cgcggcaggaucagg

SEQ ID NO: 1500075 - RNA, 17 nt, Pseudomonas aeruginosa PA01
cgcggcaggcggcggcg

SEQ ID NO: 1500076 - RNA, 15 nt, Pseudomonas aeruginosa PA01
cgcggcagcgccauc

SEQ ID NO: 1500077 - RNA, 19 nt, Pseudomonas aeruginosa PA01
cgcggcaggaaauccgccg

SEQ ID NO: 1500078 - RNA, 21 nt, Pseudomonas aeruginosa PA01
cgcggcaggaaauccgccgcg

SEQ ID NO: 1500079 - RNA, 15 nt, Pseudomonas aeruginosa PA01
cgcggcaucggccug

SEQ ID NO: 1500080 - RNA, 14 nt, Pseudomonas aeruginosa PA01
cgcggcaucccgcc

SEQ ID NO: 1500081 - RNA, 15 nt, Pseudomonas aeruginosa PA01
cgcggcaucccgccc

SEQ ID NO: 1500082 - RNA, 22 nt, Pseudomonas aeruginosa PA01
cgcggaccuugucgccggugag

SEQ ID NO: 1500083 - RNA, 15 nt, Pseudomonas aeruginosa PA01
cgcggacgauggucg

SEQ ID NO: 1500084 - RNA, 20 nt, Pseudomonas aeruginosa PA01
cgcggacgauggucgccgcg

SEQ ID NO: 1500085 - RNA, 16 nt, Pseudomonas aeruginosa PA01
cgcggacgaaccccgg

SEQ ID NO: 1500086 - RNA, 16 nt, Pseudomonas aeruginosa PA01
cgcggacgggccgcgc

SEQ ID NO: 1500087 - RNA, 18 nt, Pseudomonas aeruginosa PA01
cgcggacgggccgcgccg

SEQ ID NO: 1500088 - RNA, 14 nt, Pseudomonas aeruginosa PA01
cgcggacggccggc

SEQ ID NO: 1500089 - RNA, 13 nt, Pseudomonas aeruginosa PA01
cgcggacggccug

SEQ ID NO: 1500090 - RNA, 15 nt, Pseudomonas aeruginosa PA01
cgcggacgcuggcga

SEQ ID NO: 1500091 - RNA, 17 nt, Pseudomonas aeruginosa PA01
cgcggacgcuggcgauc

SEQ ID NO: 1500092 - RNA, 16 nt, Pseudomonas aeruginosa PA01
cgcggaauccuucgcg

SEQ ID NO: 1500093 - RNA, 21 nt, Pseudomonas aeruginosa PA01
cgcggaauccuucgcggcggc

SEQ ID NO: 1500094 - RNA, 22 nt, Pseudomonas aeruginosa PA01
cgcggaauccuucgcggcggcg

SEQ ID NO: 1500095 - RNA, 23 nt, Pseudomonas aeruginosa PA01
cgcggaauacguacucgucgcuc

SEQ ID NO: 1500096 - RNA, 18 nt, Pseudomonas aeruginosa PA01
cgcggaaggcccgcgagc

SEQ ID NO: 1500097 - RNA, 22 nt, Pseudomonas aeruginosa PA01
cgcggaaggcccgcgagccgcg

SEQ ID NO: 1500098 - RNA, 15 nt, Pseudomonas aeruginosa PA01
cgcggaaggcgucga

SEQ ID NO: 1500099 - RNA, 21 nt, Pseudomonas aeruginosa PA01
cgcggaaguaggcggcggagu

SEQ ID NO: 1500100 - RNA, 15 nt, Pseudomonas aeruginosa PA01
cgcggaagucggcgg

SEQ ID NO: 1500101 - RNA, 16 nt, Pseudomonas aeruginosa PA01
cgcggaagucggcggg

SEQ ID NO: 1500102 - RNA, 12 nt, Pseudomonas aeruginosa PA01
cgcggaaucgcg

SEQ ID NO: 1500103 - RNA, 13 nt, Pseudomonas aeruginosa PA01
cgcggaauggcgc

SEQ ID NO: 1500104 - RNA, 14 nt, Pseudomonas aeruginosa PA01
cgcggaauggcgcg

SEQ ID NO: 1500105 - RNA, 19 nt, Pseudomonas aeruginosa PA01
cgcggacaccgcggugucg

SEQ ID NO: 1500106 - RNA, 15 nt, Pseudomonas aeruginosa PA01
cgcgcuuuccggcgc

SEQ ID NO: 1500107 - RNA, 15 nt, Pseudomonas aeruginosa PA01
cgcggacaagcccag

SEQ ID NO: 1500108 - RNA, 13 nt, Pseudomonas aeruginosa PA01
cgcggacaccgcg

SEQ ID NO: 1500109 - RNA, 14 nt, Pseudomonas aeruginosa PA01
cgcggacaccgcgg

SEQ ID NO: 1500110 - RNA, 17 nt, Pseudomonas aeruginosa PA01
cgcggacagccugggcg

SEQ ID NO: 1500111 - RNA, 16 nt, Pseudomonas aeruginosa PA01
cgcggagaggaucagc

SEQ ID NO: 1500112 - RNA, 18 nt, Pseudomonas aeruginosa PA01
cgcggagcaggcggagau

SEQ ID NO: 1500113 - RNA, 21 nt, Pseudomonas aeruginosa PA01
cgcggagcguccaccagcgcc

SEQ ID NO: 1500114 - RNA, 22 nt, Pseudomonas aeruginosa PA01
cgcggagcguccaccagcgccc

SEQ ID NO: 1500115 - RNA, 23 nt, Pseudomonas aeruginosa PA01
cgcggagaauccgcucggugccu

SEQ ID NO: 1500116 - RNA, 18 nt, Pseudomonas aeruginosa PA01
cgcggauacggcaggggc

SEQ ID NO: 1500117 - RNA, 18 nt, Pseudomonas aeruginosa PA01
cgcggaucaccuggccgu

SEQ ID NO: 1500118 - RNA, 19 nt, Pseudomonas aeruginosa PA01
cgcggauaucgcuggcgcc

SEQ ID NO: 1500119 - RNA, 21 nt, Pseudomonas aeruginosa PA01
cgcggauaucgcuggcgccca

SEQ ID NO: 1500120 - RNA, 16 nt, Pseudomonas aeruginosa PA01
cgcgccggcggggaag

SEQ ID NO: 1500121 - RNA, 22 nt, Pseudomonas aeruginosa PA01
cgcgccggcggggaagccuucg

SEQ ID NO: 1500122 - RNA, 15 nt, Pseudomonas aeruginosa PA01
cgcgcuggucguagg

SEQ ID NO: 1500123 - RNA, 20 nt, Pseudomonas aeruginosa PA01
cgcgcuggucguucucgcgc

SEQ ID NO: 1500124 - RNA, 14 nt, Pseudomonas aeruginosa PA01
cgcgcuggucgacg

SEQ ID NO: 1500125 - RNA, 19 nt, Pseudomonas aeruginosa PA01
cgcgccgggcucagcgcgc

SEQ ID NO: 1500126 - RNA, 20 nt, Pseudomonas aeruginosa PA01
cgcgccgggcucagcgcgcg

SEQ ID NO: 1500127 - RNA, 14 nt, Pseudomonas aeruginosa PA01
cgcgccgggcuggc

SEQ ID NO: 1500128 - RNA, 15 nt, Pseudomonas aeruginosa PA01
cgcgccgggcuggcc

SEQ ID NO: 1500129 - RNA, 20 nt, Pseudomonas aeruginosa PA01
cgcgccgggcuggccgucga

SEQ ID NO: 1500130 - RNA, 14 nt, Pseudomonas aeruginosa PA01
cgcgccggggcagc

SEQ ID NO: 1500131 - RNA, 15 nt, Pseudomonas aeruginosa PA01
cgcgcuguagccggc

SEQ ID NO: 1500132 - RNA, 19 nt, Pseudomonas aeruginosa PA01
cgcgcuguagccggcgccg

SEQ ID NO: 1500133 - RNA, 21 nt, Pseudomonas aeruginosa PA01
cgcgcugguuuagcucggcga

SEQ ID NO: 1500134 - RNA, 17 nt, Pseudomonas aeruginosa PA01
cgcgcugucggccucga

SEQ ID NO: 1500135 - RNA, 19 nt, Pseudomonas aeruginosa PA01
cgcgcugucggccucgacg

SEQ ID NO: 1500136 - RNA, 14 nt, Pseudomonas aeruginosa PA01
cgcgcuuggacagc

SEQ ID NO: 1500137 - RNA, 15 nt, Pseudomonas aeruginosa PA01
cgcgcuuggccuugc

SEQ ID NO: 1500138 - RNA, 23 nt, Pseudomonas aeruginosa PA01
cgcgcuuggccuugccguccagc

SEQ ID NO: 1500139 - RNA, 18 nt, Pseudomonas aeruginosa PA01
cgcgcuugccgucgcgga

SEQ ID NO: 1500140 - RNA, 22 nt, Pseudomonas aeruginosa PA01
cgcgcuguugccgcgcuugccg

SEQ ID NO: 1500141 - RNA, 15 nt, Pseudomonas aeruginosa PA01
cgcgcuuccaggcac

SEQ ID NO: 1500142 - RNA, 16 nt, Pseudomonas aeruginosa PA01
cgcgcuuccgcaucgg

SEQ ID NO: 1500143 - RNA, 19 nt, Pseudomonas aeruginosa PA01
cgcgcuuccgcaucggccg

SEQ ID NO: 1500144 - RNA, 20 nt, Pseudomonas aeruginosa PA01
cgcgcuuccgcaucggccga

SEQ ID NO: 1500145 - RNA, 13 nt, Pseudomonas aeruginosa PA01
cgcgcuucuucga

SEQ ID NO: 1500146 - RNA, 11 nt, Pseudomonas aeruginosa PA01
cgcgcuugagc

SEQ ID NO: 1500147 - RNA, 16 nt, Pseudomonas aeruginosa PA01
cgcgcuugacgacugc

SEQ ID NO: 1500148 - RNA, 13 nt, Pseudomonas aeruginosa PA01
cgcggcuccagcc

SEQ ID NO: 1500149 - RNA, 18 nt, Pseudomonas aeruginosa PA01
cgcggcuccagccgcugc

SEQ ID NO: 1500150 - RNA, 16 nt, Pseudomonas aeruginosa PA01
cgcggcugaucggccg

SEQ ID NO: 1500151 - RNA, 18 nt, Pseudomonas aeruginosa PA01
cgcggcugaucggccgcc

SEQ ID NO: 1500152 - RNA, 17 nt, Pseudomonas aeruginosa PA01
cgcggcugaugccgcgg

SEQ ID NO: 1500153 - RNA, 21 nt, Pseudomonas aeruginosa PA01
cgcggcugaugccgcgguagg

SEQ ID NO: 1500154 - RNA, 15 nt, Pseudomonas aeruginosa PA01
cgcggcucuggcgca

SEQ ID NO: 1500155 - RNA, 17 nt, Pseudomonas aeruginosa PA01
cgcggcucuggcgcagg

SEQ ID NO: 1500156 - RNA, 12 nt, Pseudomonas aeruginosa PA01
cgcggcugaaga

SEQ ID NO: 1500157 - RNA, 13 nt, Pseudomonas aeruginosa PA01
cgcggcugaaggc

SEQ ID NO: 1500158 - RNA, 21 nt, Pseudomonas aeruginosa PA01
cgcggcugacgaaguccuugu

SEQ ID NO: 1500159 - RNA, 21 nt, Pseudomonas aeruginosa PA01
cgcggcugacgaagugaugga

SEQ ID NO: 1500160 - RNA, 16 nt, Pseudomonas aeruginosa PA01
cgcggcuggcgcagga

SEQ ID NO: 1500161 - RNA, 22 nt, Pseudomonas aeruginosa PA01
cgcggcuggcgcaggaccgcca

SEQ ID NO: 1500162 - RNA, 16 nt, Pseudomonas aeruginosa PA01
cgcggcuggcugcccu

SEQ ID NO: 1500163 - RNA, 19 nt, Pseudomonas aeruginosa PA01
cgcgggauagacggcggau

SEQ ID NO: 1500164 - RNA, 12 nt, Pseudomonas aeruginosa PA01
cgcggcuggugc

SEQ ID NO: 1500165 - RNA, 15 nt, Pseudomonas aeruginosa PA01
cgcggcuucggucag

SEQ ID NO: 1500166 - RNA, 17 nt, Pseudomonas aeruginosa PA01
cgcggcuguagccacgg

SEQ ID NO: 1500167 - RNA, 22 nt, Pseudomonas aeruginosa PA01
cgcggcuguagccacggcgaga

SEQ ID NO: 1500168 - RNA, 17 nt, Pseudomonas aeruginosa PA01
cgcggcuggaagucgcc

SEQ ID NO: 1500169 - RNA, 18 nt, Pseudomonas aeruginosa PA01
cgcggcuggcaggugccg

SEQ ID NO: 1500170 - RNA, 20 nt, Pseudomonas aeruginosa PA01
cgcggcuggccauccgcccu

SEQ ID NO: 1500171 - RNA, 22 nt, Pseudomonas aeruginosa PA01
cgcggcuggccauccgcccugc

SEQ ID NO: 1500172 - RNA, 20 nt, Pseudomonas aeruginosa PA01
cgcggcuaucgaucacugcc

SEQ ID NO: 1500173 - RNA, 22 nt, Pseudomonas aeruginosa PA01
cgcggcuaucgaucacugccug

SEQ ID NO: 1500174 - RNA, 17 nt, Pseudomonas aeruginosa PA01
cgcggcuacccucuccc

SEQ ID NO: 1500175 - RNA, 23 nt, Pseudomonas aeruginosa PA01
cgcggcucaccgagaaccaguac

SEQ ID NO: 1500176 - RNA, 12 nt, Pseudomonas aeruginosa PA01
cgcggcucggcg

SEQ ID NO: 1500177 - RNA, 13 nt, Pseudomonas aeruginosa PA01
cgcggcucggcgg

SEQ ID NO: 1500178 - RNA, 14 nt, Pseudomonas aeruginosa PA01
cgcggcucggcggg

SEQ ID NO: 1500179 - RNA, 15 nt, Pseudomonas aeruginosa PA01
cgcggcucggcgggc

SEQ ID NO: 1500180 - RNA, 22 nt, Pseudomonas aeruginosa PA01
cgcggcucggcgggcugccgcg

SEQ ID NO: 1500181 - RNA, 13 nt, Pseudomonas aeruginosa PA01
cgcggcucgggga

SEQ ID NO: 1500182 - RNA, 17 nt, Pseudomonas aeruginosa PA01
cgcggcguaccuucgag

SEQ ID NO: 1500183 - RNA, 20 nt, Pseudomonas aeruginosa PA01
cgcggcguaccuucgagcag

SEQ ID NO: 1500184 - RNA, 12 nt, Pseudomonas aeruginosa PA01
cgcggcgucgac

SEQ ID NO: 1500185 - RNA, 14 nt, Pseudomonas aeruginosa PA01
cgcggcgucggcga

SEQ ID NO: 1500186 - RNA, 17 nt, Pseudomonas aeruginosa PA01
cgcggcgucggcgaagc

SEQ ID NO: 1500187 - RNA, 18 nt, Pseudomonas aeruginosa PA01
cgcggcgucggcgaagcc

SEQ ID NO: 1500188 - RNA, 21 nt, Pseudomonas aeruginosa PA01
cgcggcggcggccgcaugccg

SEQ ID NO: 1500189 - RNA, 19 nt, Pseudomonas aeruginosa PA01
cgcggcguaccagccgcgg

SEQ ID NO: 1500190 - RNA, 16 nt, Pseudomonas aeruginosa PA01
cgcggcguaggcggug

SEQ ID NO: 1500191 - RNA, 13 nt, Pseudomonas aeruginosa PA01
cgcggcggugcag

SEQ ID NO: 1500192 - RNA, 14 nt, Pseudomonas aeruginosa PA01
cgcggcggcggcca

SEQ ID NO: 1500193 - RNA, 23 nt, Pseudomonas aeruginosa PA01
cgcggcggcggccagcagcacgg

SEQ ID NO: 1500194 - RNA, 11 nt, Pseudomonas aeruginosa PA01
cgcggcggcgc

SEQ ID NO: 1500195 - RNA, 14 nt, Pseudomonas aeruginosa PA01
cgcggcggcgcgga

SEQ ID NO: 1500196 - RNA, 17 nt, Pseudomonas aeruginosa PA01
cgcggcggcgcggagau

SEQ ID NO: 1500197 - RNA, 14 nt, Pseudomonas aeruginosa PA01
cgcggcggcgcguc

SEQ ID NO: 1500198 - RNA, 19 nt, Pseudomonas aeruginosa PA01
aacagcccgucgcgcgccg

SEQ ID NO: 1500199 - RNA, 13 nt, Pseudomonas aeruginosa PA01
aacagccggcggg

SEQ ID NO: 1500200 - RNA, 14 nt, Pseudomonas aeruginosa PA01
aacagccggcgggu

SEQ ID NO: 1500201 - RNA, 11 nt, Pseudomonas aeruginosa PA01
aacagcaggga

SEQ ID NO: 1500202 - RNA, 18 nt, Pseudomonas aeruginosa PA01
cgcggcgcagcggcgaac

SEQ ID NO: 1500203 - RNA, 15 nt, Pseudomonas aeruginosa PA01
cgcggcgcaggcgau

SEQ ID NO: 1500204 - RNA, 14 nt, Pseudomonas aeruginosa PA01
cgcggcgcaggcug

SEQ ID NO: 1500205 - RNA, 22 nt, Pseudomonas aeruginosa PA01
cgcggcgcaggcugucggccag

SEQ ID NO: 1500206 - RNA, 23 nt, Pseudomonas aeruginosa PA01
cgcggcgcaggcugucggccagc

SEQ ID NO: 1500207 - RNA, 15 nt, Pseudomonas aeruginosa PA01
cgcggcgcaguucgu

SEQ ID NO: 1500208 - RNA, 19 nt, Pseudomonas aeruginosa PA01
cgcggcgccacgcucaccg

SEQ ID NO: 1500209 - RNA, 14 nt, Pseudomonas aeruginosa PA01
cgcggcgccagcgc

SEQ ID NO: 1500210 - RNA, 15 nt, Pseudomonas aeruginosa PA01
cgcggcgccagcgcc

SEQ ID NO: 1500211 - RNA, 17 nt, Pseudomonas aeruginosa PA01
cgcggccacuucguccg

SEQ ID NO: 1500212 - RNA, 22 nt, Pseudomonas aeruginosa PA01
cgcggccacuucguccggccgc

SEQ ID NO: 1500213 - RNA, 13 nt, Pseudomonas aeruginosa PA01
cgcggccagcagc

SEQ ID NO: 1500214 - RNA, 14 nt, Pseudomonas aeruginosa PA01
cgcggccagcagca

SEQ ID NO: 1500215 - RNA, 15 nt, Pseudomonas aeruginosa PA01
cgcggccagcagcac

SEQ ID NO: 1500216 - RNA, 22 nt, Pseudomonas aeruginosa PA01
cgcggccagcagcacgcccugg

SEQ ID NO: 1500217 - RNA, 22 nt, Pseudomonas aeruginosa PA01
cgcggccagcccccucgcccuc

SEQ ID NO: 1500218 - RNA, 17 nt, Pseudomonas aeruginosa PA01
cgcggccagccgcuagc

SEQ ID NO: 1500219 - RNA, 14 nt, Pseudomonas aeruginosa PA01
cgcggccagcuucu

SEQ ID NO: 1500220 - RNA, 19 nt, Pseudomonas aeruginosa PA01
cgcggccagcgcggccgcc

SEQ ID NO: 1500221 - RNA, 12 nt, Pseudomonas aeruginosa PA01
cgcggccaucgg

SEQ ID NO: 1500222 - RNA, 14 nt, Pseudomonas aeruginosa PA01
cgcggccaucggcg

SEQ ID NO: 1500223 - RNA, 18 nt, Pseudomonas aeruginosa PA01
cgcggccaucggcgaagc

SEQ ID NO: 1500224 - RNA, 19 nt, Pseudomonas aeruginosa PA01
cgcggcccaccagaggcug

SEQ ID NO: 1500225 - RNA, 12 nt, Pseudomonas aeruginosa PA01
cgcggccugcag

SEQ ID NO: 1500226 - RNA, 20 nt, Pseudomonas aeruginosa PA01
cgcggccucuucgucggcga

SEQ ID NO: 1500227 - RNA, 15 nt, Pseudomonas aeruginosa PA01
cgcggccugcagcga

SEQ ID NO: 1500228 - RNA, 16 nt, Pseudomonas aeruginosa PA01
cgcggccugcgccgga

SEQ ID NO: 1500229 - RNA, 20 nt, Pseudomonas aeruginosa PA01
cgcggccuucagcgguggcg

SEQ ID NO: 1500230 - RNA, 18 nt, Pseudomonas aeruginosa PA01
cgcggccuucucgucgcc

SEQ ID NO: 1500231 - RNA, 19 nt, Pseudomonas aeruginosa PA01
cgcggccuucucgucgccg

SEQ ID NO: 1500232 - RNA, 20 nt, Pseudomonas aeruginosa PA01
cgcggccuucucgucgccgc

SEQ ID NO: 1500233 - RNA, 19 nt, Pseudomonas aeruginosa PA01
cgcggcgacagcaccacgc

SEQ ID NO: 1500234 - RNA, 21 nt, Pseudomonas aeruginosa PA01
cgcggcgacggcucuuccccu

SEQ ID NO: 1500235 - RNA, 20 nt, Pseudomonas aeruginosa PA01
cgcggcgagaacucguccgg

SEQ ID NO: 1500236 - RNA, 21 nt, Pseudomonas aeruginosa PA01
cgcggcgagaucuucaggccg

SEQ ID NO: 1500237 - RNA, 19 nt, Pseudomonas aeruginosa PA01
cgcggcgauggccgccagc

SEQ ID NO: 1500238 - RNA, 22 nt, Pseudomonas aeruginosa PA01
cgcggcgauggccgccagcagg

SEQ ID NO: 1500239 - RNA, 13 nt, Pseudomonas aeruginosa PA01
cgcggcgauggcc

SEQ ID NO: 1500240 - RNA, 13 nt, Pseudomonas aeruginosa PA01
cgcggcgagcagc

SEQ ID NO: 1500241 - RNA, 20 nt, Pseudomonas aeruginosa PA01
cgcggcgaagcgcucgacau

SEQ ID NO: 1500242 - RNA, 20 nt, Pseudomonas aeruginosa PA01
cgcggcgaagcguugcagcg

SEQ ID NO: 1500243 - RNA, 13 nt, Pseudomonas aeruginosa PA01
cgcggcgaagggc

SEQ ID NO: 1500244 - RNA, 16 nt, Pseudomonas aeruginosa PA01
cgcggcgaagguggcg

SEQ ID NO: 1500245 - RNA, 14 nt, Pseudomonas aeruginosa PA01
cgcggcgaccagcg

SEQ ID NO: 1500246 - RNA, 17 nt, Pseudomonas aeruginosa PA01
cgcggcgaccagcgcgg

SEQ ID NO: 1500247 - RNA, 18 nt, Pseudomonas aeruginosa PA01
cgcgucggcacgccgaag

SEQ ID NO: 1500248 - RNA, 14 nt, Pseudomonas aeruginosa PA01
cgcgucgcaggcga

SEQ ID NO: 1500249 - RNA, 19 nt, Pseudomonas aeruginosa PA01
cgcgucgcaggcgaugccg

SEQ ID NO: 1500250 - RNA, 21 nt, Pseudomonas aeruginosa PA01
cgcgucgcaggcgaugccgac

SEQ ID NO: 1500251 - RNA, 14 nt, Pseudomonas aeruginosa PA01
cgcgucgcacccgg

SEQ ID NO: 1500252 - RNA, 19 nt, Pseudomonas aeruginosa PA01
cgcgucgggaaaggccgcc

SEQ ID NO: 1500253 - RNA, 21 nt, Pseudomonas aeruginosa PA01
cgcgucgggaaaggccgccac

SEQ ID NO: 1500254 - RNA, 20 nt, Pseudomonas aeruginosa PA01
cgcgucccugcccgcgccuc

SEQ ID NO: 1500255 - RNA, 18 nt, Pseudomonas aeruginosa PA01
cgcgucggcucgguucca

SEQ ID NO: 1500256 - RNA, 16 nt, Pseudomonas aeruginosa PA01
cgcgugaagcuggagc

SEQ ID NO: 1500257 - RNA, 19 nt, Pseudomonas aeruginosa PA01
cgcgugcaggcgcccuggc

SEQ ID NO: 1500258 - RNA, 16 nt, Pseudomonas aeruginosa PA01
cgcgugauacagcucg

SEQ ID NO: 1500259 - RNA, 15 nt, Pseudomonas aeruginosa PA01
cgcgugccgccggac

SEQ ID NO: 1500260 - RNA, 20 nt, Pseudomonas aeruginosa PA01
cgcgugccgccggaccgucg

SEQ ID NO: 1500261 - RNA, 20 nt, Pseudomonas aeruginosa PA01
cgcgugcgcgcccucgguga

SEQ ID NO: 1500262 - RNA, 15 nt, Pseudomonas aeruginosa PA01
cgcgugcgcgccgcc

SEQ ID NO: 1500263 - RNA, 15 nt, Pseudomonas aeruginosa PA01
cgcguuuuuccgcga

SEQ ID NO: 1500264 - RNA, 21 nt, Pseudomonas aeruginosa PA01
cgcguuguagaaacgguccag

SEQ ID NO: 1500265 - RNA, 16 nt, Pseudomonas aeruginosa PA01
cgcguugugccgccac

SEQ ID NO: 1500266 - RNA, 22 nt, Pseudomonas aeruginosa PA01
cgcguugcuuguguccgccgag

SEQ ID NO: 1500267 - RNA, 19 nt, Pseudomonas aeruginosa PA01
cgcguuggcggugccgcag

SEQ ID NO: 1500268 - RNA, 17 nt, Pseudomonas aeruginosa PA01
cgcguuggcgugcucgc

SEQ ID NO: 1500269 - RNA, 16 nt, Pseudomonas aeruginosa PA01
cgcguuggcuggcggg

SEQ ID NO: 1500270 - RNA, 14 nt, Pseudomonas aeruginosa PA01
cgcguucgcggggc

SEQ ID NO: 1500271 - RNA, 14 nt, Pseudomonas aeruginosa PA01
cgcguucgcuccgg

SEQ ID NO: 1500272 - RNA, 13 nt, Pseudomonas aeruginosa PA01
cgcguucggcgau

SEQ ID NO: 1500273 - RNA, 18 nt, Pseudomonas aeruginosa PA01
cgcguucucccugagccu

SEQ ID NO: 1500274 - RNA, 20 nt, Pseudomonas aeruginosa PA01
cgcguugcgguuauucgccc

SEQ ID NO: 1500275 - RNA, 21 nt, Pseudomonas aeruginosa PA01
cgcguugcgguuauucgcccu

SEQ ID NO: 1500276 - RNA, 17 nt, Pseudomonas aeruginosa PA01
cgcguucccacucgcga

SEQ ID NO: 1500277 - RNA, 18 nt, Pseudomonas aeruginosa PA01
cgcguucaucgucggcag

SEQ ID NO: 1500278 - RNA, 17 nt, Pseudomonas aeruginosa PA01
cgcguuccaggucgcug

SEQ ID NO: 1500279 - RNA, 22 nt, Pseudomonas aeruginosa PA01
cgcguuccaggucgcugcugaa

SEQ ID NO: 1500280 - RNA, 18 nt, Pseudomonas aeruginosa PA01
cgcgugcuccgugucggc

SEQ ID NO: 1500281 - RNA, 20 nt, Pseudomonas aeruginosa PA01
cgcgugcuccgugucggcgg

SEQ ID NO: 1500282 - RNA, 21 nt, Pseudomonas aeruginosa PA01
cgcuccgacuccugcaacagu

SEQ ID NO: 1500283 - RNA, 23 nt, Pseudomonas aeruginosa PA01
cgcucccauucgcugucgucggc

SEQ ID NO: 1500284 - RNA, 19 nt, Pseudomonas aeruginosa PA01
cgcuccccacucggccagc

SEQ ID NO: 1500285 - RNA, 20 nt, Pseudomonas aeruginosa PA01
cgcuccccacucggccagca

SEQ ID NO: 1500286 - RNA, 13 nt, Pseudomonas aeruginosa PA01
cgcuccggcucuc

SEQ ID NO: 1500287 - RNA, 18 nt, Pseudomonas aeruginosa PA01
cgcuccggcugcgcggag

SEQ ID NO: 1500288 - RNA, 16 nt, Pseudomonas aeruginosa PA01
cgcuccgggcccgugc

SEQ ID NO: 1500289 - RNA, 19 nt, Pseudomonas aeruginosa PA01
cgcuccgggcuccaccagu

SEQ ID NO: 1500290 - RNA, 13 nt, Pseudomonas aeruginosa PA01
cgcuccggugcca

SEQ ID NO: 1500291 - RNA, 15 nt, Pseudomonas aeruginosa PA01
cgcuccgguggcgga

SEQ ID NO: 1500292 - RNA, 13 nt, Pseudomonas aeruginosa PA01
cgcuccggcgcgc

SEQ ID NO: 1500293 - RNA, 15 nt, Pseudomonas aeruginosa PA01
cgcuccggcgcgcca

SEQ ID NO: 1500294 - RNA, 19 nt, Pseudomonas aeruginosa PA01
cgcuccggcgcgccauggc

SEQ ID NO: 1500295 - RNA, 14 nt, Pseudomonas aeruginosa PA01
cgcuccggcgccga

SEQ ID NO: 1500296 - RNA, 15 nt, Pseudomonas aeruginosa PA01
cgcuccggcgccgag

SEQ ID NO: 1500297 - RNA, 22 nt, Pseudomonas aeruginosa PA01
cgcuccauccagucggcgcugg

SEQ ID NO: 1500298 - RNA, 18 nt, Pseudomonas aeruginosa PA01
cgcuccgcgccacgcucu

SEQ ID NO: 1500299 - RNA, 13 nt, Pseudomonas aeruginosa PA01
cgcuccgcggccg

SEQ ID NO: 1500300 - RNA, 16 nt, Pseudomonas aeruginosa PA01
cgcuccgcggccggcu

SEQ ID NO: 1500301 - RNA, 19 nt, Pseudomonas aeruginosa PA01
cgcuccgcggccggcuuca

SEQ ID NO: 1500302 - RNA, 12 nt, Pseudomonas aeruginosa PA01
cgcucccaggcu

SEQ ID NO: 1500303 - RNA, 20 nt, Pseudomonas aeruginosa PA01
cgcuccauccagucggcgcu

SEQ ID NO: 1500304 - RNA, 18 nt, Pseudomonas aeruginosa PA01
cgcuccaggugcacggcc

SEQ ID NO: 1500305 - RNA, 20 nt, Pseudomonas aeruginosa PA01
cgcucccaacagucgucgcg

SEQ ID NO: 1500306 - RNA, 23 nt, Pseudomonas aeruginosa PA01
cgcucccaacagucgucgcgcag

SEQ ID NO: 1500307 - RNA, 14 nt, Pseudomonas aeruginosa PA01
cgcucaggcugugc

SEQ ID NO: 1500308 - RNA, 20 nt, Pseudomonas aeruginosa PA01
cgcucagggaauggaugcgc

SEQ ID NO: 1500309 - RNA, 22 nt, Pseudomonas aeruginosa PA01
cgcucagggaauggaugcgcgg

SEQ ID NO: 1500310 - RNA, 23 nt, Pseudomonas aeruginosa PA01
cgcucagggacaccccgucucgc

SEQ ID NO: 1500311 - RNA, 13 nt, Pseudomonas aeruginosa PA01
cgcucaggcgcag

SEQ ID NO: 1500312 - RNA, 15 nt, Pseudomonas aeruginosa PA01
cgcucaggcgcagcg

SEQ ID NO: 1500313 - RNA, 14 nt, Pseudomonas aeruginosa PA01
cgcucaggcagcga

SEQ ID NO: 1500314 - RNA, 17 nt, Pseudomonas aeruginosa PA01
cgcucaggcagcgaucg

SEQ ID NO: 1500315 - RNA, 21 nt, Pseudomonas aeruginosa PA01
cgcucaggcagcgaucgccgc

SEQ ID NO: 1500316 - RNA, 22 nt, Pseudomonas aeruginosa PA01
cgcucaggcagcgaucgccgcc

SEQ ID NO: 1500317 - RNA, 14 nt, Pseudomonas aeruginosa PA01
cgcucagcgggccg

SEQ ID NO: 1500318 - RNA, 16 nt, Pseudomonas aeruginosa PA01
cgcucagcgggccgau

SEQ ID NO: 1500319 - RNA, 19 nt, Pseudomonas aeruginosa PA01
cgcucagcgggccgauccg

SEQ ID NO: 1500320 - RNA, 16 nt, Pseudomonas aeruginosa PA01
cgcucagcgcuucucg

SEQ ID NO: 1500321 - RNA, 24 nt, Pseudomonas aeruginosa PA01
cgcucagcggaacauuuccuugac

SEQ ID NO: 1500322 - RNA, 13 nt, Pseudomonas aeruginosa PA01
cgcucagcgcgag

SEQ ID NO: 1500323 - RNA, 13 nt, Pseudomonas aeruginosa PA01
cgcucagccccga

SEQ ID NO: 1500324 - RNA, 20 nt, Pseudomonas aeruginosa PA01
cgcucagccgaggucgccgc

SEQ ID NO: 1500325 - RNA, 23 nt, Pseudomonas aeruginosa PA01
cgcucacgcaccucgucgagcag

SEQ ID NO: 1500326 - RNA, 14 nt, Pseudomonas aeruginosa PA01
cgcucacguagccc

SEQ ID NO: 1500327 - RNA, 21 nt, Pseudomonas aeruginosa PA01
cgcucacgugaccguccagcg

SEQ ID NO: 1500328 - RNA, 22 nt, Pseudomonas aeruginosa PA01
cgcucacccugucccaucacgg

SEQ ID NO: 1500329 - RNA, 21 nt, Pseudomonas aeruginosa PA01
cgcuaccgcgcauggcggcga

SEQ ID NO: 1500330 - RNA, 17 nt, Pseudomonas aeruginosa PA01
cgcuacccugccccagc

SEQ ID NO: 1500331 - RNA, 17 nt, Pseudomonas aeruginosa PA01
cgcuaccgacaggacca

SEQ ID NO: 1500332 - RNA, 17 nt, Pseudomonas aeruginosa PA01
cgcuacccagguggucg

SEQ ID NO: 1500333 - RNA, 14 nt, Pseudomonas aeruginosa PA01
cgcggucaucgccg

SEQ ID NO: 1500334 - RNA, 16 nt, Pseudomonas aeruginosa PA01
cgcggucaucgccggc

SEQ ID NO: 1500335 - RNA, 20 nt, Pseudomonas aeruginosa PA01
cgcggucaucgccggcgccg

SEQ ID NO: 1500336 - RNA, 18 nt, Pseudomonas aeruginosa PA01
cgcggucauccgcccugc

SEQ ID NO: 1500337 - RNA, 22 nt, Pseudomonas aeruginosa PA01
cgcggucauccgcccugcgucg

SEQ ID NO: 1500338 - RNA, 15 nt, Pseudomonas aeruginosa PA01
cgcgguccaucccuu

SEQ ID NO: 1500339 - RNA, 14 nt, Pseudomonas aeruginosa PA01
cgcggucgagcagc

SEQ ID NO: 1500340 - RNA, 16 nt, Pseudomonas aeruginosa PA01
cgcggucgagcagcgc

SEQ ID NO: 1500341 - RNA, 19 nt, Pseudomonas aeruginosa PA01
cgcggucgagcagcgccgc

SEQ ID NO: 1500342 - RNA, 19 nt, Pseudomonas aeruginosa PA01
cgcggugccauucggugcg

SEQ ID NO: 1500343 - RNA, 20 nt, Pseudomonas aeruginosa PA01
cgcggugccauucggugcgc

SEQ ID NO: 1500344 - RNA, 19 nt, Pseudomonas aeruginosa PA01
cgcggugcaguucgccguu

SEQ ID NO: 1500345 - RNA, 23 nt, Pseudomonas aeruginosa PA01
cgcggugcaguucgccguucagc

SEQ ID NO: 1500346 - RNA, 16 nt, Pseudomonas aeruginosa PA01
cgcggucuucaucacc

SEQ ID NO: 1500347 - RNA, 13 nt, Pseudomonas aeruginosa PA01
cgcggucuucccg

SEQ ID NO: 1500348 - RNA, 20 nt, Pseudomonas aeruginosa PA01
cgcggucuuccgccgacugc

SEQ ID NO: 1500349 - RNA, 21 nt, Pseudomonas aeruginosa PA01
cgcggucucgcguucaucguc

SEQ ID NO: 1500350 - RNA, 15 nt, Pseudomonas aeruginosa PA01
cgcggugagggcgac

SEQ ID NO: 1500351 - RNA, 22 nt, Pseudomonas aeruginosa PA01
cgcggugagggcgacguugcgc

SEQ ID NO: 1500352 - RNA, 17 nt, Pseudomonas aeruginosa PA01
cgcgggcagcagucgca

SEQ ID NO: 1500353 - RNA, 18 nt, Pseudomonas aeruginosa PA01
cgcgggcaaccgcggcgg

SEQ ID NO: 1500354 - RNA, 20 nt, Pseudomonas aeruginosa PA01
cgcgggcaaccgcggcggcc

SEQ ID NO: 1500355 - RNA, 18 nt, Pseudomonas aeruginosa PA01
cgcgggcgaacggcagcg

SEQ ID NO: 1500356 - RNA, 22 nt, Pseudomonas aeruginosa PA01
cgcgggcgaagcgcagcuccgg

SEQ ID NO: 1500357 - RNA, 21 nt, Pseudomonas aeruginosa PA01
cgcgggcgaaggccucgucga

SEQ ID NO: 1500358 - RNA, 21 nt, Pseudomonas aeruginosa PA01
cgcgggcgaggucgccacgca

SEQ ID NO: 1500359 - RNA, 12 nt, Pseudomonas aeruginosa PA01
cgcgggcgccga

SEQ ID NO: 1500360 - RNA, 21 nt, Pseudomonas aeruginosa PA01
cgcgggcgcgcgccaccgccu

SEQ ID NO: 1500361 - RNA, 19 nt, Pseudomonas aeruginosa PA01
cgcggguuacuucgccgau

SEQ ID NO: 1500362 - RNA, 20 nt, Pseudomonas aeruginosa PA01
cgcggguuacuucgccgauc

SEQ ID NO: 1500363 - RNA, 19 nt, Pseudomonas aeruginosa PA01
cgcggguuccucacggcgc

SEQ ID NO: 1500364 - RNA, 20 nt, Pseudomonas aeruginosa PA01
cgcggguuccucacggcgca

SEQ ID NO: 1500365 - RNA, 18 nt, Pseudomonas aeruginosa PA01
cgcggguugcccggcucc

SEQ ID NO: 1500366 - RNA, 23 nt, Pseudomonas aeruginosa PA01
cgcgggcgccguggaucgcccgg

SEQ ID NO: 1500367 - RNA, 14 nt, Pseudomonas aeruginosa PA01
cgcgggcgcgcagc

SEQ ID NO: 1500368 - RNA, 17 nt, Pseudomonas aeruginosa PA01
cgcgggcgcgcagcagg

SEQ ID NO: 1500369 - RNA, 15 nt, Pseudomonas aeruginosa PA01
cgcgguacagccggu

SEQ ID NO: 1500370 - RNA, 14 nt, Pseudomonas aeruginosa PA01
cgcgguagacgcag

SEQ ID NO: 1500371 - RNA, 18 nt, Pseudomonas aeruginosa PA01
cgcguacuugccagggca

SEQ ID NO: 1500372 - RNA, 14 nt, Pseudomonas aeruginosa PA01
cgcguagaccaccu

SEQ ID NO: 1500373 - RNA, 14 nt, Pseudomonas aeruginosa PA01
cgcguagaccaucg

SEQ ID NO: 1500374 - RNA, 19 nt, Pseudomonas aeruginosa PA01
cgcguagaccaucgccggc

SEQ ID NO: 1500375 - RNA, 21 nt, Pseudomonas aeruginosa PA01
cgcguagaccaucgccggcga

SEQ ID NO: 1500376 - RNA, 23 nt, Pseudomonas aeruginosa PA01
cgcguagaccaucgccggcgagc

SEQ ID NO: 1500377 - RNA, 17 nt, Pseudomonas aeruginosa PA01
cgcguacgacuucggcg

SEQ ID NO: 1500378 - RNA, 22 nt, Pseudomonas aeruginosa PA01
cgcguacgacuucggcgacagc

SEQ ID NO: 1500379 - RNA, 19 nt, Pseudomonas aeruginosa PA01
cgcguacgcccgcagccac

SEQ ID NO: 1500380 - RNA, 19 nt, Pseudomonas aeruginosa PA01
cgcguacucaggccgggcg

SEQ ID NO: 1500381 - RNA, 20 nt, Pseudomonas aeruginosa PA01
cgcguacucaggccgggcgg

SEQ ID NO: 1500382 - RNA, 13 nt, Pseudomonas aeruginosa PA01
cgcggugggccuu

SEQ ID NO: 1500383 - RNA, 16 nt, Pseudomonas aeruginosa PA01
cgcguagcgccaggcc

SEQ ID NO: 1500384 - RNA, 21 nt, Pseudomonas aeruginosa PA01
cgcguagcgccccuuggccag

SEQ ID NO: 1500385 - RNA, 16 nt, Pseudomonas aeruginosa PA01
cgcguagcgcuucccg

SEQ ID NO: 1500386 - RNA, 22 nt, Pseudomonas aeruginosa PA01
cgcguaggcgaacacgucggcg

SEQ ID NO: 1500387 - RNA, 23 nt, Pseudomonas aeruginosa PA01
cgcguaggcgaacacgucggcgc

SEQ ID NO: 1500388 - RNA, 14 nt, Pseudomonas aeruginosa PA01
cgcguagcugggcg

SEQ ID NO: 1500389 - RNA, 17 nt, Pseudomonas aeruginosa PA01
cgcguaggggaccaccc

SEQ ID NO: 1500390 - RNA, 14 nt, Pseudomonas aeruginosa PA01
cgcgucacucgaca

SEQ ID NO: 1500391 - RNA, 20 nt, Pseudomonas aeruginosa PA01
cgcgucagcgagcuaucgcc

SEQ ID NO: 1500392 - RNA, 19 nt, Pseudomonas aeruginosa PA01
cgcgucaucaggcucaggc

SEQ ID NO: 1500393 - RNA, 23 nt, Pseudomonas aeruginosa PA01
cgcgucaucaggcucaggccggg

SEQ ID NO: 1500394 - RNA, 19 nt, Pseudomonas aeruginosa PA01
cgcguccaccuggcggcug

SEQ ID NO: 1500395 - RNA, 14 nt, Pseudomonas aeruginosa PA01
cgcguccagccggu

SEQ ID NO: 1500396 - RNA, 13 nt, Pseudomonas aeruginosa PA01
cgcguccggccag

SEQ ID NO: 1500397 - RNA, 22 nt, Pseudomonas aeruginosa PA01
cgcguccggccagccuggccag

SEQ ID NO: 1500398 - RNA, 23 nt, Pseudomonas aeruginosa PA01
cgcguccuccuggaggacgcggg

SEQ ID NO: 1500399 - RNA, 18 nt, Pseudomonas aeruginosa PA01
cgcgucccugggcgcagg

SEQ ID NO: 1500400 - RNA, 14 nt, Pseudomonas aeruginosa PA01
cgcguccauccccg

SEQ ID NO: 1500401 - RNA, 17 nt, Pseudomonas aeruginosa PA01
cgcguccauccccgccu

SEQ ID NO: 1500402 - RNA, 20 nt, Pseudomonas aeruginosa PA01
cgcguccauccccgccucga

SEQ ID NO: 1500403 - RNA, 12 nt, Pseudomonas aeruginosa PA01
cgcguccagcuc

SEQ ID NO: 1500404 - RNA, 18 nt, Pseudomonas aeruginosa PA01
cgcguccagcuccaccag

SEQ ID NO: 1500405 - RNA, 20 nt, Pseudomonas aeruginosa PA01
cgcguccagcuccaccaggc

SEQ ID NO: 1500406 - RNA, 23 nt, Pseudomonas aeruginosa PA01
cgcguccagggugcugaccuuca

SEQ ID NO: 1500407 - RNA, 15 nt, Pseudomonas aeruginosa PA01
cgcgucgaagccgga

SEQ ID NO: 1500408 - RNA, 14 nt, Pseudomonas aeruginosa PA01
cgcgucgaccaccg

SEQ ID NO: 1500409 - RNA, 16 nt, Pseudomonas aeruginosa PA01
cgcgucgaccaccgcg

SEQ ID NO: 1500410 - RNA, 22 nt, Pseudomonas aeruginosa PA01
cgcgucgaguaccgcugcggcc

SEQ ID NO: 1500411 - RNA, 20 nt, Pseudomonas aeruginosa PA01
cgcuucacucauccucgccg

SEQ ID NO: 1500412 - RNA, 23 nt, Pseudomonas aeruginosa PA01
cgcuucacucauccucgccgcug

SEQ ID NO: 1500413 - RNA, 19 nt, Pseudomonas aeruginosa PA01
cgcuucagcgccucgaccu

SEQ ID NO: 1500414 - RNA, 16 nt, Pseudomonas aeruginosa PA01
cgcuucagcgcgccga

SEQ ID NO: 1500415 - RNA, 20 nt, Pseudomonas aeruginosa PA01
cgcuucagcgguucggcacg

SEQ ID NO: 1500416 - RNA, 14 nt, Pseudomonas aeruginosa PA01
cgcuucgcccgccg

SEQ ID NO: 1500417 - RNA, 17 nt, Pseudomonas aeruginosa PA01
cgcuucgccgcccucgc

SEQ ID NO: 1500418 - RNA, 20 nt, Pseudomonas aeruginosa PA01
cgcuucgcgcagcucggcca

SEQ ID NO: 1500419 - RNA, 13 nt, Pseudomonas aeruginosa PA01
cgcuucgagcacc

SEQ ID NO: 1500420 - RNA, 16 nt, Pseudomonas aeruginosa PA01
cgcuucgagcaccccg

SEQ ID NO: 1500421 - RNA, 22 nt, Pseudomonas aeruginosa PA01
cgcuucgagcaccccgagcccg

SEQ ID NO: 1500422 - RNA, 21 nt, Pseudomonas aeruginosa PA01
cgcuuccugggaauugcgcac

SEQ ID NO: 1500423 - RNA, 18 nt, Pseudomonas aeruginosa PA01
cgcuucgaagcucucgcc

SEQ ID NO: 1500424 - RNA, 19 nt, Pseudomonas aeruginosa PA01
cgcuucgaagcucucgccg

SEQ ID NO: 1500425 - RNA, 14 nt, Pseudomonas aeruginosa PA01
cgcuuccaggcacg

SEQ ID NO: 1500426 - RNA, 19 nt, Pseudomonas aeruginosa PA01
cgcuucaucaggcugcugu

SEQ ID NO: 1500427 - RNA, 15 nt, Pseudomonas aeruginosa PA01
cgcuucauccugcgc

SEQ ID NO: 1500428 - RNA, 18 nt, Pseudomonas aeruginosa PA01
cgcuucauccugcgcgcc

SEQ ID NO: 1500429 - RNA, 21 nt, Pseudomonas aeruginosa PA01
cgcuucauccugcgcgccucu

SEQ ID NO: 1500430 - RNA, 13 nt, Pseudomonas aeruginosa PA01
cgcuuccggcgcc

SEQ ID NO: 1500431 - RNA, 13 nt, Pseudomonas aeruginosa PA01
cgcuuccucggca

SEQ ID NO: 1500432 - RNA, 12 nt, Pseudomonas aeruginosa PA01
cgcuuccucggg

SEQ ID NO: 1500433 - RNA, 21 nt, Pseudomonas aeruginosa PA01
cgcuuccagcaccucccccag

SEQ ID NO: 1500434 - RNA, 22 nt, Pseudomonas aeruginosa PA01
cgcuuccgcaucggccgacaga

SEQ ID NO: 1500435 - RNA, 17 nt, Pseudomonas aeruginosa PA01
cgcuuccgccaggcgca

SEQ ID NO: 1500436 - RNA, 23 nt, Pseudomonas aeruginosa PA01
cgcuuccgccaggcgcagccagc

SEQ ID NO: 1500437 - RNA, 18 nt, Pseudomonas aeruginosa PA01
cgcuuccgccggcgccgc

SEQ ID NO: 1500438 - RNA, 13 nt, Pseudomonas aeruginosa PA01
cgcuuccggcagc

SEQ ID NO: 1500439 - RNA, 23 nt, Pseudomonas aeruginosa PA01
cgcuucguugcuccugcggcugg

SEQ ID NO: 1500440 - RNA, 17 nt, Pseudomonas aeruginosa PA01
cgcuucggcggcuucgc

SEQ ID NO: 1500441 - RNA, 13 nt, Pseudomonas aeruginosa PA01
cgcuucggcgggg

SEQ ID NO: 1500442 - RNA, 16 nt, Pseudomonas aeruginosa PA01
cgcuucggccaccagc

SEQ ID NO: 1500443 - RNA, 16 nt, Pseudomonas aeruginosa PA01
cgcuucuuguuccucg

SEQ ID NO: 1500444 - RNA, 13 nt, Pseudomonas aeruginosa PA01
cgcuucucgacgu

SEQ ID NO: 1500445 - RNA, 20 nt, Pseudomonas aeruginosa PA01
cgcuucucgacguaggcggc

SEQ ID NO: 1500446 - RNA, 22 nt, Pseudomonas aeruginosa PA01
cgcuucucgacguaggcggcga

SEQ ID NO: 1500447 - RNA, 14 nt, Pseudomonas aeruginosa PA01
cgcuucucggcagc

SEQ ID NO: 1500448 - RNA, 17 nt, Pseudomonas aeruginosa PA01
cgcuucucggcagcgcu

SEQ ID NO: 1500449 - RNA, 15 nt, Pseudomonas aeruginosa PA01
cgcuucugcgagccg

SEQ ID NO: 1500450 - RNA, 17 nt, Pseudomonas aeruginosa PA01
cgcuucugcgagccgcg

SEQ ID NO: 1500451 - RNA, 19 nt, Pseudomonas aeruginosa PA01
cgcuucugcgagccgcgcg

SEQ ID NO: 1500452 - RNA, 17 nt, Pseudomonas aeruginosa PA01
cgcuucugcucggccug

SEQ ID NO: 1500453 - RNA, 16 nt, Pseudomonas aeruginosa PA01
cgcuucugcuggccgc

SEQ ID NO: 1500454 - RNA, 19 nt, Pseudomonas aeruginosa PA01
cgcuucugcuggccgcgca

SEQ ID NO: 1500455 - RNA, 23 nt, Pseudomonas aeruginosa PA01
cgcuucugcuggccgcgcaggaa

SEQ ID NO: 1500456 - RNA, 17 nt, Pseudomonas aeruginosa PA01
cgcuugaacgcgcgccu

SEQ ID NO: 1500457 - RNA, 14 nt, Pseudomonas aeruginosa PA01
cgcuugaagccggc

SEQ ID NO: 1500458 - RNA, 17 nt, Pseudomonas aeruginosa PA01
cgcuugagaccuucgcg

SEQ ID NO: 1500459 - RNA, 20 nt, Pseudomonas aeruginosa PA01
cgcuugagccauucggcuuc

SEQ ID NO: 1500460 - RNA, 20 nt, Pseudomonas aeruginosa PA01
cgcuugagccccggcaggca

SEQ ID NO: 1500461 - RNA, 16 nt, Pseudomonas aeruginosa PA01
cgcuugagcuggcgcu

SEQ ID NO: 1500462 - RNA, 18 nt, Pseudomonas aeruginosa PA01
cgcuugagcuggcgcugg

SEQ ID NO: 1500463 - RNA, 14 nt, Pseudomonas aeruginosa PA01
cgcuugccagccgc

SEQ ID NO: 1500464 - RNA, 12 nt, Pseudomonas aeruginosa PA01
cgcuugcgaucg

SEQ ID NO: 1500465 - RNA, 14 nt, Pseudomonas aeruginosa PA01
cgcuugcgccgccu

SEQ ID NO: 1500466 - RNA, 14 nt, Pseudomonas aeruginosa PA01
cgcuugccgcuguu

SEQ ID NO: 1500467 - RNA, 15 nt, Pseudomonas aeruginosa PA01
cgcuugccggccgcc

SEQ ID NO: 1500468 - RNA, 16 nt, Pseudomonas aeruginosa PA01
cgcuugccggccgcca

SEQ ID NO: 1500469 - RNA, 21 nt, Pseudomonas aeruginosa PA01
cgcuugccggccgccagcagg

SEQ ID NO: 1500470 - RNA, 17 nt, Pseudomonas aeruginosa PA01
cgcuugccgucgaccug

SEQ ID NO: 1500471 - RNA, 20 nt, Pseudomonas aeruginosa PA01
cgcuugccgucgcggaagcc

SEQ ID NO: 1500472 - RNA, 21 nt, Pseudomonas aeruginosa PA01
cgcuugccgucgcggaagccg

SEQ ID NO: 1500473 - RNA, 19 nt, Pseudomonas aeruginosa PA01
cgcugguuuagcucggcga

SEQ ID NO: 1500474 - RNA, 20 nt, Pseudomonas aeruginosa PA01
cgcugguuuagcucggcgau

SEQ ID NO: 1500475 - RNA, 14 nt, Pseudomonas aeruginosa PA01
cgcuggugaugucg

SEQ ID NO: 1500476 - RNA, 15 nt, Pseudomonas aeruginosa PA01
cgcuggugaucgacc

SEQ ID NO: 1500477 - RNA, 22 nt, Pseudomonas aeruginosa PA01
cgcuggugaucgagggaggucg

SEQ ID NO: 1500478 - RNA, 14 nt, Pseudomonas aeruginosa PA01
cgcuggugccgacg

SEQ ID NO: 1500479 - RNA, 13 nt, Pseudomonas aeruginosa PA01
cgcuggucggcau

SEQ ID NO: 1500480 - RNA, 22 nt, Pseudomonas aeruginosa PA01
cgcugguccagcacgcuggcga

SEQ ID NO: 1500481 - RNA, 15 nt, Pseudomonas aeruginosa PA01
cgcugguccagcugg

SEQ ID NO: 1500482 - RNA, 23 nt, Pseudomonas aeruginosa PA01
cgcugguccagcuggcgcagccg

SEQ ID NO: 1500483 - RNA, 20 nt, Pseudomonas aeruginosa PA01
cgcuggucguucucgcgcau

SEQ ID NO: 1500484 - RNA, 14 nt, Pseudomonas aeruginosa PA01
cgcuguccgccgcc

SEQ ID NO: 1500485 - RNA, 15 nt, Pseudomonas aeruginosa PA01
cgcuguccgccgccg

SEQ ID NO: 1500486 - RNA, 16 nt, Pseudomonas aeruginosa PA01
cgcuguccgccgccgc

SEQ ID NO: 1500487 - RNA, 21 nt, Pseudomonas aeruginosa PA01
cgcuguccgccgccgcggcgc

SEQ ID NO: 1500488 - RNA, 15 nt, Pseudomonas aeruginosa PA01
cgcuguccgccggcc

SEQ ID NO: 1500489 - RNA, 16 nt, Pseudomonas aeruginosa PA01
cgcuguccuccagcgg

SEQ ID NO: 1500490 - RNA, 17 nt, Pseudomonas aeruginosa PA01
cgcuguccuccagcggc

SEQ ID NO: 1500491 - RNA, 18 nt, Pseudomonas aeruginosa PA01
cgcuguccuccagcggcg

SEQ ID NO: 1500492 - RNA, 21 nt, Pseudomonas aeruginosa PA01
cgcuguccuccagcggcggga

SEQ ID NO: 1500493 - RNA, 15 nt, Pseudomonas aeruginosa PA01
cgcugucgagcaggg

SEQ ID NO: 1500494 - RNA, 19 nt, Pseudomonas aeruginosa PA01
cgcugucagggcuugcgcg

SEQ ID NO: 1500495 - RNA, 16 nt, Pseudomonas aeruginosa PA01
cgcugucgcccagcuc

SEQ ID NO: 1500496 - RNA, 14 nt, Pseudomonas aeruginosa PA01
cgcugucgcccggg

SEQ ID NO: 1500497 - RNA, 12 nt, Pseudomonas aeruginosa PA01
cgcugucgccga

SEQ ID NO: 1500498 - RNA, 20 nt, Pseudomonas aeruginosa PA01
cgcuguagcggcucgccgaa

SEQ ID NO: 1500499 - RNA, 19 nt, Pseudomonas aeruginosa PA01
cgcuguaggacagguucag

SEQ ID NO: 1500500 - RNA, 18 nt, Pseudomonas aeruginosa PA01
cgcuguaggcgagcagcg

SEQ ID NO: 1500501 - RNA, 21 nt, Pseudomonas aeruginosa PA01
cgcuguaggcgagcagcggca

SEQ ID NO: 1500502 - RNA, 14 nt, Pseudomonas aeruginosa PA01
cgcuguagccggcg

SEQ ID NO: 1500503 - RNA, 17 nt, Pseudomonas aeruginosa PA01
cgcuguacaagcgcaac

SEQ ID NO: 1500504 - RNA, 21 nt, Pseudomonas aeruginosa PA01
cgcuguacaagcgcaacgcgc

SEQ ID NO: 1500505 - RNA, 14 nt, Pseudomonas aeruginosa PA01
cgcuguagaaugcg

SEQ ID NO: 1500506 - RNA, 17 nt, Pseudomonas aeruginosa PA01
cgcuguuggccugggcg

SEQ ID NO: 1500507 - RNA, 14 nt, Pseudomonas aeruginosa PA01
cgcuguuccucguc

SEQ ID NO: 1500508 - RNA, 15 nt, Pseudomonas aeruginosa PA01
cgcuguuccgccgug

SEQ ID NO: 1500509 - RNA, 22 nt, Pseudomonas aeruginosa PA01
cgcugugugccucugaccgcgc

SEQ ID NO: 1500510 - RNA, 22 nt, Pseudomonas aeruginosa PA01
cgcuguuacugagcgugacccg

SEQ ID NO: 1500511 - RNA, 15 nt, Pseudomonas aeruginosa PA01
cgcuguugccgcgcu

SEQ ID NO: 1500512 - RNA, 18 nt, Pseudomonas aeruginosa PA01
cgcugugggugaggcguu

SEQ ID NO: 1500513 - RNA, 23 nt, Pseudomonas aeruginosa PA01
cgcugugggugaggcguucgagg

SEQ ID NO: 1500514 - RNA, 13 nt, Pseudomonas aeruginosa PA01
cgcugugcggcag

SEQ ID NO: 1500515 - RNA, 15 nt, Pseudomonas aeruginosa PA01
cgcugugcggcagca

SEQ ID NO: 1500516 - RNA, 16 nt, Pseudomonas aeruginosa PA01
cgcugugcggcagcag

SEQ ID NO: 1500517 - RNA, 21 nt, Pseudomonas aeruginosa PA01
cgcugugcagggucagucgag

SEQ ID NO: 1500518 - RNA, 16 nt, Pseudomonas aeruginosa PA01
cgcugucgucggcgcg

SEQ ID NO: 1500519 - RNA, 17 nt, Pseudomonas aeruginosa PA01
cgcugucgucggcgcgg

SEQ ID NO: 1500520 - RNA, 16 nt, Pseudomonas aeruginosa PA01
cgcugucgccggucag

SEQ ID NO: 1500521 - RNA, 23 nt, Pseudomonas aeruginosa PA01
cgcugucgcguucccacucgcga

SEQ ID NO: 1500522 - RNA, 19 nt, Pseudomonas aeruginosa PA01
cgcugugaggugggcgcgc

SEQ ID NO: 1500523 - RNA, 21 nt, Pseudomonas aeruginosa PA01
cgcugucuaucccgugccggg

SEQ ID NO: 1500524 - RNA, 20 nt, Pseudomonas aeruginosa PA01
cgcugucuaucugcgccgaa

SEQ ID NO: 1500525 - RNA, 19 nt, Pseudomonas aeruginosa PA01
cgcugucucgccagcccgg

SEQ ID NO: 1500526 - RNA, 18 nt, Pseudomonas aeruginosa PA01
cggaagaauaccgccagc

SEQ ID NO: 1500527 - RNA, 19 nt, Pseudomonas aeruginosa PA01
cggaagaauaccgccagcu

SEQ ID NO: 1500528 - RNA, 18 nt, Pseudomonas aeruginosa PA01
cggaagcacggcucggcg

SEQ ID NO: 1500529 - RNA, 16 nt, Pseudomonas aeruginosa PA01
cggaagcauggccggc

SEQ ID NO: 1500530 - RNA, 18 nt, Pseudomonas aeruginosa PA01
cggaagcauggccggcua

SEQ ID NO: 1500531 - RNA, 14 nt, Pseudomonas aeruginosa PA01
cggaagccgucggc

SEQ ID NO: 1500532 - RNA, 15 nt, Pseudomonas aeruginosa PA01
cggaagccgucggcg

SEQ ID NO: 1500533 - RNA, 22 nt, Pseudomonas aeruginosa PA01
cggaagccgucggcgaucgcca

SEQ ID NO: 1500534 - RNA, 13 nt, Pseudomonas aeruginosa PA01
cggaagccgugca

SEQ ID NO: 1500535 - RNA, 16 nt, Pseudomonas aeruginosa PA01
cggaacuugucgccgc

SEQ ID NO: 1500536 - RNA, 18 nt, Pseudomonas aeruginosa PA01
cggaacuugucgccgcug

SEQ ID NO: 1500537 - RNA, 21 nt, Pseudomonas aeruginosa PA01
cggaacuugucgccgcuggac

SEQ ID NO: 1500538 - RNA, 17 nt, Pseudomonas aeruginosa PA01
cggaagaaaagaaggcg

SEQ ID NO: 1500539 - RNA, 22 nt, Pseudomonas aeruginosa PA01
cggaagaaaagaaggcggaugg

SEQ ID NO: 1500540 - RNA, 22 nt, Pseudomonas aeruginosa PA01
cggaagacgaaguugagcaccg

SEQ ID NO: 1500541 - RNA, 14 nt, Pseudomonas aeruginosa PA01
cggaagcgccugcg

SEQ ID NO: 1500542 - RNA, 15 nt, Pseudomonas aeruginosa PA01
cggaagcgccugcgg

SEQ ID NO: 1500543 - RNA, 17 nt, Pseudomonas aeruginosa PA01
cggaagcgcucgcgcuu

SEQ ID NO: 1500544 - RNA, 18 nt, Pseudomonas aeruginosa PA01
cggaagcgcugcucgacc

SEQ ID NO: 1500545 - RNA, 15 nt, Pseudomonas aeruginosa PA01
cggaagcggccgagc

SEQ ID NO: 1500546 - RNA, 16 nt, Pseudomonas aeruginosa PA01
cggaagcgucagccgc

SEQ ID NO: 1500547 - RNA, 18 nt, Pseudomonas aeruginosa PA01
cggaagcgucagccgcgg

SEQ ID NO: 1500548 - RNA, 21 nt, Pseudomonas aeruginosa PA01
cggaagcgucagccgcggccg

SEQ ID NO: 1500549 - RNA, 22 nt, Pseudomonas aeruginosa PA01
cggaagcgucagccgcggccgg

SEQ ID NO: 1500550 - RNA, 23 nt, Pseudomonas aeruginosa PA01
cggaagcgucagccgcggccggg

SEQ ID NO: 1500551 - RNA, 16 nt, Pseudomonas aeruginosa PA01
cggaaggcggcgaagu

SEQ ID NO: 1500552 - RNA, 13 nt, Pseudomonas aeruginosa PA01
cggaaggcggcgu

SEQ ID NO: 1500553 - RNA, 14 nt, Pseudomonas aeruginosa PA01
cggaaggccacgcc

SEQ ID NO: 1500554 - RNA, 17 nt, Pseudomonas aeruginosa PA01
cggaaggccacgccgcc

SEQ ID NO: 1500555 - RNA, 21 nt, Pseudomonas aeruginosa PA01
cggaagcuucaggcucggccu

SEQ ID NO: 1500556 - RNA, 22 nt, Pseudomonas aeruginosa PA01
cggaagcuucaggcucggccug

SEQ ID NO: 1500557 - RNA, 23 nt, Pseudomonas aeruginosa PA01
cggaagcuucaggcucggccugu

SEQ ID NO: 1500558 - RNA, 17 nt, Pseudomonas aeruginosa PA01
cggaacgggacgccugg

SEQ ID NO: 1500559 - RNA, 18 nt, Pseudomonas aeruginosa PA01
cggaacgaccacgccugc

SEQ ID NO: 1500560 - RNA, 18 nt, Pseudomonas aeruginosa PA01
cggaacggcucgcgaccg

SEQ ID NO: 1500561 - RNA, 20 nt, Pseudomonas aeruginosa PA01
cggaacgucggccuggguga

SEQ ID NO: 1500562 - RNA, 15 nt, Pseudomonas aeruginosa PA01
cggaacuccggggug

SEQ ID NO: 1500563 - RNA, 21 nt, Pseudomonas aeruginosa PA01
cggaaccagugcgcgguccgc

SEQ ID NO: 1500564 - RNA, 13 nt, Pseudomonas aeruginosa PA01
cggaaugacgagc

SEQ ID NO: 1500565 - RNA, 15 nt, Pseudomonas aeruginosa PA01
cggaauuccugcucg

SEQ ID NO: 1500566 - RNA, 19 nt, Pseudomonas aeruginosa PA01
cggacaacaggccgggcgg

SEQ ID NO: 1500567 - RNA, 16 nt, Pseudomonas aeruginosa PA01
cggacaaccaccaugc

SEQ ID NO: 1500568 - RNA, 16 nt, Pseudomonas aeruginosa PA01
cggacaacccggcgcu

SEQ ID NO: 1500569 - RNA, 23 nt, Pseudomonas aeruginosa PA01
cggacaaccgccguagccgucgu

SEQ ID NO: 1500570 - RNA, 13 nt, Pseudomonas aeruginosa PA01
cggaagucggcgg

SEQ ID NO: 1500571 - RNA, 15 nt, Pseudomonas aeruginosa PA01
cggaaguucaccucg

SEQ ID NO: 1500572 - RNA, 19 nt, Pseudomonas aeruginosa PA01
cggaaguucaccucgguga

SEQ ID NO: 1500573 - RNA, 16 nt, Pseudomonas aeruginosa PA01
cggaagugcgggguga

SEQ ID NO: 1500574 - RNA, 15 nt, Pseudomonas aeruginosa PA01
cggaaggcuuccugg

SEQ ID NO: 1500575 - RNA, 20 nt, Pseudomonas aeruginosa PA01
cggaaggcuuccugguggaa

SEQ ID NO: 1500576 - RNA, 20 nt, Pseudomonas aeruginosa PA01
cggaaucgcguagcgccccu

SEQ ID NO: 1500577 - RNA, 14 nt, Pseudomonas aeruginosa PA01
cggaauccuucgcg

SEQ ID NO: 1500578 - RNA, 20 nt, Pseudomonas aeruginosa PA01
cggaauccuucgcggcggcg

SEQ ID NO: 1500579 - RNA, 23 nt, Pseudomonas aeruginosa PA01
cggaaucgacggauacgccaggu

SEQ ID NO: 1500580 - RNA, 18 nt, Pseudomonas aeruginosa PA01
cggaaaagaagccgcgca

SEQ ID NO: 1500581 - RNA, 16 nt, Pseudomonas aeruginosa PA01
cggaaacgcgcgcucu

SEQ ID NO: 1500582 - RNA, 21 nt, Pseudomonas aeruginosa PA01
cggaaacgcgcgcucucgccg

SEQ ID NO: 1500583 - RNA, 18 nt, Pseudomonas aeruginosa PA01
cggaaagccuggccggcg

SEQ ID NO: 1500584 - RNA, 21 nt, Pseudomonas aeruginosa PA01
cggaaagccuggccggcgaac

SEQ ID NO: 1500585 - RNA, 16 nt, Pseudomonas aeruginosa PA01
cggaaagcagggcgau

SEQ ID NO: 1500586 - RNA, 18 nt, Pseudomonas aeruginosa PA01
cggaaagcaguucgcccg

SEQ ID NO: 1500587 - RNA, 20 nt, Pseudomonas aeruginosa PA01
cggaacaagccgccuucggg

SEQ ID NO: 1500588 - RNA, 23 nt, Pseudomonas aeruginosa PA01
cggaacacacgcuucugcuggcc

SEQ ID NO: 1500589 - RNA, 17 nt, Pseudomonas aeruginosa PA01
cgcuuuuccggcgccgg

SEQ ID NO: 1500590 - RNA, 17 nt, Pseudomonas aeruginosa PA01
cgcuuuuccucgaccca

SEQ ID NO: 1500591 - RNA, 15 nt, Pseudomonas aeruginosa PA01
cgcuuugcgcgcagu

SEQ ID NO: 1500592 - RNA, 17 nt, Pseudomonas aeruginosa PA01
cggaaaaaggcgccuuc

SEQ ID NO: 1500593 - RNA, 22 nt, Pseudomonas aeruginosa PA01
cggaaacccgugguccgccagc

SEQ ID NO: 1500594 - RNA, 23 nt, Pseudomonas aeruginosa PA01
cggaaacccgugguccgccagca

SEQ ID NO: 1500595 - RNA, 19 nt, Pseudomonas aeruginosa PA01
cggaaacccuuccagccgc

SEQ ID NO: 1500596 - RNA, 18 nt, Pseudomonas aeruginosa PA01
cggaaaccgcggccggcu

SEQ ID NO: 1500597 - RNA, 21 nt, Pseudomonas aeruginosa PA01
cgcuuuuuucuugccgccaga

SEQ ID NO: 1500598 - RNA, 19 nt, Pseudomonas aeruginosa PA01
cgcuuggcgaaaucgagcu

SEQ ID NO: 1500599 - RNA, 16 nt, Pseudomonas aeruginosa PA01
cgcuuggcgaucacgg

SEQ ID NO: 1500600 - RNA, 19 nt, Pseudomonas aeruginosa PA01
cgcuuggcgaucacggcgc

SEQ ID NO: 1500601 - RNA, 16 nt, Pseudomonas aeruginosa PA01
cgcuuggccaggucgu

SEQ ID NO: 1500602 - RNA, 16 nt, Pseudomonas aeruginosa PA01
cgcuuggccauggcgc

SEQ ID NO: 1500603 - RNA, 17 nt, Pseudomonas aeruginosa PA01
cgcuugcugccauggcg

SEQ ID NO: 1500604 - RNA, 22 nt, Pseudomonas aeruginosa PA01
cgcuugcggucauccgccggcg

SEQ ID NO: 1500605 - RNA, 17 nt, Pseudomonas aeruginosa PA01
cgcuugcgggcgcgccu

SEQ ID NO: 1500606 - RNA, 17 nt, Pseudomonas aeruginosa PA01
cgcuuguagcagccgca

SEQ ID NO: 1500607 - RNA, 18 nt, Pseudomonas aeruginosa PA01
cgcuuguagcccaggggc

SEQ ID NO: 1500608 - RNA, 21 nt, Pseudomonas aeruginosa PA01
cgcuuguccuccagcugcgcc

SEQ ID NO: 1500609 - RNA, 17 nt, Pseudomonas aeruginosa PA01
cgcuuggacagcucgcg

SEQ ID NO: 1500610 - RNA, 16 nt, Pseudomonas aeruginosa PA01
cgcuugucguggcggg

SEQ ID NO: 1500611 - RNA, 19 nt, Pseudomonas aeruginosa PA01
cgcuuucgagaaagcgcag

SEQ ID NO: 1500612 - RNA, 23 nt, Pseudomonas aeruginosa PA01
cgcuuuccggcuugaccgccgcc

SEQ ID NO: 1500613 - RNA, 20 nt, Pseudomonas aeruginosa PA01
cgcuuugcagggucacgcgu

SEQ ID NO: 1500614 - RNA, 13 nt, Pseudomonas aeruginosa PA01
cgcuuuccucggu

SEQ ID NO: 1500615 - RNA, 22 nt, Pseudomonas aeruginosa PA01
cgcuuuccggcgcggccugcag

SEQ ID NO: 1500616 - RNA, 22 nt, Pseudomonas aeruginosa PA01
cgcuuucccgcuucggcccgcu

SEQ ID NO: 1500617 - RNA, 13 nt, Pseudomonas aeruginosa PA01
cgcuuucagcgcc

SEQ ID NO: 1500618 - RNA, 18 nt, Pseudomonas aeruginosa PA01
cgcuuucagcgccgcucg

SEQ ID NO: 1500619 - RNA, 24 nt, Pseudomonas aeruginosa PA01
cgcuuucagcgccgcucggcgagc

SEQ ID NO: 1500620 - RNA, 22 nt, Pseudomonas aeruginosa PA01
cgcuuucaggcgcucgucgagg

SEQ ID NO: 1500621 - RNA, 18 nt, Pseudomonas aeruginosa PA01
cgcuuucaucaggcgcuu

SEQ ID NO: 1500622 - RNA, 23 nt, Pseudomonas aeruginosa PA01
cgcuuucaccagggucgccaggg

SEQ ID NO: 1500623 - RNA, 14 nt, Pseudomonas aeruginosa PA01
cgcugcaucggcgc

SEQ ID NO: 1500624 - RNA, 16 nt, Pseudomonas aeruginosa PA01
cgcugcaucggcgcgc

SEQ ID NO: 1500625 - RNA, 17 nt, Pseudomonas aeruginosa PA01
cgcugcaucggcgcgcc

SEQ ID NO: 1500626 - RNA, 18 nt, Pseudomonas aeruginosa PA01
cgcugcaucggcgcgccg

SEQ ID NO: 1500627 - RNA, 19 nt, Pseudomonas aeruginosa PA01
cgcugcaucggcgcgccga

SEQ ID NO: 1500628 - RNA, 12 nt, Pseudomonas aeruginosa PA01
cgcugcaugcgg

SEQ ID NO: 1500629 - RNA, 13 nt, Pseudomonas aeruginosa PA01
cgcugcaugcgga

SEQ ID NO: 1500630 - RNA, 14 nt, Pseudomonas aeruginosa PA01
cgcugcaugcggaa

SEQ ID NO: 1500631 - RNA, 13 nt, Pseudomonas aeruginosa PA01
cgcugcagggcgg

SEQ ID NO: 1500632 - RNA, 18 nt, Pseudomonas aeruginosa PA01
cgcugcagggcggcgcug

SEQ ID NO: 1500633 - RNA, 16 nt, Pseudomonas aeruginosa PA01
cgcugcacgcacgcgc

SEQ ID NO: 1500634 - RNA, 15 nt, Pseudomonas aeruginosa PA01
cgcugcacgccuucc

SEQ ID NO: 1500635 - RNA, 17 nt, Pseudomonas aeruginosa PA01
cgcugcaaucgcugccg

SEQ ID NO: 1500636 - RNA, 15 nt, Pseudomonas aeruginosa PA01
cgcugaugugccgca

SEQ ID NO: 1500637 - RNA, 15 nt, Pseudomonas aeruginosa PA01
cgcugaugccggcga

SEQ ID NO: 1500638 - RNA, 17 nt, Pseudomonas aeruginosa PA01
cgcugaugccggcgaac

SEQ ID NO: 1500639 - RNA, 17 nt, Pseudomonas aeruginosa PA01
cgcugaugccggcgucg

SEQ ID NO: 1500640 - RNA, 21 nt, Pseudomonas aeruginosa PA01
cgcugaugccggcgucggcga

SEQ ID NO: 1500641 - RNA, 17 nt, Pseudomonas aeruginosa PA01
cgcugcaauucgucggc

SEQ ID NO: 1500642 - RNA, 17 nt, Pseudomonas aeruginosa PA01
cgcugcaccgaacggug

SEQ ID NO: 1500643 - RNA, 13 nt, Pseudomonas aeruginosa PA01
cgcugcaccgcgg

SEQ ID NO: 1500644 - RNA, 14 nt, Pseudomonas aeruginosa PA01
cgcugcaccgcggc

SEQ ID NO: 1500645 - RNA, 21 nt, Pseudomonas aeruginosa PA01
cgcugauugcgggccuuggcg

SEQ ID NO: 1500646 - RNA, 19 nt, Pseudomonas aeruginosa PA01
cgcucgacauacuccgccg

SEQ ID NO: 1500647 - RNA, 20 nt, Pseudomonas aeruginosa PA01
cgcugaggauguagccggcu

SEQ ID NO: 1500648 - RNA, 15 nt, Pseudomonas aeruginosa PA01
cgcugaggccgcccu

SEQ ID NO: 1500649 - RNA, 22 nt, Pseudomonas aeruginosa PA01
cgcugaggccgcccuggccgag

SEQ ID NO: 1500650 - RNA, 23 nt, Pseudomonas aeruginosa PA01
cgcugaggccgcccuggccgagc

SEQ ID NO: 1500651 - RNA, 16 nt, Pseudomonas aeruginosa PA01
cgcucgaacgccgccc

SEQ ID NO: 1500652 - RNA, 14 nt, Pseudomonas aeruginosa PA01
cgcuccuugagcag

SEQ ID NO: 1500653 - RNA, 16 nt, Pseudomonas aeruginosa PA01
cgcuccuugagcagcu

SEQ ID NO: 1500654 - RNA, 22 nt, Pseudomonas aeruginosa PA01
cgcuccuuguagaacggcggca

SEQ ID NO: 1500655 - RNA, 23 nt, Pseudomonas aeruginosa PA01
cgcuccuuucccagcguuguccu

SEQ ID NO: 1500656 - RNA, 13 nt, Pseudomonas aeruginosa PA01
cgcuccuuuggcg

SEQ ID NO: 1500657 - RNA, 15 nt, Pseudomonas aeruginosa PA01
cgcuccuccgggaag

SEQ ID NO: 1500658 - RNA, 21 nt, Pseudomonas aeruginosa PA01
cgcuccucagaggcgaccagc

SEQ ID NO: 1500659 - RNA, 17 nt, Pseudomonas aeruginosa PA01
cgcuccuccagcgccgc

SEQ ID NO: 1500660 - RNA, 19 nt, Pseudomonas aeruginosa PA01
cgcuccuccagcgccgcca

SEQ ID NO: 1500661 - RNA, 16 nt, Pseudomonas aeruginosa PA01
cgcuccguagggcgac

SEQ ID NO: 1500662 - RNA, 22 nt, Pseudomonas aeruginosa PA01
cgcuccguagggcgacgcccga

SEQ ID NO: 1500663 - RNA, 23 nt, Pseudomonas aeruginosa PA01
cgcuccguagggcgacgcccgag

SEQ ID NO: 1500664 - RNA, 18 nt, Pseudomonas aeruginosa PA01
cgcuccgucgcuucgccc

SEQ ID NO: 1500665 - RNA, 15 nt, Pseudomonas aeruginosa PA01
cgcuccugcgccggc

SEQ ID NO: 1500666 - RNA, 14 nt, Pseudomonas aeruginosa PA01
cgcuccucgauccg

SEQ ID NO: 1500667 - RNA, 15 nt, Pseudomonas aeruginosa PA01
cgcuccucgauccgc

SEQ ID NO: 1500668 - RNA, 18 nt, Pseudomonas aeruginosa PA01
cgcuccucgcgcugcccg

SEQ ID NO: 1500669 - RNA, 21 nt, Pseudomonas aeruginosa PA01
cgcuccucgcgcugcccggcg

SEQ ID NO: 1500670 - RNA, 18 nt, Pseudomonas aeruginosa PA01
cgcuccuggugcggcacc

SEQ ID NO: 1500671 - RNA, 18 nt, Pseudomonas aeruginosa PA01
cgcuccuguugcuggccg

SEQ ID NO: 1500672 - RNA, 19 nt, Pseudomonas aeruginosa PA01
cgcuccuguugcuggccgg

SEQ ID NO: 1500673 - RNA, 20 nt, Pseudomonas aeruginosa PA01
cgcuccuggaagaacaggcg

SEQ ID NO: 1500674 - RNA, 15 nt, Pseudomonas aeruginosa PA01
cgcuccuggcaggcu

SEQ ID NO: 1500675 - RNA, 18 nt, Pseudomonas aeruginosa PA01
cgcuccuggcaggcucac

SEQ ID NO: 1500676 - RNA, 23 nt, Pseudomonas aeruginosa PA01
cgcugaguuugcccagcgccgcc

SEQ ID NO: 1500677 - RNA, 23 nt, Pseudomonas aeruginosa PA01
cgcugaggguggaacccauggcg

SEQ ID NO: 1500678 - RNA, 21 nt, Pseudomonas aeruginosa PA01
cgcugaggaagagcagcgcgg

SEQ ID NO: 1500679 - RNA, 19 nt, Pseudomonas aeruginosa PA01
cgcugaggacugccagggu

SEQ ID NO: 1500680 - RNA, 19 nt, Pseudomonas aeruginosa PA01
cgcugaggaucacgauggc

SEQ ID NO: 1500681 - RNA, 21 nt, Pseudomonas aeruginosa PA01
cgcugaggaucacgauggccg

SEQ ID NO: 1500682 - RNA, 17 nt, Pseudomonas aeruginosa PA01
cgcugaggaucagccag

SEQ ID NO: 1500683 - RNA, 23 nt, Pseudomonas aeruginosa PA01
cgcugaggaucagccagccggcg

SEQ ID NO: 1500684 - RNA, 18 nt, Pseudomonas aeruginosa PA01
cgcugaggcucagcgcgc

SEQ ID NO: 1500685 - RNA, 17 nt, Pseudomonas aeruginosa PA01
cgcugaggcucgccggg

SEQ ID NO: 1500686 - RNA, 19 nt, Pseudomonas aeruginosa PA01
cgcugaggcucgccggguu

SEQ ID NO: 1500687 - RNA, 13 nt, Pseudomonas aeruginosa PA01
cgcugaucucggu

SEQ ID NO: 1500688 - RNA, 16 nt, Pseudomonas aeruginosa PA01
cgcugaucucgguauc

SEQ ID NO: 1500689 - RNA, 20 nt, Pseudomonas aeruginosa PA01
cgcugaucaguaccggcagc

SEQ ID NO: 1500690 - RNA, 21 nt, Pseudomonas aeruginosa PA01
cgcugaucaguaccggcagcg

SEQ ID NO: 1500691 - RNA, 16 nt, Pseudomonas aeruginosa PA01
cgcugaucaucagcag

SEQ ID NO: 1500692 - RNA, 17 nt, Pseudomonas aeruginosa PA01
cgcugaucaucagcagg

SEQ ID NO: 1500693 - RNA, 15 nt, Pseudomonas aeruginosa PA01
cgcugccccguagcc

SEQ ID NO: 1500694 - RNA, 21 nt, Pseudomonas aeruginosa PA01
cgcugccccuggcucaggcac

SEQ ID NO: 1500695 - RNA, 14 nt, Pseudomonas aeruginosa PA01
cgcugcccaucgcc

SEQ ID NO: 1500696 - RNA, 13 nt, Pseudomonas aeruginosa PA01
cgcugcccggcgc

SEQ ID NO: 1500697 - RNA, 15 nt, Pseudomonas aeruginosa PA01
cgcugcccggcgcga

SEQ ID NO: 1500698 - RNA, 14 nt, Pseudomonas aeruginosa PA01
cgcugcccucgacc

SEQ ID NO: 1500699 - RNA, 19 nt, Pseudomonas aeruginosa PA01
cgcugccgaacagcaggga

SEQ ID NO: 1500700 - RNA, 17 nt, Pseudomonas aeruginosa PA01
cgcugccgaggaacucg

SEQ ID NO: 1500701 - RNA, 12 nt, Pseudomonas aeruginosa PA01
cgcugccgccgc

SEQ ID NO: 1500702 - RNA, 14 nt, Pseudomonas aeruginosa PA01
cgcugccgccgcag

SEQ ID NO: 1500703 - RNA, 15 nt, Pseudomonas aeruginosa PA01
cgcugcaugggcucg

SEQ ID NO: 1500704 - RNA, 21 nt, Pseudomonas aeruginosa PA01
cgcugcaugggcucgcgcggg

SEQ ID NO: 1500705 - RNA, 21 nt, Pseudomonas aeruginosa PA01
cgcugcauggggauggucgag

SEQ ID NO: 1500706 - RNA, 22 nt, Pseudomonas aeruginosa PA01
cgcugcauggggauggucgaga

SEQ ID NO: 1500707 - RNA, 14 nt, Pseudomonas aeruginosa PA01
cgcugccagcaggc

SEQ ID NO: 1500708 - RNA, 15 nt, Pseudomonas aeruginosa PA01
cgcugccagcaggcc

SEQ ID NO: 1500709 - RNA, 17 nt, Pseudomonas aeruginosa PA01
cgcugccagcaggccga

SEQ ID NO: 1500710 - RNA, 13 nt, Pseudomonas aeruginosa PA01
cgcugccagcgcc

SEQ ID NO: 1500711 - RNA, 17 nt, Pseudomonas aeruginosa PA01
cgcugccagcgccgccg

SEQ ID NO: 1500712 - RNA, 22 nt, Pseudomonas aeruginosa PA01
cgcugcccagauccccugcagg

SEQ ID NO: 1500713 - RNA, 15 nt, Pseudomonas aeruginosa PA01
cgcugcccagcccgc

SEQ ID NO: 1500714 - RNA, 20 nt, Pseudomonas aeruginosa PA01
cgcugccgccgucuccgccg

SEQ ID NO: 1500715 - RNA, 22 nt, Pseudomonas aeruginosa PA01
cgcugccgccgucuccgccgcu

SEQ ID NO: 1500716 - RNA, 14 nt, Pseudomonas aeruginosa PA01
cgcugccgccgcgc

SEQ ID NO: 1500717 - RNA, 15 nt, Pseudomonas aeruginosa PA01
cgcugccgccgcgca

SEQ ID NO: 1500718 - RNA, 17 nt, Pseudomonas aeruginosa PA01
cgcugccgccgcgcagg

SEQ ID NO: 1500719 - RNA, 22 nt, Pseudomonas aeruginosa PA01
cgcugccgccgcgcccggcgcc

SEQ ID NO: 1500720 - RNA, 23 nt, Pseudomonas aeruginosa PA01
cgcugccgccgcgcccggcgcca

SEQ ID NO: 1500721 - RNA, 15 nt, Pseudomonas aeruginosa PA01
cgcugccgccgcgcu

SEQ ID NO: 1500722 - RNA, 14 nt, Pseudomonas aeruginosa PA01
cgcugccggcgcgc

SEQ ID NO: 1500723 - RNA, 17 nt, Pseudomonas aeruginosa PA01
cgcugccggcgcgcacg

SEQ ID NO: 1500724 - RNA, 23 nt, Pseudomonas aeruginosa PA01
cgcugccggccagggucgccagc

SEQ ID NO: 1500725 - RNA, 19 nt, Pseudomonas aeruginosa PA01
cgcugccguacagcccccg

SEQ ID NO: 1500726 - RNA, 19 nt, Pseudomonas aeruginosa PA01
cgcugccguagaggucgcc

SEQ ID NO: 1500727 - RNA, 21 nt, Pseudomonas aeruginosa PA01
cgcugccguucgcccgcggcg

SEQ ID NO: 1500728 - RNA, 23 nt, Pseudomonas aeruginosa PA01
cgcugccucgguuuccggccagg

SEQ ID NO: 1500729 - RNA, 16 nt, Pseudomonas aeruginosa PA01
cgcugccguugcaggc

SEQ ID NO: 1500730 - RNA, 20 nt, Pseudomonas aeruginosa PA01
cgcugccguugcaggcccag

SEQ ID NO: 1500731 - RNA, 22 nt, Pseudomonas aeruginosa PA01
cgcugccguugcaggcccagcu

SEQ ID NO: 1500732 - RNA, 18 nt, Pseudomonas aeruginosa PA01
cgcugccuaccgucacgc

SEQ ID NO: 1500733 - RNA, 14 nt, Pseudomonas aeruginosa PA01
cgcugcgagcaggu

SEQ ID NO: 1500734 - RNA, 23 nt, Pseudomonas aeruginosa PA01
cgcugcgagcagguccuguccca

SEQ ID NO: 1500735 - RNA, 13 nt, Pseudomonas aeruginosa PA01
cgcugcgaccugg

SEQ ID NO: 1500736 - RNA, 15 nt, Pseudomonas aeruginosa PA01
cgcugcgaccuggcg

SEQ ID NO: 1500737 - RNA, 14 nt, Pseudomonas aeruginosa PA01
cgcugccugcaccg

SEQ ID NO: 1500738 - RNA, 17 nt, Pseudomonas aeruginosa PA01
cgcugccugcaccgggc

SEQ ID NO: 1500739 - RNA, 18 nt, Pseudomonas aeruginosa PA01
cgcugccugcaccgggcc

SEQ ID NO: 1500740 - RNA, 20 nt, Pseudomonas aeruginosa PA01
cgcugccugcaccgggccga

SEQ ID NO: 1500741 - RNA, 22 nt, Pseudomonas aeruginosa PA01
cgcugccugcaccgggccgacc

SEQ ID NO: 1500742 - RNA, 18 nt, Pseudomonas aeruginosa PA01
cgcugccuggggacggca

SEQ ID NO: 1500743 - RNA, 19 nt, Pseudomonas aeruginosa PA01
cgcugcgcaacugccgguc

SEQ ID NO: 1500744 - RNA, 14 nt, Pseudomonas aeruginosa PA01
cgcugcgccaggcc

SEQ ID NO: 1500745 - RNA, 23 nt, Pseudomonas aeruginosa PA01
cgcugcgccaggcuuuccgccga

SEQ ID NO: 1500746 - RNA, 14 nt, Pseudomonas aeruginosa PA01
cgcugcgccgccgu

SEQ ID NO: 1500747 - RNA, 13 nt, Pseudomonas aeruginosa PA01
cgcugcgcccgcu

SEQ ID NO: 1500748 - RNA, 17 nt, Pseudomonas aeruginosa PA01
cgcugcgcaggccgaga

SEQ ID NO: 1500749 - RNA, 17 nt, Pseudomonas aeruginosa PA01
cgcugcgggcguagcgc

SEQ ID NO: 1500750 - RNA, 20 nt, Pseudomonas aeruginosa PA01
cgcugcgggcguagcgcggc

SEQ ID NO: 1500751 - RNA, 18 nt, Pseudomonas aeruginosa PA01
cgcugcggguucagucgg

SEQ ID NO: 1500752 - RNA, 19 nt, Pseudomonas aeruginosa PA01
cgcugcggguucagucggc

SEQ ID NO: 1500753 - RNA, 21 nt, Pseudomonas aeruginosa PA01
cgcugcguaguugagccccag

SEQ ID NO: 1500754 - RNA, 22 nt, Pseudomonas aeruginosa PA01
cgcugcgugcgccgcucgcgca

SEQ ID NO: 1500755 - RNA, 18 nt, Pseudomonas aeruginosa PA01
cgcugcgggucauuggcg

SEQ ID NO: 1500756 - RNA, 22 nt, Pseudomonas aeruginosa PA01
cgcugcugccauccgcgccgac

SEQ ID NO: 1500757 - RNA, 23 nt, Pseudomonas aeruginosa PA01
cgcugcucagggccgcgccgagc

SEQ ID NO: 1500758 - RNA, 19 nt, Pseudomonas aeruginosa PA01
cgcugcucagggcuccaau

SEQ ID NO: 1500759 - RNA, 15 nt, Pseudomonas aeruginosa PA01
cgcugcucgauggcc

SEQ ID NO: 1500760 - RNA, 21 nt, Pseudomonas aeruginosa PA01
cgcugcucgauggccuugagg

SEQ ID NO: 1500761 - RNA, 21 nt, Pseudomonas aeruginosa PA01
cgcugcuccuuucggaacagc

SEQ ID NO: 1500762 - RNA, 19 nt, Pseudomonas aeruginosa PA01
cgcugcguggguagccgcc

SEQ ID NO: 1500763 - RNA, 19 nt, Pseudomonas aeruginosa PA01
cgcugcuaggcuggaagcc

SEQ ID NO: 1500764 - RNA, 15 nt, Pseudomonas aeruginosa PA01
cgcugcucgacggca

SEQ ID NO: 1500765 - RNA, 17 nt, Pseudomonas aeruginosa PA01
cgcugcucgacggcacc

SEQ ID NO: 1500766 - RNA, 21 nt, Pseudomonas aeruginosa PA01
cgcugcucgaccaccucggcg

SEQ ID NO: 1500767 - RNA, 22 nt, Pseudomonas aeruginosa PA01
cgcugcucgaccaccucggcgu

SEQ ID NO: 1500768 - RNA, 18 nt, Pseudomonas aeruginosa PA01
cgcugcggcucgccgauu

SEQ ID NO: 1500769 - RNA, 18 nt, Pseudomonas aeruginosa PA01
cgcugcggcugcagggcc

SEQ ID NO: 1500770 - RNA, 13 nt, Pseudomonas aeruginosa PA01
cgcugcggccggc

SEQ ID NO: 1500771 - RNA, 15 nt, Pseudomonas aeruginosa PA01
cgcugcggccggcgc

SEQ ID NO: 1500772 - RNA, 23 nt, Pseudomonas aeruginosa PA01
cgcugcggaucaacuccgccagg

SEQ ID NO: 1500773 - RNA, 22 nt, Pseudomonas aeruginosa PA01
cgcugcgcugccagcgccgccg

SEQ ID NO: 1500774 - RNA, 15 nt, Pseudomonas aeruginosa PA01
cgcugcgccggcgcu

SEQ ID NO: 1500775 - RNA, 13 nt, Pseudomonas aeruginosa PA01
cgcugcgccggcg

SEQ ID NO: 1500776 - RNA, 16 nt, Pseudomonas aeruginosa PA01
cgcugcgcgcaguuca

SEQ ID NO: 1500777 - RNA, 22 nt, Pseudomonas aeruginosa PA01
cgcugcgcgcaguucagggcgu

SEQ ID NO: 1500778 - RNA, 15 nt, Pseudomonas aeruginosa PA01
cgcugcgcgccaucu

SEQ ID NO: 1500779 - RNA, 14 nt, Pseudomonas aeruginosa PA01
cgcugcgcggccug

SEQ ID NO: 1500780 - RNA, 24 nt, Pseudomonas aeruginosa PA01
cgcugcgcggccugcgccggacca

SEQ ID NO: 1500781 - RNA, 12 nt, Pseudomonas aeruginosa PA01
cgcugcgcggcg

SEQ ID NO: 1500782 - RNA, 18 nt, Pseudomonas aeruginosa PA01
cgcugcuucuugucgagg

SEQ ID NO: 1500783 - RNA, 21 nt, Pseudomonas aeruginosa PA01
cgcugcuucuugucgagguag

SEQ ID NO: 1500784 - RNA, 17 nt, Pseudomonas aeruginosa PA01
cgcugcuguacagcuca

SEQ ID NO: 1500785 - RNA, 17 nt, Pseudomonas aeruginosa PA01
cgcuggaaccggccggc

SEQ ID NO: 1500786 - RNA, 18 nt, Pseudomonas aeruginosa PA01
cgcugcuggauggggcug

SEQ ID NO: 1500787 - RNA, 16 nt, Pseudomonas aeruginosa PA01
cgcugcugggcggcga

SEQ ID NO: 1500788 - RNA, 18 nt, Pseudomonas aeruginosa PA01
cgcugcugggcggcgacc

SEQ ID NO: 1500789 - RNA, 16 nt, Pseudomonas aeruginosa PA01
cgcuggaacggccagg

SEQ ID NO: 1500790 - RNA, 20 nt, Pseudomonas aeruginosa PA01
cgcuggaaguuguacagcga

SEQ ID NO: 1500791 - RNA, 21 nt, Pseudomonas aeruginosa PA01
cgcuggaaguuguacagcgag

SEQ ID NO: 1500792 - RNA, 22 nt, Pseudomonas aeruginosa PA01
cgcuggaccaguucagcgcgcu

SEQ ID NO: 1500793 - RNA, 13 nt, Pseudomonas aeruginosa PA01
cgcuggacccgca

SEQ ID NO: 1500794 - RNA, 20 nt, Pseudomonas aeruginosa PA01
cgcuggacaggcgcaggggc

SEQ ID NO: 1500795 - RNA, 12 nt, Pseudomonas aeruginosa PA01
cgcuggccgaau

SEQ ID NO: 1500796 - RNA, 13 nt, Pseudomonas aeruginosa PA01
cgcuggccgacca

SEQ ID NO: 1500797 - RNA, 22 nt, Pseudomonas aeruginosa PA01
cgcuggcauacacaugcaggcu

SEQ ID NO: 1500798 - RNA, 14 nt, Pseudomonas aeruginosa PA01
cgcuggccagcgcu

SEQ ID NO: 1500799 - RNA, 21 nt, Pseudomonas aeruginosa PA01
cgcuggccaguuccaugucgc

SEQ ID NO: 1500800 - RNA, 23 nt, Pseudomonas aeruginosa PA01
cgcuggccaucuucucgaagcgc

SEQ ID NO: 1500801 - RNA, 17 nt, Pseudomonas aeruginosa PA01
cgcuggaguaucgcccu

SEQ ID NO: 1500802 - RNA, 20 nt, Pseudomonas aeruginosa PA01
cgcuggaguaucgcccuggc

SEQ ID NO: 1500803 - RNA, 13 nt, Pseudomonas aeruginosa PA01
cgcuggcaccggc

SEQ ID NO: 1500804 - RNA, 17 nt, Pseudomonas aeruginosa PA01
cgcuggcaccggccagg

SEQ ID NO: 1500805 - RNA, 21 nt, Pseudomonas aeruginosa PA01
cgcuggcagaacgcgucgacc

SEQ ID NO: 1500806 - RNA, 14 nt, Pseudomonas aeruginosa PA01
cgcuggaugccgac

SEQ ID NO: 1500807 - RNA, 19 nt, Pseudomonas aeruginosa PA01
cgcuggaugccgaccacgu

SEQ ID NO: 1500808 - RNA, 16 nt, Pseudomonas aeruginosa PA01
cgcuggauuucgccga

SEQ ID NO: 1500809 - RNA, 18 nt, Pseudomonas aeruginosa PA01
cgcuggauuucgccgagu

SEQ ID NO: 1500810 - RNA, 15 nt, Pseudomonas aeruginosa PA01
cgcuggcgcuguagg

SEQ ID NO: 1500811 - RNA, 17 nt, Pseudomonas aeruginosa PA01
cgcuggcgcuguaggcg

SEQ ID NO: 1500812 - RNA, 17 nt, Pseudomonas aeruginosa PA01
cgcuggcgcagccgcug

SEQ ID NO: 1500813 - RNA, 19 nt, Pseudomonas aeruginosa PA01
cgcuggcgcagccgcugcu

SEQ ID NO: 1500814 - RNA, 14 nt, Pseudomonas aeruginosa PA01
cgcuggcgcagcgg

SEQ ID NO: 1500815 - RNA, 13 nt, Pseudomonas aeruginosa PA01
cgcuggcggccga

SEQ ID NO: 1500816 - RNA, 18 nt, Pseudomonas aeruginosa PA01
cgcuggcggccuucggcg

SEQ ID NO: 1500817 - RNA, 17 nt, Pseudomonas aeruginosa PA01
cgcuggcggcgacgaag

SEQ ID NO: 1500818 - RNA, 20 nt, Pseudomonas aeruginosa PA01
cgcuggcgaagaaccacugg

SEQ ID NO: 1500819 - RNA, 14 nt, Pseudomonas aeruginosa PA01
cgcuggcgacgcuu

SEQ ID NO: 1500820 - RNA, 13 nt, Pseudomonas aeruginosa PA01
cgcuggcgaucac

SEQ ID NO: 1500821 - RNA, 15 nt, Pseudomonas aeruginosa PA01
cgcuggcgcagcagc

SEQ ID NO: 1500822 - RNA, 18 nt, Pseudomonas aeruginosa PA01
cgcuggcgcagcagcagg

SEQ ID NO: 1500823 - RNA, 19 nt, Pseudomonas aeruginosa PA01
cgcuggcgauguagcugcc

SEQ ID NO: 1500824 - RNA, 16 nt, Pseudomonas aeruginosa PA01
cgcuggcgaucaugcc

SEQ ID NO: 1500825 - RNA, 16 nt, Pseudomonas aeruginosa PA01
cgcuggcgaucucggc

SEQ ID NO: 1500826 - RNA, 20 nt, Pseudomonas aeruginosa PA01
cgcuggcgaucucggcgcgg

SEQ ID NO: 1500827 - RNA, 22 nt, Pseudomonas aeruginosa PA01
cgcuggcgaucucggcgcgggc

SEQ ID NO: 1500828 - RNA, 14 nt, Pseudomonas aeruginosa PA01
cgcuggccgcgcga

SEQ ID NO: 1500829 - RNA, 15 nt, Pseudomonas aeruginosa PA01
cgcuggccgcgcgac

SEQ ID NO: 1500830 - RNA, 17 nt, Pseudomonas aeruginosa PA01
cgcuggccugcagcagg

SEQ ID NO: 1500831 - RNA, 13 nt, Pseudomonas aeruginosa PA01
cgcuggccugccg

SEQ ID NO: 1500832 - RNA, 15 nt, Pseudomonas aeruginosa PA01
cgcuggccugccgau

SEQ ID NO: 1500833 - RNA, 21 nt, Pseudomonas aeruginosa PA01
cgcuggccugggguagccggc

SEQ ID NO: 1500834 - RNA, 24 nt, Pseudomonas aeruginosa PA01
cgcuggccugggguagccggccga

SEQ ID NO: 1500835 - RNA, 19 nt, Pseudomonas aeruginosa PA01
cgcuggccuggccacccuu

SEQ ID NO: 1500836 - RNA, 17 nt, Pseudomonas aeruginosa PA01
cgcuggcguuguugccg

SEQ ID NO: 1500837 - RNA, 16 nt, Pseudomonas aeruginosa PA01
cgcuggcgucgaccgc

SEQ ID NO: 1500838 - RNA, 17 nt, Pseudomonas aeruginosa PA01
cgcuggcgucgaccgcc

SEQ ID NO: 1500839 - RNA, 13 nt, Pseudomonas aeruginosa PA01
cgcugggcgcagc

SEQ ID NO: 1500840 - RNA, 16 nt, Pseudomonas aeruginosa PA01
cgcugggcgcagcccu

SEQ ID NO: 1500841 - RNA, 14 nt, Pseudomonas aeruginosa PA01
cgcugggcgaggug

SEQ ID NO: 1500842 - RNA, 15 nt, Pseudomonas aeruginosa PA01
cgcugggcgccggca

SEQ ID NO: 1500843 - RNA, 13 nt, Pseudomonas aeruginosa PA01
cgcugggcgccuc

SEQ ID NO: 1500844 - RNA, 14 nt, Pseudomonas aeruginosa PA01
cgcugggcgccucg

SEQ ID NO: 1500845 - RNA, 14 nt, Pseudomonas aeruginosa PA01
cgcugguagcccag

SEQ ID NO: 1500846 - RNA, 15 nt, Pseudomonas aeruginosa PA01
cgcugguagcccagg

SEQ ID NO: 1500847 - RNA, 16 nt, Pseudomonas aeruginosa PA01
cgcugguagcccaggc

SEQ ID NO: 1500848 - RNA, 17 nt, Pseudomonas aeruginosa PA01
cgcugguagcccaggcc

SEQ ID NO: 1500849 - RNA, 18 nt, Pseudomonas aeruginosa PA01
cgcugguagcccaggccg

SEQ ID NO: 1500850 - RNA, 18 nt, Pseudomonas aeruginosa PA01
cgggcaaccgcggcggcc

SEQ ID NO: 1500851 - RNA, 21 nt, Pseudomonas aeruginosa PA01
cgggcaaccgcggcggccuca

SEQ ID NO: 1500852 - RNA, 16 nt, Pseudomonas aeruginosa PA01
cgggcaacgccaggcc

SEQ ID NO: 1500853 - RNA, 14 nt, Pseudomonas aeruginosa PA01
cgggcaacgcgcag

SEQ ID NO: 1500854 - RNA, 16 nt, Pseudomonas aeruginosa PA01
cgggauugucgccgcc

SEQ ID NO: 1500855 - RNA, 17 nt, Pseudomonas aeruginosa PA01
cgggauugucgccgccg

SEQ ID NO: 1500856 - RNA, 18 nt, Pseudomonas aeruginosa PA01
cgggauugucgccgccga

SEQ ID NO: 1500857 - RNA, 20 nt, Pseudomonas aeruginosa PA01
cgggauugucgccgccgagu

SEQ ID NO: 1500858 - RNA, 18 nt, Pseudomonas aeruginosa PA01
cgggauuguugcggcggg

SEQ ID NO: 1500859 - RNA, 15 nt, Pseudomonas aeruginosa PA01
cgggaugcccggccg

SEQ ID NO: 1500860 - RNA, 17 nt, Pseudomonas aeruginosa PA01
cgggaugcccggccgca

SEQ ID NO: 1500861 - RNA, 22 nt, Pseudomonas aeruginosa PA01
cgggaucgaguaagugccgacc

SEQ ID NO: 1500862 - RNA, 23 nt, Pseudomonas aeruginosa PA01
cgggaucuucuaccuggcgcuga

SEQ ID NO: 1500863 - RNA, 23 nt, Pseudomonas aeruginosa PA01
cgggaucguaggcgcgcaccugc

SEQ ID NO: 1500864 - RNA, 14 nt, Pseudomonas aeruginosa PA01
cgggaucuccgcgc

SEQ ID NO: 1500865 - RNA, 20 nt, Pseudomonas aeruginosa PA01
cgggaucuccgcgccacgcg

SEQ ID NO: 1500866 - RNA, 19 nt, Pseudomonas aeruginosa PA01
cgggaucuccucgacggcg

SEQ ID NO: 1500867 - RNA, 22 nt, Pseudomonas aeruginosa PA01
cgggaucuccucgacggcggga

SEQ ID NO: 1500868 - RNA, 23 nt, Pseudomonas aeruginosa PA01
cgggacagcuugacccguugcgc

SEQ ID NO: 1500869 - RNA, 23 nt, Pseudomonas aeruginosa PA01
cgggacagcuugccguccagcga

SEQ ID NO: 1500870 - RNA, 20 nt, Pseudomonas aeruginosa PA01
cgggaccacgcucaggucgg

SEQ ID NO: 1500871 - RNA, 12 nt, Pseudomonas aeruginosa PA01
cgggacccuggu

SEQ ID NO: 1500872 - RNA, 14 nt, Pseudomonas aeruginosa PA01
cgggacccugguag

SEQ ID NO: 1500873 - RNA, 23 nt, Pseudomonas aeruginosa PA01
cgggacccugguaguccagcagg

SEQ ID NO: 1500874 - RNA, 23 nt, Pseudomonas aeruginosa PA01
cgggaccggcugcuuggccaggu

SEQ ID NO: 1500875 - RNA, 15 nt, Pseudomonas aeruginosa PA01
cggcuugaggaaaaa

SEQ ID NO: 1500876 - RNA, 17 nt, Pseudomonas aeruginosa PA01
cggcuugaccgccgccg

SEQ ID NO: 1500877 - RNA, 20 nt, Pseudomonas aeruginosa PA01
cggcuugaccgccgccgccu

SEQ ID NO: 1500878 - RNA, 22 nt, Pseudomonas aeruginosa PA01
cggcuugccgaugucgccggca

SEQ ID NO: 1500879 - RNA, 19 nt, Pseudomonas aeruginosa PA01
cggcuugaucacgccgaag

SEQ ID NO: 1500880 - RNA, 22 nt, Pseudomonas aeruginosa PA01
cggcuugcccaucuucagcauc

SEQ ID NO: 1500881 - RNA, 16 nt, Pseudomonas aeruginosa PA01
cgggaggcgccgcgcc

SEQ ID NO: 1500882 - RNA, 18 nt, Pseudomonas aeruginosa PA01
cgggaggcgccgcgccag

SEQ ID NO: 1500883 - RNA, 20 nt, Pseudomonas aeruginosa PA01
cgggaggcgccgcgccaggu

SEQ ID NO: 1500884 - RNA, 21 nt, Pseudomonas aeruginosa PA01
cgggagcgcgaggcgcaggca

SEQ ID NO: 1500885 - RNA, 14 nt, Pseudomonas aeruginosa PA01
cgggagcggccgug

SEQ ID NO: 1500886 - RNA, 16 nt, Pseudomonas aeruginosa PA01
cgggaguucauggucg

SEQ ID NO: 1500887 - RNA, 16 nt, Pseudomonas aeruginosa PA01
cgggagcuacagcgau

SEQ ID NO: 1500888 - RNA, 14 nt, Pseudomonas aeruginosa PA01
cgggaucgacgccg

SEQ ID NO: 1500889 - RNA, 23 nt, Pseudomonas aeruginosa PA01
cgggcacgcauagcgcgcuguag

SEQ ID NO: 1500890 - RNA, 16 nt, Pseudomonas aeruginosa PA01
cgggcaugcaccuacc

SEQ ID NO: 1500891 - RNA, 16 nt, Pseudomonas aeruginosa PA01
cgggcaguacucauga

SEQ ID NO: 1500892 - RNA, 16 nt, Pseudomonas aeruginosa PA01
cgggcagggcagccgc

SEQ ID NO: 1500893 - RNA, 16 nt, Pseudomonas aeruginosa PA01
cgggcaggccgaggcc

SEQ ID NO: 1500894 - RNA, 19 nt, Pseudomonas aeruginosa PA01
cgggcaggccgaggccggc

SEQ ID NO: 1500895 - RNA, 15 nt, Pseudomonas aeruginosa PA01
cgggcaccagcacgg

SEQ ID NO: 1500896 - RNA, 20 nt, Pseudomonas aeruginosa PA01
cgggcaccccgagcggcgcg

SEQ ID NO: 1500897 - RNA, 18 nt, Pseudomonas aeruginosa PA01
cgggcauugucccugcgg

SEQ ID NO: 1500898 - RNA, 20 nt, Pseudomonas aeruginosa PA01
cgggcauggcgaucuccggg

SEQ ID NO: 1500899 - RNA, 15 nt, Pseudomonas aeruginosa PA01
cgggcauggaucucc

SEQ ID NO: 1500900 - RNA, 16 nt, Pseudomonas aeruginosa PA01
cgggccagcagcuccg

SEQ ID NO: 1500901 - RNA, 17 nt, Pseudomonas aeruginosa PA01
cgggccagcagcuccgg

SEQ ID NO: 1500902 - RNA, 12 nt, Pseudomonas aeruginosa PA01
cgggccagcagg

SEQ ID NO: 1500903 - RNA, 13 nt, Pseudomonas aeruginosa PA01
cgggccagcaggc

SEQ ID NO: 1500904 - RNA, 14 nt, Pseudomonas aeruginosa PA01
cgggccagcaggcg

SEQ ID NO: 1500905 - RNA, 21 nt, Pseudomonas aeruginosa PA01
cgggccagcaggcgcucggcg

SEQ ID NO: 1500906 - RNA, 18 nt, Pseudomonas aeruginosa PA01
cgggcccgugcggcacgc

SEQ ID NO: 1500907 - RNA, 19 nt, Pseudomonas aeruginosa PA01
cgggccgaucuucgccgac

SEQ ID NO: 1500908 - RNA, 18 nt, Pseudomonas aeruginosa PA01
cgggccgaucgagcggcc
